United States Patent 11,602,557 (BUNYAVIRALES VACCINE) - sequence listing, part 12

SEQ ID NO: 13622 - RNA, 5067 nt, Artificial Sequence
  derived and/or modified CDS sequence (opt5) from CCHFV(46-ST-2012)__KR814860.1__GP
augcccaccaacaucaugcacacacugcucgugugcuucauucuguaccuucagcugcucggccuugggggagcccauggccaaagcaaugcuacggagcacaacgggaccaauacaaccacagucccuuccaccucucagagcccgaagccccuuguuuccacaaccccuccccaugcccuggaaucuagcacgaucaaaccuaccacacccaccuccgagacagaaggaucuggcgagaccgcgccucucccgaacacgacacaggggcccccucccccugaaaccacacccgagagaccggcuaccaccgugacaagcacgccuuccaccgacaauacaagcucuaccauucacgugacagauaacaaucccaccuccacgaucagcacaucuccuuccagcucucccuccacccccagcaccccucaggggauucaucacccggcccggucccugcugucugucagcucccccaagacagccaccacaccuacgcccaccagcccuggcgagaucaacucugaaacauccagccuccacucugcuaugagccgcacccccacacugcauaccgccacgcaaguguccaccgagaaugcuaaccacucugccccgagacagagcgaauccagcgcgcagccuacaaccacaucucuuaugaccucccccgcccagagcauccugcucaugucugcugccccuacggcuauucaaaauauccaucccuccccuacaaaccggagcaaacgcaaucuggagauggagauuauccuuacccugucccagggccucaagaaauauuacgggaagauucugaagcugcuccaccugacacuugaagaggacaccgaaggacugcucgagugguguaaaagaaaccugggcucuaauugcgaugacgacuuuuuccagaagcggaucgaagaguuuuucaugaccggggagggauauuuuaacgaaguucuucaguucaaaacacugagcacgcucucccccaccgagccgucucacgcccgccugccuacaguggaacccuuuaagagcuacuucgcgaaaggcuuucuguccgucgauagcggguauuucucugccaaguguuaccccagauccagcaccucuggacuccaacugauuaacgugacacagcauccugcucggaucgccgagaccccgggccccaagacgacaucccuuaaaaccaucaauugcauuaaccugcgcgcuagcguuuuuaaggaacacagagagaucgagauuaaugugcuccugccucagaucgccgucaaccuuucuaauugucauguggugauuaacagccacgucugcgauuauucccuggacaccgauggccccguucggcucccucauaucuaccacgaagggacauucauccccggaaccuacaaaauugugaucgacaagaaaaauaagcugaacgaucgcuguacacuggugacgaauugcgucauuaaaggcagagaggugcggaaggggcaaagcguucuccgccaguauaagaccgaaaucaaaauuggaaaggccucuacaggcuccagaaaacugcuuagcgaggaaccuggggacgauuguaucucccggacccagcugcucagaacagagaccgcugagauccacgacgacaacuacggaggccccggcgauaagauuacgaucugcaaugggucuaccauuguggaccagcgccugggaagcgaacugggcuguuauacaaucaaccgggucaaauccuuuaagcugugcgaaaauucugcgaccgggaagacaugcgagauugauagcaccccggugaaauguagacaaggauucugccucaagaucacacaggagggccgcgggcauguuaaacugucccggggcucugaggugguccuggacgccugugauagcuccugcgaagugaugauuccuaagggaaccggcgacauccucgucgauuguagcgggggacagcagcacuuccugaaagacaaccuuaucgaucugggcugcccccauauuccucuccuggggaagauggcuaucuacauuuguagaaugucuaaucacccccgcacgacaauggccuuucuguucugguuuuccuucggauaugugauuaccugcaucuuuuguaaggcccuuuucuacagccucaucaucauuggcacccuggggaaaaagaucaaacaauaucgggagcugaagccgcagacaugcaccauuugugaaacggcuccuguuaacgccaucgacgcggagaugcacgaucucaacugcucuuacaauauuugccccuacugugcuuccagacugacaagcgacggccuugcccgccaugugccucagugccccaaacggaaggaaaaggucgaggagaccgaacuguaucucaaccuggagagaauccccuggaucgugcgcaaacugcuucagguuucugaauccacaggaguggcccucaagcggagcuccuggcugauuguccugcucgugcugcuuaccgugagccugucuccuguucaaagcgcuccggucggccacgggaaaacaaucgagaccuaccagacgagagaaggauuuaccuccauuugucucuucaugcugggcucuauccuguuucuugugagcugccucgugaaggggcuggucgacuccgugucugauagcuucuuucccggacuguccguuuguaaaacaugcucuauuggcagcaucaauggguucgagaucgagucccauaaguguuauugcagccucuuuuguugcccuuacugucggcacugcucugccgaccgcgaaauucaucagcugcaccuuuccaucugcaaaaagagaaagaccggcagcaacgugaugcuggcugucuguaaacggaugugcuucagagccacaauugaggcgucucgccgggcccuccugaucagauccauuaucaaugcuaccuucgugauuuguauccugacgcuuacaaucugcguugugagcaccuccgccgucgaaauggagucucugcccgcuggaacaugggaacgcgaggaggaucucaccaacuuuugucaccaggaaugccaagugaccgagacagaaugucugugcccuuaugaggcccucguucugagaaagccccuuuuccuggacagcauugugaaaggcaugaagaaucuccugaacuccacgagccuggagaccucucuuuccaucgaagcgccuuggggagccauuaauguccagagcacauuuaaaccgaccgugucuacagcuaacaucgcccugagcugguccucuguggagcaucggggaaauaagauucucgucaccggccgcagcgaauccaucaugaagcuggaggaaagaacggggguuucuugggaucucggaguggaggacgcuagcgaguccaaacugcuuacagugagcaucauggaucugucucagauguacucccccgucuucgaauaucucagcggcgaccggcaaguggaggaauggccuaaggccaccuguaccggggauugccccgagcgcuguggcugcacauccucuaccugccugcacaaagaauggccucauagcagaaacuggcgguguaaucccacauggugcuggggaguuggcacgggguguaccugcuguggaguggacgucaaggaucuguuuacagaccacauguucgugaaauggaagguugaguacauuaagaccgaggccaucgugugcgucgaacuuacaucccaggagcgccaguguucucugauugaagcuggcaccagauuuaaccucgggccggugacgaucacccugagcgagccucggaauauucagcaaaaacucccucccgaaaucaucacacugcaucccaagguugaggagggauucuuugaucuuaugcacgugcagaaaguccuguccgcgagcaccgugugcaagcugcagucuuguacacacggcauucccggcgaccuccagguguaccauaucgggaaccugcuuaaaggagaccgcauuaacggccaccugauccauaagauugaaccucacuucaauaccuccuggaugagcugggaugggugcgaccucgauuauuacuguaacaugggagacuggccgucuugcacauauacgggcgucacccaacacaaucaugccgcuuuuguuaaccugcucaauaucgagacagauuacaccaagaccuuccacuuucauuccaaaagagugacagcccacggggacacgccccagcuggaucuuaaggcccggccuaccuauggagcuggcgaaauuacagugcuggucgagguggccgacauggagcugcauaccaaaaagguugaaaucagcggccucaaauucgcgucucuggcuugcacaggguguuacgccugcagcuccggaaucucuuguaaggugcgcauucacgucgaugagcccgacgaacuuaccgugcacguuaaaagcuccgauccugacguggucgccgcuagcacgucccugauggccagaaagcucgaguucggcacagauucuaccuuuaaggcguucagcgcuaugcccaaaaccucccugugcuuuuauaucguggaacgggaguacuguaagucuugcagcgaggaagacacacagaaaugugucgacaccagacucgagcagccgcaauccauucugaucgaacauaaggggacaauuaucggaaaacagaacgauaccugcacggccaaggccucuuguuggcuugagagcgugaaguccuucuuuuacggccugaaaaauaugcuggggagcguuuucggaaacuuuuucaucggcauucuccuguuucuugcuccuuucgugcugcucguccuguuuuucauguucggcuggaagauccucuuuugcuucaaauguugccgccggacaagagggcugcuuaaguaucgccaccugaaagacgaugaagagaccggauaccggagaauuaucgagcgccugaauaacaagaagggcaaaaaucggcuccuggacggggaaagacuugccgaucggaagauugcugagcuguuuucuacaaaaacccauaucggauga

SEQ ID NO: 13623 - RNA, 5067 nt, Artificial Sequence
  derived and/or modified CDS sequence (opt5) from CCHFV(44-ST-2010)__KR814859.1__GP
augcccaucaacauuaugcacacccugcucgugugcuucauccuguaccuucagcugagcggccucgggggagcccauggccaauccaaugcuacagagcacaacgggacgaauaccacaaccgucccuggaacaucucagagcccgaagcccccugccuccaccacacugccccauaccccugaaucuagcacgguuaaacuuaccacacccaccuccgagacagaaggcucuggggagaccacgccuccgcccaacacaacccagggacugccucccccuggcacaacccccgaaagaccggcgaccacagcuacgagcauguccagcaccgacaauaugaacucuacaacccaggugacagauaauaccccuacguccacagugagcauuucucccuccagcucuccuuccaugcccagcaccucccaaggcauccacuaucccguccggucucuccugagcguguccagcccuaagaccguuacaaccccgacacccaugucuccuggggagaugucccccgagacgagcucucagcauagcgccaugucccgcauuccuacccuguacacagccacccaggugucuacagaaaacaccaauagaagcacgccccggcaguccgagagcucugcucaaccggccacccaguccccuacaaccagccccacacagaccauccuccugaugucugcugccccuaaagcgauccaggacaugcaccccuccccuacgaaccgcagcaagagaaaucuugaagucgagauuauccugacacucucccaaggacugaaaaaguauuacggcaagauucuuaaacugcuccaccugacccuggaggaagauacagaggggcuccuggaaugguguaagcggaaccuuggaucuaauugcgacgaugacuuuuuccagaaacgcaucgaggaauuuuucauuaccggcgagggguauuuuaacgaggugcugcaguucaagacccucagcacacugucccccacggaaccgucucauguuagacuuccuaccgccgagcccuuuaaaagcuacuucgcuaagggauuucuguccaucgauagcggcuauuucucugccaaguguuacccccgguccagcacaucuggccuccaacugauuaaugugacccagcacccugcucgcaucgccgaaacaccggggcccaaaaccacgucccugaagacaaucaacugcauuaaccucagagcgagcgucuuuaaagagcaucgggaaguggagaucaaugugcugcuuccucagauugccgucaaccugucuaauugucacguugugaucaacagccacgugugcgacuacucccucgauaccgacggacccguccgccugccucggauucaucacgagggcaccuucauccccgggacauauaagaucgugauugauaaaaagaauaaacuuaacgaccgguguagccugguuaccaauugcgugaucaagggacgcgaagucagaaagggccagucugugcuccggcaauacaaaacagagauuaagaucgggaaagcuagcacgggaagcagaaagcugcuguccgaggaaccuggcgaugacuguauuucucgcacccagcuccugaaaacagaaaccgccgagauccaugacgauaacuauggcgggcccggagacaagaucacaauuugcaauggcagcaccaucguugaucagcggcuuggguccgagcugggauguuacacgauuaacagagugaagucuuuuaaacucugcgaaaauagcgcuaccggcaagacaugcgagaucgacuccaccccggucaaaugucgccagggguucugccugaagauuacacaagaaggccggggacacgugaaacugucuagaggcagcgaggucgugcuugaugccugugacuccagcugcgagaucaugauuccuaaggggaccggagauauccucguugacuguucuggcgggcagcagcauuuccugaaggauaaccugaucgaccucggaugcccccacauuccucugcuuggcaaaauggccaucuauauuugucgcauguccaaucacccccggacaaccauggcuuuucugcucugguucagcuuuggguacgugaucacgugcauuuucuguaaggcgcuguuuuauucucugaucaucauuggcacacuuggaaagaagaucaaacaguacagagaacucaagccgcaaaccugcaccauuugugagacagccccugucaacgcuaucgaugccgaaaugcaugaccugaauugcuccuacaacauuugccccuauugugccagccgccugaccucugacggccucgcucggcacgugacgcagugcccuaagagaaaagagaagguugaagagacagagcuguaccuuaaccuggaacgcauccccuggaucgugcggaaacuccugcaggucuccgagagcaccgggguggcccugaagagauccagcuggcuuauugugcuccugguucugcucacagucucucugagccccgugcaguccgcgccugugggacauggcaaaaccaucgaaacauaucaaacccgggagggguucacgaauauuugucuuuuuaugcugggaucuauccucuucauugucagcugccuggugaagggccugguugauuccgugucugacagcuuuuucccggggcuuuccgucuguaaaaccugcucuuuuggcagcaucaacggauucgaaaucgagucccacaaguguuacugcagccucuuuuguugccccuauugucgccacugcucugcugauagagagauucaucagcugcaccugggcaucugcaagaaacggaagacaggguccaaugugaugcucgccguuuguaaaagaaugugcuucaaggccaccauugaagcuagccgccgggcccugcuuaucagaucuauuaucaacacaaccuucgugauuuguauccugacgcucgcuaucugcgucguguccacaagcgccguugagauggaaaaucugccugcgggaaccugggagcgcgaagaggaccugacaaacuuuugucaucaggagugccaaguguccgaaaccgagugucuuugccccuacgaagcccugguccucagaaaaccucuguuccucgauucuauugugaagggcaugaagaaucugcuuaacagcaccucccuggagacaagccucucuaucgaggcucccuggggagccauuaaugugcaguccacguuuaaaccuaccgucagcacagcuaacaucgcccugucuuggagcuccguugaacaccggggaaauaagauucuggugaccggccgcucugagagcaucaugaaacuugaagagagaacagggguguccugggaccugggcgucgaagaugcgucugagagcaagcuccugaccguguccaucauggaccucagccagauguauucuccgguuuucgaguaccuguccggagauagacagguggaagaguggcccaaagccacguguacaggcgacugcccugaacgcugugggugcaccagcucuaccugccuucauaaggaguggccccacuccagaaacuggcgguguaauccuacauggugcuggggagucggcaccggguguacaugcuguggaguggauguuaaggaccuguuuacggaucacauguucauuaaauggaagguggaauacaucaaaaccgaggcuauugucugcguggagcucacaagccaagaacgccaguguucccugaucgaggccggcaccagauuuaaccugggccccguuacaauuacccuuucugaaccgcggaauauccagcagaagcugccucccgagaucauuacgcuccaucccaaaaucgaagagggguucuuugaccugaugcacgugcaaaagguccucagcgcuuccaccgugugcaagcugcagagcuguacacaugggauuccuggcgaccuucagaucuaucacauugggaaccugcugaaaggagaucgccucaacggccaucugauccacaagauugagccccacuucaauaccucuuggauguccugggacgggugcgaucuugacuacuauuguaacaugggagauuggccuagcugcacauacaccggcgugacacagcauaaucacgccgccuuugucaaccugcucaauaucgaaacggacuauaccaaaacauuccauuuucacucuaagagaguuaccgcucacggcgauaccccgcaacuggaccucaaagcgcggcccacauacggggccggagagaucacggugcugguggaagucgcugauauggagcuucauaccaagaaaguggagauuuccggccugaaguucgccagccuggccugcacaggguguuaugcuugcucuagcggaaucuccuguaagguucgcauucacguggacgaaccugaugagcucaccguccaugugaaaucuagcgaccccgauguuguggccgcguccacaagccugauggcuagaaaacuugaguucggcaccgacuccacguuuaaagccuucucugccaugccuaagacaagccugugcuuuuacaucgucgaacgggaauacuguaaauccugcucugaggacgauaccaagaaguguguggacaccaaacucgaucagccccagagcauucugaucgagcacaaggggacaaucauuggaaaacaaaacgauaccugcacagcuaaggccuccuguuggcucgaaucugucaaauccuucuuuuauggccugaagaauaugcuuggcuccguguucgggaacuuuuucguuggaauccugcuguuucucgcgccguucgugcugcuuguccuguuuuucaugugcggcuggaagauucucuucuguuuuaaaugcugcagacgcacccgggggcuguucaaguacagacaucucaaagacgacgaggaaacgggauaucgccggaucauugagagacugaauagcaagaaaggcaagaaccgccuucuggauggggaacggcuggcugacagaaagaucgccgagcucuuuucuacaaaaucccacaucggauga

SEQ ID NO: 13624 - RNA, 5067 nt, Artificial Sequence
  derived and/or modified CDS sequence (opt5) from CCHFV(37-R-2013)__KR814858.1__GP
augcccaccaacaucaugcacacacugcucgugugcuucauucuguaccuucagcugcucggccuugggggagcccauagacaaagcaaugcuacggagcacaacggcaccaauacaaccacagccccuuccaccucucagagcccgaagcccccugucuccacagcgcccccucaugcucccgaaaccucuacgaucaaaccuaccacaccggccagcgagaccgaaggguccggagagacaacgcccccucccaacaccacacagggcccuucucccccggaagccaccccugagcggcccgcuacaaccguuaccagcacaccuuccacggacaauaccaacagcacaacccacgccacagauaauaaccccaccucuacgauuuccacaagccccucuuccagcccuucuaccccguccacaccccaggggauccaucacccugcucgcaaucuucugagcguguccucucccaagaccgccaccacaccuacgcccaccagcccgggagacauuuccagcgagacaucuucccuccacagcgcgaugucuagaaccccuacacugcauaccgccacgcaagcuagcaccgaaaacgccaaucacuccgcuccccggcagucugagagcuccgcccagcagacaaccacaagcccuaugaccucucccgcgcaaccuauccuggugauguccgccgcucccacggccauccagaacauucauccgagcccuacaaaucgcucuaaaagaaaccucgaaauggagaucauucugacccuuucccagggccugaagaaauauuacggcaagauccucaagcugcuucaccugacacucgaggaagauaccgaggggcugcuggaaugguguaaacggaaucucggaagcaacugcgacgaugacuuuuuccagaagcgcauugaggaauuuuucaugaccggcgagggguauuuuaacgagguccugcaauucaaaacacuuuccacgcugucucccaccgaacccagccacgcuagaccuccgacaguggagcccuuuaaguccuacuucgccaaaggauuucucucuaucgauagcggcuauuucuccgccaaguguuacccucggcugaccacaagcgggcuucagcugauuaauguuacccagcaucccgcucgcaucgcggaaacgccuggacccaagacaaccucucucaaaaccaucaacugcauuaaucugagagccuccguguuuaaggagcaccgggaaaucgagauuaacguccugcucccucaaaucgcugugaaucugagcaacugucauguugugauuaauucucacgucugcgacuauucccuugauacagacggccccgugcgccugccgcauaucuaccacgagggcaccuucaucccugggacauacaaaauugugaucgauaagaaaaacaagcucaaugacagauguacgcuggucaccaacugcguuauuaaaggacgggaagugcgcaagggccagagcgugcuuagacaguauaagacagagaucaaaauugggaaggccucuaccggaagccggaaacugcucuccgaagaacccggcgaugacuguaucagcagaacacagcugcugcgcaccgaaacggccgagauccacgacgauaauuacgggggaccuggcgacaagauuaccaucugcaacggcucuacaauugucgaucaacggcucggguccgagcugggauguuauaccaucaauagagugaaauccuuuaagcugugcgaaaacagcgcuacaggcaagaccugcgagauugacucuacacccguuaaaugucgccagggguucugccugaagaucacccaggaaggacggggccaugugaaacucagcagaggguccgaggucgugcuggaugccugugacacgucuugcgagguuaugauuccgaagggcacaggagauauccugguggacuguagcggcgggcagcaacacuuccuuaaagauaaucucaucgaccugggaugcccucauauuccccugcucggcaagauggcgaucuacauuugucgcauguccaaccacccucggaccaccauggcuuuucuguucugguuuucuuucggguaugucaucacaugcaucuuuuguaaggcccuuuucuacagccugauuaucauuggaacccucggcaaaaagaucaaacaguauagagaacugaagccccagacgugcacaauuugugagaccgcccccgugaacgcuaucgaugccgaaaugcacgaccugaauugcuccuacaacauuugcccuuacugugcuagccgccuuacaucugacgggcucgcccggcaugucccgcagugccccaaaagaaaggagaagguggaagagaccgagcuguaucugaaucucgaacgcaucccuuggaucguucggaaacugcuucaaguguccgagagcacaggcgucgcgcugaagagaucuuccuggcucauugugcugcugguucuucucaccgugagccugucucccguccaguccgccccugugggacacggcaaaacgaucgaaaccuaccagacacgggagggguuuaccagcgugugucuguucaugcucggauccauucuguuucuuguuagcugccuggucaagggccucguggauucugugagcgacuccuucuuucccgggcugucugucuguaaaacaugcagcaucggauccauuaacggcuucgaaaucgagucucauaaguguuauugcagccuguuuuguugcccuuacugucgccacugcuccgcugauagagagauccaucagcuucaccucucuauuugcaaaaagcggaagauggggagcaaugugaugcuggccguuuguaaaagaaugugcuuccgcgcuaccaucgaagccucccggagagcgcugcucauucgcagcaucauuaacacgacauucgugaucuguauucugacccuuacaaucugcgucgugucuaccuccgccguugagauggaaaaucugccgagcggcaccugggagagagaagaggaccucacaaacuuuugucaccaagagugccaggugacggaaaccgagugucugugccccuaugaagcucugguccuucggaagccucuguuccucgauucuaucgugaaaggaaugaagaaucugcucaacuccacaagccuggagaccucccuuucuauugaggcccccuggggcgcuaucaauguucagagcacauuuaaaccuaccguguccacggccaacauugcccugagcuggucuuccgucgaacaucgcgggaauaagauccucgugacaggaagaagcgagucuauuaugaagcuggaggagcggaccggcgugagcugggaccugggggucgaugacgcuuccgaaucuaaacuucugaccguuagcaucauggaucucucccaaauguacucucccguguucgaguaucugagcggagaccgccagguggaggaauggccgaaggcgacauguaccggcgauugcccugagagaugugggugcacauccagcacgugccuccacaaagaauggccccauucucggaacuggcgcuguaaucccaccuggugcuggggcgucggaacaggcuguaccugcugugggguggacguuaaggaucuguuuacagaccacauguucgugaaauggaaggucgaguacaucaagaccgaagccauugugugcguugagcuuacgucccaggagagacaguguagccugaucgaagcuggaacccgguuuaaccucggcccugugacaauuacccuguccgagccccgcaacauccaacagaaacugccuccggaaauuaucacacuucaucccaaggucgaggaaggguucuuugaccugaugcacgugcagaaaguucucucugccagcaccgugugcaagcugcaguccuguacacacggaaucccuggcgaucuccaagucuaccauauuggcaaucugcuuaaaggggacagagugaacggacaccugauccauaagauugagccccacuucaauacgucuuggaugagcugggauggcugcgaccuggauuauuacuguaacaugggggacuggccuuccugcaccuauacaggagugacccagcacaaucaugccgcuuuugucaaccuccugaauaucgagaccgauuacacaaagacguuccacuuucauagcaaacggguuaccgcccacggcgacacaccccagcuugaucugaaggcgagaccgaccuauggggcuggagaaauuacagugcucguggaggucgccgacauggaacugcauaccaaaaagguggagaucucuggccucaaauucgccucccuggcuugcacgggcuguuacgccugcagcucugggauuuccuguaagguucgcauccacguggaugagccugacgaacuuacaguccacgugaaaagcaacgaucccgacguuguggcggcuucuaccagccugauggcccggaagcuggaguucggaaccgacuccacauuuaaggccuucucugcuaugccuaaaaccagccucugcuuuuauaucgucgaaagagaguacuguaaguccugcagcgaagaggauacacagaaauguguggacaccaagcuggagcaaccccaguccauucuuaucgaacauaaaggcacgauuaucgggaagcagaaugucacaugcaccgccaaggcuucuuguuggcuggagagcgugaaauccuucuuuuacggacucaagaacaugcugggcucuguuuucgggaacuuuuucauuggaauccuccuguuucuugccccuuucgugcugcugguccucuuuuucauguucggcuggaaaauccuguuuugcuucaaguguugccgccggacaagaggccuucugaaauaucgccuccugaaggaugacgaagagaccggguaccggagaauuaucgaacgccucaauaauaagaaaggaaagaaccggcugcuugauggcgagagacuggcggaccggaaaauugccgagcuguuuagcacgaagacccacaucggguga

SEQ ID NO: 13625 - RNA, 5067 nt, Artificial Sequence
  derived and/or modified CDS sequence (opt5) from CCHFV(36-ST-2014)__KR814857.1__GP
augcccaucaacauuaugcacacccugcucgugugcuucauccuguaccuucagcugagcggccucgggggagcccauggccaauccaaugcuacagagcacaacgggacgaauaccacaaccgucccuggaacaucucagagcccgaagcccccugccuccaccacacugccccauaccccugaaucuagcacgguuaaacuuaccacacccaccuccgagacagaaggcucuggggagaccacgccuccgcccaacacaacccagggacugccucccccuggcacaacccccgaaagaccggcgaccacagcuacgagcauguccagcaccgacaauaugaacucuacaacccaggugacagauaauaccccuacguccacagugagcauuucucccuccagcucuccuuccaugcccagcaccucccaaggcauccacuaucccguccggucucuccugagcguguccagcccuaagaccguuacaaccccgacacccaugucuccuggggagaugucccccgagacgagcucucagcauagcgccaugucccgcauuccuacccuguacacagccacccaggugucuacagaaaacaccaauagaagcacgccccggcaguccgagagcucugcucaaccggccacccaguccccuacaaccagccccacacagaccauccuccugaugucugcugccccuaaagcgauccaggacaugcaccccuccccuacgaaccgcagcaagagaaaucuugaagucgagauuauccugacacucucccaaggacugaaaaaguauuacggcaagauucuuaaacugcuccaccugacccuggaggaagauacagaggggcuccuggaaugguguaagcggaaccuuggaucuaauugcgacgaugacuuuuuccagaaacgcaucgaggaauuuuucauuaccggcgagggguauuuuaacgaggugcugcaguucaagacccucagcacacugucccccacggaaccgucucauguuagacuuccuaccgccgagcccuuuaaaagcuacuucgcuaagggauuucuguccaucgauagcggcuauuucucugccaaguguuacccccgguccagcacaucuggccuccaacugauuaaugugacccagcacccugcucgcaucgccgaaacaccggggcccaaaaccacgucccugaagacaaucaacugcauuaaccucagagcgagcgucuuuaaagagcaucgggaaguggagaucaaugugcugcuuccucagauugccgucaaccugucuaauugucacguugugaucaacagccacgugugcgacuacucccucgauaccgacggacccguccgccugccucggauucaucacgagggcaccuucauccccgggacauauaagaucgugauugauaaaaagaauaaacuuaacgaccgguguagccugguuaccaauugcgugaucaagggacgcgaagucagaaagggccagucugugcuccggcaauacaaaacagagauuaagaucgggaaagcguccacgggaagcagaaagcugcuguccgaggaaccuggcgaugacuguauuucucgcacccagcuccugaaaacagaaaccgccgagauccaugacgauaacuauggcgggcccggagacaagaucacaauuugcaauggcagcaccaucguugaucagcggcuuggguccgagcugggauguuacacgauuaacagagugaagucuuuuaaacucugcgaaaauagcgcuaccggcaagacaugcgagaucgacuccaccccggucaaaugucgccagggguucugccugaagauuacacaagaaggccggggacacgugaaacugucuagaggcagcgaggucgugcuugaugccugugacuccagcugcgagaucaugauuccuaaggggaccggagauauccucguugacuguucuggcgggcagcagcauuuccugaaggauaaccugaucgaccucggaugcccccacauuccucugcuuggcaaaauggccaucuauauuugucgcauguccaaucacccccggacaaccauggcuuuucuguucugguuuagcuucggguacgugaucacgugcaucuuuuguaaggcucucuucuauucucugauuaucauuggcacacuggggaaaaagaucaaacaguacagagaacuuaagccgcaaaccugcaccauuugugagacagccccugucaacgcuaucgaugccgaaaugcaugaccucaauugcuccuacaacauuugccccuauugugccagccgccugaccucugacggccuggcucggcacgugacgcagugcccuaagagaaaagagaagguugaagagacagagcucuaccugaaccuugaacgcauccccuggaucgugcggaaacugcuccaggucuccgagagcaccgggguggcccugaagagauccagcuggcugauugugcuucucguucugcugacagucucucucagccccgugcaguccgcgccugugggacauggcaaaaccaucgaaacauaucaaacccgggagggguuuacgaauauuugucuguucaugcuuggaucuauccuguuuauugucagcugccucgugaagggccugguugauuccgugucugacagcuucuuuccggggcuguccgucuguaaaaccugcucuaucggcagcaucaacggauucgaaauugagucccacaaguguuacugcagccucuuuuguugccccuauugucgccacugcucugcugauagagagauccaucagcuucaccugggcauuugcaagaaacggaagacaggguccaaugugaugcuggccguuuguaaaagaaugugcuucaaggccaccaucgaagcuagccgccgggcccuccugauuagaucuaucauuaacacaaccuucgugaucuguauccuuacgcuggcuauuugcgucguguccacaagcgccguugagauggaaaaucucccugcgggaaccugggagcgcgaagaggaccugacaaacuuuugucaucaggagugccaaguguccgaaaccgagugucugugccccuacgaagcccuuguccugagaaaaccucucuuccuggauucuaucgugaagggcaugaagaaucuccugaacagcaccucccuugagacaagccugucuauugaggcucccuggggagccaucaaugugcaguccacguuuaaaccuaccgucagcacagcuaacauugcccucucuuggagcuccguugaacaccggggaaauaagauccuggugaccggccgcucugagagcaucaugaaacuggaagagagaacagggguguccugggaccuuggcgucgaagaugcgucugagagcaagcugcucaccguguccauuauggaccugagccagauguauucuccgguuuucgaguaccucuccggagauagacagguggaagaguggcccaaagccacguguacaggcgacugcccugaacgcugugggugcaccagcucuaccugccugcauaaggaguggccccacuccagaaacuggcgguguaauccuacauggugcuggggagucggcaccggguguacaugcuguggaguggauguuaaggaccuuuuuacggaucacauguucaucaaauggaagguggaauacauuaaaaccgaggcuaucgucugcguggagcugacaagccaagaacgccaguguucccucauugaggccggcaccagauuuaaccugggccccguuacaaucacccugucugaaccgcggaauauccagcagaaacuuccucccgagauuaucacgcugcaucccaaaauugaagagggguucuuugaccucaugcacgugcaaaagguccugagcgcuuccaccgugugcaagcuccagagcuguacacauggaaucccuggcgaccugcagauuuaucacaucgggaaccuucugaaaggagaucgccugaacggccaucucauucacaagaucgagccccacuucaauaccucuuggauguccugggacgggugcgaucuggacuacuauuguaacaugggagauuggccuagcugcacauacaccggcgugacacagcauaaucacgccgccuuugucaaccuucugaauaucgaaacggacuauaccaaaacauuccauuuucacucuaagagaguuaccgcucacggcgauaccccgcaacucgaccugaaagcgcggcccacauacggggccggagagauuacggugcucguggaagucgcugauauggagcugcauaccaagaaaguggagaucuccggccuuaaguucgccagccuggccugcacaggguguuaugcuugcucuagcggaauuuccuguaagguuagaauccacguggacgaaccugaugagcugaccguccaugugaaaucuagcgaccccgauguuguggccgcguccacaagccucauggcucgcaagcuggaguucggcaccgacuccacguuuaaagccuucucugccaugccuaagacaagccuuugcuuuuacauugucgaacgggaauacuguaaauccugcucugaggacgauaccaagaaguguguggacaccaaacuggaucagccccagagcauccucaucgagcacaaggggacaauuaucggaaaacaaaacgauaccugcacagcuaaggccuccuguuggcuggaaucugucaagagcuucuuuuauggccucaagaauaugcugggcuccguguucgggaacuuuuucguuggcauucuucuguuucuggcgccguucgugcuccugguccuuuucuuuaugugcggauggaaguuccuguuuuguuucaaaugcugcagacgcacccgggggcucuuuaaguacagacaucugaaagacgacgaggaaacgggauaucgccggaucauugagagacucaauagcaagaaaggcaagaaccgccugcuugauggggaacggcuggcugacagaaagaucgccgagcuguucucuacaaaaucccacaucggauga

SEQ ID NO: 13626 - RNA, 5067 nt, Artificial Sequence
  derived and/or modified CDS sequence (opt5) from CCHFV(24-R-2012)__KR814856.1__GP
augcccaccaacaucaugcacacacugcucgugugcuucauucuguaccuucagcugcucggccuugggggagcccauagacaaagcaaugcuacggagcacaacggcaccaauacaaccacagccccuuccaccucucagagcccgaagcccccugucuccacagcgcccccucaugcucccgaaucuagcaccaucaaaccuacgaccccggccuccgagacagaagggucuggagagaccacacccccucccaacaccacgcagggcccuagcccgcccgaagccacaccugagcggaccgcuacaaccgccaccuccacacccagcacggacaauaccaacucuacaacccacgcuacagauaauaacccuaccuccacgauuagcacaucucccuccagcucucccuccaccccuagcaccccgcaggggauccaucaccccgcccgcaaucugcuguccguuucuagcccuaagacagcgaccacacccacgccuaccucccccggagacauuagcucugagacauccagccuccacucugccaugagcagaaccccgacacugcauaccgcuacgcaagccuccaccgaaaacgcuaaucacucugccccucggcagagcgaguccagcgcgcagcagacaaccacaucucccaugaccuccccugcccaacccauccuggugaugagcgcugccccuacggcuauccagaacauucaucccucuccgacaaaucgcuccaaaagaaaccucgaaauggagaucauucugacccuuagccagggccugaagaaauauuacggcaagauccucaagcugcuucaccugacacucgaggaagauaccgaggggcugcuggaaugguguaaacggaaucucggauccaacugcgacgaugacuuuuuccagaagcgcauugaggaauuuuucaugaccggcgagggguauuuuaacgaggugcugcaauucaaaacacuuucuacgcugagcccuaccgaacccucccacgccagacccccuacagucgagccguuuaagucuuacuucgccaaaggauuucucagcaucgauuccggcuauuucagcgcuaaguguuacccccggcugucuaccuccgggcuucagcugauuaaugugacacagcauccugcgcgcaucgccgaaacccccggaccuaagacgacaagccucaaaaccaucaacugcauuaaucugagagcuucuguuuuuaaggagcaccgggaaaucgagauuaacgugcugcucccccaaaucgccgucaaucuguccaacugucaugugguuauuaauagccacgugugcgacuauucucuugauaccgacggcccuguccgccugccccauaucuaccacgagggcacauucaucccggggaccuacaaaauugugaucgauaagaaaaacaagcucaaugacagauguacacuggugacgaacugcgucauuaaaggacgggaaguucgcaagggccagagcgugcuuagacaguauaagaccgagaucaaaauugggaaggccuccacaggaagccggaaacugcucucugaagaaccuggcgaugacuguaucuccagaacccagcugcugcgcacagaaaccgcugagauccacgacgauaauuacgggggacccggcgacaagauuacgaucugcaacggcagcaccauuguggaucaacggcucggguccgagcugggauguuauacaaucaauagagucaaaucuuuuaaacuuugcgaaaacagcgccaccggcaagacaugcgagauugacuccaccccugugaaaugucgccagggguucugccugaagaucacacaggaaggacggggccauguuaaacucucuagagggagcgaggugguccuggaugcgugugacaccuccugcgaggugaugauucccaagggcacgggagauauccugguugacuguucuggcgggcagcaacacuuccuuaaagauaaucucaucgaccugggaugcccgcauauuccucugcucggcaagauggcuaucuacauuugucgcaugagcaaccacccccggacaaccauggccuuucuguucugguuuuccuucggguaugugauuaccugcaucuuuuguaaggcccuuuucuacagccugaucaucauuggaacacucggcaaaaagaucaaacaguauagagaacugaagccucagaccugcacgauuugugagacagcucccgucaacgccaucgaugcugaaaugcacgaccugaauugcucuuacaacauuugccccuacugugccucccgccuuaccagcgacgggcucgcgcggcaugugccucagugcccgaaaagaaaggagaaggucgaagagacagagcuguaucugaaucucgaacgcauccccuggaucgugcggaaacugcuucaaguuucugaguccaccggcguggcccugaagagaagcucuuggcucauuguccugcuggugcuucucacaguuucccugagcccugugcaguccgcucccgucggacacggcaaaaccaucgaaacguaccagacccgggagggguuuacaagcgugugucuguucaugcucggaucuauucuguuucuugugagcugccugguuaagggccucgucgauuccgugucugacagcuucuuuccugggcuguccguguguaaaaccugcucuaucggaagcauuaacggcuucgaaaucgagucccauaaguguuauugcucucuguuuuguugccccuacugucgccacugcagcgccgauagagagauccaucagcuucaccucuccauuugcaaaaagcggaagauggggagcaaugucaugcuggcuguguguaaaagaaugugcuuccgcgccacaaucgaagcgucucggagagcccugcucauucgcuccaucauuaacaccacguucguuaucuguauucugacacuuaccaucugcguggucagcacaucugcuguggagauggaaaaucugccuuccggcaccugggagagagaagaggaccucaccaacuuuugucaccaagagugccagguuacagaaacggagugucugugcccguaugaagcccuggugcuucggaagccccuguuccucgauagcaucgucaaaggaaugaagaaucugcucaacuccaccucucuggagacaagccuuuccauugaggcuccuuggggcgccaucaaugugcagagcaccuuuaaacccacaguuucuaccgccaacauugcucuguccuggagcucuguggaacaucgcgggaauaagauccucgucacgggaagaagcgaguccauuaugaagcuggaggagcggacaggcgugucuugggaccuggggguggaagaugcgagcgaguccaaacuucugaccgucucuaucauggaccucagccaaauguacuccccuguuuucgaguaucugagcggagaucgccagguggaagaguggcccaaggccaccuguacaggcgacugcccggaaagaugugggugcaccucuuccacaugccuccacaaagaguggccucauagccggaacuggcgcuguaaucccacguggugcuggggcgugggaaccggcuguacaugcuguggggucgaugugaaggaccuguuuaccgaucacauguucguuaaauggaagguggaauacaucaagacagaggcuauugucugcguggagcuuaccucccaggaaagacaguguucucugaucgaggccggaacgcgguuuaaccucggccccguuaccauuacacugagcgaaccucgcaacauccaacagaaacugcccccugagauuaucacccuucauccgaagguggaagagggguucuuugaccugaugcacguccagaaagugcucuccgccucuacaguuugcaagcugcagagcuguacccacggaauccccggcgaccuccaaguguaccauauuggcaaucugcuuaaaggggauagagucaacggacaccugauccauaagauugagccucacuucaauacauccuggaugagcugggacggcugcgaucuggacuauuacuguaacaugggggauuggcccucuugcacguauaccggagugacacagcacaaucaugcugccuuugugaaccuccugaauaucgaaaccgacuacaccaagacauuccacuuucauuccaaacgggucacggcgcacggcgauaccccucagcuugaccugaaggcuagacccacauauggggccggagagauuaccguucucguggaaguggccgauauggagcugcauacaaagaaggucgagaucagcggccucaaauucgcuucucuggccugcaccggcuguuacgcgugcuccagcgggauuucuuguaaggugcgcauccacguugacgaaccggaugagcuuacggugcacgucaaaagcaacgacccugaugugguugcugccuccacaucucugauggcccggaagcuggaauuuggaaccgacagcaccuuuaaggcuuucuccgccaugcccaaaacaagccucugcuuuuauaucguggagagagaauacuguaaguccugcucugaggaggacacccagaaaugugucgauacaaagcuggaacaaccucagagcauucuuaucgagcauaaaggcaccauuaucgggaagcagaaugacacgugcacagcuaaggccuccuguuggcuggaaucugugaaauccuucuuuuacggacucaagaacaugcugggcagcgucuucgggaauuucuucauuggaauccuccuguuucuugcgcccuucgugcugcugguucucuuuuucauguucggcuggaaaauccuguuuugcuucaaguguugccgccggaccagaggccuucugaaauaucgccuccugaaggaugacgaggaaacaggguaccggagaauuaucgagcgccucaacaauaagaaaggaaagaaccggcugcuugauggcgagagacuggccgaccggaaaauugcugaacuguuuucuaccaagacgcacaucggguga

SEQ ID NO: 13627 - RNA, 5064 nt, Artificial Sequence
  derived and/or modified CDS sequence (opt5) from CCHFV(Oman-199809166)__KR864901.1__GP
augcccgugaacaccaugcacacacugcucgucuacgccguuuucugccugcagcuuuggagcccuggcgggacgagaggacuguccaaugagacccaacauaacgaaacaggcaucacccgggcuccggaggggucucagggacccagccucccuguguccacagccucucccauuaugagcgacccuuccaucaccacacugucugcgagcaccuccggccuugaagggagcggagauacgacacccccugcuauuacacagggcccgacccugcccgagacaaccccugaacccucuacgacaaccggcacaaaugccuuuuccaccgccaucgcuaacgugagcacccagacagucaaggacacgccuacccccacagugcaaaccucuccgccuuccacacccgaugccagcaccauuccucaggggacgcaccauacagcucgcggacuccugucuguuaccgugaccaaacccgaggagguccccacaccuaccggcccggaacaggccuccaucgagacaaauagcuccagacuggcgacgucuaagacccccagcccuucccccacagcccaggugaccacagaaaacagcaauccuaacaccucucggcaacucguucuguccacgcagcccgcuaccagcucuccggugacaagcccugcccagcuuaauuucguccaguccgcuaccacaaucgccgugcaagacgcgcaccccucuccuaccaaccgcagcaaaagaaaucuggagauggaggugauucucacgcugucccaggggcuucggaaguauuacggacgcauccugaaacuccuggaucugacacucgaagaggacaccgaaggccugcuugagugguguaagagaaaccuggggcucacaugcgaugacaacuuuuuccagaagcggauugaagaguuuuuccugaccggagagggccauuuuaaugaaguccuucaauucaaaacccccagcacacugucuccuacggaguccgccagcguuggccuccccaccguggaaccguuuaagucuuauuucgcuaaaggguuucuguccaucgauagcggauacuucuccgccaaguguuauccucgcgcuucuaauagcggccugcagcucauuaacgugacacagcacuccgccagaaucgccgacacccccgggcccaaaauuacaaaccugaagaccaucaauugcaucaaccuuaaggcucuggucuuuaaagagcaccgggaaauugagaucaaugugcuccugccucagguugcggugaaccuuucuaauugucauguccacauuaagagccaugugugcgauuacucccuggacaucgauggaacgguucgccucccgcggauucaccacgagggcacauucauccccgggaccuauaaaaucgugauugacaagaaaaacaagcaaaaugacagauguaaccuggucaccaauugcgugaucaaaggacgcgaagucagaaagggccagagcgugcugcggcaguacagaacagagauucgcaucggcaaggccucuuccgggagccggagacuccugucugaagaguccggagaagauuguauuagccgcacccagcuucugcggacagagacggcugagauccauggcgacaacuacgggggaccuggcgauaaaaucaccauuugcaaugggucuacaaucguugaccaaagacucggcagcgaacugggauguuauaccauuaaccgcgugaaguccuucaaacugugcgagaauagcgccacaggcaagucuugcgaaaucgauaacacccccgucaaauguaagcagggguuuugccuuaagauuacgcaggagggacggggccacgugaaacucuccagagacagcgagguugugcuggaugccugugacuccucuugcgaaaucaugauuccuaaggggaccggagauauccuggucgacuguagcggcgggcagcaacauuuccucaaagauaaucugaucgaccuuggcugccccaacauuccucugcucggaaagauggcuaucuacauuugucgcauguccaaccaccccaaaacaaccauggccuuucuguucugguuuucuuucggcuaugugaucacaugcauucuguguaaggugaucuuuuaccuucucaucguugucgggacccugggaaagaaauucaagcaguaucgggagcugaaaccgcagacaugcaccauuugugaaacgacaccugugaaugcgaucgacgcugagaugcaugaucucaacugcagcuacaauauuugccccuauugugccuccagacugaccucugacggccuugcccgccacgugaugcagugcccuaagcggaaagaaaagaucgaggagaccgaacuguaccucaaccuggagcggauucccugggucgugagaaagcugcuucaaguuagcgaauccacagggguggcucucaaacgcagcucuuggcugaucguccugcucgugcugcuuaccguuucccugagcccggugcagucugccccuaucggacacggcaagacgauugagacauaccagaccagagaaggguauacauccaucugucucuuuguccugggcagcauucuguucaucgugucucaucuuaugaaaggacucguugauuccgugggcaauagcuuuuuccccgggcuguccauuugcaagaccuguagcaucggaucuaucaacggcuuugagauugagagccacaaaugcuacuguucccuguucugcuguccuuauugccggcauuguucugcugacaaggaaauccacaaacuccaccugagcauuugcaagaagagaaaagccggguccaaugucaugcuugcggugugcaagcgcauguguuuccgggccacaauggaggugucuaacaaagcucugcucaucagaagcgucauuaauaccacguuuguugugugcauccugauucuggccgugugugucguguccaccucugcuguugaaauggagagccuucccgccggaacaugggaacgcgaggaggaucugaccaacuucugccaucaagaaugucaggugacagagaccgaaugccucugucccuacgaggcgcugguccucagaaagccucuguuucuugacuccaucgccaaaggcaugaagaaucugcucaacagcacgucucuggagacaucccugagcaucgaagcuccguggggcgccauuaaugugcagucuaccuucaagcccacaguuuccaccgcuaacaucgcccuuagcugguccucuguggagcaccgggggaauaaaauucuggucagcggacgcuccgaaagcaucaugaagcucgaggaaagaaccggcauuucuugggaucuggggguggaggacgccuccgagagcaaacuccugacaguuucugugauggaucuuagccagauguauuccccugucuuugaauaccugucuggagaccggcaaguggaggaauggcccaaggcuacgugcaccggcgauuguccugagcgcugcggguguacaagcucuaccugccuccauaaagaauggccccacucuagaaacuggcggugcaacccuacaugguguuggggagugggcaccggcugcacguguugcgggcuggacgucaaggaucuguucacagacuauauguuuguuaaguggaaaguggaguacaucaagaccgaggcgaucgugugugucgaacuuaccagccaggagcgccagugcucccugauugaagccggaacaagauucaaucucggcccggugaccaucacacugagcgagccccggaacauucagcaaaaacucccucccgaaaucguuacgcugcauccucgcauugaggagggguuuuucgaccuuaugcacgugcagaagguccugucugcuuccaccguguguaaacugcagagcugcacacacggaguucccggcgaucuccagguguaccauaucgggaaucugcuuaagggagacaaggucaacggccaccugauccauaaaguggaaccgcacuuuaauaccuccuggaugucuugggauggcugugaccucgauuauuacugcaacaugggggacuggccuagcuguacauauaccggagucacgcaacauaaucacgccgccuucgugaaccugcucaauauugagaccgauuacacaaagaacuuucacuuccauuccaaaagaguuaccgcucacggcgacacaccccagcuggaucuuaaggcccggcccaauuauggggcgggagaaaucaccgugcuggucgagguggcugacauggagcugcauaccaaaaagauugaaaucucuggccucaaauucgccagccugacgugcaccgggugcuacgccuguuccagcggaauuucuugcaagguuagaauccacguggaugagccugacgaacuuacaguccacgugaaguccgaggaucccgacauuguggcugccagcuccucccugauggcgcgcaaacucgaauuuggcaccgacagcaccuucaaggcuuuuucugccaugccuaaaacaagccuguguuucuauaucguugagcgggaguacugcaaguccuguucuaaagaagauacgcagaagugcgucaacgccaagcucgagagaccgcaaagcauccugauugaacauaaaggcaccaucauugggaagcagaaugacacauguaccgcuaaagccuccugcuggcuugagagcgugaaguccuuuuucuacggacugaaaaacaugcugucuggcaucuuugggaauguguucauuggaaucuuucucuuccuggcucccuuuauccuucugauucucuucuucauguuuggcuggcgcauccuguucuguuuuaagugcugucggagaacacgcggacucuucaaguaucggcaccugaaagaugacgaagagaccggguacagaaagauuaucgagcgccuuaacaacaaaaagggcaaaaauaagcugcuggauggcgaacggcucgccgacagaaagauugcggagcuguuuagcacgaaaacacauaucggguga

SEQ ID NO: 13628 - RNA, 5064 nt, Artificial Sequence
  derived and/or modified CDS sequence (opt5) from CCHFV(Oman_812956)__KY362518.1__GP
augcccgugaacaccaugcacacacugcucguguacgccguuuucugccugcagcuuuggagcccuggcgggacgagaggacuguccaaugagacccaacauaacgagacaggcaucacccgggcuccggaggggucucagggacccagccucccuguguccacagccucucccauuaugagcgacccuuccaucaccacacugucugcgagcaccuccggccuugaagggagcggagauacgacacccccugcuauuacacagggcccgacccugcccgagacaaccccugaacccucuacgacaaccggcacaaaugccuuuuccaccgccaucgcuaacgugagcacccagacagucaaggacacgccuacccccacagugcaaaccucuccgccuuccacacccgaugccagcaccauuccucaggggacgcaccauacagcucgcggacuccugucuguuaccgugaccaaacccgaggagguccccacaccuaccggcccggaacaggccuccaucgagacaaauagccccagacuggcgacguccaagaccccuucucccagcccuacagcccaggugaccacagaaaacuccaaucccaacaccagccggcaacucguucugucuacgcagccggcuaccuccagcccugugacaucucccgcccagcuuaauuucguccagagcgcuaccacaaucgccgugcaagacgcgcacccuucccccaccaaccgcucuaaaagaaaucuggagauggaggugauucucacgcugagccaggggcuucggaaguauuacggacgcauccugaaacuccuggaucugacacucgaagaggacaccgaaggccugcuugagugguguaagagaaaccuggggcucacaugcgaugacaacuuuuuccagaagcggauugaagaguuuuuccugaccggagagggccauuuuaaugaaguccuucaauucaaaaccccuuccacacugagccccacggagucugccuccguuggccucccgaccguggaaccuuuuaagagcuauuucgcuaaaggguuucugucuaucgauuccggauacuucagcgccaaguguuauccccgcgcuuccaauucuggccugcagcucauuaacgugacacagcacagcgccagaaucgccgacacccccgggccuaaaauuacaaaccugaagaccaucaauugcaucaaccuuaaggcucuggucuuuaaagagcaccgggaaauugagaucaaugugcuccugccgcagguugcggugaaccuuuccaauugucauguccacauuaagucucaugugugcgauuacagccuggacaucgauggaacgguucgccucccccggauucaccacgagggcacauucaucccugggaccuauaaaaucgugauugacaagaaaaacaagcaaaaugacagauguaaccuggucaccaauugcgugaucaaaggacgcgaagucagaaagggccaguccgugcugcggcaguacagaacagagauucgcaucggcaaggccagcucugggucccggagacuccugagcgaagagucuggagaagauuguauuucccgcacccagcuucugcggacagagacggcugagauccauggcgacaacuacgggggacccggcgauaaaaucaccauuugcaaugggagcacaaucguugaccaaagacucggcucugaacugggauguuauaccauuaaccgcgucaagagcuucaaacugugcgaaaauuccgccacaggcaagagcugcgaaaucgauaacaccccugugaaauguaagcagggguuuugccuuaagauuacgcaggagggacggggccacgugaaacucucuagagacuccgagguugugcuggaugccugugacagcuccugcgaaaucaugauucccaaggggaccggagauauccuggucgacuguucuggcgggcagcaacauuuccucaaagauaaucugaucgaccuuggcugcccuaacauuccccugcucggaaagauggcuaucuacauuugucgcaugagcaaccacccgaaaacaaccauggccuuucuguucugguuuuccuucggcuaugugaucacaugcauucuguguaaggugaucuuuuaccuucucaucguugucgggacccugggaaagaaauucaagcaguaucgggagcugaaaccucagacaugcaccauuugugaaacgacacccgugaaugcgaucgacgcugagaugcaugaucucaacugcucuuacaauauuugcccuuauugugccagcagacugaccuccgacggccuugcccgccacgugaugcagugccccaagcggaaagaaaagaucgaggagaccgaacuguaccucaaccuggagcggauuccgugggucgugagaaagcugcuucaaguuucugaaagcacagggguggcucucaaacgcuccagcuggcugaucguccugcucgugcugcuuaccguuucucuguccccugugcagagcgcccccaucggacacggcaagacgauugagacauaccagaccagagaaggguauacaucuaucugucucuuuguccugggcuccauucuguucaucgugagccaucuuaugaaaggacucguugauucugugggcaauuccuuuuucccugggcugagcauuugcaagaccuguuccaucggaagcaucaacggcuuugagauugagucucacaaaugcuacuguagccuguucugcugucccuauugccggcauuguuccgcugacaaggaaauccacaaacuccaccugucuauuugcaagaagagaaaagccgggagcaaugucaugcuugcggugugcaagcgcauguguuuccgggccacaauggagguguccaacaaagcucugcucaucagaucugucauuaauaccacguuuguugugugcauccugauucuggccgugugugucgugagcaccuccgcuguugaaauggagucucuucccgccggaacaugggaacgcgaggaggaucugaccaacuucugccaucaagaaugucaggugacagagaccgaaugccucuguccuuacgaggcgcugguccucagaaagccgcuguuuuucgacagcaucgccaaaggcaugaagaaucuucugaacuccacgagccucgagacaucucuguccaucgaagcucccuggggcgccauuaaugugcagagcaccuuuaagccuacaguuucuaccgcuaacaucgcccuguccuggagcuccguggagcaccgggggaauaaaauucuugucucuggacgcagcgaauccaucaugaagcuggaggaaagaaccggcauuagcugggaucucgggguggaggacgccucugaguccaaacugcucacaguuagcgugauggaucugucucagauguauagccccgucuucgaauaccuuuccggagaccggcaaguggaggaauggccuaaggcuacgugcaccggcgauugucccgagcgcugcggguguacaucuagcacaugccugcauaaagaauggccucacuccagaaacuggcggugcaacccgaccugguguuggggagugggcaccggcugcacguguugcgggcucgacgucaaggaucuguuuacagacuauauguucguuaaguggaaaguggaguacaucaagaccgaggcgaucgugugugucgaacugaccucucaggagcgccagugcagccuuauugaagccggaacaagauuuaaucugggccccgugaccaucacacucuccgagccucggaacauucagcaaaaacugcccccugaaaucguuacgcuccauccccgcauugaggagggguucuuugaccugaugcacgugcagaagguccuuagcgcuucuaccguguguaaacugcaguccugcacacacggaguuccgggcgaucuucagguguaccauaucgggaaucuccugaagggagacaaggucaacggccaccuuauccauaaaguggaaccucacuucaauaccagcuggauguccugggauggcugugaccuggauuauuacugcaacaugggggacuggcccucuuguacauauaccggagucacgcaacauaaucacgccgccuuugugaaccuccugaauauugagaccgauuacacaaagaacuuccacuuccauagcaaaagaguuaccgcucacggcgacacaccccagcucgaucugaaggcccggccuaauuauggggcgggagaaaucaccgugcuugucgagguggcugacauggagcugcauaccaaaaagauugaaaucuccggccugaaauuugccucucucacgugcaccgggugcuacgccuguagcuccggaauuagcugcaagguuagaauccacguggaugagcccgacgaacugacaguccacgugaagucugaggauccugacauuguggcugccuccagcucucuuauggcgcgcaaacuggaguucggcaccgacuccaccuuuaaggcuuucagcgccaugccgaaaacaucucucuguuuuuauaucguugagcgggaguacugcaagagcuguuccaaagaagauacgcagaagugcgucaacgccaagcuggagagaccccaaucuauccucauugaacauaaaggcaccaucauugggaagcagaaugacacauguaccgcuaaagccagcugcuggcuggaguccgucaagagcuucuuuuacggacuuaaaaacaugcuguccggcaucuucgggaauguguuuauuggaaucuuccuguuucucgcuccuuucauccugcuuauucuguucuuuauguucggcuggcgcauccucuuuuguuucaagugcugucggagaacacgcgggcuguuuaaguaucggcaccucaaagaugacgaagagaccggauacagaaagauuaucgagcgccugaacaacaaaaagggcaaaaauaagcugcuggauggcgaacggcuggccgacagaaagauugcggaacucuucucuacgaaaacacauaucggguga

SEQ ID NO: 13629 - RNA, 5064 nt, Artificial Sequence
  derived and/or modified CDS sequence (opt5) from CCHFV(Oman)__DQ211632.1__GP
augcccgugaacaccaugcacacacugcucgucuacgccguuuucugccugcagcuuuggagcccuggcgggacgagaggacuguccaaugagacccaacauaacgaaacaggcaucacccgggcuccggaggggucucagggacccagccucccuguguccacagccucucccauuaugagcgacccuuccaucaccacacccucugcgagcaccuccggccuggaagggagcggagauacgaccccuccggcuauuacacagggccccaccccucccgagacaaccccugaacccucuacgacaaccggcacaaaugccuuuuccaccgccaucgcuaacgugagcacccagacagucaaggacacgccgaccccuacagugcaaaccucucccccuuccacacccgaugccagcaccauuccccaggggacgcaccauacagcucgcggacuucugucuguuaccgugaccaaaccugaggaggucccgacacccaccggcccugaacaggccuccaucgagacaaauagccccagacucgcgacguccaagaccccuucucccagcccgacagcccaggugaccacagaaaacuccaauccuaacaccagccggcaacugguucugucuacgcagcccgcuaccuccagcccugugacaucucccgcccagcucaucuucguccagagcgcuaccacaguggccgugcaagacgcgcacccuucccccaccaaucgcucuaaaagaaaccuggagauggaggucauucuuacgcugagccaggggcuccggaaguauuacggacgcauccugaaacuucuggaucucacacuggaagaggacaccgaaggccugcucgagugguguaagagaaaucuggggcuuacaugcgaugacaacuuuuuccagaagcggauugaagaguuuuuccugaccggagagggccauuuuaaugaaguucuccaauucaaaaccccguccacacugagcucuacggaguccgccagcgugggccuuccuaccguggaacccuuuaagucuuauuucgcuaaaggguuucuguccaucgauagcggauacuucuccgccaaguguuauccccgcgcuucuaacagcggccuccagcugauuaaugucacacagcacuccgccagaaucgccgacaccccugggccgaaaauuacaaaccugaagaccaucaacugcaucaaucucaaggcucugguguuuaaagagcaccgggaaauugagaucaacguucuucugccccagguggcggucaaucucucuaacugucaugugcacauuaagagccauguuugcgauuacucccuggacaucgauggaacggugcgccuuccucggauucaccacgagggcacauucauccccgggaccuauaaaaucgucauugacaagaaaaauaagcaaaacgacagauguaaucuggugaccaacugcgucaucaaaggacgcgaagugagaaagggccagagcguucuccggcaguacagaacagagauucgcaucggcaaggccucuuccgggagccggagacugcugucugaagaguccggagaagauuguauuagccgcacccagcuccugcggacagagacggcugagauccauggcgacaauuacgggggaccuggcgauaaaaucaccauuugcaacgggucuacaaucguggaccaaagacuuggcagcgaacugggauguuauaccauuaaucgcgucaaguccuucaaacucugcgagaacagcgccacaggcaagucuugcgaaaucgauaauacccccgugaaauguaagcagggguuuugccugaagauuacgcaggagggacggggccacguuaaacuguccagagacagcgaggugguccuugaugccugugacuccucuugcgaaaucaugauuccuaaggggaccggagauauccucguggacuguagcggcgggcagcaacauuuccugaaagauaaccugaucgaccucggcugccccaauauuccgcugcuuggaaagauggcuaucuacauuugucgcauguccaaccacccuaaaacaaccauggccuuucuguucugguuuucuuucggcuaugugaucacaugcauucucuguaagguuaucuuuuaccugcugaucgucguggggacccuuggaaagaaauucaagcaguaucgggagcucaaaccccagacaugcaccauuugugaaacgacaccugugaacgcgaucgacgcugagaugcaugaucugaauugcagcuacaacauuugccccuauugugccuccagacugaccucugacggccucgcccgccacgucaugcagugcccgaagcggaaagaaaagaucgaggagaccgaacuguaccuuaaucuggagcggauuccuugggugguuagaaagcuccugcaagugagcgaauccacaggggucgcucugaaacgcagcucuuggcuuaucgugcuccugguucugcucaccgugucccugagccccguccagucugccccuaucggacacggcaagacgauugagacauaccagaccagagaaggguauacauccaucugucuuuuugugcugggcagcauucucuucaucguuucucaucugaugaaaggacugguggauuccgucggcaacagcuuuuuccccgggcuuuccauuugcaagaccuguagcaucggaucuaucaauggcuuugagauugagagccacaaaugcuucuguucccucuucugcugucccuacugccggcauuguucugcugacaaggaaauccacaaacugcaccugagcauuugcaagaagagaaaagccggguccaacgugaugcucgcggugugcaagcgcauguguuuucgggccacaauggaggucucuaauaaagcucugcuuaucagaagcguuauuaacaccacguucguggugugcauccugauucucgccgucugugugguuuccaccucugcuguggaaauggagagccugccugccggaacaugggaacgcgaggaggaucugaccaauuuuugccaucaagaaugucaggucacagagaccgaaugccuuuguccguaugaggcgcuggugcucagaaagccccuguuccucgacuccaucgccaaaggcaugaagaaccugcuuaauagcacgucucuggagacaucccucagcaucgaagcuccuuggggcgccauuaacguucagucuaccuuuaagcccacaguguccaccgcuaauaucgcccugagcugguccucugucgagcaccgggggaacaaaauucuggugagcggacgcuccgaaagcaucaugaaacuugaggaaagaaccggcauuucuugggaucuggggguugaggacgccuccgagagcaaacuccugacagugucugucauggaucucagccagauguacuccccuguguucgaauaucugucuggagaccggcaaguggaggaauggcccaaggcuacgugcaccggcgauuguccugagcgcugcggguguacaagcucuaccugccuucauaaagaauggccgcacucuagaaauuggcggugcaaccccacaugguguuggggagucggcaccggcugcacguguugcgggcuggacguuaaggaucucuuuacagacuacauguucgugaaguggaaaguggaguauaucaagaccgaggcgaucgucuguguggaacugaccagccaggagcgccagugcucccugauugaagccggaacaagauuuaaccuuggcccuguuaccaucacacugagcgagccccggaauauucagcaaaaacucccucccgaaaucgugacgcugcauccgcgcauugaggagggguucuuugaccucaugcacguccagaaggugcugucugcuuccaccguuuguaaacuucagagcugcacacacggagugccuggcgaucugcaggucuaccauaucgggaaccugcucaagggagacaaggugaauggccaccugauccauaaagucgaaccccacuucaacaccuccuggaugucuugggauggcugugaccuugauuacuauugcaauaugggggacuggcccagcuguacauacaccggagugacgcaacauaaccacgccgccuuuguuaaucugcucaacauugagaccgauuauacaaagaauuuccacuuccauuccaaaagagugaccgcucacggcgacacaccucagcuggaucucaaggcccggcccaacuacggggcgggagaagucaccgugcugguugagguggcugacauggagcuucauacaaagaagaucgaaauuucuggccugaaauuugccagccugacgugcaccgggugcuaugccuguuccagcggaaucucuugcaagguccgcauucacguggaugagccugacgaacucacagugcacguuaaguccgaggauccggacaucgucgcugccagcuccucccugauggcgagaaaacuugaguucggcaccgacagcaccuuuaaggcuuucucugccaugcccaaaacaagccuguguuuuuacauuguggaacgggaguauugcaaguccuguucuaaagaagauacgcagaagugcgugaaugccaagcucgagagaccucaaagcauccugaucgaacauaaaggcaccauuaucgggaagcagaacgacacauguaccgcuaaagccuccugcuggcucgagagcgucaaguccuucuuuuacggacugaaaaauaugcuuucuggcauuuucgggaacguguuuaucggaauuuuccuguuucuggcucccuucauccuccugauccuuuucuuuauguucggcuggcgcauucuguuuuguuucaagugcugucggagaacacgcgggcucuuuaaguaccggcaccugaaagaugacgaagagaccggauauagaaagaucauugagcgccucaauaacaaaaagggcaaaaacaagcugcuugauggcgaacggcuggccgacagaaagaucgcggagcuguucagcacgaaaacacauauuggguga

SEQ ID NO: 13630 - RNA, 5064 nt, Artificial Sequence
  derived and/or modified CDS sequence (opt5) from CCHFV(3820-ST-2007)__KR814868.1__GP
augcccaucaacauuaugcacacccugcucgugugcuucauccuguaccuucagcugagcggccucgggggagcccauggccaauccaaugcuacagagcacaacgggacgaauaccacaaccgucccuggaacaucucagagcccgaagcccccugccuccaccacacugccccauaccccugaaucuagcacgguuaaacuuaccacacccaccuccgagacagaaggcucuggggagaccacgccuccgaacacaacccagggacugccccucccuggcacaacccccgaaagaagcgcgaccacagcuacguccaccagcucuacagacaauaugaacuccaccacacaggugaccgauaauacgccuacaagcaccgugucuauuucccccucuucuuccagcuccaugccgucuaccagccaaggcauccaccauccuguccggucccugcugagcgugucuucccccaagacaguuaccacaccuacgcccaugagccccggggagaugucuccugagaccagcucccagcacucugccaugagccgcgugccgacacucuauaccgccacacagauuuccaccgaaaacacggacagaagcacaccccggcagucugaguccagcguccaaccugcuacccagucucccaucaccuccccugcccagacaauccugcuuaugagcgcugcccccaaagcgauucaggauaugcacccguccccuaccaaucgcucuaagagaaaccuggaaguggagaucauucucacgcugagccaaggacuuaaaaaguacuauggcaagauccugaaacuccugcaucugacacucgaggaagacaccgaggggcugcuugaaugguguaagcggaaucugggauccaacugcgaugacgacuuuuuccagaaacgcauugaggaauuuuucaucacaggcgagggguacuuuaaugagguucuccaguucaagacccugucuacccuuagccccacagaaccuucccacgugagacugcccacggccgagccuuuuaaaagcuauuucgcuaagggauuucucucuauugauuccggcuacuucagcgccaaguguuauccccggucuuccaccagcggccugcaacugaucaacgucacacagcauccggcucgcaucgccgaaaccccugggcccaaaacaaccucucucaagacgauuaauugcaucaaccugagagcgagcguguuuaaagagcaccgggaaguggagauuaacguccuucugccccagaucgccguuaaucucuccaacugucacguggugauuaauagccaugucugcgauuacucucuggacacagauggaccugugcgccuuccgagaauccaccaugagggcaccuucauccccgggaccuacaagauuguuaucgaccggaaaaacaagcugaaugaucgcuguucccucgugacaaacugcgucauuaaaggaagagaagugcggaagggccagagcguucugagacaauauaagaccgagaucaaaauugggaagacauccacgggaucucgcaaacugcucagcgaggaaccuggcgacgacuguaucucccggacccagcugcuuaagacagaaaccgcugagauccacgaugacaauuacggcucucccggggauaaaauuacaaucugcaacggaagcaccauuguggaccagagacugggcuccgagcucggguguuauacgaucaaucgcgucaagucuuuuaagcugugcgaaaacagcgccaccggaaaaacaugcgagauugauuccaccccugugaagugucggcagggcuucugccugaaaaucacacaagaagggagaggccaugucaaacuuagccgcggaucugaggugguucucgacgcuugugauuccagcugcgagauuaugauccccaagggcaccggggacauccugguggauuguucuggaggccagcagcacuuccugaaggacaaucucauugaucuggggugcccucacaucccccuucugggaaagauggccauuuacaucugucggauguccaaccauccgagaacaaccauggccuuucucuucugguuuagcuucggcuaugucauuacgugcaucuuuuguaaagcucuguucuacucucugaucauuaucgggacacuuggcaagaaaauuaagcaguaucgcgaacucaaaccucaaaccugcaccaucugugagacagcgcccgugaaugccauugacgcugaaaugcacgaccugaacugcuccuacaauaucugcccuuacugugccagccggcugaccuccgauggacucgccagacauguuacgcagugccccaagcgcaaggagaaaguggaagagacagagcuguaucuuaaccuggaacggaucccguggauugucagaaagcuccuucaggugagcgagucuaccggcguggcucugaaacggagcuccuggcuuaucguucuccugguccugcucgccgugucucugagcccugugcaguccgcgcccgucgggcacggaaagacaauugaaaccuaccaaacacgcgagggcuuuaccucuaucugucuuuucaugcuggggagcauucucuuuaucguguccugccugguuaaaggacugguggacucugucagcgauuccuucuuuccuggccuuagcguguguaagacgugcucuaucggguccauuaacggcuucgaaaucgagagccacaaauguuauugcucucucuuuuguugccccuacuguagacauugcuccgcugaccgggagauucaccagcugcaucugagcaucugcaagaagagaaaaaccggauccaauguuaugcucgccguguguaagcgcaugugcuucaaagccacaauugaggcuucucggagagcccugcuuauccgcagcauuaucaacaccacauucgucauguguauccugacccucgcuauuugcgugguuuccacgagcgccguggaaauggaagaucugcccgcgggcacaugggagagagaagaggaccugaccaauuuuugucaccaggagugccaagucacagaaaccgagugucuuugcccuuaugaagcccuggugcuccggaagccgcuguuccucgauucuaucgugaaagggaugaagaaccugcuuaauuccaccagccuggagacaucucucagcauugaggcucccuggggagccaucaacguccaguccacguuuaagccuaccguuucuacagcuaauauugcccugagcugguccucuguggaacaucgcggcaacaaaauccuggugaccgggagaagcgaguccaucaugaaacuugaggaacggacaggagucagcugggaccugggcguggaagaugcgucugaguccaagcuccugaccguuagcauuauggaccucucccagauguacucucccguguucgaguaucugagcggggaucgccaggucgaagaguggccuaaggccacguguacaggcgacugccccgaaagauguggaugcaccuccucuaccugccuucacaaagaguggccucacagccggaauuggcgcuguaacccgacauggugcuggggcguggggaccggauguacaugcuguggcguugaugugaaggaccuguuuacggaccauauguucaucaaguggaaagucgaauacauuaagaccgaggcuaucgugugcguugagcucacaucccaagaaagacaguguagccugauugaggccgggacccgguuuaaucugggacccgugacaaucacccuuucugaaccucgcaacauccagcagaaacugcccccugagauuaucacgcuccaccccaagauugaagagggcuucuuugaucugaugcauguccaaaaagugcucuccgcuagcaccgugugcaagcugcagucuuguacacacggcaucccgggggaccuucagauuuaccauaucggaaaucugcugaagggcgauagagucaacgggcaccucauucacaaaaucgagccucauuucaauaccuccuggaugagcugggacggaugcgaucuggacuauuacuguaacaugggcgauuggcccucuugcacauauaccgggguuacacagcacaaccaugccgccuuugugaaucuucugaacaucgaaacggacuacaccaagacauuccacuuucacagcaaacgggugaccgcucauggagauacaccccaacucgaccugaaggcgagaccuaccuauggcgccggcgagauuacgguccucguggaaguugcugauauggagcugcacaccaaaaagguggagaucuccgggcuuaaauucgccucucugacaugcaccggauguuacgccugcagcuccggcauuagcuguaagguccgcauccauguggacgaacccgaugagcugacaguucacgugaaguccucugacccugacgucguggcugccagcaccucccucauggcgcggaaacuggaguucgggacggauucuacauuuaaggcuuucagcgccaugccgaaaaccucccuuugcuuuuauauugucgaaagagaauacuguaagucuugcagcgaggacgauaccaaaaaguguguggacacaaagcuggagcagccccaguccauccucaucgaacauaaaggaaccauuaucggcaagcaaaaugauacaugcaccgccaaagcuagcuguuggcuggagucuguuaaguccuucuuuuacgggcucaaaaacaugcugggaagcguguucggcagcuuuuucgucggcauucuucuguuucuggccccuuucgugcuccugguucuguuuuucauguucggguggaagauccuguuuugcuucaaguguugccgccggacgagaggacucuuuaaauaucgccaccugaaggacgaugaagagacaggcuaccggagaauuaucgaacgccucaauuccaaaaaggggaaaaaccggcugcuugacggagagagacuggcggaucggaagaucgcugagcuguucagcaccaagacacacauuggcuga

SEQ ID NO: 13631 - RNA, 5058 nt, Artificial Sequence
  derived and/or modified CDS sequence (opt5) from CCHFV(SR3)__AJ538199.1__GP
augcacaucagccugauguacgccguguucugccuccagcuguguggccuugggaagaccaacggaccccauaauggcacagagcacaacaauacgcaugucaugaccacaccugacgauucccaaucuccggaacccccuguuagcaccgcucugcccgugacaccugaccccuccaccgugacaccuucuaccccggccagcgggcucgagggauccggcgaagucuauacgucuagccccauuaccacaaaagggcugucccuuccugaggcgaccagcgaacccccugcuacaaccucugugguuacguccagcgccucugauacagacuccagcacccaggccgcuggagauacacccaccccgaccgugagaacaucucugccuuccagccccuccacgccuucuaccagccagggcacacacuaccccguccggucccuccugagcgugaccucucccaagccugaggagacaccgacccccuccaaaagcggcaaggacgaucuggccacgaacucuccucaucccgcuacaagccgcccuaccacacccccgaccaccgcccagaaaccuacagaaaauaacucccacaauacgaccgagcaacucgaaucucugacacaccuugcgacccuggggcucaugaucagccccacacagaccguucugccucaguccgugacgagcauugccauccaggacauucauaacucucccaccaauagauccaagcggaaccuugauauggagaucauccugacacucagccaaggacugaagaaauauuacggcaagauucugaaacuccugcaccuuacccuggaggaagacacagaggggcuccuggaauggugcaagcgcaaucuuggacuggauugugacgauaccuuuuuccagaaaagaaucgaggaauuuuucauuacgggcgaggggcauuuuaacgagguccuccaguuccggacacugggaacccugucuacaaccgaauccacccacgcuggcagcccuacaguggagcccuuuaaguccuauuucgccaagggcuuucucucuaucgacagcggguacuucuccgcuaaaugcuauucucgcacgagcaauuccggacugcagcuuauuaacgugaccagacacagcacacggaucgccgacaccccgggcccuaagauuacaaaucugaaaaccaucaacuguaugaaccucaaggcgucugucuuuaaagaacaucgcgagguugaaaucaaugugcugcuuccccaaguggccgucaaccuguccaauugccacguggcuauuaagagccauaucugugauuacucucucgacacggauggggccauuagacugccccagauccaccaugagggaacauucauuccuggcaccuacaaaaucguuaucgacaagaagucccggcugaacgaucgcugcacccucuuuacaaauugugugauuaaagggagagagguccggaagggacagagcgugcugcgccaauauaaaaccgaaaucagaauuggccgggcuucuacaggcagcagacgccuucuguccgaggaaagcggggacgauugcaucucucggacgcagcuccugagaaccgagacagccgaaguucacggagacaacuacggcgggccgggagauaagauuaccaucuguaauggcuccacaguggucgaccagcgccuggggagcgagcuuggcugcuauaccaucaaccgggugagauccuucaaacucugcgaaaauucugccacgggaaagagcugugagauugauuccauccccgucaagugcaaacagggcuacugucugaagauuacccaagaggggcgcggacacgugaaacugucucggggcagcgaaguugugcucgacgucugcgacuccucuugugaggugaugaucccuaaggggacaggagauauucugguugacugcagcggcgggcagcagcauuuccuuaaagauaaccugguggaccucggcugucccaagaucccucugcugggaaagauggcuauuuauaucugcagaauguccaaucaccccaaaaccacaauggcguuucuuuucugguuuagcuucggcuacgucaucaccuguauucucugcaaggccaucuuuuuccugcugauuaucuuugggacacucggaaaacgcuucaagcaguaucgggagcugaaaccucaaaccuguacgauuugcgaaacaacccccgugaacgcuaucgaugccgagaugcaugaccuuaauugcucuuacaacaucuguccguacugcgccuccagacugaccagcgauggccucgcucgccacgugacacaguguccucggagaaaggaaaagguugaggaaaccgagcuguaucugaaucuugagcggauucccugggucgugcgcaaacuccuccaggugucugaauccacggggacaguccugaagagaagcucuuggcucaucgugcugcuuguucuguuuaccgugucccucagcccuguccaguccgcccccauuggacacggcaaaacaaucgagaccuaccgggugagagaagaguauacaagcauuugccuguucguucuggggucuauccuuuuuaucgugagcuuccucaugaagggccuggucgacggagugggcaacaucuuuuucccggggcuguccguuuguaaaaccugcucuauuggaagcauuaacggcuucgaaaucgagucccauaaguguuacugcucucucuuuuguugcccuuauugucgccacugcagcgcggauggggagauucaucaacugcaccuuuccaucugcaaaaagcggaagacgggaucuaaugugaugcuggcugucuguaaaagaaugugcuuccgcgccaccauggaagugagcaacaaggcccucuuuaucagauccauuaucaauacaaccuucgugauguguauucugaaaggcgaguuugcugccgucaagagcauccaucccauugaaauggagucucugccugcugggacaugggaacgggaggaggaccuuaccaacuucugccaccaggaaugucagguuacggagacagaaugccugugucccuacgaggcccucgugcugcgcagaccccucuuucuggauuccaucgugaaaggcaugaagaaucuucugaacagcaccucucucgagacaucccugagcauugaagcgccuuggggagccaucaauguccaguccaccuauaagccgaccgugucuacagcuaacaucgcccugagcugguccagcguugagcaccggggcaauaaagugcuugucucugggcgcuccgaaagcauuaugaagcuggaggaaagaacgggaaucucuugggaccucggcguggaggaugcuagcgaguccaaacugcucaccguuucugugauggaccugagccaaauguacucccccgucuucgaauaccuuucuggggacagacagguggaggaauggccuaaggccacaugcaccggagauugucccgagcgcugcggcuguacaagcuccacgugccugcauaaagaauggccucacagcagaaacuggcggugcaaucccaccugguguuggggcguugggacaggaugcaccuguugcggccucgacgugaaggaucuguuuaccgacuauauguucgucaaguggaaaguggaguacauuaagacagaggcgaucgugugugucgaacugaccucucaggagcgccaaugcucccuuauugaagccgggacaagauuuaaccugggaagcguuacgaucacccucuccgagccucggaauauccagcagaaacugccgcccgaaauuaucacacuccauccuaagauugaggagggcuucuuugaucugaugcacgugcagaaagugcuuucugcuagcaccgucuguaagcugcaauccugcacacauggggugcccggagaccugcagguuuaucacaucggcaaccuccugaagggcgauagagugaaugggcaccuuauucauaaaaucgaacagcacuucaacaccucuuggaugagcugggacggaugugaucuggacuacuauugcaacaugggcgauuggccuuccuguacguacaccggggucacacagcauaaucacgccagcuucgugaaccuccugaauaucgagaccgacuauacaaagaccuuucacuuccauucuaaacgcguuacagcucacggagauacgccccaacucgaccugaaggcccggccgaccuacggcgccggggaaauuacagugcuugucgagguggcugacauggagcugcauaccaaaaagaucgaaauuuccggacugaaauuugcgggccugaccugcacaggcugcuacgccuguagcucugggaucuccugcaagguccggauucacguggaugagccugacgaacugacgguucaugucaagagcgaugaccccgaugugguggcugccucuagcucccuuauggcccgcaaacuggaguucggaaccgacucuacauuuaaggcuuucagcgccaugcccaaaaccucccucuguuuuuauaucguugaacgggaguacugcaagagcuguaacaaagaggauacacagaagugcgugaauaccaagcuggaacagccucaguccauucucaucgagcacaaaggcacgaucauugggaagcaaaacaauacauguaccgcgaaggcuucuugcuggcuggaaagcgucaaauccuucuuuuauggacuuaaaaacaugcugggcgggaucuucggaaauguguuuauuggcaucuucaccuuccugacacccuuuauucuccugauccuuuucuuuauguucggcuggagaauccuguuuuguuucaagugcugucgccggaccagagggcucuuuaaguaccgccaccugaaagacgaugaggaaacaggauaucggaagauuaucgagagacucaacaauaaaaagggcaaaaaccggcugcuugacggggagcgccuggccgauagaaagauugccgaacuguucucuaccaagacgcauaucggauga

SEQ ID NO: 13632 - RNA, 5055 nt, Artificial Sequence
  derived and/or modified CDS sequence (opt5) from CCHFV(SPU 187/90)__KJ682814.1__GP
augcacaucagccugauguacgccgugcucugccugcagcuuuguucccugggcgagacccauagaucucacaacgaaauugggcauaauaagacagacgucaugacgacccccggagauaaccucagcuccgagcaaccuguuucuacagcucugagcaucaccccggaccccuccacagugaccccuacaacccccgccucuggcagcgaaggguccggagagguguauacgagcucuccuauuaccacagaaucccuuagccugcccgagaccacaccugagcucccggcgaccacgggcaucgauucuuccagcgcuucuggggucgacuccagcacacaggccgccggaggcaccuccgcucugacagugcggaccucucugcccaauagcccuuccacccccagcacaccucaggauacguaccaccccguucgcauucuccugucugugaccggcccggggccugaagagacauccacccccagcggaucuggcaaagaaagcuccgccacaucuagccuucauccuaucuccgacagacugcccacacccccugcuacggcccaggggccgacagagaacaauagccacaacgcgaccgagcaccccaagccucucacccaaucugccacacccggacugaugaccuccccuacacagaucguccauccccagagcgcuacgucuauuaccgugcaggauacauauccguccccuaaaaaucggagcaagcgcaaccuugaaauggagaucauucugacccucucccaaggccugaaaaaguacuaugggaagauccugagacuccugcggcuuacacuggaagaggacaccgaaggacuccuggaguggugcaaacgcaaucuuggccuggauugugacgauacguucuuucagaagagaauugaggaguucuuuaucaccggcgaagggcacuucaacgaaguucuccaguuuaaaacacccggaacccugucuacaaccgagagcacgccugccgaacugcccacagcugagccuuucaaguccuacuuugccaaaggcuuccucucuauugacagcggguauuacuccgcgaagugcuacagcggaaccucuaauuccggccugcagcuuaucaacaucacacggcauagcacccgcauuguggauacccccgggccgaagaucacaaaucugaaaacgauuaacuguaucaaucucaaggccucuauuuuuaaagagcacagagaagucgagaucaacgugcugcuuccucaaaucgcugugaaccuguccaauugccacgucguuauuaagagccaugugugugacuauucucucgacaucgauggaaccgugcggcugccccacauuuaccaugaaggcgucuucauccccggcacauauaaaauugugaucgacaagaaaaacaagcugaaugaucgcugcacccucuuuacaaacuguguuaucaaggggagagaggugcggaaaggacagagcguccugcgccaguacaagaccgaaauuagaaucggcaaagccuccacggggagccggagacuucugucugaggagccuuccgacgauugcauuagccgcacacaacuccugcggaccgaaaccgcugagauccacggagacaauuauggcgggccgggcgauaagauuacaaucuguaacggauccaccauuguggaccagagacugggcucugaacuugggugcuacacaaucaaucgcguuaagagcuucaaacucugcgagaacuccgccacgggaaagucuugugagaucgauagcgugcccgucaaaugccggcagggcuauugucugagaauuacccaggaagggcgcggacaugugaagcugucccggggcucugaggucgugcucgacgccugcgauacaagcugugaaaucaugauuccuaaagggaccggcgacauccugguugacugcuccggaggccaacagcacuuucuuaaggauaaucugauugaccucgggugucccaaaaucccucugcugggaaagauggcuaucuacauuugcagaaugagcaaccaccccaagacaaccauggcguuccuuuucugguuuucuuucggcuacgugaucacguguauucucugcaaagccaucuuuuaucugcugauuaucaucgggacccucggaaagcgcuucaaacaguaccgggagcugaagccucagacauguaccauuugcgaaacaacccccgucaaugcuaucgaugccgagaugcaugaccuuaacugcuccuauaauauuuguccguacugcgccagcagacugacaucugauggccucgcucgccacgugacccaauguccuaaacggaaggagaagguugaagagacggaacuguaucugaaccuugagagaauccccugggugguccggaaacuccuccagguguccgaaagcacagggguggcccugaagagaucuuccuggcugauuguucugcuuguccuguuuaccgugagccucuccccugugcagagcgcgcccaucggccauggaaaaaccaucgaggcuuacagagcccgggagggcuauacaucuauuugccuguucguccuggggagcauccuuuuugugguuuccugucucaugaagggacugguggacucugucggcaauagcuucuuuccggggcuguccauuugcaaaaccuguucuaucggaagcauuaacggcuucgaaaucgagucccacaagugcuacuguucucucuuuugcuguccuuacugcagacacugcagcgccgauaaagaaauucauaagcugcaccuuuccaucuguaagaaacgcaagacggggagcaacgugaugcuggcuguuugcaaacggauguguuucagagccacaauggaggugucuaaucgcgcucucuuuaucagauccauuaucaacaccacauucguccugugcauucugauccuugccguguguguugugagcaccucugcggucgaaauggagaaucugcccgccggcacaugggagcgggaagaggaccucaccaacuucugccaucaggaaugucaagugacggagaccgagugccuguguccuuaugaagcucucgugcugcgcagaccccuuuuucuggauuccauugucaagggaaugaaaaaucuccugaacagcacaucccuggagaccucucuuagcaucgaagcccccuggggcgcuaucaauguucaguccacauacaagccuaccgugagcacggccaacauugcgcugucuugguccagcguggagcaccgggggaauaagauccucgucucuggacgcagcgaauccauuaugaaacuggaggagagaacaggcaucucuugggaccucgggguggaagaugccagcgaguccaagcugcuuaccguuucugugauggaccugagccagauguauuccccggucuucgaauaccucagcggagauagacagguggaggaauggcccaaagcuacaugcaccggcgacuguccugagcgcugcggcugcaccucuuccacaugucugcauaaggaguggccccacagcagaaacuggcggugcaauccuacgugguguuggggaguuggaaccggcugcacauguugcgggcuggacgugaaagaucuuuuuaccgacuauauguucgucaaguggaagguggaauacauuaaaacagaggccaucguuuguguggaacugaccucccaagagcgccagugcucucucaucgaagcuggaacgagauuuaaccugggccccgucacaauuacccucagcgagccucggaauauccagcaaaagcugccgcccgagauuaucacccuucacccuagaauugaagagggguucuuugaucugaugcaugugcagaaagugcuguccgccucuacagucuguaagcuccagagcugcacccacggaguucccggcgaccuucagguguaucauaucggcaaccugcugaaaggggauaaggugaauggacaccucauucauaagaucgaaccucacuucaacacauccuggaugagcugggacggcugugaucuggacuacuacugcaacaugggggauuggcccucuugcacguauaccggagucacacaacacaaucaugccuccuuugugaaccuccugaauaucgagaccgacuacaccaaaaacuuccacuuucauagcaagcgcguuaccgcucacggcgauacgccgcagcuugaccugaaagcgcggccuaccuauggggccggagagauuacagugcuggucgaaguggcugauauggagcuccacaccaagaaaaucgaaauuucuggccugaaguucgccucccuuacauguaccggcugcuacgccuguagcucugggaucagcugcaaaguucgcauucauguggacgagcccgacgaacugacaguccacgugaaguccgaugaccccgaugucguggcugccucuagcucccucauggcgcgcaagcuggaguuuggaacggacagcaucuucaaggcuuucuccgccaugccuaaaaccucucucuguuuuuauaucguugagcgggaacauugcaaaagcuguuccgaggaagauacaaagaaaugcgugaauaccaagcuggagcagccccagucuauucuuaucgaacacaagggcaccauuaucgggaaacaaaacagcacauguacggccaagaccuccugcuggcuggagucugucaagagcuucuuuuacggacugaaaaauaugcucuccggcauuuucgggaacguguuuaucggaaucuuccuguuucuugcuccuuucauucugcucauccuguuuuucauguuuggcuggcggauucucuucuguuucaaaugcugccgccggacaagaggccuguuuaaguaucgccaucuuaaggacgaugaggaaaccggguaccggagaaucauugagcggcugaauaacaaaaaggggaaaaauaagcugcucgacggcgaacgccuggccgauagacggaucgcggagcuuuucagcacaaaaacccacauuggguga

SEQ ID NO: 13633 - RNA, 5055 nt, Artificial Sequence
  derived and/or modified CDS sequence (opt5) from CCHFV(SPU 48/90)__KJ682813.1__GP
augcacaucagccugauguacgccgugcucugccugcagcuuuguggccugggggagacccauagaucccacaacgaaacaggacauaauaagacggacgucgcuaccacacccggcgauaaccucucuagcgagcaacugguuuccaccgcccuuucuauuacaccugacccgagcaccgugacacccaccacguccgcgucugggcuggaaggaagcggcgagguguauaccuccagccucaucacaaccgaaucucugucccugcucgagacaaccccuaaacugcccacgacaaccgggauugauacaagcucugcuuccgacgucgauagcucuacccaggccgccggagacaccuccgcucuuacagugcggacgagcccucccuccaauccuucuaccccgagcacaccccaggauacccaccauccuaugcgcaaccugcucuccguuacaagccccggcccugaggaaaccucuacgcccuccggcagcgggaaggagucuccggccacaagcuccccucaccccgugucuaauagaagccagaccccucccgcuaccgcccaaggacccacagaagacaacuccuacaaugcgaccgagcacccugagcaucugacacagagcgccacgucuggccuuaugaccuccccgacacagaucguccacccccagagcgcuaccucuauuacagugcaagauaccuauccuucccccacgaaccggagcaaacgcaaucuggaaauggagaucauccucacccugucccaggggcugaagaaauacuauggaaagauucucagacugcuucggcugacacucgaagaggacaccgaaggccugcuugaguggugcaagcgcaaccuggggcucgauugugacgauacauucuuucagaaaagaaucgaggaguucuuuauuaccggagagggccauuucaaugaaguucugcaguuuaagacgccuggcacacugucuaccacagagagcacccccgccgaaccgccuaccgcugagcccuucaaauccuacuuugccaagggguuccucucuaucgacagcggauauuacuccgcgaaaugcuacagcggcacaucuaacuccgggcugcaacuuauuaauaucacgcggcacagcaccaagauugccgacacaccuggacccaagaucaccaaccugaaaacaaucaauuguauuaaccucaaggcuucuaucuuuaaagagcaccgcgaaguggagauuaacguccugcuuccucagguggccgugaaucuguccaacugccaugucguuaucaagagccacgugugugauuauccccucgacauugauggcaccgugagacugccgcauaucuaccacgaaggggucuucaucccuggaacguauaaaauugugaucgacaagaaaacaaagcugaaugaucggugcacccucuuuaccgacuguguuauuaagggccgcgaggugagaaaaggccagucuguccugcggcaauacaagacagaaauccgcauugggaaaaccagcacaggauccagacggcuucugagcgaggagcccucugaugacugcaucuccagaacgcagcuccugcgcaccgaaacagcugagauccauggcgauaacuaugggggacccggcgacaagauuaccaucuguaaugggagcacaauuguggaucagcggcugggcuccgaacuuggaugcuacaccaucaacagaguuaaaucuuucaagcucugcgagaauagcgccacgggcaaguccugugugauugacucugucccugugaaaugccgccagggguauugucugcggaucacccaagagggaagaggccacgucaagcugagccgcggguccgaagugguucucgacgccugcgauacaucuugugagauuaugaucccgaaaggaaccggcgacauccugguggauugcagcgggggccagcagcacuuucuuaaggacaaccugauugaucucggaugucccaaaaucccucugcugggcaagauggcuauuuacaucugccggauguccaaucaucccacaaccacaauggcguuccuuuucugguuuagcuucggguacgucauuaccuguauccucugcaaggccaucuuuuaucugcugauuaucauuggaacgcucggcaaaagauuccgccaguaccgggaacugaagccucaaacauguaccaucugcgagaccacacccgugaacgcuauugacgccgaaaugcacgaucuuaauugcucuuauaacaucuguccuuacugcgccuccagacugaccagcgacgggcucgcucgccauguuacgcagugucccaaacggaaggagaaaguggaggaaacagagcuguaucugaaucuugaaagaaucccgugggucgugcggaagcuccuccaggugucugaguccaccggaguugcccugaagcgcagcucuuggcucauuguccugcuugugcuguuuacagugucccucagcccuguccaguccgcgcccaucggccacgggaaaaccauugaggcuuacagagcccgggaaggcuauacaagcaucugccuguucgugcugggaucuauucuuuuuguugugagcugucucaugaagagacuggucgauuccgugggcaacucuuucuuuccugggcugagcaucugcaaaaccuguuccaucucuagcauuaauggauucgagaucgaaucccacaagugcuacuguucucucuuuugcugucccuacugccgccauugcagcgccgacaaagagauucacaagcugcaucuuuccaucuguaaaaagcggaagacgggcagcaacguuaugcuggcugugugcaaaagaauguguuuccgcgccaccauggaagucucugauagagcucucuuuauucgguccaucauuaacacaaccuucgugcugugcauccugauccuugccguuuguguggucagcacaucugcgguggagauggaaaaucugccggccgggaccugggagcgcgaggaagaccucacgaacuucugccaccaagagugucaggugacagaaaccgagugccuguguccuuaugaggcucucguccugagaaagccccuuuuucgggauuccauuguuaaaggaaugaagaaucugcucaacagcacaucccuggaaaccucucugagcaucgaggccccuuggggcgcuauuaaugugcaguccaccuacaaacccacagugagcacggccaacaucgcgcuuucuugguccagcgucgaacaucgcgggaauaagauucuggugucuggcagaagcgaguccaucaugaagcucgaagaacggaccggaaucucuugggaccugggcguugaggacgccagcgaauccaaacuccugacagugucugucauggaucuuagccagauguauucccccguguucgaguaccugagcggggaccgccaaguugaagaguggccuaaggcuaccugcacaggagauuguccggaaagaugcggcugcaccucuuccacgugucuccacaaagaguggccccacagccggaacuggcgcugcaauccuacaugguguuggggagugggaaccggcugcaccuguugcggccuggacgucaaggaucuguuuacagacuauauguucgugaaauggaagguugaguacauuaagaccgaagccaucgugugugucgagcuuacaucccaggaaagacagugcucucugauugaggcugggacgcgguuuaaccucggacccgugaccaucacacugagcgaaccuagaaauauucaacagaaacugcccccugagaucaucacccugcauccgcgcauugaggaaggcuucuuugaucuuaugcacgugcagaagguccuguccgccucuacaguuuguaaacugcagagcugcacccauggggugcccggagaccuccaaguguaucacaucggcaaccugcuuaagggggauaaagucaauggacaucugauucacaagaucgagccucacuucaacacguccuggaugagcugggacggcugugaucucgacuacuacugcaauaugggcgauuggcccucuugcaccuauacaggggugacccagcauaaccgggccuccuuuguuaaccugcucaauauugaaacagacuacaccaagaacuuccacuuucauagcaaaagagugacagcucacggagacacgccucagcuggaucuuaaggcgcgccccaccuauggcgccggggagaucacaguccugguggagguugcugacauggaacugcacaccaaaaagauugagaucucuggacucaaauucgccucccugaccuguacaggcugcuacgccuguagcucugggaucagcugcaaggugcggauucaugucgaugaaccggacgagcuuacggugcacgucaaauccgaugacccugaugugguugcugccucuagcucccugauggcgagaaagcucgaauuuggaaccgacagcacauucaaggcuuucuccgccaugcccaaaaccucucuguguuuuuauaucguggagaaggaguacugcaaaagcuguuccgaagaggauacaaagaaaugcgucaauaccaagcucgaacagccccaaucuauucugaucgagcauaagggcacgauuaucggcaaacagaacagcacauguaccgccaagguguccugcuggcuugaaucugcuaagagcuucuuuuaugggcugaaagacaugcuguccggaaucuucggcaauguuuuuauugggaucuuccucuuucuggccccuuucauucuucugauccucuuuuucauguuuggauggcgcauucugcucuguuucaaaugcugccggagaacccgcggccuguucaaguaccggcaccuuaaggaugacgaggagacaggguacagacggaucaucgaacgccugaacaauaaaaaggggaaaaacaagcugcucgacggcgagagacuggcggaucggcgcauugcugaacuuuuuagcaccaaaacacauaucggcuga

SEQ ID NO: 13634 - RNA, 5055 nt, Artificial Sequence
  derived and/or modified CDS sequence (opt5) from CCHFV(Sudan AB1-2009)__HQ378187.1__GP
augcacaucagccugauuuacgccauccucugccugcagcuuuguggccugggggagacccauggaucccacaacgaaacaagacauaauaagacggacaccauuacaacccccggcgauaaccucucuagcgagccuuccgugucuacagcucugagcaucaccccggaccccuccacagucaccccuacgacccccgccucugggcuugaaggaagcggcgagguuuauacauccccucccauuaccacagggagccugccucucccgggaaccacgcccgaacugccugcgacaaccggcacagauaccucuuccgcuagcgacguggauucuuccacccaaacagccggcgggacguucacccugacagugcggaccagccucccccgcucuccuuccacacccagcaccccgcaggacacgcaccauccugucagaaaucugcuuuccgugacaucucccggaccugaugagaccagcacccccuccggcacagggaaagagagccccgccaccucuuccccucacccgguuagcaaccggcccccuacacccccugcuacggcccagggacccaccgaaaaugacucucacaacgcuacagagcauccggaaagccugacccaguccgccacaaccggcccuaugacgucucccacccaaaucgugcacccucagagcgcgacacccaucaccguccaggauacacauccuucccccaccaaucgcagcaagagaaaccucgagauggagauuauccugacgcuuucucaggggcugaaaaaguacuauggaaaaauucuccggcugcugcaccucacacuggaagaggacaccgaaggccuucuggaguggugcaagcgcaaucucggccuggauugugacgauacauuuuuccaaaagagaaucgaagaguuuuucauuaccggggagggacacuuuaacgaagugcuucaguuccggaccccgggcacacuguccacgaccgagagcaccccugccgggcuccccaccgcugaacccuuuaaaucuuacuucgccaagggauuucuguccaucgacagcggcuauuacuccgcuaaaugcuauucugggacaagcaauuccggacugcagcucauuaacaucacccgccauucuacgagaaucguugacacaccuggcccgaagauuaccaaucugaaaaccaucaacuguauuaaucuuaaggccagcaucuucaaggagcaccgggaaguggagauuaacguccugcucccccagguggcggugaaccuguccaauugccaugucguuaucaaaagccacgugugugauuacucucuugacaucgauggcgccgugcgccugccucauauuuaccacgagggggucuuuauccccggaacauauaagauugugaucgacaaaaagaacaaacucaaugauagaugcacccuguucacaaacuguguuauuaagggccgggaagugcgcaaagggcaauccguccugagacaguacaagacggaggugcggaucggaaaggcuagcaccggcucuagacgccuccuguccgaggaaccuagcgacgauugcaucucucggacacagcuucugagaaccgaaacagccgagauucacggggacaauuauggcggacccggcgauaaaaucaccauuuguaacgggagcacgaucguugaccaacgccucggauccgagcugggcugcuacaccauuaaucgggucaagagcuuuaaacugugcgaaaacucugcuacagggaagaauugugagaucgauuccgugccugugaaaugcagacagggauauugucuucgcauuacccaggaaggccgggggcaugucaagcucagcagaggcuccgaggugguucuggacgccugcgacacaucuugugagaucaugauccccaagggaaccggcgauauucugguggacugcagcgggggacagcaacacuuccucaaagauaaccugaucgaccuuggcuguccgaagauuccucugcucgggaaaauggccaucuacauuugccgcauguccaaucaucccaagacaaccauggcuuuccuguuuugguucucuuuuggauaucugaucacguguauccuuugcaaagcgauuuucuaccuccugaucauuaucggcacacuggggaagcggcucaagcaguacagagaacugaaaccucagaccuguaccauuugcgagacaacccccgucaacgccaucgaugcugaaaugcacgaccuuaauugcagcuauaacaucuguccguacugcgccucccgccugacgucugauggccucgcccggcacgugauucaguguccuaagagaaaagagaagguugaagagacagagcuguaucugaaucuugaacggauccccugggugguccgcaaacuccugcaagugagcgaguccaccggaguggcucugaagagaagcucuuggcucauuguucugcuuguccuguuuacagugucccucagcccugugcagucugcccccaucggccaggggaagaccauugaagcguaccgggcuagagagggauauacauccaucugccuguucguccugggcagcauccuuuuuauugugucuugucucaugaaagggcugguugacuccgugggaaacagcuucuuucccggccuguccaucugcaagaccuguagcauuucuagcaucaacggguucgaaauugagucccauaaaugcuacuguucucucuuuugcuguccuuauugccgccacugcagcacggauaaggagauccauaaacugcaccuuuccauuuguaagaaacggaagaccggcucuaaugucaugcuggccgugugcaagagaauguguuuccgcgccacaauggaaguuagcaacagagcucucuuuauccgguccaucauuaauaccacauucgugcugugcauccugauucuugccgucugugugguuucuaccagcgcuguggagauggaaaaccugccggccggaacgugggagcgcgaagaggaccucacaaauuucugccaucaggagugucaagucaccgaaacagagugccugugucccuacgaagcgcucgugcugagaaaaccucuuuuucuggauuccaucgccaagggcaugaaaaaccuccugaauagcaccucucuggagaccucccuuagcauugaggcucccuggggagccaucaacgugcagucuacauacaagccuacggucuccaccgcuaauaucgcccugagcugguccucuguugaacaccgggggaacaaaauucucgugagcggccgcuccgagagcaucaugaagcuggaagagagaacagggauuucuugggaccucggaguggaagaugcguccgagagcaagcugcuuaccgucucugugauggaccugagccagauguauucccccguuuucgaguaccucucuggcgaccgccagguggaagaguggccuaaagccacaugcaccggcgauuguccggaacggugcgggugcacgagcuccacaugucugcacaaggaguggccccauucuagaaauuggcggugcaacccuaccugguguuggggagucggcaccgggugcacauguugcggacuggacgugaaagaucuuuuuaccgacuauauguucguuaaguggaaaguggaauacaucaagacagaggcuauugucuguguggagcugacgagccaagaacgccagugcucccucaucgaggccggcaccagauuuaaucuggggcccguuacaaucacccucagcgaaccucggaacauucagcaaaagcugcccccggagaucauuacacuucacccuagaaucgaagagggauucuuugaucugaugcaugugcagaaaguccugucugcuuccaccguguguaagcuccagagcugcacgcacggcgugcccggcgaccugcaggucuaucauauugggaaucuucugaaaggagauaagguuaacggccaccucauccacaaaauugagccccauuucaacaccuccuggaugucuugggacgggugugaucuggacuacuauugcaauaugggagauuggccuagcugcacauacaccggcgugacacaacacaaccaugccuccuuugugaaucuccugaacaucgaaaccgacuacacaaagaauuuccacuuucacucuaagcgcgucacggcccauggggauacaccccagcuugaccugaaagcucggccuacauauggagcgggcgagaucaccgugcugguugaaguggccgacauggagcuccacaccaagaaaauugagaucagcggccugaaguucgcuucccuuacauguacggggugcuacgccuguagcucuggaauuuccugcaaagucagaauccauguggaugaaccggacgagcugaccguucacgucaagagcgaugaccccgaugugguggccgcuucuuccagccucauggcccgcaaacuggaauuuggcacagacucuaccuucaaggcguucagcgcuaugccuaagacaucccucuguuuuuauauugucgagcgggaacauugcaaaucuuguaacgaggaggauaccaagaaaugcgugaauacgaagcuggaacagccccagagcauccuuaucgagcacaaagggacaauuaucggaaagcaaaacuccaccuguaccgccagagccagcugcuggcuggaauccguuaagucuuucuuuuacggccugaaaaauaugcucagcgggauuuucggaaacguguuuaugggcaucuuccuguuucuugcuccuuucauucugcucauccuguuuuucauguuuggcuggcgcauccucuucuguuucaagugcugccggagaacacgcgggcuguuuaaauaucggcaccuuaaggacgaugaggaaaccggauacagacggauuaucgagcgccugaauaacaaaaagggcaagaauaaacugcucgacggggagagacuggccgaucggcgcauugcggaacuuuucuccacaaagacccauaucggauga

SEQ ID NO: 13635 - RNA, 5055 nt, Artificial Sequence
  derived and/or modified CDS sequence (opt5) from CCHFV(Sudan Al-Fulah 9-2008)__HQ378185.1__GP
augcacaucagccugauguacgccgugcucugccugcagcuuuguggccugggggagacccauagaucccacaacgaaacaguccauaauaagacggacauuguuaccacacccucugaugaccucagcuccgagcagcuggugucuaccgcucuuagcaucacaccugauccguccaccgugacacccaccacgucugccagcggacuggaaggcuccggggaggucuauaccagcucuccuauuacaaccgaaucccucagccagcccgagacaaccccuaaacugcccgcgacgacaggaaucgacaccucuuccgcuagcgauguggacucuuccacacaggccgccggcgauaccagcacccugacaguucggacguccccuccgaacucucccagcaccccuuccacaccccaggacacccaccauccuaugcgcaaucuccugagcgugacaucucccgggccggaggaaaccuccacgccuagcggaucuggcaaggagagcuccgcuacaucuagcccccacccugucuccaacagaccccaaacacccccugccaccgcucagggcccgacagaagauaauagccacaacgccaccgagcaucccgagcaccuuacacagucugcgacguccgggccuaugaccagccccacacagauugugcauccucaaucugccaccacaaucaccguucaggacacguaccccuccccgaccaaucggagcaaacgcaaccuggaaauggagaucauucucacacugucccagggacuuaagaaauauuacggcaagauccugagacuccugcggcugacccucgaagaggauacagaagggcugcuugaguggugcaagcgcaaucugggacucgacugugaugacaccuucuuucagaaaagaauugaggaguucuuuaucacgggcgaggggcacuucaacgacgugcugcaauuuaagacaccuggaacccuuucuacaaccgaaagcacccccgcuaaaccucccacagccgagccuuucaaguccuauuuugcuaaaggcuuccugacgauugauucuggcuacuauagcgccaagugcuacuccgggaccagcaauucuggacuccagcugaucaacauuacacggcacuccacccgcaucgucgacacacccggcccgaagaucaccaaucugaaaacgauuaacuguaucaaucucaaggcgagcauuuuuaaagaacauagagagguggagaucaacgugcugcuuccucaggucgccguuaaccugucuaauugccacguggugauuaagucccaugucugugauuacccccucgacaucgaugggacagugcggcugccccacaucuaucaugaaggaguuuucauuccuggcaccuacaaaaucgugauugacaagaaaaacaaacuuaaugaucgcugcacccuguuuacagacugugucaucaaggggagagaggugcggaaaggacaaagcguucuccgccaguauaagaccgaaauuagaaucggcaaggcuucuacaggcagccggagacugcuguccgaggaaccgagcgaugacugcaucucucgcacgcagcuccugcggaccgagacagccgagauucacggggauaacuacggaggccccggggacaagaucaccauuuguaauggauccacaaucguggaccagagacuuggcagcgaacuggggugcuauaccauuaaccgcgucaaauccuucaagcucugcgaaaauucugcuacgggcaagagcugugugaucgauuccgucccugugaaaugccggcaaggauacugucugagaauuacccaggaaggccgcgggcacguuaagcugucucggggaagcgaggugguccuugacgccugcgauacauccugugagaucaugauccccaaaggcaccggggacauucucguggauugcucuggaggccagcagcauuuucugaaggacaaccugguugaucucggguguccuaaaaucccccugcuuggcaagauggccauuuauaucugcagaaugagcaaucacccuaagacaaccauggcuuuccuguucugguuuuccuucggauacgugauuacauguauccucugcaaagcgaucuuuuaccugcugauuaucauuggcacccuugggaagcgcuuccggcaauauagagaacucaaaccccagacguguacaaucugcgagaccaccccggucaacgccauugacgcugaaaugcaugaucugaauugcagcuacaacaucuguccuuauugcgccucucgccugacauccgacggacucgcccggcacgugacccagugucccaagagaaaagagaagguggaagagacggagcuguaccuuaaucuggaacggaucccuuggguuguccgcaagcuccuucaggugagcgagucuacaggcguggcucugaaaagauccagcuggcuuauuguccuccuggugcuguuuaccguuucucucucccccgugcaaagcgccccgaucgggcacggaaagacaauugaagcguaucgggcuagagagggcuacaccuccaucugccuguucguccuugggagcauucuguuuaucgugucuugucucaugaaaggccugguugauagcgugggaaacuccuucuuuccuggccugucuaucugcaagacauguagcauuuccucuaucaauggguucgaaauugagagccauaaaugcuauuguucccuguuuugcugucccuacugccgccacugcucugccgacaaggagauccauaaacuccaccugagcauuuguaagaagcggaaaaccggauccaacgucaugcuggccgugugcaagagaauguguuuccgcgcuacgauggaaguuagcaacagagcccucuuuauccggucuauuaucaauaccacauucgugcugugcauccuuauucuggcugucugugugguguccaccagcgccgucgagauggaaaaccucccugcgggcacaugggagcgcgaagaggaucugaccaauuucugccaucaggagugucagguuacggaaacagagugccugugucccuacgaagcccuugugcugagacggccccucuuucuggacucuaucgugaaagggaugaagaaccuccuuaauuccaccagccuggagacaucccugucuauugaggcuccuuggggagccaucaacguccagagcaccuauaaaccgaccguguccacagcuaauauugcccucagcuggucuuccguugaacaccgcggcaacaagauccuggugagcgggagaucugagagcaucaugaagcuggaggaacggacgggcauuuccugggaccuuggagucgaagaugcgucugagagcaaacugcucaccguguccguuauggaccugucucaaauguacagccccguguucgaguaucucuccggcgaucgccaggucgaagaguggccuaaggccacaugcaccggggacugucccgaaagaugcggaugcacaagcucuaccugucugcacaaagaguggccucauucccggaauuggcgcugcaaccccacgugguguuggggcguggggacaggaugcaccuguugcggccuugauguuaaggaccuguuuaccgauuacauguucgugaaauggaaggucgaauauaucaagacagaggcuauuguguguguggagcucaccagccaggaaagacaaugcucccugaucgaggccggcacacgguuuaaucuggggccugucacgauuacccuuucugaaccgagaaacauccagcagaaacugcccccugagaucauuacacuccacccccgcaucgaagagggauucuuugaccugaugcauguucagaaggugcucagcgcuuccaccguguguaaacugcaaucuugcacacacggcgucccuggggaucuucagguguaccauauuggaaaucugcugaagggcgacaaaguuaacgggcaccucauccacaagauugagccccauuucaauaccagcuggauguccugggauggaugugaccuggauuauuacugcaacaugggcgacuggccgagcugcacguacaccggcgugacacagcacaaccaugccucuuuugucaaucuucugaacaucgaaaccgacuauacaaagaauuuccacuuucacuccaaacgggugaccgcccauggggauacaccucagcucgaccugaaggcuagacccacguacggagcgggcgagauuaccguucucguggaagucgccgauauggagcugcacaccaaaaagaucgagaucagcgggcuuaaauucgcuucucugaccuguaccggaugcuaugccuguuccagcggcauuucuugcaaggugcgcauccaugucgacgaacccgaugagcugacagugcacguuaaaagcgacgauccugacguggucgccgcuuccucuagccucauggcccggaagcuggaauuugggacggauuccaccuucaaggcguucagcgcuaugcccaaaacaucccuuuguuuuuacauuguggagaaggaauauugcaaaucuuguagcgaggaggacaccaagaaaugcguuaacacaaagcuggaacaaccucaguccauccucauugagcauaagggaaccaucaucggcaaacaaaauucuacguguacagccaaggugagcugcuggcuggaauccgccaaaucuuucuuuuacggccucaaggauaugcugagcgggauuuucggaaacgucuuuaucggcauuuuccuuuuucuggcuccguucgugcugcucgugcuguuuuucauguuuggguggagaauccuucuguguuuccgcugcugccggagaacccgcggacucuucaaauaucggcaccugaaggacgacgaggaaaccggcuacagacggauuaucgagcgccucaauaacaagaaagggaagaauaaacugcuugauggagagagacuggccgaccggaagaucgcggaacuguuuuccacaaaaacccacauuggcuga

SEQ ID NO: 13636 - RNA, 5055 nt, Artificial Sequence
  derived and/or modified CDS sequence (opt5) from CCHFV(SPU4/81)__DQ157175.1__GP
augcacaucagccugauguacgccgugcucugccugcagcuuuguggccugggggagacccauggauccuauaacgaaacaggccacaauaagacggacgucaugaccacacccggggauaaccucucuagcgagcaaccuguuuccaccgcucugucuauuacaccggaccccagcaccgugacaccuaccacgcccgccaauggacuugaaggcuccggggagguguacaccucuagcccuaucacaaccgaaucccugagccuccccgagacaaccccugagcugccggcgacggcuggaauugauacaucuuccgccagcgacgucgauucuuccacccaggccgcuggcggcacaagcgcccccaccgugagaaccucucugccuaacucccccagcacaccuuccacgccccaggaaacccaucacccgguucggaaucuccugucugugacaagccuugggccugaggaaaccuccacacccagcggaccuggcaaagagucuuccgcuaccagcucuccccaucccgucagcaacaagccuccgacgcccccugcccgcgcgcaggggcccacagagaauaacucccacaaugccaccgaacacccugagccccugacccaaucugcuacaccgggacucaugaccagcccuacacaggugguucauccccaguccgccacgagcaucaccgugcaggacacauauccuucucccaccaacagauccaaacggaaucuggaaacagagauuauccuuacccugagccaaggccucaagaaauacuaugggaagauccugcgccugcucagacugacgcuugaagaggauaccgagggacugcucgaauggugcaagcggaaccugggccuugacugugaugacacauucuuucagaaacgcauugaggaguucuuuaucaccggcgaggggcacuucaaugaaguccugcaguuuaagacaccuggaacccucucuacgacagaguccacccccgcugagcugccgacagccgaaccuuucaaaagcuacuuugcgaagggcuuccuguccauugauucuggguauuacagcgccaaaugcuacuccggaaccucuaacagcggccuccagcugaucaauauuaccagacauuccacacggaucguggacacgcccgggcccaagauuaccaaccuuaagacaaucaacuguaucaaucugaaagcuagcauuuuuaaggagcaccgcgaaguggagaucaacguccuccugccucaagccgcuguuaaucuuucuaacugccacguggugauuaaaucccaugucugugauuauagccuggacaucgacggaaccgugagacucccgcacauuuaccaugaaggcguuuucauccccggcacauauaagaucgugauugauaaaaaggacaaacugaaugaucggugcacccuguuuacggacugugucaucaaggggcgcgaggugagaaagggacagucuguucuccggcaguacaaaacagagauucgcaucggcaaggccuccauugggagcagacggcugcuuucugaagaaccuagcgaugacugcaucuccagaacccaacugcuccgcaccgaaacagccgagauccacggagauaacuauggcgggcccggcgacaaaauuaccaucuguaauggaagcacaauuguggaucagcggcugggcucugagcuggggugcuacacgaucaacagagucaaguccuucaaacuuugcgaaaauagcgcuaccggaaaguccugugagauugaaucugugccugucaagugccgccagggcuauugucuccggaucacacaggaggggagaggacaugugaaacugagccgcggcuccgaaguugugcuggacgcgugcgauaccucuugugagauuaugauccccaaggggacaggcgacauccucgucgacugcagcggaggccaacagcacuuucugaaagauaaccuuauugaccugggguguccuaagaucccccuccugggaaaaauggccauuuacaucugccggauguccaaucacccgaagaccacgauggcuuuccuguucugguuuucuuucggcuacgugauuaccuguauccuuugcaaggccaucuuuuaucuccugauuaucauugggacacugggaaaaagauucaagcaguaccgcgagcucaaaccucagaccuguacaaucugcgaaaccacacccguuaacgccauugaugcugagaugcaugaccugaauugcagcuauaacaucuguccuuacugcgccucccggcuuaccagcgauggccuggcgagacacgugacgcaaugucccaagcgcaaagaaaaggucgaggaaacagagcucuaucugaaucuggagcggaucccguggguggugagaaaacuucuccagguuucugaauccaccggggucgcucugaaacggagcucuuggcugauugugcuccuggugcuuuuuaccgucucccugagcccugugcagucugcccccaucggccauggaaagacaauugaggccuaccgcgcuagagaaggcuauaccuccaucugccucuucguucuggggagcauucuguuuaucguguccugucuuaugaaaggacucgucgacagcgugggcaacucuuucuuuccugggcugagcaucugcaagacguguuccauuucuagcaucaacggauucgagauugaaucccacaaaugcuacuguucucuguuuugcugucccuacugccggcacugcagcgccgauaaggagauccauaaacuccaccuguccauuuguaagaagagaaaaacaggcucuaauguuaugcuugcugugugcaagcgcauguguuuccgggccaccauggaggucagcaacagagcgcuguuuauccgcuccauuaucaauacaaccuucgugcucugcauccugauucuggccguuuguguggucagcacaucugcuguggaaauggagaaccuucccgccgggaccugggaaagagaggaggaccugacgaauuucugccaucaggaaugucaagugaccgagacagaaugccucuguccuuaugaggcucugguccuccggaaaccgcuguuucuugauuccaucguuaagggcaugaaaaaccugcucaauagcaccucucuggaaacaucccugagcauugaggcccccuggggagcgaucaacgugcaguccaccuacaagccuacggugucuacagccaauauugcucuuagcugguccagcgucgagcaccgcggcaacaagauccuggugucugggagauccgaaagcaucaugaaacucgaggaacggaccggaauuucuugggaccugggcguugaggaugccagcgaauccaagcuccugacagugucugucauggaccuuagccagauguauucccccguguucgaguaccugucuggggaucgccagguugaggaauggccuaaagcuaccugcaccggagacugucccgagagaugcggcugcacaagcuccacgugucuccauaaggaauggccucacagccggaauuggcgcugcaacccgaccugguguuggggcguggggacaggaugcaccuguugcggccuggacgucaaagaucuguuuacagacuauauguucgugaaguggaagguugaguacaucaaaaccgaagccauugugugugucgagcuuacgucucaagagagacagugcucccugaucgaagccgggacacgguuuaaucucggacccgugaccauuacccugagcgagccucgcaacauccagcaaaagcugcccccugaaaucauuacacuccaccccagaaucgaggagggcuucuuugaucuuaugcaugugcagaaaguccuguccgcuucuaccguuuguaagcugcagagcugcacacacggggugccgggagaccuccagguguaucauauuggcaaucugcuuaaaggcgauaaggucaacgggcaccugauccauaagauugaaccucacuucaacacguccuggaugucuugggacggaugugaucucgacuacuacugcaauaugggcgauuggcccagcugcaccuauacaggggugacccaacacaaccaugcguccuuuguuaaucugcucaacaucgagacagacuacaccaaaaauuuccacuuucauagcaagcgggugacggcccacggagauacaccccagcuggaccuuaaagcuagaccuaccuauggcgccggggaaauuaccguccugguggagguugccgauauggaacugcacacaaagaaaaucgagaucucuggacucaaguucgcuucccugaccuguacaggcugcuacgccuguagcucuggcauuuccugcaaagugcgcauccaugucgacgagcccgacgaacuuacggugcacgucaagagcgaugacccugaugugguugcggcuucuagcucccugauggcccggaagcucgaguuugggaccgacucuacauucaaagccuucagcgcuaugccgaagaccucccuguguuuuuauauuguggaaagagagcauugcaaaagcuguuccgaagaggauaccaagaaaugcgucaacacaaagcucgagcagccccagucuauccugauugaacacaagggaacgaucaucggcaaacaaaauagcaccuguacagccaaggcguccugcuggcuugagucugugaaaucuuucuuuuacgggcugaagaacaugcuguccggaauuuucggcaauguuuuuaucgggauuuuccucuuucugggaccuuucauccuucugauucucuuuuucauguuuggcuggcgcauccuguucuguuucaaaugcugccggagaacccgcggccuccugaaguaucggcaucuuaaggaagacgaggaaacaggguacagacgcaucauugagcggcugaacaauaaaaagggaaagaacaagcugcucgauggcgagagacuggcugaccggcgcaucgccgaacuuuuuagcaccaaaacgcacauuggguga

SEQ ID NO: 13637 - RNA, 5055 nt, Artificial Sequence
  derived and/or modified CDS sequence (opt5) from CCHFV(NIV 11703)__JN572086.1__GP
augcacaccagccugaucuacgugguccucugccugcagcuuuguucccugggcaagacacaugggucucacaacggaacggagcauaauaaaaccgacguuaugacaacccccggcgauaaccaaagcccugaaccgcucguguccacagcccugcccgugaccccugaccccucuacagucaccccuacggcucccgccagcgggcuugagggauccggcgaaguguauaccucuagcuccauuacaaccaaggggcugagccucccuaaagcgacaucugagcugcuggcuaccacgggaaugguuacauccagcgccucugauaucgacccguccacccaggccgcuggcgauacacccaccccuaccgugagaacaagccuccccaauucuccuuccacgcccagcaccucccaggacacacaccauccgguccggaaccugcuuucugugaccagcccuaagcccgaagagacaccuacccccuccaaaagcgauaaggacucuuccgccacgaauagcccccacccugcugccucucgccugagcacaccgcccaccaccgaucagggcccuacagagaacaauaaccacaauuccaccgaacaacucgagucucugacaagaagcgcgacguccagcucuaugguuucccuuacccagacagugcugccccagagcgccaccucuauugcuacacaggacacccauccuucccccacgaaccggagcaagcgcaaucucgaaauggagaucauucugacccugccgcaagggcucaaaaaguacuauggaaaaauccugaaacuucugcaccucacacuggaggaagauaccgagggccuucuggaauggugcaaaagaaaccucgggcuggacugugaugacacauucuuucagaagcggaucgaggaguucuuuauuaccggagaaggccauuucaaugagguccugcaguuucgcgccccugggacgcucuccacaaccgaacccacacacgcuggaucuccuaccgccgagcccuucaagagcuacuuugcgaaaggcuuccuguccaucgacucuggcuauuuuagcgccaagugcuacuccagaaccagcaacucugggcuucagcugauuaaugugacacggcacuccacgcgcaucgcugauaccccuggacccaaaauuacaaaccucaagaccaucaacuguauuaaucugaaagccagcguguucaaggaacauagagaggucgaaaucaacguucuucugccgcaaguggcugugaaucucucuaacugccacgucgccaucaaaucccaugugugugacuauagccuggauacagacggcgccauucggcugccucacauccauuacgaggggaccuuuauucccggaacguacaagaucguuauugauaagaaaaauaagcucaacgaccgcugcacacuguucaccaauugugugaucaaaggcagagagguccggaaggggcagucugugcuucgccaguauaaaaccgaaaucagaauuggacgggcuagcacaggcuccagacgccugcucagcgaggaaucuggcgaugacugcaucucccggacccaacugcugagaacagagacggcggaaguucacggggauaacuacggaggccccggggacaagauuaccaucuguaauggaagcacaguggucgaucagcgccuuggcuccgagcucgggugcuauaccauuaaccgggugaagucuuuuaaacugugcgagaauagcgccacaggcaaguccugugaaaucgacucuaucccugucaaaugcagacagggauacugucugaagauuacccaggagggccgcgggcacgugaaacucagccggggauccgaaguugugcuggacgcuugcgauucuagcugugaggucaugaucccgaagggcacgggggacauucuuguggauugcuccggaggccaacagcauuuccugaaggacaaccucaucgaucuggggugucccaaaauuccucugcuuggcaagauggccaucuauauuugcagaaugagcaaucaccccaaaaccacaauggccuuccucuuuugguucucuuuuggauacguuaucaccuguauccugugcaaggugauuuucuaucugcucaucauuuuuggcacacuggggaaacgcuucaagcaguaccgggagcuuaagccucagaccuguacaaucugcgaaaccacgcccgucaacgcuauugacgccgagaugcaugaucugaauugcuccuacaacaucuguccuuauugcgcgagcagacucacaucugacggacuggcucgccacgugacccaaugucccaaacggaaggaaaaaguggaggaaaccgagcuguaccuuaaccucgagagaaucccguggguuguccggaagcugcuccagguguccgaaagcacaggcauugcccugaaaagaucuuccuggcugaucgugcuucugguccucuuuaccgugagcauuacgccuguucaguccgcccccaucgggcacggaaagacaauugaggcuuaucgcgcccgggaagaguacaccagcaucugccuguucgugcugggcucuguccuuuuugugguuagcugucucaugaaagggcugguggauuccgucggcaauaucuucuuuccuggacuguucauuugcaagacauguucuaucggcagcauuaacggguuugaaaucgagucccauaagugcuauuguucucucuucugcugucccuacugcagacacugcagcgcugaccgcgagauucaucagcugcaccuuuccaucuguaaaaagcggaaaaccggaucuaaugugaugcuggccguuugcaagagaauguguuuccgcacaaccauggaagugagcaacaaagcgcucuuugucagauccaucauuaauacgaccuucguggugugcauccugauucuggccgucuguguugugagcacaucugcuguggagauggaaucccuuccggccggcaccugggagcgggaagaggaucugacaaacuuuugccaucaagagugucaggucaccgaaacggagugccucuguccuuaugaagcucuggugcuccgcagaccccuguuccuugacagcaucguuaaggggaugaagaaucugcucaacucuacaucccuggagaccagccuguccauugaggccccuuggggagcgaucaaugugcagucuacauacaaacccaccgucagcgccgcuaacauugcccuuuccuggagcucuguggaacaccggggcaauaagauccugguuuccgggcgcagcgagucuaucaugaaacucgaagagagaaccggcauuagcugggaucugggaguggaagacgcuuccgagucuaagcuccugacagucagcgugauggaccuuucccagauguacucucccguuuuugaguaucugagcggcgaucggcaaguggaagaguggccuaaagccacgugcaccggggacuguccggaacgcugcggaugcacauccagcaccugucuccacaaggaguggccccauucuagaaacuggcggugcaauccuacaugguguuggggcgucgggaccggaugcacguguugcggccuggaugugaaggaccuguucacagauuacauguuugugaaauggaaggucgaauauaucaaaaccgaggccauuguuuguguggagcuuaccucccaggaacgccagugcagccugaucgaggcuggcacaagauucaaccucggguccgugaccauuacacugucugaaccccggaauauccaacagaagcucccucccgagaucauuacgcugcacccuagaaucgaagagggauuuuucgaccuuaugcauguccagaaagugcugagcgcguccaccguuuguaagcugcagucuugcacacacggcgugccgggggaucuccaagucuaccauauuggaaaccugcuuaagggcgaccgcgugaacgggcaccugauccacaaaauugagcagcaucucaauaccagcuggauguccugggauggaugugaccuggauuauuacugcaacaugggcgacuggcccagcugcacauauaccggcguuacgcagcacaaucaugccucuuuugugaaccuccugaauaucgaaaccgauuacacaaagaccuuccacuuucacuccaaacgggucacagcucauggggacaccccucagcuugaccugaaggccagacccacauacggagccggcgagaucacggugcuggucgaaguggcugauauggagcuccacaccaaaaagauugagaucagcgggcugaaauucgccucucuuuccuguacaggaugcuaugcguguagcucuggcauuagcugcaagguucgcauccauguggacgaaccugaugagcugaccguccacgugaaguccgacgaucccgacguuguggcugccucuagcucccucauggcccggaaacuggaaagcgggaccgauuccacauucaaggcuuuuucugccaugccgaaaacgagccucuguuucuacauugucgagagagaauauugcaagggauguuccaaagaggacacccaaaagugcgugaacacaaagcuggagcagccucagucuauccuuauugaacauaaaggcaccaucaucggcaagcagaauaacacauguaccgcgaaagcuagcugcuggcuggaguccgugaagucuuucuuuuacgggcugaaaaauaugcucagcggaauuuuuggcaacguuuuccuggggaucuuuuccuuccuugcccccuuuguccugcucauucuguucuuuauguucggauggcgcauccucuucuguuuuaagugcugccggagaacgcgcggccuguucaaguaucggcaccuuaaagaugacgaagagacaggguacagaaagauuaucgaacggcugaauaacaaaaagggaaagaauaagcugcucgauggcgagcgccuggccgacagaaagaucgcugagcuuuuuagcaccaaaacccacauuggcuga

SEQ ID NO: 13638 - RNA, 5055 nt, Artificial Sequence
  derived and/or modified CDS sequence (opt5) from CCHFV(NIV 112143)__JN572085.1__GP
augcacaccagccugaucuacgugguccucugccugcagcuuuguucccugggcaagacacaugggucucacaacggaacggagcauaauaaaaccgacguuaugacaacccccggcgauaaccaaagcccugaaccgcucguguccacagcccugcccgugaccccugaccccucuacaauuaccccuacggcucccgccagcgggcuugagggauccggcgaagucuauaccucuagcuccaucacaaccaaggggcugagccucccuaaagcgacaucugagcugcuggcuaccacgggaauggugacauccagcgccucugauauugacccguccacccaggccgcuggcgauacacccaccccuaccguuagaacaagccuccccaauucuccuuccacgcccagcaccucccaggacacacaccauccggugcggaaccugcuuucugucaccagcccuaagcccgaagagacaccuacccccuccaaaagcgauaaggacucuuccgccacgaauagcccccacccugcugccucucgccugagcacaccgcccaccaccgaucagggcccuacagagaacaauaaccacaauuccaccgaacaacucgagucucugacaagaagcgcgacguccagcucuauggugucccuuacccagacaguucugccccagagcgccaccucuaucgcuacacaggacacccauccuucccccacgaaccggagcaagcgcaaucucgaaauggagauuauccugacccugccgcaagggcucaaaaaguacuauggaaaaauccugaaacuucugcaccucacacuggaggaagauaccgagggccuucuggaauggugcaaaagaaaccucgggcuggacugugaugacacauucuuucagaagcggauugaggaguucuuuaucaccggagaaggccauuucaaugaggugcugcaguuucgcgccccugggacgcucuccacaaccgaacccacacacgcuggaucuccuaccgccgagcccuucaagagcuacuuugcgaaaggcuuccuguccauugacucuggcuauuuuagcgccaagugcuacuccagaaccagcaacucugggcuucagcugaucaaugucacacggcacuccacgcgcauugcugauaccccuggacccaaaaucacaaaccucaagaccauuaacuguaucaaucugaaagccagcguguucaaggaacauagagagguggaaaucaacguccuucugccgcaaguugcugugaaucucucuaacugccacguggccauuaaaucccaugucugugacuauagccuggauacagacggcgccauccggcugccucacauucauuacgaggggaccuuuauccccggaacguacaagauugugaucgauaagaaaaauaagcucaacgaccgcugcacacuguucaccaauuguguuaucaaaggcagagaggugcggaaggggcagucuguccuucgccaguauaaaaccgaaauuagaaucggacgggcuagcacaggcuccagacgccugcucagcgaggaaucuggcgaugacugcauuucccggacccaacugcugagaacagagacggcggaagugcacggggauaacuacggaggccccggggacaagaucaccauuuguaauggaagcacaguuguggaucagcgccuuggcuccgagcucgggugcuauaccaucaaccgggucaagucuuuuaaacugugcgagaauagcgccacaggcaaguccugugaaaucgacucuauuccugugaaaugcagacagggauacugucugaagaucacccaggagggccgcgggcacgucaaacucagccggggauccgaagugguucuggacgcuugcgauucuagcugugaggugaugauuccgaagggcacgggggacauccuugucgauugcuccggaggccaacagcauuuccugaaggacaaccucauugaucuggggugucccaaaaucccucugcuuggcaagauggccauuuauaucugcagaaugagcaaucaccccaaaaccacaauggccuuccucuuuugguucucuuuuggauacgugaucaccuguauucugugcaagguuaucuucuaucugcucauuaucuuuggcacacuggggaaacgcuucaagcaguaccgggagcuuaagccucagaccuguacaauuugcgaaaccacgcccgugaacgcuaucgacgccgagaugcaugaucugaauugcuccuacaacaucuguccuuauugcgcgagcagacucacaucugacggacuggcucgccacgucacccaaugucccaaacggaaggaaaaaguggaggaaaccgagcuguaccuuaaccucgagcgcauuccgugggugguucggaagcugcugcaggucuccgaaagcacaggcaucgcccucaaaagaucuuccuggcugauugugcuucuggugcucuuuaccgucagcaucacgccugugcaguccgcccccauugggcacggaaagacaaucgaggcuuauagagcccgggaagaguacaccagcaucugccuguucguucugggcucugugcuuuuugucgugagcugucucaugaaagggcugguugauuccgugggcaauauuuucuuuccuggacuguucaucugcaagacauguucuauuggcagcaucaacggguuugaaauugagucccauaagugcuauuguucucucuucugcugucccuacugcagacacugcagcgcugaccgcgagauccaucagcugcaccuuuccaucuguaaaaagcggaaaaccggaucuaaugucaugcuggccgugugcaagagaauguguuuccgcgcgacaauggaaguuagcaacaaagcccucuuugugagauccauuaucaauaccacguucgucgugugcauucugauccuggcuauuuguguggucagcaccucugccguugagauggaaucccuuccggcuggcacaugggagcgggaagaggaucugaccaacuuuugccaucaagagugucaggugacagaaaccgagugccucuguccuuaugaagcccuggugcuccgcagaccccuguuccuugacagcaucgucaaggggaugaagaaucugcucaacucuacgucccuggagacaagccuguccauugaggcgccuuggggagccaucaaugugcagucuaccuacaaacccacaguuagcgcugccaacaucgcucuuuccuggagcucuguggaacaccggggcaauaagauucuggucuccgggcgcagcgagucuaucaugaaacucgaagagagaaccggcauuagcugggaucugggaguggaagacgccuccgagucuaagcuccugaccguuagcgugauggaccuuucccagauguacucucccgucuuugaguaucugagcggcgaucggcaaguggaagaguggccuaaagccacaugcacgggggacuguccggaacgcugcggaugcaccuccagcacaugucuccacaaggaguggccccauucuagaaacuggcggugcaauccuaccugguguuggggcguugggacaggaugcaccuguugcggccuggaugugaaggaccuguucacggauuacauguuugucaaauggaagguggaauauaucaaaacagaggcuauugugugugucgagcuuaccucccaggaacgccagugcagccugaucgaggcgggcaccagauucaaccucggguccguuacaaucacccugucugaaccccggaauauucaacagaagcucccucccgagaucauuacacugcacccuagaaucgaagagggauuuuucgaccuuaugcaugugcagaaagugcugagcgccuccacggucuguaagcugcagucuugcacccacggcgugccgggggaucuccaaguuuaccauauuggaaaccugcuuaagggcgaccgcgugaacgggcaccugauccacaaaaucgagcagcaucucaauacaagcuggauguccugggauggaugugaccuggauuauuacugcaacaugggcgacuggcccagcugcaccuauacaggcgucacccagcacaaucaugcuucuuuugugaaccuccugaauauugaaacggauuacaccaagacauuccacuuucacuccaaacggguuaccgcccauggggacacaccucagcuugaccugaaggccagacccaccuacggagcuggcgagaucacagugcuggucgaaguggccgauauggagcuccacacgaaaaagauugagaucagcgggcugaaauucgcgucucuuuccuguaccggaugcuaugcuuguagcucuggcauuagcugcaagguccgcauccauguggacgaaccugaugagcugacaguucacgugaaguccgacgaucccgacgucguggccgccucuagcucccucauggcucggaaacuggaguucgggaccgauagcaccuuuaaggccuucuccgcgaugccgaaaacaucucucuguuuuuacauuguugaaagagaauauugcaagggauguagcaaagaggacacgcaaaagugcgugaacaccaagcuggagcagccucaguccauccuuaucgaacauaaaggcacaauuaucggcaagcagaauaacaccuguacagcuaaagccucuugcuggcuggagagcgucaaguccuucuuuuacgggcugaaaaauaugcucucuggaauuuucggcaacguguuucuggggaucuucagcuuucuugcccccuucgugcugcucauucuguuuuucauguucggauggcgcauccucuuuuguuucaagugcugccggagaacccgcggccuguuuaaguaucggcaccuuaaagaugacgaagagacgggguacagaaagaucauugaacggcugaauaacaaaaagggaaagaauaagcugcucgauggcgagcgccuggcugacagaaagaucgccgagcuuuucuccacaaaaacccacauuggcuga

SEQ ID NO: 13639 - RNA, 5055 nt, Artificial Sequence
  derived and/or modified CDS sequence (opt5) from CCHFV(NIVA 118594)__JN572084.1__GP
augcacaccagccugaucuacgugguccucugccugcagcuuuguucccugggcaagacacaugggucucacaacggaacggagcauaauaaaaccgacguuaugacaacccccggcgauaaccaaagcccugaaccgcucguguccacagcccugcccgugaccccugaccccucuacagucaccccuacggcucccgccagcgggcuugagggauccggcgaaguguauaccucuagcuccauuacaaccaaggggcugagccucccuaaagcgacaucugagcugcuggcuaccacgggaaugguuacauccagcgccucugauaucgacccguccacccaggccgcuggcgauacacccaccccuaccgugagaacaagccuccccaauucuccuuccacgcccagcaccucccaggacacacaccauccgguccggaaccugcuuucugugaccagcccuaagcccgaagagacaccuacccccuccaaaagcgauaaggacucuuccgccacgaauagcccccacccugcugccucucgccugagcacaccgcccaccaccgaucagggcccuacagagaacaauaaccacaauuccaccgaacaacucgagucucugacaagaagcgcgacguccagcucuaugguuucccuuacccagacagugcugccccagagcgccaccucuauugcuacacaggacacccauccuucccccacgaaccggagcaagcgcaaucucgaaauggagaucauucugacccugccgcaagggcucaaaaaguacuauggaaaaauccugaaacuucugcaccucacacuggaggaagauaccgagggccuucuggaauggugcaaaagaaaccucgggcuggacugugaugacacauucuuucagaagcggaucgaggaguucuuuauuaccggagaaggccauuucaaugagguccugcaguuucgcgccccugggacgcucuccacaaccgaacccacacacgcuggaucuccuaccgccgagcccuucaagagcuacuuugcgaaaggcuuccuguccaucgacucuggcuauuuuagcgccaagugcuacuccagaaccagcaacucugggcuucagcugauuaaugugacacggcacuccacgcgcaucgcugauaccccuggacccaaaauuacaaaccucaagaccaucaacuguauuaaucugaaagccagcguguucaaggaacauagagaguuugaaaucaacguccuucugccgcaaguugcugugaaucucucuaacugccacguggccaucaaaucccaugucugugacuauagccuggauacagacggcgccauucggcugccucacauccauuacgaggggaccuucauucccggaacguacaagaucgugauugauaagaaaaauaagcucaacgaccgcugcacacuguuuaccaauuguguuaucaaaggcagagaggugcggaaggggcagucuguccuucgccaguauaaaaccgaaaucagaauuggacgggcuagcacaggcuccagacgccugcucagcgaggaaucuggcgaugacugcaucucccggacccaacugcugagaacagagacggcggaagugcacggggauaacuacggaggccccggggacaagauuaccaucuguaauggaagcacaguuguggaucagcgccuuggcuccgagcucgggugcuauaccauuaaccgggucaagucuuucaaacugugcgagaauagcgccacaggcaaguccugugaaaucgacucuaucccugugaaaugcagacagggauacugucugaagauuacccaggagggccgcgggcacgucaaacucagccggggauccgaagugguucuggacgcuugcgauucuagcugugaggugaugaucccgaagggcacgggggacauucuugucgauugcuccggaggccaacagcauuuccugaaggacaaccucaucgaucuggggugucccaaaauuccucugcuuggcaagauggccaucuauauuugcagaaugagcaaucaccccaaaaccacaauggccuuucucuucugguuuucuuucggauacgugaucaccuguauccugugcaagguuauuuucuaucugcucaucauuuucggcacacuggggaaacgcuuuaagcaguaccgggagcuuaagccucagaccuguacaaucugcgaaaccacgcccgugaacgcuauugacgccgagaugcaugaucugaauugcuccuacaacaucuguccuuauugcgcgagcagacucacaucugacggacuggcucgccacgucacccaaugucccaaacggaaggaaaaaguggaggaaaccgagcuguaccuuaaccucgagagaaucccgugggugguucggaagcugcugcaggucuccgaaagcacaggcauugcccucaaaagaucuuccuggcugaucgugcuucuggugcucuuuaccgucagcauuacgccugugcaguccgcccccaucgggcacggaaagacaauugaggcuuaucgcgcccgggaagaguacaccagcaucugccuguuuguucugggcucugugcuuuucgucgugagcugucucaugaaagggcugguugauuccgugggcaauaucuuuuucccuggacuguuuauuugcaagacauguucuaucggcagcauuaacggguucgaaaucgagucccauaagugcuauuguucucucuucugcugucccuacugcagacacugcagcgcugaccgcgagauucaucagcugcaccuuuccaucuguaaaaagcggaaaaccggaucuaaugucaugcuggccgugugcaagagaauguguuuucgcacaaccauggaaguuagcaacaaagcccucuucgugagauccaucauuaauacgaccuuugucgugugcauccugauucuggcggugugugucguuagcacaucugcuguggagauggaaucccuuccggccggcaccugggagcgggaagaggaucugacaaacuucugccaucaagagugucaggugaccgaaacggagugccucuguccuuaugaagcucugguccuccgcagaccccuguuucuugacagcaucgugaaggggaugaagaaucugcucaacucuacaucccuggagaccagccuguccauugaggccccuuggggagcgaucaauguucagucuacauacaaacccaccgugagcgccgcuaacauugcccuuuccuggagcucugucgaacaccggggcaauaagauccugguguccgggcgcagcgagucuaucaugaaacucgaagagagaaccggcauuagcugggaucugggaguugaagacgcuuccgagucuaagcuccugacagugagcgucauggaccuuucccagauguacucucccguguucgaguaucugagcggcgaucggcaaguugaagaguggccuaaagccacgugcaccggggacuguccggaacgcugcggaugcacauccagcaccugucuccacaaggaguggccccauucuagaaacuggcggugcaauccuacaugguguuggggcguggggaccggaugcacguguugcggccuggaugucaaggaccuguuuacagauuacauguucgugaaauggaagguggaauauaucaaaaccgaggccauugucuguguugagcuuaccucccaggaacgccagugcagccugaucgaggcuggcacaagauuuaaccucggguccgugaccauuacacugucugaaccccggaauauccaacagaagcucccucccgagaucauuacgcugcacccuagaaucgaagagggauucuuugaccuuaugcaugugcagaaaguccugagcgcguccaccguguguaagcugcagucuugcacacacggcguuccgggggaucuccaaguguaccauauuggaaaccugcuuaagggcgaccgcgucaacgggcaccugauccacaaaauugagcagcaucucaauaccagcuggauguccugggauggaugugaccuggauuauuacugcaacaugggcgacuggcccagcugcacauauaccggcgugacgcagcacaaucaugccucuuucguuaaccuccugaauaucgaaaccgauuacacaaagaccuuucacuuccacuccaaacgggugacagcucauggggacaccccucagcuugaccugaaggccagacccacauacggagccggcgagaucacgguccugguggaagucgcugauauggagcuccacaccaaaaagauugagaucagcgggcugaaauucgccucucuuuccuguacaggaugcuaugcguguagcucuggcauuagcugcaaggugcgcauccauguugacgaaccugaugagcugaccgugcacgucaaguccgacgaucccgacgugguugcugccucuagcucccucauggcccggaaacuggaaagcgggaccgauuccacauuuaaggcuuucucugccaugccgaaaacgagccucuguuuuuacauuguggagagagaauauugcaagggauguuccaaagaggacacccaaaagugcgucaacacaaagcuggagcagccucagucuauccuuauugaacauaaaggcaccaucaucggcaagcagaauaacacauguaccgcgaaagcuagcugcuggcuggaguccgugaagucuuucuuuuacgggcugaaaaauaugcucagcggaauuuucggcaacguguuucuggggaucuucuccuuucuugcccccuucguucugcucauucuguuuuucauguucggauggcgcauccucuuuuguuucaagugcugccggagaacgcgcggccuguuuaaguaucggcaccuuaaagaugacgaagagacaggguacagaaagauuaucgaacggcugaauaacaaaaagggaaagaauaagcugcucgauggcgagcgccuggccgacagaaagaucgcugagcuuuucagcaccaaaacccacauuggcuga

SEQ ID NO: 13640 - RNA, 5055 nt, Artificial Sequence
  derived and/or modified CDS sequence (opt5) from CCHFV(UCCR4448)__KY484042.1__GP
augcacaucagccugauguacgccgugcucugccugcagcuuuguggccugggggagacccauggaucccacaacgaaacaggccauaauaagacggacgucaugaccacacccggggauaaccucucuagcgagcaaccuguuuccaccgcucugucuauuacaccggaccccagcaccgugacaccuaccacgcccgccuccggacuugaaggcucuggggagguguauaccagcccucccaucauuacagaaucccugagccucccugagaccacaccggagcugucugcgaccgcuggaaucgauacguccagcgccucugacgucgauuccagcacacaggccgcuagaggcaccucugcccugacagugcggaccucccuccccaauagcccuuccacccccucuacaccucaggaaacgcaccaucccguucgcaaccugcuuagcgugaccuccccgagaccugaggaaacaagcacccccucuggcuccgggaaagagagcucugcuacaagcggaccucaccccgucuccaauaagcccccuaccccgcccgccaaaacgcagggcccuacagagaacaauucucacaacgcgaccgaacaucccgagccucugacccaaagcgccacacucgggcugaugaccucccccacacagauugugcacccgcagagcgcuacgucuaucaccguucaggacacauacccuucccccaccaaucggagcaagcgcaaccuugaaauggagaucauucugacacucucucaaggacugaaaaaguauuacggcaagauccugagacuccugcggcuuacccuggaagaggauacggaggggcuccuggaauggugcaaacgcaaucuuggacuggacugugaugacaccuucuuucagaagagaauugaggaguucuuuaucacaggcgaaggccauuucaacgaagugcuccaguuuaaaaccccugggacacuguccaccacggagagcacacccgccgagcugccuaccgcugaacccuucaaguccuauuuugccaaaggauuccucucuauugauagcggcuacuauuccgcgaagugcuacucugggacaagcaauuccggacugcagcuuaucaacauuacccggcacagcgcccgcaucgucgacaccccgggcccuaaggugacaaaucugaaaacgaucaacuguauuaaccucaaggcuucuaucuuuaaagagcacagagaaguggagauuaauguccugcuuccccaaguugccgugaaccuguccaauugccaugugaucauuaagagccacgucugugauuacucucucgacaucgacgggaccgugcggcugccccauaucuaucacgaaggaguuuucauuccuggcacauacaaaaucgugauugauaagaaagacaagcugaacgaucgcugcacccucuuuacagacugugucaucaagggcagagaggugcggaaagggcaguccguucugcgccaguauaagaccgagauuagaaucggaaaagcuagcacgggcucucggagacuucugagcgaagagacauccgaugacugcaucagccgcacccaacuccugcggaccgaaacagccgagauucauggggauaauuacggaggcccgggggacaagaucaccauuuguaacggcucuacaaucguggaucagagacugggauccgagcuuggcugcuauacgauuaaucgcgucaaauccuucaagcucugcgaaaacuccgccaccgggaagucuugugagaucgacagcgugcccgucaaaugccggcagggauacugucugagaauuacacaggaaggccgcgggcacgugaagcugucccggggaucugagguugugcucgaugcuugcgacaccagcugugaaaucaugaucccuaaaggcacaggggacauucuggucgauugcuccggcggacaacagcacuuucuuaaggacaaucugaucgaucucggcugucccaaaauuccucugcuggggaagauggcgaucuauauuugcagaaugucuaaccaucccaagaccacgauggccuuccuuuucugguuuagcuucggauacgugaucaccuguauccucugcaaagcuaucuuuuaccugcugauuauuaucggcacacucgggaagcgcuucaaacaguaucgggagcugaagccucagaccuguacaauuugcgagaccacacccguuaaugccaucgacgccgaaaugcacgaucuuaacugcuccuacaauaucuguccguauugcgcuagcagacugaccucugacggacucgcccgccaugugacgcaauguccuaaacggaaggagaaggucgaagagacagaacuguaccugaaccuugagcgcauucccuggguggugcggaaacuccugcagguuuccgagagcaccggcgucgcgcugaagagaucuuccuggcucaucgugcugcuugugcuguuuaccauuagccucucuccuguccaguccgcucccaucagccacgggaaaacaauugaagccuauagagcccgggagggcuacaccuccaucugccuguucgugcugggaagcauccuuuuuauuguuucuuaucucaugaagggccugguggauagcgucgggaauagcuucuuuccgggacugucuaucuguaaaacgugcagcacauccucuauuaacggcuucgaaaucgagagccacaaguguuacugcucccucuuuuguugcccuuacuguagacauugcucugcugacaaagaaauucacaagcugcaucuuagcaucugcaagaaacgcaagaccggguccaacgugaugcuggccguuuguaaacggaugugcuucagagcuacaauggaggugagcaaucgcgcccucuuuauuagaucuaucaucaacaccacauucguccuguguauucugauccuugcggugugcguuguguccaccagcgccgucgagauggaaaaucugcccgcuggaacgugggagcgggaagaggaucucaccaacuucugucaccaggagugccaagugacagaaaccgagugucugugcccuuaugaagcccucgugcugcgcaagccccuuuuucuggacucuauugucaaaggcaugaagaaucuccugaacuccacaagccuggagaccucccuuucuaucgaagcucccuggggcgccauuaauguucagagcacguacaagccuacaguguccaccgcgaacaucgcccugagcuggucuuccguggagcauagagggaauaaaauccucgucagcggacggucugagagcauuaugaagcuggaagagaaaacaggcaucuccugggaucucgggguggaagacgcuucugagagcaagcugcuuaccguuuccgugauggaucugucucagauguauagcccggucuucgaauaccucuccggagaccgccagguggaggaguggcccaaagccaccuguacaggcgacugcccugaaagaugugggugcacgagcucuaccugccugcacaaggaguggccccacucccggaacuggcgcuguaauccuacauggugcuggggaguuggcaccggcuguacaugcugugggcuggaugugaaggaccuuuuuaccgauuauauguucgucaaauggaagguggaauacauuaaaacggaggcuaucguuugcguggaacugacaagccaagagagacaguguucccucauugaggccggaacccgguuuaaccugggccccgucaccaucacacucucugaaccucgcaauauccagcaaaagcugccgcccgagauuaucacccuucauccuagaauugaagagggguucuuugaccugaugcacgugcagaaagugcugagcgccuccacagucugcaagcuccagucuuguacgcauggaguucccggcgaucuucagguguaucacaucgggaaccugcugaagggagacaaagugaauggccaucucauucacaagaucgagccucacuucaacaccagcuggauguccugggauggcugcgaccuggauuacuacuguaacaugggggacuggcccagcugcacauauaccggagucacacaacauaaucacgcuucuuuugugaaccuccugaauauugaaaccgauuacacgaaaaacuuccauuuucacuccaagcggguuaccgcgcacggcgacacaccgcagcuugaucugaaagccagaccuaccuauggggcuggagagaucacagugcuggucgaaguggccgacauggagcuccauaccaagaaaaucgaaauuagcggccugaaguucgccucucuuacaugcacgggguguuacgcuugcuccagcggaaucucuuguaagguucgcauucacguggacgagcccgaugagcugaccguccaugugaaaagcgacgaucccgacgucguggccgcguccucuagccucauggcucggaagcuggaauuuggcacagauuccaccuucaaagccuucagcgccaugccuaagaccucccucugcuuuuauaucguugagagagaacacuguaaaucuugcagcgaggaagacacaaagaagugugugaauacgaaacuggagcagccccaguccauucuuaucgagcauaagggcaccaucauugggaaacaaaacucuacaugcaccgcuaaggccagcuguuggcuggaauccgucaaaucuuucuuuuacggacugaagaauaugcucagcggcaucuucgggaacguguuuauuggaaucuuccuguuucuugcgccuuucauucugcucauccuguuuuucauguuuggcuggaagauccucuucugcuucaaauguugccgccggacaagagggcuguuuaaguaucgccaccuuaaagaugacgaggaaaccggauaccggagaauuaucgagcgccugaauaacaagaaaggcaagaauaagcugcucgauggcgaaauucuggcugaccggagaaucgccgagcuuuucuccacgaaaacacacauuggguga

SEQ ID NO: 13641 - RNA, 5055 nt, Artificial Sequence
  derived and/or modified CDS sequence (opt5) from CCHFV(UCCR4401)__KY484035.1__GP
augcacaucagccugauguacgccauucucugccugcagcuuuguggccugggggagacccauggaucccacaacgaaacaagacauaauaagacggacaccaugacaacccccggcgauaacccuucuagcgagccgcccguguccacagcucucucuaucacccuggacccuagcacagucacccccacgaccccugccuccgggcuugaaggaucuggcgagguuuauacaagcccucccauuaccacagggucccugccgcucagcgaaaccacgcccgagcugccugugacaaccggaacagauacccugucugcgggcgacguggaucccuccacccaaacagcuggcgggacgagcgccccuaccguccggacaucucuccccaauuccccgagcaccccuucuacaccccaggacacccaccauccugugcgcaaccugcuuuccguuacgagccccggacccgaugagacauccaccccuucuggcaccgggaaagaaagcuccgccacaagcucuccgcaccccguguccaauagaccucccaccccucccgcuacagcccagggaccgacggagaacgacagccacaauucuaccgaacauccugagagccugacacaguccgcuacccccggccucaugacaucuccuacccaaaucguccacccccagagcgccacgccuauuaccgugcaggauacacaucccuccccgaccaaccggagcaagcgcaaucugaaaauggagaucauccuuacacugucucaggggcucaagaaauacuauggaaagauucugagacugcuccaacugacccuugaagaggacacggaaggccugcucgaguggugcaagcggaaccugggccuugauugugacgauacauucuuucagaaacgcaucgaagaguucuuuauuaccggggagggacacuucaaugaaguucugcaguuuagaacaccuggcacccucuccaccacagagagcacgcccgcggggcugcccaccgccgaaccuuucaagucuuacuuugcuaaaggauuccuguccaucgacagcggcuauuacuccgccaagugcuauucugggacaagcaacuccggacuccagcugauuaauaucacccggcacucuacacgcauuguggacaccccgggccccaaaaucacgaaccuuaagacaaucaauuguauuaaccugaaggcuagcaucuuuaaagagcauagagaagucgagauuaacgugcuccugccucaaguggccgucaaucuuuccaacugccacguugugaucaagagccaugugugugauuacucucuggacauugauggcgcgguccggcucccccacaucuaccaugaggggguguucaucccuggaaccuauaaaauuguuaucgacaagaaaaauaagcugaacgaucgcugcacccuguuuacagacugugugauuaaaggcagagaaguccggaaggggcaguccgugcuccgccaguacaagaccgagaucagaauuggaaaagccagcacaggcucucggagacugcuuuccgaagaacccagcgaugacugcaucucucgcacgcaacugcuccggaccgaaacagcugagauccacggggauaauuauggcggaccuggcgacaagauuaccaucuguaacgggagcacaauuguugaucagagacugggauccgagcugggcugcuacaccaucaaucgcgugcggagcuucaaacuuugcgaaaacucugccacggggaagaauugugagauugacuccguccccgugaaaugcagacagggauauugucuccgcaucacccaggaaggccgggggcacgucaagcugagcagaggcuccgaggugguucuggacgcuugcgauacaucuugugagauuaugaucccgaagggaaccggcgacauccucguggauugcagcgggggacaacagcauuuucugaaagacaaccuuauugaucugggcuguccuaagaucccccuccuggggaaaauggccauuuacaucugccgcauguccaaucacccuaagacaaccauggccuuccuguucugguuuucuuucggauaugucauuacauguauccuuugcaaagcuaucuuuuaccuccugauuaucgugggcacccuggggaagcggcucaagcaguacagagaacugaaaccccagacguguacaauuugcgagaccaccccgguuaacgcgaucgacgccgaaaugcaugaucuuaauugcagcuauaacauuuguccuuacugcgcuucccgccugacaucugacggccucgcccggcacgugauccaaugucccaagagaaaagagaaggucgaagagaccgagcuguaucugaaucuugaacggaucccuuggguggugcgcaaacuccugcagguuagcgaguccacgggagucgcccugaagagaagcucuuggcucauugugcugcuugugcuguucacagucucccucagccccgugcagucugcucccaucggccaggggaagaccauugaagccuaccgggcgagagagggauauacauccaucugccuguuuguucugggcagcauucuuuucaucgugucuugucucaugaaagggcuggucgauuccgugggaaacagcuuuuucccuggccuguccaucugcaagaccuguagcauuucuagcaucaacggguuugaaauugagucccacaaaugcuacuguucucucuucugcuguccguauugccgccauugcagcacagacaaggagauccacaaacugcaucuuuccauuuguaagaaacggaagaccggcucuaauguuaugcuggcugugugcaagcucauguguuuuagagccacgauggaagucagcaaccgcgcccuguucaucagauccauuaucaauaccacauuugugcugugcauccuuauucuggcuguuuguguggucucuaccagcgccguggagauggaaaaccuccccgcuggaacaugggagcgggaagaggaucugaccaauuucugccaccaagagugucaggugacggaaacagagugccucuguccuuacgaagcccugguccuucgcaaaccccuguuccucgacuccaccgcgaagggcaugaaaaaccugcugaauagcacaucucuugagaccucccugagcaucgaggccccuuggggagcuauuaacguucagucuaccuacaagcccacaguguccacggccaauaucgcucucagcugguccucuguggaacauagagggaacaaaauucuggucagcggccgguccgagagcaucaugaagcucgaggagcgcaccgggaucucuugggaucugggaguggaagacgccuccgagagcaaacuucugacaguuucugugauggaccucagccagauguauuccccugucuuugaguaccugucuggcgauagacaaguggaagaguggccgaaagcgaccugcacaggcgacugucccgaacggugcgggugcaccagcuccacgugucugcacaaggaguggccucacucucgcaauuggagaugcaaccccacaugguguuggggaguuggcaccgggugcaccuguugcggacuugaugugaaagaccuguucacagauuauauguuugucaaguggaaaguggaauacauuaagaccgaggccaucguuuguguggagcucacaagccaggaacggcagugcucccugauugaggcuggcacgcgcuucaaucucgggccugucaccaucacacugagcgaacccagaaacauucaacagaaacuuccgccugagaucaucacccugcauccccggauugaagagggauuuuucgaccugaugcacgugcagaaggugcucucugccuccacagucuguaagcugcagagcugcacccauggcguucccggcgaucuucaaguguaucacaucgggaaucugcucaaaggagacaaggugaacggccaucugauucacaaaaucgagccucacuuuaacacguccuggaugucuugggaugggugugaccucgauuacuauugcaauaugggagacuggcccagcugcaccuacacaggcgucacccagcauaaccacgcuuccuucgugaaucugcuuaacauugaaacagauuacaccaagaauuuucauuuccacucuaagagaguuacagcccacggggacacgccucagcuggaccugaaagcccgcccgaccuauggagcuggcgagaucacagugcucgucgaaguggcggauauggagcugcauaccaagaaaauugagaucagcggccuuaaguuugccucccuggcuuguaccgggugcuacgccuguagcucuggaaucuccugcaaaguucggauucacguggacgaacccgaugagcucacaguccaugucaagagcgacgauccugacgugguggccgcuucuuccagccugauggccagaaaacucgaguucggcacggauucuaccuuuaaggcguucagcgcuaugcccaagacaucccuguguuucuauaucguugaacgcgaacacugcaaaucuuguagcgaggaggacaccaagaaaugcgugaacacaaaacuugaacagccucaauccauucugaucgagcauaaggggaccauuaucggaaagcagaauagcacguguacagccaaggccuccugcuggcuggaaucugucaagagcuuuuucuacggccucaagaacaugcuguccgggaucuuuggaaauguguucaugggcauuuuucuuuuccuggcucccuuuauccuccugauucucuucuuuauguucggcuggcggauccuguuuuguuucaaaugcugcagacgcacccgggggcuuuucaaguauagacaccugaaagaugacgaggaaaccggauaccgccggauuaucgagaagcugaacaauaagaaaggcaagaacaaacuccuggauggggagagacuugccgaccggcgcaucgcggaacuguuuucuacaaagacccacauuggauga

SEQ ID NO: 13642 - RNA, 5055 nt, Artificial Sequence
  derived and/or modified CDS sequence (opt5) from CCHFV(IbAn7620)__KX013451.1__GP
augcacaucagccugauuuacgccauccucugccugcagcuuuguggccugggggagaccuauggaucccauaacgaaacaagacacaauaagacggacaccaugacaacccccggcgauaaccucucuagcgagccuccgguguccacagcucuguucauuacccccgacccuucuacagucacccccacgaccccugccagcgggcuugaaggauccggcgagguuuacacaucucccccuaucaccacagggagccugccgcuccccgaaaccacgccugagcugcccgcgacaaccggaacagauaccuccagcgcuucugacguggauuuuuccacccaaacagccggcggcacgagcgcccugaccgugcggacagggcucccugacucucccuccaccccgagcacaccucaggauacccaucaccccaugcgcaaucugcuuucugucacguccccuggacccgacgagacaagcacccccuccggcaccgggagagaaucuagcgcuacauccagcccucauccggugucuaaccggcccccuacacccccugccacagcucagggacccacggagaaugauucccacaacgccaccgaacacccggagagccugacacagucugcgaccccuggccucaugacaagccccacccaaacgauucauccucaguccgccacccccaucacaguucaggacaaacagccuucucccaccaaucgcagcaagagaaaccuggagauggaaaucauucuuacacugucccaagggcucaaaaaguauuacggaaaaauccugcggcugcuccaccugacccuugaggaagauacggagggccugcucgaauggugcaagcgcaaucugggccuugacugugaugacaacuucuuucagaagagaauugaggaguucuuuaucacaggggaaggacauuucaaugaggugcugcaguuucggaccccgggcacacucagcaccaccgaaucuaccccugcugggcugcccacggccgagcccuucaaauccuauuuugcuaagggauuccugagcauugacucuggcuacuauuccgccaaaugcuacagcgggaccuccaacucuggacuccagcugaucaauauuacacgccacagcaccagaaucgucgauacaccuggcccgaagaucaccaaccuuaaaacgauuaauuguaucaaccugaaggcguccauuuuuaaggaacaccgggagguggagaucaacguucuccugccccaaguggccgucaaucuuucuaacugccauguggugauuaaaagccacgucugugacuacucccuggauaucgacggcgcuguucgccucccucauaucuaucacgaagggguguucauucccggaacauacaagaucgugauugauaaaaagaauaaacugaacgacagaugcacccuguuuaccgauugugucaucaagggccgggaggugcgcaaagggcagagcguucucagacaguauaagacagaaauucggaucggaaaggccucuaccggcuccagacgccugcuuagcgaggaaccuucugacgauugcaucucccggacacaacugcucagaacggagaccgcugagauucauggggacaauuacggcggacccggcgauaaaaucacaauuuguaacgggagcaccaucguggaccagcgccugggaucugaacugggcugcuauacaauuaaucgggucaagagcuucaaacuuugcgagaacuccgccaccgggaagaauugugaaaucgacagcgugccuguuaaaugcagacagggauacugucuccgcauuacgcaggagggccgggggcacgugaagcugucuagaggcuccgagaucguccuggaugccugcgacaccagcugugaaaucaugauucccaagggaacaggcgauauccucguggacugcuccgggggacaacagcacuuccugaaagauaaccuuauugaccugggcuguccgaagaucccucuccuggggaaaauggcuauuuauaucugccgcaugucuaaucaucccaagaccacaauggcguuucuguucugguuuagcuucggauacgucaucaccuguauucuuugcaaagccaucuuuuaccuccugauuaucauuggcacacuggggaagcggcucaagcaguauagagagcugaaaccucagaccuguacgaucugcgaaacaacccccgugaacgcuaucgaugccgagaugcacgaccuuaauugcuccuacaacauuuguccguauugcgccucucgccugaccagcgauggccucgcucggcauguuauccaauguccuaagagaaaagaaaagguggaggagacagaacuguaccugaaucuugagcggauucccugggucgugcgcaaacuccugcagguuuccgaaucuaccggaguggcccugaagagaagcuccuggcucaucguccugcuugugcuguucacggugagccucucuccuguucaguccgcgcccauuggccaggggaagacaaccgaggcuuaucgggccagagaaggauacacaagcaucugccuguuuguccugggcucuauccuuuucauuguguccugucucaugaaagggcugguggacagcgucggaaacucuuucuuccccggccuguccaucugcaagaccuguagcauuuccagcaucaacggguuugagauugagucucacaaaugcuauuguagccucuucugcuguccuuacugccgccacugcuccacagauaaggaaauccauaaacugcaccuuucuauuuguaagaaacggaagaccggcagcaaugugaugcuggccguuugcaagagaauguguuuucgcgcuacgauggagguguccaacagagcccucuucauccggucuaucauuaauaccacauucguccugugcauccugauucuugcuguguguguugugagcaccuccgccgucgaaauggagaaccugccggcgggaacaugggaacgcgaggaggaccucaccaauuuuugccaucaagaaugucaggugacggagacagaaugccugugucccuacgaggcccucguucugagaaaaccucuuuuccuggauucuaucgcuaagggcaugaaaaacccccucaauagcaccucccuggagacaagccugucuauugaagccccuuggggagcuaucgacgugcaguccaccuauaagcccaccgucagcacagccaacaucgcgcuuucuugguccagcguggagcaccgggggaauaaaauucugguguccggccgcucugaaagcaucaugaagcucgaggaaagaacggggauuuccugggaccugggagucgaggaugccagcgagucuaagcuccugaccguuuccgugauggaccuuagccagauguacucuccuguguuugaauaucugagcggcgaucggcaagucgaggaauggccgaaagcuacaugcaccggcgacugucccgagcgcugcgggugcacauccucuaccugucuccauaaggaauggccucacagcagaaacuggcggugcaaucccacgugguguuggggagugggcacagggugcaccuguugcggacuggauguuaaagaccuguucaccgauuacauguuugugaaguggaaagucgaguauaucaagacagaggccauuguguguguugaacuuaccucccaggagcgccagugcucucugaucgaagcuggcacaagauucaaccucgggccugugacgaucacccugagcgagccccggaauauucaacagaagcucccgccugaaaucauuacacugcaccccagaaucgaggagggauuuuucgaccuuaugcauguccagaaagugcuguccgccagcaccguuuguaagcugcagucuugcacacacggcgugcccggcgaucuccaagucuaccauauugggaaccugcuuaaaggagacaaggugaauggccaccugauccauaaaauugaaccucacuuuaacaccuccuggaugagcugggaugggugugaccucgauuauuacugcaacaugggagacuggcccuccugcacguacaccggcgugacacagcacaaucaugccucuuucgucaaccugcucaauaucgagaccgacuauacaaagaacuuucacuuccauagcaagcgcguuaccgcucacggggauacaccucagcuggaccuuaaagcgcggccgacguacggagccggcgaaaucaccgugcugguggaggucgcuaauauggagcugcacacaaagaaaauugaaaucuccggccucaaguuugccucucugaccuguaccgggugcuaugccuguagcuccggaauuagcugcaaagugagaauccauguugaugagcccgacgaacuuacagugcacgucaagucugaugacccugaugugguugcugccuccagcucucugauggcgcgcaaacucgaguucggcacggacuccaccuucaaggcuuuuagcgccaugcccaagacaucucuguguuucuacauuguggaacgggagcauugcaaaagcuguuccgaggaagauaccaagaaaugcgucaacacaaagcucgagcagccucaaucuauccugaucgaacacaaagggaccauuaucggaaagcagaauagcacguguacagccaaggcuuccugcuggcuugagagcgugaaauccuuuuucuauggccugaagaacaugcugucugggauuuuuggaaaugucuucaugggcaucuuucucuuccuggcccccuuuauucuucugauccucuucuuuauguucggcuggagaauccuguucuguuuuaaaugcugccgccggaccagagggcucuuuaaguaccgccaucugaaagacgaugaagagaccggauaucggagaauuaucgagcggcuuaacaauaagaagggcaaaaacaagcugcuggacggggaacgccucgcggacagacggauugcugagcuguuuagcacaaaaacccacaucggauga

SEQ ID NO: 13643 - RNA, 5055 nt, Artificial Sequence
  derived and/or modified CDS sequence (opt5) from CCHFV(Zahedan 2007)__KC867273.1__GP
augcacaucagccugauguacgccguguucugccuccagcuguguggccuugggaagaccaacggaccccauaauggcacagagcacaacaauacgcaugucaugaccacaccugacgauucccaaucuccggaacccccuguuagcaccgcucugcccgugacaccugaccccuccaccgugacaccuucuaccccggccagcgggcucgagggauccggcgaaguccacacgucuagccccauuaccacaaaagggcugucccuuccugaggcgaccagcgaacccccuucuacaaccuccgugguuacgagcucugcuuccgauacagacagcucuacccaggccgccggagauacacccaccccgaccgugagaacaucccugccuagcucccccucuacgccuagcaccucccagggcacacauuaucccguccggagccuccugucugugaccggccccaagccugaggagacaccgacccccuccaaaagcgggaaggacaaccuggcuaccaauucuccucaccccgccacaagccgcccuaccacccccuccacaaucgcucagaaaccgaccgaaaacaauucucacaacacaacggagcaacucgaaagccugacccaucuugccacacugggauccaagauuagcccuacccagacaguucucccccagucugugaccuccaucgcgauucaggauauccacacgagcccuaccaauagaucuaagcggaaccuggacauggagaucauucuuacacugucccaaggccucaaaaaguacuaugggaaaauccugaagcugcuccgccugacccuugaggaagauacagagggacugcucgaauggugcaaaagaaaucugggccuugacugugaugacaccuuuuuccagaagcggauugaggaauuuuucaucacgggggagggacauuuuaacgagguccugcaguuccgcacacucggcacccugagcacaaccgaauccacccacgccggcucucccacaguggagccuuuuaagagcuacuucgcuaaaggguuucuguccauugauucuggauauuucagcgccaagugcuacuccagaacgagcaauucuggccuccagcugaucaacgugacccggcacuccacacgcauugcugacacccccgggccgaaaaucacaaaucuuaagaccaucaacuguauuaaccugaaagccagcgucuuuaaggaacauagagagguugaaaucaaugugcuccugccucaaguggcggucaaccuuucuaauugccacguggccauuaaaucccauaucugugacuauagccuggauacggacggagcuauucggcucccccagauccaccaugagggcacauucauccccgggaccuacaagauuguuaucgauaagaaaucuaagcugaacgaccgcugcacccuguuuacaaauugugugauuaaaggaagagagguccggaagggccagagcgugcuccgccaauacaaaaccgaaaucagaauuggccgggccuccacagggagcagacgccugcuuucugaggaauccggagaugacugcaucagccggacgcagcugcucagaaccgagacagcugaaguucacggcgauaacuaugggggaccuggcgacaagaucaccauuuguaauggguccacaguggucgaucagcgccugggcucugagcugggaugcuacaccaucaaccgggugcgcagcuucaagcugugcgagaacuccgccacgggcaaaucuugugaaauugacagcaucccggucaagugcaaacagggguucugucucaagauuacccaagagggaagaggccacgugaaacugucccgggggucugaaguugugcuggaugucugcgacagcuccugugaggugaugauccccaagggaacaggcgacauucucguugauugcagcgggggccagcagcauuuucugaaggacaaccuuguggaucugggauguccuaaaaucccccuccugggcaagauggccaucuauauuugcagaaugucuaaucacccuaaaaccacaauggcuuuccuguuuugguucuccuuuggguacgucaucaccuguauucuuugcaaggcgaucuucuuucuccugauuaucuucggaacacugggcaaacgcuuuaagcaguaucgggagcucaagccccaaaccuguacgaucugcgaaacaaccccugugaacgccauugacgcugagaugcaugaucugaauugcagcuacaacaucugucccuauugcgccucuagacuuaccuccgacgggcuggcccgccacgugacacaguguccgcggagaaaagaaaagguugaggaaaccgagcucuaccugaaucuggagcggauuccuugggucgugcgcaaacuucuccaggugagcgaaucuacgggaacaguccugaagagauccagcuggcugaucgugcuccugguucuuuucaccgugucccugagccccguccagucugcuccuauuggccacgggaaaacaaucgagaccuaccgggugagagaagaguauacaagcaucugccucuuuguucugggcuccauucuguucaucgugucuuuucuuaugaagggacucgucgauggcguggggaacauuuucuuccccggacugagcguuuguaaaaccugcuccaucggcucuauuaacggguuugaaaucgagagccaucgcuguuacugcucccuguucuguugcccguauugucggcacugcucugccgacggagagauccaucaacuccaccugagcauuugcaagaagagaaaaacgggcuccaaugugaugcuugcggucuguaagcgcaugugcuuuagagcuaccauggaagugagcaacaaagugcuguucauccggucuauuaucaauacaaccuuugucguuuguauucucauccuggccgugugcguggucuccacaagcgccguggagauggaaucucugccugcugggaccugggagcgcgaagaggaucuuacgaacuucugucaucaggagugccagguuacagaaaccgagugucugugccccuacgaagcccucgugcugagacggccucucuuucuggacuccauugucaaggauaugaaaaaucuucugaacagcacaucccucgagaccucucugagcaucgaggcucccuggggcgccaucaaugugcaguccaccuauaagcccacaguuagcacggcgaacauugcccugucuugguccagcguggaacaccgcggaaauaagguccuugugucuggcagaagcgaguccaucaugaaacuggaagaacggaccgggauuucuugggaccucggaguugaagaugcuagcgaguccaagcugcucacagugucugucauggaccugagccaaauguacuccccuguguucgaguaucuuagcggcgaccgccagguggaagaguggccgaaagccaccuguacaggggauugccccgaaagauguggaugcaccucuuccacgugccugcacaaggaguggccucauagccggaacuggcgcuguaaucccacauggugcuggggcgucggcaccggguguaccugcuguggacucgacguuaaagaucuguuuacagacuacauguucgugaaguggaagguggaauacaucaaaaccgaggcuauugucugcguggagcugacaucccaggaaagacaauguucucuuaucgaggccggcacgcgguuuaaccuggggagcguuaccaucacacucuccgaaccuagaaauauucagcagaagcugcccccugagaucauuacccuccacccgaaaaucgaagagggauucuuugaucugaugcaugugcagaagguccuuucugcgagcacagugugcaaacugcaauccuguacccacggcguucccggggaccuucagguguaucauauuggaaaccuccugaagggcgaucgcgucaauggccaccuuauccacaagaucgagcagcauuucaacacgagcuggaugucuugggacgggugcgaucuggacuacuauuguaacaugggagauuggccuuccugcaccuacacaggcgugacccagcacaaucaugccagcuucgucaaccuccugaauauugaaacagacuauaccaaaacauuucacuuccacucuaagcgggugacggcucauggggauacgccccaacucgaccugaaagccagaccuacauacggagcuggcgagaucaccguucuuguggaagucgccgacauggagcugcacaccaagaaaauugagaucuccgggcugaaguuugccggacucacaugcacgggcuguuaugcuugcagcucuggcauuagcuguaaagugcgcauccauguugaugaacccgacgagcugaccgugcacgucaaguccgaugacccggaugugguggcggccucuagcucccuuauggcucggaagcuggaguucgggacagacagcaccuuuaaagccuucuccgccaugccuaagacaucucucugcuuuuacauuguugagagagaauacuguaaaagcugcuccaaggaggauacccagaaaugugucaacacgaagcuggagcagccccagucuauccucaucgaacauaagggaacaauuaucggcaaacaaaauaauaccugcaccgcuaaggccagcuguuggcuggaguccgugaaaucuuucuuuuaugggcuuaagaauaugcugggaggcauuuucgggaacguguuuaucggaauuuucacauuccugacccccuuuauccuccugaucuucuuuuucauguuuggcuggcgcauucuuuucugcuuuaaauguugccggagaacacgcggccuguucaaguaccggcaccucaaggacgaugaagagaccggguauagaaaaaucauugaacggcugaauaacaagaaaggaaagaaucgccuccuggacggcgagagacuugcggaucggaaaaucgcugagcuguuuagcacgaagacacacauuggguga

SEQ ID NO: 13644 - RNA, 5055 nt, Artificial Sequence
  derived and/or modified CDS sequence (opt5) from CCHFV(Afg09-2990)__HM452306.1__GP
augcacaucagccugauguacgccguguucugccuccagcuguguggccuugggaagaccaacggaccccauaauggcacagagcacaacaauacgcaugucaugaccacaccugacgauucccaaucuccggaacccccuguuagcaccgcucugcccgugacaccugaccccuccaccgugacaccuucuaccccggccagcgggcucgagggauccggcgaagucuauacgucuagccccauuaccacaaaagggcugucccuuccugaggcgaccagcgaacccccugcuacaaccucugugguuacguccagcgccucugauacagacuccagcacccaggccgcuggagauacacccaccccgaccgugagaacaucucugccuuccagccccuccacgccuucuaccagccagggcacacacuaccccguccggucccuccugagcgugaccucucccaagccugaggagacaccgacccccuccaaaagcggcaaggacaaccuggccaccaauucuccucaucccgcuacaagccgcccuaccacgcccccgacaaccgcccagaaaccuacagaaaacaauucccacaacacgaccgagcaacucgaaucucugacacaccuugcgacccuggggagcaugaucucccccacacagaccguucucccucagagcgugacgucuauugccauccaggauauucauaauucccccaccaacagaagcaagcggaaucuggacauggagaucauccuuacacugucucaaggacucaagaaauauuacggcaagauucugaaacugcuccaccugacccuugaggaagauacagaggggcugcucgaauggugcaagcgcaaccugggacuugacugugaugacaccuuuuuccagaaaagaaucgaggaauuuuucauuacgggcgaggggcauuuuaaugagguccugcaguuccggacacucggaacccuguccacaaccgaaagcacccacgcuggcuccccuacaguggagcccuuuaagucuuauuucgccaagggcuuucugagcaucgauuccggguacuucucugcuaaaugcuauagccgcacguccaacagcggacuccagcugauuaaugugaccagacacucuacacggaucgccgacaccccgggcccuaagauuacaaaccuuaaaaccaucaacuguaugaaucugaaggcguccgucuuuaaagaacaucgcgagguugaaaucaacgugcuccugccccaaguggccgucaaucuuagcaacugccacguggcuauuaagucucauaucugugacuacucccuggauacggacggggccauuagacucccccagauccaccaugagggaacauucauuccuggcaccuacaaaaucguuaucgauaaaaagagcaagcugaaugaccggugcacccuguuuacaaacugugugauuaaggggcgcgaggucagaaaaggacagucugugcuccggcaauauaagaccgaaauccgcauuggcagagcuagcgccggcucccggagacugcuuagcgaggaaucuggggaugacugcaucucccgcacacagcugcuccggacggagaccgccgaaguucacggagauaauuacggcgggccgggagacaaaauuacaaucuguaacggcagcaccguggucgaucagagacugggguccgagcugggcugcuauacaaucaaucgcgugcggucuuucaagcucugcgagaacagcgcuaccggaaaguccugugaaauugacucuauccccgucaaaugcaagcagggcuacugucucaaaauuacgcaagaggggagaggacacgugaagcugagccgcggcuccgaaguugugcuggaugucugcgacucuagcugugaggugaugaucccuaaagggaccggagacauucucguugauugcuccggcgggcagcagcauuaucugaaggacaaucuuguggaucugggcugucccaagaucccucuccugggaaaaauggcgauuuacaucugccggaugagcaaccaccccaagacaaccauggccuuccuguuuugguucucuuuuggcuaugucaucacauguauucuuugcaaagcuaucuucuuucuccugauuaucuucgggacccugggaaagagauuuaaacaguaccgcgagcucaagccucaaacauguaccauuugcgaaacgacacccgugaaugccaucgacgccgagaugcaugaucugaacugcuccuacaauaucuguccguauugcgcuagccggcuuaccucugacggccuggccagacacgugacccaguguccucgccggaaggaaaaaguugaggaaacagagcucuaccugaaccuggagcgcauucccugggucgugcggaagcugcuccagguguccgaaagcaccgggacgguccugaaaagaucuuccuggcugaucgugcuccugguucuuuucacagugagccuguccccuguccagagcgcgcccauuggacacggcaagaccaucgagacauauagagugcgggaagaguacaccucuauuugccucuuuguucuggggagcauccuguucaucguguccuuucuuaugaaaggccucgucgauggagugggcaacauuuucuuuccggggcugucuguuuguaagacaugcagcaucggauccauuaauggcuucgaaaucgagucucauaaauguuauugcagccuguucuguugcccuuacuguagacacugcuccgcugacggggagauucaucaacuccaccugucuaucugcaagaagcgcaaaaccggaagcaacgugaugcuugccgucuguaagcggaugugcuuuagagccacgauggaaguguccaauaaagcucuguucauccgcagcauuaucaacaccacauuuguggucuguauucucauccuggccguuugcguggugucuaccuccgcugucgagauggaaagccugcccgccggcacaugggagagagaagaggaucuuaccaauuucugucaucaggagugccaggugacggaaacagagugucugugcccuuaugaagcgcucguucugcggcgcccccucuuucuggacucuauugugaaggggaugaaaaaccuucuuaauuccaccagccucgagacaucccugucuaucgaggcccccuggggcgcuauuaacguccagagcaccuacaagccuaccguguccacagccaauaucgcucugagcuggucuuccguugaacacagaggaaacaaggugcuugucagcggccggucugagagcaucaugaaacuggaggaacgcacggggauuuccugggaucucggaguggaagacgccucugagagcaagcugcucaccguuuccgugauggaucugucucaaauguacagcccggucuucgaguaucuuuccggcgacagacagguggaagaguggcccaaagcgacauguaccggggacugcccugaacgguguggaugcacaagcucuaccugccugcacaaggaguggccccauucccgcaauuggagauguaacccuacguggugcuggggcgugggcacaggguguaccugcuguggacucgaugucaaagaccuguuuaccgauuacauguucguuaaguggaagguggaauauaucaaaacagaggccauugugugcgucgagcugaccagccaggaacggcaauguucccuuaucgaggcuggcacacgcuuuaaucuggggucugugacgauuacccucagcgaacccagaaacauccagcagaagcugccuccggagaucauuacacuccaccccaaaaucgaagagggauucuuugaccugaugcauguucagaaggugcuuuccgccucuaccgucugcaaacugcaaagcuguacacacggcgugccuggggaucugcagguuuaccauauuggaaaucuccugaagggcgaccgggugaacggccaccuuauccacaagauugagcagcauuucaacaccuccuggaugagcugggaugggugcgaccuggauuauuacuguaauaugggagacuggcccucuugcacguauaccggcgucacacagcacaaccaugcuuccuuugugaaucuccugaacaucgaaaccgauuacacaaaaaccuuccacuuccacagcaagagagucacagcccauggggacacgccucaacucgaucugaaagcccgccccaccuacggagcuggcgagaucacagugcuuguugaaguggcggacauggagcugcacaccaagaaaauugagaucucugggcugaaguuugccggacuuaccugcacaggcuguuaugcuugcuccagcggcauuucuuguaaaguccggauccauguggacgaaccggaugagcugacgguucacgucaagagcgacgauccugacgugguggccgccuccucuagccuuauggcuagaaagcuggaguucgggaccgauuccacauuuaaagccuucagcgcgaugcccaagaccucccucugcuuuuacauuguggaacgcgaauauuguaaaucuugcagcaaggaggacacacagaaauguguuaauaccaagcuggagcagccccaguccauccucauugaacauaagggaacgaucaucggcaaacaaaacaauacaugcaccgcuaaggccucuuguuggcuggagagcgucaaauccuucuuuuacgggcuuaagaacaugcugggaggcauuuucgggaauguguuuaucggaauuuucaccuuucugacaccuuucauccuccugauucuuuucuuuauguucggcuggcggauccuguuuugcuucaaauguugcagacgcacccggggccucuuuaaguauagacaccugaaggaugacgaagagacaggguaccgcaaaaucauugaacggcucaacaauaagaaaggaaagaacagacugcuugauggcgagcggcuggccgaccgcaaaaucgcugagcuguucucuaccaagacgcacauuggguga

SEQ ID NO: 13645 - RNA, 5055 nt, Artificial Sequence
  derived and/or modified CDS sequence (opt5) from CCHFV(SPU41/84)__AY900142.1__GP
augcacaucagccugauguacgccgugcucugccugcagcuuuguggccugggggagacccauggaucccacaacggcacaagauauaauaacacggacgcuaccacaacccccggggauucucaaagcccugaaccgcccgucuccacagccucuagcauuacccauaauccuuccacaguuaccucuacgacccccacaagcggauccgagggcagcggggaaguguacaccucuuccccuaucacaaccgagggacucagcccucccggcacgacaccggaacugcccgcgaccacaggcauugacaccucuggggcuuccgaugccaacccuagcacccaggccgcucggggaacaucugcccuuacggugcacaccucccugcccagcuccccuucuacacccccgaucagccaggacacccaucacccuguccgcaaucuccuguccgugacaagccccaugccugaggagaccacggcucccucuggcuccgggaaggaaagcucugccacaagcucuccccacccugcguccgauagaccgcccaccccucccgccaccgcucagggacugacagagagcaacucccauaaugccaccgaacaccucgagagccugacacaaucugcuacgccuggccuuguuaccucccccgcccagacagugcauccgcacagcgcgaccucuauugccgcuccugacacacaccccaacccuaccaaucgguccaaacgcaaccuggagauggaaaucauccucacgcugagccaggggcuuaagaaauauuacggaaagauucugagacuccugcaucugacccucgaggaagauacagagggccugcuugaauggugcaaacggaaucugggccucgacugugaugacaccuucuuucagaagcgcaucgaggaguucuuuauuacaggggaaggacacuucaacgagguccugcaauuuagaacccccggcacgguguccacaaccgaaucuacacaugccgggccucccaccgcugagccguucaagagcuauuuugccaaaggaucccuuucuaucgauagcggcuacuauuccgccaagugcuacagcgggaccucuaauuccggacugcagcucauuaacaucacacggcacagcacgaaaauugcugacaccccuggccccaagaucacaaaucugaaaaccaucaacuguauuaaccugaaggcgcucacauucaaggaacaucgcgagguugagaucaaugugcugcuuccccaggucgccgugaaccugucuaauugccacguggucauuaaaucccacguuugugauuacagccucgacaucgacggcaccgugagacugccucauauucaccaugaagggaucuuuaucccgggaacguauaagauugugaucgauaaaaagaacaaaaugaaugaccggugcacacuuuucaccaacugugucauuaagggccgcgaggugagaaaagggcagucuguucugaagcaauacaagaccgaaauccggauuggaaaagcuagcacaggcucccgcagacuccugagcgaggaaucuuccgaugacugcaucagccggacccagcugcucagaacagagacggccgagauccacggggauaauuauggcggacccggcgacaagauuaccaucuguaacggguccacaguggucgaucagcgccugggaucugaacuuggcugcuacaccauuaaucgggugaaaacauuuaagcugugcgagaacagcgccaccgggaaauccugugaaaucgacucuguuccugugaagugcagacaaggauauugucucaagauuacgcaggagggccgcgggcacgucaaacugagccggggcuccgaggugguccuggaugcuugcgacaccucuugugaagugaugauccccaagggaacaggcgauauucuuguugacugcagcgggggacagcagcauuuccucaaagacaaucugaucgaucugggcuguccuaagaucccccuccuggggaaaauggccauuuacaucugcagaauguccaaccacccuaagaccacaauggcguuucuuuucugguucagcuuuggauaugugauuaccuguaucauuugcaaggucaucuucuaccugcucaucauugugggcacacuggggaaacgcuuuaagcaauaccgggagcugaaaccccagaccuguacgaucugcgaaacaaccccgguuaaugcuauugacgccgagaugcaugaucuuaacugcucuuauaauaucuguccuuacugcgccuccagacucaccagcgacggccuggcucgccacgugacacagugucccaagcggaaagaaaaggucgaggagaccgaacuguaucucaaccuggagcggauuccuuggguggugcgcaaacuucugcagguuucugaauccacgggagucgcccucaaacggagcucuuggcugguggugcugcuuguccuccugacagugucccugagccccguucaauccgcuccgaucagccauggcaagaccguggaggccuacagagcgcgggaaggguauacaucuaugugccucuucguccugggaagcgugcuuuuucugguuuccugucucaugaaaggccugguggauucugucgggaacaccuucuuuccuggacugagcaucugcaagacauguuccauuucuagcaucaauggcuucgagauugagucccaccgcugcuacuguucucucuuuugcugucccuauugcagacacugcagcgccaacaaagaaauccaucagcuucaccuguccauuuguaagaaacggaaggcugggagcaaugugaugcuggccguuugcaagagaauguguuuccgcgcuaccauggaggugucuaaccgggcccucuuuaucagauccaucauuaauacgaccuucguccugugcauccuuauucuggcggccuguguggugagcacaucugcugucgaaauggagucccucccugccggcaccugggaacgcgaggaggaccugacaaacuuuugccaucaggaaugucagguugcugauaccgagugccugugucccuacgaagcccuugugcugagacggccccucuuccuggacagcaucgugaaaggaaugaagaaucuccugaacuccacgucucuugagacaagccuguccauugaggccccuuggggcgcuaucaauguccaaagcaccuacaaaccgacagugucuaccgcgaacauugcccucuccuggagcucuguugaacaccgcgggaauaagauccuggugagcggaagauccgagucuaucaugaaacuggaagagagaaccggcauuagcugggaucuuggggucgaagacgcuuccgagucuaagcugcucacagugagcguuauggaucugucccagauguauagccccguguucgaguaccucucuggagaccgccaggucgaagaguggccuaaggccacgugcaccggcgauugucccgaaagaugcggcugcacauccagcaccugucugcauaaagaguggccucacucccggaacuggcgcugcaaucccacaugguguuggggaguggggaccggcugcacguguugcgggcuugacguuaaggaccuguuuacagauuauauguucgugaaauggaaggucgaauacaucaaaaccgaggccauuguguguguggagcucaccucucaggaaagacaaugcagccugaucgaggcuggaacacgguuuaaccugggcccugucaccauuacacuuuccgaaccgcgcaauauccagcagaagcugcccccugagaucauuacgcuccaccccagaaucgaagagggguucuuugaccugaugcauguucaaaaggugcucucugccagcaccguguguaaacugcaguccugcacacacggagucccuggcgaucuucagguguaucauauuggcaaccugcugaagggggacaaaguuaacggacaccucgugcacaagaucgagccccauuucaauaccagcuggaugucuugggauggcugugaccuggauuacuauugcaacaugggggacuggccguccugcacauacaccggagucacgcagcacaaucaugcgagcuuugugaacaugcuuaauauugaaaccgauuacacaaagaacuuccacuuucauucuaagcggguuaccgcucacggcgacacaccucaacuggaucucaaggccagacccaccuauggggccggagagaucacagugcuggucgaaguggcugacauggagcuccacacgaaaaagaucgagauuuccggccugaaauucaccagccuuacauguaccggcugcuacgccuguucuagcgggaucuccugcaagguccgcauucauguggaugaacccgacgagcugaccguucacgugaaaucugaagacccugaugucguggcggcuagcuccagccugauggcccggaagcucgaguuuggaacagacuccacguucaaagccuuuucugcuaugcccaagaccagccuguguuucuauaucguugaaagagaguacugcaaguccuguucugaggaagauacacagaaaugcgugaauaccaaacuugagcagccucagagcauucugaucgaacgcaagggcacaauuaucgggaagcaaaacaauaccuguaaagccaaggcuggaugcuggcucgaguccgucaagucuuucuuuuauggccugaaaaacaugcucagcgggaucuucggaaauguguuuauuggcaucuuccuguuucuugccccguucauucugcugauccucuuuuucauguuuggcuggcggauucuguucuguuuuaagugcugcagacgcacgcgggggcuuuucaaauacagacaucugaaggacgaugaagagacaggauaucgcaaaaucaucgagcggcucaacaauaagaagggcaaaaacaagcugcucgacggggaaagacuggcggaucggcgcauugccgagcuuuucuccaccaaaacccacaucggauga

SEQ ID NO: 13646 - RNA, 5055 nt, Artificial Sequence
  derived and/or modified CDS sequence (opt5) from CCHFV(SPU103/87)__DQ211634.1__GP
augcacaucagccugauguacgccgugcucugccugcagcuuuguggccuugggggagcucauggcucccacaacgggaccagauauaauaacacaggagcccucacgacccugggcgacgggcaaucuagcgagcccccugucuccacagcgccgucuaccacacauaaucccagcaccguuacauccaccacgccugcuucuggaagcgaaggcuccggcgagguguacaccgccagccccgugacaaccgaagggcuuucuccucccggaacaaccccugagcugccggccacgacaggcauugauaccuccggggcuagcgacgccgaucccucuacacaggcugccggagacaccuccgcgcucaccguccggacaagccugccuucuucccccagcacgcugccuaccucccaggauacacaccaucccgugcgcaaccuccugucuguuaccagcccgagaccugaagagacaaccgcccccuccggcagcgggaucgagucuuccgcuacgagcucuccucaccccgccagcgaccggcccccuacaccgcccgcugccgcgcagggaccuaccgaauccaauucucacaacgccaccgagcaucuugaaagccugacacaauccgcuacccccgaucucgugacaagcccugcccagacgguccacccccagucugcuaccuccauugccgccccggacacacauccuagccccaccaaucgcucuaagagaaaccuggagguggagaucauucuuacacugucccagggccucaaaaaguauuacggcaaaauccugcggcugcuccaccugacccuugaagaggauacggaagggcugcucgaguggugcaagcgcaaucugggacuugacugugaugacaccuucuuucagaaaagaaucgaagaguucuuuauuacaggcgaggggcacuucaacgaaguucugcaauuucggaccccuggaacagugagcaccacggaguccacacaugcugggcccccuaccgcggaacccuucaagucuuauuuugccaagggguuccucagcaucgauuccggauacuauucugcuaaaugcuacagcggcacauccaauagcggccugcagcugauuaacaucacccgccacucuaccagaauugccgacacaccggggccuaagaucacgaaucucaaaaccauuaacuguaucaaucugaaggcccuuacauuuaaagagcaucgggaagucgagaucaacgugcugcucccccagguggcugucaaccuguccaauugccacguugugauuaagagccaugugugugacuacucucuugauaucgacggaaccguccgccugccccacauucaccaugagggcaucuucauuccugggacauauaagaucgugaucgauaaaaagaacaaacucaaugacagaugcacccuguuuacggauuguguuauuaagggacgggaagugcgcaaaggccaauccguccugaagcaguacaaaacagagaucagaauugggaaggccagcaccggcucucggagacuccugagcgaagaguccagcgacgauugcaucucucgcacccagcuucugcggacagaaaccgcggagauucacggagacaacuauggcgggccgggagauaagaucacaaucuguaauggcuccacgauuguggaccaaagacucgggagcgagcugggaugcuacaccaucaaccgcguuaaaacauucaagcugugcgaaaauuccgcuaccggcaaaucuugugagauugauagcgugcccgucaagugccggcagggguauugucuuaaaaucacacaggaaggcagaggacaugugaagcucucccgcggcucugaggucgugcuggacgccugcgacaccagcugugagguuaugauuccuaaggggacgggagauauccugguggacugcuccggcgggcagcaacacuuucucaaagauaaccugauugaccuuggaugucccaagaucccucugcucggcaaaauggccaucuacauuugccggaugucuaaucaccccaagaccacaauggcuuuccuguucugguuuagcuucggguaugucaucaccugugugcugugcaaagccaucuuuuaccuucucauuauuguuggcacacugggaaagagacugaagcaguaccgcgaacucaaaccucagaccuguacaaucugcgagaccacgcccgugaacgcuaucgaugccgaaaugcaugaccugaauugcuccuauaacauuuguccguacugcgcgagccggcuuacaucugauggccuggccagacacgucacccaguguccuaagcgcaaagagaagguggaagagaccgagcucuaucugaaucuggaacggauccccugggugguuagacggcuucuccaagucuccgagagcacagggguggcucugaaaagaucuuccuggcugauugugcuccugguccuuuucaccgugagccugucuccuguucaguccgcccccaucagccauggaaagacgguggaggcuuaccaggccagagaaggcuauacagggaugugccucuuuguccugggauccauucuguuccuugugagcugucucaugaagggccugguugacucuguggggaacaccuuuuucccgggccugagcaucugcaaaacauguuccaucucuagcauuaauggauuugaaaucgagucccaccggugcuacuguucucucuucugcuguccuuauugcagacauugcagcgcgaacaaggagauucaccagcugcaccuuuccaucuguaaaaagcgcaaaaccggcucuaacgucaugcuggccgugugcaagcggauguguuuuagagcuacaauggaaguuagcaaucgcgcccucuucauuagauccaucaucaacaccacguuugugcugugcauucugauccuugcugucuguguggugagcaccucugccgucgagauggaaucccugcccgccgggacaugggagcgggaagaggaucucaccaauuucugccaucaagagugucagguuacagacaccgaaugccuguguccuuacgaggcucucgugcugcgcagaccccuuuuccuggauaacauugugaaaggaaugaagaaucuccugaacagcacgucucuggaaacaucccuuagcaucgaggcgcccuggggcgccauuaauguccaguccaccuacaagccuacagugucuaccgcuaacaucgcccugagcugguccagcguugagcaccgggggaauaaaauucucgugucuggacgcuccgaaagcaucaugaagcuggaggaaagaaccggcaucucuugggaccucggcgucgaggaugccagcgaauccaaacugcuuacagugucuguuauggaccugagccagauguauuccccgguguuugaguaccucucuggggaccggcaagucgaggaauggcccaaggcuacgugcaccggagauuguccugagcgcugcggcugcacaagcuccaccugucugcauaaagaauggccccacagcagaaacuggcggugcaauccuacaugguguuggggcgugggaaccggcugcacguguugcgggcuggacguuaaggaucuuuucacagacuauauguuugugaaguggaaaauugaguacaucaagaccgaagccauugucuguguggagcugaccucucaggagcgccagugcucccucaucgaagcgggaacaagauucaaccugggccccgugaccauuacacucagcgagccucggaauauccaacagaaacugccguccgaaaucauuacgcuucaucccagaaucgaggaaggcuuuuucgaucugaugcacguccagaagguucugucugcuagcaccguguguaaacuccaguccugcacacacggggugccuggagaccugcaagucuaucauauuggcaaccuucugaagggggauaaggugaauggacaccucguucauaaaaucgagccccacuuuaacaccucuuggaugagcugggacggcugugaucuggacuacuauugcaacaugggggauuggccuuccugcacauacaccggagugacgcagcacaaucaugccagcuucgucaaccuccugaauauugagaccgacuacacaaagaacuuucacuuccauucuaaacgcgugaccgcccacggcgauacaccccagcuugaccugaaggcucggccgaccuauggcgccggggaaaucacaguucugguggaggucgcggacauggaacuccauacgaaaaagaucgagauuuccggacugaaguuuaccagccuuacauguaccggcugcuacgcuuguucuuccgggaucagcugcaaagugcgcauucacgucgaugagccugacgaacugaccgugcacguuaagucugaugaccccgauguggucgccgccagcuccucucucauggcucgcaaacuggaguucggaacagacagcacguuuaaggccuucuccgcuaugcccaaaaccagccucuguuucuauaucguggaacgggaguacugcaaguccuguucugaagaggauacacagaaaugcguuaauaccaagcuggagcaaccucagagcauucuuaucgaacauaagggcacaauuaucgggaaacagaacaauaccuguaaggccagagcgggaugcuggcuggaguccgugaaaucuuucuuuuauggccugaagaacaugcucagcggcaucuuugggaaugucuucauuggaaucuuucuguuccuugcccccuuuauucugcucauccuguucuuuauguucggcuggcgcauucucuuuuguuucaaaugcugccggagaacgcgcgggcuguucaaguaccggcaccuuaaggacgaugaagagacaggauauagaaaaaucaucgaacggcugaacaauaagaaaggcaagaacaaacugcucgacggggagcgccuggcugauagacggauugccgagcuguuuuccaccaagacccauaucggauga

SEQ ID NO: 13647 - RNA, 5055 nt, Artificial Sequence
  derived and/or modified CDS sequence (opt5) from CCHFV(Iran-53)__DQ446216.1__GP
augcacaucagccugauguacgccguguucugccuccagcuguguggccuugggaagaccaacggaccccauaauggcacagagcacaacaauacgcaugucaugaccacaccugacgauucccaaucuccggaacccccuguuagcaccgcucugcccgugacaccugaccccuccaccgugacaccuucuaccccggccagcgggcucgagggauccggcgaagucuauacgucuagccccauuaccacaaaagggcugucccuuccugaggcgaccagcgaacccccugcuacaaccucugugguuacguccagcgccucugauacagacuccagcacccaggccgcuggaggcacacccaccccgaccgugagaacaucucugccuuccagccccuccacgccuucuaccagccagggcacacacuaccccguccggucccuccugagcgugaccucucccaagccugaggagacaccgacccccuccaaaagcgggaaggauaaccuggccacaaauucuccucaucccgcuacgagccgcccuaccgcgcccccgaccacagcccagaaaccuaccgaaaacaauucccacaacacaacggagcaacucgaaucucugacccaccuugccacacugggaagcaugaucucccccacccagacaguucucccucagagcgugaccucuauugcuauccaggacauucauacgucccccaccaauagaagcaagcggaaccuggaugucgagaucauccuuacacugucucaaggccucaagaaauauuacgggaagauucugaaacugcuccaccugacccuugaggaagacacagagggacugcucgaauggugcaagcgcaaucugggccuugauugugacgauaccuuuuuccagaaaagaaucgaggaauuuuucauuacgggggagggacauuuuaacgaggugcugcaguuccggacacucggcacccuguccacaaccgaaagcacccacgccggcuccccuacaguggagcccuuuaagucuuauuucgcuaagggguuucugagcaucgacuccggauacuucucugccaaaugcuauagccgcacguccaauagcggccuccagcugauuaacgucaccagacacucuacacggaucgcggauaccccggggccuaagauuacaaaucuuaaaaccaucaacuguaucaaccugaaggccuccguuuuuaaagaacaucgcgagguggaaauuaaugugcuccugccccaagucgcugugaaccuuagcaauugccacguugccaucaagucucauauuugugacuacucccuggacacggauggagcuaucagacucccccagauucaccaugagggcacauucaucccugggaccuacaaaaucgugauugacaaaaagagcaagcugaacgaucggugcacccuguuuacaaauugugucaucaagggacgcgaggugagaaaaggccagucuguucuccggcaauauaagaccgaaauucgcaucggcagagccagcacagggucccggagacugcuuagcgaggaaucuggagacgauugcauuucccgcacgcagcugcuccggaccgagacagccgaagugcacggcgacaacuacgggggaccgggcgauaaaaucaccaucuguaaugggagcacagucguggaccagagacugggcuccgagcugggaugcuauaccauuaaccgcguccggucuuucaaacuuugcgagaauagcgcuacgggcaaguccugugaaaucgauucuauucccgugaagugcaagcagggguacugucucaaaaucacccaagagggaagaggccacguuaagcugagccgcggguccgaagugguccuggacgugugcgauucuagcugugagguuaugauuccuaaaggaacaggcgacauccucguggacugcuccgggggccagcagcauuuccugaaggauaaccuugucgaccugggaugucccaagauuccucuccugggcaaaauggcgaucuauaucugccggaugagcaaucaccccaagaccacaauggccuuucuguucugguuuucuuucggguacgugauuaccuguauccuuugcaaagcuaucuuuuuccuccugauuauuuuuggaacacugggcaagagauucaaacaguaucgcgagcucaagccucaaaccuguacgaucugcgaaacaacccccgugaacgccaucgaugccgagaugcaugaccugaauugcuccuacaacauuuguccguacugcgcuagccggcuuaccucugaugggcuggccagacacguuacacaguguccucgccggaaggaaaaagucgaggaaaccgagcucuaucugaaucuggagagaauccccuggguggugcggaaacuucuccaggucuccgaaagcacgggaacagugcugaagagaucuuccuggcugauuguucuccuggugcuuuuuaccgucagccuguccccugugcagagcgcgcccaucggccacgggaagacaauugagaccuaccgcguucgggaagaguauacaucuaucugccucuucgugcugggcagcauccuguuuauugucuccuuccuuaugaaaggacucguggacggcguugggaacaucuuuuucccgggacugucuguguguaagaccugcagcauuggcuccaucaacggguucgaaauugagucucauaaauguuacugcagccuguuuuguugcccuuauuguagacacugcuccgcugauggagagauccaucaacuccaccugucuaucugcaagaagcgcaaaacgggcagcaaugucaugcuugccguguguaagcggaugugcuucagagccaccauggaaguguccaacaaagcucuguuuauucgcagcaucauuaauacaaccuucgucguuuguauccucauucuggccgugugcguggucucuacauccgcuguggagauggaaagccugcccgccgggaccugggagagagaagaggaccuuacgaacuuuugucaucaggagugccagguuacagaaaccgagugucugugcccuuacgaagcgcucgugcugcggcgcccccucuuccuggauucuaucgucaagggcaugaaaaaucuucugaacuccacaagccucgagaccucccugucuauugaggcccccuggggagcuaucaaugugcagagcaccuauaagccuacaguuuccacggccaacaucgcucugagcuggucuuccguggaacacagaggcaauaagguccuugugagcgggcggucugagagcauuaugaaacuggaggaacgcaccggaaucuccugggaccucggcguugaagaugccucugagagcaagcugcucacaguguccgucauggaccugucucaaauguacagcccgguguuugaguaccuuuccggggauagacagguggaagaguggcccaaagcgaccuguacaggagacugcccugaacgguguggcugcaccagcucuacgugccugcacaaggaguggccccauucccgcaacuggagauguaauccuacauggugcuggggcgucgggaccggauguaccugcuguggccucgacguuaaagaucuguucacagacuauauguuugugaaguggaagguggaauacauuaaaaccgaggccaucgucugcguggagcugacaagccaggaacggcaauguucccuuauugaggcugggacgcgcuucaaccugggaucuguuaccaucacacucagcgaacccagaaauauccagcagaagcugccuccggagauuaucacccuccaccccaaaauugaagagggcuuuuucgaucugaugcaugugcagaagguccuuuccgccucuacagugugcaaacugcaaagcuguacccacgggguuccuggagaccuucagguguaucauaucggcaaccuccugaagggcgaucgggucaaugggcaccuuauucacaagaucgagcagcauuuuaacacguccuggaugagcugggacggaugcgaucuggacuacuauuguaacaugggcgauuggcccucuugcaccuacacaggggugacccagcacaaucaugcuuccuucgucaaccuccugaauaucgaaacagacuauaccaaaacauuccacuuucacagcaagagagugacggcccauggagauaccccucaacucgaccugaaagcccgccccacauacggcgcuggggagguuaccgugcuugucgaaguggcggauauggagcugcacaccaagaaaauugagaucucuggacugaaguucgccggccucacaugcacgggcuguuacgcuugcuccagcgggauuucuuguaaaguucggauccauguggacgaaccggacgagcugaccguccacguuaagagcgaugacccugaugugguggccgccuccucuagccuuauggcuagaaagcuggaauuuggaacagacuccaccuucaaagccuuuagcgcgaugcccaagacaucccucugcuucuauauugucgagcgcgaauacuguaaaucuugcagcaaggaggauacccagaaaugugugaacacgaagcuggagcagccccaguccauccucauugaacauaagggcacaaucaucgggaaacaaaauaauaccugcaccgcuaaggccucuuguuggcuggagagcgugaaauccuuuuucuauggacuuaagaacaugcugggcgggauuuuuggaaacgucuucaucggcauuuuuacauuccugaccccuuucauccuccugauucuguuuuucauguuuggcuggcggauccuguucugcuuuaaauguugcagacgcacacggggacucuucaaguacagacaccugaaggacgaugaagagaccggguaucgcaaaaucauugaacggcucaauaacaagaaaggcaagaauagacugcuugacggggagcggcuggccgaucgcaaaaucgcugagcuguuuucuacgaagacacacauuggauga

SEQ ID NO: 13648 - RNA, 5055 nt, Artificial Sequence
  derived and/or modified CDS sequence (opt5) from CCHFV(Iran-52)__DQ446215.1__GP
augcacaucagccugauguacgccguguucugccuccagcuguguggccuugggaagaccaacggaccccauaauggcacagagcacaacaauacgcaugucaugaccacaccugacgauucccaaucuccggaacccccuguuagcaccgcucugcccgugacaccugaccccuccaccgugacaccuucuaccccggccagcgggcucgagggauccggcgaagucuauacgucuagccccauuaccacaaaagggcugucccuuccugaggcgaccagcgaacccccugcuacaaccucugugguuacguccagcgccucugauacagacuccagcacccaggccgcuggagauacacccaccccgaccgugagaacaucucugccuuccagccccuccacgccuucuaccagccagggcacacacuaccccguccggucccuccugagcgugaccucucccaagccugaggagacaccgacccccuccaaaagcggcaaggacgaucuggccacgaacucuccucaucccgcuacaagccgcccuaccacacccccgaccaccgcccagaaaccuacagaaaauaacucccacaauacgaccgagcaacucgaaucucugacacaccuugcgacccuggggcucaugaucagccccacacagaccguucugccucaguccgugacgagcauugccauccaggacauucauaacucucccaccaauagauccaagcggaaccuugauauggagaucauccugacacucagccaaggacugaagaaauauuacggcaagauucugaaacuccugcaccuuacccuggaggaagacacagaggggcuccuggaauggugcaagcgcaaucuuggacuggauugugacgauaccuuuuuccagaaaagaaucgaggaauuuuucauuacgggcgaggggcauuuuaacgagguccuccaguuccggacacugggaacccugucuacaaccgaauccacccacgcuggcagcccuacaguggagcccuuuaaguccuauuucgccaagggcuuucucucuaucgacagcggguacuucuccgcuaaaugcuauucucgcacgagcaauuccggacugcagcuuauuaacgugaccagacacagcacacggaucgccgacaccccgggcccuaagauuacaaaucugaaaaccaucaacuguaugaaccucaaggcgucugucuuuaaagaacaucgcgagguugaaaucaaugugcugcuuccccaaguggccgucaaccuguccaauugccacguggcuauuaagagccauaucugugauuacucucucgacacggauggggccauuagacugccccagauccaccaugagggaacauucauuccuggcaccuacaaaaucguuaucgacaagaaguccaaacugaacgaucggugcacccucuuuacaaauugugugauuaaggggcgcgaggucagaaaaggacagagcgugcugcggcaauauaagaccgaaauccgcauuggcagagcuucuacaggcagccggagacuucuguccgaggaaagcggggacgauugcaucucucgcacgcagcuccugcggaccgagacagccgaaguucacggagacaacuacggcgggccgggagauaaaauuaccaucuguaauggcuccacaguggucgaccagagacuggggagcgagcuuggcugcuauaccaucaaccgcgugcgguccuucaagcucugcgaaaauucugccacgggaaagagcugugaaauugauuccauccccgucaaaugcaagcagggcuacugucugaaaauuacccaagaggggagaggacacgugaagcugucucgcggcagcgaaguugugcucgacgucugcgacuccucuugugaggugaugaucccuaaagggacaggagauauucugguugacugcagcggcgggcagcagcauuuccuuaaggauaaccugguggaccucggcugucccaagaucccucugcugggaaaaauggcuauuuauaucugccggauguccaaucaccccaagaccacaauggcguuucuuuucugguuuagcuucggcuacgucaucaccuguauucucugcaaagccaucuuuuuccugcugauuaucuuugggacacucggaaagagauucaaacaguaucgcgagcugaagccucaaaccuguacgauuugcgaaacaacccccgugaacgcuaucgaugccgagaugcaugaccuuaauugcucuuacaacaucuguccguacugcgccucccggcugaccagcgauggccucgcuagacacgugacacaguguccucgccggaaggaaaaaguugaggaaaccgagcuguaucugaaucuugagcggauucccugggucgugagaaagcuccuccaggugucugaauccacggggacaguccugaaacgcagcucuuggcugaucgugcugcuuguucuguuuaccgugucccucagcccuguccaguccgcccccauuggacacggcaagacaaucgagaccuacagagugcgggaagaguauacaagcauuugccuguucguucuggggucuauccuuuuuaucgugagcuuccucaugaaaggccuggucgacggagugggcaacaucuuuuucccggggcuguccguuuguaagaccugcucuauuggaagcauuaacggcuucgaaaucgagucccauaaauguuacugcucucucuuuuguugcccuuauuguagacacugcagcgcggauggggagauucaucaacugcaccuuuccaucugcaagaagcgcaaaacgggaucuaaugugaugcuggcugucuguaagcggaugugcuucagagccaccauggaagugagcaacaaagcccucuuuauccgcuccauuaucaauacaaccuucguggucuguauucugauccuggcuguuugcguggugagcacaucugccgucgagauggaaucccuucccgcuggcaccugggagagagaagaggaccugacgaacuuuugucaucaggagugccaggugacagaaaccgagugucucugcccuuacgaagcccugguucuccggcgcccccuguuccuugauagcauugugaaggggaugaaaaaucugcucaacucuacaucccuggagaccagccuguccaucgaggcgcccuggggcgccauuaauguccagucuaccuauaagccuacagugagcacggcuaacaucgcccuuuccuggagcucuguugaacacagaggaaauaaggugcuggucuccggccggagcgagucuaucaugaaacucgaggagcgcaccgggauuagcugggaccugggaguggaagaugcuuccgagucuaagcuccugacaguuagcgugauggaccuuucccaaauguacucuccggucuuugaguaccugagcggcgacagacagguggaagaguggcccaaagccaccuguacaggggauugcccugaacgguguggaugcaccuccagcacgugccuccacaaggaguggccccauucucgcaacuggagauguaauccuacauggugcuggggcgugggcaccggguguaccugcuguggacuggacgucaaagaucuguucacagacuauauguuuguuaaguggaagguggaauacaucaaaaccgaggcgauugugugcgucgagcuuacaucccaggaacggcaauguagccugaucgaggccggcacgcgcuucaaccucggguccgugaccauuacacugucugaacccagaaauauccagcagaagcucccuccggagaucauuacccugcaccccaaaaucgaagagggauuuuucgaucuuaugcauguucagaaggugcugagcgcuuccacagucugcaaacugcaaucuuguacccacggcgugccuggggaccuccagguuuaucauauuggaaaccugcuuaagggcgaucgggugaauggccaccugauccacaagauugagcagcauuuuaacacgagcuggauguccugggacgggugcgaucucgacuacuauuguaacaugggagauuggcccagcugcaccuacacaggcgucacccagcacaaucaugccucuuucgugaaccugcucaauaucgaaacagacuauaccaaaacauuccacuuucacuccaagagagucacggcucauggggauaccccucaacuggaccuuaaagcccgccccacauacggagccggcgagaucaccgugcugguugaaguggcugacauggagcugcacaccaagaaaauugagaucagcgggcucaaguucgcgggacugacaugcacgggcuguuacgccuguucuuccggcauuagcugcaaaguccggauccauguggaggaaccggaugaacuuaccguucacgugaagucugacgauccugacgucguggcugccagcuccucucugauggccagaaagcucgaguuugggacagauagcaccuucaaggcuuuuuccgccaugcccaaaacaagccugugcuucuauauuguggaacgcgaguacuguaaauccugcucuaaggaggacacccagaaauguguuaacacgaagcucgaacagccccagagcauccugauugagcauaagggaacaaucaucggcaaacaaaauaauaccugcaccgcgaaggcuuccuguuggcuugaaucugucaagagcuuuuucuaugggcugaaaaacaugcugggaggcauuuuugggaacguguucaucggaauuuuuacauuccucaccccuuucauccugcuuauucuguuuuucauguuuggcuggcggauccucuucugcuuuaaauguugcagacgcacacggggccuguucaaguacagacaccucaaggaugacgaggaaaccggguaucgcaaaaucauugagcggcugaauaacaagaaaggaaagaauagacuucuggauggcgagcggcuggccgaccgcaaaaucgccgaacucuuuuccacgaagacacacauuggguga

SEQ ID NO: 13649 - RNA, 5055 nt, Artificial Sequence
  derived and/or modified CDS sequence (opt5) from CCHFV(75024)__AB069671.1__GP
augcacaucagccugaugugcgccgugcucugucugcagcuuuacggccugggggagacccauggauccucuaacgaaacagagcacaauaagacgaacgucguuaccacacccggcgacagccaauccccugaaccgcucgugucuaccacacugcccgugacccuugauagcuccacagucaccccuacgacccccgcuucugggccugagggaagcggcgaaguguauacauccccucccauuaccacagaggggcugagcccgucugaggccaccuccgaacuccccgcgacgacaggaaucggcauuagcucugcuuccgacguugauagcucuacccaggccgccggcgacacauccaccccuaccgugagaacaagcccucccaauuccucuagcacgcccccgaccucccaggauacacaucacccuaugcggaaccugcugagcgucaccucucucaaacccgaggaaacauccgcuccuagcaagucugggaaagagagccccgccgcuuccucuccccauccuguggccagccgcccgcccaccccucccacgacagcgcagggaccuaucgagaauaacucccacaauaccaccggccaacuggaaagcguuacacagucugccacccuugggcccauggcuuccccgacacagacggugcugagccagaacgucaccucuauugccauccaagacacacacccuucccccaccaauagaagcaagcggaaccucgagauggaaaucauucugacacuuccucagggacugaaaaaguacuauggcaaggugcuccgccugcugcagcucacccuggaggaagauacggaggggcuucuggaguggugcaaaagaaaucucggacuggacugugaugacaccuucuuucagaagcggaucgaagaguucuuuauuacaggcgaaggccauuucaacgaggugcuucaauuucgcacccccgggacacuguccaccacggaaucuacacacgcugagagcccuaccgccgagcccuucaaauccuacuuugcgaagggauuccucucuaucgauagcggcuauuuuuccgccaaaugcuacagcagaacaucuaauuccgggcugcagcugauuaacgucacccggcauagcacccgcaucgcugacacaccgggaccuaagauuacgaaucucaagaccaucucuuguaucaaccugaaagccuccguuuucaaggaacacagagagguggaaauuaacgugcuucugccccaggucgcugugaaucucagcaacugccacguuacaaucaaaucucaugugugugauuauagccuggacauugacggcaccguccggcuuccccacauccaucacgaggggacauuuauuccuggaaccuacaagaucgugaucgauaaaaagaauaaacugaacgaccgcugcacccucuucacaaauuguguuauuaagggcagagaagugcggaagggccaauccguccugcgccaguacaaaaccgagaucagaauugggaaggccagcaccggaucucggagacugcucuccgaggaaagcggcgaugacugcaucucccgcacacagcugcuucggaccgagacagccgaaauucauggggauaacuauggaggcccgggggacaaaaucacgaucuguaauggcucuaccauuguggaucagagacugggaagcgagaugggcugcuacacaaucaaccgcgucaaguccuuuaaacucugcgaaaauucugcuaccggaaagagcugugaaauugacuccauccccgugaagugccggcaaggguauugucugaaaauuacacaggagggcagagggcacguuaagcugucucgcggaagcgaagugguccuugaugcgugcgacuccagcugugaggugaugaucccuaaaggcaccggggauauucucguugacugcucuggcggacagcagcacuuccugaaggacaaccugaucgaucucggcugucccuccaucccucugcuugggaaaauggccauuuacaucugccggaugagcaaucaucccaagacgaccauggcuuuccuguuuugguucucuuuuggauaugugauuacauguauccucugcaaggccauuuucuaccugcugaucaucgucggcacccuugggaaaagauuuaagcaauaucgcgaacucaaaccucagacauguaccauuugcgagacaacccccgccaacgcuaucgacgccgagaugcacgaucugaauugcuccuacaacauuuguccguacugcgcgagccggcugacgucugacggacucgcuagacaugugacacaguguccuaagcgcaaagaaaagguggaggaaaccgagcuguaucuuaaucuggaacggauccccuggguugucagaaagcuccuucagguguccgagagcaccggcguggcccugaaacgguccagcuggcuuauuguccuccuggugcuguucgccaucucucucagcccuguucaauccgcucccaucgggcacggcaagacaauugagaccuaccaggcccgcgaagaguauacgucuaucugccuguuugugcuuggaagcauucuguucaucgucuccugucucaugaaaggccugguggauucuauugggaacaucuuuuucccgggacugagcaucugcaagacauguuccauuggcucuaucaacggguuugaaauugagagccacaaaugcuacuguucccuucucugcuguccuuauugcagacauugcagcgcugaccgggaaauccaccagcugcaucugucuauuuguaagaaaagaaagaccggauccaauguuaugcucgccgugugcaagcgcauguguuuccgggcgacaauggaggucagcaacaaagcccugcuuaucagaucuauuaucaauaccacauuugugguuugcauccugauucucgcugugugugucguguccaccagcgccguggagauggaaucccugcccgcuggcacgugggagcgcgaagaggaucugaccaacuucugccaccaggagugucaagucacagaaaccgagugccuuuguccuuacgaagcccugguucucagacggccccuguuccucgacucuaucgugcgcgggaugaagaaucagcugaacagcacaucccuugagaccagccugucuauugaagcgcccuggggcgccaucaaugugcaguccacguauaaaccuacagucagcaccgcuaacauugcccucucuuggagcuccguggagcauagaggaaauaagauccugguuucuggccggagcgaguccaucaugaaacuggaggagcgcacagggauuucuugggaucuuggaguggaagacgcuagcgaguccaagcugcucaccgucagcgugauggaucugucucaaauguacuccccgguuuuugaauaccucagcggcgacagacagguggaggaguggcccaaggcuaccugcacaggggauuguccugaacggugcggaugcacgaccuccacaugucugcacaaagaguggccccacucucgcaacuggagaugcaauccuaccugguguuggggcgucggcacagggugcaccuguugcggacuugacgugaaggaccuguucacggauuauaugaucguuaaauggaagguggaauacauuaaaacagaggccaucgucuguguggaacucaccagccaggagcggcagugcucccugauugaggcuggcacccgcuuuaaccuggggucugugacaaucacccuuagcgaacccagaaauauccaacagaagcugccuccggagauuaucacacuccauccccggauugaagagggauucuuugaccugaugcacguccagaagguucucuccgcgagcacgguguguaaacugcagucuugcacccauggcgugccuggggaucuucaagucuaucacgugggaaaccugcugaagggcgacaaaguuaauggccaucucauccacaagauugagccccaccugaacacauccuggaugagcugggaugggugugaccuugauuacuauugcaacaugggagacuggccuucuugcaccuacacaggcgugacccagcauaaucacgccuccuucgucaaccugcucaauaucgaaacggauuauaccaagagcuuucauuuccacucuaaaagagugacagcucacggggacacgccccagcuggaucucaaggcccgcccgacauacggagccggcgagauuaccguucugguggaagucgcugacauggaguuuacaccuaaaaagaucgaaaucagcgggcuuaaauucgccucccugacguguaccggaugcuacgcguguucuagcggcauuuccugcaaggugcggauccaugucgaugagcccgacgagcugacagugcacguuaaaagcgacgaucccgacguggucgcugccuccucuagccucauggccagaaagcuggaauuuggcaccgauuccaccuucaaagccuuuucugccaugccuaagacaagccuuuguuucuauauuguggagcgcgaauacugcaaguccuguucuaaagaggacacgcagaagugcguuaacaccaaacuggaacaaccccagagcauccucauugagcauaaggggacaaucaucggaaaacagaauaacaccuguacagcgaaggcuuccugcuggcuggagagcgugaagucuuucuuuuauggccucaaaaauaugcuguccgggauuuucggaaaccuuuuuaugggcaucuuccuguuucuggccccuuucauucuccugauccuguuuuucauguuuggguggcggauucuguucuguuuuaagugcugcagacgcacccggggacucuucaaauacagacaccugaaggaugacgaagagacgggcuaucgccggaucaucgaaagacucaauaacaaaaagggcaagaauaaacugcuugauggggagcggcuggccgaccgcagaauugcugaacuguucagcacaaagacccauaucggauga

SEQ ID NO: 13650 - RNA, 5055 nt, Artificial Sequence
  derived and/or modified CDS sequence (opt5) from CCHFV(7803)__AB069672.1__GP
augcacaucagccugaugugcgccgugcucugucugcagcuuuacggccugggggagacccauggauccucuaacgaaacagagcacaauaagacgaacgucguuaccacacccggcgacagccaauccccugaaccgcucgugucuaccacacugcccgugacccuugauagcuccacagucaccccuacgacccccgcuucugagccugaagggagcggagagguguauacauccccucccauuaccacagagggccugagcccgucugaagccaccuccgagcuccccguuacgacagggaucggaauuagcucugcguccgacguggauagcucuacccaggcugccggcgacacauccaccccuaccgucagaacaagcccucccaauucccccucuacgccgccuaccagccaggauacacaucaccccaugcggaaccugcuguccgugaccagccucaaaucugaagagacauccgccccuagcaagucuggcaaagagagccccgcugccuccucuccccauccuguugcuagccgcccgcccacccacccuaucacggcccaggggcccacagaaaauaacucccacaauaccaccggacaacuggagagcgugacacagucugcgacccuuggcccuauggccucccccacacagacgguccugagccagaacgugaccucuauugcuauccaagacacacauccguccccuaccaauagaagcaagcggaaccucgaaauggagaucauucugacacuuccccaggggcugaaaaaguacuauggaaaggugcuccgccugcugcagcucacccuggaagaggauacggagggccuucuggaauggugcaaaagaaaucucgggcuggacugugaugacaccuucuuucagaagcggaucgaggaguucuuuauuacaggagaaggccacuucaacgaaguccuucaauuucgcaccccuggcacacuguccaccacggagucuacacaugccgagagccccaccgcugaaccuuucaaauccuacuuugccaagggguuccucucuaucgauagcggauauuuuuccgcgaaaugcuacagcagaacaucugacuccggccugcagcugauuaauguuacccggcacagcacccgcaucgccgauacacccgggccgaagauuacgaaccucaagaccaucucuuguaucaaucugaaggcuuccguguucaaagagcacagagaaguggagauuaacguccuucugccucagguggccguuaaccucagcaauugccaugugacaaucaaaucucacgucugugacuauagccuggacauugauggaaccgugcggcuuccccauauccaccaugaaggcacauuuauucccgggaccuacaagaucguuaucgacaaaaagaacaaacugaaugaucgcugcacccucuucacaaacugugugauuaagggaagagagguccggaagggccaauccgugcugcgccaguacaaaaccgagaucagaauuggcaaggcuagcaccgggucucggagacugcucuccgaagagagcggagacgauugcaucucccgcacacagcugcuucggaccgaaacagccgagauucacggcgacaauuaugggggaccuggcgauaaaaucacgaucuguaacgggucuaccauugucgaccagagacugggcagcgagaugggaugcuacacaaucaaucgcgugaaguccuuuaaacucugcgaaaacucugccaccggcaagagcugugagauugauuccaucccgguuaagugccggcaaggguauugucugaaaauuacacaggaaggaagaggccacgugaagcugucucgcgggagcgaggucauccuugacgcuugcgauuccagcugugaagugaugauucccaaaggaaccggcgacauccucguugacugcucugggggccagcagcauuuccugaaggauaaucugaucgaccucggauguccuuccauuccccugcuuggcaaaauggcgaucuacauuugccggaugagcaaccacccuaagacgaccauggccuuccuguuuugguucucuuuuggguaugugaucacauguauucucugcaaggcuaucuucuaccugcugaucauugucggaacccuuggcaaaagauuuaagcaauaucgcgagcucaaaccccagacauguaccaucugcgagacaaccccugccaaugccauugaugcugaaaugcaugaccugaacugcuccuacaauaucugucccuacugcgccagccggcugacgucugaugggcucgcgagacacgugacacaguguccgaagcgcaaagagaagguggaagagaccgaacuguaucuuaaccuggagcggauuccuuggguugucagaaagcuccuucagguguccgagagcaccggaguggcucugaaacgguccagcuggcuuaucguccuccuggugcuguucgccaucucucucagccccguucaauccgccccuauuucucacggcaagacaaucgaaaccuaccaggcucgcgaggaauauacgagcauuugccuguuugugcuuggguccauccuguucauugucucuugucucaugaaaggccugguggacagcaucggaaauaucuuuuuccccggccuguccauuugcaagacauguucuaucgggagcauuaacggauuugagaucgaaucccauaaaugcuacuguagccuucucugcuguccguauugcagacacugcucugccgaucgggagauucaucagcugcaccuguccaucuguaagaaaagaaagaccggcagcaacguuaugcucgcugccugcaagcgcauguguuuccgggcgacaauggaggugucuaauaaagcccugcuuauuagauccaucaucaacaccacauuugucguguacauucugauccucgcuguuugcguggucagcaccuccgccguggaaauggagucucugccugcugggacgugggaacgcgaggaggaccugaccaauuucugucaucaggaaugccaagugacagagaccgaaugucuuugccccuaugaggcccugguccucagacggccucuguuccucgauagcauuguucgcggaaugaagaacccccuuaauuccacaagccuggaaaccucucuguccaucgaggcgcccuggggcgccauuaacgugcagagcacguacaaaccuacagugucuaccgcuaauaucgcccucagcugguccucugucgagcacagagggaacaagauccuggugagcggccgguccgaaucuauuaugaaacuggaggaacgcacaggaaucagcugggaccuuggcguugaggaugcuuccgaaagcaagcugcucaccgugucugucauggaccugucccagauguacagcccgguguuugaguaucucuccggggauagacaaguugaggaauggcccaaggccaccuguacaggagacugcccugagcgguguggcugcacgaccucuacaugccugcacaaagaauggccccauagccgcaauuggagauguaacccuaccuggugcuggggaguggggacaggcuguaccugcuguggccuugacgucaaggaucuguucacggacuacaugauugugaaauggaagguugaguauaucaaaacacgggggauugugugcgucgaacucaccucccaggagcgccaguguucucugaucgaggccggaaccagauuuaaucugggcagcgugacaaucacccuuuccgaaccccggaacauucagcaaaagcugccuccggagaucauuacacuccaccccagaaucgaagagggguucuuugaucugaugcaugugcagaagguccucagcgcuucuacgguuugcaaacugcaguccuguacccacggagugccuggcgaccuucagguguaccaugucgggaaucugcugaagggagauaaagugaacggccaccucauucacaagaucgagccccaucugaauacaagcuggaugucuugggacggcugcgaucuugacuauuacuguaacaugggggauuggccuuccugcaccuauacaggaguuacccaacacaaccaugcgagcuucgugaaucugcucaacauugaaacggacuacaccaaaucuuuucacuuccacagcaagcgcgucacagcccauggcgauacgccccagcuggaccucaaggcucggccgacauacggggccggagagaucaccgugcugguugaaguggccgauauggaguuuacaccuaaaaagaucgaaauuuccggccuuaaauucgcuucucugacgugcaccggguguuaugccugcagcuccggaaucagcuguaagguccgcauucacguggacgagcccgacgagcugacaguccaugugaaauccgaugaccccgauguuguggcggcuucuagcucccucauggccagaaagcuggaauuuggcaccgacucuaccuucaaagccuuuagcgcuaugccuaagacaucccuuugcuucuacaucgucgagcgggaauauuguaagucuugcagcaaagaggauacgcagaagugugugaauaccaaacuggaacagccccaauccauucucaucgagcacaagggcacaaucauugggaaacagaacaauaccugcacagccaaggcgagcuguuggcuggagucuguuaaguccuucuuuuacggacucaaaaacaugcugagcggcaucuucgggaacuuuuucaugggaauuuuucuuuuccuggcuccuuuuauccugcucauucuguucuuuauguucggcuggagaauccuguuuugcuucaaguguugccgccggaccagagggcuguucaaauaucgccaucucaaggacgaugaagagacgggauaccggagaaucauugaacggcugaauaauaaaaagggcaagaacaaacuccuggacggcgagcgccuugccgauagacggaucgccgaacuguuuucuacaaagacccacauuggguga

SEQ ID NO: 13651 - RNA, 5055 nt, Artificial Sequence
  derived and/or modified CDS sequence (opt5) from CCHFV(Hodzha)__AY223476.1__GP
augcacauccugcucaugugcgccgugcugugucuucagcaauacggccugggggagacccauagacccaacaauggaacagagcacaacaagacgaauguccucaccacaccuggcgacaaacugagcccggagcuucccguuuccaccgcucugucugugacaccugauagcuccaccgugacacccaccacgccugucucugggcucgaaggaagcggcgacguguauaccagcccucccguuacaaccaaggggcugucuccgagcaaagccacauccgagcugcccgcgagcucuggaauugauaccuccagcgcuucugacguggauuccagcacgcaggccgcccgggacacaucuacccucacaguccgcaccuccccucccagcuccccuucuacacccccgacaagccaggauacguaccaucuggugagaaaccuucuguccguuaccagcccuuggcccgaagagacaaccgcuccuucuaaguccggcaaagagagccccguggccaauucuccccacccugucacaagccggccguccucucccccuaucaccgugcagggccccacggaaaacagcucccauaauacaaccgggcaacucgagagcauggcucagucuaccacacuggugccuauggccucccccacccagacaguccuuagccagucuguuacgucccuggcggugcaagacgcccacccgagcccuaccaaccgcuccaagagaaaucucgaaauggugauuauccugacacugccccagggacucaagaaauauuacggcaagguccugcggcuucugcagcucacccuggaggaggauacagaagggcuucuggaguggugcaaacgcaaccucggacuggacugugaugacaccuucuuucagaagagaauugaagaguucuuuaucacgggcgaagggcacuucaaugaggugcugcaauuuaaaaccccuucuacacucagcaccacagaguccacccaugcuguuucucccacggccgaaccuuucaagagcuauuuugcuaagggauuccuguccaucgauagcggcuacuuuucugccaaaugcuauuccaagacaagcaacucuggccuucagcugauuaaugugacccggcacuccacacgcaucgcggacacccccgggccgaaaauuaccaaccucaagacaaucagcuguauuaaucugaaagccucugucuucaaggagcauagagaaguggagaucaacguucuucugccucagguggcugucaaccucagcaauugccacgugacgauuaaaucccacgucugugacuacagccuggauguggacggaaccguucggcugccccauauccaccauggcgggacauuuauccccggaaccuacaagauugugaucgauaagaaaaacaagcucaaugaccgcugcacacuguauaccaacugugucauuaaaggcagagaagugcggaaggggcaaucuauccuucgccaguacaaaacggagauuagaaucggaaaggccuccacaggcagccggagacugcucuccgaggaaucuggcgaugacugcaucagccgcacccagcugcugcggaccgagacagcugaaauucacggggaugacuauggaggcccuggggauaagaucaccauuuguaauggauccacaaucguugaccagagacuuggcucugagcucgggugcuacacgauuaaccgcgugaaauccuucaagcugugcaaaaauuccgccaccggcaagucuugugaaaucgauagcacaccggucaaaugccggcaaggauauugucugaagaucacccaggagggcagagggcaugugaagcucucccgcggaagcgaggugguucuggacgccugcgacucuuccugugaagucaugauucccaaaggcacaggggauauccuuguggacugcagcggaggccagcagcacuuucugaaggauaaccucauugaccugggguguccucggaucccccugcuuggcaaaauggcuauuuacaucugcagaaugucuaaucacccuaagaccacgauggcguuccucuucugguuuuccuucggauaugugauuaccuguauccugugcaaagccaucuuuuaccugcucauuaucgucggcacacuggggaagcgcuucaagcaauaccgggagcuuaaaccccagaccuguacaauuugcgaaaccaccccugcuaacgccaucgaugccgagaugcaugaccugaauugcagcuauaacauuugucccuacugcgcuucuagacucaccuccgauggacuggcccgccacgugacgcaguguccgaagcggaaagagaagguugaagagacagaacuguaucuuaaucucgagagaaucccuuggaucgugcggaaacugcugcaggucagcgaauccaccggcguggcgcucaagcgcagcucuuggcugauuguucuucuggugcucuuugcugucagccugucccccgugcaaucugccccuaucgggcauggaaaaaccauugagacauaccaggccagagaggacuauaccagcaucugccuguucguucuuggcuccauucucuuuaucgugucuugucugaugaaggggcuggucgauagcaucggcaacauuuucuuucccggacucacgaucugcaagacauguuccauuggcucuaucaauggguucgaaauugagagccacaaaugcuacuguucccugcuuugcuguccguauugccggcacugcagcgcugacagagaaauccaucagcugcaccucucuaucuguaagaaacgcaagaccggauccaacgugaugcuggccgugugcaaacggauguguuuuagagcuacaauggaggucagcaacaaggcccugcuuauucgcucuaucauuaauaccacauucguugugugcauccugauucucgcggugugugucguguccaccagcgccguugaaauggagucccugccugcuggcacgugggagagagaagaggaucucaccaacuuuugccaucaggaaugucaagugacagagaccgaaugccugugucccuacgaggcccuuguccugcggcgcccucucuuccuggacucuaucgugaaggggacaaagaaucugcuuaacagcaccucccuggagacgagccucucuauugaagcucccuggggagccaucaauguucaguccacauacaagcccaccgugagcacagcgaacaucgcccugucuuggagcuccgucgagcacagaggcaauaaaauucucgugucugggcggagcgaauccaucaugaagcuggaggagcgcaccggcauuucuugggaucuuggaguugaagacgcuagcgaguccaaacugcucaccgugagcgucauggaccugucucagauguauuccccuguguucgaauaccugagcggcgauagacaaguggaggaauggccgaaggccacaugcacgggggacugucccgagcggugcggaugcaccuccucuacaugucuucauaaggaguggccucacagccgcaacuggagaugcaaucccaccugguguuggggcgucgggacaggaugcaccuguugcggccuggauguuaaagaccucuuuacggauuauauguucgugaaguggaaaguggacuacaucaagacagaagcuauugucuguguggagcugaccucccaggaacggcagugcucucucguugaggccggcacccgcuuuaaccuggggccugugacaaucacccuuagcgaacccagaaauauccagcaaaaacugccuccggagauuaucacacugcacccccggauugaggaaggauucuuugaucucaugcauguccagaaggugcuguccgccagcacgguuuguaaacuucagucuugcacccacggcgugccuggggaccugcaggucuaucauaucggaaaccuccugaaaggcgauaaggugaaugggcaccucauucauaaaaucgagccccacuucaacacauccuggaugagcugggacggaugugaucuggacuacuauugcaauaugggcgauuggccuucuugcaccuacacaggcgucacccaacacaaccaugcuuccuuugugaaccuucugaauaucgaaacggacuacaccaagagcuuccacuuucauucuaaaagaguuacagcgcacggggacacaccccagcuggaucucaaggcccgcccgacauauggagcuggcgagauuaccgugcuggucgaaguggccgacauggagcuucacaccaaaaagaucgagauuacggggcugaaguucgccagccucaccuguacaggaugcuacgcuuguuccucuggcaucagcugcaaaguucggauucauguggaugaaccugacgagcugaccguccacgugaaguccgaugaccccgaugugguugccgcgagcuccucucucauggcuagaaaacuggaauuugggaccgacagcacauucaaggccuuuuccgccaugcccaaaacgucucuuuguuucuauaucgucgagcgcgaguacugcaagagcuguuccaaggaagauacccagaaaugcgugaacacaaagcuggagcagccucaaucuauucugaucgaacggaaaggaaccaucauuggcaagcagaauaacacauguaccgcuaaagccagcugcuggcucgaguccgucaagagcuucuuuuauggccugaagaauaugcuuucugggaucuucggaaacguguuugugggcauuuuccuguuucucgcgcccuucauccugcucauucuguuuuucauguuuggguggagaauccuuuucuguuuuaaaugcugccgccggacgagaggacuguucaaguacaaacaucugaaggacgaugaagagacaggcuaucgccggaucauugagagacucaauaacaaaaaggggaagaauaaacugcuugacggagaacggcuggcugaccgcagaaucgccgaacucuucuccaccaagacccacauuggcuga

SEQ ID NO: 13652 - RNA, 5055 nt, Artificial Sequence
  derived and/or modified CDS sequence (opt5) from CCHFV(Hodzha)__KX013448.1__GP
augcacauccugcucaugugcgccgugcugugucuucagcaauacggccugggggagacccauagacccaacaauggaacagaacacaacaagacgaauguccucaccacaccuagcgacaaacuguccccggagcccccuguuucuaccgcucuuagcgugacacccgauuccucuaccgugacaccuaccacgcccgucagcggccuggaaggguccggagagguguauaccucuccuccgguuacaaccaagggccucagccccuccaaagccacaagcgaacugccugcgaccacggggauugacacaucuuccgcuagcgauguggacucuuccacccaggccgcccgggauacaagcacccugaccguccgcacaucucccccuuccagccccuccacgccgccuaccucucaggacacauaccaucucgugagaaaccugcuuagcguuaccucccccagaccugaggagacaaccgcucccagcaagucuggaaaagaaucccccguggccaauagcccucacccggucacgucucgccccagcuccccucccaucacagugcagggcccuaccgagaacucuagccauaauaccacaggccaacuggaauccauggcucagagcaccacacucgugcccauggccucuccgacgcagaccguccugucccagagcguuacaucucuugcggugcaagaugcccacccuucccccaccaacagaagcaagcggaaucuggagauggagauuauccucacacugccucaggggcugaagaaauauuacggaaaggugcuccgccugcuucagcugacccucgaagaggacacggaaggccugcuugaguggugcaaaagaaaccuggggcucgauugugacgauaccuucuuucagaagcggauugaagaguucuuuaucacaggagagggccacuucaaugaaguccugcaauuuaaaacccccuccacacugucuaccacggagagcacacaugcuguguccccuaccgccgaacccuucaagucuuauuuugcuaagggguuccucagcaucgacuccggauacuuuagcgccaaaugcuauucuaagacauccaacagcggccugcagcuuauuaauguuacccgccacucuaccagaaucgcggauacaccgggcccuaaaauuacgaaccugaagaccaucuccuguauuaaucucaaagccagcguguucaaggagcaucgggaagucgagaucaacgugcugcuuccccagguugcugugaaccugucuaauugccacgucacaauuaaaagccacgugugugacuacucccucgacgucgaugggaccgugcgccugccccauauccaccauggaggcacauuuaucccugggaccuacaagauuguuaucgacaagaaaaacaagcugaaugauagaugcacgcucuauacaaacugugugauuaaaggacgggagguccgcaagggccaaagcauccugagacaguacaaaaccgaaauucggaucgggaaggccucuaccggauccagacgccuucugagcgaggaauccggcgacgauugcaucucucggacacagcuccugagaaccgagacagcugaaauucacggcgacgauuaugggggaccgggcgacaagaucacgauuuguaaugggagcaccaucguggaucagcgccugggauccgagcuuggcugcuacacaauuaaccggguuaaaucuuucaagcucugcgagaauagcgccaccgggaaauccugugaaaucgacucuacacccgugaagugcagacaaggcuauugucugaaaaucacccaggagggacgcggccaugucaagcugagccggggguccgaaguggugcucgaugccugcgacagcucuugugagguuaugauuccuaagggaacgggcgacauccuggucgauugcuccgggggacagcagcacuuucuuaaagacaaccugauugaucucggcugucccagaaucccucugcuggggaagauggcuauuuacaucugccgcaugagcaaucaccccgagaccacaauggcguuccuuuucugguuuucuuucggcuaugugauuaccuguauccucugcaaagccaucuuuuaccugcugauuaucgugggaacacucggcaagcgguucaaacaauacagagaacugaagccucagaccuguacaauuugcgagaccacgcccgcuaacgccaucgacgccgaaaugcaugaucuuaauugcuccuauaacauuuguccguacugcgcuagccgccugacaucugacgggcucgcccggcacgucacccaguguccuaagagaaaagagaagguggaagagaccgagcuguaucugaaucuugaacggauccccuggaucguucgcaaacuccuucagguguccgagagcacaggagucgcgcugaagagauccagcuggcucauugugcugcuuguucuguuugcugugucucucagcccuguccaauccgcccccaucggccaugggaaaaccauugaaacguaccaggcccgggaggaauauacaucuaucugccuguucgugcugggaagcauucuuuuuaucguuuccugucucaugaagggccugguggauucuaucgggaacauuuucuuuccgggccugaccaucugcaaaacauguagcauuggauccaucaauggcuucgagauugagucucacaagugcuacuguagccuccugugcuguccuuauugcagacacugccccgcugaccgcgaaauccaucagcuucaccuguccaucuguaagaaacggaagaccgggagcaacgucaugcucgccgugugcaaaagaauguguuuucgcgcuacaauggaggugucuaacaaggcccugcugauuagauccaucauuaauaccacguucgucguuugcauccuuauucuggcgguguguguggucagcaccucugccguggaaauggagucccucccugcuggaacaugggaacgggaggaggaucugaccaacuuuugccaucaggaaugucaaguuacagagaccgaaugccucugucccuacgaggcccuggugcuucgcagaccccuguuccucgacagcaucgucaaaggcaagaagaaucugcugaacuccacgucucuugagacaagccuguccauugaagcuccuuggggagccaucaaugugcagagcaccuacaaaccgacaguuucuaccgcgaacaucgcccucuccuggagcucuguggagcaccgggggaauaagauucuggucagcggccgcuccgaaucuaucaugaaacucgaggaaagaaccgggauuagcugggaucugggcguggaggacgcuuccgagucuaagcugcugacaguuagcgugauggaucucucccagauguauagccccgucuucgaauaccugucuggagaccggcaaguggaggaauggccuaaagccacgugcaccggcgacuguuccgagcgcugcgggugcacaagcuccaccugucugcauaaggaauggccccacucuagaaacuggcggugcaauccuacaugguguuggggagugggcaccgggugcacguguugcggacuugaugucaaggaccuguuuacagauuauauguucguuaaauggaagguggacuacaucaaaaccgaggcuauugugugugucgagcucaccagccaggaacgccagugcucccugguggaggccggcacaagauuuaaccucggccccguuaccaucacacugucugaaccucggaauauccagcaaaaacuuccgcccgagauuaucacgcugcacccuagaauugaagagggguucuuugaucugaugcaugugcagaagguccucagcgccuccaccguguguaagcugcagagcugcacacacggaguucccggcgaccuucagguguaucauaucgggaaccugcucaagggagauaaagucaauggccaccugauucauaagaucgagccucacuucaacaccucuuggauguccugggacgggugugaucucgacuacuauugcaauaugggagauuggcccagcugcacauacaccggcgugacgcaacacaaccaugcuucuuuugucaaccugcuuaauaucgaaaccgacuacacaaaauccuuccacuuucauagcaagcgcgugaccgcgcacggcgauacaccgcagcuggaccugaaagcccggccuaccuauggggcuggagagauuacaguucucguggaagucgccgacauggagcugcacacgaagaaaaucgagauuaccggccuuaaguucgccucucugacauguaccgggugcuacgcuuguagcuccggaaucucuugcaaggugcggauucauguugaugaacccgacgagcucaccgugcacgucaaaagcgaugaccccgaugugguggccgcguccagcucccugauggcucgcaagcucgaauuuggcacagacucuacguucaaagccuuuagcgccaugccuaagaccucccuguguuucuauaucguugagcgggaauacugcaaaucuuguagcaaggaggauacacagaagugcgucaacaccaaacuugagcagccccaauccauucugaucgaacagaaggggacaaucauuggaaaacagaauaacaccuguacggcuaaggccucuugcuggcuggagagcgugaaauccuucuuuuauggccucaagaauaugcugagcggcaucuucgggaacguguuugucggaauuuuccuuuuucuggcgccuuucauccuccugauucucuuuuucauguuuggcuggagaauccuguucuguuuuaagugcugccgccggacaagagggcuuuucaaauacaagcaucugaaagacgaugaagagaccggauaucgccggaucauugaaagacugaauaacaagaaaggcaagaauaagcuccuggacggggagcggcuugcugaucgcagaaucgccgagcuguucucuaccaaaacacacauuggauga

SEQ ID NO: 13653 - RNA, 5055 nt, Artificial Sequence
  derived and/or modified CDS sequence (opt5) from CCHFV(Baghdad 12)__AJ538197.2__GP
augcacaucagccugauuuacgccgugcucugccugcagcuuuauggccugggggagacccauggauccucuagcggcacagaacacaacagaacgaaugucguugcuacccccgggggaucccaaucuccugagccgcucgugagcacaacccugcccgugacacuugacuccucuaccgucaccccugccacccaggcgagcggccccgaaggguccggagagguguacacgagcccucccaccacaaccgaaggccugucuccuuccgaugcuacaagcgagcucccgaccacgacaggcaucgggauuucuuccagcucugacguuaacuccagcacccaggccgccggagauacauccacccccaccgcucggacaucucugccugacagccccuccacgccucccaccagccaggauacacaucacccgaugcgcaaucugcucucugugaccucccugaagccugaggaaacacccgccccuagcaaaucuggcaaggagagccccgcugccuccucuccccauccugucgcgagcagaccgcccaccccuuccacgacagcccaagggcccaccgaaaacaauagccggaacaccacagugcagcuuaaaucuguuacccaguccgcuacacugggaccuauggccagccccacgcagaccgugcuccugcaaucugucacauccaucgcuauucaggacacccacccgagcccuacaaaucgcuccagacggaaccuugagauggagaucauccugacccucccccagggccugaagaaauauuacgggaaggugcugcgccuccugcagcuuacgcuggaagaggauaccgaaggacuccuggagugguguaagagaaaucuuggccuggacugcgaugacacauucuuucaaaaacggauugaagaguucuuuaucaccggcgaggggcacuucaacgaagugcuccaguuucgcacaccuggaacccugucuacgacagagagcacccaugccggcucccccacagucgaaccuuucaagucuuauuuugcgaaaggguuccugcucauugauagcggauacuuuuccgccaaguguuauagcagaaccucuaauuccggccugcagcuuaucaacguuacccggcacagcacaaaaauugcugacacgcccgggccgaagaucaccaaucugaagacaauuucuugcaucaaccucaaagccuccaucuucaaggagcaucgcgaaauugagaucaaugugcugcuuccucaaguggcugucaaccugagcaacugucacgugaccauuaaaucucacguuugcgauuacagccucaauaucgacggaacagugaagcugccccauauucaccaugagggcaucuuuauccccggcaccuacaaaauugucaucgacaagaaaaacaagcugaaugauagauguacgcuuuucacaaacugcgugauuaaggggcgggaaguucgcaaaggacaguccgugcugagacaguauaagaccgagauccggauuggcaaagccagcaccgggucuagacgccuucuguccgaagagagcggagacgauuguaucucccggacaagacuccugcgcaccgaaacagccgagauccacggcgacucuuacgggggcccuggagauaagauuacgaucugcaauggcagcaccauugucgaccagcggcugggguccgagaugggauguuauacaaucaacagagugaaaucuuuuaagcucugcgaaaauagcgcuaccggcaaguccugcaaaauugauucuaucccggucaagugucgccaaggguacugccucaaaauuacacaggagggacggggccaugugaagcugagcagaggguccgaaguugugcuggacgcgugugauagcucuugcgaggucaugauccccaaaggcaccggagacauccucguggauuguuccggcgggcagcagcacuuccugaaggacaaccuuauugaccugggaugcccuaauaucccccuccugggcaagauggccauuuauaucugucgcaugagcaaccacccuaaaacgaccauggcuuuccuguuuugguucucuuuuggguacguuauuacaugcauccuuuguaaggccaucuucuaucuccugauuaucgugggaacccugggcaaacgguuuaagcaauacagagagcucaaaccccagacaugcaccauuugugaaacaaccccugucaaugccaucgaugcugagaugcaugaccugaacugcuccuacaauauuugccccuauugugccagccgccuuacgucugaugggcuggcgcggcacgugacacagugcccgaagagaaaggaaaaaguggaggaaaccgagcucuaccugaaccuggagcggaucccuuggguuguccgcaaacuucuccagguguccgaaagcaccggcguggcucugaaaagauccagcuggcugaucguccuccuggugcuucuggccguuucuagcucccccgugcaaucugccccuauuggauauggcaagacaaucgagaccuaccaggcucgggaaggguauacgagcauuugucucuucguccugggauccauccuguuuauugugucuugccuuacaaaaggccucguugacagcaucgggaauaucuucuuucccggacuguccauuuguaagaccugcucuaucggcagcauuaacggguucgagguggaaucccauaaauguuacugcagccugcucuguugcccguauuguagacacugcucugccgaucgcgagauccaccagcugcaucuuuccauuugcaagaagcggaaaacaggcagcucugucaugcuggcuguguguaagagaaugugcuuucgcgccaccauggagguuuccaacaaagcgcuccugaucagaagcauuaucaauacaaccuucguggucuguauccugacgcuugccgugugcguggucuccaccucugcuguugaaauggagagccugccugccggaacaugggaacgggaggaagaccucaccaacuuuugucaccaggagugccaagugacagagaccgaaugucugugccccuacgaggcucucgugcugcgcaagccucuuuuccuggauuccauugucaaaggcacgaagaaucuccugaacagcacaucucuggaaaccucccuuagcaucgaggcccccuggggagcgauuaaugugcagucuacauacaagcccaccguuagcaccgccaacaucgcucuguccuggucuagcguggagcauagagggaauaaaauucucgucuccggccggucugaaagcaucaugaagcuggaggaacgcacagggaucuccugggaccucggaguggaggaugccagcgaaucuaaacugcuuacgguuuccgugauggaccugagccagauguauuccccugucuucgaguaccucucuggcgauagacaaguggaggaauggccgaaggcuaccuguacaggcgacugccccgagcggugugggugcaccacaagcacaugccugcacaaagaauggccucauucccgcaacuggagauguaaucccacguggugcuggggaguuggcacaggguguaccugcuguggacuggaugugaaggaccuuuuuaccgacuauauguucgucaaguggaaaguggaguacauuaagacagaugccaucgugugcgucgaacugaccucucaggagcggcaguguagccucauugaggccggcacacgcuuuaaccugggguccguuacgaucacccucagcgaaccuagaaauauucagcaaaaacugcccccugagaucaucacacuucacccgcggauugaagagggauucuuugaccugaugcacgugcagaaggugcugucugcuuccaccgucugcaaacuccagagcuguacacauggcgugcccggcgaucugcagguuuaucacaucgggaaccuucugaagggagacaaggugaauggccaucucauucacaaaaucgaaccucauuucaacaccucuuggauguccugggaugggugcgaccuggauuacuauuguaauaugggagacuggcccagcugcacguacaccggcgucacacaacacaaccacgcgucuuuugugaaccuccugaauauugagaccgauuacacaaagagcuuccauuuucacuccaaaagaguuaccgcccauggggacacaccucagcuugaucugaaggugcgccccacguauggagcuggcgagaucaccguccugguggaagucgccgacauggagcuccacacaaagaagauugaaaucucuggccugaaauucgccagccuuaccugcaccggguguuacgcuugcuccagcggaaucuccuguaaggugcggauucacguugaugagccggacgagcugacagugcaugucaagucugacgauccugacgugguugccgcgagcuccucucucauggcuagaaaacuggaauuuggcacggauagcaccuucaaggccuuuuccgccaugcccaaaacaucucucugcuucuauaucguggagcgcgaauacuguaagagcugcuccaaagaggacacccagaagugugucaacacaaagcuggaacagccccaaagcauucuuaucgagcacaaagggaccauuaucggaaagcagaauaacacgugcacagcuaaaaccucuuguuggcuggaguccgugaaguccuucuuuuauggccugaaaaauaugcucucugggaucuucggaaacuuuuucaugggcauuuuucuguuccuugccccuuuuauccugcucauucuguucuuuauguucggcuggcggauccucuuuugcuucaaguguugcagacgcacccgggggcuguucaaguacagacaucuuaaagaugacgaagagacaggauaucgccggauuaucgaaagacugaauaacaagaaaggcaagaauaaacugcucgauggggagcggcuggcggaccgcagaaucgcugaacuuuuuagcaccaagacacacauuggauga

SEQ ID NO: 13654 - RNA, 5055 nt, Artificial Sequence
  derived and/or modified CDS sequence (opt5) from CCHFV(TADJ/HU8966 )__AY179962.1__GP
augcacaugcugcucaugugcgccgugcugugucuucagcuguacggccucgggggaacccugagaagcaacaauggcacagagcauaacaagacgaauguccuuaccacacccggggacaaacuguccccugaaccgcccguuucuaccgcucucccugugacacccgauagcuccaccgugacaccuaccacgcccgccucuggacuggagggcagcggggaagucuauaccuccccuccgaucacaaccaagggacugucucccagcgaggcgacauccgaaccucccgcuaccacgggcaugggcauuagcucugccuccgggguggacuucagcacacaagccgcucgggauaccucuacacucaccguucugaccuccccucccaacagcccgaauacaccucccacgucucaggacacccaccauccugugcgcucccuucugagcgucacaucccccagacccgaggagaccacagccccuucuaaaagcggaaaggaauccccggcugccaacagcucucaccccgugaccucccggccuagcucuccccucaucacgguucgcggcccuacagagaauagcucccauaacaccaccgggcagcuggaaucuaugacacagagcaccacacuugugcccauggcguccccgacgcaaaccguccugagccagucugugacauccauugccgugcaggaugcucacccuagcucuaccaauagauccaaacggaaccucgagauggagaucauucugacacugccccagggacucaagaaguacuauggcaaaguccugcgccuucugcaacucacccuggaagaggacacggaagggcuucuggaguggugcaagagaaaucucggacuggauugugacgauaccuuuuuccagaaacggaucgaagaguuuuucaucacaggcgagggccacuuuaacgaaguucugcaguuccgcaccccugggacacucagcaccacggaguccacacaugccggaucucccaccgcugaaccuuuuaagagcuacuucgccaaaggcuuucuguccauugacucuggguauuucagcgcgaagugcuacuccagaacaagcaauucuggacuucggcugaucaacgugacccgccacuccaccagaauugccgauacacccggcccgaagaucacgaaucucaaaaccauuagcuguaucaaccugcgggcuucuauuuuuaaggagcaucgcgaaguggagaucaacguccuucugccucagguggccguuaaucucuccaacugccacguggcuaucaaaagccacgucugugacuauucucuggauguggacgggacaguuagacugccccauauucaccauggaggcaccuucauccccggcacauacaagauugugaucgacaaaaagaauaaacucaacgaucggugcacccuguuuacgaauugugucauuaaggggagagaggugcgcaagggacaaagcauccuucggcaguacaaaacagaaaucagaauuggcaaggccuccaccgggagccgccggcugcucucugaggaauccggagacgauugcaucagcagaacccagcugcugcgcacagagaccgccgaaauucacggcgacgauuaugggggcccuggagacaaaaucacaauuuguaacggcuccacgaucgucgaucaacggcuugggucugagcucggaugcuacaccaucaauagaguuaagagcuucaaacugugcgagaacuccgcuacaggcaagaauugugaaauugacucugugccggugaagugccgccagggguauugucugaaaaucacccaggagggacggggccaugucaagcucagcagaggguccgaagugguucuggaugcgugcgacucuagcugugaggugaugauucccaaaggcacaggagauaucuccgucgacugcagcggcgggcagcaacacuuccuuaaggacaaccugauugaucucggauguccuaaaaucccccugcugggcaagauggccauuuacaucugccgcaugucuaaucacccuaagaccacgauggcuuuucuuuucugguuuuccuucggguaugugaucacccggauucucuguaaagccaucuuuuaccugcugauuaucgugggaacacucggcaagagauucaaacaguaucgggagcugaagccccagaccugcacaauuugugaaaccacgccugccaacgcuaucgacgccgagaugcaugaucuuaauugcagcuacaacaucugccccuacugugcgucucgccugaccuccgacgggcucgcuagacacguuacgcagugcccgaaacggaaggaaagagucgaggaaacagagcuguaucugaaucuugagcgcauuccuuggaucgugcggaagcuccugcaagugagcgaaucuaccggcgucgcccugaaaagauccagcuggcucauugugcugcuuguucuguuuaccgugucccucagccccguccagucugccccuaucggauacggcaacacaauugagaccuaucaggcucgcgaagaguacacgagcaucugucuguucgugcugggguccauccuuuuuauuguuucuugccucaugaagggacugguggauagcaucggcaacauuuucuuucccgggcugacaaucuguaaaaccugcuccauuggaucuaucaauggcuucgaaaucgagagccauaaguguuauugcucccuccuguguugcccguacuguagacacugcucugccgaccgggagauucaccagcuucaucugagcaucugcaaaaagcgcaaaacaggguccaacgucaugcucgcuguguguaagagaaugugcuuucgggccaccauggaaguuagcaauaaggcgcugcugauucgcucuaucauuaacacaaccuucguggucuguauccuuauucuggccgugugcaucguguccacgagcgcugucgagauggaaucucucccugccggcaccugggagagagaagaggaucugacaaauuucugucaccaagagugccagguuaccgaaacagagugucucugccccuaugaagcucuggugcuucggcgcccucuguuucucgacuccaucgugaaaggaaugaagaacccccugaauagcaccucccuggagacgucucuuagcauugaggcccccuggggcgcgaucaacguccaguccacauacaaaccuaccgugagcacagccaauauugcucugucuugguccagcaucgaacauagagggaacaauauucucguuucuggacggagcgaguccaucaugaagcuggaggaacgcaccggcaucucuggggaucucggaguggaagacgccagcgaguccaaacugcuuaccgucucugugauggaucugagccagauguacuccccgguuuucgaguaucucagcggcgacagacaaguggaagaguggcccaaggcuacauguacgggcgauugcccugaacggugugggugcaccucuuccacaugccugcacaaggaguggccccauagcagaaacuggcgcuguaauccuaccuggugcuggggagucggcacaggguguaccugcuguggacuggacgugaaagaccuuuuuauugauuacauguucguuaaguggaaaguggacuauaucaagacggaagccauugucugcguggagcugacaucccaggagcggcaguguucucucguggaagccggcaccagauuuaaccuggggcccgucaccaucacacucagcgagccucgcaauauucaacagaaacugccgcccgaaaucaucacccuucacccucggauugaggaaggauucuuugaucugaugcacguucagaaggugcuguccgcuucuacagugugcaagcuccagagcuguacgcauggcguccccggcgaccugcaaguguaccacaucgggaaccuucugaaaggagauaaggagaacggccaucucauucacaaaaucgagccucauuucaauaccuccuggaugagcugggacgggugcgaucuggacuauuacuguaacaugggagauuggcccucuugcacauauaccggcguuacacagcacaaucacgcguccuuugugaaccuccugaauauugaaaccgacuacacaaagagcuuccauuuucacucuaaaagagucaccgcccauggggauacaccgcagcuugaccugaaggcucgcccuaccuacggagccggcgagaucacagugcugguugaaguggccgauauggagcuccacaccaagaaaauugagaucacaggccugaaguucgcuucccuuacgugcaccggguguuaugccugcagcucuggaaucagcuguaaaguccggauucacguggacgaacccgacgagcugacaguccaugugaaguccgaugaccccgauguuguggcggcuucuagcucccucauggccagaaaacuggaauuuggcaccgacagcaccuucaaggccuucuccgcuaugccuaaaacaucucucugcuuuuacaucgucgagcgcgaauauagaaagagcuguuccaaggaggauacgcagaaaugcgugaacaccaagcuggagcaaccccagucuauucuuaucgaacacaaagggacaauuaucggaaagcagaauaacaccuguacagccaaagcgagcugcuggcuggaguccguuaagucuuucuuuuacggccugaagaauaugcucagcgggaucuucggaaacguguuugucggcauuuuccuguuucuugcuccuuucauccugcucauucuguuuuucauguuuggcuggcggauccucuccuguuucaaaugcugucggcgcaccagagggcugcuuaagcaucggcaccugaaagacgaugaagagacgggauaucgcagaauuaucgaacggcugaauaacaagaaaggcaagaauaagcuccuggacggggagagacuugccgaucgccggaucgccgagcuguucagcacaaaaacccauauuggauga

SEQ ID NO: 13655 - RNA, 5055 nt, Artificial Sequence
  derived and/or modified CDS sequence (opt5) from CCHFV(K168_40)__KX013457.1__GP
augcacaucagccugaugugcgccgugcucugucugcagcuuuacggccuugggggaacccauggccuccacaacgggacagagcauaauaagacgaacgcugucaccacauccucuaauagccaauccucugaaagccccgccagaaccgcgccuccgguuacacccgacuccccuaccgugacacccaccacgccugcuucugcccccgagggaagcggcgaagcccacuccagcccuccgaacaauaccgaggggcccucucugccugaauccacaagcgagcccccugcugccaccucuacaggcauucccuccgcuagcgaugugaacucuuccacccaggccgcgcgggacacgagcacaccgaccguccgcacauccccucccaauucuccuagcaccccucccacaccccaggagacccaucacccggugagaaaccuucuguccguuacgagccacaaacccgaagagaccucugccccuuccgaaagcggaaaggagucucccgcugccaauagcccucaucccguggcuucccggccgccuacacccucuaccacagcccagggcccuaccgagaacaauaacuauaauacgacagggcaacucgaaagccugacccaguccaccacacugggacccaugaccagccucacacagacggaucugccucagucugucaccuccaucgcggugcaagacacacaccccagcccgaccaaccgcucuaaaagaaaucuugagauggaaauuauccugacacucccucagggccugaagaaauacuaugggaagguucuucggcugcuccagcugacccuggaggaagauacggagggacuccuggaguggugcaagcgcaaccuuggccuggacugugaugacaccuucuuucagaaaagaauugaagaguucuuuaucacaggggaaggacauuucaacgaggugcuccaauuucggacccccggcacacuguccaccacggaaagcacacacgccggccuucccaccgcugagccuuucaaguccuacuuugccaaaggguuccugucuaucgauagcggauauuuuuccgcuaagugcuacucucgcacaagcaauuccggccuccagcugauuaacgucaccagacacagcacccggaucgccgacacaccggggcccaaaauuacgaaucugaagaccaucucuuguauuaaccucaaggccuccguguucaaagagcaucgcgaaguggagaucaauguccugcuuccucagguugcugugaaccugagcaauugccacgugacaauuaagucucaugucugugauuauucccucgacaucgauggaaccgugagacugccccacauccaucacgacggcacauuuauuccugggaccuacaaaaucguuauugaccggaagaacaaacuuaaugaucgcugcacgcuguucacaaacugugugaucaagggaagagaaguccggaaaggccaaagcgugcucagacaguacaagaccgagauucgcaucggcaaggcgucuaccgggagccggagacugcuguccgacgaaagcggagaugacugcaucucucgcacacagcuccugcggaccgagacagccgagauucacggcgauaauuaugggggacccggcgacaaaaucacgauuuguaacggguccaccaucguugaucagagacuuggcagcgaacugggaugcuacacaauuaaucgcgugaaguccuuuaaacucugcgagaacucugcuaccggcaagagcugugaagucgacuccaucccugugaaaugccggcaaggguauugucugaagaucacacaggagggaagaggccaugucaagcugucucgcgggagcgaggugguucuugaugccugcgacuccucuugugaagugaugauucccaaaggaaccggcgauauccucgucgacugcagcgggggccagcagcacuuccugaaggacaaucugauugaucucggauguccgaaaaucccucugcuuggcaagauggccauuuacaucugccggauguccaaccaucccaaaacgaccauggcuuuccuguuuugguucagcuuuggguaugugauuacauguaucguuugcaaggccaucuucuaccuccugauuaucgugggaacccugggcaagagauuuaaacaauaucgcgagcuuaagccucagacauguaccauuugcgaaacaacccccacgaacgcgaucgacgcugagaugcacgaucucaauugcucuuacaacauuuguccguacugcgccucccggcugacaagcgacgggcuggccagacacgucacccauuguccuaaacggaaggaaaaaguggaggagaccgaacucuaucugaaucuugagcgcauccccugggugguuagaaagcugcuccaggucucugaauccacaggaguggcucugaagcggagcucuuggcugaucgugcuucucguccuguucgccgugucccugagcccuguucaguccgcucccauuggccacgggaaaaccaucgagacguaccaagugagagaagaguauacaagcauuugccucuuuguccugggcucuauccuuuucauugugagcugucugaugaagggacucguuaacuccgugggcaauaucuuuuuccccgggcugucuaucugcaaaaccuguagcauuggauccaucaacggcuuugagauugaaucucauaagugcuacuguagccugcuuugcuguccuuauugccgccacugcuccgccgaucgggagauccaucagcuccaccugucuauuuguaaaaagagaaaaacagggagcaaugucaugcuggcggugugcaagcgcauguguuucagagccaccguugaaguguccaacaaggcucucagcauccggucuaucauuaauacaaccuuugucgugugcauccugauucuugccgugugugucguuuccacgagcgcuguggagauggaaucucugccggccggaaccugggagcgcgaggaagaccucacaaacuucugccaccaggagugucaggugaccgaaacagagugccugugucccuacgaggcgcugguccuuagacggccucuguuccucgauggcaucgugaaagggaugaagaaucugcucaacuccaccagccuggaaacgucccuuucuauugaggcccccuggggcgcuaucaauguucaaagcacauauaaaccuaccguguccgccgcuaacauugcccugagcuggucuuccgucgaacaucgcggaaauaagauccucgugagcggcagaucugagagcaucaugaaacuggaggaacggacagggauuuccugggaccugggaguugaggaugccucugaaagcaaacuucugaccguguccgucauggaccucucucagauguacagccccguguuugaguaccuguccggcgaucgccagguugaagaguggccuaaggcuaccugcacaggggacuguccggaaagaugcggaugcacgagcucuaccugucuccacaaggaguggccccauucccggaacuggcgcugcaacccuacaugguguuggggcgugggcaccgggugcacauguugcggacuggaugucaaggaccuuuucaccgacuauauguuugugaaauggaagguggaguacaucaaaacggaagcgauugucuguguugagcugacaagccaagaaagacagugcucccucaucgaggccggcacccgguucaaucuggggcccgugaccauuacacugucugaaccuagaaacauccagcagaaacuucccccggagaucauuacccugcacccucgcaucgaggaaggauuuuucgaucucaugcaugugcaaaagguccugagcgcuuccacaguguguaagcuccagucuugcacgcacggcguucccggggaccuucagguguaucacauuggaaaucugcugaagggcgauaaagucaacggccaucugauccacaagauugagccccauuuuaauaccagcuggauguccugggacgggugugaucucgacuacuauugcaacaugggagauuggccuagcugcacauacaccggcgugacacagcacaaucacgccucuuucaucaaccugcuuaauaucgaaaccgacuauacgaaauccuuucauuuccacagcaagcggguuaccgcccauggggauacaccccaacuggaccucaaggcuagaccuaacuacggagccggcgagauuaccgugcuggucgagguggcggauauggaacuccacaccaaaaagaucgagauuucugggcugaaauuugcuucccuuacauguacaggaugcuacgccuguagcucuggcaucagcugcaagguccgcauucauguggacgaaccggaugagcugacgguucacgugaaauccgacgaccccgaugucguggccgcuucuagcucccugauggcccggaagcucgaguucggcaccgacagcacauuuaaagcguucuccgcuaugccuaagaccucucuguguuucuauaucguugaaagagaguacugcaagagcuguuccaaagaagauacccagaagugcgugaauacaaaacuugagcacccccagucuauucugaucgaacauaaggggacgaucauuggaaaacagaacaauaccuguacagccaagaccagcugcuggcucgaguccgucaagagcuuuuucuauggccugaaaaacaugcucucugggaucuuuggaaauguguucgugggcauuuuucuguuccuugccccuuuuauccugcugauucucuucuuuauguucggguggcgcauccuguuuuguuucaagugcugccggagaacacgcggacuuuuccgguacaaacaccuggaagacgaugaggagaccggcuauagacggaucauugaacgccucaacaacaagaaaggcaagaauaagcugcucgacggggagagacuggcugaucggcgcaucgccgaacuguuuuccacgaaaacacauauuggauga

SEQ ID NO: 13656 - RNA, 5055 nt, Artificial Sequence
  derived and/or modified CDS sequence (opt5) from CCHFV(K128_76)__KX013454.1__GP
augcacaucagccugaugugcgccgugcucugucugcagcuuuacggccucgggggaacccauggcucccacaacgagacagaacauaauaagacgaacgcugucaccacaucuagcgacucccaaucucccgagccuccgaccagaacaacccugcccguuacaccugauagccccaccgugacgccuaccacacccgccuccgcgccugaagggucuggagaggugcacaccagcccgcccaauacaaccgaaggcccuucccugcccgagagcacgccugagcccccgacagcuaccucuacagggauuccuuccgccagcgacgucaacucuuccacccaggccgcucgggauaccagcacacccacggugcauaccucuccucccaauucccccagcacaccuccgacccuucaggaaacacaccaccccaugcgcaaccugcucuccguuaccucucauaaaccugaggaaacgagcgcccccuccgagagcggaaaggagucuccugcugccaauagcccccacccgguggcggacagaccuuccacaucuagcaccaccgcccagggccccacagaaaacaauuccuauaacaccacagagcaacuggaaucucugacgcagagcaccacacucggcccuaugaccucccugacacagaccguccuuagccagucugugacguccaucgcuguucaagauacccaucugagccccacaaaucggucuaaacgcaaccucgagauggaaauuauccugacccuuccucaggggcugaagaaauacuauggaaaggugcucagacugcugcagcucacacuggaggaggacaccgaaggccuucuggaguggugcaagcggaaucucgaucuggacugugaugacacguucuuucagaaacgcauugaagaguucuuuaucacaggggaaggauacuucaacgagguccuucaauuuagaacccccggcacacuguccaccaccgagagcacacacgccgggcucccgacggcugaaccuuucaaguccuauuuugccaaaggauuccugucuaucgauagcggcuacuuuuccgcgaagugcuauucucggaccagcaauuccggccugcagcucauuaacgugacacgccacagcaccagaaucgccgacacacccgggcccaaaauuaccaaccugaagacgaucucuuguauuaaucuuaaggcuuccguguucaaagagcaucgggaagucgagaucaacguucugcucccucagguggccgugaaucugagcaacugccacgucacaauuaagucucaugugugugauuacucccuugacaucgacggaaccguuaaacugccgcacauccaucacgauggcaccuuuauucccgggacauacaagaucgugauugaccgcaaaaauaagcucaacgauagaugcacccuguucacaaauugugucaucaaaggacgggaagugcgcaagggccaaagcguucugagacaguauaagacggagauucggaucgggaaggcuucuaccggaagcagacgccuccuguccgacgagagcggcgaugacugcaucucucggacacagcuucugagaaccgaaacagccgagauucacggcgauaacuacgggggaccuggcgacaaaaucaccauuuguaauggguccacgaucguggaucagcgccucggaagcgaacugggcugcuauaccauuaaccgggucaaauccuuuaagcugugcgaaaauucugccacagggaaaagcugugagaucgacuccauccccgugaagugcagacaaggcuacugucuuaagauuacccaggagggacgcggccaugucaaacucucucgggggagcgaggugguucuggaugcuugcgacuccucuugugaagugaugaucccuaagggaacaggcgacauucuggucgauugcagcgggggacagcagcacuuccucaaagacaaccugaucgaucuuggcugucccaagauuccucugcucgggaaaauggcgaucuauauuugcagaauguccaaucaucccaagaccacaauggccuuccuguuuugguucagcuuuggcuacgugaucaccuguaucguuugcaaggcuauuuucuaucugcuuaucauugugggaacgcucggcaaacgcuuuaagcaauaccgggagcugaaaccgcagacauguaccaucugcgaaaccacaccuaccaacgccauugacgccgagaugcacgaucugaauugcucuuacaacaucugucccuauugcgcuuccagacucacgagcgacgggcuggcccgccacgucacacauuguccuaagcggaaagagaagguggaagagaccgaacuuuaccugaaccucgagagaauccccugggugguucggaagcugcugcaggucucugaauccacaggaguggcgcuuaaacgcagcucuuggcucauugugcugcugguccucuucgcugugucccugagcccgguucaguccgccccuaucagccacggcaagaccauugagacauaucaagugagagaggaauacaccucuaucugccuuuuuguccuggggagcauucucuucaucguguccugucugaugaaaggacugguuaauucugugggcaacaucuuuuuccccgggcuuagcauuugcaagacguguuccaucggcucuauuaauggauuugagaucgaaagccauaaaugcuauuguucccuccugugcuguccuuacugccggcacugcucugccgauagagagauucaucagcugcaccucagcaucuguaagaaacgcaagaccggcuccaacgucaugcuggcugugugcaagcggauguguuucagagccacaauggaaguuagcaauaaagcucuuuuuauccgcucuauuaucaacaccacauucguggucugcauucugauccucgccguguguguggucuccaccagcgcgguugagauggagucucugcccgccgggacgugggaaagagaggaagaccugacaaauuucugccaccaggagugucaggugaccgagacagaaugccuuugucccuaugaggcucuggugcuccggcgcccucuguuucaagauuccauugucaagggaaugaaaaaccuccugaauagcaccucccuugaaaccucucugagcaucgaggccccguggggcgcuauuaacgugcaguccacauacaagcccgccguuagcgcggccaauaucgcucucucuugguccagcguggaacauagagggucuaaaauccuggucagcggacgguccgagucuauuaugaagcuggaggaacgcacgggcaucagcugggaccuugggguggaggaugccuccgaaucuaagcugcucaccguuagcgugauggaccugucccagauguacagcccugucuucgaguaucucucuggcgauagacaaguggaagaguggcccaaagcuacaugcaccggagacuguccugagcggugcggcugcacauccagcaccugucugcacaaggaauggccccauucccgcaacuggagaugcaauccuacgugguguuggggaguugggacaggcugcaccuguugcgggcuugacgugaaagaucuguuuaccgacuacauguucgucaaguggaaaguggaguauauuaagacagaagccaucgugugugucgagcucaccucucaggaacggcagugcagccugauugaggccggaacacgcuuuaaccugggcccgguuacgaucacccuuuccgagcccagaaauauccagcaaaagcugccucccgaaauuaucacacuccacccucggauugaggaaggcuucuuugaucugaugcaugugcagaaagugcucucugcuagcaccgucuguaagcugcaguccugcacacacggggugcccggagaccuucagguuuaccacaucggcaaccugcugaaaggggauagagugaacggacaucucauucacaagaucgagccgcauuucaauaccagcuggaugucuugggacggcugugaucuggacuauuacugcaacaugggggauuggccuuccugcacguauaccggagucacacaacacaaucacgcgagcuuugugaaccuucugaauaucgagaccgacuacacaaaaucuuuccauuuucacuccaagcgcguuaccgcccauggcgauacaccccagcucgaccugaaggcucggcccaacuacggcgccggggaaauuacggugcucgucgagguggccgauauggaacugcacaccaaaaagaucgagauuagcggacuuaaauucgcuucucugacauguaccggcugcuaugccuguagcuccgggaucucuugcaagguccgcauucauguggacgaaccugacgagcugaccguucacgugaaaagcgaugaccccgaugucguggcggcuuccagcucccucauggccagaaagcuggaguuuggaacagacucuacguucaaagccuucagcgcuaugccuaagaccucccuuuguuuuuacaucguugaacgggaguauugcaagucuuguagcaaagaagauacacagaagugcgugaauaccaaacuggagcagccgcaauccauucucaucgaacacaagggcacaaucauugggaaacagaacaauaccuguacggccaagacaucuugcuggcuggagagcgucaaguccuucuuuuacggacucaaaaacaugcugagcggcaucuucggcaauguguuuguggggauuuuccuuuuucuggcgcccuucauccugcucauucuguuuuucauguuuggauggagaauccuuuucuguuucaagugcugccgccggaccagaggccuguuucgcuauaaacaucucgagaacgacgaagagaccggguaccggagaaucauugaacggcugaauaacaagaaaggaaagaauaagcuccuggauggcgagcgccuugcugacagacggaucgccgaacuguucucuacaaaaacccacauuggguga

SEQ ID NO: 13657 - RNA, 5055 nt, Artificial Sequence
  derived and/or modified CDS sequence (opt5) from CCHFV(K168_125)__KX013460.1__GP
augcacaucagccugaugugcgccgugcucugucugcagcuuuacggccuugggggaacccauggccuccacaacgggacagagcauaauaagacgaacgcugucaccacauccucuaauagccaauccucugaaagccccgccagaaccgcgccuccgguuacacccgacuccccuaccgugacacccaccacgccugcuucugcccccgagggaagcggcgaagcccacuccagcccuccgaacaauaccgaggggcccucucugccugaauccacaagcgagcccccugcugccaccucuacagggauucccuccgcuagcgaugugaacucuuccacccaggccgcgcgggacacgagcacaccgaccguccgcacauccccucccaauucuccuagcaccccucccacaccccaggagacccaucacccggugagaaaccuucuguccguuacgagccacaaacccgaagagaccucugccccuuccgaaagcggcaaggagucucccgcugccaauagcccucaucccguggcuucccggccgccuacacccucuaccacagcccagggcccuaccgagaacaauaacuauaauacgacagggcaacucgaaagccugacccaguccaccacacugggacccaugaccagccucacacagacggaucugccucagucugucaccuccaucgcggugcaagacacacaccccagcccgaccaaccgcucuaaaagaaaucuugagauggaaauuauccugacacucccucagggccugaagaaauacuaugggaagguucuucggcugcuccagcugacccuggaggaagauacggagggacuccuggaguggugcaagcgcaaccuuggccuggacugugaugacaccuucuuucagaaaagaauugaagaguucuuuaucacaggggaaggacauuucaacgaggugcuccaauuucggacccccggcacacuguccaccacggaaagcacacacgccggccuucccaccgcugagccuuucaaguccuacuuugccaaaggguuccugucuaucgauagcggauauuuuuccgcuaagugcuacucucgcacaagcaauuccggccuccagcugauuaacgucaccagacacagcacccggaucgccgacacaccggggcugaaaauuacgaaucucaagaccaucucuuguauuaaccugaaggccuccguguucaaagagcaucgcgaaguggagaucaauguccuucugccccagguugcugugaaccucagcaauugccacgugacaauuaagucucaugucugugauuauucccuggacaucgauggaaccgugagacuuccucacauccaucacgacggcacauuuauucccgggaccuacaaaaucguuauugaccggaagaacaaacugaaugaucgcugcacacucuucacgaacugugugaucaagggaagagaaguccggaaaggccaaagcgugcugagacaguacaagaccgagauucgcaucggcaaggcgucuaccgggagccggagacugcucuccgacgaaagcggagaugacugcaucucucgcacacagcugcuucggaccgagacagccgagauucacggcgauaauuaugggggaccuggcgacaaaaucacgauuuguaacggguccaccaucguugaucagagacugggcagcgaacucggaugcuacacaauuaaucgcgugaaguccuuuaaacugugcgagaacucugcuaccggcaagagcugugaagucgacuccauccccgugaaaugccggcaaggguauugucugaagaucacacaggagggaagaggccaugucaaacuuucucgcgggagcgaggugguucucgaugccugcgacuccucuugugaagugaugauuccuaagggaaccggcgauauccuggucgacugcagcgggggccagcagcacuuccugaaggacaaucucauugaucugggaugucccaaagugccgcuucugggcaagauggccaucuacauuugccggauguccaaccauccuaaaacgaccauggcuuuccucuuuugguucagcuuuggguauguuaucacauguauugugugcaaggccaucuucuaccugcugaucauugucggaacccuuggcaagagauuuaaacaauaucgcgagcucaagccccagacauguaccaucugcgaaacaaccccuacgaacgcgauugacgcugagaugcacgaucugaauugcucuuacaacaucugucccuacugcgccucccggcugacaagcgacgggcucgccagacacgugacccauuguccgaaacggaaggaaaaaguggaggagaccgaacuguaucuuaaucuggagcgcauuccuuggguugucagaaagcuccuucaggugucugaauccacaggaguggcucugaagcggagcucuuggcugaucguccuccuggugcuguucgccguuucccucagccccgugcaguccgcuccuaucggccacgggaaaaccauugagacguaccaagucagagaagaguauacaagcaucugccuguuugugcuuggcucuauucuguucaucguuagcugucucaugaagggacuggugaacuccgucggcaauaucuuuuuccccgggcugucuauuugcaaaaccuguagcaucggauccauuaacggcuuugagaucgaaucucauaagugcuacuguagccuucucugcugucccuauugccgccacugcuccgccgaucgggagauucaucagcugcaccugucuaucuguaaaaagagaaaaacagggagcaaugugaugcucgcgguuugcaagcgcauguguuucagagccaccguggaagucuccaacaaggcucugagcauucggucuaucaucaauacaaccuuuguggugugcauucuuauccuggccgucuguguuguguccacgagcgcuguggagauggaaucucucccugccggaaccugggagcgcgaggaagaccugacaaacuucugccaccaggagugucaggucaccgaaacagagugccuguguccguacgaggcgcuugugcugagacggccccucuuccuggauuccauuguuaaaggcaagaaaaaucuccugaacagcaccucccuugaaacgucucugagcaucgaggccccuuggggagcuauuaaugugcaauccacauauaagcccaccgucagcgccgcuaacaucgcccucucuugguccagcguggaacaucgcggcaauaaaauucugguuucuggaagaagcgaguccaucaugaagcuggaggaacggacaggcaucucuugggaccuugggguggaggaugccagcgaauccaagcugcucaccgucucugugauggaccugagccagauguacuccccuguuuuugaguaccucagcggagaucgccagguggaagaguggcccaaagcuaccugcacaggcgacuguccugaaagaugcgggugcacgucuuccaccugucugcacaaggaguggccgcauagccggaacuggcgcugcaaccccacaugguguuggggagucggcaccggcugcacauguugcgggcuugaugugaaagaccuguucaccgacuauauguuugugaaguggaaagucgaguacauuaagacggaagcgaucguuuguguggagcucacaucccaagaaagacagugcucucugauugaggccggaacccgguucaaucugggcccugugaccaucacacuuagcgaacccagaaacauucagcagaagcugccucccgagaucaucacccuccacccgcgcauugaggaaggguuuuucgaucugaugcauguccaaaaagugcucuccgcuucuacaguuuguaagcugcagagcugcacgcacggagugccuggcgaccuucaggucuaucacaucgggaaucugcugaaaggagauaaggugaacggccaucucauucacaaaaucgagccccauuuuaauaccuccuggaugagcugggacggcugugaucuggacuacuauugcaacaugggggauuggcccucuugcacauacaccggaguuacacagcacaaucacgccuccuucauuaaccuucugaauaucgaaaccgacuauaccaagagcuuucauuuccacucuaagcgggugacggcccauggcgauacaccucaacucgaccugaaagcuagacccaacuacggggccggagagaucaccguccucguggaggucgcggauauggaacugcacacaaagaaaauugagaucuccggccuuaaguuugcuagccugaccuguacagggugcuacgccuguucuagcggaauuuccugcaaagugcgcauccauguugacgaaccugaugagcugacggugcacgucaagucugacgacccggaugugguugccgcuagcuccagccucauggcccggaaacuggaguucggcaccgacuccacauuuaaggcguucucugcuaugcccaagaccagccuuuguuucuauauuguggaaagagaguacugcaaauccuguucuaaggaagauacccagaaaugcgucaauacaaagcuggagcacccucagagcauccucauugaacauaaaggcacgaucaucgggaagcagaacaauaccuguacagccaagaccuccugcuggcuggagucugugaaauccuuuuucuauggacucaagaacaugcugagcggcauuuuugggaauguguucguuggaaucuuucuuuuccuggcccccuuuauucugcucauccuguucuuuauguucggcuggcgcauucuguuuuguuucaaaugcugccggagaacacgcgggcuguuccgguacaagcaccucgaagacgaugaggagaccggauauagacggaucaucgaacgccugaacaacaaaaagggcaagaauaaacuccuggacggcgagagacuugcugaucggcgcauugccgaacuguuuagcacgaagacacauaucggguga

SEQ ID NO: 13658 - RNA, 5052 nt, Artificial Sequence
  derived and/or modified CDS sequence (opt5) from CCHFV(Kosova Hoti)__EU037902.1__GP
augcacacccugcucgugugcuucauccuguaccuucagcugcucggccugggaggagcccauggccaaagcaacgcuacagagcacaaugggacgaacaccacaaccgcccccggaacaucccagucuccuaagccgcccgcgagcaccacaccuucccaugcucccgaaccuucuaccauuaaacuuacgacccccacaagcgagaccgaaggcuccggggagacaaccccuccgacgaauacaacccaggacucucccccucuggaaacaacccccgagagaagcgccaccacagccacguccaccagcggaacagauaacaugaauagcaccacacagaugaccgacaacacgccuacauccaccgucagcaccucucucuccagcucucccuccacaccgagcaccucccaaggcaugcaccauccuguucggucucugcugagcguguccagccccaagacagcuacgaccccuacacccaugucucccggcgagauguccagcgaaaccucuagccagcacuccgccaugucucgcacaccuaccccgcacacggcuacccaggugagcacagagaaugccaacagauccaccagccggcagucugaauccagcgcgcaacccgccacacagucuccugucaccucccccgcucagagcauccuccugauguccgccacgccuacaaccauucagaauauccaucccucuccgacaaaccgcagcaaaagaaaucuugagauggagauuauccugacccucucccaagggcugaagaaauauuacggaaagauccuuaagcugcuccaccugacccuggaagaggauacagaaggccuccuggagugguguaaacggaaccuugggucuaauugcgacgaugacuuuuuccagaagcgcauugaagaguuuuucaucacgggagagggcuauuuuaacgaagugcugcaguucaaaacccucagcacaccuuccagcaccgagcccucucaugcuagacugccuacagccgaacccuuuaaguccuacuucgcgaaaggguuucuuagcauugauucuggauauuucuccgccaaguguuacccucggagcucuaccagcggccugcaacucaucaauguuacgcagcaccccgcucgcauugccgagacaccgggcccuaagaccaccucccugaaaacaaucaacugcauuaaccugagagcuagcguguuuaaggaacaccgggaggucgagaucaaugugcuccugccccagaucgccguuaaccuuucuaauugucauguggucauuaacucccacgugugcgacuauagccuggauaccgacgggcccgugcgccucccuagaaucuaccaugaaggaacauucaugccgggcacguacaaaauugucaucgaucggaagaauaaacugaacgaccgcuguacccuuguuacaaauugcgugauuaaggggagagaggugcggaaaggacaguccguccugagacaauauaagaccgaaaucaagaucggcaaagcccccacagggucucgcaagcuccugagcgaggaaccuggagaugacuguauuucccggacccagcugcucagaacggagaccgcugagauccacgacgauaacuacggcggccccggggacaaaauuacaaucugcaauggaucuaccauuguggaucagcgccugggcagcgaacuuggguguuauacaaucaaccggguuaaguccuuuaaacugugcgaaaauucugcgaccggaaagacaugcgaaaucgacagcaccccugugaaguguagacagggcuucugccucaaaauuacgcaaaaggggcgcggccaugucaaacugucccggggaagcgaggugguucuggaugccugugacucuaacugcgaggugaugauccccaagggcacaggggauauucuugucgacuguuccggaggccagcagcacuuccucaaagauaaucugaucgaccuggggugcccucacauuccccuccugggaaagauggcuaucuacauuuguagaaugagcaaccauccgaagaccaccauggccuuucuuuucugguuuucuuucggcuaugugaucacaugcaucuuuuguaaagcccuguucuacucccucauuaucauugggacccugggcaagaaaaucaagcaguaucgcgaacugaaaccucaaacgugcacaauuugugagaccgcucccgucaaugccaucgaugcggaaaugcacgaccuuaacugcagcuacaacaucugcccuuacugugcuucucggcucacauccgacggacuggccagacaugugaagcagugccccaagcgcaaagagaagguugaagagaccgagcuguaucucaaucuggaacggauuccguggguggucagaaaacuucuccaggugagcgaguccacaggcguugcccugaagcggagcucuuggcugaucgugcugcuuguccuccugaccgugagccuguccccugugcagucugcucccguugggcacggaaaaacgauugaaaccuaccaaacacgcgagggcuuuaccagcaucugucucuucaugcugggguccauucuuuuuaucgucucuugccuggugaagggacucguggauagcgucuccgacucuuucuuuccuggccugagcguguguaaaacaugcuccaucgggagcauuaacggcuucgaaaucgagucucacaaguguuauugcucccuguuuuguugccccuacuguagacauugcagcgccgaucgggagauucaccagcuucaucucaauaucugcaagaaaagaaagaccggaucuaacguuaugcuggcuguguguaaacgcaugugcuuccgggccacgauugaagcguccagacgcgcccugcucaucagaagcaucauuaauacaaccuucgucaucuguauucugacacuuaccaucugcgugguuuccaccucugcuguggagauggaaaaccugcccgccggcacaugggagcgggaagaggaccucacgaauuuuugucaccaggagugccaagucaccgaaacagagugucugugcccuuaugaagcucuggugcuucgcaagccgcuguuccucgauagcauuguuaaagggaugaagaaccugcucaauuccaccagccuggagacaucucuuuccaucgaggcccccuggggagcgauuaacgugcagagcaccuuuaagccuacggucucuacagccaauaucgcucugagcugguccucuguggaacauagaggcaacaaaauccucgugaccgggcggagcgaguccauuaugaagcuggaggagcgcaccggaaucucuugggaccugggcgucgaagaugccagcgaguccaaacuucugacaguuagcauuauggaccucucucagauguacucccccguguucgaguaucugagcggggauagacagguggaagaguggccuaaggcuaccuguacaggcgacugcccccaacgguguggaugcacguccucuaccugccuccacaaagaauggccucacagccgcaauuggagauguaacccgacauggugcuggggcgucgggaccggauguacaugcuguggcguggauguuaaggaccuguuuaccgaucauauguucgugaaguggaaagucgaguacaucaagacggaagccauugugugcguugagcuuaccucccaggagcggcaguguucucugaucgaagccgggacacgcuuuaaucucggacccgugaccaucacacugagcgagccuagaaacauucagcaaaaacugcccccugaaaucauuacccuucaccccaagaucgaggaaggcuucuuugaccugaugcauguccagaaagugcucuccgcuagcacaguuugcaagcugcagucuuguacgcacggcauuccgggggaccuccagguguaccauaucggaaaccugcuuaagggcgaucgggucaaugggcaccugauccacaaaauugagccucauuucaacaccuccuggaugagcugggacggaugcgaucuggacuauuacuguaauaugggcgauuggcccucuugcacauauaccggggugacccaacacaaccaugcggccuuugugaaucuccugaacaucgagacagacuacacgaagaccuuccacuuucacuccaaaagagucacagcucauggagauacaccccagcuugaccugaaggcccgcccuaccuauggcgccggcgaaauuaccguucucguggagguggcugauauggaacugcacacgaaaaaggucgagaucagcgggcucaaauucgccucucuggcgugcacaggauguuacgcuugcagcuccggcauuucuuguaaggugcggauccauguugacgagcccgaugaacuuaccgugcacgucaagagcuccgacccugaugugguugccgccgggaccagccugauggcuagaaaacuggaguucggaacagacuccaccuuuaaggccuucucugcgaugccgaaaacaagccucugcuuuuauauuguggaaaaggaguacuguaaauccugcucugaagacgauaccaagaagugugucgacacgaaacuggagcagccccaaagcauccuuaucgagcaucgcggcacaauuaucgggaagcagaaugauaccugcacagcuaaagccuccuguuggcuggaaucugugaagucuuucuuuuacggacucaaaaacaugcugggcuccgucuucggcaacuuuuucauugggauccuccuguuucuugccccuuucgugcugcugguucucuuuuucauguucggauggaagauucuguuuugcuucaaguguugccggagaacccgcggccuuuuuaaauaucggcaccugaaggacgaugaggaaacgggguacagacgcaucaucgagcggcucaauaauaaaaaggggaaaaacagacugcucgacggcgaacggcuggcugaucgcaagauugccgagcuuuucagcaccaagacacacaucggguga

SEQ ID NO: 13659 - RNA, 5049 nt, Artificial Sequence
  derived and/or modified CDS sequence (opt5) from CCHFV(Oman)__DQ211632.1__GP
augcacacccugcucguguacgccgucuucugccugcagcuuuggagccccggcgggacaagaggacuguccaacgagacgcaacauaaugaaaccggcaucacacgggcuccugaggggucucagggaccgagccuccccguuuccaccgccucuccuauuaugagcgaccccuccaucacaaccccuucugcgagcacauccggccuggaagggagcggagauaccacgcccccugcuauuacccagggcccgacacccccugagaccacacccgaaccuucuaccacgacaggcaccaacgccuuuuccacagccaucgcuaaugugagcacccagaccgugaaggacacacccacgccgaccguccaaacaucuccucccuccaccccugaugccagcacaauuccccaggggacccaccauacggcucgcggacuucugucugugacaguuaccaaacccgaggaggugccuaccccgacaggccccgaacaggccuccaucgagaccaacagcccuagacucgcgacauccaagacgcccucuccuagccccaccgcccaggucacaaccgaaaauuccaacccgaauacaagccggcaacuggugcugucuacccagccugcuacguccagccccguuaccucuccugcccagcucaucuucgugcagagcgcuacaaccgucgccgugcaagacgcgcaccccuccccuacaaaccgcucuaaaagaaaucuggagauggaggugauucuuacccugagccaggggcuccggaaguauuacggacgcauccugaaacuucuggaucucacgcuggaagaggacacagaaggccugcucgagugguguaagagaaaccuggggcuuaccugcgaugacaauuucuuccagaagcggauugaagaguuuuuccugacaggagagggccauuuuaacgaaguccuccaauucaaaacccccuccacccugagcucuacagaguccgccagcguuggccuuccgacgguggaaccuuuuaagucuuauuucgcuaaaggguuucuguccaucgauagcggauacuucuccgccaaguguuauccccgcgcuucuaauagcggccuccagcugauuaacgugacccagcacuccgccagaaucgccgacacacccgggccuaaaauuaccaaucugaagacaaucaacugcaucaaccucaaggcucuggucuuuaaagagcaccgggaaauugagaucaaugugcuucugccgcagguugcggugaaccucucuaauugucauguccacauuaagagccaugugugcgauuacucccuggacaucgauggaaccguucgccuucccagaauccaccacgagggcacguucaucccugggacauauaaaaucgugauugacaagaaaaacaagcaaaaugaccgguguaaccuggucaccaauugcgugaucaaaggacgcgaagucagaaagggccagagcgugcuccggcaguacagaaccgagauucgcaucggcaaggccucuuccgggagccggagacugcugucugaagaguccggagaagauuguauuagccgcacacagcuccugcggaccgagacagcugagauccauggcgacaacuacgggggacccggcgauaaaaucacgauuugcaaugggucuaccaucguugaccaaagacuuggcagcgaacugggauguuauacaauuaaccgcgugaaguccuucaaacucugcgagaauagcgccaccggcaagucuugcgaaaucgauaacacaccugucaaauguaagcagggguuuugccugaagauuacccaggagggacggggccacgugaaacuguccagagacagcgagguugugcuugaugccugugacuccucuugcgaaaucaugauucccaaggggacgggagauauccucgucgacuguagcggcgggcagcaacauuuccugaaagauaaucugaucgaccucggcugcccuaacauuccccugcuuggaaagauggcuaucuacauuugucgcauguccaaucacccgaaaaccacaauggccuuucuguucugguuuucuuucggcuaugugauuaccugcauucucuguaaggugaucuuuuaccugcugaucguugucgggacacuuggaaagaaauucaagcaguaucgggagcucaaaccucagaccugcacaauuugugaaaccacgcccgugaacgcgaucgacgcugagaugcaugaucugaacugcagcuacaauauuugcccuuauugugccuccagacugacaucugacggccucgcccgccacgugaugcagugccccaagcggaaagaaaagaucgaggagaccgaacuguaccuuaaccuggagcggauuccgugggucgugagaaagcuccugcaaguuagcgaauccaccgggguggcucugaaacgcagcucuuggcuuaucguccuccuggugcugcucacaguuucccugagcccugugcagucugcccccaucggacacggcaagaccauugagacguaccagacaagagaaggguauaccuccaucugucuuuuuguccugggcagcauucucuucaucgugucucaucugaugaaaggacugguugauuccgugggcaauagcuuuuucccugggcuuuccauuugcaagacauguagcaucggaucuaucaacggcuuugagauugagagccacaaaugcuucuguucccucuucugcugucccuacugccggcauuguucugcugacaaggaaauccacaaacugcaccugagcauuugcaagaagagaaaagccggguccaaugucaugcucgcggugugcaagcgcauguguuuucgggccaccauggaggugucuaacaaagcucugcuuaucagaagcgucauuaauacaaccuucguugugugcauccugauucucgccgugugugucguguccacgucugcuguugaaauggagagccugcccgccggaaccugggaacgcgaggaggaucugacaaacuuuugccaucaagaaugucaggugaccgagacagaaugccuuuguccuuaugaggcgcugguccucagaaagccgcuguuccucgacuccaucgccaaaggcaugaagaaucugcuuaacagcaccucucuggagacgucccucagcaucgaagcucccuggggcgccauuaaugugcagucuacauuuaagccuaccguuuccacagcuaacaucgcccugagcugguccucuguggagcaccgggggaauaaaauucuggucagcggacgcuccgaaagcaucaugaaacuugaggaaagaaccggcauuucuugggaucuggggguggaggacgccuccgagagcaagcuccugaccguuucugugauggaucucagccagauguacucccccgucuucgaauaucugucuggagaccggcaaguggaggaauggccuaaggcuacaugcacgggcgauugucccgagcgcugcggguguaccagcuccacaugccuucauaaagaauggccucacucuagaaacuggcggugcaauccgaccugguguuggggagugggcacaggcugcaccuguugcgggcuggacgucaaggaucucuuuacggacuacauguucguuaaguggaaaguggaguauaucaagacagaggcgaucgugugugucgaacugaccagccaggagcgccagugcucccugauugaagccggaaccagauuuaaccuuggccccgugacaaucacccugagcgagccucggaacauucagcaaaaacugcccccugaaaucguuacacugcauccccgcauugaggagggguucuuugaccucaugcacgugcagaagguccugucugcuuccacgguguguaaacuucagagcugcacccacggaguuccgggcgaucuccagguguaccauaucgggaaucugcucaagggagacaaggucaacggccaccugauccauaaaguggaaccucacuucaauacauccuggaugucuugggauggcugugaccuugauuacuauugcaacaugggggacuggcccagcuguaccuacacaggagucacccaacauaaucacgccgccuuugugaaccugcucaauauugagacggauuauaccaagaacuuccacuuccauuccaaaagaguuacagcucacggcgacacaccccagcuggaucucaaggcccggccuaauuacggggcgggagaagugaccguccugguggagguugcugacauggagcuucauaccaaaaagaucgaaauuucuggccugaaauuugccagccugacaugcacggggugcuaugccuguuccagcggaaucucuugcaaggugcgcauucacgucgaugagcccgacgaacucaccgugcacgugaaguccgaggauccugacaucguugcugccucuagcucccugauggcgagaaaacuugaauuuggcacagacagcaccuuuaaggcuuucucugccaugccgaaaaccagccuguguuuuuacauugucgagcgggaguauugcaaguccuguucuaaagaagauacacagaagugcgugaacgccaagcucgagagaccccaaagcauccugaucgaacauaaaggcacgauuaucgggaagcagaaugacaccuguacagcuaaagccuccugcuggcucgagagcgugaaguccuucuuuuacggacugaaaaacaugcuuucuggcauuuucgggaaugucuuuaucggaauuuuccuguuucuggcuccuuucauccuccugauccuuuucuuuauguucggcuggcgcauucuguuuuguuucaagugcugucggagaacccgcgggcucuuuaaguaccggcaccugaaagaugacgaagagacaggauauagaaagaucauugagcgccucaacaauaaaaagggcaaaaacaagcugcuugauggcgaacggcuggccgacagaaagaucgcggagcuguucagcaccaaaacgcauauuggguga

SEQ ID NO: 13660 - RNA, 5049 nt, Artificial Sequence
  derived and/or modified CDS sequence (opt5) from CCHFV(Oman_812956)__KY362518.1__GP
augcacacccugcucguguacgccgucuucugccugcagcuuuggagccccggcgggacaagaggacuguccaacgagacgcaacauaaugaaaccggcaucacacgggcuccugaggggucucagggaccgagccuccccguuuccaccgccucuccuauuaugagcgaccccuccaucacaacccugucugcgagcacauccggccuugaagggagcggagauaccacgccucccgcuauuacccagggcccuacacugccggagaccacacccgaaccuucuaccacgacaggcaccaacgccuuuuccacagccaucgcuaaugugagcacccagaccgugaaggacacacccacgccuaccguccaaacaucucccccguccaccccugaugccagcacaauuccccaggggacccaccauacggcucgcggacuccugucugugacaguuaccaaaccugaggaggugcccacccccacaggcccugaacaggccuccaucgagaccaacagcccgagacuggcgacauccaagacgcccucuccuagccccaccgcccaggucacaaccgaaaauuccaacccuaauacaagccggcaacucgugcugucuacccagcccgcuacguccagcccgguuaccucuccugcccagcuuaacuucgugcagagcgcuacaaccaucgccguccaagacgcgcaccccuccccuacaaaucgcucuaaaagaaaccuggagauggaggugauucucacccugagccaggggcuucggaaguauuacggacgcauccugaaacuccuggaucugacgcucgaagaggacacagaaggccugcuugagugguguaagagaaaucuggggcugaccugcgaugacaacuuuuuccagaagcggauugaagaguuuuuccugacaggagagggccauuuuaaugaagugcuucaauucaaaacccccuccacccugagcccuacagagucugccuccgucggccuccccacgguugaaccguuuaagagcuauuucgcuaaaggguuucugucuaucgauuccggauacuucagcgccaaguguuauccucgcgcuuccaacucuggccugcagcucauuaaugugacccagcacagcgccagaaucgccgacacacccgggcccaaaauuaccaaccugaagacaaucaacugcaucaaucuuaaggcucugguguuuaaagagcaccgggaaauugagaucaacguccuccugccucagguggcgguuaaucuuuccaacugucaugugcacauuaagucucaugucugcgauuacagccuggacaucgauggaaccgugcgccucccgagaauccaccacgagggcacguucauccccgggacauauaaaaucguuauugacaagaaaaauaagcaaaacgaccgguguaaucuggugaccaacugcgucaucaaaggacgcgaagugagaaagggccaguccguccugcggcaguacagaaccgagauucgcaucggcaaggccagcucugggucccggagacuccugagcgaagagucuggagaagauuguauuucccgcacacagcuucugcggaccgagacagcugagauccauggcgacaauuacgggggaccuggcgauaaaaucacgauuugcaacgggagcaccaucguggaccaaagacucggcucugaacugggauguuauacaauuaaucgcguuaagagcuucaaacugugcgagaacuccgccaccggcaagagcugcgaaaucgauaauacacccgugaaauguaagcagggguuuugccuuaagauuacccaggagggacggggccacgucaaacucucuagagacuccgaggugguucuggaugccugugacagcuccugcgaaaucaugauuccuaaggggacgggagauauccugguggacuguucuggcgggcagcaacauuuccucaaagauaaccugaucgaccuuggcugccccaauauuccucugcucggaaagauggcuaucuacauuugucgcaugagcaaccaccccaaaaccacaauggccuuucuguucugguuuuccuucggcuaugucauuaccugcauucuguguaaggugaucuuuuaccuucucaucgugguugggacacugggaaagaaauucaagcaguaucgggagcugaaaccgcagaccugcacaauuugugaaaccacgccugucaacgcgaucgacgcugagaugcaugaucucaauugcucuuacaacauuugccccuauugugccagcagacugacauccgacggccuugcccgccacgugaugcagugcccuaagcggaaagaaaagaucgaggagaccgaacuguaccucaaucuggagcggauucccuggguggucagaaagcugcuucaagugucugaaagcaccgggguugcucucaaacgcuccagcuggcugaucgugcugcucguccugcuuacagugucucuguccccgguucagagcgccccuaucggacacggcaagaccauugagacguaccagacaagagaaggguauaccucuaucugucucuuugugcugggcuccauucuguucaucgucagccaucuuaugaaaggacucguggauucuguuggcaacuccuuuuuccccgggcugagcauuugcaagacauguuccaucggaagcaucaauggcuuugagauugagucucacaaaugcuacuguagccuguucugcuguccuuauugccggcauuguuccgcugacaaggaaauccacaaacuccaccugucuauuugcaagaagagaaaagccgggagcaacgugaugcuugcggucugcaagcgcauguguuuccgggccaccauggagguguccaauaaagcucugcucaucagaucugugauuaacacaaccuuugucguuugcauccugauucuggccguguguguggucagcacguccgcuguggaaauggagucucuucccgccggaaccugggaacgcgaggaggaucugacaaauuucugccaucaagaaugucagguuaccgagacagaaugccucugucccuacgaggcgcuggugcucagaaagccucuguuuuucgacagcaucgccaaaggcaugaagaaccuucucaauuccaccagccucgagacgucucuguccaucgaagcuccguggggcgccauuaacguccagagcacauuuaagcccaccgugucuacagcuaauaucgcccuguccuggagcuccguugagcaccgggggaacaaaauucuugugucuggacgcagcgaauccaucaugaagcuggaggaaagaaccggcauuagcugggaucucggggucgaggacgccucugaguccaaacugcucaccgugagcguuauggaucugucucagauguauagcccuguguucgaauaccuuuccggagaccggcaagucgaggaauggcccaaggcuacaugcacgggcgauuguccugagcgcugcggguguaccucuagcacaugccugcauaaagaauggccccacuccagaaauuggcggugcaacccuaccugguguuggggagugggcacaggcugcaccuguugcgggcucgacgugaaggaucuguuuacggacuauauguucgucaaguggaaaguugaguacaucaagacagaggcgaucguguguguggaacugaccucucaggagcgccagugcagccuuauugaagccggaaccagauuuaaccugggcccggucacaaucacccucuccgagccccggaauauucagcaaaaacugccucccgaaaucgugacacuccauccucgcauugaggagggguucuuugaccugaugcacguucagaaggugcuuagcgcuucuacggucuguaaacugcaguccugcacccacggagugcccggcgaucugcagguuuaccauaucgggaaccuccugaagggagacaaggugaauggccaccuuauccauaaagucgaaccgcacuucaacacaagcuggauguccugggauggcugugaccuggauuauuacugcaauaugggggacuggccuucuuguaccuauacaggagugacccaacauaaccacgccgccuuugucaaucuccugaacauugagacggauuacaccaagaauuuccacuuccauagcaaaagagugacagcucacggcgacacaccccagcucgaucugaaggcccggcccaacuauggggcgggagaaaucaccguucuuguggaggucgcugacauggagcugcauaccaaaaagauugaaaucuccggccugaaauuugccucucucacaugcacggggugcuacgccuguagcuccggaauuagcugcaaggugagaauccacguugaugagccugacgaacugaccgugcacgucaagucugaggaucccgacauuguggcugccuccagcucucuuauggcgcgcaaacuggaguucggcacagacuccaccuuuaaggcuuucagcgccaugccuaaaaccucucucuguuuuuauaucguggagcgggaguacugcaagagcuguuccaaagaagauacacagaagugcguuaaugccaagcuggagagaccgcaaucuauccucauugaacauaaaggcacgaucauugggaagcagaacgacaccuguacagcuaaagccagcugcuggcuggaguccgucaagagcuucuuuuacggacuuaaaaauaugcuguccggcaucuucgggaacguguuuauuggaaucuuccuguuucucgcucccuucauccugcuuauucuguucuuuauguucggcuggcgcauccucuuuuguuucaagugcugucggagaacccgcgggcuguuuaaguaucggcaccucaaagaugacgaagagacaggauacagaaagauuaucgagcgccugaauaacaaaaagggcaaaaacaaacuucuggauggcgaacggcuggccgacagaaagauugcggaacucuucucuaccaagacgcauaucggguga

SEQ ID NO: 13661 - RNA, 5049 nt, Artificial Sequence
  derived and/or modified CDS sequence (opt5) from CCHFV(Oman-199809166)__KR864901.1__GP
augcacacccugcucguguacgccgucuucugccugcagcuuuggagccccggcgggacaagaggacuguccaacgagacgcaacauaaugaaaccggcaucacacgggcuccugaggggucucagggaccgagccuccccguuuccaccgccucuccuauuaugagcgaccccuccaucacaacccugucugcgagcacauccggccuugaagggagcggagauaccacgccucccgcuauuacccagggcccuacacugccggagaccacacccgaaccuucuaccacgacaggcaccaacgccuuuuccacagccaucgcuaaugugagcacccagaccgugaaggacacacccacgccuaccguccaaacaucucccccguccaccccugaugccagcacaauuccccaggggacccaccauacggcucgcggacuccugucugugacaguuaccaaaccugaggaggugcccacccccacaggcccugaacaggccuccaucgagaccaacagcuccagacuggcgacaucuaagacgccgagccccuccccuaccgcccaggucacaaccgaaaauagcaaccccaauacaucucggcaacucgugcuguccacccagccugcuacgagcucucccguuaccagcccggcccagcuuaacuucgugcaguccgcuacaaccaucgccguccaagacgcgcacccuucucccacaaaucgcagcaaaagaaaccuggagauggaggugauucucacccugucccaggggcuucggaaguauuacggacgcauccugaaacuccuggaucugacgcucgaagaggacacagaaggccugcuugagugguguaagagaaaucuggggcugaccugcgaugacaacuuuuuccagaagcggauugaagaguuuuuccucacaggagagggccauuuuaaugaagugcuucaauucaaaaccccuagcacccugucucccacagaguccgccagcgucggccucccuacgguugaacccuuuaagucuuauuucgcuaaaggguuucuguccaucgauagcggauacuucuccgccaaguguuauccgcgcgcuucuaacagcggccugcagcucauuaaugugacccagcacuccgccagaaucgccgacacaccugggcccaaaauuaccaaccugaagacaaucaacugcaucaaucuuaaggcucugguguuuaaagagcaccgggaaauugagaucaacguccuccugccccagguggcgguuaaucuuucuaacugucaugugcacauuaagagccaugucugcgauuacucccuggacaucgauggaaccgugcgccucccuagaauccaccacgagggcacguucaucccggggacauauaaaaucguuauugacaagaaaaauaagcaaaacgaccgguguaaucuggugaccaacugcgucaucaaaggacgcgaagugagaaagggccagagcguccugcggcaguacagaaccgagauucgcaucggcaaggccucuuccgggagccggagacuccugucugaagaguccggagaagauuguauuagccgcacacagcuucugcggaccgagacagcugagauccauggcgacaauuacgggggacccggcgauaaaaucacgauuugcaacgggucuaccaucguggaccaaagacucggcagcgaacugggauguuauacaauuaaucgcguuaaguccuucaaacugugcgagaacagcgccaccggcaagucuugcgaaaucgauaauacaccugugaaauguaagcagggguuuugccuuaagauuacccaggagggacggggccacgucaaacucuccagagacagcgaggugguucuggaugccugugacuccucuugcgaaaucaugauucccaaggggacgggagauauccugguggacuguagcggcgggcagcaacauuuccucaaagauaaccugaucgaccuuggcugcccuaauauuccccugcucggaaagauggcuaucuacauuugucgcauguccaaccacccuaaaaccacaauggccuuucuguucugguuuucuuucggcuaugucauuaccugcauucuguguaaggugaucuuuuaccuucucaucgugguugggacacugggaaagaaauucaagcaguaucgggagcugaaaccccagaccugcacaauuugugaaaccacgccggucaacgcgaucgacgcugagaugcaugaucucaauugcagcuacaacauuugcccuuauugugccuccagacugacaucugacggccuugcccgccacgugaugcagugccccaagcggaaagaaaagaucgaggagaccgaacuguaccucaaucuggagcggauuccuuggguggucagaaagcugcuucaagugagcgaauccaccgggguugcucucaaacgcagcucuuggcugaucgugcugcucguccugcuuacagugucccugagccccguucagucugccccgaucggacacggcaagaccauugagacguaccagacaagagaaggguauaccuccaucugucucuuugugcugggcagcauucuguucaucgucucucaucuuaugaaaggacucguggauuccguuggcaacagcuuuuucccugggcuguccauuugcaagacauguagcaucggaucuaucaauggcuuugagauugagagccacaaaugcuacuguucccuguucugcugucccuauugccggcauuguucugcugacaaggaaauccacaaacuccaccugagcauuugcaagaagagaaaagccggguccaacgugaugcuugcggucugcaagcgcauguguuuccgggccaccauggaggugucuaauaaagcucugcucaucagaagcgugauuaacacaaccuuugucguuugcauccugauucuggccguguguguggucuccacgucugcuguggaaauggagagccuuccugccggaaccugggaacgcgaggaggaucugacaaauuucugccaucaagaaugucagguuaccgagacagaaugccucugucccuacgaggcgcuggugcucagaaagccccuguuucuugacuccaucgccaaaggcaugaagaaccugcucaauagcaccucucuggagacgucccugagcaucgaagcuccuuggggcgccauuaacguccagucuacauucaagccgaccguguccacagcuaauaucgcccuuagcugguccucuguugagcaccgggggaacaaaauucuggugagcggacgcuccgaaagcaucaugaagcucgaggaaagaaccggcauuucuugggaucugggggucgaggacgccuccgagagcaaacuccugaccgugucuguuauggaucuuagccagauguauucccccguguuugaauaccugucuggagaccggcaagucgaggaauggccuaaggcuacaugcacgggcgauugucccgagcgcugcggguguaccagcuccacaugccuccauaaagaauggccucacucuagaaauuggcggugcaaccccaccugguguuggggagugggcacaggcugcaccuguugcgggcuggacgugaaggaucuguucacggacuauauguuugucaaguggaaaguugaguacaucaagacagaggcgaucguguguguggaacuuaccagccaggagcgccagugcucccugauugaagccggaaccagauucaaccucggcccugucacaaucacccugagcgagccgcggaauauucagcaaaaacugcccccugaaaucgugacacuccauccccgcauugaggagggguuuuucgaccuuaugcacguucagaaggugcugucugcuuccacggucuguaaacugcagagcugcacccacggagugccuggcgaucuccagguuuaccauaucgggaaccugcuuaagggagacaaggugaauggccaccugauccauaaagucgaaccccacuuuaacacauccuggaugucuugggauggcugugaccucgauuauuacugcaauaugggggacuggccgagcuguaccuauacaggagugacccaacauaaccacgccgccuucgucaaucugcucaacauugagacggauuacaccaagaauuuucacuuccauuccaaaagagugacagcucacggcgacaccccucagcuggaucuuaaggcccggcccaacuauggggcgggagaaaucacaguucugguggaggucgcugacauggagcugcauaccaaaaagauugaaaucucuggccucaaauucgccagccugacaugcacggggugcuacgccuguuccagcggaauuucuugcaaggugagaauccacguugaugagcccgacgaacuuaccgugcacgucaaguccgaggauccugacauuguggcugccucuagcucccugauggcgcgcaaacucgaauuuggcacagacagcaccuucaaggcuuuuucugccaugcccaaaaccagccuguguuucuauaucguggagcgggaguacugcaaguccuguucuaaagaagauacacagaagugcguuaaugccaagcucgagagaccucaaagcauccugauugaacauaaaggcacgaucauugggaagcagaacgacaccuguacagcuaaagccuccugcuggcuugagagcgucaaguccuuuuucuacggacugaaaaauaugcugucuggcaucuuugggaacguguucauuggaaucuuucucuuccuggcuccguuuauccuucugauucucuucuucauguuuggcuggcgcauccuguucuguuuuaagugcugucggagaacccgcggacucuucaaguaucggcaccugaaagaugacgaagagacaggguacagaaagauuaucgagcgccuuaauaacaaaaagggcaaaaacaagcugcuggauggcgaacggcucgccgacagaaagauugcggagcuguuuagcaccaaaacgcauaucggguga

SEQ ID NO: 13662 - RNA, 5055 nt, Artificial Sequence
  derived and/or modified CDS sequence (opt5) from CCHFV(BA66019)__AF350448.1__GP
auguacacccugcucgugugcgccguccuguguccccagcuuuggagccuggagggcacacacguuccucauaacgaaacgaagcacaaugggaccggaaucacagcugccccgggcgagucccaagggcccaugucuccugcgagcaccgcugugccccucacaccugaacccccuaacaccaaaccggccgccuccgcuucugagcuggaaagcuccggagagggccauacaucucuucuggccaccacgcaggggcucaccagccccgaggcuacaccugaacugcccaccacaaccgacacgggaguguccagcacaucugucguggauauuggcacccagauggccaaggacacaccuaccuccaccgcgcacacaagccugcccucuaauccguccgccccuagcacggcucagggcacccaucacacaaucagagggcuccugucuguuaccuccacaaaacccgaggaagccagcaccccuacggaucccggaaaggcuggcgccgagacagggagcccccggccugcgauuucucgcaaaccgacccuuagccccaccgccgaggcuccuacagaaaucaacaauuccagcacccccaagcaaccugagcccucuauucagccggccacaccuucccuggugaucagccccgcucagccugccuucccccagucugccacgagcaccgcugcgcaagacaucuauuccucuccuacaaacagaagcaagcggaaucucaaaauggaaauuauccugacccuuucccagggacugaagaaauacuauggcaagauucagaaaacacucgggcugacccuggaggaagauacggagggacuccuggaguggugcaagcgcaaccuuggccugaccugugacgauaacuuuuuccagaagagaaucgaagaguuuuuccucacaggcgaaggguacuuuaaugagguccugcaauucaaaacccccagcacaccgggaucuaccgaaccuacgcacgccgaggcucccacagugaagcccuuuaaauccuauuucgcccggggcuuucuuaccauuaauagcggguacuucucugccaagugcuauuccuggacaagcaacuccggacugcagcucaucaauguuacccagcauccugcucgcauugccgacaccccgggccccaaaaucacaaaccugaagacgaucaauuguauuaaccugaaagcgucuguguuuaaggagcacagagaaaucgagauuaacguccuccugccucaaguggcugugaaucuuagcaacugccauguccugaucaagucccacguuugugauuacucucucgacauugaugggaccauccggcugccccgcaucuaccacgaaggaacauucauuccuggcaccuauaaaaucgugauugacaagagagauaaacagaaugaccggugcacacuugugaccaacugugucaucaagggccgcgaggugagaaaagggcagagcgcccugcggcaguaccgcacggaaauuagaaucggaaaggccuccgcuggcagccggagacuccugucugaggaguccggggacgauugcaucagccgcacacaacugcuccggaccgaaaccgccgagguucauggagacaauuauggcgggcccggcgauaagauuacaaucuguaacggaucuaccauuguggaccagagacugggcuccgaacuugggugcuacacaaucaaucgcgucaaauccuuuaagcugugcgagaacucuggaacgggcaaaagcuguaagauugauaaacacccugugaagugccggcagggguucugucucaagaucacccaggagggaagaggccauguuaaacugucccgcgggagcgaagugguccuggacgcuugcgauucuuccugugagauuaugauccccaagggcacaggagacauccuuguggauugcagcggcgggcaacagcacuuccucaaagacaaucuggucgaucugggauguccgaacauuccucuccugggcaagauggccaucuauauuugccggauguccaaucaucccaaaaccacaauggcguuucuuuucugguuuucuuucggguacgugaucaccuguaucuuuugcaagauuaucuucuaucugcucauuguugugggaacgcugggcaagaaauuuaagcaguacagagaacugaaaccucagaccuguacaaucugcgagaccacacccaccaacgccauugacgcugaaaugcacgaccuuaagugcagcuacaauaucuguccguauugcgccucccgccucacaucugaugggcuggcucggcacgucacccaauguccuaaaagaaaggagaaaguggaggaaacggagcuguaccucaaccuggaacgcauucccuggaucguucggaagcugcuucaggugagcgaguccacaggcgucgcccucaagagaucuagcuggcugaucgugcugcuugugcuccugaccguuucccugagcccuguccagucugcgcccauuggacauggcaaaaccaucgaagccuaucagacacgggagggguacaccuccgugugccucuucaugcugggaggcauucuuuuuguggucagcugucugaugaaggggcucguggacucuguuuccaauagcuucuuucccggacugucuaucugcaaaacguguuccauuggcagcgugaacggguucgagaucgaaucccacaagugcuauuguagccugcuuugcugucucuacugccgccauugcucugcugauagagagauccaccaacugcaccugagcauuuguaaaaagcggagagccggcggaaacgucaugcucgcugugugcaagcgcaugugucugcgggccacaauggaaguuuccaauaaagugcuuuuuaucagaucuauuaucaacaccacauucgucauuugcauccuggugcucgccguuuguauugugagcaccuccgcugucgagauggaaucucugccugcgggcacaugggagcgcgaggaagaccugaccaauuucugccaucaggagugucaggugacggaaaccgagugccuuuguccguaugaggcccuggugcucagaaagccccuguuuagcgauuccaucgucaaagggaugaagaaccuccugaauagcacaagccuugaaaccucccugagcaucgaggcuccuuggggagccauuaacguucaaucuacauucaaacccaccguguccacggccaauaucgcucucagcuggucuuccguggaacaccggggcaacaagauucuggucagcgggcgcuccgagucuaucaugaagcuggaagagagaacaggaauuagcugggaccuuggcguggaggaugccuccgaaagcaaacugcucaccguuucugugauggaccugucccagauguacagcccugucuuugaguaccucucuggcgaucgccagguggaagaguggcccaaggcgacaugcaccggggacuguccugaucggugcggaugcaccagcuccacaugucugcauaaagaauggccgcacucuagaaauuggcggugcaaccccacgugguguuggggcguugggaccggaugcacauguugcggccuugacgugaaggaucuguucaccgacuauauguuugucaaauggaagguggaguacaucaagacagaggcuaucguuuguguggaacucaauagccaggagcgccaaugcucccugauugaagccgggaccagauucaaccugggaccugucacgaucacacuuucugagccccggaauauucagcagaaacugccucccgaaaucauuacccuccauccgcgcaucgaggagggcuuuuucgaccugaugcacgugcagaaggugcucagcgccuccaccgucuguaaacugcaaagcugcacacacggcguuccuggggaucuucagaucuaucauauuggaaaccugcugaagggcgacagagugaaugggcaccucauccauaaaauugaaccccacuuuaacaccucuuggauguccugggauggaugugaccuggauuacuauugcaacaugggcgacuggcccagcugcacauacacgggggugacccagcauaaucacgcugccuucgucaaccuucugaauaucgagacagauuauaccaagaacuuucacuuccauuccaaacgggugacagcgcacggagacaccccucagcucgaucugaaggcuagacccacguacggcgccggcgaaauuaccguucucguggaggucgccgacauggagcugcauacaaagaaaaucgcuauuucugggcuuaaguuugccagccugaccuguacaggaugcuacgcuuguuccucuggcaucagcugcaaagugcgcauccacguugaugaaccugacgagcugaccgugcacgucaaguccgaagauccggacauuguggccgcgucuucuucccucauggcccggaaacuggaguucgggacagacagcacguucaaggcuuuuucugccaugcccaagaccucccuuuguuucuauaucgucgaaagagaguacugcgagagcuguucuaaagaagauacacaaaagugcgugaauaccaaacuggagcagccucagagcauucucaucgaacauaagggaaccauuaucggcaaacaaaacgacacauguacggcuaaggccuccugcuggcuggagucuguuaagagcuuuuucuaugggcucaaaaauaugcuguccggaaucuuuggcaacguguucauuggcaucuuucuuuuccuggcccccuuuauucugcucauccuguucuuuauguucggguggcgcauucuuuucuguuuuaagugcugccggagaacccgcggacuguucaaauaccgguaucucaaggaugacgaagagagcggcuacagacgcaucaucgagcggcugaauaacaaaaaggggaagaauaaacuccuggauggagaaagacuugcugaccggcgcauugcggagcuguuuuccacaaagacccacaucggcuga

SEQ ID NO: 13663 - RNA, 5055 nt, Artificial Sequence
  derived and/or modified CDS sequence (opt5) from CCHFV(SPU 18/88)__KJ682810.1__GP
auguacacaccccugcucugcgccauccugugucuucagcuguggagccucgagggcauuuaugggcuguccaacaagacccaacacaaugacacgucuaccaucaaagugccugaggagagccagaagacaucccuuccggcuaacaccgccucucccauuacaagcgauccuuccucugcgaccagcacagcucuggccuccggacccgaaggcagcggggacaccucuacguccccuagcgucaccacacagggacccacccuccuggagacaaccccugaaccgcauacgacaaucgauauugacgagucuuccaccgccaucgcugauaucagcacacagaccguuaaagacauucccaccccuacaacgcacaccucucugcccuccacaccuagcgcccccaccaucccgcaagaggcucaucacacagccagaggccuccuguccgugaccucuacgaagccuggggaaacaagcacccccaccuccccuggagaggcgagcacagaagccucuagcccccagcccaccauuuccgagacaccuucuccgcccccuacgacccaggcucccacagagaucaauaacccuaauaccagccggcagcccaugccguccacacaaccugccgcucccaacucugugaccccucccguccagccuacguucagccaguccgaugugagcaccguugcccaggacauucaucccucuccgacaaaucgcuccaaaagaaaccuugaaauggagaucauucugacccucagccaaggccugaagaaguacuauggcaaagugcuuaagcugcucgaucugacacuggaagaggacaccgaagggcuccuggaguggugcaaacggaaucuuggacugacgugugaugacaacuuuuuccagaagcgcaucgaggaauuuuuccucacaggcgaggggcacuuuaaugaaguccugcaguucaaaaccccuucuacacuuucccccaccgagcccgcgagaguggaaagcccuaccguugagccguuuaaguccuacuucgccaagggauuucugucuauggauagcggcuauuucuccgcuaaaugcuaccccaagucuagcaacuccgggcuccaacugaucaaugugacacagcacagcauucggaucacggacaccccuggacccaaaauuacaucucugaagaccaucaacuguauuaaucucaaagcccuggucuuuaaggagcaucgcgaaaucgagaucaacgugcuucugccucagguggcugucaaccucuccaauugccacguucugauuaaaagccaugccugugacuauucucuugauaucgacggccccgugagacugccucggauucaccacgaaggcacauucauccccgggaccuacaagauugugaucgauaagaaaaacaagcagaaugaccgcugcacgcucgucacaaacugugugaucaaaggaagagagauucggaagggccaauccguucugcgccaguacagaaccgaaaucaaaauugggaaggccagcucuggaagccggcgccugcucuccgaggagagcaaugaugacugccugucuagaacccagcuucugcggacagaaaacgcugagauccauuccgauaauuauggcgggccgggagacaagauuaccaucuguaacggcagcacaauuguggaucagagacucggcuccgaacuggggugcuacacgaucaaucgcgucaaaucuuuuaagcugugcgagaacagcgcgaccggaaaauccugugagaucgacucuacaccugugcggugcagacaaggcuucugucuuaagauuacccaggaagggcgcggacacguuaaacucagccggggcuccgaggugguccuggaugccugcgacucuagcugugaaaucaugauucccaaggggacaggcgacauccugguggauugcuccggaggccagcagcauuuccucaaggacaaucuggucgaucuuggguguccuaacauuccccugcucggaaaaauggcuaucuauaucugcagaaugagcaaucacccgaagaccacgaugggcuuucuguucugguuuucuuucggguacgugauuaccuguauccugugcaaaguuaucuuuuaucuucucauuguggucggaacacugggcaagaaauucaagcaauaccgcgagcugaagccucagaccuguacaauuugcgaaaccaaccccgugaaugccaucgacgccgagaugcaugaucucaacugcuccuauaacaucuguccuuacugcgcuagccggcugacaucugacgggcuugccagacacguuaugcagugucccaaacgcaaggagaaaauugaagagaccgaacuguaccucaaucuggagcggauccccuggguggucagaaagcugcuucagguguccgaaagcacgggcguggcgcucaaaagaucuuccuggcugguuauucugcucguccugcuuacagugagccuguccccugugcaaagcgcuccgaucucucacggagagaccgucgagguguaucagacccgggaaggcuacacaagcauuugccucuuuguucugggguccauccuguuccuugugucuugucucaugaagggacuggucgauagcgugggcaacuccuuuucucccgggcugagcaucugcaaaaccuguuccauuggaucuaucaauggcuucgagauugaaagccauaagugcuauuguucccucuuuugcuguccuuacugcagacacugcagcgccgacaucgagauucauaagcugcaccuuucuaucuguaaaaagcggaaaacgggguccaacguuaugcuggccgugugcaagcgcauguguuucagagcuacagucgaagugagcaauaaagcccuccugauucggaacaucaucaauaccacauuuguugugugcauucugauccuugcugucuguguggugucuaccuccgccgucgagauggagaaccugcccgcgggcacaugggaaaaggaggaagaucucaccaauuucugccaccaggagugucaaguuacggagaccgaaugccuguguccuuaugaggcccucgugcugagaaagccccuuuuccuggacagcauugugaaaggaaagaaaaaccuccuuaauuccacaucucuggaaaccagccuuuccaucgaggcuccuuggggcgccauuaacguccagagcacauuuaagccgaccgugucugcugccaauaucgcgcuguccuggagcucuguugaacaucgcgggaacaaaauccucgugagcggacgguccgagucuauuaugaagcuggaggaaagaacgggcaucagcugggaucucggggucgaggacgccuccgaaucuaagcugcuuacagugagcguuauggaucugucccagauguacagccccguguucgaguaucucucuggagaccgccaggucgaagaguggccuaaagcuaccugcacaggcgacugucccgagagaugcgggugcaccuccagcaccugucugcacaaggaauggccucauucccggaauuggcgcugcaaccccacaugguguuggggcgugggaacgggcugcaccuguugcgggcuggauguuaaagaccuuuuuacagauuacauguucgugaaguggaaagucgacuacauuaagaccgaggccaucguguguguggaacugacaucucaagagagacagugcagccucauugaagcuggaacccgguuuaaccugggcccggucacgaucacacucuccgagccucgcaauauccagcagaagcugccucccgagauuguuacccuucaccccagaaucgaagagggguucuuugaucugaugcauauucaaaaagugcugucugccagcaccguguguaagcuccaguccugcacacacggaguccccggcgaccugcagaucuaucacauuggcaaccuucugaaaggggauaaggugaauggacaucucauccacaaaauugaaccucauuucaacaccagcuggaugucuugggacggcugugaucuggacuacuauugcaauaugggggauuggccguccugcagcuacacaggaguuacgcagcacaaccaugccgcuuuugugaauaugcucaacaucgagaccgacuauacaaagaauuuccacuuucacucuaaacgggucaccgcgcauggcgauacaccccaacuggaccuuaaggcccgcccuaccuacggggcuggagagaucacggugcugguugaaguggccgacauggagcugcacaccaagaaaauugaaaucuccggccucaaguucgccagccugacauguaccggcugcuaugcuuguucuagcgggauuuccugcaaagucagaauccauguggaugagcccgacgaacuuacaguccacgugaagucugaggauccugacauuguugccgcgagcuccagccugauggcucggaaacucgaguuuggaaccgauuccacauucaaggccuucucugccaugcccaagacgagccuguguuuuuacaucguggaacgcgaguacugcaaauccuguucuaaggaagacacccagaaaugcgucaacacaaagcucgagcagccgcaaagcauccugauugaacacaaaggcaccaucauugggaagcagaaugauaccuguacaggaaaggcuggcugcuggcuugaguccaucaaaucuuucuuuuaugggcugaagaacaugcugagcggaauuuucggcaauguguuuaucggcaucuuccucuuucuggccccuuucauuaugcuuauccuguuuuucauguuuggguggcgcauucucuucuguuucaaaugcugccggagaacgcgcggacuguuuaaguaccggcaucucaaagacgaugaggaaaucggcuauagaaagauuaucgagcgccugaagaacaaaaaggggaaaaauaagcugcuggacggagaacggcuggcggauagaaaaauugcugaacucuucuccaccaagacacacaucggcuga

SEQ ID NO: 13664 - RNA, 5055 nt, Artificial Sequence
  derived and/or modified CDS sequence (opt5) from CCHFV(66019)__AB069669.1__GP
auguacacccugcucgugugcgccguccuguguccccagcuuuggagccuggagggcacacacguuccucauaacgaaacgaagcacaaugggaccggaaucacagcugccccgggcgagucccaagggcccaugucuccugcgagcaccgcugugccccucacaccugaacccccuaacaccaaaccggccgccuccgcuucugagcuggaaagcuccggagagggccauacaucucuucuggccaccacgcaggggcucaccagccccgaggcuacaccugaacugcccaccacaaccgacacgggaguguccagcacaucugucguggauauuggcacccagauggccaaggacacaccuaccuccaccgcgcacacaagccugcccucuaauccguccgccccuagcacggcucagggcacccaucacacaaucagagggcuccugucuguuaccuccacaaaacccgaggaagccagcaccccuacggaucccggaaaggcuggcgccgagacagggucccccagaccugcgauuucucgcaaaccgacccuuagccccaccgccgaggcuccuacagaaaucaacaauuccagcacccccaagcaaccugagcccucuauucagccggccacaccuucccuggugaucagccccgcucagccugccuucccccagucugccacgagcaccgcugcgcaagacaucuauuccucuccuacaaacagaagcaagcggaaucucaaaauggaaauuauccugacccuuucccagggacugaagaaauacuauggcaagauucagaaaacacucgggcugacccuggaggaagauacggagggacuccuggaguggugcaagcgcaaccuuggccugaccugugacgauaacuuuuuccagaagagaaucgaagaguuuuuccucacaggcgaaggguacuuuaaugagguccugcaauucaaaacccccagcacaccgggaucuaccgaaccuacgcacacagaggcccccaccgugaagcccuuuaaauccuauuucgcucggggcuuucuuacaauugacagcggguacuucucugccaagugcuauucccgcaccagcaauuccggacugcagcucaucaacguuacccagcauccugccagaauugcugauacaccgggccccaaaaucacgaaucugaagaccaucaacuguauuaaucugaaagccucuguguuuaaggagcaccgggaaaucgagauuaacguccuccugccucaaguggcggugaaccuuagcaauugccauguccugaucaagucccacguuugugacuacucucucgauauugacgggacaauccgccugcccagaaucuaccacgaaggaaccuucauuccuggcacauauaaaaucgugauugauaagcgggacaaacagaacgaccgcugcacccuugugacgaauugugucaucaagggcagagaggugcggcgcgggcagagcgcucugagacaguaccggacagaaauuagaaucggaaaagccuccgccggcagccgccggcuccugucugaggaguccggggaugacugcaucagcagaacccaacugcuccgcaccgaaacagcugagguucauggagauaacuauggcgggcccggcgacaagauuaccaucuguaauggaucuacaauuguggaucagcggcugggcuccgaacuugggugcuacacgaucaacagagucaagagcuuuaaacugugcgaaaauucuggaaccggcaagagcuguaaaauugacaacacaccugugaagugccgccagggguucugucucaaaaucacccaggagggacggggccacguuaagcuguccagagggagcgaagugguccuggaugccugcgacucuuccugugagauuaugauccccaagggcacaggagauauccuuguggacugcagcggcgggcaacagcauuuccucaaagauaaucuggucgaccugggauguccgaacauuccucuccugggcaagauggcuaucuauauuugccgcauguccaaucaccccaaaaccacgauggccuuucuuuucugguuuucuuucggguacgugaucaccuguaucuuuugcaagauuaucuucuaucugcucauuguugugggaacacugggcaaaaaguuuaagcaguaccgggaacugaaaccucagaccuguacaaucugcgagaccacacccaccaacgcgauugacgccgaaaugcaugaucuuaagugcagcuacaauaucuguccguauugcgcuuccagacucacgucugacgggcuggcccgccacgucacacaauguccuaaacggaaggagaaaguggaggaaaccgagcuguaccucaaccuggaacggauucccuggaucguucggaagcugcuucaggugagcgaguccaccggcgucgcucucaaacgcucuagcuggcugaucgugcugcuugugcuccugacaguuucccugagcccuguccagucugcccccauuggacacggcaagaccaucgaagcguaucagacgagagagggguacacauccgugugccucuucaugcugggaggcauucuuuuuguggucagcugucugaugaaggggcucguggauucuguuuccaauagcuucuuucccggacugucuaucugcaaaaccuguuccauuggcagcgugaacggguucgagaucgaaucccauaagugcuauuguagccugcuuugcugucucuacugccggcacugcucugccgacagagagauccaucaacugcaccugagcauuuguaaaaagcgccgggcuggcggaaacgucaugcucgccgugugcaaaagaaugugucugcgcgcuacaauggaaguuuccaauaaggugcuuuuuaucagaucuauuaucaacaccacauucgucauuugcauccuggugcucgccguuuguauugugagcaccuccgccgucgagauggaaucucugccugcuggcacgugggagcgggaggaagaucugaccaauuucugccaccaggagugucaggugacagaaaccgagugccuuuguccguaugaggcgcuggugcuccgcaagccccuguuuagcgacuccaucgucaaagggaugaagaaccuccuuaauucuacaagccuggaaaccucccugagcaucgaggccccuuggggagcuauuaacguucaaucuacguucaaacccacaguguccaccgccaauaucgcccucagcuggucuuccguggaacauagaggcaacaagauucuggucagcgggcgguccgagucuaucaugaaacuggaggagcgcacaggaauuagcugggaucuuggcguggaggacgcuuccgaaagcaagcugcucaccguuucugugauggaucugucccagauguacagcccugucuuugaguaccucucuggcgacagacagguggaagaguggcccaaggcgaccugcacagggaauuguccugaucggugcggaugcacgagcuccaccugucugcacaaagaauggccgcauucucgcaacuggagaugcaaucccacaugguguuggggcguugggaccggaugcacauguugcggccuugacgugaaggaucuguucaccgacuauauguuugucaaauggaagguggaguacaucaaaacggaggccaucguuuguguggaacucaacagccaggagcggcaaugcucccugauugaagcugggacacgcuucaaucugggaccugucaccaucacccuuucugagcccagaaacauucagcagaagcugccuagcgaaaucauuacacuccacccccggaucgaggagggcuuuuucgaccugaugcaugugcagaaggugcucuccgccagcaccgucuguaaacugcaaucuugcacacacggcguuccgggggaucuucagaucuaucacauuggaaaucugcugaagggcgacagagugaacgggcaucucauccacaaaauugaaccucauuuuaacacguccuggaugagcugggauggaugugaccuggauuacuauugcaauaugggcgacuggcccuccugcaccuacacaggggugacccagcacaaccaugccgcuuucgucaaucuucugaacaucgagacagauuauaccaagaauuuucacuuccacucuaaacgcgugacggcccauggagacacaccccagcucgaucugaaggcgcggccuacauacggcgcuggcgaaauuaccguucucguggaggucgccgacauggagcugcacaccaaaaagaucgccauuagcgggcuuaaguuugcuucccugaccuguacaggaugcuacgccuguucuagcggcaucuccugcaaagugagaauccauguugaugaacccgacgagcugacggugcacgucaagagcgaagauccugacauuguggcugccucuuccagccucauggcgcgcaaacuggaguucgggaccgacucuacauucaaggccuuuuccgcuaugccgaaaaccagccuuuguuucuauaucgucgaacgggaguacugcgagucuuguagcaaggaagauacccaaaagugcgugaacacaaaacuggagcagccccaguccauucucaucgaacacaagggaacgauuaucggcaaacaaaaugacaccuguacagccaaggcuucuugcuggcuggagagcguuaaauccuuuuucuaugggcucaagaacaugcugagcggaaucuuuggcaauguguucauuggcaucuuucuuuuccuggccccuuuuauucugcucauccuguucuuuauguucggguggcgcauucuuuucuguuuuaagugcugcagacggaccagaggacuguucaaauaccgcuaucucaaggaugacgaagaguccggcuaccggagaaucaucgagcggcugaacaauaaaaaggggaaaaacaagcuccuggauggagaacgccuugccgacagacggauugcugagcuguuuucuacaaagacccauaucggcuga

SEQ ID NO: 13665 - RNA, 5052 nt, Artificial Sequence
  derived and/or modified CDS sequence (opt5) from CCHFV(Gaib)__KX013445.1__GP
auguacaucccccugguguaugccgucauuuaccuccagcuguauggccuugggggagcucacggccugcucaacaagaccgagcaaaaugaaacagggaucacggccacccauggaagaguucagggcccuccgagcgcguccauuacacugcccgugaccccugacccccuuucugcuacaagcgccgccuccaccucugggccugagggaagcggcgaagugcccacauccccuucuaccaucacgcagggccugaccagcuccgagaacacaccgcagcuccccaccgcuacagauaccgggauuagcucuacguccaucaucgacgucagcacacaaaccgccggagauacaucuaccccuaccgcucacacaucccugcccaauagcccuucugcccccuucacgucccaggacacccggcauacagugcgcggccugcucaccguuacaagcaccaaauccgaugaagcgucuacgcugacagacccgaaggaggccagcaccgaggcuagauccccuagccccucuauuucccggaccccuacacccagccccaccgugcaggccucuacagaaaacaauacgccuagcaccccgcgccagcccgagccuacaaccagacccgcccuuccuucccccacaaccucuccgacgcaaccuagccugucccagagcgcuaccucugcggccauccaggauaugcaccccuccccuacaaaccggagccgcagaaaucucgaaauggagauuauccugacccuuucucaggggcugaaaaaguacuauggaaaaauucucaagcugcuggaccucacacuggaggaagauaccgagggccuucuggaauggugcaagcggaaccucgaccugacgugugaugagaacuuuuuccuuaaacgcaucgaagaguuuuuccuguccggggagggacauuuuaaugaaguccuccaauucaaggcucccagcacaauguccucuaccgagccuacacacgccgggcccccgaccguggaaccuuuuaaaagcuacuucgcuaagggcuuucuguccauugacucuggcuauuucagcgccaaaugcuaccccagaaccuccaauagcggacugcagcucaucaacguuacacagcacacggcccggaucgcugauacccccggcccuaagauuacaaaugugaagaccaucaacuguauuaaucugaaagcgucugucuuuaagaaacaucgcgagguggaaaucaacgugcuucugccgcaaauugccgucaaccucuccaauugccacguucugaucaagagccaugugugugacuacucucuuaacuucgacgggauggugagacugccccggauccaccacgagggaacauuuauuccuggcaccuauaaaaucgucauugaucgcaagaauaaacagaacgacagaugcacgcucgugacaaauuguguuaucaaggggcgggaggugagaaagggacaguccgcucugcgccaguaccggaccgaaauuaaaaucggcgaggccagcaucggcucuagacgccugcucagcgaagaguccagcgaugacugcauuucucggacccaacugcuuagaacagaaaccgccgagauccauaacgauaauuaugggggacccggcgacaagauuacaaucuguaacggguccacgauugucgaucagcgccugggaagcgagcucggcugcuacaccaucaaucgggugaaauccuucaagcugugugaaaacucugcuacagggaaaagcugcgagauugacuccaucccuguuaagugcagacagggcuucugucugaagaucacccaggaaggacgcggccacgugaaacuuucucgggggagcgaggucgugcucgaugccugcgacuccucuugugagauuaugauccccaagggaacaggcgauauucuggucgacugcagcgggggacaacagcauuuucugaaagacaaucucaucgaucugggcuguccuaacauuccccuucuggggaagauggcgaucuauaucugcagaauguccaaucacccgaaaaccacgauggcuuuccucuuuugguucagcuuuggcuacgugauuaccuguaucuucugcaaggccaucuuuuaucugcugauuauuguuggaacacuuggcaagaaauucaagcaguaccgcgaacucaaaccucagaccuguacaaucugcgagaccacacccgugaacgccaucgacgcugaaaugcaugaucugaauuguucuuacaacauuugcccuuauugcgccucccggcugaccagcgacgggcucgcuagacacgucgugcacugucccaagcggaaagagaagaucgaagagacggagcuguaccuuaaccuggaacgcguuccguggguggucagaaagcuccugcaagugucugaguccacaggaguggcccugaaacggagcucuuggcuuauuguucuccugguccugcucaccgugucccugagcccugugcaguccgcgcccaucggccaugggaagaccauugaaacauaucagaccagagagggauacacgagcaucugccuuuuuguccugggcgggauccucuucauugugucuugucugaugaaaggccugguugauagcgugggaaauaacuuuuucccuggccuuacaaucugcaagaccuguuccauuucuagcaucaauggguuugaaauugagucccacaaaugcuauuguucucuccugugcugucccuacugccgccauuguagcgccgaccgggagauccaccagcugcaccucuccauuugcaagaaaagaaagacaggaucuaacgucaugcuggcugugugcaagcgcaugugucuuagaguuaccacagaagugagcaaucgggcccuguucauccgcuccaucauuaacaccacguucgucaucugcauucucauccuggcuguguguguuauuagcaccucugccguggagauggaaaaucugcccgcgggcacaugggagagagaagaggaucuuaccaacuuuugccaucaagagugucaggucacagaaaccgagugccuguguccuuaugaagcccucgugcugcggaaaccccucuucuccgacagcaucgugaaggggaugaaaaaucugcuuaacucuacgucccuggagacaagccucuccaucgaggcucccuggggagccauuaauguccagucuaccuuuaagccuacaguuagcaccgcuaacaucgcccuguccuggagcucuauugaacaccgcggcaauaaaauccugguguccgggagaagcgagucuauuaugaaacuugaggaacggaccggcaucagcugggaucugggaguggaagacgccuccgagucucgccuccugacagucagcgugauggaucucucccaaauguacucucccguuuucgaguaccugagcggcgacagacagguggaagaguggccuaaggcuacgugcaccggggauugucccgaacggugcggauguacauccucuaccugccuucauaaagaguggccucacagccgcaacuggagaugcaauccgacaugguguuggggcgucgggaccggaugcacguguugcggccuggacgugaaggaccucuuuacagauuauauguucguuaaauggaagguggaauacaucaaaaccgaggcgauugucuguguggagcugaccucccaggaacggcagugcagccugaucgaggccggcacaagauuuaaccuugggcccguuaccauuacacuguccgaaccucgcaacauccaacagaagcucccgccugagauuaucacgcugcauccccggauugaagagggauucuuugaccucaugcacgugcagaagguccugucugcuagcaccguguguaaacuucaguccugcacacacggcgugccgggggaucugcaagucuaucauaucggaaaucugcucaagggcgacaaaguuaacgggcaccugauccauaagauugagccucacuucaauaccucuuggaugagcugggauggaugugaccuugauuacuauugcaacaugggcgacuggcccuccuguacauacaccggcgugacgcagcauaaucacgccgccuuugugaaccugcucaauaucgaaaccgauuauacaaagaacuuccacuuucauagcaagagagucaccgcucacggggacacaccccagcuggaucucaaggcccgcccuaccuacggagcgggcgagauuacagugcugguugaaguggcugacauggagcuucauacgaaaaagaucgagauuucugggcugaaauucgccucccugaccugcacaggaugcuacgccuguagcucuggcaucuccugcaagguccggauccacguggaugaacccgacgagcucaccguucacgugaaaagcgaagacccugauauugucgcugccucuagcucccugauggcgagaaaacuugaguucgggaccgacucuacauuuaaggcuuucagcgccaugccgaagacgucccuguguuuuuauaucguggaacgcgaguacugcaagagcuguucccgggaggauacccagaaaugcgucucuacaaagcucgaacaaccccagagcauucugaucgagcauaaaggaaccauuaucggcaagcagaauaacacauguaccacgaaaacaaccugcuggcucgaauccgugaagucuuucuuuuauggccugaagaauaugcuuagcuccaucuucgggaacguuuuugugggaauuuucucuuuucuggccccuuucauccugcucauucuguuuuucauguucggcuggagaauccuguuuuguuucaaaugcugucgccggaccagagggcuuuuuaaguaccggcaccucaaagacgaugaggaaacaggauaucgcagaauuaucgagcggcugaauaacaagaaaggcaagagcaagcuccuggacggggagcgccuugcugauagaaaaauugccgaacuguucuccaccaagacacauaucggauga

SEQ ID NO: 13666 - RNA, 5055 nt, Artificial Sequence
  derived and/or modified CDS sequence (opt5) from CCHFV(SPU415/85)__DQ211635.1__GP
auguacacaccccuggugugcgccgucaucugucuccagcuguggaaccuuggcgggacacugguuuucauuaauagaacgcaacacaacgagaccggaacaguggcuaccccugaaggcacacuccggccgcgccugcccgugagcaccgcccuuccuacaaaguccgacagacccucugucgggccugcggcuagcuccucuggacuggagggcagcggggaacccaauaccuccccuucuaucacgaccaaaggacucacaccgcccgagaccaccccugcccugcccaccgccacggauacagacgcuagcuccaccggcgugguugaugugagcacacagaugaccaaggacauuccuaugucuaccgccuauacaaaucccccguccacgccuagcgcucccucuaccccucagggcacacaucacaccgcccgggggcugcucuccgucgcgagcacaaaaucugaagagguguccaugagcaccucccccgccaagacgucuacagagaccagcuccccucccccggcuaccagcgaaacacccaccccuucucccacaacgcagguuccuaccggaaacaacaaucccaacacaucccgccaaccgaccccuagcgcccagcccgcuaugucuaauccugccacaagccccgcgcagccuaaccugucccagucugcucccccgaccgccgaucaaggcgugcauccuagccccacgaauagauccaaacggaaccuugagaucgaaauuauccugacccucagccaggggcugcgcaaguacuauggaaagauccuuaaacugcucgaccugacacuggaggaggauaccgaaggccuccuggaguggugcaagagaaaucuugggcugacaugugacgauaacuuuuuccagaaacggauugaagaguuuuuccucaccggagaaggcuacuuuaaugagguccugcaguucaaggugcccucuacgcuuuccagcacagagccuacccacacacgcccgcccaccguggaaccuuuuaaaucuuauuucgccaagggcuuucuguccaugaacagcggguacuucuccgcuaagugcuaucccagaaccucuaacagcggacuccaacugaucaaugucacaaaacauuccgccaagauugccgacacgccuggccccaaaaucaccaaccugaagacaauuaauuguaucaaccuccgggcuucuguuuuuaaagagcaccgcgaaguggagauuaaugugcugcuuccucaggucgcggugaaccugagcaauugccacgcccagaucaagucccauguuugugauuacagccucgcuaccgacgggauggugagacugccccacauccaucacgaaggaacauucauuccgggcaccuacaaaaucgucauugauaagaagaacaaacaaaaugaccggugcacgcuugugacaaacuguguuaucaaggggcgcgaggugagaaaaggacagucugcccugcggcaguauaagaccgagauuagaaucggcaaagccuccagcggcucucgccggcuccuguccgaagagagcgacggggauugcaucucuagaacccagcugcuccgcacagaaaccacagagauucacagcgacaauuacggaggcccuggggauaagaucacgauuuguaacggauccaccaucgucgaccaacggcugggcagcgaacuugggugcuauacaauuaauagagugaagucuuuuaaacugugcgagaacuccgcuaccggcaagagcugugagaucgauuccacacccgucaaaugccgccagggauucugucucaagaucacccaggaaggccgggggcaugugaaacugucuagaggaagcgagauuguucuggacgccugcgauuccaauugugaaaucaugauuccuaagggcacgggggacauccuuguggauugcucuggaggccagcaacacuuccucaaggacaaccugauugaucuggggugucccaacaucccgcuccugggcaaaauggcgauuuacaucugccgcaugagcaaucauccuaagaccacaauggcuuuucuuuucugguuuuccuucggauaugucaucaccuguauucugugcaaagugaucuuuuaccuccugauuguugccggcacaguggggaagaaauucaagcaguaucgggagcugagaccccagaccuguacaaucugcgagaccauuccugucaacgccaucgacgcugaaaugcacgaccuuaauugcucuuacaacaucugucccuacugcgccagccgccucacguccgauggacuggcucggcaugugaugcagugucccaagagaaaagagaagguggaagagacagaacuguaucucaaucuggagcggauuccuuggguuguccgcaaacuucugcaagugagcgagucuaccggcguggcccucaagagauccagcuggcugaccguccugcuugugcuccugaucguuucucuguccccggugcagagcgcgcccauugggcacggaaaaacaaucgaaaccuaccaggcccgggagggcuauacgucuuuuugccucuucauucugggguccauccuuuuugucgugagcugucugguuaagggccucaucgacuccgugggaaacagcuucuuuccuggccugucuauuugcaaaacauguagcaucggguccauuaauggauucgaaaucgagucucacaagugcuacuguagccuguuuugcugucccuauugcagacauugcuccgcugaucgcgaaauucacaaacuucaucucucuaucuguaagaagcggaaaaccggcagcaacgucaugcuggccgugugcaagagaauguguuuccgcgcuacaaucgagguuuccaauagagcccugcucauucggaacaucauuaauaccacauucguggucugcauccugacccuugcgguguguguggucucuacgagcgccguugagauggaaucccugccugcugggaccugggagaaagaagaggaccucacaaacuuuugccaccaggaaugucaagugaccgagacagagugccugugucccuacgaagcccuggugcuucgcaagccucuguuccucgauagcauugucaagggaaugaaaaaucugcucaacucuaccucccuggagacgagccuuucuaucgaagcuccguggggcgccauuaaugugcaguccacauuuaagcccaccguuagcgccgcuaacaucgcgcuguccuggucuagcguggagcacagagggaacaaaauccucgucuccggccggagcgagucuauuaugaagcuggaggaacgcacaggaaucuccugggaccugggcguggaagaugccagcgagucuaaacuucugaccguuagcgugauggaccucucccagauguauucuccugucuucgaauaccugagcggggauagacaaguggaggaguggcccaaggcuaccugcacaggagacuguccugaacggugcggcugcacguccucuaccugucuccauaaggaguggccccacagccgcaauuggagaugcaacccgacaugguguuggggaguugggaccggcugcacauguugcggccuggaugugaaagaccuuuuuaccgauuacauguucgucaaguggaaaguggaauauauuaagacggaggccaucgugugugucgaacugacaucccaggagcggcagugcagccucauugaggccgggacccgcuuuaaucugggaccuguuaccaucacacugucugaacccagaaacauccagcaaaaacuucccccugagauuaucacccugcauccccggauugaagagggcuucuuugaccucaugcacgugcagagagugcuguccgcuagcacagucuguaagcuccaguccugcacgcauggggugccuggagaccugcagguuuaccacaucggcaaucuucugaagggggauaaagugaacggacaccugauucauaagaucgaaccgcacuucaauaccucuuggaugagcugggacggcugugaucucgacuauuacugcaacaugggcgauuggcccuccugcacauauaccggggucacacaacauaaucacgccgcguuugugaaccugcuuaauaucgagaccgacuacacgaaaaacuuccauuuucacucuaagcgcguuaccgcucacggagauacaccucagcuggaccucaaagcccggcccaccuauggcgccggggaggugacaguccugguggaagucgcugauauggagcuccauaccaagaaaauugaaaucagcggacugaaguucgccucccuuacauguacgggcugcuacgcguguagcucugggauuuccugcaaggugaaaauccacguugacgagccugaugagcugaccgugcaugucaagagcgaagaccccgauauuguggcugccggaucuucccugauggccagaaaacucgaguucggcgcugacagcacauuuaaggccuucucugcuaugccgaaaaccagccuguguuuuuacaucguugaacgcgaguauugcaaguccuguucucgggaagacaccagaaagugcgugaauacaaaacuugaucgcccucagagcauucugaucgagcacaagggcacgaucauugggaaacagaacaauaccuguacagccaaggcguccugcuggcucgagagcgucaaauccuucuuuuacggacugaagaacaugcucucuggcaucuucgggaacguguuuauuggaaucuuccuguuuauugcccccuucgugcuucugauccuguuuuucauguucggcuggcggauccucuuuuguuucaagugcugcagacgcacccgggggcuguuuaaauauagacaccuuaaggacgaugaagagacaggauaccggaaaauuaucgaacgccugaauaacaagaaaggcaagaauaagcuccuggacggcgagagacucgcugaucggaaaauugccgaacuguucagcaccaagucccauaucggguga

SEQ ID NO: 13667 - RNA, 5055 nt, Artificial Sequence
  derived and/or modified CDS sequence (opt5) from CCHFV(SPU 431/85)__KJ682812.1__GP
auguacacaccccuggugugcgccgucaucugucuccagcuguggaaccuuggcgggacccugguuagcacgaauagaacccaacacaacgagacaggaaccguggcuacaccugaaggcacccuccggccgcgccugcccguguccacagcccuuccuaccaagucugacagacccagcgucgggccugcggcuuccucuagcggacuggagggcuccggggaacccaauacgucuccuagcauuaccacaaaaggacucaccccgcccgagacaaccccugcccugcccacggccacagauaccgacgcuuccagcacaggcgugguugaugugucuacccagaugaccaaggacaucccuauguccacagccuauacgaaucccccgagcaccccuucugcucccuccacaccucagggcacccaucacacagcccgggggcugcucagcgucgcgucuaccaaauccgaagaggugagcauguccacgucucccgccaagacaagcaccgagaccuccucucccccuccggcuacaucugaaacccccacaccuucccccacgacccagguuccuacaggaaacaacaaucccaacaccagccgccaaccgacaccuucugcccagcccgcuaugagcaauccugccaccucccccgcgcagccuaaccugucucagagcgcucccccgacggccgaucaaggcgugcauccuucccccaccaauagaagcaaacggaaccuugagauugaaaucauucugacacucucucaggggcugcgcaaguacuauggaaagauccuuaaacugcucgaccugacccuggaggaggauacagaaggccuccuggaguggugcaagagaaaucuugggcugaccugugacgauaacuucuuucagaaacggaucgaagaguucuuucucacgggagaaggcuacuucaaugagguccugcaguuuaaggugcccuccacacuuagcucuaccgagccuacacacacccgcccgcccaccguggaaccuuucaaauccuauuuugccaagggcuuccugagcaugaacuccggguacuuuucugcuaagugcuaucccagaacaagcaacuccggacuccaacugauuaaugucacgaaacauucugccaagaucgccgacaccccuggccccaaaauuacaaaccugaagaccaucaauuguauuaaccuccgggcuagcguuuucaaagagcaccgcgaaguggagaucaaugugcugcuuccucaggucgcggugaaccuguccaauugccacgcccagauuaagagccauguuugugauuacucucucgcuacagacgggauggugagacugccccacauccaucacgaaggaaccuuuaucccgggcacguacaaaauugucaucgauaagaagaacaaacaaaaugaccggugcacacuugugaccaacuguguuauuaaggggcgcgaggugagaaaaggacaguccgcccugcggcaguauaagaccgagaucagaauuggcaaagccagcucuggcucccgccggcuccugagcgaagagucugacggggauugcaucagcagaacacagcugcuccgcaccgaaacaacggagauccacuccgacaauuacggaggcccuggggauaagauuaccaucuguaacggaagcacaauugucgaccaacggcugggcucugaacuugggugcuauaccaucaauagagugaaguccuucaaacugugcgagaacagcgcuacaggcaaguccugugagauugauucuacccccgucaaaugccgccagggauuuugucucaagaucacgcaggaaggccgggggcaugugaaacugagcagaggauccgagaucguucuggacgccugcgauucuaauugugaaauuaugaucccuaagggcaccggggacauucuuguggauugcagcggaggccagcaacacuuccucaaggacaaccugaucgaucuggggugucccaacauuccgcuccugggcaaaauggcgaucuacauuugccgcauguccaaucauccuaagacaaccauggcuuuccuguuuugguucucuuuuggauaugucaucacauguauccuuugcaaagugauuuucuaccuccugaucguugccggcaccguggggaagaaauuuaagcaguaucgggagcugagaccccagacauguaccauuugcgagacgaucccugucaacgccauugacgcugaaaugcacgaccuuaauugcagcuacaacaucugucccuacugcgccucccgccucacaagcgauggacuggcucggcaugugaugcagugucccaagagaaaagagaagguggaagagaccgaacuguaucucaaucuggagcggaucccuuggguuguccgcaaacuucugcaagugucugaguccaccggcguggcccucaagagaagcucuuggcugacaguccugcuugugcuccugauuguuucccugagcccggugcagucugcgcccaucgggcacggaaaaaccauugaaacguaccaggcccgggagggcuauacauccuucugccucuuuauccuggggagcauucuuuucgucguguccugucugguuaagggccucaucgacagcgugggaaacagcuuuuucccuggccugagcaucugcaaaaccuguuccauugggucuaucaauggauuugaaauugagagccacaagugcuacuguucccuguucugcugucccuauugcagacauugcccugcugaucgcgaaauccacaaacuucaucucucuauuuguaaaaagcggaaaacaggcagcaacgucaugcuggccgugugcaagagaauguguuuucgcgcuaccaucgagguuuccaauagagcccugcucauccggaacauuaucaauacaaccuucguggucugcauucugacgcuugcgguguguguggucucuaccagcgccguugagauggaaucccugcccgcugggacaugggagaaagaagaggaccucaccaacuucugccaccaggaaugucaagugacagagaccgagugccuguguccuuacgaagcccuggugcuucgcaagccgcuguuucucgauagcaucgucaagggaagaaagaaucugcucaacucuacgucccuggagacaagccuuucuauugaagcucccuggggcgccaucaaugugcaguccaccuucaagccuacaguuagcgccgcuaacauugcgcuguccuggucuagcguggagcaccgggggaacaaaauccucgucuccggccgcagcgagucuaucaugaagcuggaagagagaaccggaauuuccugggaccugggcguggaagaugccagcgagucuaaacuucugaccguuagcgugauggaccucucccagauguauucucccgucuuugaauaccugagcggggaucggcaaguggaggaguggccuaaggcuacaugcacgggagacugucccgaacgcugcggcugcaccuccucuacaugucuccauaaggaguggccgcacagcagaaauuggcggugcaacccuaccugguguuggggaguugggacaggcugcaccuguugcggccuggaugugaaagaccuuuucacggauuacauguuugucaaguggaaaguggaauauaucaagacagaggccauugugugugucgaacugaccucccaggagcgccagugcagccucaucgaggccgggaccagauucaaucugggacccguuacaauuacccugucugaaccccggaacauccagcaaaaacuuccucccgagaucauuacacugcauccuagaaucgaagagggcuuuuucgaccucaugcacgugcagcgcgugcuguccgcuagcacggucuguaagcuccaguccugcacccauggggugccgggagaccugcagguuuaccacauuggcaaucuucugaagggggauaaagugaacggacaccugauccauaagauugaaccccacuuuaauacaucuuggaugagcugggacggcugugaucucgacuauuacugcaacaugggcgauuggccuuccugcaccuauacaggggucacccaacauaaucacgccgcguucgugaaccugcuuaauaucgagacggacuacaccaaaaacuuucauuuccacucuaagcggguuacagcucacggagauacaccccagcuggaccucaaagccagaccuaccuauggcgccggggaggugaccguccugguggaagucgcugauauggagcuccauacaaagaaaaucgaaauuagcggacugaaguuugccucccuuacguguaccggcugcuacgcguguagcucugggaucuccugcaaggugaaaauucacguugacgagcccgaugagcugacagugcaugucaagagcgaagacccggauaucguggcugccggaucuucccugauggcccgcaaacucgaguucggcgcugacagcaccuucaaggccuuuucugcuaugccuaaaaccagccuguguuucuacauuguugaacgggaguauugcaaguccuguucuagagaagacacacgcaagugcgugaauacgaaacuugaucggccccagagcauccugauugagcacaagggcaccaucaucgggaaacagaacaauacauguaccgccaaggcguccugcuggcucgagagcgucaaauccuuuuucuacggacugaagaacaugcucucuggcauuuuugggaacguguucaucggaauuuuucuguucaucgccccuuuugugcuucugauucuguucuuuauguucggcuggagaauccucuucuguuuuaagugcugccgccggacaagagggcuguucaaauaucggcaccuuaaggacgaugaagagaccggauaccgcaaaaucauugaaagacugaauaacaagaaaggcaagaauaagcuccuggacggcgagcggcucgcugaucgcaaaaucgccgaacuguuuagcacgaagucccauauuggguga

SEQ ID NO: 13668 - RNA, 5055 nt, Artificial Sequence
  derived and/or modified CDS sequence (opt5) from CCHFV(8402)__AB069674.1__GP
auguacacaccccugcucugcgccgugcugugucuucagcuguggagccucgagggcucccacgggcugucuaacaagacccaacauagcaauacguccaccacaaaagcuccugaagucucucaggagcuuggacugccgguuagcaccguguccacaaucaccucugaucccccuagcauuacauccgccgugagcgucucuggcuccgaagggagcggagacaccaacacgucucccuccgugaccacacagggcccuacccuccccgagacaacccuggaaccucugacgacaaccgacacagaugcgagcucuaccguuguggucgacguguccacccagacaguuaaggauacgccgaucagcaccacauauaccucccuccccucuacaccuagcgagcccaccacgccucaagggacacaccauaccgcuagaggacugcuuuccgugaccagcacaaaacccgaggaagccucuacccaggccaauccgggcaagauuuccauggagacaaacggcccucggcuggcuaucagcgaaacgcccucuuucagcccuaccacacaggcccccaccgaaaauuccaaccccauuacaucuaaacagcucaugcugagcgcucaaccugucaccccgaaucccaugacguccccugugcagcccgcccuuagccagucugacaccuccacagcgauccaggaugugcacccuagccccaccgggcgcucuaagagaaaccuggagauggaaaucauucucacacugucccaaggacugaagaaauacuauggcaagauccucaaacugcuugaccugacccucgaggaagauacggaggggcugcuugaauggugcaagcggaaucugggacucgucugugacgauaacuuuuuccagaaacgcauugaggaguuuuuccugacaggcaaggggcauuuuaaugaaguucugcaguucaagaccccgagcacacucuccccuaccggacccgccagaaccggcucuccuacaguggagcccuuuaaaagcuacuucgcuaagggcuuucuguccauggacucuggguauuucagcgccaaaugcuacccucgggcuuccaacagcggacuucaacugaucaaugugacgcagcacucuacccgcauuacagauacccccggcccgaagaucacaaaccucaaaaccauuaauuguaucaaccugaaggccuccgucuuuaaagaacacagagagaucgaaauuaacgugcuucugccucagguugcggugaaucucagcucuugccauguccugaucaagucccacgugugugacuauagccuggacauugaugggcccguucggcucccccgcauccaucacgagggaacguucauuccuggcacauacaagaucgugaucgacaaaaagaacaaacagaaugauagaugcacccuggucaccaacugugugauuaaggggcgggagauccgcaaaggacaaucuguccuuagacaguaccggacagaaauuaagaucggcaaggccagcuccggcagccgcagacugcucucugaggaauccggggacgauugcauuagccggacccagcugcugagaacagagacggcugaaauccacaaugacaacuauggaggcccgggggauaaaaucaccauuuguaauggauccacagugguugaccagcgccuuggcucugagcucgggugcuacaccaucaaccgggucaagagcuuuaaacugugcgaaaauuccgccacaggcaagucuugugaaauugauagcacccccgugaaaugcagacaaggauucugucugaagaucacgcaggagggccgcgggcaugugaagcucucccggggaucugaaguugugcuggacgcuugcgauagcuccugugagauuaugaucccuaaaggcaccggggacauucuugucgacugcagcggaggccagcagcacuuccugaaggauaaccucaucgaccuggggugucccaauaucccucugcuuggcaaaauggccauuuauaucugcagaaugucuaaccaucccaagacaaccauggccuuucucuucugguuuuccuucggauacguggugacauguauucugugcaaaguuaucuuuuaucugcucauugucgugggcacccuggggaagaaguucaaacaauaccgcgagcuuaagccucagacauguaccaucugcgaaacgacacccgugaaugcuaucgaugcggagaugcacgaccugaacugcagcuauaauauuuguccguacugcgccucucggcucaccuccgauggacuggcuagacaugucaugcaguguccuaaacgcaaggagaaaaucgaggaaaccgagcuguaccuuaaccucgagcggauucccugggugguuagaaagcugcuucaggugagcgaaucuacaggcgucgcccucaaacgcuccagcuggcuggugguucuucuggugcuccugaccgucucccugagcccugugcaaucugcccccaucgggcacggaaagacgguugagacauaucagacccgggaaggcuacacaagcauuugccuuuuugugcucggguccauccuguucaucgucucuugucugaugaagggccucguggacagcgugggaaacuccuuuuucccgggccugucuauuugcaaaaccuguagcaucggguccgucaauggauuugagauugaaucucacaagugcuauuguagccuuuucugcuguccuuacugcagacauugcuccgcugaucgggagauccaccgccugcaucucagcauuuguaaaaagagaaaaacaggcucuaacguuaugcuggccgugugcaagcggauguguuuuagagcgaccguggaggucuccaauaaggcucugcuuauccgcaacaucauuaauacgaccuucgugcugugcauccucauucuggccguuuguguggucagcacaucugccguggaaauggagucccuccccgcugggaccugggaacgggaggaagaccugacaaacuucugccaccaggagugucaaguuaccgagacggaaugccuuuguccuuaugaggcccuggugcucagaaaaccccuguuuagcgauuccaucgucaagggaaugaaaaaucugcuuaacucuacaagccuggaaaccucccucagcauugaggcucccuggggcgccaucaaugugcagucuacauucaagccuaccguuuccgcggccaacauugcucugagcuggucuagcguggagcaccgcgggaauaaaauccucgucuccggcagaucugaaagcaucaugaagcuggaggaacggaccggaauuuccugggaccuuggcguggaggaugccucugaaagcaagcugcucacaguguccgucauggaccugagccagauguacucuccgguuuuugaguaucuguccggggaucgccagguggaggaauggcccaaagcuacgugcaccggagacuguccugagagaugcggcugcacaagcuccaccugucuucauaaggaauggccccacucucggaacuggcgcugcaauccuacaugguguuggggaguggggaccggcugcacguguugcggccuggacgucaaagaucucuucacagacuacauguuuaucaaguggaaaguggaguacauuaagaccgaagccaucguuuguguggagcugaccagccaagagagacagugcacacucauugaagcggggacccgguucaaccugggacccgucacaaucacgcuuuccgagccucgcaauauccagcagaagcugccgcccgaaauugugacccugcauccuagaaucgaggaaggcuuuuucgaucucaugcacguucaaaaagugcugucugccagcacagucuguaagcugcaguccugcacccauggggugcccggagaccugcaggucuaucacauuggcaaccuccugaaaggggauaaggugaacggacaccucauccauaaaauugagccucacuuuaauacaagcuggaugucuugggacggcugugaucuggacuacuauugcaacaugggcgauuggcccuccugcaccuacacggggguuacccagcauaaucacgcugccuucgugaacaugcuuaauaucgagacagacuauaccaagaacuuucauuuccacagcaaacgggucacagcucacggagauaccccgcaacuggaccugaaggcccgcccuacauacggcgccggggaaaucacggugcucguugagguggcugauauggaacugcauaccaagaaaauugagaucucuggacuuaaguuugcgucccugacauguaccggcugcuaugccuguagcucugggauuagcugcaaagucagaauccacguggacgagcccgacgaacucaccgugcauguuaaguccgaggaucccgacauugucgcugccucuagcucccugauggcccggaaacucgaguucggaacagauagcacguucaaggcuuuuuccgccaugccuaagaccucucuguguuucuacaucguggagagagaauacugcaaaagcuguuccaaggaggacacacagaaaugcgugaauaccaaacuugagcagccccaaucuauucugaucgaacacaaaggcacaaucauuggcaagcagagcaacaccuguacggcgaaggcuuccugcuggcuggagucugucaagagcuuuuucuaugggcucaagaauaugcuguccggaaucuuuggcaacguguucauugggguuuuucuuuucuuugccccuuucauccugcucauucuguuuuucauguucggauggcgcauccucuuuuguuucaaaugcugccggagaacacgcggccuguuuaaguaccggcaccuuaaagaugacgaagagaccggguauagaaagaucauugaacgccugaauaacaagaaaggaaagaauaaacugcucgauggcgagcggcuggccgacagaaagaucgcugagcuuuucagcaccaaaacacauauuggcuga

SEQ ID NO: 13669 - RNA, 5055 nt, Artificial Sequence
  derived and/or modified CDS sequence (opt5) from CCHFV(SPU 383/87)__KJ682806.1__GP
auguacacaccccugcucugcgccauccugugucuucagcuguggagccucgagggcauuuaugggcuguccaacagaacacaacacaaugacacgucuaccaucaaggugccugaagagagccagaaaacaucccuuccggcuaacaccgccucucccauuacaagcgauccucccuccaccacaucuaccgcgagcgcuuccggaccugaaggcagcggggacacgucuaccuccccucccgucacaacccagggaccgacacccccugagaccacgcccgaaccucauacaaccaucgauauugacaagagcucuacagccaucgccgauaucuccacccagaccguuaaagacauucccacaccgacgacccacacaagccugccuucuacccucuccgcucccacaaucccucaagaggcccaucacaccgcucggggccugcugagcauuacguccacaaagcccggggaggccucuacccccaucagcccuggagaagcguccaccgaggccagcucuccgcagcccacaauuuccgaaaccccuucucccccucccacagcucaggccccgacggagaucaauagcccuaacaccagccgccagcccaugccuuccacacaacccgcugccccuaauucugugacccaucccgcgcagccgacaccuagccaguccgaugugcccaccgccgcucaggacauucaccccaacccuaucaauagaagcaaacggaaccucgagauggaaaucauucugacgcuuucucaaggccugaagaaguacuauggcaaaguccucaagcugcuugaucugacccucgaggaagacacagaggggcugcuggaauccugcaaacgcaaucucggacugaccugugaugacaacuucuuucagaagagaaucgaggaguucuuucuuacaggcgaagggcacuucaaugaggugcugcaguuuaaaaccccgagcacgcucucucccacagaaccugcccggguugagucccccaccguggaaccuuucaagagcuacuuugcuaagggauuccuguccauggauucuggcuauuuuagcgccaaaugcuacuccaagucuagcaacuccgggcuucaacugauuaaugucacacagcaucucauccgcauuaccgacacccccggaccuaaaaucacaaaccugaagacgaucaauuguauuaaccugaaagcccucguguucaaggagcacagagagaucgaaauuaacguucugcuuccccagguggcugucaaucugagcaacugccaugugcucaucaaaucucacgugugugacuauucccuggauauugacggcccgguccggcuuccucgcauccaccaugagggcaccuuuauccccgggacauacaagauuguuaucgauaagaauaacaaacagaaugacagaugcacccuggugacaaacugugugauuaagggacgggaaauccgcaaaggccaaagcguccucagacaguaccggaccgagauuaagaucgggaaagcgucuuccggaagccgcagacugcugucugaagagagcaaugaugacugccucucccggacgcagcugcuuagaacagagaacgccgaaauucacagcgauaauuauggcgggccuggagacaagaucaccaucuguaacggcucuaccauuguggaucagcgccugggcuccgagcucgggugcuacacaaucaaucggguuaagagcuucaaacugugcgaaaacuccgcuaccggaaagucuugugagauugacagcacacccgugagaugccgccaaggcuuuugucugaaaaucacgcaggaggggcggggacaugucaaacuuuccagaggcucugaagugguucucgaugccugcgacagcuccugugagauuaugaucccgaaagggaccggcgacauccugguggauugcucuggaggccagcagcacuuccugaaggacaaucucgucgaucugggguguccuaacauuccccuucugggaaagauggccaucuauauuugccgcaugagcaaucauccuaaaacaaccauggcuuuccucuuuugguucuccuuuggcuacgugaucacauguauucugugcaaggucaucuucuaucugcuugugguuguggggacccucgggaaaaaguuuaaacaauaccgggaacugaagccccagacguguaccaucugcgagacaaaccccgucaacgccauugacgcggaaaugcacgaucugaauugcagcuauaacaucuguccuuacugcgcuucuagacucaccuccgacggccuggcccgccacgugauucaguguccgaagcggaaagagaagaucgaggaaacagagcuuuaccugaaucucgaacggauucccuggguugugcgcaaacugcugcaggucagcgagucuaccgggguggcccuuaagcgguccagcuggcucgugauccugcugguucuccugacagucucucuuuccccugugcaaagcgcucccaucucccauggcgaaaccguggaggucuaucagacgagagagggauacacaagcauuugccuguucgugcucggcucuauccuguuucugguuagcugucuuaugaaagggcucguggauuccgucggaaacucuuucuuuccuggccugagcauuugcaagaccuguuccaucgggucuauuaauggauucgaaaucgagagccacaaaugcuauuguucccuguuuugcugucccuacugccggcauugcucugccgacauugaaauccaccgccuccaccugagcaucuguaagaagagaaaaaccggcuccaacgugaugcuugcuguuugcaagcggauguguuucagagccacaguggaggucagcaauaaagcgcugcucauucgcaacaucauuaauaccacguuugugguuugcauccugauucuggccgugugugucgugucuacauccgcuguggaaauggagaaccuuccugccgggaccugggagaaggaagaggaucugacaaauuucugccaucaggaaugucaagucaccgagacagagugccucuguccguaugaagcucugguucuccggaaaccccuguuccuugacagcaucgugaagggcaugaagaaccugcucaauucuaccucccuggagacgagccuguccaucgaagccccuuggggagcgauuaacgugcagucuaccuuuaaacccacagucagcgccgcuaauaucgcccuuuccuggagcucuguggagcacagaggcaacaagauucugguuuccgggcgcagcgaaucuaucaugaaacucgaggagagaaccggaauuagcugggaucugggcguggaagacgcuuccgagucuaagcuccugacagucagcgugauggaucuuucccagauguacucuccuguuuucgaauaucugagcggggacagacagguggaggaauggcccaaagcuaccugcacgggagacuguccggagcgcugcggcugcacauccagcaccugucuccauaaggaguggccucacucuagaaacuggcggugcaaucccacaugguguuggggagucggcaccggaugcaccuguugcggccuggaugugaaggaccuguuuacagauuacauguucguuaaauggaagguggacuacaucaaaacggaagccaucgucuguguggagcuuaccucccaagaacgccagugcagccugauugaggccgggacaagauuuaaccucggacccgugaccaucacacuguccgaaccucggaauauucagcagaagcugcccccugagaucgucacccuccauccgcgcauugaggaaggcuucuuugaucuuaugcacauccaaaaaguucugucugcgagcacgguguguaagcugcaguccugcacacacggggugcccggagaccuccagauuuaucauaucggcaaccugcuuaagggcgauaaagucaaugggcaccugauccauaagauugagccucacuucaacaccucuuggaugagcugggacggaugugaucucgacuacuauugcaauaugggcgauuggcccuccugcagcuacaccggggugacacagcauaaccacgccgcuuuuguuaauaugcugaacaucgaaaccgacuauaccaaaaauuuccacuuucauucuaagagagugacggcccacggagauaccccucaacucgaccugaaagcccggcccacauacggcgcuggggagauuaccguccuuguggagguugccgacauggaacugcauacaaagaaaaucgagauuuccggacugaaguucgcgagccucaccuguacgggcugcuaugcuuguucuuccggcaucagcugcaaggugcgcauccacgucgaugaaccggacgagcugaccgugcacgucaaaucugaagauccugacauuguggccgccagcuccucucuuauggcuagaaagcuggaguuugggacagauagcaccuucaaagccuucuccgcgaugcccaagacaagccucuguuuuuacaucguugagcgggaauacugcaaauccuguucuaaggaggacacccagaagugcgugaacacaaaacuggaacagccucaaagcauucucaucgagcauaagggaacgauuuucggcaaacagaaugauaccuguacagcuaaggccuccugcuggcuggaaucugucaagagcuuuuucuaugggcuuaagaacaugcuguccggaaucuuuggcaauguguucaucgggguuuuucuguuccucgcccccuuuauuaugcugauccuuuucuuuauguucggauggcgcauucuguucuguuuuaagugcugcagacggaccagaggccucuucaaauaccgccaccugaaggacgaugaggagaucggcuaucggaaaauuaucgaaagacucaacaacaagaaagggaagaauaagcugcuugacggagagcgccuggcugaucggaaaauugccgaacuguuuucuaccaagacacauaucggcuga

SEQ ID NO: 13670 - RNA, 5055 nt, Artificial Sequence
  derived and/or modified CDS sequence (opt5) from CCHFV(SPU 497/88)__KJ682808.1__GP
auguacacaccccugcucugcgccauccugugucuucagcuguggagccucgagggcauuuaugggcuguccaacaagacccaacacaaugacacgucuaccaucaaagugccugaagagagccagaagacaucccuuccggcuaacauugccucucccaccacaagcgauccucccuccgcgaccucuacagcuagcgccuccggaccugaaggcagcggggacaccucuacgucccccagcgucaccacacagggaccuaccccgcuggagaucacacccgaaccucauaccacgauugauaucgacaaaucuuccacaagcaucgccgauauuucuaccagaacaguuaaggacauccccaccccuaccacacacacgucccuccccagcaccccguccgcuccuacaauuccccaggaggugcaucacaccgcccggggccugcugucugugacaagcaccaaaccugaggaggcuuccacgcucacaagccccggggaagccucuaccgaagcguccagcccccaaccuaccaucucugagacaccgucucccccucccaccacacaggccccuacggagauuaauaaccccaauaccucccgccagccgaugccuucuacacagcccgcugccccuaacagcgucacacccccugugcaacccaccuucucccagagcgauguuucuaccgcugcccaggacauccauccguccccuacgaauagaagcaagcggaaccuggaaauggagauuauccuuacccugucucagggacucaagaaauacuauggcaaggugcugaaacuucuggaucucacacuggaagaggacaccgaaggccugcucgaguggugcaagcgcaaucuggggcuuacaugugaugacaacuuuuuccagaaaagaaucgaggaauuuuuccugaccggagagggccacuuuaaugaaguccuccaauucaagacgcccuccacacugagccccaccgagccugcgcggguggaauccccgacaguugagcccuuuaagucuuacuucgccaaaggguuucuuagcauggauuccggauauuucucugcuaagugcuacccuaaaagcuccaacagcggccugcagcucauuaaugugacccaacaccugauccgcauuaccgacacacccgggccuaagaucacgaaccugaaaaccauuaauuguaucaaccucaaggcccuggucuuuaaagagcauagagaaaucgagauuaacgugcuucugccccagguggcugucaaucucucuaacugccacguucugaucaagucccaugugugugacuauagccuugauauugacggaccugugcggcugccccgcauccaccacgaaggcacauucauuccgggcaccuacaagaucgucaucgauaaaaagacaaaacagaaugacagaugcacccucgugacgaacuguguuauuaaggggcgggagauccgcaaaggacagucugugcugagacaauaccggacagaaauuaagaucggcaaggccuccagcgggucucgcagacugcucagcgaggaguccaaugaugacugccugagccggacccagcuucugagaaccgaaaacgccgagauucauucugauaauuauggaggcccuggggacaaaaucacaauuuguaacggauccaccaucgucgaucagcgccucggcagcgaacugggcugcuacacaaucaaucgggugaaguccuuuaaacugugcgagaacucugcuacgggaaagagcugugagauugacuccacccccguuagaugccgccagggguucugucuuaaaaucacacaagaaggcaaggggcacgugaagcucucucggggaagcgaggucgugcuggaugcgugcgacuccucuugugaaauuaugaucccuaaaggcaccggggacauucuggucgauugcagcggcggacagcagcauuuccucaaggacaaucugguggaucuuggcugucccaacaucccgcugcucgggaaaauggccaucuauauuugcagaauguccaaucacccuaagacaaccaugguuuuucuguucugguuuagcuucggauacgugaucacguguauucugugcaaagucaucuuuuaucuucucauugugguuggcacccuggggaagaaguucaaacaguaccgcgagcugaagccccaaacauguaccaucugcgaaacaaacccugugaaugcuaucgacgccgagaugcaugaucucaacugcucuuauaacauuugucccuacugcgccucccggcugaccagcgacggacuugcuagacacgucaugcagugucccaaacgcaaggagaaaaucgaagagacagaacuguaccucaaucuggagcggauuccuuggguggugagaaagcugcuucagguuucugaauccaccggcgucgcccucaaacgcagcucuuggcuggugauccugcucgugcugcuuacggucucccugagcccggugcaguccgcgcccauuagccacggggagacaguugagguguaucaaacccgggaaggcuacaccucuaucugccucuuuguccugggaggcauccuguuccuugugagcugucucaugaaggggcugguugauuccgugggaaacagcuuuuucccuggccugagcauuugcaagacauguuccaucgggucuauuaauggauuugagaucgaaagccauaaaugcuauuguucccucuucugcugucccuacugcagacacugcucugcugacauugagauccauaagcugcaccuuagcauuuguaaaaagcggaaaaccugguccaacgucaugcuggccgugugcaagcgcauguguuuuagagccacgguugaagugagcaauaaggcucuccugauccggaacaucauuaauacaaccuucgucgugugcauccugauucuugccaucuguguggucucuacauccgcuguugagauggagaaccugccugccggcaccugggaaaaagaggaagaucucacaaauuucugccaccaggagugucaggugaccgagacggaaugccugugucccuaugaggcgcucgugcugagaaagccucuuuuucuggacagcauugucaaagggaugcgcaaccuccuuaauucuaccucccuggaaacaagccuuuccaucgaggccccguggggcgcuaucaacgugcaaucuaccuucaagcccacaguuagcgccgcuaauauugcccuguccuggagcucuguggaacaucggggaaacaaaauccucgucuccggcagaagcgagucuauuaugaagcuggaggaacgcaccgggaucagcugggaucucggaguggaggacgcguccgaaucuaagcugcuuacgguuagcgugauggaucugucccagauguacucuccugucuuugaguaucucagcggcgacagacagguggaagaguggcccaaagccacaugcaccggggacuguccugagcggugcggaugcacauccagcaccugucugcacaaggaauggccccauucucgcaauuggagaugcaacccgaccugguguuggggcguugggacaggcugcacguguugcggacuggaugugaaagaccuuuucaccgauuacauguuugucaaguggaaaguggacuacauuaagacagaggcuaucgugugugucgaacugaccucccaggagcggcaaugcagccucaucgaagccggcacacgcuucaaccuggggccuguuaccauuacgcucuccgagcccagaaauauccagcagaagcugcccccugagauugugacacuucacccccggaucgaagagggauuuuucgaucugaugcauauucagaaagugcugucugcuagcaccgucuguaagcuccaauccugcacccacggcgugccuggggaccugcagaucuaucacauuggaaaccuucugaaaggcgauaagguuaauggccaucucauccacaaaaucgaaccgcauuuuaacacaucuuggaugagcugggacgggugugaucuggacuacuauugcaauaugggagauuggcccuccugcagcuacaccggcgugacacagcacaaccaugccgccuucgucaauaugcucaacauugagacggacuauaccaagaauuuucacuuccacucuaaacgcgugacagcucauggggauaccccucagcuggaccuuaaggcgagacccacauacggagccggcgagaucaccguucugguggaagucgcugacauggagcugcacacgaagaaaauugaaaucuccgggcucaaguuugccagccugaccuguacaggaugcuaugccuguucuuccggcauuagcugcaaagugcggauccaugucgaugagccugacgaacuuaccgugcacguuaagucugaggaucccgacaucguggcugccagcuccucucugauggcgcgcaaacucgaguucggcacagauagcaccuucaaggcuuuuuccgccaugccgaagacaagccuguguuucuacauugucgaaagagaguacugcaaauccuguucuaaggaagacacgcaaaaaugcgugaacaccaagcucgagcagccucagagcauccugauugaacacaaagggacaaucauuggaaagcaaaaugauaccuguaccgcccgggcuuccugcuggcuugagucuaucaagagcuuuuucuauggccugaaaaacaugcuguccgggaucuuuggaaauguuuucauuggcaucuuucucuucuuugcccccuucauuaugcugauccuguuuuucauguucggguggcgcauucuguuuuguuucaagugcugcagacggacaagaggacucuuuaaauaccgccaucugaaggacgaugaggaagugggcuaucggaaaaucauugagagacucaacaauaagaagggcaaaaacaagcugcuugacggggaacgccuggcggaucggaaaaucgcugagcuguucucuacgaagacccacaucggauga

SEQ ID NO: 13671 - RNA, 5055 nt, Artificial Sequence
  derived and/or modified CDS sequence (opt5) from CCHFV(88166)__AB069675.1__GP
auguacacaccccugcucugcgccgugcugugucuucagcuguggagccucgagggcucccacgggcugucuaacaagacccaacauagcaauacguccaccacaaaagcuccugaagucucucaggagcuuggacugccgguuagcaccguguccacaaucaccucugaucccccuagcauuacauccgccgugagcgucucuggcuccgaagggagcggagacaccaacacgucucccuccgugaccacacagggcccuacccuccccgagacaacccuggaaccucugacgacaaccgacacagaugcgagcucuaccguuguggucgacguguccacccagacaguuaaggauacgccgaucagcaccacauauaccucccuccccucuacaccuagcgagcccaccacgccucaagggacacaccauaccgcuagaggacugcuuuccgugaccagcacaaaacccgaggaagccucuacccaggccaauccgggcaagauuuccauggagacaaacagcccucggcuggcuaucucugaaacgcccagcuucuccccuaccacacaggcccccaccgaaaauucuaaccccauuacaagcaaacagcucaugcuguccgcucaaccugucaccccgaaucccaugacgagcccugugcagcccgcccuuucucaguccgacaccagcacagcgauccaggauauccacccuucucccaccggccgcuccaagagaaaccuggagauggaaauuauccucacacugagccaagggcugaagaaauacuauggaaagauucucaaacugcuugaccugacccucgaggaagauacggagggccugcuugaauggugcaagcggaaucuggggcucgugugugacgauaacuuuuuccagaaacgcaucgaggaguuuuuccugacaggaaagggccauuuuaaugaaguccugcaguucaagaccccguccacacucucuccuaccgggcccgccagaaccggaagcccuacaguugagcccuuuaaauccuacuucgcuaagggcuuucugucuauggacagcggcuauuucuccgccaaaugcuacccucgggcuagcaacucugggcuucaacugauuaaugugacgcagcacuccacccgcaucacagauacccccggaccgaagauuacaaaccucaaaaccaucaauuguaucaaccugaaggccagcguguuuaaagaacacagagagauugaaaucaacguccuucugccucagguggcgguuaaucucucuuccugccaugugcugauuaagagccacgucugugacuauucucuggacaucgauggccccgugcggcucccccgcauucaucacgaggggacguucaucccuggaacauacaagaucguuauugacaaaaagaacaaacagaaugauagaugcacccuggugaccaacugugucaucaagggccgggagauucgcaaagggcaaagcgugcuuagacaguaccggacagaaaucaagauuggaaaggccuccagcggcucucgcagacugcucuccgaggaaagcggcgacgauugcaucucccggacccagcugcugagaacagagacggcugaaauccacucugacaauuaugggggaccgggcgauaaaauuaccaucuguaacgggagcacagucguggaccagcgccuuggauccgagcucggcugcuacaccauuaaucggguuaagucuuuuaaacugugcgagaacagcgccacagggaaguccugugaaaucgauucuacccccgugaaaugcagacaaggcuucugucugaagauuacgcaggagggacgcggccaugucaagcucagccggggguccgaagugguucuggacgcuugcgauagcucuugugagaucaugauuccuaaaggaaccggcgacauccuuguggacugcuccgggggacagcagcacuuccugaaggauaaucucaucgaccugggcugucccaacauuccucugcuugggaaaauggccaucuauauuugcagaaugagcaaucaucccaagacaaccaugggcuuucucuucugguuuucuuucggauacgucgugacauguauccugugcaaagugaucuuuuaucugcucauuguugucggcacccuggggaagaaguucaaacaauaccgcgagcuuaagccucagacauguaccaucugcgaaacgacacccgugaacgccauugaugcugagaugcacgaccugaauugcuccuauaacaucuguccguacugcgcgagccggcucaccucugauggacuggccagacaugugaugcaguguccuaaacgcaaggaaaagauugaggaaaccgagcuguaccuuaaucucgagcggauccccugggucgugagaaagcugcugcagguuuccgaaagcacaggcguggcucucaaacgcuccagcuggcuggucgugcuucugguucuccugaccgugucucugagcccuguccaauccgcccccauugggcacggaaagacgguggagacauaucagacccgggaaggcuacacaucuaucugccuuuuuguucucgggagcauccuguucauuguguccugucugaugaagggccucgucgacucugugggaaacagcuuuuucccgggccuguccaucugcaaaaccuguucuauugggagcgugaacggauuugagaucgaaucccacaagugcuauuguagccuuuucugcuguccuuacugcagacauugcucugccgaucgggagauucaccgccugcaucucuccaucuguaaaaagagaaaaacauggagcaaugucaugcuggcuguuugcaagcggauguguuuuagagccaccguggaggugucuaacaaggcgcugcuuauccgcaauauuaucaacacgaccuucguccugugcauucucauccuggcuguguguguuguguccacaagcgccgucgaaauggagucccuccccgccggcaccugggaacgggaggaagaccugacaaauuucugccaccaggagugucaagugaccgagacggaaugccuuuguccuuaugaggcucugguucucagaaaaccccuguuuucugauagcauugugaaggggaugaaaaaccugcuuaauuccacaagccuggaaaccucucucuccaucgaggcccccuggggagcuauuaacguccagagcacauucaagccuaccaugucugccgcgaauaucgcccugagcugguccucuguggagcaccgcggcaacaaaauccucguuagcgggagauccgaaucuauuaugaagcuggaggaacggaccggcaucagcuggaaucuuggaguggaggacgcuuccgaaagcaagcugcucacagucucugugauggaucugucccagauguacagcccgguguuugaguaucuguccggcgaccgccaggucgaggaauggcccaaagccacgugcaccggggauuguccugagagaugcggaugcacaucuagcaccugucuucauaaggaauggccccacucccggaacuggcgcugcaauccuacaugguguuggggcguugggaccggaugcacguguugcggccuggacgugaaagaccucuucacagauuacauguuuauuaaguggaaaguggaguacaucaagaccgaagcuauugucuguguggagcugaccucucaagagagacagugcacacucaucgaagccggcacccgguucaaccuggggcccguuacaaucacgcuuagcgagccucgcaauauucagcagaagcugccgcccgaaaucgugacccugcauccuagaauugaggaaggauuuuucgaccucaugcacguccaaaaagugcuguccgcgagcacaguuuguaaacuucagucuugcacccauggcgugcccggggaucugcaggucuaucacaucggaaaccuccugaaaggcgacaaggugaacgggcaccucauucauaaaaucgagccucacuuuaauacauccuggaugagcugggauggaugugaccuggauuacuauugcaacaugggcgacuggcccucuugcaccuacacgggcgucacccagcauaaucacgccgcuuucgugaacaugcuuaauaucgagacagauuauaccaagaacuuucauuuccacuccaaacggguuacagcccacggggacaccccgcaacuggaucugaaggcucgcccuacauacggagccggcgaaauuacggugcucgucgagguggccgacauggaacugcauaccaagaaaaucgagauuagcgggcuuaaguuugcuucucugacauguaccggaugcuaugcguguagcuccggcaucucuugcaaaguucggauucacguggaugagcccgacgaacucaccguccauguuaagagcgaggaccccgaucugguggccgcuuccagcucccucauggccagaaaacuggaguucgggacagacucuacguucaaggccuuuagcgcuaugccuaagaccucccuuuguuucuacaucguggagagagaauacugcaaaucuuguagcaaggaggauacacagaaaugcgucaauaccaagcuggagcagccccaauccauucugaucgaacacaaaggaacaaucauuggcaagcagaacaauaccuguacggccaaggcgucuugcuggcucgagagcgugaaauccuuuuucuauggccugaagaacaugcuuagcgggaucuuuggaaauguguucauuggcgucuuucuguucuuugcuccuuucauccuccugauucucuuuuucauguucggguggcgcauccuguuuuguuucaaaugcugccggagaacacgcggacuuuuuaaguaccggcaccugaaagacgaugaagagaccggcuauagaaagaucauugaacgccugaacaauaagaaagggaagaacaaacuccuggacggagagcggcuugccgauagaaagaucgccgagcuguucucuaccaaaacacauauuggcuga

SEQ ID NO: 13672 - RNA, 5055 nt, Artificial Sequence
  derived and/or modified CDS sequence (opt5) from CCHFV(strain BA88166)__AF338470.1__GP
auguacacaccccugcucugcgccgugcugugucuucagcuguggagccucgagggcucccacgggcugucuaacaagacccaacauagcaauacguccaccacaaaagcuccugaagucucucaggagcuuggacugccgguuagcaccguguccacaaucaccucugaucccccuagcauuacauccgccgugagcgucucuggcuccgaagggagcggagacaccaacacgucucccuccgugaccacacagggcccuacccuccccgagacaacccuggaaccucugacgacaaccgacacagaugcgagcucuaccguuguggucgacguguccacccagacaguuaaggauacgccgaucagcaccacauauaccucccuccccucuacaccuagcgagcccaccacgccucaagggacacaccauaccgcuagaggacugcuuuccgugaccagcacaaaacccgaggaagccucuacccaggccaauccgggcaagauuuccauggagacaaacagcccucggcuggcuaucucugaaacgcccagcuucuccccuaccacacaggcccccaccgaaaauucuaaccccauuacaagcaaacagcucaugcuguccgcucaaccugucaccccgaaucccaugacgagcccugugcagcccgcccuuucucaguccgacaccagcacagcgauccaggauauccacccuucucccaccggccgcuccaagagaaaccuggagauggaaauuauccucacacugagccaagggcugaagaaauacuauggaaagauucucaaacugcuugaccugacccucgaggaagauacggagggccugcuugaauggugcaagcggaaucuggggcucgugugugacgauaacuuuuuccagaaacgcaucgaggaguuuuuccugacaggaaagggccauuuuaaugaaguccugcaguucaagaccccguccacacucucuccuaccgggcccgccagaaccggaagcccuacaguugagcccuuuaaauccuacuucgcuaagggcuuucugucuauggacagcggcuauuucuccgccaaaugcuacccucgggcuagcaacucugggcuucaacugauuaaugugacgcagcacuccacccgcaucacagauacccccggaccgaagauuacaaaccucaaaaccaucaauuguaucaaccugaaggccagcguguuuaaagaacacagagagauugaaaucaacguccuucugccucagguggcgguuaaucucucuuccugccaugugcugauuaagagccacgucugugacuauucucuggacaucgauggccccgugcggcucccccgcauucaucacgaggggacguucaucccuggaacauacaagaucguuauugacaaaaagaacaaacagaaugauagaugcacccuggugaccaacugugucaucaagggccgggagauucgcaaagggcaaagcgugcuuagacaguaccggacagaaaucaagauuggaaaggccuccagcggcucucgcagacugcucuccgaggaaagcggcgacgauugcaucucccggacccagcugcugagaacagagacggcugaaauccacucugacaauuaugggggaccgggcgauaaaauuaccaucuguaacgggagcacagucguggaccagcgccuuggauccgagcucggcugcuacaccauuaaucggguuaagucuuuuaaacugugcgagaacagcgccacagggaaguccugugaaaucgauucuacccccgugaaaugcagacaaggcuucugucugaagauuacgcaggagggacgcggccaugucaagcucagccggggguccgaagugguucuggacgcuugcgauagcucuugugagaucaugauuccuaaaggaaccggcgacauccuuguggacugcuccgggggacagcagcacuuccugaaggauaaucucaucgaccugggcugucccaacauuccucugcuugggaaaauggccaucuauauuugcagaaugagcaaucaucccaagacaaccaugggcuuucucuucugguuuucuuucggauacgucgugacauguauccugugcaaaggcaucuuuuaucugcucauugugguugggacccugggaaagaaguucaaacaauaccgcgagcuuaagccucagacauguaccaucugcgaaacgacacccgucaacgccauugaugcugagaugcacgaccugaauugcuccuauaacaucuguccguacugcgcgagccggcucaccucugauggccuggccagacaugugaugcaguguccuaaacgcaaggagaaaauugaggaaaccgagcuguaccuuaaucucgagcggauccccuggguggucagaaagcugcuccagguguccgaaagcacagggguugcucugaaacgcuccagcuggcuggugguccuucuggugcuccugaccguuucucugagcccugugcaauccgcccccauuggacacggcaagacggucgagacauaucagacccgggaaggguacacaucuaucugccuuuuugugcucggcagcauccuguucauuguuuccugucugaugaagggacucguggacucugucggcaacagcuuuuucccggggcuguccaucugcaaaaccuguucuauuggaagcgugaacggcuuugagaucgaaucccacaagugcuauuguagccuuuucugcuguccuuacugcagacauugcucugccgaucgggagauucaccgccugcaucucuccaucuguaaaaagagaaaaacauggagcaaugugaugcuggcugucugcaagcggauguguuuuagagccaccguugaggugucuaacaaggcgcugcuuauccgcaauauuaucaacacgaccuucgugcugugcauucucauccuggcugucugugugguuuccacaagcgccguggaaauggagucccuccccgccgggaccugggaacgggaggaagaccugacaaauuucugccaccaggagugucaagucaccgagacggaaugccuuuguccuuaugaggcucuggugcucagaaaaccccuguaccuggauucuauuguuaagggaaugaaaaaccuucugaauagcacaucccucgaaaccagccugucuaucgaggcccccuggggcgcuauuaacgugcaguccacauuuaagccuaccaugagcgccgcgaauaucgcccucucuuggagcuccgucgagcaccgcgggaacaaaauccuggugucuggcagaagcgaauccauuaugaaacuugaggaacggaccggaaucucuuggaaucugggcguugaggacgcuagcgaauccaagcuccugacagugagcgucauggaucugucucagauguauuccccgguguucgaguaccuuagcggggaccgccagguggaggaauggcccaaagccacgugcaccggagauuguccugagagaugcggcugcacauccucuaccugucugcauaaggaauggccccacagccggaacuggcgcugcaauccuacaugguguuggggagucgggaccggcugcacguguugcggccucgacguuaaagaccuguuuacagauuacauguucauuaaguggaaaguggaguauaucaagaccgaagcuauugugugugucgagcucaccucccaagagagacagugcacacugaucgaagccgggacccgguuuaaccuuggacccgugaucauuacacugucugagccucgcaauauccagcagaagcugccgcccgaaauuguuacgcuccauccuagaaucgaggaaggcuucuuugaccugaugcacgugcaaaaaguccuuagcgcguccaccguguguaagcugcagagcugcacacaugggguucccggagaucuccagguguaccacauuggcaaccugcucaaaggggacaaggucaacggacaccugauccauaaaaucgagccucacuucaauaccucuuggauguccugggauggcugugaccuugauuauuacugcaacaugggcgacuggcccagcugcacauauaccggggugacgcagcauaaucacgccgcuuuugucaacaugcugaauauugagaccgauuacacaaagaacuuccauuuucacucuaaacgggugaccgcccacggagacacaccgcaacuggaucucaaggcucgcccuaccuauggcgccggggaaaucacaguucugguggaggucgccgacauggaacuucauacgaagaaaauugagaucuccggacugaaguucgcuagccucaccuguacaggcugcuacgcguguucuagcgggauuuccugcaaagugagaauccacguugaugagcccgacgaacugaccgugcaugucaagucugaggaccccgauauuguggccgcuagcuccagccucauggcccggaaacuggaauuuggaaccgacuccacauucaaggccuucucugcuaugccuaagacgagccuuuguuuuuacaucguggagagagaauauugcaaauccuguucuaaggaggauacccagaaaugcguuaauacaaagcuggagcagccccaaagcauccugauugaacacaaaggcaccaucauuggcaagcagaacaauacauguaccgccaaggcguccugcuggcucgagucugucaagagcuucuuuuacgggcugaagaacaugcuuuccggaaucuucggcaauguguuuauugggguguuccuguuuuucgcuccuuuuauccuccugauccucuucuuuauguucggauggcgcauucuguucuguuuuaaaugcugccggagaacgcgcggccuuuucaaguaucggcaccugaaagacgaugaagagacaggguacagaaagaucauugaacgccugaacaauaagaaaggaaagaacaaacuccuggacggcgagcggcuugccgauagaaagaucgccgagcuguuuagcaccaaaacccauauuggcuga

SEQ ID NO: 13673 - RNA, 5055 nt, Artificial Sequence
  derived and/or modified CDS sequence (opt5) from CCHFV(SPU 130/89)__KJ682807.1__GP
auguacacaccccugcucugcgccauccugugucuucagcuguggagccucgagggcauuuaugggcuguccaacaagacccaacacaaugacaacucuacgaccaaagcuccugaagagagccauaagacaucccuuccggccaauaccgcgucucccaucacaagcgauccucccuccaccacaucuaccacgagcgcuuccggaccugaaggcagcggggacaccucuacaucucccccugugaccacacagggaccggccagccccgagaccacgccugaaccccacacaaccauugauaucgacaaaucuuccacagccauugcugauaucagcacccagaccgucaaggacaucccuacacccacgacccauacaucucugccguccacccucagcgccccuacaauuccccaggaggcucaccauaccgccagaggccugcuguccguuacgcggcacaaaccuggggaggcgucuaagcccacaagccccggagaagccuccaccgaggcuagcuccucccaaccuaccaucagcgaaacaccgucucccccucccaccacacaggccccuacggagauuaacaaucccaacaccagccgccagccgaugccuuccacacagcccgcugccccuucuagcgugacccaccccgcgcaaccuacacccucccagagcgaugugccgaccgccgcucaggacauccauccuucucccacgaauagauccaagcggaaccucgagauggaaauuauccugacccuuagccagggccugaaaaaguacuauggcaaaguccucaagcugcuugaucugacacucgaggaagacaccgaggggcugcuggaauggugcaaacgcaaucucggacugacaugugaugacaacuucuuucaaaagagaauugaggaguucuuucuuaccggcgaagggcacuucaaugaggugcugcaguuuaagacgcccucuacacucuccccuaccgaaccggcccggguugagagccccacaguggaaccuuucaaauccuacuuugcuaagggauuccugucuauggauagcggcuauuuuuccgccaaaugcuaccccaagucuagcaacuccgggcuucagcugaucaaugucacccaacaucucauccgcauuaccgacacaccuggacccaaaaucacgaaccugaagaccauuaauuguaucaaccugaaagcccucguguucaaggagcacagagagauugaaaucaacguucugcuuccucagguggcugucaaucugagcaacugccacgugcucaucaagucucaugugugugacuauucccuggauauugacggccccguccggcuuccgagcauccaccaugagggcacauuuauuccugggaccuacaaaaucguuauugauaagaaaaauaagcagaacgaccgcugcacacuggugaccaauugugugaucaaaggaagagaaauccggaagggccagucuguccuccgccaauacagaacggagauuaagaucgggaaagcguccagcggaucucggcgccugcugagcgaggaacccaacuaugauugccucuccagaacacagcugcuucggaccgagaaugccgaaauucacagcgacaacuacggcgggccuggagauaagaucaccauuuguaauggcucuacaaucguggaccagagacugggcuccgagcucgggugcuauaccauuaaccgcguuaagagcuucaagcugugcgaaaauuccgcuacaggaaaaucuugugagaucgauagcacgcccgugcggugcagacagggcuuuugucugaagaucacccaagaggggcgcggacaugucaaacuuucccggggcucugaagugguucucgacgccugcgauagcuccugugagauuaugaucccgaaagggacaggcgacauucugguggacugcucuggaggccagcagcacuuccugaaggauaaccucgucgaccugggguguccuaauaucccccuucugggaaaaauggccauuuacaucugcagaaugagcaaccacccuaagaccacaauggcuuuccucuuuugguucuccuuuggcuaugugaucaccuguauucugugcaaagucaucuucuaccugcuuauugugguugggacgcucggaaagaaguuuaaacaguaucgcgaacugaagccccaaaccuguacaaucugcgagaccaaucccgugaacgccauugaugcggaaaugcaugaccugaacugcagcuacaauaucuguccuuacugcgcuucucggcucacauccgauggccuggccagacacgucaugcaguguccgaaacgcaaggagaaaaucgaggaaaccgagcuuuaucugaaccucgaacggauucccugggugguuagaaagcugcuccaggugagcgagucuacaggggucgcccuuaaacgcuccagcuggcucguggugcugcugguucuccugaccgucucucuuuccccugugcagagcgcucccaucucccauggcgaaacgguggaggucuaccaaacacgggagggauauaccagcauuugccuguucgugcucggcucuauccuguuucugguuagcugucuuaugaaggggcucguggacuccgucggaaauucuuucuuuccuggccugagcauuugcaagaccuguuccaucgggucuaucaacggauucgaaauugagagccacaaaugcuacuguucccuguuuugcugucccuauugcagacacugcucugccgauaucgaaauucauaagcuccaccugagcaucuguaaaaagcggaaaacaggcuccaaugugaugcuugcuguuugcaagcgcauguguuucagagccaccguggaggucagcaacaaggcgcugcucauucggaauaucauuaacacgacauuugugguuugcauccugauccuggccgugugugucgugucuaccuccgcuguggaaauggagaaucuuccugccgggacaugggagaaagaagaggaccugaccaacuucugccaucaggaaugucaggucacagagaccgagugccucuguccguacgaagcucugguucucagaaagccccugagccuugauucuauugugaaaggcaugaagaaucugcucaacuccacgagccuggagaccucccugucuaucgaagccccuuggggagcgauuaaugugcaaagcacauucaaacccaccgucuccgccgcuaacaucgcccuuagcuggucuuccguggagcaccgcggcaauaagauucugguuagcgggcggucugaaagcaucaugaagcucgaggagagaacaggaaucuccugggaccugggcguggaagaugcuucugagagcaaacuccugaccgucuccgugauggaccuuucucagauguauagcccuguuuuugaauaccuguccggggaucgccagguggaggaauggcccaaggccacgugcacaggagacuguccggagagaugcggcugcaccagcucuacaugucuccauaaagaguggccucacucccggaacuggcgcugcaaccccaccugguguuggggcgucgggaccggaugcacauguugcggccuggacgugaaggaucuguucacggacuacauguuuguuaaauggaagguggauuauauuaagaccgaagccaucgucuguguggagcuuacaagccaggaaagacaaugcucccugauugaggcugggacccgguucaaucucggacccgugacaaucacccugucugaaccucgcaacauucagcagaaacugcccccugagaucgucacgcugcacccgagaaucgaggaaggcuuuuucgaccuuaugcauauucagaagguucugagcgcguccacaguguguaaacugcaaucuugcacccacggggugcccggagaucuccagaucuaccauauuggcaaucugcuuaagggcgacaaagucaacgggcaccugauccauaagauugagccucacuuuaauaccagcuggauguccugggauggaugugaccucgauuauuacugcaacaugggcgacuggcccagcugcucuuauacaggggugacccagcacaaucaugccgcuuucguuaacaugcugaauaucgaaacagauuacacgaaaaacuuucacuuccauuccaagcgggugaccgcccacggagacacaccucagcucgaucugaaggcccgccccaccuauggcgcuggggagauuacaguccuuguggagguugccgacauggaacugcacaccaaaaagguggagaucagcggacugaaauuugcgucucucacguguaccggcugcuacgcuuguuccagcggcaucucuugcaagguccggauucauguggacgaaccggaugagcugacaguccacgugaaaagcgaagacccugauaucguugccgccuccucuagccuuauggcuagaaagcuggaguucgggaccgacuccacauuuaaggccuucagcgcgaugcccaaaaccucccucuguuucuacauuguggagcgcgaacauugcaagucuuguagcaaagaggauacacaaagaugcgucaauacgaagcuggaacagccucaguccauccucauugagcacaaaggaaccaucaucggcaagcaaaacgacacauguaccgcuaaggccucuugcuggcuggaaagcauuaaauccuuuuucuaugggcuuaagaauaugcugucuggaaucuuuggcaacguguucauugggguuuuucuguuccucgcccccuuuaucauucugauccuuuucuuuauguucggauggcggauccuguuuuguuucaaaugcugcagacgcacccggggccuccugaaguacagacaucucaaagaugacgaggagauuggcuaucgcaagaucauugaacggcugaauaacaagaaagggaagaacaaacuucuggauggagagagacuggcugaccgcaagaucgccgaacucuucagcacaaaaacgcacauuggcuga

SEQ ID NO: 13674 - RNA, 5052 nt, Artificial Sequence
  derived and/or modified CDS sequence (opt5) from CCHFV(4701-ST-2009)__KR814872.1__GP
augcacacccugcucgugugcuucauccuguaccuucagcugagcggccucgggggagcccauggccaauccaacgcuacagagcacaaugggacgaacaccacaaccgcccccggaacaucucagagcccuaagccgcccgcguccaccacacugccucauacccccgaaucuagcacggucaaacuuaccacaccuaccuccgagacagaaggcucuggggagaccacgcccccuccgaauacaacccagggacugccccucacaggcaccaccccugaaagaagcgcuacaacggccaccuccacaagcucuaccgacaacaugaacuccacaacccagguuacggauaauacacccaccagcaccgugucuauuuccccuagcagcuccagcuccaugcccucuacaccgcaaggcacccaccauccugugcggagccugcuguccgucagcucucccaagacagugacgaccccuacacccaugucccccggggagaugagcccugagaccucuagccagcacuccgccaugucucgcguuccgacacucuauaccgcuacccaggugagcaccgaaaauacagacagauccacgccccggcagagcgagucuuccguccaaccugccacacagagccccaucaccucuccugcucagacgauucugcuuauguccgccgcgcccaaagccauccaggauaugcacccgagcccuacaaaccgcuccaagagaaaucuggaaguggagauuauccucacccugucucaaggacuuaaaaaguacuauggcaagauccugaaacuccugcaucugacacucgaggaagacaccgaggggcugcuugaaugguguaagcggaaccugggaagcaauugcgaugacgauuucuuccagaaacgcauugaggaauuuuucaucaccggcgagggguacuuuaacgagguucuccaguucaagacacuguccacgcuuucucccaccgaaccuagccacgugagacugcccacagcugagccuuuuaaauccuauuucgccaagggauuucucagcauugacucuggcuacuucuccgcuaaguguuauccccggagcucuaccuccggccugcaacugaucaaugucacacagcauccggcccgcauugcggaaaccccugggcccaaaacgacaagccucaagaccaucaacugcauuaaucugagagccucuguguuuaaagagcaccgggaaguggagaucaacguccuucugccccagaucgcuguuaaccucagcaauugucacguggugauuaacucccaugucugcgauuacagccuggacaccgauggaccugugcgccuuccgagaauccaccaugagggcacauucauucccgggaccuacaagaucguuauugaccggaaaaauaagcugaacgaucgcuguucucucgugacaaauugcgucaucaaaggaagagaagugcggaagggccaguccguucugagacaauauaagacggagaucaaaauugggaaggccagcaccggaucccgcaaacugcucucugaggaaccuggcgacgacuguaucagccggacacagcugcuuaagaccgaaacagcugagauucacgaugacaacuacggcgggcccggagauaaaaucaccauuugcaauggcuccacgguggucgaccagagacuggggucugagcucggauguuauaccaucaaccgcgucaagagcuuuaagcugugcgaaaauuccgccacaggcaaaaccugcgagaucgauucuacaccugugaagugucggcagggguucugccugaaaauuacccaagaaggcagaggacaugugaaacuuagccgcggcuccgagguugugcucgacgccugugauagcucuugcgagaucaugauucccaaggggacaggagacauccuggucgauuguuccggcgggcagcagcacuuccugaaggacaaccucauugaucugggaugcccucacaucccccuucugggcaagauggcuauuuacaucugucggaugagcaaucauccgagaaccacgauggcguuucucuucugguuuucuuucggguaugugaucacaugcaucuuuuguaaagcccuguucuacucccugauuauuaucggcacccuuggaaagaaaauuaagcaguaucgcgaacucaaaccucaaaccugcacaaucugugagaccgcucccguuaacgccaucgacgccgaaaugcacgaccugaauugcagcuacaacauuugcccuuacugugcuucucggcugacguccgauggccucgccagacaugugacacagugccccaagcgcaaggagaaagucgaagagaccgagcuguaucuuaaucuggaacggaucccguggauugugagaaagcuccuucaggugagcgaguccacagggguugcgcugaaacggagcucuuggcuuaucguccuccuggugcugcucaccgugagccuguccccuguccagucugcucccgugggacacggcaagacaauugaaaccuaccaaacgcgcgagggguuuaccagcaucugucuuuucaugcugggauccauccucuuuauuguuucuugccuggugaaaggccuggucgacagcguguccgauucuuucuuuccugggcuuagcguuuguaagacaugcuccaucggcagcauuaacggauucgaaaucgagucucacaaauguuauugcucccucuuuuguugccccuacuguagacauugcagcgccgaccgggagauucaccagcugcaucugucuaucugcaagaagagaaaaaccggcuccaacgugaugcucgccgucuguaagcgcaugugcuucaaagcuacaaucgaagccagccggagagcucugcuuauucgcuccaucauuaauaccacguucgugauguguauccugacacucgccauuugcguugugucuaccagcgcggucgagauggaagaucugcccgccgggacaugggagagagaagaggaccugaccaacuuuugucaccaggagugccaagugaccgaaacagagugucuuugcccuuaugaagcucuggugcuccggaagccgcuguuccucgauuccaucgucaaaggaaugaagaaucugcuuaacagcacgucucuggagaccucccucagcauugaggcccccuggggcgcuaucaauguucagucuacauuuaagccuaccgugagcacagccaacaucgcgcuguccuggucuagcguggaacaucgcgggaauaaaauucuggucaccggaagauccgagucuaucaugaaacuugaggaacggacgggcgugagcugggaccuggggguugaagaugccuccgagagcaagcuccugacagugucuauuauggaccucucccagauguacagccccgucuucgaguaucuguccggcgaucgccagguggaagaguggccuaaggcuaccuguaccggagacugccccgaaagauguggcugcacaucuucuaccugccuucacaaagaguggccucacucccggaacuggcgcuguaauccgacauggugcuggggaguuggaacgggcuguaccugcugugggguggaugucaaggaccuguuuacagaccauauguucaucaaguggaaaguggaauacauuaagaccgaggccaucguuugcguggagcucacaucucaagaaagacaguguagccugaucgaggcuggaacccgguuuaaccugggccccgucacgauuacccuuuccgaaccucgcaauauccagcagaaacugcccccugagauuaucacacuccaccccaagauugaagagggcuucuuugaucugaugcaugugcaaaaagugcucagcgccucuaccgucugcaagcugcaguccuguacacacgggaucccgggagaccuucagaucuaccauauuggcaaccugcugaagggggauagaguuaauggacaccucauccacaaaauugagccucauuucaacaccagcuggaugucuugggacggcugcgaucuggacuauuacuguaauaugggggauuggcccuccugcacauauacgggagugacccagcacaaccaugccgcuuuugugaaccuucugaauaucgaaacagacuacaccaagaccuuccacuuucacagcaaacgggucacagcgcauggcgauacgccccaacucgaccugaaggccagaccuaccuauggcgcuggggagauuacagugcucguugaaguggccgauauggagcugcacaccaaaaaggucgagaucucuggacuuaaauucgccagccugacaugcaccggcuguuacgcuugcuccucugggauuagcuguaaggugcgcauccauguugacgaacccgaugagcugacggugcacgucaaguccagcgacccugacguggucgccgcguccacaucucucauggcucggaaacuggaauuuggaaccgauagcaccuuuaaggccuucuccgccaugccgaaaacaucucuuugcuuuuauaucguggagagagaauacuguaagagcugcuccgaggacgauaccaaaaaguguguugacacaaagcuggagcagccccagucuauucucaucgaacauaaaggcaccauuaucgggaagcaaaacgauacgugcacagcuaaagccagcuguuggcuggaguccgucaagagcuucuuuuacggacucaaaaauaugcugggcucuguguucggcggguuuuucguggggauucuucuguuucuggcgccuuucguucuccuggugcuguuuuucauguucggcuggaagauccuguuuugcuucaaguguugccgccggaccagagggcucuuuaaauaucgccaccugaaggacgaugaagagacaggauaccggagaaucauugaacgccucaacuccaaaaagggcaaaaaucggcugcuugacggggagagacuggcugaucggaagaucgccgagcuguucagcaccaagacgcacauuggauga

SEQ ID NO: 13675 - RNA, 5052 nt, Artificial Sequence
  derived and/or modified CDS sequence (opt5) from CCHFV(36-ST-2014)__KR814857.1__GP
augcacacccugcucgugugcuucauccuguaccuucagcugagcggccucgggggagcccauggccaauccaacgcuacagagcacaaugggacgaacaccacaaccguccccggaacaucucagagcccuaagccgcccgccuccaccacacugccucauacccccgaaucuagcacgguuaaacuuaccacaccuaccuccgagacagaaggcucuggggagaccacgcccccuccgaauacaacccagggacugcccccucccggcacaaccccugaaagacccgcgaccacagcuacgagcauguccagcaccgacaacaugaacucuacaacccaggugacagauaauaccccgacguccacagugagcauuucuccuuccagcucucccuccaugccuagcaccucccaaggcauccacuaucccguccggucucuccugagcguguccagccccaagaccguuacaaccccuacaccgaugucucccggggagauguccccugagacgagcucucagcauagcgccaugucccgcauucccacccuguacacagccacccaggugucuacagaaaauaccaacagaagcacgccucggcaguccgagagcucugcucaacccgccacccaguccccgacaaccagcccuacacagaccauccuccugaugucugcugcccccaaagcgauucaggacaugcacccuucccccacgaaucgcagcaagagaaaccuugaagucgagaucauccugacacucucccaaggacugaaaaaguauuacggcaagauucuuaaacugcuccaccugacccuggaggaagauacagaggggcuccuggaaugguguaagcggaaucuuggaucuaacugcgacgaugacuuuuuccagaaacgcaucgaggaauuuuucauuaccggcgagggguauuuuaaugaggugcugcaguucaagacccucagcacacuguccccuacggaacccucucauguuagacuuccgaccgccgagccuuuuaaaagcuacuucgcuaagggauuucuguccaucgauagcggcuauuucucugccaaguguuacccccgguccagcacaucuggccuccaacugauuaacgugacccagcaccccgcucgcaucgccgaaacaccugggccgaaaaccacgucccugaagacaauuaauugcaucaaccucagagcgagcgucuuuaaagagcaucgggaaguggagaucaacgugcugcuuccccagauugccgucaaucugucuaacugucacguugugaucaauagccacgugugcgacuacucccucgauaccgacggaccuguccgccugccccggauucaucacgagggcaccuucaucccugggacauauaagauugugaucgauaaaaagaacaaacuuaaugaccgguguagccugguuaccaacugcgugaucaagggacgcgaagucagaaagggccagucugugcuccggcaauacaaaacagagauuaagaucgggaaagcguccacgggaagcagaaagcugcuguccgaggaacccggcgaugacuguauuucucgcacccagcuccugaaaacagaaaccgccgagauccaugacgauaauuauggcgggccuggagacaagauuacaaucugcaacggcagcaccaucguugaucagcggcuuggguccgagcugggauguuacacgauuaauagagugaagucuuuuaaacucugcgaaaacagcgcuaccggcaagacaugcgagaucgacuccacccccgucaaaugucgccagggguucugccugaagauuacacaagaaggccggggacacgugaaacugucuagaggcagcgaggucgugcuugaugccugugacuccagcugcgagaucaugauuccgaaggggaccggagauauccucguugacuguucuggcgggcagcagcauuuccugaaggauaaucugauugaccucggaugcccucacaucccccugcuuggcaaaauggccaucuauauuugucgcauguccaaccacccucggacaaccauggcuuuucuguucugguuuagcuucggguacgugaucacgugcaucuuuuguaaggcucucuucuauucucugauuauuaucggcacacuggggaaaaagaucaaacaguacagagaacuuaagccccaaaccugcaccauuugugagacagccccggucaaugcuaucgaugccgaaaugcaugaccucaacugcuccuacaauauuugcccuuauugugccagccgccugaccucugacggccuggcucggcacgugacgcagugccccaagagaaaagagaagguugaagagacagagcucuaccugaaccuugaacgcaucccuuggauugugcggaaacugcuccaggucuccgagagcaccgggguggcccugaagagauccagcuggcugaucgugcuucucguucugcugacagucucucucagccccgugcaguccgcgcccgugggacauggcaaaaccaucgaaacauaucaaacccgggagggguuuacgaacauuugucuguucaugcuuggaucuauccuguuuauugucagcugccucgugaagggccugguugauuccgugucugacagcuucuuuccugggcuguccgucuguaaaaccugcucuaucggcagcauuaauggauucgaaaucgagucccacaaguguuacugcagccucuuuuguugcccguauugucgccacugcucugcugauagagagauccaucagcuucaccugggcauuugcaagaaacggaagacaggguccaacgugaugcuggccguuuguaaaagaaugugcuucaaggccaccaucgaagcuagccgccgggcccuccugauuagaucuaucauuaauacaaccuucgugaucuguauucuuacgcuggcuaucugcgucguguccacaagcgccguugagauggaaaaccuccccgcgggaaccugggagcgcgaagaggaccugacaaauuuuugucaucaggagugccaaguguccgaaaccgagugucugugcccuuacgaagcccuuguccugagaaaaccccucuuccuggauucuaucgugaagggcaugaagaaccuccugaauagcaccucccuugagacaagccugucuauugaggcuccuuggggagccaucaacgugcaguccacguuuaaacccaccgucagcacagcuaauauugcccucucuuggagcuccguugaacaccggggaaacaagauccuggugaccggccgcucugagagcauuaugaaacuggaagagagaacagggguguccugggaccuuggcgucgaagaugcgucugagagcaagcugcucaccguguccaucauggaccugagccagauguauucuccuguuuucgaguaccucuccggagauagacagguggaagaguggccgaaagccacguguacaggcgacugccccgaacgcugugggugcaccagcucuaccugccugcauaaggaguggccucacuccagaaauuggcgguguaaccccacauggugcuggggagucggcaccggguguacaugcuguggaguggauguuaaggaccuuuuuacggaucacauguucaucaaauggaagguggaauacauuaaaaccgaggcuaucgucugcguggagcugacaagccaagaacgccaguguucccucauugaggccggcaccagauuuaaucugggcccuguuacaaucacccugucugaaccccggaacauucagcagaaacuuccgccugagaucaucacgcugcaucccaaaauugaagagggguucuuugaccucaugcacgugcaaaagguccugagcgcuuccaccgugugcaagcuccagagcuguacacauggaauccccggcgaccugcagauuuaucacaucgggaaucuucugaaaggagaucgccugaacggccaucucauucacaagaucgagccucacuucaacaccucuuggauguccugggacgggugcgaucuggacuacuauuguaauaugggagauuggcccagcugcacauacaccggcgugacacagcauaaccacgccgccuuugucaaucuucugaacauugaaacggacuauaccaaaacauuccauuuucacucuaagagaguuaccgcucacggcgauaccccucaacucgaccugaaagcgcggccgacauacggggccggagagaucacggugcucguggaagucgcugauauggagcugcauaccaagaaaguggagaucuccggccuuaaguucgccagccuggccugcacaggguguuaugcuugcucuagcggaauuuccuguaagguuagaauccacguggacgaacccgaugagcugaccguccaugugaaaucuagcgacccugauguuguggccgcguccacaagccucauggcucgcaagcuggaguucggcaccgacuccacguuuaaagccuucucugccaugcccaagacaagccuuugcuuuuacauugucgaacgggaauacuguaaauccugcucugaggacgauaccaagaaguguguggacaccaaacuggaucagccucagagcauccucauugagcacaaggggacaaucaucggaaaacaaaaugauaccugcacagcuaaggccuccuguuggcuggaaucugucaagagcuucuuuuauggccucaagaacaugcugggcuccguguucgggaacuuuuucguuggcauucuucuguuucuggcgcccuucgugcuccugguccuuuucuuuaugugcggauggaaguuccuguuuuguuucaaaugcugcagacgcacccgggggcucuuuaaguacagacaucugaaagacgacgaggaaacgggauaucgccggaucauugagagacucaauagcaagaaaggcaagaaucgccugcuugauggggaacggcuggcugacagaaagaucgccgagcuguucucuacaaaaucccacauuggauga

SEQ ID NO: 13676 - RNA, 5055 nt, Artificial Sequence
  derived and/or modified CDS sequence (opt5) from CCHFV(Matin)__AF467769.2__GP
auguacacccugcuccugugcgccauccuuuguagccagcugugguccucugagggcauucacgggcucagcaacgaaacacaacauggaaaugcuuccacgaucaaggcccccgaggugucucagggccuggggcuuccugucagcaccgcgccgcccauuacauccgacccucccucuaucaccagcgcugccuccguuagcggaccugaaggcucuggggauacaaacaccuccccucccgugacaacccagggacugacgcucccggagaccacacuggaacugcucaccacaaccaauacgggcgccagcucuacagugauugucgacguguccacccagacaguuaaagauacccccgugagcaccgcucacacaucuccucccggcacgccuuccgcccccaccacaccgcaagggacccaucacacagcuagaggacugcuuagcgucaccuccacgaagucugaggaggccagcacacagaccaacccuaaaaagaccuccauggaaacaaauagccccggcccugcgaccucugagacacccucccccagcccuacgacccaggccccgacagaaaacaauaaccccaauaccccucggcagcccacaccucccacccaaccggcuacgccuucucccgugaccagcccugcccugcucgcuuccucucagggggacacaagcaccgccguucaggaugugcaucccuccccuacaaaccgcagcaaaagaaaucuggagauggagaucauccuuacccugucucagggacucaagaaguauuacggcaaaauucugaagcugcucgaccugacgcuugaagaggauacagaagggcugcucgaguggugcaaacggaaccugggacuugucugugacgauuccuucuuucaaaagcgcaucgaagaguucuuucugaccggcgagggccacuucaaugaagugcuccaguuuaaaacacccagcacccugucuccgaccgagccugcgagagccgggucccccacaguggaacccuucaagagcuauuuugcucggggacugcucuccauggacucuggcuacuucagcgccaagugcuauccucgcgcuuccaacucugggcugcagcuuauuaauaucacgcaacacagcgccagaauuaccgauacaccgggacccaaaaucaccaaccugaagacaauuaacuguaucaaucucaaagccuccaccuuuaaggagcaucgggaaaucgagauuaacguccugcuuccucagguugcugugaaucugagcucuugccacgugcucaucaaaucccaugucugugacuacagccuggauauugacggccccgugcgccugccuagaauccaccacgaggggacguucauucccggaacauauaagaucguuaucgacaaaaagaacaagcagaaugaucggugcaccauugugaccaacugugucaucaaaggccgcgaaauuagaaagggccagucugugcuccggcaauacaaaacagagaucaagauugggaaagcguccagcggaucucgcagacugcuuagcgaagaguccggcgacgauugcaucagccggacccagcugcucagaacagaaacggccgagauccauucugacuccuacgggggaccuggcgauaagauuaccaucuguaaugggagcacaguuguggaccagcgccugggcuccgagcugggaugcuauaccauuaaccgggucaagucuuuuaaacuuugcgaaaauagcgcuacaggcaaguccugugagaucgauucuacccccgugaaaugcagacagggguucugucucaagauuacgcaagaaggacgcggccacgucaaacugagccggggguccgaggugguucuggacgccugcgauucuagcugugagaucaugauuccgaagggaaccggcgacauccucguggauugcuccgggggccagcagcauuuucugaaggacaaccuuaucgaccugggauguccuaauauuccccuccugggcaaaauggccaucuacauuugcagaaugagcaaccacccuaagacaaccauggucuuccuguucugguuuucuuucggguaugugaucacauguauucuuugcaaaguuaucuuuuaccuccugaucguggucggaacccugggcaagaaauucaagcaguaucgcgaacucaagccccaaacauguaccauuugcgagacgacaccggugaaugcuaucgaugccgaaaugcaugaccugaacugcuccuacaauauuuguccuuauugcgcgagccggcuuaccucugaugggcuggcuagacacgugaugcagugucccaaacgcaaggagaaaaucgaagagaccgagcucuaccugaaccuggaacggauuccuuggguugucagaaagcugcuccagguguccgagagcacaggaguggcccugaaaagaucuuccuggcuggucgugcuccugguucuucugaccgugagccucucccccguccagagcgcccccaucggccacgggaagacgguggaaacauaccaaauccgggagggcuauaccucuguuugccuguuugugcugggaagcauucuuuucaucgucuccugucucaugaaaggccugguggacucugaugggaacagcuuuuucccuggacuguccauuugcaagacauguucuaucggcagcauuaauggguuugaaaucgagucccauaagugcuacuguucucucuucugcuguccguauugcagacacugcagcaccgaccgggagauccauaaacugcaccuuuccauuuguaagaaacgcaagacaggaagcaacguuaugcuggcugugugcaaaagaauguguuuucgggccaccgucgaagugucuaauaaggcucuccugaucagauccauuaucaacacgaccuucguggucugcauucugauccuugccguuuguguggugagcacaucugcggucgagauggaaucccugcccgccggcaccugggagcgcgaagaggaucucauuaauuuuugccaccaggagugucaggugacagaaaccgagugccuguguccuuacgaagcucucguucugcggaagccccuuuuccuggacagcaucaucaaagggaugaagaaccuccuuaauuccacgucucuggagacaagccuuuccauugaggccccuuggggcgcuaucaacgugcaaagcaccuucaaacccacaaugucugccgcgaauauugcccuguccuggagcucugucgaacauagaggaaacaagauccucgugagcggccgcuccgagucuauuaugaaacuggaagagagaaccgggaucagcugggaucucggaguugaagacgcuuccgagucuaagcugcuuaccgugagcgucauggaucugucccagauguauagcccuguguuugaguaccucucuggcgaccggcagguugaagaguggccgaaggccacaugcacgggggauugucccgaacgcugcggaugcaccuccagcacaugucugcacaaagaguggccucauuccagaaauuggcggugcaaccccaccugguguuggggcgugggcacagggugcaccuguugcggacuggacgucaaggaccuuuucacggauuauauguuugugaaauggaagguggaauacaucaaaacagaggucauuguuuguguggagcugaccucucaggaacgccaaugcagccucaucgaggcuggcaccagauucaaucuggggccugugacaauuacccucuccgaaccccggaacauccagcagaagcugccgccugagauugucacacuucacccccgcaucgaagagggauuuuucgaccugaugcaugugcagaagguucugucugccagcacgguguguaaacuccaauccugcacccacggcguccccggggaucuucagguguaccacaucggaaaucuucugaagggcgacaaaguuaacggccaucucauucacaagaucgagccucauuuuaacacaagcuggaugucuugggaugggugugaccuggauuauuacugcaauaugggagacuggcccuccugcagcuauaccggcgugacacagcacaaccaugccgcuuucgucaauaugcucucuauugaaaccgauuacacgaaaaacuuucacuuccacuccaagagagugaccgcgcauggggacacaccucagcuggaucuuaaagcccggccgaccuauggagcuggcgagaucacaguccugguggaaguugccgacauggagcugcacaccaagaagauugagaucagcgggcucaaauuugccucucugacauguacgggaugcuacgcuuguagcuccggcauuucuugcaaggugcgcauccaugucgaugaacccgacgagcuuaccgugcacguuaaaagcgaagacccugauaucguggccgcguccagcucccugauggcuagaaagcucgaguucggcacagacucuaccuuuaaagccuucagcgccaugcccaagaccucccuguguuucuauauugucgaacgggaguacugcaagucuuguagcaaagaggauacacaaaagugcgugaauacgaaacucgaacagccucaguccauccugauugagcacaaggggaccaucauuggaaaacaaaacgacacauguaccgcuaaggccucuugcuggcuugaaagcgugaaguccuuuuucuacggccugaaaaauaugcugagcgggaucuuuggaaacguuuucaucggcauuuuucucuuccuggcgcccuuugcucugcugauccucuucuuuauguucggguggcgcauucuguuuuguuucaagugcugccgccggacaagaggacucuucaaauaucgccaucugaaggaugacgaggaaaccggcuaccggaaaaucauugagagacuuaauaacaagaagggcaaaaauaagcugcuggauggggagcgccucgccgaccggaaaaucgccgaacuguuuucuacgaagacacacgucggauga

SEQ ID NO: 13677 - RNA, 5052 nt, Artificial Sequence
  derived and/or modified CDS sequence (opt5) from CCHFV(UCCR4405)__KY484029.1__GP
augcacgcccugcucgugugcuucauccuguaccuucagcugagcggccucgggggagcucauagacaauccaacgccaccgagcacaauggcacaaacacgaccacagcgcccgggaccucucagagcccuaagccgcccgucuccacaacccugccucauacacccgaagccucuaccauuaaacuuacgaccccuacaagcgagaccgaaggauccggcgagacaacgcccccuccgaauaccacacaggggcugccccucccuggaaccacacccgaacggucugccaccaccgccacaagcacguccagcaccgacgauaugaacucuacaacccagaugacagacaauaccccuacguccacaguuagcaucggccugucuuccagccccucuaugccguccaccagccaaggcauucacuauccugugcgcucccugcucucugugagcucccccaagaccgcuacaaccccuacacccaugagccccggggaggucucuccugagacguccagccagcauucugccaugagcagaaucccgacccuguacacagcuacccagguguccacagaaaacaccaaucggucuauuccccgccagagcgaguccagcguucaaccugccacgcagucucccaucaccuccccugcgcagacaauccuucugaugagcgccgcucccaccgccauucaggauaugcacccgucuccuaaaaacagauccaagcggaaucucgaaguggagaucauucugacacuuagccaaggacugaaaaaguauuacggcaagauccucaaacugcugcaccucacccuggaggaagacacggaggggcuucuggaaugguguaagcgcaaccucggauccaauugcgaugacgacuuuuuccagaaaagaauugaggaauuuuucaucacaggcgagggguauuuuaacgagguccugcaguucaagacccccucuacacuuagcccuaccgaacccucccaugugcggcugccuaccgcugagcccuuuaaaucuuacuucgccaagggauuucucagcauugauuccggcuauuucagcgcgaaguguuacccgagaucuuccacaagcggccugcaacugaucaauguuacgcagcacccugcccgcaucgcugaaacccccgggcccaaaacaaccucucucaagacaauuaacugcaucaaucugcgggccuccguguuuaaagagcaucgcgaagucgagauuaacgugcuucugccucagaucgcugugaaccucagcaauugucacgucguuauuaacucucacgugugcgauuacagccuggacaccgauggaccggugagacuuccccggauccaucacgagggcgccuucaucccugggacguauaagauugucaucgacaaaaagaauaaacugaacgaucgcuguucccucgugacaaauugcguuauuaagggaagagaagugcggaagggccagagcguccugagacaauacaaaaccgagaucaagauugggaaagccucuaccggaucccgcaagcugcucagcgaggaacccggcgacgacuguaucucccggacacagcugcuuaaaaccgaaacagcugagauccaugaugacaacuauggcgggccuggagauaagauuacgaucugcaauggcucuaccauuguggaccagagacuggggagcgagcucggauguuacacaaucaaccgcguuaaguccuuuaaacugugcgaaaauucugcgaccggcaagacaugcgagauugauagcacccccgugaaaugucggcagggguucugccugaagaucacgcaagaaggcagaggacacgucaaacuuucccgcggcucugaggugguccucgacgccugugauagcuccugcgaggugaugauuccuaaggggaccggagacauccugguugauuguagcggcgggcagcagcauuuccugaaggacaaccucaucgaucugggaugcccccacauuccgcuucugggcaaaauggcuaucuauauuugucggaugucuaaucacccuagaacaaccauggccuuucucuucugguuuuccuucggguacgugaucacaugcaucuuuuguaaggcccuguucuauagccugauuaucauuggcacccuugggaaaaagaucaaacaguaccgcgaacucaagccccaaacaugcaccauuugugagacggcuccugucaacgccaucgacgcggaaaugcaugaccugaagugcucuuacaauauuugccccuauugugcuucccggcugacaagcgauggccucgccagacacgugacccagugcccgaaacgcaaggagaaaguugaagagaccgagcuguaccuuaaccuggaacggaucccuuggaucgugagaaagcuccugcaggucucugaguccacagggguggcccugaaacggagcuccuggcuuauugugcuccugguucugcucaccgucagccugucucccgugcagagcgcuccugugggacauggcaagacgaucgaaacauaucaaacccgcgagggguuuacauccauuugucuuuucaugcugggaucuauccucuuuauugucagcugccuggugaaaggccugguugacuccgugucugauagcuucuuucccgggcuuuccgucuguaagaccugcucuaucggcagcaucaauggauucgaaauugagucccacaaguguuacugcagccucuuuuguugccccuauuguagacacuacucugccgaccgggagauccaucagcugcaccuguccauuugcaaaaagagaaaaacaggcagcaacgugaugcucgcuguuugcaagcgcauguguuucaaagccaccaucgaagcgucucggagagcccugcuuauucgcuccaucauuaacacgaccuucgugaucugcauccugauucucgcuaucugugucgugagcacauccgccguugagauggaaaaucugccugcugggaccugggagagagaagaggaucugacaaacuuuugccaucaggagugucaagugaccgaaacggagugccuuuguccguaugaagcccugguccuccggaagccccuguuccucgacucuacagugaagggaaugaaaaaucugcuuaacagcaccucccuggagacaagccucucuauugaggcgccuuggggcgccaucaaugugcaguccaccuuuaagcccaccgucagcacagcuaacauugcccugucuuggagcuccguugaacaccgcgggaauaaaauccuggugacgggaagaucugagagcaucaugaaacuugaggaacggaccggcguguccugggaucugggggucgaagacgcuucugagagcaagcuccugacaguguccauuauggaucucagccagauguacucuccuguuuucgaguaccuguccggcgaccgccagguggaagaguggcccaaggcuaccugcacaggagauuguccugaaagaugcggcuguaccagcuccacgugccuucauaaggaguggccgcacucucggaacuggcgcugcaaucccacaugguguuggggagucggaaccggcugcaccuguugcgggguggacguuaaagaucuguuuacagaccacauguucgugaaguggaaagucgaauauaucaagaccgaggccauuguguguguugagcucacaagccaagaaagacagugcucccugaucgaggcuggaacgcgguuuaaccugggcccugugaccauuacacuuucugaaccccgcaauauccagcagaaacugccucccgagaucauuacccuccauccgaagaucgaagagggcuucuuugaccugaugcacguccaaaaggugcucagcgcguccacaguguguaaacugcagagcugcacccaugggauuccuggagaucuucagaucuaccacauuggcaaccugcugaagggggacagagucaauggacaucucauccacaaaauugagccccacuucaacacgucuuggauguccugggauggcugugaccuggauuauuacugcaauauggggaacuggcccagcuguaccuauacaggaguuacccagcauaaccacgccgcuuuugugaaucuucugaacaucgaaacagacuacaccaagacauuccauuuucacucuaaacgggugacggcccacggcgauaccccucaacucgaccugaaggccagacccacauauggcgcuggggagaucaccguccucguggaaguugccgauauggagcugcauaccaaaaagguggagauuuccggacuuaaguucgcgagccuggucugcacaggcugcuacgcuuguucuagcgggaucuccugcaaagugcgcauucacguugacgaaccugaugagcugacggugcaugucaagucuagcgacccggauguggucgccgccuccaccagccucauggcucggaaacuggaguucggaacagacuccaucuuuaaggccuucucugcgaugcccaaaaccagccuuuguuuuuacauuguggaaagagaauauugcaaguccuguucugaggacgauacaaagaaaugcguugacaccaagcuggagcagccucagagcauccucaucgaacacaaaggcacgauuaucgggaagcaaaaugauacauguaccgcuaaagccuccugcuggcuggagucugucaagagcuucuuuuacggacucaagaacaugcugggcuccguguucggcaacuuuuucguggggauucuucuguuucuggcccccuucguucuccuggugcuuuucuuuauguucggauggaaaauccuguuuuguuucaagugcugucgccggaccagaggccucuuuaaauaucgccaucugaaggacgaugaagagacaggguaccggagaauuaucgaacgccucaauagcaaaaagggaaagaaucggcugcuugacggcgagagacuggcugaucggaaaaucgccgagcuguucucuaccaagacacacauuggguga

SEQ ID NO: 13678 - RNA, 5052 nt, Artificial Sequence
  derived and/or modified CDS sequence (opt5) from CCHFV(Drosdov)__DQ211630.1__GP
augcacgcccugcucgugugcuucauccuguaccuucagcugagcggccucgggggagcucauagacaauccaacgccaccgagcacaauggcacaaacacgaccacagcgcccgggaccucucagagcccuaagccgcccgucuccacaacccugccucauacacccgaagccucuaccauuaaacuuacgaccccuacaagcgagaccgaaggauccggcgagacaacgcccccuccgaauaccacacaggggcugccccucccuggaaccacacccgaacggucugccaccaccgccacaagcacguccagcaccgacgauaugaacucuacaacccagaugacagacaauaccccuacguccacaguuagcaucggccugucuuccagccccucuaugccguccaccagccaaggcauucacuauccugugcgcucccugcucucugugagcucccccaagaccgcuacaaccccuacacccaugagccccggggaggucucuccugagacguccagccagcauucugccaugagcagaaucccgacccuguacacagcuacccagguguccacagaaaacaccaaucggucuauuccccgccagagcgaguccagcguucaaccugccacgcagucucccaucaccuccccugcgcagacaauccuucugaugagcgccgcucccaccgccauucaggauaugcacccgucuccuaaaaacagauccaagcggaaucucgaaguggagaucauucugacacuuagccaaggacugaaaaaguauuacggcaagauccucaaacugcugcaccucacccuggaggaagacacggaggggcuucuggaaugguguaagcgcaaccucggauccaauugcgaugacgacuuuuuccagaaaagaauugaggaauuuuucaucacaggcgagggguauuuuaacgagguccugcaguucaagacccccucuacacuuagcccuaccgaacccucccaugugcggcugccuaccgcugagcccuuuaaaucuuacuucgccaagggauuucucagcauugauuccggcuauuucagcgcgaaguguuacccgagaucuuccacaagcggccugcaacugaucaauguuacgcagcacccugcccgcaucgcugaaacccccgggcccaaaacaaccucucucaagacaauuaacugcaucaaucugcgggccuccguguuuaaagagcaucgcgaagucgagauuaacgugcuucugccucagaucgcugugaaccucagcaauugucacgucguuauuaacucucacgugugcgauuacagccuggacaccgauggaccggugagacuuccccggauccaucacgagggcgccuucaucccugggacguauaagauugucaucgacaaaaagaauaaacugaacgaucgcuguucccucgugacaaauugcguuauuaagggaagagaagugcggaagggccagagcguccugagacaauacaaaaccgagaucaagauugggaaagccucuaccggaucccgcaagcugcucagcgaggaacccggcgacgacuguaucucccggacacagcugcuuaaaaccgaaacagcugagauccaugaugacaacuauggcgggccuggagauaagauuacgaucugcaauggcucuaccauuguggaccagagacuggggagcgagcucggauguuacacaaucaaccgcguuaaguccuuuaaacugugcgaaaauucugcgaccggcaagacaugcgagauugauagcacccccgugaaaugucggcagggguucugccugaagaucacgcaagaaggcagaggacacgucaaacuuucccgcggcucugaggugguccucgacgccugugauagcuccugcgaggugaugauuccuaaggggaccggagacauccugguugauuguagcggcgggcagcagcauuuccugaaggacaaccucaucgaucugggaugcccccacauuccgcuucugggcaaaauggcuaucuauauuugucggaugucuaaucacccuagaacaaccauggccuuucucuucugguuuuccuucggguacgugaucacaugcaucuuuuguaaggcccuguucuauagccugauuaucauuggcacccuugggaaaaagaucaaacaguaccgcgaacucaagccccaaacaugcaccauuugugagacggcuccugucaacgccaucgacgcggaaaugcaugaccugaagugcucuuacaauauuugccccuauugugcuucccggcugacaagcgauggccucgccagacacgugacccagugcccgaaacgcaaggagaaaguugaagagaccgagcuguaccuuaaccuggaacggaucccuuggaucgugagaaagcuccugcaggucucugaguccacagggguggcccugaaacggagcuccuggcuuauugugcuccugguucugcucaccgucagccugucucccgugcagagcgcuccugugggacauggcaagacgaucgaaacauaucaaacccgcgagggguuuacauccauuugucuuuucaugcugggaucuauccucuuuauugucagcugccuggugaaaggccugguugacuccgugucugauagcuucuuucccgggcuuuccgucuguaagaccugcucuaucggcagcaucaauggauucgaaauugagucccacaaguguuacugcagccucuuuuguugccccuauuguagacacuacucugccgaccgggagauccaucagcugcaccuguccauuugcaaaaagagaaaaacaggcagcaacgugaugcucgcuguuugcaagcgcauguguuucaaagccaccaucgaagcgucucggagagcccugcuuauucgcuccaucauuaacacgaccuucgugaucugcauccugauucucgcuaucugugucgugagcacauccgccguugagauggaaaaucugccugcugggaccugggagagagaagaggaucugacaaacuuuugccaucaggagugucaagugaccgaaacggagugccuuuguccguaugaagcccugguccuccggaagccccuguuccucgacucuacagugaagggaaugaaaaaucugcuuaacagcaccucccuggagacaagccucucuauugaggcgccuuggggcgccaucaaugugcaguccaccuuuaagcccaccgucagcacagcuaacauugcccugucuuggagcuccguugaacaccgcgggaauaaaauccuggugacgggaagaucugagagcaucaugaaacuugaggaacggaccggcguguccugggaucugggggucgaagacgcuucugagagcaagcuccugacaguguccauuauggaucucagccagauguacucuccuguuuucgaguaccuguccggcgaccgccagguggaagaguggcccaaggcuaccugcacaggagauuguccugaaagaugcggcuguaccagcuccacgugccuucauaaggaguggccgcacucucggaacuggcgcugcaaucccacaugguguuggggagucggaaccggcugcaccuguugcgggguggacguuaaagaucuguuuacagaccacauguucgugaaguggaaagucgaauauaugaagaccgaggccaucguguguguugagcucacaagccaagaaagacagugcucccugauugaggcuggaacgcgguuuaaccugggcccugugaccaucacacuuucugaaccccgcaauauucagcagaaacugccucccgagaucaucacccuccauccgaagauugaagagggcuucuuugaccugaugcacguccaaaaggugcucagcgcguccacaguguguaaacugcagagcugcacccaugggaucccuggagaucuucagauuuaccacaucggcaaccugcugaagggggacagagucaauggacaucucauucacaaaaucgagccccacuucaacacgucuuggauguccugggauggcugugaccuggauuauuacugcaauauggggaacuggcccagcuguaccuauacaggaguuacccagcauaaccacgccgcuuuugugaaucuucugaacauugaaacagacuacaccaagacauuccauuuucacucuaaacgggugacggcccacggcgauaccccucaacucgaccugaaggccagacccacauauggcgcuggggagaucaccguccucguggaaguugccgauauggagcugcauaccaaaaagguggagaucuccggacuuaaguucgcgagccuggucugcacaggcugcuacgcuuguucuagcgggauuuccugcaaagugcgcauccacguugacgaaccugaugagcugacggugcaugucaagucuagcgacccggauguggucgccgccuccaccagccucauggcucggaaacuggaguucggaacagacuccauuuuuaaggccuucucugcgaugcccaaaaccagccuuuguuuuuacaucguggaaagagaauauugcaaguccuguucugaggacgauacaaagaaaugcguugacaccaagcuggagcagccucagagcauucucaucgaacacaaaggcacgaucauugggaagcaaaaugauacauguaccgcuaaagccuccugcuggcuggagucugucaagagcuucuuuuacggacucaagaacaugcugggcuccguguucggcaacuuuuucguggggauccuucuguuucuggcccccuucguucuccuggugcuuuucuuuauguucggauggaaaauucuguuuuguuucaagugcugucgccggaccagaggccucuuuaaauaucgccaucugaaggacgaugaagagacaggguaccggagaaucauugaacgccucaauagcaaaaagggaaagaaucggcugcuugacggcgagagacuggcugaucggaaaaucgccgagcuguucucuaccaagacacacaucggguga

SEQ ID NO: 13679 - RNA, 5052 nt, Artificial Sequence
  derived and/or modified CDS sequence (opt5) from CCHFV(44-ST-2010)__KR814859.1__GP
augcacacccugcucgugugcuucauccuguaccuucagcugagcggccucgggggagcccauggccaauccaacgcuacagagcacaaugggacgaacaccacaaccguccccggaacaucucagagcccuaagccgcccgccuccaccacacugccucauacccccgaaucuagcacgguuaaacuuaccacaccuaccuccgagacagaaggcucuggggagaccacgcccccuccgaauacaacccagggacugcccccucccggcacaaccccugaaagacccgcgaccacagcuacgagcauguccagcaccgacaacaugaacucuacaacccaggugacagauaauaccccgacguccacagugagcauuucuccuuccagcucucccuccaugccuagcaccucccaaggcauccacuaucccguccggucucuccugagcguguccagccccaagaccguuacaaccccuacaccgaugucucccggggagauguccccugagacgagcucucagcauagcgccaugucccgcauucccacccuguacacagccacccaggugucuacagaaaauaccaacagaagcacgccucggcaguccgagagcucugcucaacccgccacccaguccccgacaaccagcccuacacagaccauccuccugaugucugcugcccccaaagcgauucaggacaugcacccuucccccacgaaucgcagcaagagaaaccuugaagucgagaucauccugacacucucccaaggacugaaaaaguauuacggcaagauucuuaaacugcuccaccugacccuggaggaagauacagaggggcuccuggaaugguguaagcggaaucuuggaucuaacugcgacgaugacuuuuuccagaaacgcaucgaggaauuuuucauuaccggcgagggguauuuuaaugaggugcugcaguucaagacccucagcacacuguccccuacggaacccucucauguuagacuuccgaccgccgagccuuuuaaaagcuacuucgcuaagggauuucuguccaucgauagcggcuauuucucugccaaguguuacccccgguccagcacaucuggccuccaacugauuaacgugacccagcaccccgcucgcaucgccgaaacaccugggccgaaaaccacgucccugaagacaauuaauugcaucaaccucagagcgagcgucuuuaaagagcaucgggaaguggagaucaacgugcugcuuccccagauugccgucaaucugucuaacugucacguugugaucaauagccacgugugcgacuacucccucgauaccgacggaccuguccgccugccccggauucaucacgagggcaccuucaucccugggacauauaagauugugaucgauaaaaagaacaaacuuaaugaccgguguagccugguuaccaacugcgugaucaagggacgcgaagucagaaagggccagucugugcuccggcaauacaaaacagagauuaagaucgggaaagcuagcacgggaagcagaaagcugcuguccgaggaacccggcgaugacuguauuucucgcacccagcuccugaaaacagaaaccgccgagauccaugacgauaauuauggcgggccuggagacaagauuacaaucugcaacggcagcaccaucguugaucagcggcuuggguccgagcugggauguuacacgauuaauagagugaagucuuuuaaacucugcgaaaacagcgcuaccggcaagacaugcgagaucgacuccacccccgucaaaugucgccagggguucugccugaagauuacacaagaaggccggggacacgugaaacugucuagaggcagcgaggucgugcuugaugccugugacuccagcugcgagaucaugauuccgaaggggaccggagauauccucguugacuguucuggcgggcagcagcauuuccugaaggauaaucugauugaccucggaugcccucacaucccccugcuuggcaaaauggccaucuauauuugucgcauguccaaccacccucggacaaccauggcuuuucugcucugguucagcuuuggguacgugaucacgugcauuuucuguaaggcgcuguuuuauucucugaucauuaucggcacacuuggaaagaagaucaaacaguacagagaacucaagccccaaaccugcaccauuugugagacagccccggucaaugcuaucgaugccgaaaugcaugaccugaacugcuccuacaauauuugcccuuauugugccagccgccugaccucugacggccucgcucggcacgugacgcagugccccaagagaaaagagaagguugaagagacagagcuguaccuuaaccuggaacgcaucccuuggauugugcggaaacuccugcaggucuccgagagcaccgggguggcccugaagagauccagcuggcuuaucgugcuccugguucugcucacagucucucugagccccgugcaguccgcgcccgugggacauggcaaaaccaucgaaacauaucaaacccgggagggguucacgaacauuugucuuuuuaugcugggaucuauccucuucauugucagcugccuggugaagggccugguugauuccgugucugacagcuuuuucccugggcuuuccgucuguaaaaccugcucuuuuggcagcaucaauggauucgaaauugagucccacaaguguuacugcagccucuuuuguugcccguauugucgccacugcucugcugauagagagauccaucagcugcaccugggcaucugcaagaaacggaagacaggguccaacgugaugcucgccguuuguaaaagaaugugcuucaaggccaccauugaagcuagccgccgggcccugcuuaucagaucuauuaucaauacaaccuucgugauuuguauccugacgcucgcuauuugcgucguguccacaagcgccguugagauggaaaaccugcccgcgggaaccugggagcgcgaagaggaccugacaaauuuuugucaucaggagugccaaguguccgaaaccgagugucuuugcccuuacgaagcccugguccucagaaaaccccuguuccucgauucuaucgugaagggcaugaagaaccugcuuaauagcaccucccuggagacaagccucucuaucgaggcuccuuggggagccauuaacgugcaguccacguuuaaacccaccgucagcacagcuaauaucgcccugucuuggagcuccguugaacaccggggaaacaagauucuggugaccggccgcucugagagcaucaugaaacuugaagagagaacagggguguccugggaccugggcgucgaagaugcgucugagagcaagcuccugaccguguccauuauggaccucagccagauguauucuccuguuuucgaguaccuguccggagauagacagguggaagaguggccgaaagccacguguacaggcgacugccccgaacgcugugggugcaccagcucuaccugccuucauaaggaguggccucacuccagaaauuggcgguguaaccccacauggugcuggggagucggcaccggguguacaugcuguggaguggauguuaaggaccuguuuacggaucacauguucaucaaauggaagguggaauacaucaaaaccgaggcuauugucugcguggagcucacaagccaagaacgccaguguucccugaucgaggccggcaccagauuuaaucugggcccuguuacaauuacccuuucugaaccccggaacauccagcagaagcugccgccugagauuaucacgcuccaucccaaaaucgaagagggguucuuugaccugaugcacgugcaaaagguccucagcgcuuccaccgugugcaagcugcagagcuguacacaugggauucccggcgaccuucagaucuaucacauugggaaucugcugaaaggagaucgccucaacggccaucugauccacaagauugagccucacuucaacaccucuuggauguccugggacgggugcgaucuugacuacuauuguaauaugggagauuggcccagcugcacauacaccggcgugacacagcauaaccacgccgccuuugucaaucugcucaacaucgaaacggacuauaccaaaacauuccauuuucacucuaagagaguuaccgcucacggcgauaccccucaacuggaccucaaagcgcggccgacauacggggccggagagauuacggugcugguggaagucgcugauauggagcuucauaccaagaaaguggagaucuccggccugaaguucgccagccuggccugcacaggguguuaugcuugcucuagcggaaucuccuguaagguucgcauucacguggacgaacccgaugagcucaccguccaugugaaaucuagcgacccugauguuguggccgcguccacaagccugauggcuagaaaacuugaguucggcaccgacuccacguuuaaagccuucucugccaugcccaagacaagccugugcuuuuacaucgucgaacgggaauacuguaaauccugcucugaggacgauaccaagaaguguguggacaccaaacucgaucagccucagagcauucugaucgagcacaaggggacaauuaucggaaaacaaaaugauaccugcacagcuaaggccuccuguuggcucgaaucugucaaauccuucuuuuauggccugaagaacaugcuuggcuccguguucgggaacuuuuucguuggaauccugcuguuucucgcgcccuucgugcugcuuguccuguuuuucaugugcggcuggaagauucucuucuguuuuaaaugcugcagacgcacccgggggcuguucaaguacagacaucucaaagacgacgaggaaacgggauaucgccggaucauugagagacugaauagcaagaaaggcaagaaucgccuucuggauggggaacggcuggcugacagaaagaucgccgagcucuuuucuacaaaaucccacauuggauga

SEQ ID NO: 13680 - RNA, 5052 nt, Artificial Sequence
  derived and/or modified CDS sequence (opt5) from CCHFV(3756-ST-2007)__KR814866.1__GP
augcacacccugcucgugugcuucauccuguaccuucagcugagcggccucgggggagcccauggccaauccaacgcuacagagcacaauagaacgaacaccacaaccguccccgggacaucucagagcccuaagccgcccgccuccaccacacugccucauacccccgaaucuagcacgguuaaacuuaccacaccuaccuccgagacagaaggaucuggcgagaccacgcccccuccgaauacaacccaggggcugccccucccuggaacaacccccgaacggagcgcgaccacagcuacguccaccagcucuacagacaacaugaauaccacaacccaggugacggauaacacaccuaccuccaccgugagcauuucucccuccagcucuccguccaugccuagcacaucccaaggcauccacuaucccguccgcucucugcugagcguguccagcccuaagaccguuacaacgcccacccccaugucuccuggcgagauguccccggagacaagcucucagcauagcgccaugucccggauucccacccucuacacagccacccaggugucuacggaaaauaucaacagaagcaccccucgccaguccgagagcucuguccaacccgcuacacaguccccuauuaccagccccgcccagacaauccugcuuaugucugcugccccgaaagcgauccaggacaugcacccuucccccaccaauagaagcaagcggaaccuggaaguggagauuauccucacgcugucccaagggcuuaaaaaguauuacggaaagauucugaaacuccugcaccugacacucgaggaagauaccgagggccugcuugaaugguguaagcgcaaucuggggucuaacugcgacgaugacuuuuuccagaaaagaaucgaggaauuuuucauuacaggagagggcuauuuuaaugagguucuccaguucaagacccugagcacccuuuccccuacagaacccucucaugugcggcugccuacggccgagcccuuuaaaagcuacuucgcuaagggguuucucuccaucgauagcggauauuucucugccaaguguuacccgcgcuccagcaccucuggccugcaacugauuaacgucacacagcacccugcuagaaucgccgaaacccccggccccaaaacaaccucccucaagacgaucaauugcauuaaccugcgggcgagcguguuuaaagagcaucgcgaaguggagaucaacguccuucugccucagauugccguuaaucucucuaacugucacguggugaucaauagccacgucugcgacuacucccuggauacagacgggccggugagacuuccccggauucaucacgagggaaccuucaucccuggcaccuauaagaucguuauugaucgcaaaaacaagcugaaugacagauguagccucgugacaaacugcgucaucaaagggcgggaagugagaaagggacagucuguucugcgccaauacaagaccgagauuaaaaucggcaaggcuuccacagggagccggaaacugcucuccgaggaacccggagaugacuguauuucuagaacgcagcugcuuaagaccgaaacagccgagauccaugacgauaauuauggcggcccuggggacaaaaucaccauuugcaacggaagcacaaucguggaucagcgccugggcuccgagcucggguguuacaccauuaaucgggucaagucuuuuaagcugugcgaaaacagcgcuacgggaaaaaccugcgagaucgacuccacacccgugaaguguagacagggcuucugccugaaaauuacccaagaagggcgcggccacgucaaacuuucucggggaagcgaggugguucucgaugccugugacuccagcugcgagaucaugauuccuaaaggcacaggggauauccugguggacuguucuggaggccagcagcauuuccugaaggauaaucucaucgaccuggggugcccccacauuccgcuucugggaaagauggccaucuauauuuguagaauguccaaccacccucgcaccacaauggcuuuucucuucugguuuagcuucggcuacgucauuaccugcaucuuuuguaaagcgcuguucuauucucugaucaucauugggacgcuuggcaagaaaaucaagcaguaccgggaacucaaaccccaaacaugcaccauuugugagaccgccccugugaaugcuaucgaugccgaaaugcaugaccugaacugcuccuacaauauuugccccuauugugccagcagacugacaucugacggacucgcucgccacguuacccagugcccgaagcggaaggagaaaguggaagagacggagcuguaccuuaaccuggaaagaaucccuuggaucguccggaagcuccuucagguguccgagagcacaggcguggcccugaaacgcuccagcuggcuuauuguucuccugguccugcucaccgugucucugagccccgugcaguccgcgccugucgggcauggaaagacaaucgaaaccuaucaaacaagagagggcuuuaccucuauuugucuuuucaugcuggggagcauccucuuuauuguguccugccugguuaaaggacugguggauucugucagcgacuccuucuuucccggccuuucuguguguaagacgugcagcaucggguccaucaacggcuucgaaauugagagccacaaauguuacugcucucucuuuuguugccccuauugucggcacugcuccgcugauagagagauccaucagcugcaccugagcauuugcaagaagcgcaaaaccggaucuaauguuaugcucgccguguguaagcggaugugcuucaaagccacaaucgaggcuuccagacgcgcccugcuuauuagaagcaucauuaacaccacauucgucaucuguauccugacccucgcuauuugcgugguuuccacgucugccguggaaauggaagaccugccugcgggcacaugggagcgggaagaggaucugaccaauuuuugucaucaggagugccaagucacagaaaccgagugucuuugcccguacgaagcccuggugcuccgcaagccccuguuccucgacagcaucgugaaagggaugaagaaccugcuuaauuccaccagccuggagacaucucucuccauugaggcuccuuggggagccaucaacguccagagcacguuuaagcccaccguuucuacagcuaauauugcccugagcugguccucuguggaacacagaggcaacaaaauccuggugaccgggcggagcgaguccaucaugaaacuugaggaacgcacaggagucucuugggaucugggcguggaagacgcgagcgaguccaagcuccugaccguuagcauuauggaucucucucagauguauuccccuguguucgaguaccugagcggggacagacaggucgaagaguggcccaaggccacguguacaggcgauugcccugaacgguguggaugcaccuccucuaccugccuucauaaagaguggccgcacagccgcaauuggagauguaaccccacauggugcuggggcguggggaccggauguacaugcuguggcguugacgugaaggaucuguuuacggaccacauguucaucaaguggaaagucgaauacauuaagaccgaggcuaucgugugcguugagcucacaucccaagaacggcaguguucucugauugaggccgggacccgcuuuaaucugggaccugugacaaucacccuuagcgaacccagaaacauccagcagaaacugccucccgagauuaucacgcuccauccgaagauugaagagggcuucuuugaccugaugcacguccaaaaagugcucuccgcuagcaccgugugcaagcugcagucuuguacacauggcaucccuggggaucuucagauuuaucacaucggaaaucugcugaagggcgaccgggucaacgggcaucucauucacaaaaucgagccccacuucaauaccuccuggaugagcugggauggaugcgaccuggauuacuauuguaacaugggcgacuggcccucuugcacauacaccgggguuacacagcauaaccacgccgccuuugugaaucuucugaacaucgaaacggauuauaccaagacauuccauuuucacuccaaaagagugaccgcucacggagacaccccucaacucgaucugaaggcgcgccccacauacggcgccggcgagauuacgguccucguggaaguugcugacauggagcugcauaccaaaaagguggagaucagcgggcuuaaauucgccucucugacaugcaccggauguuaugccugcagcuccggcauuucuuguaagguccggauccacguggaugaaccugacgagcugacaguucaugucaagagcuccgauccggacgugguggcugccagcaccucccucauggcgagaaaacuggaguucgggacggacucuacauuuaaggcuuucagcgccaugcccaaaaccucccuuugcuuuuacauugucgaacgcgaauacuguaagucuugcagcgaggaugacaccaaaaaguguguggauacaaagcuggagcagccucaguccauccucaucgaacacaaaggaaccauuaucggcaagcaaaaugacacaugcaccgccaaggcuucuuguuggcuggagagcguuaaguccuucuuuuaugggcucaaaaacaugcugggaagcguguucggcuccuuuuucgucggcauucuucuguuucugacgcccuucgugcuccugguucuguuuuucauguucggguggaagauccuguuuugcuucaaguguugccggagaacacgcggacucuuuaaauaccggcaucugaaggaugacgaagagaccggcuauagacgcauuaucgaacggcucaauucuaaaaaggggaaaaacagacugcuugauggagagcggcuggccgaccgcaagaucgcggagcuguucagcacaaagacccacauuggcuga

SEQ ID NO: 13681 - RNA, 5052 nt, Artificial Sequence
  derived and/or modified CDS sequence (opt5) from CCHFV(47-ST-2013)__KR814861.1__GP
augcacacccugcucgccugcuucauccuguaccuucagcugagcggccucgggggagcucauggccaauccaacgccacagagcacaaugggacgaacaccacaaccgugcccggaacaucucagagcccuaagccgcccgcguccaccacacugccucauacccccgaaucuagcacggucaaacuuaccacaccuaccuccgagacagaaggcucuggggagaccacgcccccuccgaauacaacccagggacugcccccucccggcacaaccccugaaagaagcgcuaccacagccacguccaccagcucuacagacaacaugaacuccaccacacagaugaccggcaauacgcccacaccgaccguuaauaugagcccuucuuccagccccucuaugccuuccaccagccaagggauucacuaucccgugcggucccuccugucugugcccagcccuaagacagccaccacaccgacgcccgucuccccuggagagaugagccccgagaccucuucccagcauagcgcuacaucucgcaucccuacccuguacacagccacccaggugagcacggaaaacaccaauagauccacaccccggcagucuaaaagcuccguucaaccggcuacccagagcccuauuacacccccugcccagaccauccuccugaugucugcggcccccaaggcuauucaggauaugcacccuucccccacgaaccgcagcaaaagaaaucuugagguggaaaucauccugacacucucucaaggccugaagaaguauuacgggaaaauucuuaagcugcuccaccugacccuggaggaggacacagaaggacuccuggagugguguaaacggaaccuuggcuccaauugcgaugacgacuuuuuccagaagcgcaucgaagaguuuuucauuaccggggaaggauauuuuaacgagguccugcaguucaaaacccucagcacacuguccccgacggagccuucucaugugagacuucccaccgccgaacccuuuaagagcuacuaugcuaagggcuuccugucccucgacucuggcuacuuuagcgccaaauguuacccucgguccagcacaucugggcugcaacugaucaauguuacccagcacccggcgcgcauugccgagacacccggaccuaagaccacgucccucaaaacaaucaacugcauuaaccugagagcuagcguguucaaggaacaucgggaggucgaaaucaaugugcuucugccccagaucgccgugaaccucucuaauugucacgucguuauuaacucccacgugugcgauuauccucuggacaccgauggccccgugcgccuuccuagaauccaucacgaggggaccuuuauucccggaacauacaaaaucgucauugacaagaaaaauaagcugaacgaucgguguagccucgugaccaauugcguuaucaagggccgcgaggugagaaaagggcagucuguccugcggcaauauaagacagaaaucaaaauuggaaaggcuagcacgggcuccagaaaacugcucagcgaggaaccgggcgacgauuguaucucucgcacccagcugcuuaagacagagaccgccgaaauucaugacgacaacuacgggggaccuggcgauaagaucacaauuugcaauggguccaccaucguggaccagcggcugggaagcgagcucggcuguuauacgaucaacagaguuaaauccuucaagcugugcaaaaauucugccaccgggaagacaugcgagauugauagcacccccgugaaaugucgccagggcuuuugccugaagaucacacaagaaggacggggccacgucaagcuguccagagggucugaggugguccucgacgcuugugauagcuccugcgaaauuaugaucccuaaaggaaccggcgacauucugguggauuguucugggggacagcagcauuuccugaaggacaaccucaucgaucugggcugcccccacauuccgcuucuggggaaaauggcgaucuacaucugucgcaugagcaaucacccucggacaaccauggccuuccucuuuugguucuccuuuggcuauguuauuacgugcaucuucuguaaggcucuguuuuacagccugauuaucauuggaacacuuggcaaaaagaucaagcaguacagagagcucaaaccccaaaccugcaccaucugugagacagccccugugaacgccauugacgcugaaaugcaugaucugaauugcucuuauaacaucugccccuacugugccucccgccugaccagcgacgggcucgcgcggcacgucacgcagugccccaagagaaaagagaagguggaagagacagaacuguaucuuaaccuggagcgcauuccuuggaucguucggaaacuccuucaggugucugaguccaccggagucgcucugaagagaagcucuuggcuuauugugcuccuggugcugcucacaguuucccugagcccgguccaguccgcccccgugggccaugggaaaaccaucgaaacauaccaaacccgggagggauucacgagcaucugucuuuuuaugcugggcucuauucucuucaucgugagcugccuggucaaggggcugguggacuccguuucugauagcuuuuucccuggccuuuccguguguagaaccugcucuauuggaagcaucaauggcuuugaaauugagucccacaaguguuauugcucucucuucuguugccccuacugucgccacugcagcgccgaccgggaaauccaucagcugcaccuguccaucugcaaaaagagaaaaacagggagcaacgucaugcucgcuguguguaagcgcaugugcuuuaaagccaccauugaggcuucucggagagcccuguucauccgcuccauuaucaauacaaccuucguuacguguauucuuacacuggcgaucugcguggucagcaccucugccguggagauggaagaucucccugcuggaacaugggagagagaagaggaccugaccaacuuuugucaucaggaaugccaaguuaccgagacagagugucugugccccuaugaagcccuugugcugcggaagccucucuuccuggauuccauugucaagggcaugaaaaaucuccugaacagcacgucccuugagaccucucugagcaucgaagcuccguggggagccaucaaugugcaguccacauuuaagcccaccgugagcacagcgaacauugcccucucuugguccagcgucgagcaccgcggaaauaaaauccugguuaccggcagaucugagagcauuaugaagcuggaggaacggacggggguguccugggaccuuggcguggaagaugcuucugagagcaaacugcucacagucuccaucauggaccugucucagauguacagcccuguguucgaauaccucuccggagaucgccagguugaggaguggcccaaggccaccuguaccggcgaaugcccugagagaugugggugcacaagcucuaccugccugcauaaggaauggccccacucccggaacuggcgcuguaauccgacauggugcuggggagugggcacgggguguaccugcuguggagucgacgugaaagaucuuuuuacagaccacauguucauuaaguggaaaguugaguauaucaagaccgaagcuaucgugugcgucgagcugacaagccaagagagacaguguucccucauugaagccggcacccgguuuaaccugggcccugugacgaucacccugucugagccccgcaauauucagcagaaacuucccccugaaaucauuacacugcaucccaagaucgaggaaggguucuuugaucucaugcacguucaaaaggugcugagcgccuccaccgucugcaaacuccagucuuguacacauggaaucccuggcgaccugcagauuuaccacaucgggaaccuucugaagggagacagagugaauggccaucugauucacaaaaucgagccgcacuucaacaccagcuggauguccugggaugggugcgaccucgauuauuacuguaacaugggagacuggcccagcugcacauauacgggcgugacccagcauaaucacgcugcguuugucaaccugcuuaauauugagacagauuacaccaagaccuuccauuuucacucuaaacggguuacagcccacggcgacacgccucaacuggaucucaaggcuagacccaccuauggggccggagaaaucacagugcugguggaggucgccgacauggaacuccauaccaaaaagguggagguuuccggccugaaguucgcuagccuugccugcacaggguguuacgcguguucuuccggaauuagcugcaaagugcgcauccacgucgaugagccugacgaacugaccgugcauguuaagucuagcgaucccgacguggucgcugccuccacgucucugauggcccggaaacucgaguucggcacagauagcaccuuuaaggcuuucuccgccaugccgaaaaccagccugugcuuuuacaucguggaaagagaguauuguaaguccugcucugaagacgacacaaagaaaugugucgauaccaaacuugagcagccucagagcauucugaucgagcacaaagggacaauuaucggaaagcaaaacgauaccugcacggcgaaggcuuccuguuggcucgaaucuguuaagagcuucuuuuacggccugaagaauaugcucggcuccguguucgggaacuuuuucguggggauucugcuuuuucuggcccccuucguccugcucgugcuguuuuucauguucggcuggaaaauccuguuuugcuucaaguguugccgccggacaagagggcuguuuaaauaucgccaucucaaggaugacgaggaaaccggauaccggagaaucauugagcgccuuaauucuaaaaagggcaagaaccggcuccuggauggggaaagacuugccgaccggaaaaucgcugagcuguucagcacaaagacccacauuggauga

SEQ ID NO: 13682 - RNA, 5052 nt, Artificial Sequence
  derived and/or modified CDS sequence (opt5) from CCHFV(1-CR/HU-2015)__KU161584.1__GP
augcacacccugcucgugugcuucauccuguaccuucagcugcucggccuugggggagcccaugagcaaagcaacgcuacagaccacaauagaacgaacaccauuacagcccccuccaccucucagaauccuaagccgcccgcgagcacaaccccuccccauacaccugaauccucuaccaucaaacuuauuacgagcaccggcgaggcugaaggguccggagagacaacacccccucugaacaccacccagggcccguuucccccugaaacgacaucugagcaccccgccagcaccgccacaaauaccuccagcaccaacucuaugaacuccacaacgcagaugaccgauaauacacucaccagcacagucucuaccucccugagcaucucuccuuccacgcccagcacaucccaagggauucauuauccgguucggucucugcucagcguguccagcccuaagaccgcugccacccccacaccuaugucuacccgcgagauguccagcgaaacaucuagccagcacuccgcuaugucuagaacgcccaccuuccacacagccacccaggugagcacagagaaugcgaaccgguccacgccccgccagagcgaaucuuccgcccaaccugcuacccagagcccgaugaccucucccgcccaguccaucuuucuggucagcgcugccccuacaaccauccagaauauucaucccuccccuacaaacagaucuaaacggaaucuugagauggagaucauucugacccucccccaaggacugaagaaauacuauggcaagauccuuaagcugcuccaccugacgcuggaagaggacacagaaggccuccuggagugguguaaacgcaaccuugggagcaauugcgaugacgaguucuuucagaagagaauugaagaguucuuuaucaccggagaaggcuacuucaacgaggugcugcaguuuaaaacacucuccacccugucuccgaccgaaccuagccaugcgcggcccccuacagccgagcccuucaaguccuauuuugcuaaaggguuccuuagcauugauucuggauacuuuuccgccaaguguuauccucgcagcucuacguccggccugcaacucaucaacaucacccagcaccccgcuagaauugccgaaacaccggggccuaagaccacaagccugaaaaccaucaauugcauuaaccugcgggccucuguuuucaaggagcaccgcgagguggaaaucaauguccuccugccccagauugcugugaaccuuagcaauugucauguugugaucaacucccacgucugcgacuacagccuggauacggacggacccgugagacucccucggaucuaccaugagggcacauucauuccgggcaccuauaaaaucgugauugauaagaaaaauaagcugaacgaccgcuguacccuugucacaaauugcguuaucaaagggagagaagugcggaagggacagucugugcugagacaauacaagaccgagauuaaaaucggcaaggcguccacagggagccgcaaacuccuguccgaggaacccggagaugacuguaucucucggacgcagcugcucagaaccgagacagccgaaauucacgaugacaacuauggcgggccuggagacaagaucaccauuugcaauggcagcacaaucgucgaucagcgccugggcuccgagcuuggguguuacaccauuaaccgggugaaaucuuuuaagcugugcgaaaauagcgcuacgggaaagaccugcgagaucgacuccacacccguuaaauguagacagggcuucugccucaagauuacccaagaggggcgcggacaugugaaacugucucggggcagcgaagucgugcuggaugccugugacuccagcugcgagguuaugaucccuaaggggacaggcgauauccuuguggacuguucuggaggccagcagcacuuucucaaagauaaccugauugaccuggggugcccccacaucccucuccugggaaagauggccauuuauaucuguagaauguccaaucauccccgcaccacaauggcuuuccuguuuugguucagcuuuggcuacgucauuaccugcaucuucuguaaggcccuguuuuauucucucaucauuaucgggacgcuggggaaaaagauuaaacaguaccgggaacugaagccgcaaacaugcaccaucugugagaccgcgccugugaacgcuauugaugccgaaaugcacgaccuuaacugcuccuacaauaucugccccuauugugccagcagacucacaucugauggccuggcucgccaugucacccagugcccuaaacggaaggagaagguggaggaaacggagcuguaccucaaccuggaaagaauccccuggauuguucggaaacuucuucagguguccgagagcacaggggucgcccucaagcgcuccagcuggcugaucgugcugcuuguucuccugaccgugucucugagcccgguccaguccgcuccugugggccacggaaaaacaauugaaaccuaucaaacaagagagggcuucaccucuaucugucucuuuaugcuggggagcauucuuuucaucguguccugccugguuaagggacucgucgacucugugagcgacuccuuuuuccccggccugucugugugucggacgugcagcaucggguccauuaauggauucgagaucgaaagccacaaauguuacugcucucuguuuuguugcccuuauuguagacauugcuccgccgaucgcgagauucaccagcuucaucucagcaucugcaagaaacggaagaccggcucuaacgucaugcuggcgguguguaagagaaugugcuuccgcgccacaauggaggcuuccagacgggcccugcucauucgcagcaucauuaauaccacauuuguuaucuguauccugacccuuacgauuugcguggucuccacaucugcuguggaaauggaaaaccugcccgccgggaccugggagagagaggaagaccucacaaauuucugucaccaggagugccaaguuaccgaaaccgagugucugugccccuacgaggcgcuggugcuucggaaaccucuguuucucgauagcaucgucaagggcaugaaaaaccugcucaauuccacaagccuggaaacgucucuuuccauugaggccccguggggagcuaucaacgugcagagcaccuucaagcccacaguuucuaccgccaauauugcucugagcugguccucuguggaacaucgcggcaacaaaauccucgucacagggagaagcgaguccaucaugaagcuggaggaacggaccggagugucuugggaccugggcguggaggaugccagcgaauccaaacuucugacggucagcauuauggaccucucucagauguauuccccuguuuuugaguaccugagcggggaucgccagguggaagaguggcccaaggccacauguaccggagacugcccugaaagauguggcugcaccuccucuacaugccuccacaaggaguggccccacagccggaauuggcgcuguaacccuaccuggugcuggggagugggcacaggauguacgugcuguggcgucgaugugaaagaccuguucaccgaucauauguuuguuaaguggaaaguggaguacaucaagacagaagcuauugucugcguggagcuuaccucccaagaaagacaguguucucugaucgaggcggggacacgguucaaucucggaccgguuaccauuacgcugagcgaacccagaaacauccagcagaagcugccucccgagaucauuacccuucacccuaaaaucgaggaaggcuuuuucgaccugaugcaugugcaaaagguccucuccgccagcacagugugcaaacugcagucuuguacccacgggauucccggagaucuccagguuuaucauaucggcaaccugcuuaagggcgaccgcgugaaugggcaccugauucacaaaaucgagccgcauuuuaacacauccuggaugagcugggacggaugcgaucuggacuacuauuguaauaugggcgauuggccuucuugcaccuacacaggggucacgcagcacaaccaugcugccuucgugaaucuccugaacauugaaaccgacuauacaaagaccuuccacuuucacuccaagcgggugaccgcccauggagauacaccccaacuugaccugaaagcuagacccacguacggcgccggggagaucaccguccucguugagguggcggauauggaacugcacacaaagaaaguggagaucagcggacucaaguucgcuucucuggccugcaccggcuguuaugccugcagcuccggcauuucuuguaaaguccgcauccauguggacgaaccugaugagcuuacaguucacgucaagagcuccgaccccgaugugguggcugccagcaccucccugauggcgcggaaacuggaauuugggacggacucuacauucaaggcuuuuagcgccaugccuaagaccucccucugcuucuacauuguugagagagaguacuguaaaucuugcagcgaagaugacaccaagaaauguguggacacaaagcuggagcagccgcaguccauccuuauugaacauaaaggaaccaucaucggcaagcaaaaugauacaugcaccgccaaggcuucuuguuggcuggagagcgucaaauccuuuuucuaugggcucaagaacaugcugggaagcguguuuggcaauuucuuuauugggauccuccuguuccuugcccccuucguccugcuggugcucuuuuucauguuuggauggaaaauucuguucugcuuuaaguguugccgccggacgagaggccuuuucaaauaccgccaccugaaggacgaugaagagacaggcuaucggagaaucauugagcggcucaacaauaagaaagggaagaaccgccugcucgacggagaaagacuggcugaucggaaaaucgccgagcuguuuucuaccaagacacacaucggcuga

SEQ ID NO: 13683 - RNA, 5049 nt, Artificial Sequence
  derived and/or modified CDS sequence (opt5) from CCHFV(3820-ST-2007)__KR814868.1__GP
augcacacccugcucgugugcuucauccuguaccuucagcugagcggccucgggggagcccauggccaauccaacgcuacagagcacaaugggacgaacaccacaaccguccccggaacaucucagagcccuaagccgcccgccuccaccacacugccucauacccccgaaucuagcacgguuaaacuuaccacaccuaccuccgagacagaaggcucuggggagaccacgcccccuaauacaacccagggacugccgcuccccggcacaaccccugaaagaagcgcgaccacagcuacguccaccagcucuacagacaacaugaacuccaccacacaggugaccgauaauacgcccacaagcaccgugucuauuuccccuucuucuuccagcuccaugcccucuaccagccaaggcauccaccauccgguccggucccugcugagcgugucuuccccuaagacaguuaccacacccacgccuaugagccccggggagaugucucccgagaccagcucccagcacucugccaugagccgcgugccuacacucuauaccgccacacagauuuccaccgaaaauacggacagaagcaccccgcggcagucugaguccagcguccaacccgcuacacagucuccuaucaccucccccgcccagacaauucugcuuaugagcgcugccccuaaagcgauccaggauaugcaccccuccccgaccaaccgcucuaagagaaaucuggaaguggagaucauucucacgcugagccaaggacuuaaaaaguacuauggcaagauccugaaacuccugcaucugacacucgaggaagacaccgaggggcugcuugaaugguguaagcggaaccugggauccaauugcgaugacgacuuuuuccagaaacgcauugaggaauuuuucaucacaggcgagggguacuuuaacgagguucuccaguucaagacccugucuacccuuagcccuacagaacccucccacgugagacugccuacggccgagcccuuuaaaagcuauuucgcuaagggauuucucucuauugauuccggcuacuucagcgccaaguguuauccucggucuuccaccagcggccugcaacugaucaaugucacacagcaucccgcucgcauugccgaaaccccggggccuaaaacaaccucucucaagacgaucaacugcaucaaucugagagcgagcguguuuaaagagcaccgggaaguggagauuaacguccuucugccccagaucgccguuaaccucuccaauugucacguggugauuaacagccaugucugcgauuacucucuggacacagauggacccgugcgccuuccuagaauccaccaugagggcaccuucauuccggggaccuacaagaucguuaucgaccggaaaaauaagcugaacgaucgcuguucccucgugacaaauugcgucauuaaaggaagagaagugcggaagggccagagcguucugagacaauauaagaccgagaucaaaauugggaagacauccacgggaucucgcaaacugcucagcgaggaacccggcgacgacuguaucucccggacccagcugcuuaagacagaaaccgcugagauucacgaugacaacuacggcucuccuggggauaaaaucacaaucugcaauggaagcaccauuguggaccagagacugggcuccgagcucggguguuauacgaucaaccgcgucaagucuuuuaagcugugcgaaaauagcgccaccggaaaaacaugcgagauugauuccacccccgugaagugucggcagggcuucugccugaaaaucacacaagaagggagaggccaugucaaacuuagccgcggaucugaggugguucucgacgcuugugauuccagcugcgagauuaugaucccuaagggcaccggggacauucugguggauuguucuggaggccagcagcacuuccugaaggacaaccucaucgaucuggggugcccccacaucccucuucugggaaagauggccauuuacaucugucggauguccaaucaucccagaacaaccauggccuuucucuucugguuuagcuucggcuaugucauuacgugcaucuuuuguaaagcucuguucuacucucugauuaucaucgggacacuuggcaagaaaauuaagcaguaucgcgaacucaaaccgcaaaccugcaccaucugugagacagcgccugugaacgccauugacgcugaaaugcacgaccugaauugcuccuacaacaucugccccuacugugccagccggcugaccuccgauggacucgccagacauguuacgcagugcccuaagcgcaaggagaaaguggaagagacagagcuguaucuuaaucuggaacggauucccuggaucgucagaaagcuccuucaggugagcgagucuaccggcguggcucugaaacggagcuccuggcuuaucguucuccugguccugcucgccgugucucugagcccggugcaguccgcgccugucgggcacggaaagacaauugaaaccuaccaaacacgcgagggcuuuaccucuaucugucuuuucaugcuggggagcauucucuuuaucguguccugccugguuaaaggacugguggacucugucagcgauuccuucuuucccggccuuagcguguguaagacgugcucuauuggguccaucaacggcuucgaaaucgagagccacaaauguuauugcucucucuuuuguugcccuuacuguagacauugcuccgcugaccgggagauucaccagcugcaucugagcaucugcaagaagagaaaaaccggauccaacguuaugcucgccguguguaagcgcaugugcuucaaagccacaauugaggcuucucggagagcccugcuuauccgcagcauuaucaauaccacauucgucauguguauucugacccucgcuaucugcgugguuuccacgagcgccguggaaauggaagaucugcccgcgggcacaugggagagagaagaggaccugaccaacuuuugucaccaggagugccaagucacagaaaccgagugucuuugccccuaugaagcccuggugcuccggaagccucuguuccucgauucuaucgugaaagggaugaagaaucugcuuaacuccaccagccuggagacaucucucagcauugaggcuccguggggagccaucaauguccaguccacguuuaagcccaccguuucuacagcuaacauugcccugagcugguccucuguggaacaucgcggcaauaaaauccuggugaccgggagaagcgaguccauuaugaaacuugaggaacggacaggagucagcugggaccugggcguggaagaugcgucugaguccaagcuccugaccguuagcaucauggaccucucccagauguacucuccuguguucgaguaucugagcggggaucgccaggucgaagaguggcccaaggccacguguacaggcgacugcccugaaagauguggaugcaccuccucuaccugccuucacaaagaguggccccacagccggaacuggcgcuguaauccuacauggugcuggggcguggggaccggauguacaugcuguggcguugaugugaaggaccuguuuacggaccauauguucaucaaguggaaagucgaauacauuaagaccgaggcuaucgugugcguugagcucacaucccaagaaagacaguguagccugauugaggccgggacccgguuuaaccugggaccggugacaaucacccuuucugaaccccgcaauauucagcagaaacugccucccgagaucaucacgcuccacccuaagauugaagagggcuucuuugaucugaugcauguccaaaaagugcucuccgcuagcaccgugugcaagcugcagucuuguacacacggcauccccggggaccuucagauuuaccauaucggaaaccugcugaagggcgauagagucaaugggcaccucauucacaaaaucgagccgcauuucaacaccuccuggaugagcugggacggaugcgaucuggacuauuacuguaauaugggcgauuggccuucuugcacauauaccgggguuacacagcacaaccaugccgccuuugugaaccuucugaauauugaaacggacuacaccaagacauuccacuuucacagcaaacgggugaccgcucauggagauacaccccaacucgaccugaaggcgagacccaccuauggcgccggcgagaucacgguccucguggaaguugcugauauggagcugcacaccaaaaagguggagaucuccgggcuuaaauucgccucucugacaugcaccggauguuacgccugcagcuccggcauuagcuguaagguccgcauccauguggacgaaccugaugagcugacaguucacgugaaguccucugaccccgacgucguggcugccagcaccucccucauggcgcggaaacuggaguucgggacggauucuacauuuaaggcuuucagcgccaugccuaaaaccucccuuugcuuuuauauugucgaaagagaauacuguaagucuugcagcgaggacgauaccaaaaaguguguggacacaaagcuggagcagccgcaguccauccucauugaacauaaaggaaccaucaucggcaagcaaaacgauacaugcaccgccaaagcuagcuguuggcuggagucuguuaaguccuucuuuuacgggcucaaaaauaugcugggaagcguguucggcagcuuuuucgucggcauucuucuguuucuggcccccuucgugcuccugguucuguuuuucauguucggguggaagauccuguuuugcuucaaguguugccgccggacgagaggacucuuuaaauaucgccaccugaaggacgaugaagagacaggcuaccggagaauuaucgaacgccucaacuccaaaaaggggaaaaaucggcugcuugacggagagagacuggcggaucggaagauugcugagcuguucagcaccaagacacacaucggcuga

SEQ ID NO: 13684 - RNA, 5052 nt, Artificial Sequence
  derived and/or modified CDS sequence (opt5) from CCHFV(Ast199)__KX056051.1__GP
augcacacccuucucgugugcuucauccuguaccuucagcugagcggccucgggggagcccauguccaauccaacgcuacagagcacaauggcacgaacaccacaaccguucccgggacaucucagagcccuaagccgcccgccuccaccacacugccucauacccccgaaucuagcacggugaaacuuaccacaccuaccuccgagacagaaggaucuggcgagaccacgcccccuccgaauacaacccaggggcugcccccucccggaacaaccccugaaagacccgcgaccacagcuacgaccacaagcuccaccgacaacaugaauagcacaacccaggugacggauaacacaccgaccucuaccgucuccauuagcccuucuuccaaucccagcaugccuucuacaucccaaggcauccacuaucccgugcggagccuccuguccguuucuagccccaagaccgugacaacgccuaccccgaugucccccggcgagaugagcccugagacaucuucccagcauagcgccaugucucgcauucccacccuguacacagccgcucaggucagcaccgaaaacacgaauagauccaccccucggcagucugagagcuccgcccaacccgcuacacagagcccgaccacauuuccugcccagaccaucccccucaugucugcggccccuaaagcuauucaggacaugcaccccuccccuacgaaccgcagcaagagaaaucuggaaguggagaucauccuuacacugucucaagggcucaaaaaguauuacggaaagauucugaaacuucugcaccucacccuggaggaagauacagagggccugcucgaaugguguaagcggaaccugggguccaauugcgacgaugacuucuuucagaaacgcaucgaggaguucuuuauuaccggagaaggcuauuucaacgagguucuucaguuuaagacccccagcacacuguccccgacggaaccuucucaugugagacuccccaccgccgagcccuucaaaagcuacuuugcuaagggguuccuguccaucgauucuggauauuuuagcgccaaguguuacccucgguccagcacaucuggccuucaacugauuaaugucacccagcacccggcgcgcaucgccgaaacacccggcccuaaaaccacgucccucaagacaauuaacugcaucaaccugagagcuagcguguucaaagagcaucgggaaguggagaucaauguccugcucccccagauugccguuaaccugucuaauugucacguggugaucaacucccacgucugcgacuacagccuugauaccgacgggccugugcgccugccccggauucaucacgagggaaccuuuaucccuggcacauauaagauuguuaucgauaaaaagaauaaacucaacgacagauguucucuggugaccaauugcgucaucaaggggcgcgaagugagaaagggacagagcguucuucggcaauacaaaacagagauuaagaucggcaaggcuuccacggggagcagaaaacugcucucugaggaacccggagaugacuguauuucccgcacccagcugcugaaaacagaaaccgccgagauccaugacgauaacuauggcggcccgggggacaagauuacaaucugcaauggaagcaccaucguggaucagcggcucggcuccgagcugggguguuacacgauuaacagagucaagucuuucaaacuuugcgaaaauagcgccaccggaaagacaugcgagaucgacuccaccccugugaaaugucgccagggcuucugccugaagauuacacaagaagggcggggccacgucaaacucucuagaggaagcgaggugguucuggaugcuugugacuccucuugcgagaucaugauucccaagggcaccggggauauccugguggacuguagcggaggccagcagcauuuucuuaaggauaaccucauugaccuggggugcccucacaucccccugcucggaaaaauggcgaucuauauuugucgcauguccaaucacccgcggacaaccauggccuuccuguuuugguucagcuuuggcuacgucaucacgugcauuuucuguaaggcucuguuuuauucucuuaucauuaucgggacacucggcaaaaagaucaaacaguacagagaacugaagccucaaaccugcaccauuugugagacagcccccgugaacgccaucgaugcugaaaugcaugaccugaauugcuccuacaacauuugcccuuauugugccagccgccuuaccucugacggacucgcgcggcacguuacgcagugccccaagagaaaagagaagguggaagagacagagcuguaccugaaccucgaacgcauccccuggauuguccggaaacugcuucagguguccgagagcaccggcguggcucugaagagauguucuuggcucaucguucugcugguccuucucacagugucccugagcccugugcaguccgccccggucgggcauggaaaaaccaucgaaacauaucaaacccgggagggcuucacgaauauuugccuguuuaugcucgggagcauccuguucauugugucuugucuuguuaagggacugguggauagcgucuccgacagcuuuuuccccggccucucugugugcaaaaccuguuccaucgggucuauuaacggcuuugaaaucgagagccacaagugcuacuguucccuguucugcuguccuuauugccgccacugcucugccgauagagagauccaucagcugcaccuuggaauuuguaagaaacggaagacaggcagcaauguuaugcucgcugugugcaaaagaauguguuucaaggccaccaucgaggcuucccgccgggcccugcugauuagaagcaucauuaacacaaccuuugucaucugcauucucacgcuggcgaucugugugguuucuacauccgccguggaaauggaaaaucuucccgcugggaccugggagcgcgaagaggaccugacaaacuucugccaucaggagugucaagucaccgaaaccgagugccucuguccuuacgaagcccuggugcugagaaaaccccuuuuucuggauagcaucgugaagggaaugaagaaucuccugaacucuacaucccucgagacgagccuguccauugaggcuccuuggggcgccaucaauguccagucuaccuucaaaccgacaguuagcaccgcgaacauugcccuuuccuggagcucuguggaacaccgggggaauaagauccuggugacaggacgcuccgagagcauuaugaaacucgaagagagaaccggcgucucuugggaccuggggguggaagaugcuagcgaguccaagcugcuuacgguuucuaucauggaccugagccagauguauucccccguguuugaguaccucucuggcgaucggcaggucgaagaguggccuaaagccacaugcaccggagacugucccgaacgcugcggcugcaccagcuccacaugucugcauaaggaguggccucacagcagaaacuggcggugcaaucccaccugguguuggggaguggggacaggcugcacguguugcgggguugaugugaaggaccucuucaccgaucacauguuuaucaaauggaaggucgaauacauuaaaacagaggcuaucguguguguugagcugaccucucaagaacgccagugcucccuuauugaggccggaacaagauucaaccugggcccggugaccaucacgcucagcgaaccucggaauauucagcagaagcugccucccgagaucaucacccugcaucccaaaauugaagagggcuuuuucgaccuuaugcacguccaaaaggugcuguccgccucuacaguguguaagcuccagagcugcacccaugggauccccggagaccugcagauuuaucacaucggcaaccuccugaaaggggaucgccuuaacggacaucugauucacaagaucgagccucacuuuaauacauccuggaugucuugggacggcugugaucuggacuacuauugcaacaugggggauuggccgagcugcaccuacacaggagucacgcagcauaaucacgcugcguucguuaaccuccugaauauugaaaccgacuauacaaaaaccuuucauuuccacuccaagagagugaccgcccacggcgauacaccccaacuugaccugaaagcucggccuacguacggcgccggggagaucaccgugcucgucgaaguggccgauauggagcugcauacaaagaaaguugaggugagcggacucaaguucgcuucucuggccuguaccggcugcuaugcguguuccagcgggaucucuugcaagguccgcauucacguggacgaacccgaugagcuuacaguucaugugaaauccagcgacccugaugucguggcugccucuaccagccugauggccagaaagcuggaauuuggaacggacuccacauucaaggcuuuuucugccaugcccaaaaccagccucuguuucuacaucgucgagcgggaauacugcaaauccuguagcgaggacgauaccaagaagugcguggacacaaaacuggagcagccgcaguccauucuuaucgaacacaagggcaccauuaucgggaaacaaaacgauacauguaccgcgaaggcuucuugcuggcuggagagcguuaaauccuuuuucuauggacucaagaauaugcugggcucuguguuuggcaacuucuuugucgggauccuccuguuccuugccccuuuugugcugcugguucucuucuucauuuuuggauggaagauccuguucuguuuuaaaugcugcagacgcacgcggggccuuuucaaguacagacaucugaaagacgaugaagagacaggguaucgcaagauuaucgaacggcucaauagcaaaaagggaaagaacagacugcucgacggcgagcgccuggccgaucggaaaauugcugagcuguuuuccaccaagacacacaucggguga

SEQ ID NO: 13685 - RNA, 5052 nt, Artificial Sequence
  derived and/or modified CDS sequence (opt5) from CCHFV(Turkey200310849)__DQ211636.1__GP
augcacacccugcucgugugcuucauccuguaccuucagcugcucugucugggcggggcccauggacaacuuaacacaacggagcacaauggcaccaacaauacaaccgcucccggggccagccaguccccuaagccgcccaugucuacaaccccuccccaugcgccugaaagcuccacaauuaaacccaccacgccuaucucugaggcugaaggaagcggcgagaccacauccaccccgaacacaacccaggggcugucuagccccgaaacgacauccgagagaccugccaccacagccauuagcaccucuuccaccgacagcacaaaucccacgacccagaugacagauaacaccccuacacucaccgucucuacgucccccucuagcuccccgagcacaccuuccacaccccaaggaaucuaucacccugcucggucucugcugagcguuuccagccccaagaccgugaccacccccacaccuacgucuccgggcgagauguccagcgaaaccucuagccagcauuccgccaugucucgcauucccacaccucacaccgcuacaagagugagcaccgagaauacgaaccacuccacaccccggcagagcgaaucuuccgcccagcaaaccaccccuagccccaugacaucuccggcgcaguccauccuccugaugagcgccgcuccuaccgccguccaggacauccaucccuccccuacgaaucgcucuaaaagaaaccuugagacagagauuauccugacccucagccagggccugaagaaauacuaugggaagauucuuaagcugcuccaccugacacuggaagaggauaccgaaggacuccuggaguggugcaaacggaaucuuggcuccaacugugacgaugacuuuuuccaaaagcgcaucgaagaguuuuucaugaccggggagggauacuuuaaugaagugcugcaguucaaaacacucucuacgcugagccccaccgagccuucccaugcuagacuucccacagccgaaccguuuaagagcuauuucgcgaaaggcuuucugucuauugauuccggguacuucagcgccaagugcuauccucggucuuccgcuagcggacuccagcugaucaacguuacccaacaccccgcccgcauugcugagacacccggcccuaagaccacgucucugaaaacaaucaauuguaucaaccucagagccagcguguuuaaggaacaccgggagauugagaucaacguccugcuuccgcagauugccgugaaucuguccaacugccauguugugaucaauagccacgucugugacuacucucucgauaccgacggccccgugcgccugccuagaauuuaccaugaagggaccuucauccccggaacauauaaaaucgugauugauaagaaaaacaaacuuaaugaccggugcacccuggucacaaacuguguuaucaagggccgcgaggugagaaaggggcaguccgugcuccggcaguacaagacggaaauuaaaaucggaaaggcuagcaccggcuuuagaaaacugcuguccgaggaaccuggggaugacugcauuucucgcacacaacuccugcggaccgagacagcggagauccacgacgauaauuauggaggccccggcgacaagaucaccauuuguaacgggagcacgaucgucgaucagagacuuggauccgaacugggcugcuacaccauuaaucgcgugaaaucuuucaagcucugcgagaacagcgccacagggaagaccugugaaguugacuccacaccugugaaaugccggcagggauucugucugaagaucacccaggagggcagagggcaugucaaacugucucgcggcagcgaggugguucuugaugcuugcgacuccagcugugaagugaugauucccaagggaacaggcgauauccucgucgacugcucugggggacaacagcacuuucugaaagauaaucugauugaccucggcuguccgcacaucccucugcuugggaagauggccaucuauauuugccggauguccaaccaucccagaaccacgauggccuuccuguuuugguucagcuuuggauacgugaucacauguauuucuugcaaggcucucuucuauucccugaucauuaucggcacccuggggaaaaagaucaaacaguaccgcgagcuuaagccucagaccuguacaauuugcgaaaccgcccccgucaaugcgaucgaugcugagaugcacgaccucaacugcagcuacaauauuuguccguauugcgccucucggcugacguccgacggccuggccagacaugugacacaauguccuaaacgcaaggaaaagguugaggagaccgaacucuaccugaaccuugagcggauccccuggauugugagaaaacugcuccaggucagcgaauccacaggaguggcucugaagcggagcucuuggcugaucguucuucucgugcugcugaccgucagccucuccccugugcagucugcccccgugggccacgggaaaacaaucgagauuuaucagacccgcgaaggauuugcuagcaucugccuguucaugcuuggcuccauucuguuuaucguuucuugucucgucaaggggcugguggauagcguguccgacucuuucuuucccggacugagcgucugcaaaacguguuccauuggcagcgugaacggguucgagaucgagucucacaagugcuacuguucccucuuuugcuguccuuauugcagacauugcagcgccgaucgggaaauccaccaacuccaucugucuauuuguaaaaagagaaagaccggcuccaauguuaugcuggcggugugcaaacgcauguguuuccgggccacaaucgaggcuagcagacgcgcccuccugauuagauccaucauuaacaccacauucgucaucugcauucuuacccugacgaucugugugguuucuacaagcgcuguggaaauggagaaucucccggccggaaccugggaacgggaggaggaccugacaaacuuuugccaccaggaaugucaggucaccgagaccgaaugccugugucccuacgaggcgcuugugcugcgcaagccucucuuccuggauuccaucguuaaaggcaugaagaaucuccugaacagcacaucucuugagacgucccugagcauugaagcccccuggggagcuaucaaugugcaaucuaccuuuaaaccugccgucagcacagcuaacauugcccucuccuggucuagcguggagcauagagggaauaagauccuggugaccggccgguccgaaucuauuaugaagcuggaggaacgcacaggggucagcugggaccuuggaguugaggaugccuccgagagcaaacugcucaccgugucuaucauggaccugucccagauguauagccccguguucgaauaccucuccggcgauagacaggucgaggaauggccuaaggcuacgugcacaggggacuguccggagcggugcggcugcaccucuagcaccugucugcacaaagaauggccccacucccgcaacuggagaugcaauccuacaugguguuggggagugggcaccgggugcacauguugcggaguugaugugaaggaccuuuuuacggaucauauguucgucaaauggaagguggaguacaucaagaccgaggcgauuguuuguguggaacugacaucucaggagcggcaaugcagccucaucgaagccggcacccgcuuuaaccuggggcccgucacaauuacccuguccgagccuagaaauauccagcagaaacuucccccggaaauuaucacgcugcacccuaagaucgaggagggauucuuugaccucaugcaugugcagaaaguucugagcgcuucuaccguguguaagcuccaauccugcacacacggcauucccggcgaccugcaggucuaucauaucgggaaccuucugaaaggagaucgggugaauggccaccugauucacaagaucgaaagccauuucaacaccucuuggauguccugggacgggugugaucucgacuacuauugcaacaugggagauuggcccagcugcacauacaccggcgugacacagcacaaucaugccgccuuugucaaccugcuuaauauugagacggacuauaccaagacauuccacuuucacucuaaaagaguuaccgcucauggggauaccccucagcuggaccucaaggcccgccccacauacggagcgggcgaaaucacggugcugguggaggucgcugauauggagcuccacaccaaaaagguggaaauuagcggccugaaauucgccucccuugccuguacagggugcuaugcuuguucuagcggaaucuccugcaagguucggauccauguggacgagccugaugaacugaccguccacgugaaaagcuccgacccggauguuguggccgcgucuacaagccugauggcuagaaagcucgaguucggcaccgacuccacguuuaaggccuucucugccaugcccaaaacaagccuguguuuuuacauugucgaacgcgaguacugcaaguccuguucugaggacgauacccaaaaaugcguggacacccggcuugaacagccucagagcauccugauugagcauaaggggacaaucauuggaaaacaaaacgauaccuguacagcuaaggccuccugcuggcucgaaagcgucaagucuuucuuuuauggccugaaaaauaugcucggguccguguucggaaaccuguuuaucggcauccuucuguuccuggcucccuuuguucuccuggugcuuuucuuuauguucggcuggaagauucuguucuguuuuaaaugcugcagacgcacccgggggcuuuucaaguacagacaccugaaagacgaugaggaaacgggauaucgccggaucauugagagacucaauagcaagaagggcaaaaaccggcugcuugacggggaucgccuggccgacagaaagaucgcggagcuguuuucuacaaaaacccacauuggauga

SEQ ID NO: 13686 - RNA, 5052 nt, Artificial Sequence
  derived and/or modified CDS sequence (opt5) from CCHFV(5170-R-2011)__KR814873.1__GP
augcacacccugcucgugugcuucauccuguaccuucagcugagcggccucgggggagcccauggccaauccaacgagacagaacacaaugggacgaacaccacaaccguccccggaacaucucagagcccuaagccgcccgcuuccaccacacugcagcauaccccugagucuagcacgguuaaacuuaccacacccaccuccgaaacagagggcucuggggaaaccacgccucccccuaauacaacccagggacugccgcccccuggcacaacccccgagagaagcgccaccacagcgacguccaccagcucuacagacaacaugaauagcaccacacaagugaccgauaacacgccuacaagcaccgugucuauuucccccagcagcuccccgagcaugccuuccaccucucagggcauccacuaucccauucggagccuccuguccgucagcucuccuaagacagugaccacacccacgcccaucuccccuggggagaugagcccggaaaccucuagccagcauuccgcuaugucucgcauucccacacuguacaccgccacacagguuagcaccgagaauacgaacagauccaccccucggcaaagcgaaucuuccgugcagcccgccacacagagcccuaucaccucucccgcucagacaauccuccugauguccgccgcuccgaaagccauucaagacaugcacccuagccccaccaaucgcuccaagagaaaccuugaggucgagaucauucugacgcucucucagggacugaaaaaguauuacggcaagauccuuaaacugcuccaccugacacuggaagaggauaccgaagggcuccuggagugguguaagcggaaucuuggaagcaacugcgacgaugacuuuuuccagaaacgcauugaagaguuuuucaucacaggcgagggguauuuuaaugaagugcugcaauucaagacccucuccacccugucuccuacagagcuuagccauguuagacugcccacggcggaaccuuuuaaauccuacuucgccaagggauuucucagcauugauucuggcuauuucuccgcuaaguguuacccccggagcucuaccuccggccugcagcugaucaacgugacacagcacccggcccgcaucgcugagaccccugggcccaaaacaaccagccucaagacgauuaauugcaucaaccugagagccucugucuuuaaagaacaucgggagguggagauuaacgugcuucugccccagaucgcggucaaucucagcaacugucacguugugauuaauucccacgugugcgacuacagccuggauacagacggaccuguccgccuuccgagaauccaucacgaaggcaccuucauccccgggaccuauaagauugugaucgauaaaaagaacaaacugaaugaccgguguucucucguuacaaacugcgugauuaagggacgcgaggucagaaagggccaauccgugcugcggcaguacaaaaccgaaaucaagauugggaaagccagcacaggauccagaaagcugcucucugaggaaccuggcgaugacuguaucagccgcacgcagcugcuuaaaaccgagacagcugagauccaugacgauaauuauggcgggcccggagacaagauuaccaucugcaacggcuccacaauuguugaucagcggcuggggucugaacucggauguuacaccaucaauagagugaaguccuuuaaacugugcgagaacuccgccacgggcaagaccugcgaaauugacucuacaccugucaaaugucgccaaggguucugccugaagaucacccaggagggccggggacacgugaaacuuagcagaggcuccgaggucgugcucgauguuugugacagcucuugcgaaauuaugauccccaaggggacaggagauauccugguggacuguuccggcgggcagcagcauuuccugaaggauaaucucauugaccugggaugcccucacaucccccuucugggcaaaauggcuauuuauaucugucgcaugagcaaccacccgcggaccacaauggccuuucucuucugguuuucuuucggguacgucauuaccugcaucuuuuguaaggcccuguucuauucccugaucauuaucggcacgcuugggaaaaagauuaaacaauacagagagcucaagccucagacaugcaccaucugugaaaccgcucccgugaaugcgauugaugccgagaugcaugaccugaacugcagcuacaauaucugcccuuauugugcuucucgccugacauccgaaggccucgcccggcacguuacccagugccccaagagaaaagagaagguggaggaaacggagcuguaccuuaaccuggaacgcaucccguggauuguccggaaacuccuucaggugagcgaguccacagggguggcccugaagagaagcucuuggcuuaucguucuccugguccugcucaccgugagccuguccccugugcaaucugcucccgucggacauggcaaaacaauugaaaccuaucagacacgggagggguuuaccagcaucugucuuuucaugcugggauccauucucuuuaucgugucuugccugguuaagggccugguggacagcgucuccgauucuuucuuuccugggcuuagcguguguaaaacgugcuccaucggcagcauuaacggauucgagaucgaaucucacaaguguuacugcucccucuuuuguugccccuauugucgccacugcagcgccgacagagagauucaucagcugcaccugucuaucugcaagaaacggaagaccggcuccaauguuaugcucgcgguguguaaaagaaugugcuucaaggcuacaauugaagccagccgccgggcccugcuuaucagauccauuaucaacaccacauucgucaucuguauucugacccucgcuaucugcgugguuucuacgagcgccguggagauggaagaucugcccgcugggacaugggagcgcgaggaagaccugaccaauuuuugucaucaagagugccaggucacagaaaccgagugucuuugcccuuacgaggcccuggugcucagaaaaccgcuguuccucgauuccauugugaagggaaugaagaaccugcuuaauagcaccucucuggaaacaucccucagcaucgaggcgcccuggggcgccauuaacguccagucuacguuuaaaccuaccguuagcacagcuaauaucgcccuguccuggucuagcguggaacaccgggggaacaagauccuggugaccggacgcuccgagucuauuaugaaacuugaagagagaacaggcgucagcugggaccuggggguggaggaugcuuccgaaagcaagcuccugaccguuucuaucauggaccucucccagauguauagccccguguucgaguaccuguccggcgaucggcaagucgaagaguggccuaaagccacguguacaggagacugccccgaacgcuguggcugcaccucuucuaccugccuucauaaggaguggccucacuccagaaauuggcgguguaacccgacauggugcuggggagugggaaccggcuguacaugcugugggguugaugugaaggaccuguuuacggaucacauguucauuaaauggaaggucgaguacaucaaaaccgaagcgauugugugcguugagcucacaucucaggaacgccaguguagccugaucgaggccggaaccagauuuaaucugggccccgugacaaucacccuuuccgaaccucggaacauucagcaaaagcugcccccugagaucauuacgcuccaucccaaaaucgaggaaggcuucuuugaccugaugcacguccagaaggugcucagcgcuucuaccgugugcaagcugcaguccuguacacaugggauuccgggagaccuucagaucuaucacauuggcaaucugcugaaaggggaucgcgucaacggacaucucauccacaagaucgagccucacuucaauaccagcuggaugucuugggacggcugcgaucuggacuacuauuguaacaugggggauuggcccuccugcacauacaccggaguuacacaacauaaccacgccgcuuuugugaaucuucugaacauugaaacggacuauaccaaaacauuccauuuucacagcaagagagugaccgcccacggcgauacaccccagcucgaccugaaagcccggccuaccuacggcgcuggggagaucacgguccucguggagguugcggauauggaacugcauaccaagaaaguggagauuucuggacuuaaguucgccagccugacaugcaccggcuguuaugcuugcuccucugggaucagcuguaagguccgcauucacguggacgaacccgaugagcugacaguucaugugaaauccagcgacccugaugucguggccgccuccaccucucucauggcuagaaagcuggaguucggaacggacagcacauuuaaagccuucuccgcgaugccgaagaccucucuuugcuuuuacaucgucgaacgggaguacuguaaaagcugcuccgaagacgauaccaagaaguguguggacacaaaacuggagcagccccaaucuauccucauugaacacaagggcaccaucauugggaaacagaaugauacaugcaccgcuaaggccagcuguuggcuggaguccguuaagagcuucuuuuauggacucaaaaacaugcugggcucuguguucggcuccuuuuucgucgggauccuucuguuucuggccccuuucgugcuccugguucuguuuuucauguucggauggaagauucuguuuugcuucaaauguugcagacgcacgcggggccucuuuaaguacagacaucugaaagacgaugaagagacaggguaucgccggaucaucgagagacucaauagcaagaaaggaaagaaccgccugcuugacggcgaacggcuggcugauagaaagauugccgagcuguucucuaccaaaacacacaucggguga

SEQ ID NO: 13687 - RNA, 5055 nt, Artificial Sequence
  derived and/or modified CDS sequence (opt5) from CCHFV(SCT ex Afghanistan)__KC344856.1__GP
auguacacccugcucgugugcgccauccuguguccccagccuuggagccuugagggcacacacgucccgcugaacgggacgaagcauaauggaaccggcauuacagcugcccccgggggaucccaaggcccuaccucucccgcgagcacagcuguuucccucaccccugaccccuucacaaccgaaccuacggccucugccguggagcuggaaagcuccggggagggacacaccucucuuagcgugacaacccagggccugacauccccggaaaccacgcccggccucccuacagucaccgauacaggggugagcucuaccuccaucuuuggaauuggcaucagaguugcuggggacacccccacaagcacgacccauacaggacugccuucuucccccagcaugccgucuaccgcccagggcccucaccaugcugugcgggggcugcucuccgucagcuccacacgccccggagaggccucuaccauuacggugccuggcgaggcgggcacagaagccaacagcuccagcucugcuaucuccaaaaagcccgcccccagcccuaccgcugaggccaucaccgaagcgaauaacucuagcaauccgagacagcccgagcuguccacacaaccugccauucccgggcuuguuaccucuagcgcucagccuauccugcuccaguccgccacaagcacggcugcccaggauauuuaucccucuccgaccaaccgguccaaacgcaaucuggagauggaaaucauucuuacacugagccaaggacucaagaaauacuauggcaagauccugcggauucuggaccucacccuggaggaagauacagaggggcuucuggaauggugcaagagaaaccucggacugaccuguaaugacaacuucuuucaggagcgcaucgaggaguucuuucuuacgggcgaagggcacuucaaugaagugcugcaguuuaaaaccccuucuacacucucccccaccgagccuacacacaccagaacgcccacagucaagccuuucaaaagcuacuuugcccggggauuccuguccaucgauucuggcuauuuuagcgcuaagugcuacuccaaaaccucuaacagcggccugcagcucauuaauaucacacaacaucccgcgcgcauugccgacaccccggggccuaagaucaccaaccugaaggcuauuaauuguaucaaccuuaaagccuccguguucaaggaacacagagagaucgagauuaacgugcugcucccccaggucgccguuaaucugagcaacugccaugugcuuaucaaaucucacgugugugauuauucccuggacauugauggagcuguccggcucccccacgugcaucacaagggcacauuuaucccugggacguacaaaauuguuaucgacaagcgcaauaaacagaacgauagaugcacccuggugacaaauugugucaucaagggaaaggaaauucggaaaggccaaagcgcccugcgccaguacagaaccgagauccggauugggaaggcgucugcuggcuccagacgccuccugagcgaagagucuggagacgacugcaucagccggacacagcuucugagaaccgaaacggccgaggugcauaacgauaauuauggcgggccgggagacaaaauuacaaucuguaacggcuccaccauuguugaucagcgccucgggagcgagcugggaugcuacaccaucaaucgggugaagucuuucaaacugugcgaaaacuccgccacaggcaagagcuguaagaucgacuccacccccgucaaaugcagacaaggguucugucuuaagauuacacaggagggccgcggacacgugaaacucucucggggcagcgaagucgugcuggaugcuugcgacuccucuugugagaucaugauuccuaaggggacgggagauauccugguugacugcagcggcgggcagcagcauuuucucaaagauaaucugauugaccuuggaugucccaacaucccucugcucggcaagauggccaucuauauuugcagaauguccaaucaccccaagaccacaauggcuuuccuguuuugguucucuuuuggguacgugaucaccuguauuuucugcaaagucaucuuuuaucugcuuauugugguuggcacacucggaaagaaauucaagcaauaccgcgagcugaaaccucagaccuguacgaucugcgaaaccacacccaccaacgccaucgaugcggagaugcacgaccugaauugcagcuauaacauuuguccguacugcgccucccggcucacaagcgacggccuggcuagacaugugacccaguguccuaagcgcaaggaaaaagucgaggaaacagagcuuuaccugaaccucgagcggauccccuggauugugagaaagcugcuucaggugucugaauccaccgggguugcccugaaacggagcucuuggcucaucguccugcuggugcuccugacggugucccuuagcccuguccaaucugcucccauuggacacggcaagacaaucgagaccuaucagacccgcgaaggguacaucuccgugugccuguuuguucucggaggcauucuguucguggucagcugucugaucaaagggcuuguggauuccguuggcaauagcuuuuucccgggacucucuauuugcaagacauguagcaucggcuccgugaacggguuugagauugaaucucauaaaugcuauuguagccugcugugcuguccuuacugcagacacugcuccaccgaccgggagauccaccagcuccaucugucuauuuguaagaagagacgcacgggaggcaaugucaugcuugccgugugcaaacggauguguuucagagcgacaauggagguuagcaacaaggugcuguucauccgcaauaucauuaacaccacauuugucaucugcauucucauccuggccguguguguggucuccaccucugcuguugaaauggagagccugcccgccgggacaugggaaagagaggaagaucuuaccaauuucugccaccaggagugucaagugacggagaccgaaugccuguguccuuaugaggcucucgugcugcggaaaccccucuuucugaacuccauugucaagggaaugaaaaaucuucugaacagcacaaaucucgaaaccucucuguccaucgaggcccccuggggcgccaucaacgugcagagcacauucaagccuaccguuucuacggcuaauauugcgcuguccuggagcuccguggagcaucgcggcaacaagauccuugucucugggagaagcgaauccauuaugaaacuggaggaacggacaggaaucagcugggaccucggcguggaggaugccucugaauccaagagccugaccguuucugugauggaccucagccagauguacuccccggucuuugaguaucugucuggggaucgccaaguggaggaauggcccaaagcuacaugcaccggagacuguccugagagaugcggcugcaccagcuccacaugucuucacaaggaauggccccauucucggaauuggcgcugcaacccuacgugguguuggggaguugggaccggcugcacauguugcggccuggaugugaaagaccucuucaccgauuacauguuugucaaguggaagguggaguacauuaaaacagaagccaucgugugugucgagcugaccagccaggagagacagugcucccugaucgaagccgggacgcgguucaaccuuggacccguuacaauuacccugagcgagccucgcaauauccagcaaaagcucccgcccgaaauuaucacccugcacccuagaauugaggaaggcuuuuucgaccucaugcacgugcagaaagugcugucugcuuccacagucuguaaacuucagagcugcacccauggggugcccggagaucugcagguuuaucacaucggcaaccugcucaaaggggacaagcugaauggacauaugauucacaagaucgagccucauuuuaacacauccuggaugucuugggacggcugugaucuugacuacuauugcaauaugggcgauuggcccagcugcacguacaccggggugacacaacacaaccacgccgcguucgucaaucugcucaacaucgagaccgacuauacaaagaauuuucauuuccacuccaagcgggugaccgcucauggagauacgccgcagcuggaccucaaagccagaccuaccuacggcgccggggaaauuacaguucugguggaggucgcugauauggaacuucacaccaagaaaaucgacauuucuggacugaaguucgccagccugacaugugcgggcugcuaugcuuguuccagcgggaucucuugcaaagugcgcauucacgucgaugagcccgacgagcucaccgugcauguuaaguccgaagaucccgacaucguggccgccagcacaucucugaucgcucggaaacuugagcugggaacggauuccaccuuuaaagccuucagcgcuaugccuaagacaucucucuguuuuuacauugucgaaagagaguacugcaaaagcuguuccaaggaagacacccagaaaugcgugaacaccaagcuggagcacccccagggcauccucauugagcauaagggcacaaucauugggaaacaaaaugacacguguaccgccaaggcgggaugcuggcuggaaucuguuaagagcuucuuuuauggccuuaagaacaugcuguccgggaucuucggaaauguguuuaucggcauuuuccuguuucucgccccuuucguccugcuuauccuguuuuucauguucggguggcgccuccuguuuuguuucaaaugcugccggagaacacgcggacucuuuaaguaccggcaccugaaggaggaugaagagagcggcuauagacgcauuaucgaacggcuuaacaauaaaaagggcaaaaacaagcugcuggacggggagagacucgcugaucggcgcauugccgagcuguucuccaccaaaacacauaucggauga

SEQ ID NO: 13688 - RNA, 5055 nt, Artificial Sequence
  derived and/or modified CDS sequence (opt5) from CCHFV(SPU 44/08)__KJ682805.1__GP
auguacacaccccugcucugcgccauccugugucuucagcuguggagccucgagggcauuuaugggcuguccaacaauacccaacacaacgacacgucuaccaucaaggugccugaagagagccagaaaacaucccuuccggcuaauaccgccucucccauuacaagcgauccucccccuaccacacccaccgcguccgcuucuggaccugaaggcagcggggacacguccaccagcccgcccgucacaacccagggaccuacacccccugagaccacgcccgaaccgcauacaaccaucgauauugacaagucuuccacagccaucgccgauaucagcacccagaccguuaaaaacauuccuacacccacggcucacaccucucugccuuccacacucagcgcccccaccaugccccaagaggcucaucacacagccagaggccugcugucugugaccuccacgaagccuggggaggcgagcacaccgaccucccccggagaagccucuaccgaggcuagcuccccucagcccacaauccgggaaaccccuucucccccgccuacaacgcagacccccacagagauuaauaacccuaauaccagccgccagcccaugccuuccacacaacccgccgcuccgagcucugugacccauccugcccagcccacgcccagccaguccgacgucccuaccgcggcccaggauauccacccgucucccacaaacagaagcaaacggaaucucgagauggaaauuauccugacccuuucccaaggccugaagaaguacuauggcaaagugcucaagcugcuugaccugacacucgaggaagauaccgaggggcugcuggaauggugcaaacgcaaccucggacugacgugugacgauaauuucuuucagaagagaauugaggaguucuuucuuacaggcgaagggcacuucaacgagguucugcaguuuaaaaccccuagcacacucucucccaccgaaccugcucggguggagucccccaccgucgaaccuuucaagagcuacuuugccaagggauuccugcuuauggacucuggcuauuuuuccgcuaaaugcuaccccaagagcuccaauucugggcugcaacucaucaacgugacacagcaucugauccgcauuacggauaccccgggaccuaaaaucacaaaucugaagaccauuaacuguaucaaccucaaagcccugguuuucaaggagcacagagagauugaaaucaaugugcuucugccccaggucgccgugaaccucagcaauugccaugugcugaucaaaucccacgucugugacuauucuauugacaucgauggcccuguucggcuuccccgcauucaccaugagggcacauuuaucccggggaccuacaagauugugaucgacaagaaaaacaagcagaaugauagaugcacgcuggugacaaacugugucaucaaaggacgggaaauucgcaagggccaaagcgugcucagacaguaccggaccgagaucaaaauugggaaggcuuccagcggaucucgcagacugcuguccgaagagagcaaugacgauugccucucucggacccagcugcuuagaacagagaacgcggaaauccacuccgacaauuauggcgggccuggagauaagauuaccaucuguaacggcagcacaauuguugaccagcgccugggcucugagcucgggugcuacacgaucaaucgggugaaauccuucaagcugugcgaaaacagcgccaccggaaaaagcugugagaucgauucuacacccgucagaugccgccaaggcuuuugucugaagauuacccaggaggggcggggacaugugaaacuuuccagaggcagcgaaguugugcucgacgcuugcgauuccucuugugagaucaugauuccuaaggggacaggcgacauccuggucgacugcagcggaggccagcagcacuuccugaaggauaaucucguggaccuggggugucccaacauuccccuucugggaaaaauggccaucuauaucugccgcauguccaaucauccuaagaccacgauggccuuccucuuuugguucucuuuuggcuacgucauuaccuguauccugugcaaagcuauuuucuaucugcuuaucgugguugggacacucggaaagaaauuuaagcaauaccgggaacugaagccgcagaccuguacaauuugcgagaccaaccccgugaacgccaucgaugcggaaaugcacgaccugaauugcagcuauaacaucuguccuuacugcgcuuccagacucacaucugauggccuggcccgccacgucaugcagugucccaaacggaaggagaaaauugaggaaaccgagcuuuaccugaaucucgaaagaaucccuugggugguucgcaagcugcuccaggugagcgaguccacgggggucgcccuuaaacggagcucuuggcucgugauucugcuggugcuccugacaguuucccuuagccccguccaaucugcuccuaucucccauggcgaaaccguggagguguaucagaccagagagggauacacaagcauuugccuguucguccucggcucuauccuguuucugguguccugucuuaugcgggggcucguugacagcguguccaacagcuucuuuccgggacugucuaucugcaagaccuguagcauuggcuccaucaauggguucgaaauugagucucacaaaugcuauuguagccuguuuugcugucccuacugccgccauugcuccgccgauaucgaaauucacaagcuccaccugucuaucuguaagaaaagaaagacgggaagcaacgucaugcuugcugugugcaaacggauguguuucagagccacaguugagguguccaauaaggcgcugcucauucgcaacaucaucaauaccacauuugucgugugcauucugauccuggccguuuguguggucucuaccagcgcuguggaaauggagaaccuuccugccggcacaugggagaaagaagaggaccugaccaauuucugccaucaggaaugucaagugacggagaccgagugccucugucccuaugaagcucugguccuccggaagccucuguuccuugauuccauuguuaaggggaugaaaaaccugcucaauagcacaucucuggagaccucccugagcaucgaagcccccuggggcgcgauuaacgugcagucuacauuuaagccgaccguguccgccgcuaauaucgcccuuagcugguccucugucgagcacagaggaaacaaaauccuggugagcggccgcuccgaaagcauuaugaagcucgaggagagaacggggaucucuugggaccugggaguugaagaugcuuccgagagcaaacuccugacagugucugucauggaccuuagccagauguacuccccuguguucgaauaucugucuggcgaucggcagguugaggaauggcccaaggcuaccugcacaggggacugucccgagcgcugcggaugcaccagcuccaccugucuccauaaggaguggccucacucuagaaacuggcggugcaaucccacaugguguuggggcguggggacgggcugcaccuguugcggacuggacgucaaagaucuguuuacagacuacauguucgugaaguggaaaguugauuacauuaagaccgaagccaucgugugugucgagcuuacaagccaagaacgccagugcucccugauugaggccggcaccagauuuaaccucgggccugugacgaucacacugagcgaaccgcggaauauccagcagaaacugcccccugagauugugacccugcauccccgcaucgaggaaggauucuuugaccuuaugcacauucaaaagguccugucugcguccaccguuuguaagcugcagagcugcacacacggcgugccuggggaucuccagaucuaucauauuggaaaccugcuuaaaggcgacaaggugaauggccaccugauccauaaaauugagccccacuucaacaccuccuggaugucuugggaugggugugaccucgauuacuauugcaauaugggagacuggccgagcugcuccuacacaggcgucacgcagcauaaccacgccgcuuuugugaauaugcugaacaucgaaaccgauuauacaaagaauuuccacuuucauucuaaaagaguuaccgcccacggggacacaccucaacucgaucugaaggcccggcccaccuacggagcuggcgagaucacggugcuugucgagguggccgacauggaacugcauaccaaaaagauugagaucagcgggcugaaguucgcgucccucacauguaccggaugcuaugcuuguagcucuggcauuuccugcaaaguucgcauccacguggacgaaccugaugagcugacaguccacgucaagagcgaagaccccgauauuguggccgccucuuccagccuuauggcuagaaaacuggaguuuggcaccgacucuacauucaaggccuucagcgcgaugccuaaaacgucccucuguuuuuacaucguggagcgggaauacugcaagucuuguagcaaggaggauacccagaaaugcguuaacacaaagcuggaacagccccaauccauccucauugagcauaaagggaccaucauuggaaagcagaaugacaccuguacagcuaaagccagcugcuggcuggaauccaucaagucuuucuuuuauggccuuaagaacaugcugagcgggauuuucggaaauguguuuaucggcaucuuccuguuucucgccccguucauuaugcugauccuguuuuucauguuuggguggcgcauucuuuucuguuucaaaugcugcagacggacgagaggacucuuuaaguaccgccaccugaaagaugacgaggagaucggcuaucggaagauuaucgaaagacucaacaacaaaaagggcaagaauaaacugcuugauggggagcgccuggcugaccggaagauugccgaacuguucuccaccaaaacacauaucggauga

SEQ ID NO: 13689 - RNA, 5052 nt, Artificial Sequence
  derived and/or modified CDS sequence (opt5) from CCHFV(K323_27)__KX013472.1__GP
augcacacccugcucgugugcuucauccuguaccuucagcugagcggccucgggggagcccauggccaauccaacgcuacagagcacaaugggacgaacaccacaaccguccccggaacaucucagagcccuaagccgcccgccuccaccacacugccucauacccccgaaucuagcacgguuaaacuuaccacaccuaccuccgagacagaaggcucuggggagaccacgcccccuccgaauacaacccagggacugccccucccuggcacaacccccgaaagaagcgcgaccacagcuacguccaccagcucuacagacaacaugaauagcaccacacaggugaccgauaacacgccuacaagcaccgugucuauuucccccuccucuuccccgagcaugccuuccaccucucaaggcauccaccaucccguccggagccugcuguccgugagcucuccuaagacaguuaccacacccacgcccauguccccuggggagaugagcccggagaccucuagccagcacuccgccaugucucgcauucccacacucuauaccgccacacaggugagcaccgaaaauacggacagauccaccccucggcagagcgagucuuccguccaacccgcuacacagagcccuaucaccucucccgcccagacaauucugcuuauguccgcugccccgaaagcgauccaggauaugcacccuagccccaccaaccgcuccaagagaaaucuggaaguggagaucauucucacgcugucucaaggacuuaaaaaguacuauggcaagauccugaaacuccugcaucugacacucgaggaagacaccgaggggcugcuugaaugguguaagcggaaccugggaagcaauugcgaugacgacuuuuuccagaaacgcauugaggaauuuuucaucacaggcgagggguacuuuaacgagguucuccaguucaagacccuguccacccuuucuccuacagaaagcucccacgugagacugcccacggccgagccuuuuaaaagcuauuucgcuaagggauuucucucuauugauuccggcuacuucagcgccaaguguuauccccggucuuccaccagcggccugcaacugaucaaugucacacagcauccggcucgcauugccgaaaccccugggcccaaaacaaccucucucaagacgaucaacugcaucaaucugagagcgagcguguuuaaagagcaccgggaaguggagauuaacguccuucugccccagaucgccguuaaccucuccaauugucacguggugauuagcucucaugucugcgauuacucccuggacacagauggaccugugcgccuuccgagaauccaccaugagggcaccuucauucccgggaccuacaagaucguuaucgaccggaaagauaagcugaacgaccgcuguagccucgugacaaauugcgucauuaaaggaagagaagugcggaagggccaguccguucugagacaauauaagaccgagaucaaaauugggaaggcuucuacaggaagccgcaaacugcucuccgaggagccuggcgacgauuguaucucucggacgcagcugcuuaagaccgaaacagccgagauucacgacgauaacuacggcgggcccggagacaaaaucaccaucugcaauggcagcacaauuguggaucagagacugggguccgagcucggauguuauaccaucaaccgcgucaagucuuuuaagcugugcgaaaauagcgcuacgggcaaaaccugcgagauugacuccacaccugugaagugucggcagggguucugccugaaaaucacccaagaaggcagaggacaugucaaacuuagccgcggcucugaggugguucucgaugccugugacuccagcugcgagauuaugauccccaaggggacaggagauauucugguggacuguucuggcgggcagcagcacuuccugaaggauaaccucaucgaccugggaugcccucacaucccccuucugggcaagauggccauuuacaucugucggauguccaaucauccgagaaccacaauggcuuuucucuucugguuuagcuucggguaugucauuaccugcaucuuuuguaaagcgcuguucuaccugcuuauuaucaucggcacgcucggaaagaaaauuaagcaguaucgcgaacugaaaccucaaacaugcaccaucugugagaccgcccccgugaacgcuauugacgccgaaaugcacgaucugaauugcucuuacaacaucugcccuuacugugccucccggcucacaagcgacggccuggcuagacauguuacccagugccccaagcgcaaggagaaaguggaagagacggagcuuuaucugaaucucgaacggauuccguggaucgucagaaagcugcuccagguguccgagagcacagggguggcccuuaaacggucuagcuggcucaccguucugcugguccuccugacagugucccuuucuccugugcagagcgcgcccgucggacacggcaacaccaucgaaacauaccaaacccgcgagggguuuacguccauuugucuguucaugcucggaucuauccuguuuauugugagcugccugguuaagggccuuguggauuccgucucugacagcuucuuuccugggcucuccguguguaaaaccugcagcaucggcucuauuaauggauucgaaaucgagucccacaaguguuauugcagccuguuuuguugcccccauuguagacaccggucugcugauagagagauccaucagcugcaccucuccauuugcaaaaagcgcaagacaggcagcaacguuaugcuggccgugugcaaacggaugugucccaaggccaccaucgaagcuagcagacgcgcccuuccuauuagaucuaucauuaacacaacccuggucaugugcauccucacgcuggcuauuugugugguuagcacauccgccguggagauggaagaccugccggcggggaccugggagcgggaagaggaucuuacaaauuucugccaucaggagugucaagucaccgaaaccgagugccugugucccuacgaagcccucgugcugcgcaaaccucucuuccuggacagcaucgcuaagggaaugaaaaaccuucuuaauucuacaucccucgagacgagccugucuaucgaggcccccuggggcgcuauuaacgugcagagcaccuuuaagccuacagucuccaccgccaauaucgcgcugucuuggagcuccguugaacacagagggaacaagauucuugugacaggacggucugagagcaucaugaaacuggaggaacgcaccggcguguccugggaucucggggucgaagacgccagcgagucuaagcugcucacgguguccauuauggaucugagccagauguauucccccguuuucgaguaccuuucuggcgacagacagguggaagaguggccuaaagcuacaugcaccggagauuguccggaacggugcggcuguaccagcuccacaugccugcacaaggaguggccccauucucgcaauuggagaugcaacccuaccugguguuggggagucggaacaggcugcacguguugcgggguggacguuaaagaccucuuuaccgaucacauguucaucaaguggaagguggaauauaucaaaacagaggccauugucuguguggagcugaccggacaagaacggcagugcagccugaucgaggcuggcacacgcuuuaaucuuggccccguuaccauuacgcuguccgaaccuagaaacauccagcagaagcugcccccggagauuaucacccugcauccuaaaaucgaagagggguucuuugaccucaugcacgugcaaaagguccugagcgccucuacaguguguaaacuucaguccugcacccaugggauucccggcgaucugcagaucuaccacauugggaaucugcucaagggagaccgggugaacggccaccugauccauaagauugagccccacuucaauacaagcuggaugucuugggaugggugugaccuugauuacuauugcaacaugggagacuggccuuccuguaccuacacaggcgucacgcagcauaaucacgccgcuuuuguuaaccugcucaacaucgaaaccgauuauacaaaaaccuuccacuuucauagcaagagagugaccgcgcacggcgacacaccccaacuggaucucaaagcccgcccuacguacggggcuggagagauuaccgugcuggucgaaguggccgacauggagcuucauacaaagaaaguugagaucucuggccugaaguucgccagccugaccugcacagggugcuaugcuuguuccucuggaaucagcugcaaagugcggauucacgucgaugaaccggacgagcucaccgugcauguuaaguccagcgaccccgauguggucgccgcguccacgucucugauggcuagaaagcuggaauuuggcacagacagcaccuucaaagccuucuccgccaugccuaagaccucucuguguuuuuacaucguggagcgcgaauauugcaaaagcuguuccgaggaugacacaaagaaaugcgucgauaccaagcucgagcagccccagucuauucugaucgaacacaaggggacaauuaucggaaaacaaaaugacaccuguacggcuaaggccagcugcuggcucgaguccgugaaauccuucuuuuacggccugaagaacaugcuuggcucuguuuucggguccuuuuucgugggaauccugcuguuucucgcgccuuucguccugcuugugcuguuuuucauguuuggcuggaaaauucucuucuguuucaagugcugucggagaacacgcgggcuguuuaaguaccggcaccucaaugaugacgaagagaccggauauagacgcaucauugaacggcugaacagcaaaaagggcaaaaauagacuucuggauggggagcggcuggcugaccgcaagaucgccgaacucuucucuacaaaaacccauauuggauga

SEQ ID NO: 13690 - RNA, 5052 nt, Artificial Sequence
  derived and/or modified CDS sequence (opt5) from CCHFV(1231-CR/TI-2015)__KU161585.1__GP
augcacacccugcucgugugcuucauccuguaccuucagcugcucggccuugggggagcccaugagcaaagcaacgcuacagaccacaauagaacgaacaccauuacagcccccuccaccucucagaauccuaagccgcccgcgagcacaaccccuccccauacaccugaauccucuaccaucaaacuuauuacgagcaccggcgaggcugaaggguccggagagacaacacccccucugaacaccacccagggcccguuucccccugaaacgacaucugagcaccccgccagcaccgccacaaauaccuccagcaccaacucuaugaacuccacaacgcagaugaccgauaagacacucaccagcacagucucuaccucccugagcaucucuccuuccacgcccagcacaucccaagggauucauuauccgauccggucucugcucagcguuuccagcccucgcaccgcugccacccccacaccuaugucuaccagagagauguccagcgaaacaaauucucagcacagcgcugugucccggacgcccaccuuccacacagccacccaggugucuacagagaaugacaaccgcagcacccccagacaguccgaaagcucugcgcaaccugccacgcaguccccgaugaccagccccgcucagucuauccugcuugucuccgccgcuccuacaaccauucagaauauccaucccagcccuacaaaccgguccaaacgcaaucuggagauggagauuauccucacccugccccaaggacuuaagaaauacuauggcaagauucugaagcuccugcaccugacgcucgaagaggauacagaaggccugcuugagugguguaaaagaaaccuggggucuaauugcgacgaugaauuuuuccagaagcggaucgaggaguuuuucauuaccggagaaggcuacuuuaacgaggugcuccaguucaaaacacugagcacccuuuccccgauggaaccuucucaugccagacccccuaccgcggagcccuuuaagagcuauuucgccaaaggguuucuguccaucgacagcggauacuucucugcuaaguguuauccucgcuccucuagcuccggccuccaacugaucaacauuacacagcaccccgcccggaucgcugaaacgccggggccuaagaccacaagccugaaaaccauuaauugcaucaaccuccgcgccucuguuuuuaaggagcacagagagguggaaauuaauguccugcuuccccagaucgccgugaaccugagcaauugucauguugugaucaacucccacgucugcgauuacagccucgacacagauggacccgugcggcugccucgcauuuaccaugagggcaccuucaucccgggcacguauaaaauugugaucgacaagaaaaauaaacuuaacgauagauguacacuggucaccaauugcguuaccaaggggcgggaagugagaaagggacagucugugcuccgccaauacaagacagagauuaaaaucggcaaggcuuccaccgggagccggaaacugcuguccgaggaacccggagacgauuguaucucuagaacacagcuccugcgcacggagaccgcggaaauucacgacgacaacuauggcgggccuggagauaagaucacaauuugcaauggcagcaccaucgucgaccagcggcuuggcuccgagcugggguguuacacaauuaacagagugaaaucuuucaagcucugcgaaaauagcgccaccggaaagacgugcgagaucgauuccacccccguuaaaugucgccagggcuuuugccugaagauuacacaagaggggcggggacaugugaaacugucuagaggcagcgaagucgugcuugacgcuugugauuccagcugcgagguuaugaucccuaaggggaccggcgacauccucguggauuguucuggaggccagcagcacuuccugaaagacaaccugauugaucucgggugcccccacaucccucugcuuggaaagauggccauuuauaucugucgcauguccaaucauccccggacaaccauggccuuucuguucugguuuagcuucggcuacgucauuacaugcaucuuuuguaaggcucucuucuauucucugaucauuaucgggacccuggggaaaaagauuaaacaguacagagaacuuaagccgcaaacgugcacaaucugugagaccgccccugugaacgcgauugacgcugaaaugcacgaucucaacugcuccuacaauaucugccccuauugugccagccgccugaccucugacggccuggcccggcaugucacacagugcccuaaaagaaaggagaagguggaggaaaccgagcucuaccugaaccuugaacggauccccuggauuguucgcaaacugcuccagguguccgagagcacgggggucgcucugaagagauccagcuggcugaucgugcuucucguucugcugacagugucucucagcccgguccaguccgccccugugggccacggaaaaaccauugaaacauaucaaacccgggagggcuuuacaucuaucugucuguucaugcuugggagcauucuguuuaucguguccugccucguuaagggacuggucgagucugugagcgacuccuucuuucccggccugucuguguguagaaccugcagcaucggguccauuaauggauucgaaaucgagagccacaaauguuacugcucucuuuucuguugcccuuauugucgccauugcuccgcugaucgggaaauucaccagcuccaucugagcaucugcaagaaaagaaagacgggcucuaacgucaugcuggccguguguaagcgcaugugcuuuagagcgaccauggaggccucccggcgcgcucuccugauuagaagcaucauuaauacaaccuucguuaucuguauccuuacacugaccauuugcguggucuccacgucugccguggaaauggagaaccuccccgcugggacaugggagcgggaagaggaccugaccaauuuuugucaccaggaaugccaaguuacagagaccgagugucugugccccuacgaagcccuugugcugcgcaaaccucucuuccuggauagcaucgucaagggcaugaaaaaccuccuuaauuccaccagccuggagacaucucuguccauugaagcgccguggggagccaucaacgugcagagcacguuuaagcccaccguuucuacagcuaauauugcccucagcugguccucuguggagcauagaggcaacaaaauccuggucaccgggcggagcgaauccaucaugaagcuggaggagcgcacaggagugucuugggaccuuggcguggaagaugcuagcgaguccaagcugcucaccgucagcauuauggaccugucucagauguauuccccuguuuucgaauaccucagcggggauagacagguggaggaauggcccaaagccacguguacaggagacugcccugagcgguguggcugcaccuccucuaccugccugcacaaggaguggccccacagccgcaauuggagauguaacccuacauggugcuggggagugggcaccggauguacaugcuguggcgucgaugugaaagaccuuuuuacggaucauauguucguuaaguggaaaguggaauacaucaagaccgaggccauugucugcguggaacugacaucccaagagcggcaguguucucucaucgaagcugggaccagauuuaaucugggaccgguuacaauuacccugagcgagccccgcaacauccagcagaaacuuccucccgagaucauuacgcugcacccuaagaucgaagagggcuucuuugaccucaugcaugugcaaaagguccuguccgcgagcaccgugugcaaacuccagucuuguacacacgggauucccggagaucugcagguuuaucauaucggcaaccuucugaagggcgaccgggugaaugggcaccugauucacaaaaucgaaccgcauuucaacaccuccuggaugagcugggacggaugcgaucucgacuacuauuguaauaugggcgauuggccuucuugcacauacaccggggucacacagcacaaccaugccgcuuuugugaaucugcuuaacauugagacggacuauaccaagacauuccacuuccacuccaagagagugaccgcccauggagauacaccccaacuggaccucaaagcccgccccaccuacggcgcuggggagaucacgguccugguugaaguggccgauauggagcuccacaccaagaaaguggaaaucagcggacugaaguuugcgucucuugcuugcacaggcuguuaugccugcagcuccggcauuucuuguaaaguccggauccauguggacgagccugaugaacugaccguucacgucaagagcuccgaccccgaugugguggccgcuagcacaucccugauggccagaaaacucgaguucgggaccgacucuacguuuaaggcguucagcgcuaugccuaagacaucccugugcuuuuacauuguugagcgcgaauacuguaaaucuugcagcgaggaugacaccaagaaauguguggacaccaaacuugaacagccgcaguccauccugauugagcauaagggaacaaucaucggcaagcaaaaugauaccugcacagccaaggccucuuguuggcucgaaagcgucaaauccuucuuuuaugggcugaagaacaugcucggaagcguguucggcaacuuuuucauugggauccugcuuuuucuggcucccuucguccugcucgugcuguucuuuauguucggauggaaaauucuguuuugcuucaaguguugccggagaacccgcggccuguuuaaauaccggcaccucaaggacgaugaggagacgggcuauagacggaucauugaacgccugaauaauaagaaagggaagaacagacuccuggacggagagcggcuugccgaucgcaaaaucgcugaacuguucucuacaaagacccacaucggcuga

SEQ ID NO: 13691 - RNA, 5052 nt, Artificial Sequence
  derived and/or modified CDS sequence (opt5) from CCHFV(K229_194)__KX013463.1__GP
augcacacccugcucgugugcuucauccuguaccuucagcugagcggccucgggggagcccauggccaauccaacgcuacagagcacaaugggacgaacaccacaaccguccccggaacaucucagagcccuaagccgcccgccuccaccacacugccucauacccccgaaucuagcacgguuaaacuuaccacaccuaccuccgagacagaaggcucuggggagaccacgcccccuccgaauacaacccagggacugcccccucccggcacaaccccugaaagacccgcgaccacagcuacgagcaccuccagcacagacaacaugaacucuaccacacaggugaccgauaauacgccgauuuccacagugagcaucucuccuuccagcucucccuccaugccuagcaccucccaaggcauucacuaucccguccggucucuccugagcguguccagccccaagaccguuacaaccccuacaccgaugucucccggggagauguccccugagacgagcucucagcauagcgccaugucccgcauccccacccuguacacagccacccaggugucuacagaaaauaccaacagaagcacgccucggcaguccgagagcucugcucaacccgccacccaguccccgacaaccagcccuacacagaccauucuccugaugucugcugcccccaaagcgauccaggacaugcacccuucccccacgaaucgcagcaagagaaaccuugaagucgagaucauucugacacucucccaaggacugaaaaaguauuacggcaagauccuuaaacugcuccaccugacccuggaggaagauacagaggggcuccuggaaugguguaagcggaaucuuggaucuaacugcgacgaugacuuuuuccagaaacgcauugaggaauuuuucaucaccggcgagggguauuuuaaugaggugcugcaguucaagacccucaacacacugagcccuacggaacccucccauguuagacuuccgaccgccgagccuuuuaaaucuuacuucgcuaagggauuucugagcguggauuccggcuauuucagcgccaaguguuacccccggucuuccacaagcggccuccaacugauuaaugucacccagcaccccgcucgcaucgccgaaacaccugggccgaaaaccacgucucugaagacaauuaacugcaucaaccucagagcguccguguuuaaagagcaucgggaaguggagaucaauguccugcuuccccagauugccguuaaccugagcaauugucacguggugaucaacucucacgucugcgacuacagccucgauaccgacggaccugugcgccugccccggauucaucacgagggcaccuucaucccugggacauauaagauuguuaucgauaaaaagaauaaacuuaacgacagauguucccuggugaccaauugcgucaucaagggacgcgaagugagaaagggccagagcguucuccggcaauacaaaacagagauuaagaucgggaaggcuucuacgggauccagaaaacugcugagcgaggaacccggcgaugacuguauuucccgcacccagcuccugaaaacagaaaccgccgagauccaugacgauaacuauggcgggccuggagacaagauuacaaucugcaauggcucuaccaucguggaucagcggcuugggagcgagcugggauguuacacgauuaacagagucaaguccuuuaaacucugcgaaaauucugcuaccggcaagacaugcgagaucgacagcacccccgugaaaugucgccagggguucugccugaagauuacacaagaaggccggggacacgucaaacuguccagaggcucugaggugguucuugaugccugugacagcuccugcgagaucaugauuccgaaggggaccggagauauccucguggacuguagcggcgggcagcagcauuuccugaagggaaaccugauugaucucggcugcccucacaucccccugcuugggaaaauggccaucuauauuugucgcaugucuaaucacccucggacaaccauggcuuuucuguucugguuuuccuucggcuacgucaucacgugcaucuuuuguaaggcucucuucuauagccugauuauuaucggaacacugggcaaaaagaucaaacaguacagagaacuuaagccccaaaccugcaccauuugugagacagccccggugaacgcuaucgacgccgaaaugcaugaucucaauugcucuuacaacauuugcccuuauugugccucccgccugaccagcgacgggcuggcucggcacguuacgcagugccccaagagaaaagagaagguggaagagacagagcucuaccugaaccuugaacgcaucccuuggauuguccggaaacugcuccaggugucugaguccaccggaguggcccugaagagaagcuccuggcugaucguucuucucguccugcugacagugagccucucucccgugcagagcgcgcccgucggccaugggaaaaccaucgaaacauaucaaacccgggagggauuuacgaauauuugucuguucaugcuuggcuccauccuguuuauugugucuugccucguuaaggggcugguggacagcgucuccgauucuuucuuuccuggccugagcguguguaaaaccugcuccaucggaucuauuaacggcuucgaaaucgagagccacaaguguuacugcucccuuuucuguugcccguauugucgccacugcagcgcugacagagagauccaucagcuccaccuggggauuugcaagaaacggaagacaggaucuaauguuaugcuggccguguguaaaagaaugugcuuuaaggccaccaucgaggcuucccgccgggcccuccugauuagaagcaucauuaacacaaccuucgucaucuguauucuuacgcuggcuaucugcgugguuucuacauccgccguggaaauggaaaaucuccccgcgggcaccugggagcgcgaagaggaucugaccagcuuuugucaucaggagugccaagucacagaaaccgagugucugugcccuuacgaagcccuugugcugagaaaaccccucuuccuggacuccaucgugaaggggaagaaaaaccuccuuaauucuacaagccuugagacgucccugagcauugaggcuccuuggggagccaucaacguccagucuaccuuuaagcccacaguuuccaccgcuaauauugcccucagcuggucuagcguggaacaccggggcaacaaaauccuggugacagggcgcuccgagucuauuaugaagcuggaagagagaaccggcgucagcugggaucuuggaguggaagacgcguccgagucuaaacugcucacgguuagcaucauggaucugucccagauguauagcccuguguucgaguaccucucuggcgaccggcaggucgaagaguggccgaaggccacauguaccggggauugccccgaacgcuguggaugcaccuccagcacaugccugcauaaggaguggccucacuccagaaauuggcgguguaaccccaccuggugcuggggcguggggacaggauguacgugcuguggcguugacgugaaagaucuuuuuaccgaccacauguucaucaaguggaaagucgaauacauuaagacagaggcuaucgugugcguugagcugaccucucaagaacgccaguguagccucauugaggccggcacaagauuuaaucuggggccugugaccaucacgcuguccgaaccccggaacauucagcagaaacuuccgccugagaucaucacccugcaucccaagauugaagagggauucuuugaucucaugcacguccaaaaggugcugucugcuagcacagugugcaaacuccaguccuguacccauggcauccccggggaccugcagauuuaucacaucggaaaucuucugaagggcgaccgccugaacgggcaucucauucacaaaaucgagccucacuucaacacaagcuggaugucuugggauggaugcgaccuggauuacuauuguaauaugggcgacuggcccuccugcaccuacacaggcgucacgcagcauaaccacgccgccuuuguuaaucuucugaacauugaaaccgauuauacaaagaccuuccauuuucacagcaaaagagugaccgcucacggggacacaccucaacucgaucugaaggcgcggccgacguacggagccggcgagaucaccgugcucgucgaaguggcugacauggagcugcauaccaaaaagguugagaucucugggcuuaaguucgccucccuggccugcacaggauguuauagcugcucuagcggcauuuccuguaaagugagaauccacgucgaugaacccgacgagcugacagugcauguuaagucuagcgauccugacguggucgcugccuccaccagccucauggcgcgcaaacuggaguucgggacggauuccacauuuaaggcuuucucugccaugcccaaaaccagccuuugcuuuuacauuguggaacgggaauacuguaaguccugcucugaggacgacaccaagaaaugugucgauacaaagcuggagcagccucagagcauccucauugaacacaaaggaaccaucaucggcaagcaaaaugacacaugcaccgccaaagcguccuguuggcuggagucuguuaagagcuucuuuuauggccucaagaacaugcugggguccguguucggaaacuuuuucgugggcauucuucuguuucuggcccccuucguccuccuggugcuguuuuucauguucggguggaaaauccuguuuugcuucaaguguugcagacgcacgcggggacucuuuaaauacagacaucugaaggaugacgaagagacaggcuaucgcaaaauuaucgaacggcucaauagcaagaaggggaaaaauagacugcuugauggagagcgccuggcggaccggaagauugcugagcuguucucuaccaaaacacacaucggcuga

SEQ ID NO: 13692 - RNA, 5052 nt, Artificial Sequence
  derived and/or modified CDS sequence (opt5) from CCHFV(K315_14)__KX013469.1__GP
augcacacccugcucgugugcuucauccuguaccuucagcugagcggccucgggggagcccauggccaauccaacgagacagaacacaaugggacgaacaccacaaccguccccggaacaucucagagcccuaagccgcccgcuuccaccacacugcagcauaccccugagucuagcacgguuaaacuuaccacacccaccuccgaaacagagggcucuggggaaaccacgccucccccuaauacaacccagggacugccgcccccuggcacaacccccgagagaagcgccaccacagcgacguccaccagcucuacagacaacaugaacuccaccacacaagugaccgauaauacgccuacaagcaccgugucuauuucccccagcagcuccccgagcaugccuuccaccucucagggcauccacuaucccauucggagccuccuguccgucagcucuccuaagacagugaccacacccacgcccaucuccccuggggagaugagcccggaaaccucuagccagcauuccgcuaugucucgcauucccacacuguacaccgccacacagguuagcaccgagaauacgaacagauccaccccucggcaaagcgaaucuuccgugcagcccgccacacagagcccuaucaccucucccgcucagacaauccuccugauguccgccgcuccgaaagccauucaagacaugcacccuagccccaccaaucgcuccaagagaaaccuugaggucgagaucauucugacgcucucucagggacugaaaaaguauuacggcaagauccuuaaacugcuccaccugacacuggaagaggauaccgaagggcuccuggagugguguaagcggaaucuuggaagcaacugcgacgaugacuuuuuccagaaacgcauugaagaguuuuucaucacaggcgagggguauuuuaaugaagugcugcaauucaagacccucuccacccugucuccuacagagcccagccauguuagacuuccuacggcggaacccuuuaaauccuacuucgccaagggauuucugagcauugauucuggcuauuucuccgcuaaguguuacccgcggagcucuaccuccggccuccagcugaucaacgugacacagcacccugcccgcaucgcugagacccccgggcccaaaacaaccagccugaagacgauuaauugcaucaaccucagagccucugucuuuaaagaacaucgggagguggagauuaacgugcugcuuccucagaucgcggucaaucugagcaacugucacguugugauuaauucccacgugugcgacuacagccucgauacagacggaccgguccgccugcccagaauccaucacgaaggcaccuucaucccugggaccuauaagauugugaucgauaaaaagaacaaacuuaaugaccgguguucucugguuacaaacugcgugauuaagggacgcgaggucagaaagggccaauccgugcuccggcaguacaaaaccgaaaucagaauugggaaggccagcacaggaucccgcaaacugcugucugaggaacccggcgaugacuguaucagccggacgcagcuccugaagaccgagacagcugagauccaugacgauaauuauggcgggccuggagacaaaauuaccaucugcaacggcuccacaguuguggaucagagacuugggucugaacugggauguuacaccauuaaucgcgucaagagcuuuaagcucugcaaaaacuccgccacgggcaagaccugcgagaucgacucuacacccgugaaaugucggcaaggguucugccugaagauuacccaggaaggcagaggacacgucaaacugagccgcggcuccgaggugguucuugaugugugugacagcucuugcgagaucaugauuccuaaggggacaggagauauccucgucgacuguuccggcgggcagcagcauuuccugaaggauaaucugaucgaccucggaugcccccacauuccgcugcuuggcaaaauggcuaucuauauuugucggaugagcaaccacccuagaaccacaauggccuuucuguucugguuuucuuucggguacgugauuaccugcaucuuuuguaaggcccucuucuauucccugaucaucauuggcacgcuggggaaaaagaucaaacaauaccgcgaacuuaagccccagacaugcaccauuugugagaccgcuccuguuaaugcgaucgaugccgaaaugcaugaccucaacugcagcuacaauauuugccccuauugugcuucucggcugacauccgagggccuggccagacacgugacccagugcccgaagcgcaaagaaaaggucgaggagacggaacucuaccugaaccuugagcggaucccuuggaucgugagaaaacugcuccaggugagcgaauccacagggguugcccugaagcggagcucuuggcugauuguccuucucgugcugcugaccgugagccucucccccguccaaucugcuccugugggacauggcaaaacaaucgagaccuaucagacacgcgaaggguuuaccagcauuugucuguucaugcuuggauccauccuguuuauuguuucuugccucgugaagggccuggucuacagcguguccgacucuuucuuucccgggcugagcguuuguaaaacgugcuccaucggcagcaucaacggauucgagauugagucucacaaguguuauugcucccucuuuuguugccccuacuguagacacugcagcgccgaucgggaaauccaucagcuucaccugucuauuugcaagaaaagaaagaccggcuccaaugugaugcuggcggucuguaaacgcaugugcuucaaggcuacaaucgaggccagccggagagcccuccugauucgcuccaucauuaacaccacauucgugaucuguauccuuacccuggcuauuugcguugugucuacgagcgccgucgaaauggaggaccucccugcugggacaugggaaagagaggaggaucugaccaauuuuugucaucaagaaugccaggugacagagaccgaaugucugugcccguaugaggcccuugugcugcggaaaccccucuuccuggacuccaucgucaagggaaugaagaaacuccugaacagcaccucucuugagacaucccugagcauugaagcgccuuggggcgccaucaauguucagucuacguuuaagcccaccgugagcacagcuaacauugcccucuccuggucuagcguggagcaccgcgggaauaaaauccuggucaccggaagauccgaaucuaucaugaagcuggaggaacggacaggcgugagcugggaucuugggguugaggacgcuuccgagagcaaacugcucaccgugucuauuauggaucugucccagauguacagcccugucuucgaauaccucuccggcgaccgccaaguggaggaauggcccaaggccacguguacaggagauugcccugagagauguggcugcaccucuucuaccugccugcauaaggaauggccgcacucccggaacuggcgcuguaaucccacauggugcuggggaguuggaaccggcuguacaugcugugggguggacgucaaagaucuuuuuacggaccacauguucaucaaguggaaaguggaguauauuaagaccgaggcgaucguuugcguggaacugacaucucaggagagacaguguagccucauugaagccggaacccgguuuaaccugggcccugucacaaucacccuguccgagccccgcaauauccagcaaaaacuuccucccgaaauuaucacgcugcauccgaagauugaggagggcuucuuugaucucaugcacgugcagaaggugcugagcgcuucuaccgucugcaaacuccaguccuguacacaugggaucccuggagaccugcagauuuaccacaucggcaaccuucugaagggggacagaguuaauggacaucugauucacaaaaucgaaccccacuucaacaccagcuggaugucuugggauggcugcgaccucgauuauuacuguaauaugggggacuggcccuccugcacauauaccggagugacacaacauaaccacgccgcuuuugugaaccugcuuaauaucgagacggauuacaccaagacauuccauuuucacagcaaacgggucaccgcccacggcgacaccccucagcuggaucucaaggccagacccacauauggcgcuggggaaauuacggugcugguugagguggcggacauggagcuccauaccaaaaaggucgaaaucucuggacugaaguucgccagccuuacaugcaccggcuguuacgcuugcuccucugggauuagcuguaaagugcgcauccacguugaugagccugacgaacugacagugcaugucaaguccagcgauccggacguggucgccgccuccaccucucugauggcucggaaacucgaguucggaacggauagcacauuuaaggccuucuccgcgaugcccaaaaccucucugugcuuuuacauuguggaaagagaguauuguaagagcugcuccgaggacgacaccaagaaauguguugauacaaaacuugaacagccucaaucuauccugaucgagcacaagggcaccauuaucgggaagcagaacgacacaugcaccgcuaaagccagcuguuggcucgaauccgucaagagcuucuuuuacggacugaagaauaugcucggcucuguguucggcuccuuuuucguggggauucugcuuuuucuggcccccuucguucugcucgugcuguuuuucauguucggauggaaaauccuguuuugcuucaaguguugccgccggacgagaggccuuuuuaaauaucgccaucucaaggaugacgaggaaacaggguaccggagaauuaucgagcgccugaacagcaaaaagggaaagaaucggcuccuggauggcgagagacuugcugaccggaaaaucgccgaacuguucucuaccaagacacacauuggguga

SEQ ID NO: 13693 - RNA, 5055 nt, Artificial Sequence
  derived and/or modified CDS sequence (opt5) from CCHFV(BA8402)__AF350449.1__GP
auguacacaccccugcucugcgccgugcugugucuucagcuguggagccucgagggcucccacgggcugucuaacaagacccaacauagcaauacguccaccacaaaagcuccugaagucucucaggagcuuggacugccgguuagcaccguguccacaaucaccucugaacccccuagcauuacauccgccgugagcgucucuggcuccgaggggagcggagacaccaacacgucucccuccgugaccacacagggcccuacccuccccgaaacaacccuggagccucugacgacaaccgauacagacgcgagcucuaccguuguggucgauguguccacccagacaguuaaggacacgccgaucagcaccacauauaccucccuccccucuacaccuagcgagcccaccacgccucaagggacacaccauaccgcuagaggacugcuuuccgugaccagcacaaaacccgaagaggccucuccgcaggccaauccuggcaagauuuccauggaaaccaacggcccccggcuggcuaucagcgagacaccuucuuucagccccacgacccaggcccccacagaaaauuccaacccuauuaccucuaaacagcucaugcugagcgcucaaccggucacacccaauccuaugaccucccccgugcagccugcccuuagccagucugauacguccaccgcgauccaggacgugcaccccagcccgacagggcgcucuaagagaaaccuggaaauggagaucauucucacccugucccaaggacugaagaaauacuauggcaagauccucaaacugcuugaucugacacucgaagaggacaccgaagggcugcuugaguggugcaagcggaaucugggacucgucugugaugacaacuuuuuccagaaacgcauugaggaauuuuuccugacgggcaaggggcauuuuaaugagguucugcaguucaagacaccuagcacccucucccccacaggaccugccagaaccggcucucccaccguggaaccuuuuaaaagcuacuucgcuaagggcuuucuguccauggauucuggguauuucagcgccaaaugcuacccccgggcuuccaacagcggacuucaacugaucaaugugacacagcacucuacgcgcauuaccgacacaccgggcccuaagaucaccaaccucaaaacaauuaauuguaucaaccugaaggccuccgucuuuaaagagcacagagaaaucgagauuaacgugcuucugccccagguugcggugaaucucagcucuugccauguccugaucaagucccacgugugugauuauagccuggacauugacgggcccguucggcucccucgcauccaucacgagggaaccuucauuccgggcacguacaagaucgugaucgauaaaaagaacaaacagaaugacagaugcacacuggucaccaacugugugauuaaggggcgggaaauccgcaaaggacaaucuguccuuagacaguaccggaccgagauuaagaucggcaaggccagcuccggcagccgcagacugcucucugaagaguccggggaugacugcauuagccggacacagcugcugagaaccgaaacagcugagauccacaaugauaacuauggaggccccggggacaaaaucacgauuuguaauggauccaccgugguugaucagcgccuuggcucugagcucgggugcuacacaaucaaccgggugaauagcuuuaaccugugcgaaaauaccgccacaggcaaguccugugagauugacucuaccccugucaaaugcagacaaggauucugucugaagaucacgcaggaaggccgcgggcaugugaaacucagccggggauccgagguugugcuggaugcuugcgagucuagcugugaaauuaugauccccaagggcaccggggacauucuugucgauugcuccggaggccagcagcacuuccugaaggacaaccucaucgaccugggguguccuaauaucccccugcuuggcaaaauggccauuuauaucugcagaaugagcaaccauccuaagacaaccauggccuuucucuucugguuuucuuucggauacguggugacauguauucugugcaaaguuaucuuuuaucugcucauugucgugggcacccuggggaagaaauucaagcaauaccgcgagcuuaagccccagacauguaccaucugcgaaacgacaccggugaaugcuaucgaugcggagaugcacgaccugaacugcuccuauaacauuuguccuuacugcgccagccggcccaccucugauggacucgcuagacaugucaugcaguguccuaaacgcaaggagaaaaucgaggagaccgcccuguaccugaaucuugaacggauucccugggugguuagaaagcuccuccagguguccgagagcacaggcgucgcccugaaacggucuuccuggcuggugguucugcuugugcugcucaccgucagccuguccccggugcaaagcgcuccuaucgggcacggaaagacgguugaaacauaucagacccgcgagggcuacacaucuauuugccuguuugugcuugggagcauccucuucaucgucuccugucugaugaaaggccugguggacucugugggaaacagcuuuuuccccggccucuccauuugcaagaccuguucuaucgggagcgucaauggauuugaaauugagucccacaagugcuauuguucucuguucugcuguccuuacugcagacauugcagcgccgaucgggagauccaccgccuucaucuguccauuuguaaaaagagaaaaacaggcagcaacguuaugcucgcggugugcaagcggauguguuuuagagcuaccguggaagucucuaauaaagcccugcugauccgcaacaucauuaauacgaccuucgugcuuugcauccugauucucgccguuuguguggucuccacaagcgcuguggagauggaaucucugcccgccgggaccugggagcgggaagaggaccucacaaacuucugccaccaggagugucaaguuaccgaaacggagugccugugucccuaugaagcucuugugcugagaaagccucucuuuuccgauagcaucgucaagggaaugaaaaaucugcugaacuccacaucucuugagaccagccuguccauugaggccccguggggcgcgaucaaugugcagagcacauucaagcccaccguuucugccgcuaacauugcccucuccuggagcucuguggaacaccgcgggaauaaaauccuggucagcggcagauccgagucuaucaugaagcucgaggaacggaccggaauuagcugggaccugggcguggaagaugcuuccgagucuaaacuucugacagugagcgucauggaccucucccagauguacagcccuguuuuugaguaucugucuggggaucgccagguggaagaguggcccaaggccacgugcaccggagacuguccugaaagaugcggcugcacauccagcaccugucugcauaaggaguggccccacucccggaacuggcgcugcaauccuacaugguguuggggaguggggaccggcugcacguguugcggccuugaugucaaagaccuguucacagacuacauguuuaucaaguggaaaguggaauacauuaagaccgaggcgaucguuuguguggagcucaccucucaagaaagacagugcacacugauugaggccgggacccgguucaaccucggaccggucacaaucacgcugagcgaaccccgcaacauccagcagaaacuuccucccgagauugugacccugcauccuagaaucgaagagggcuuuuucgaucugaugcacguucaaaaggugcucuccgcuucuacagucuguaagcugcagagcugcacccauggggugcccggagaccuucaggucuaucacauuggcaaucugcucaaaggggauaaggugaacggacaccugauccauaaaauugagccgcacuuuaauacauccuggaugagcugggacggcugugaucuccauuacuauugcaacaugggcgacuggccuucuugcaccuacacggggguuacccagcacaaucaugccgcuuucgugaacaugcugaauaucgaaacagauuauaccaagaacuuucacuuccacuccaaacgggucacagcccauggagacacaccccaacuugaucugaaggcccgccccaccuacggcgcuggggagaucacggugcugguugaaguggcggacauggagcuccacaccaaaaagauugagaucagcggacugaaguuugccucucuuacauguaccggcugcuaugcuuguuccagcgggauuucuugcaaagucagaauccauguggaugaaccugacgagcugaccgugcacguuaagagcgaagaucccgacauugucgccgccuccucuagccucauggcucggaaacuggaguucggaacagacuccacguucaaggccuuuagcgcgaugccuaaaaccucccucuguuucuacaucguggaaagagaguacugcgagucuuguagcaaggaagauacacagaagugcgugaauaccaaacuggagcagccgcaauccauucuuaucgaacacaagggcacaaucauuggcaaacagucuaacaccuguacggcuaaggccagcugcuggcuggaguccgucaaaucuuucuuuuaugggcugaagaauaugcucagcggaaucuuuggcaacguguucauugggguuuuucuguucuuugcccccuucauccuucugauucucuuuuucauguucggauggcgcauccuguuuuguuucaagugcugccggagaacacgcggccucuuuaaauaccggcaucugaaggacgaugaagagaccggguauagaaaaaucauugagcgccuuaauaacaagaaaggaaagaauaagcugcuggacggcgaacggcucgcugauagaaaaaucgccgagcuguucuccaccaagacacacauuggcuga

SEQ ID NO: 13694 - RNA, 5055 nt, Artificial Sequence
  derived and/or modified CDS sequence (opt5) from CCHFV(UCCR4459)__KY484032.1__GP
auguacacaccccugcucugcgccgugcugugucuucagcuguggagccucgagggcucccacgggcugucuaacaagacccaacauagcaauacguccaccacaaaagcuccugaagucucucaggaguucggacuuccgguuagcaccguguccacaaucaccucugaucccccuagcauuacauccgccgugagcgucucuggcuccgaagggagcggagacaccaacacgucucccuccgugaccacacagggccugacccucccugagacaacccuggaacugcucacgacaaccgacacagaugcgagcucuaccguuguggucgacguguccacccagacaguuaaggauacgcccaucagcaccacacacaccucccugccuucuacaccgagcgcuaccacgacaccccaagggacccaucacaccgccagaggacuucuguccgugacaagcaccaaaccugagggcgccucuacacaggcuaaucccgagaagauuuccauggaaacgaacagcccucggcucgccaucucugagacccccagcuuuuccccgacaacccaggcuccuacagaaaauucuaaccccauuaccagcaaacagcugaucuucuccgcccaaccugucacgcccaaucccgugaccccuccggugcagcccgcgcuuagccagucugacacauccaccgccauccaggauauucauccuagccccacaucucgcuccaagagaaaccuggagauggagaucauucucacccugagccaaggccugaagaaauauuacgggaagauccucaaacugcuugaccugacgcucgaagaggauacagaaggacugcuugaguggugcaagcggaaucugggccucgucugugacgaugacuuuuuccagaaacgcauugaagaguuuuuccugaccggggagggacacuuuaacgaaguucugcaguucaagacaccuuccacccucucucccaccggcccggcuagaacagggagcccuacgguggagcccuuuaaguccuauuucgccaaaggauuucugucuauggauagcggcuacuucuccgcuaagugcuauccucgggccagcaauucuggccuucaacugaucaacgugacccagcacuccacacgcauuaccgacacacccgggccuaaagucaccaaucucaagacgaucaacuguaucaaucugaaagcgagcguguuuaaggaacauagagagauugaaaucaacguucuucugccccagguggccgucaaccucucuuccugccacgugcugauuaaaagccauguuugugacuacucucuggauaucgacggaccggugcggcucccucgcauucaccacgagggcacauucauccccgggaccuauaagcuggucaucgauaagaaaaauaagcagaacgacagaugcacccuuauuacaaauugugugaucaaaggacgggagauucgcaagggccaaagcguccugagacaguaccggaccgaaaucaaaauugggaaggcuuccagcggaucucgcagacuccuguccgaggaaagcggcgaugacugcaucucccggacacagcugucuagaacggagaccgccgaaauccauagcgauaacuacggcgggcccggagacaagauuacaaucuguaauggcuccaccauuguggaucagcgccuugggucugagcucggaugcuauacaaucaaccggguuaagagcuucaagcugugcgaaaauuccgcuaccggcaaaucuugugagauugacagcacgccuaucaagugcagacaaggguuuugucugaaaauuacccaggagggccgcggacacgugaagcucucccggggcagcgaagucgugcuggaugccugcgacucuuccugugagaucaugaucccgaaggggacaggagacauucuuguugauugcagcggcgggcagcagcauuuccugaaagacaaccucaucgaucugggaugucccaauauuccucugcuuggcaagauggccaucuacauuugcagaaugucuaaccaccccaaaaccacaauggcuuuucucuucugguuuuccuucggguaugugaucaccuguauccugugcaaggucaucuuuuaccugcucauuguggugggcacacuggggaaaaaguucaagcaauaucgcgagcuuaaaccucagaccuguacgauuugcgaaacaacccccguuaaugcgaucgacgccgagaugcaugaucugaacugcagcuacaauauuuguccuuauugcgcuucucggcucaccuccgacggccuggccagacacgucaugcagugucccaagcgcaaagaaaagguggaggaaacagagcuguaccuuaaccucgagcggaucccguggguggucagaaaacugcuucaggugagcgaauccaccgggguugcccucaagcgcagcucuuggcuggugguccuucuggugcuccugacgguuagccuguccccugugcaaucugcucccaucggacacggcaaaacagucgagaccuaccagacacgggaaggguauaccagcauuugccuuuuugugcucggauccauccuguucauuguuucuugucugaugaagggccucguggauagcgucggaaauuccuuuuucccuggccugucuaucugcaagacauguagcauuggauccaucaacggcuuugagaucgaaagccauaaaugcuacuguucucuuuucugcugucccuauugcagacacugcuccgccgaccgggagauucauaagcugcaccucagcaucuguaaaaagcgcaaaaccgggucuaacgugaugcuggcggugugcaagagaauguguuuccgggcuacggucgagguuuccaauaaggcccugcuuauuagaaacaucauuaauaccacauuuguggugugcauccugauucucgccgucugugugguuagcaccuccgcuguggaaauggagucucugccggccggaacaugggaacgcgaggaagaucucaccaacuucugccaccaggagugucaagucacggagacagaaugccuguguccuuacgaggcucuugugcugcggaaaccccucuuuagcgacuccaucguuaagggcaugaaaaaucugcugaacagcaccucucuugaaacaucccugagcaucgaggccccuuggggagcgauuaaugugcagucuaccuucaagcccaccgucagcgccgcuaacaucgcccucuccuggucuagcguggagcauagagggaauaaaauucugguuuccggccgcucugaaagcaucaugaagcucgaggaaagaacagggauuuccugggaucugggcguggaggacgcuagcgaaucuaaacuucugacggucuccaucauggaucucagccagauguauucccccguguuugaguaccugucuggagacagacagguggaggaauggccuaaagcgaccugcacaggcgacuguccggagcgcugcgggugcaccagcuccacaugucugcacaaggaauggccccauucuagaaacuggcggugcaauccuaccugguguuggggagucggcacggggugcacauguugcggacuugauguuaaagaccuguucaccgauuauauguuugugaaguggaaaguggaguacaucaagaccgaagccauugucuguguggagcucacaagccaagagcgccagugcucccugaucgaagccggcaccagauucaaccucggccccguuacaauuacgcugagcgagccucggaauauccagcagaaacuucccccugaaauugugacccugcacccgcgcaucgaggaaggguuuuucgaccugaugcaugucaagaaggugcucucugcuuccacaguuuguaaacugcaaagcugcacccacggagugcccggcgaucuucaggucuaccacaucgggaaccugcucaagggagacaaagugaauggccaucugauucacaagaucgagccucauuuuaacacaucuuggauguccugggaugggugugaccucgauuauuacugcaacaugggagacuggcccagcugcucuuauaccggcgucacgcagcacaaucaugccgcuuucgugaacaugcugaauauugagaccgauuacacaaaaaucuuucacuuccacagcaagagaguuaccgcccauggcgacacaccucagcuugaucugaaggcccggcccaccuauggggcuggagaaauuacagugcuggucgagguggcggacauggaacuccacacgaaaaagaucgagauuuccggccugaaauucgccucucuuaccuguacagggugcuacgcuuguagcuccggaaucagcugcaagguucgcauccauguggacgagccggaugaacugaccguccacgugaaauccgaggacccugauauuguggccgccucuagcucccucauggcuagaaagcuggaauuuggcaccgacucuacauucaaggccuuuagcgcgaugcccaaaacgucccucuguuucuauaucguugagcgggaauacugcaagucuuguagcaaagaggauacccaaaagugcgucaacacaaaacuggagcagccccaguccauucuuaucgaacacaaggggaccauuaucggaaagcaaaaugacacauguaccagcaaagcuggcugcuggcuggagucugugaaguccuuuuucuacggccugaaaaacaugcucagcgggaucuuuggaaauguguucauuggcaucuuucuguuccuugccccuuuuauucugcucauccuguucuucauguuuggguggcggauucucuucuguuuuaagugcugccgccggacgagaggacuguucaaauaucgccaucuuaaggaugacgaagagacaggcuaccggaagaucaucgaaagacugaacaauaaaaaggggaaaaacaagcugcucgauggagagcgccuggccgaccggaaaauugcugagcuguuuucuaccaagacccacaucggcuga

SEQ ID NO: 13695 - RNA, 5052 nt, Artificial Sequence
  derived and/or modified CDS sequence (opt5) from CCHFV(Ast149)__KX056054.1__GP
augcacacccuucucgugugcuucauccuguaccuucagcugagcggccucgggggagcccauggccaauccaacgcuacagagcacaaugggacgaacaccacaaccgcccccggaacaucucagagcccuaagccgcccgcguccaccacaccuccccauaccccugaaucuagcacggucaaacugaccacacccaccuccgagacagaaggcucuggggagaccacgccuccgcccaauacaacccagggacuuccucccccuggcacaacccccgaaagaccggcuaccacagccacgagcaccuccagcacagacaacaugaacucuaccacacagguuaccgauaauacgccuacauccaccgugagcaccucucccuccagcucuccuuccaugcccagcacaucccaaggcauucacuaucccgugcggucucugcucagcgucuccagcccuaagaccgugacaacgccgacccccaugucuccuggggagaugucccccgagacaagcucucagcauagcgccaugucccgcaucccuacccuguacacagcugcccagguuucuaccgaaaaugcuaacagaagcacgccccggcaguccgagagcucugcccaaccggcgacccaguccccuacaaccuuucccgcccagacaauucugcucaugagcgcugccccuaaagcuauccaggacaugcaccccucuccuaccaaucgcuccaagagaaaccuggaaguggagauuauccuuacgcugagccaaggacucaaaaaguauuacggcaagauccugaaacuucugcaccucacacuggaggaagauaccgaggggcugcucgaaugguguaagcggaaucugggauccaacugcgacgaugacuucuuucagaaacgcauugaggaguucuuuaucacaggcgagggguauuucaaugagguccuucaguuuaagacccugucuacccucagccccacagaaccgucccaugugagacugccuacggccgagcccuucaaaucuuacuuugcgaagggauuccuuagcauugauuccggcuauuuuagcgccaaguguuacccccggucuuccaccagcggccugcaacucaucaacguuacacagcacccugcucgcauugccgaaaccccggggcccaaaacaaccucucugaagacgaucaauugcauuaaccugagagcuuccguguucaaagagcaucgggaagucgagaucaacgugcuccugccucagaucgccgugaaucuuagcaacugucacgucguuauuuacucucacgugugcgacuauagccuggauacagacggacccgugcgccucccuagaauccaucacgagggcaccuuuauucccgggaccuacaagaucgucauugauaaaaagaauaaacugaacgaccgguguucccuugugacaaauugcguuaucaagggacgcgaagugagaaagggccagagcguccugcggcaauauaaaaccgagaucaagauugggaaagccucuacaggauccagaaagcuccugagcgaagaaccuggcgaugacuguaucucccgcacgcagcugcucaaaaccgaaacagcugagauucaugacgauaacuacggcgggcccggagacaagaucaccauuugcaauggcucuacaaucguggaucagcggcuggggagcgagcuuggauguuauaccaucaacagaguuaaguccuucaaacugugcgaaaauucugcgacgggcaagaccugcgagauugacagcacaccggugaaaugucgccagggguucugccucaagaucacccaagaaggccggggacacgucaaacuguccagaggcucugaggugguccuggaugccugugacagcuccugcgagauuaugaucccuaaggggacaggagauauucuuguggacuguagcggcgggcagcagcauuuucucaaggauaaccugaucgaccugggaugcccccacauuccucuccugggcaaaauggcuaucuacaucugucgcaugucuaaucacccccggaccacaauggccuuccuguuuugguucuccuuuggguauguuauuaccugcaucuucuguaaggcccuguuuuacagccucauuaucauuggcacgcuggggaaaaagaucaaacaguacagagaacugaagccgcaaacaugcaccaucugugagaccgcuccugugaacgccauugaugcggaaaugcaugaccuuaauugcucuuauaacaucugccccuacugugcuucccgccucacaagcgacggccuggcccggcacgucacccagugcccuaagagaaaagagaagguggaagagacggagcuguaucucaaucuggaacgcauucccuggaucguucggaaacuucuucaggugucugaguccacaggggucgcccucaagagaagcuccuggcugauugugcugcuugugcuccugaccguuagccugucucccguccagagcgcuccugugggacauggcaaaacaaucgaaaccuaccaaacacgggagggguucaccaacaucugucucuuuaugcugggauccauucuuuucaucgugucuugccuggucaagggccucguggauagcguuuccgacuccuuuuucccggggcugagcguguguaaaacgugcuccauuggcucuaucaacggauuugaaauugagagccacaaguguuauugcucccuguucuguugccccuacugucgccacugcagcgccgauagagagauccaucagcuucaccucggcaucugcaagaaacggaagaccgggucuaaugucaugcuggcuguguguaaaagaaugugcuucaaggccacaauugaagcgucccgccgggcccugccuaucagaagcauuaucaacaccacauuuguuauuuguauccucacccuggcuauuugcguggucucuacguccgccguggagauggaaaaucuucccgcuggaacaugggagcgcgaagaggaccugaccaacuucugucaucaggagugccaaguuacagaaaccgagugucucugcccuuaugaagcccuggugcugagaaaaccccuuuuucuggauagcaucgucaagggcaugaagaaucuccugaacuccaccucucucgagacaagccuguccaucgaggcgccuuggggagccauuaaugugcagagcacguucaaaccgaccgugucuacagcuaacaucgcccuuuccuggagcucugucgaacaccggggaaauaagauucugguuaccggccgcagcgaguccaucaugaaacucgaagagagaacaggggugucuugggaccugggcguggaagaugcuagcgaguccaagcugcuuaccgucucuauuauggaccugagccagauguacucccccguguuugaguaccucagcggagaucggcagguugaagaguggccuaaagccacguguacaggcgacugccccgaacgcugugggugcaccucuucuaccugccugcauaaggaguggccucacagcagaaacuggcgguguaaucccacauggugcuggggagugggcaccggguguacaugcuguggagucgaugugaaggaccucuucacggaucacauguuuaucaaauggaagguugaauauaucaaaaccgaggccauugugugcgucgagcugacaucccaagaacgccaguguucucuuaucgaggcuggcaccagauucaaccugggcccggugacaauuacccucagcgaaccucggaauauccagcagaagcugccucccgagauuaucacgcugcaucccaaaaucgaagagggguuuuucgaccuuaugcacguucaaaaggugcuguccgcgucuaccgucugcaagcuccagagcuguacacauggcauucccggagaccugcagaucuaccacauugggaaccuccugaaaggagaucgccuuaauggccaucugauccacaagauugagccucacuuuaacaccuccuggaugagcugggacgggugcgaucuggacuauuacuguaacaugggagauuggccgucuugcacauauaccggcgugacacagcauaaucacgccgcuuucgugaaccuccugaauaucgaaacggacuacaccaaaacauuucauuuccacuccaagagagucaccgcccacggcgauacaccccaacuugaccugaaagcccggccuaccuauggggcuggagagauuacgguucucguggaaguggccgauauggagcugcauaccaagaaagucgaggugagcggccucaaguucgcgucucuggcuugcacaggguguuacgccugcuccagcggaaucucuuguaagguuagaauccacguggacgaacccgaugagcuuaccguccaugugaaaagcuccgacccugauguuguggccgcuucuacaagccugauggcccgcaagcuggaauuuggcaccgacuccacguucaaagcguuuagcgcuaugcccaagacaucccucugcuucuacauugucgagcgggaauauuguaaaucuugcagcgaggacgauaccaagaaguguguggacaccaaacuggagcagccgcaguccauccuuauugaacacaaggggacaaucauuggaaaacaaaacgauaccugcacagccaaggccucuuguuggcuggagagcgucaaauccuuuuucuacggccucaagaauaugcugggcucuguguuugggaacuucuuuguuggaauccuccuguuccuugcuccuuuugugcugcuggcccucuucuucaucuuuggcuggaagauucuguucugcuuuaaauguugcagacgcacccgggggcuuuucaaguauagacaucugaaagacgaugaagagacgggauaccgcaagaucauugaacggcucaauagcaaaaagggcaagaacagacugcucgacggggagcgccuggcugaucggaaaaucgccgagcuguuuuccacaaagacccacauuggauga

SEQ ID NO: 13696 - RNA, 5052 nt, Artificial Sequence
  derived and/or modified CDS sequence (opt5) from CCHFV(Ast137)__KX056057.1__GP
augcacacccugcucgugugcuucauccuguaccuucagcugagcggccucgggggagcccauggccaauccaacgcuacagagcacaaugggacgaacaccacaaccguccccggaacaucucagagcccuaagccgcccgccuccaccacacugccucauacccccgaaucuagcacgguuaaacuuaccacaccuaccuccgagacagaaggcucuggggagaccacgcccccuccgaauacaacccagggacugcccccucccggcacaaccccugaaagacccgcgaccacagcuacgagcaccuccagcacagacaacaugaacucuaccacacaggugaccgauaauacgccgacauccaccgugagcauuucuccuuccagcucucccuccaugccuagcaccucccaaggcauccacuaucccguccggucucuccugagcguguccagccccaagacaguuaccacaccuacgccgaugucucccggggagauguccccugagaccagcucucagcauagcgccaugucccgcauucccacacuguacaccgccgcucaggugucuacagaaaauaccaacagaagcacgccucggcaguccgagagcucugcccaacccgcuacccaguccccgacaaccuuuccugcccagacaauccuccugaugagcgcggcccccaaagcuauucaggacaugcacccuucucccaccaaucgcuccaagagaaaccuugaagucgagaucauccugacgcucagccaaggacugaaaaaguauuacggcaagauucuuaaacugcuccaccugacacuggaggaagauaccgaggggcuccuggaaugguguaagcggaaucuuggauccaacugcgacgaugacuucuuucagaaacgcaucgaggaguucuuuauuacaggcgaaggguauuucaaugaggugcugcaguuuaagacccucucuacccugagcccuacagaacccucccauguuagacuuccgacggccgagccuuucaaaucuuacuuugcuaagggauuccugagcaucgauuccggcuauuuuagcgccaaguguuacccccggucuuccaccagcggccuccaacugauuaacgugacacagcaccccgcgcgcaucgccgaaaccccugggccgaaaacaaccucucugaagacgauuaauugcaucaaccucagagcuuccgucuucaaagagcaucgggaaguggagaucaacgugcugcuuccccagauugccgucaaucugagcaacugucacguugugaucaauucucacgugugcgacuacagccucgauacagacggaccuguccgccugcccagaauccaucacgagggcaccuuuaucccugggaccuauaagauugugaucgauaaaaagaacaaacuuaaugaccgguguucccugguuacaaacugcgugaucaagggacgcgaagucagaaagggccagagcgugcuccggcaauacaaaaccgagauuaagaucgggaaggcuucuacaggauccagaaagcugcugagcgaggaacccggcgaugacuguauuucccgcacgcagcuccugaaaaccgaaacagccgagauccaugacgauaauuauggcgggccuggagacaagauuaccaucugcaacggcucuacaaucguugaucagcggcuugggagcgagcugggauguuacaccauuaauagagugaaguccuucaaacucugcgaaaacucugccacgggcaagaccugcgagaucgacagcacacccgucaaaugucgccagggguucugccugaagauuacccaagaaggccggggacacgugaaacuguccagaggcucugaggucgugcuugaugcuugugacagcuccugcgagaucaugauuccgaaggggacaggagauauccucguugacuguagcggcgggcagcagcauuuucugaaggauaaucugauugaccucggaugcccucacaucccccugcuuggcaaaauggcgauccacauuugucgcaugucuaaccauccucggaccacaauggccuuccuguuuugguucuccuuuggguaugugauuaccugcauuuucuguaaggcucucuuuuacagccugaucauuaucggcacgcuggggaaaaagaucaaacaguauagagaacuuaagccccaaacaugcaccauuugugagaccgccccggucaaugccaucgaugcugaaaugcacgaccucaacugcucuuacaauauuugcccuuacugugccucccgccugacaagcgacggccuggcgcggcaugugacccagugccccaagagaaaagagaagguugaagagacggagcucuaucugaaccuugaacgcaucccuuggauugugcggaaacugcuccaggucucugaguccacagggguggcucugaagagaagcuccuggcugaucgugcuucucguucugcugaccgucagccucucucccgugcagagcgcccccgugggacacggcaaaacaaucgaaaccuaccaaacacgggagggguucaccaacauuugucuguuuaugcuuggauccauccuguucauugucucuuaucucgugaagggccugguugauagcguguccgacagcuuuuucccugggcugucugucugcaaaacguguuccaucggcucuauuaauggauuugaaaucgagagccacaagugcuacuguucccuuuucugcuguccguauugccgccauuguagcgccgauagagagauccaccagcuccaucugggcauuugcaagaaacggaagaccgggucuaacgugaugcuggcuguuugcaaaagaauguguuucaaggccacaaucgaggcuucccgccgggcccuccugauuagaagcaucauuaauaccacauuugugaucugcauucuuacccuggcgaucugugucgugucuacguccgccguugaaauggaaaaccuccccgcuggaacaugggagcgcgaagaggaccugaccaauuucugccaccaggagugucaagugacagaaaccgagugccuguguccuuacgaagcccuuguccugagaaaaccccucuuucuggauagcaucgugaagggcaccaagaaccuccuuaauuccacaucucuggagacgagccuguccauugaggcuccuuggggagccaucaacgugcagagcaccuucaaacccacagucucuaccgcgaauauugcccucuccuggagcucuguugaacaucggggaaacaagauccuggugacaggccgcagcgaguccauuaugaaacuggaagagagaaccggggugucuugggaccuuggcgucgaagaugcuagcgaguccaagcugcucacggugucuaucauggaccugagccagauguauuccccuguuuuugaguaccucagcggagauagacagguggaagaguggccgaaagccacaugcaccggcgacugucccgaacgcugcggguguaccucuuccacaugccugcacaaggaguggccucacagcagaaauuggcggugcaaccccaccugguguuggggagucggcacagggugcacguguugcggaguggauguuaaggaccuuuucaccgaucauauguuuaucaaauggaagguggaauacauuaaaacagaggcuaucgucuguguggagcugaccucccaagaacgccagugcucucucauugaggccggcacaagauucaaucugggcccuguuaccaucacgcugagcgaaccccggaacauucagcagaaacuuccgccugagaucaucacccugcaccccaaaauugaagagggguuuuucgaccucaugcaugugcaaaagguccuguccgccucuacaguguguaagcuccagagcugcacccacggaauccccggcgaccugcagauuuaucauaucgggaaucuucugaaaggagaucgccugaacggccaccucauucacaagaucgagccucauuuuaacacauccuggaugagcugggacgggugugaucuggacuacuauugcaauaugggagauuggcccucuuguaccuacacaggcgugacgcagcacaaccaugcugcguucgucaaucuucugaacauugaaaccgacuauacaaaaaccuuucacuuccacuccaagagaguuaccgcccauggcgauacaccucaacucgaccugaaagcucggccgacguacggggccggagagaucaccgugcucguggaagucgccgauauggagcugcacacaaagaaaguggagguuagcggccuuaaguucgcuucucuggccugcaccgggugcuaugcguguuccagcggaaucucuugcaaggugcggauucaugucgacgaacccgaugagcugacagugcacguuaaaagcuccgacccugauguggucgcugccucuaccagccucauggcccgcaagcuggaauuuggcacggacuccacauucaaggcuuuuagcgccaugcccaaaaccucccuuuguuucuacaucguggagcgggaauacugcaaaucuuguagcgaggacgauaccaagaagugcgucgacacaaaacuggagcagccucaguccauucucaucgaacauaaggggaccauuaucggaaaacaaaaugauacauguaccgcgaaggcuucuugcuggcuggagagcgugaaauccuuuuucuauggccucaagaacaugcugggcucuguuuuugggaauuucuuugugggaauccuucuguuccuggcccccuuuguccuccuggugcuuuucuucauuuuuggcuggaagauccuguucuguuuuaaaugcuguagacgcacgcggggacucuucaaguacagacaccugaaagacgaugaagagacaggguaucgcaagauuaucgaacggcucaacagcaaaaagggcaagaauagacugcuugacggggagcgccuggccgaucggaaaauugcugagcuguuuuccaccaagacacacaucggauga

SEQ ID NO: 13697 - RNA, 5055 nt, Artificial Sequence
  derived and/or modified CDS sequence (opt5) from CCHFV(C-68031)__DQ211629.1__GP
auguacaccccgcugcucugcgccgugcugugucuucagcuguggagccucgagggcucccacgggcugucuaacaagacacaacauagcaauacguccaccacaaaagcuccugaagucucucaggaguucggacuuccgguuagcaccguguccacaaucaccucugaucccccuagcauuacauccgccgugagcgucucuggcuccgaagggagcggagacaccaacacgucucccuccgugaccacacagggccugacccucccugagacaacccuggaacugcucacgacaaccgacacagaugcgagcucuaccguuguggucgacguguccacccagacaguuaaggauacgcccaucagcaccacacacaccucccugccuucuacaccgagcgcucccaccacgccucaagggacacaucacaccgccagaggacuucuguccgugaccagcacaaaacccgagggcgccucuacccaggcuaauccugagaagauuuccauggaaacaaacagcccccggcucgccaucucugagacgccgagcuuuuccccuaccacacaggcucccaccgaaaauucuaacccuauuacaagcaaacagcugauccuuuccgcccaacccgucacccccaauccugugacgccgcccgugcagccugcgcugagccagucugacaccuccacagccauccaggauauucaucccagcccuaccucucgcuccaagagaaaccucgagauggagaucauucugacacugagccaaggccucaagaaauauuacgggaagauccugaaacuucuggaccucacccuggaagaggauacggaaggacuucuggaguggugcaagcggaaucucggccuggucugugacgaugacuucuuucagaaacgcauugaagaguucuuucugacaggggagggacacuucaacgaaguucuccaguuuaagacccccuccacacugucuccgaccggcccugcuagaaccgggagccccacaguggagccuuucaaguccuauuuugccaaaggauuccuuucuauggauagcggcuacuuuuccgcuaagugcuauccccgggccagcaauucuggccugcaacucaucaacgugacgcagcacuccacccgcauuacagacaccccugggcccaaagucacaaaucugaagaccaucaacuguaucaaucuuaaagcgagcguguucaaggaacauagagagauugaaaucaacguucugcucccccagguggccgucaaccugucuuccugccacgugcugauuaaaagccauguuugugacuacucucucgauaucgacggaccugugcggcugccccgcauucaccacgagggcacguuuauccccgggacauauaaacuugucaucgauaagaaaaauaagcagaacgacagaugcacccugauuaccaauugugugaucaaaggacgggagauucgcaagggccaaagcguccucagacaguaccggacagaaaucaaaauugggaaggcuuccagcggaucucgcagacugcuguccgaggaaagcggcgaugacugcaucucccggacccagcuuucuagaacagagacggccgaaauccauagcgauaacuacggcgggccuggagacaagauuaccaucuguaauggcuccacaauuguggaucagcgccucgggucugagcugggaugcuauaccaucaaccggguuaagagcuucaagcugugcgaaaauuccgcuacaggcaaaucuugugaaauugacagcaccccgaucaagugcagacaaggguucugucucaaaauuacgcaggagggccgcggacacgugaagcugucccggggcagcgaagucgugcuugaugccugcgacucuuccugugagaucaugauccccaaggggaccggagacauucugguugauugcagcggcgggcagcagcauuuucucaaagacaaccugaucgaucugggauguccuaauauuccccuucucggcaagauggccaucuacauuugcagaaugucuaaccacccuaaaacaaccauggcuuuccuguuuugguucuccuuuggguaugugaucacauguauccugugcaaggucauuuucuaccuccugaucguggugggcacccuugggaaaaaguuuaagcaauaucgcgagcugaaaccccagacauguaccauuugcgaaacgacaccuguuaaugcgaucgacgccgagaugcaugaucucaacugcagcuacaauauuugucccuauugcgcuucucggcugaccuccgacggccuggccagacacgucaugcaguguccgaagcgcaaagaaaagguggaggaaaccgagcuuuaccucaaccuggagcggaucccuuggguggucagaaaacugcuccaggugagcgaauccacagggguugcccugaagcgcagcucuuggcuugugguccugcucgugcugcugaccguuagccuuucccccgugcaaucugcuccuaucggacacggcaaaacggucgagacauaccagacccgggaaggguauacaagcauuugccucuucgugcugggauccauccuguuuauuguuucuugucucaugaagggccugguggauagcgucggaaauuccuucuuucccggccuuucuaucugcaagaccuguagcauuggauccaucaacggcuucgagacagaaagccauaaaugcuacuguucucuguuuugcuguccguauugcagacacugcuccgccgaccgggagauccauaagcuccaccugagcauuuguaaaaagcgcaaaaccgggucuaacgugaugcuggcggugugcaagagaauguguuuccgggcuacggucgagguuuccaauaaggcccuucugaucagaaacauuaucaauaccacauucguggugugcauucucauccuggccgucugugugguuagcaccuccgcuguggaaauggagucucucccugccggaacaugggaacgcgaggaagaucugaccaacuuuugccaccaggagugucaagucacggagacagaaugccuuugucccuacgaggcucuggugcuccggaaaccucuguucagcgacuccauuguuaagggcaugaaaaaucugcuuaacagcaccucucuggaaacaucccucagcaucgaggcccccuggggagcgaucaaugugcagucuaccuuuaagcccaccgucagcgccgcuaacauugcccuguccuggucuagcguggagcauagagggaauaaaauccucguuuccggccgcucugaaagcauuaugaagcuggaggaaagaacagggaucuccugggaucuuggcguggaggacgcuagcgaaucuaagcugcucacggucuccauuauggaucugagccagauguauuccccuguguucgaguaccugucuggagaccgccagguggaggaauggccgaaagcgaccugcacaggcgacugucccgagcggugcgggugcaccagcuccacaugucuucacaaggaauggccucauucuagaaacuggcggugcaaucccaccugguguuggggagucggcacggggugcacauguugcggacuggauguuaaagaccucuuuaccgauuauauguucgugaaguggaaaguggaguacaucaagaccgaagccaucgucuguguggagcugacaagccaagagcgccagugcucccucauugaagccggcaccagauuuaaccugggcccuguuacaaucacgcuuagcgagccccggaauauucagcagaagcugccuccggaaaucgugacccugcacccccgcauugaggaaggguucuuugaccucaugcaugucaaaaaggugcugucugcuuccacaguuuguaaacuucaaagcugcacccacggagugccuggcgaucugcaggucuaccacaucgggaaccuccugaagggagacaaagugaauggccaucucauccacaagauugagccccauuucaacacaucuuggauguccugggaugggugugaccuggauuauuacugcaacaugggagacuggccuagcugcucuuauaccggcgucacgcagcacaaucaugccgcuuuugugaacaugcuuaauaucgagaccgauuacacaaaaauuuuccacuuucacagcaagagaguuaccgcccauggcgacacaccccagcuggaucugaaggcccggccgaccuauggggcuggagaaaucacagugcucgucgagguggcggacauggaacugcacacgaaaaagauugagaucuccggccuuaaauucgccucucugaccuguacagggugcuacgcuuguagcuccggaauuagcugcaagguucgcauccauguggacgagccugaugaacucaccguccacgugaaauccgaggaccccgauaucguggccgccucuagcucccugauggcuagaaagcucgaguucggcaccgacucuacauuuaaggccuucagcgcgaugcccaaaacgucccuguguuuuuauauuguugagcgggaauacugcaagucuuguagcaaagaggauacccaaaagugcgucaacacaaaacuugagcagccucaguccauccugauugaacacaaggggaccaucauuggaaagcaaaaugacacauguaccagcaaagcuggcugcuggcuggagucugugaaguccuucuuuuacggccucaaaaacaugcugagcgggaucuucggaaauguguuuaucggcauuuuccuuuuucuggcccccuucauccuccugauucucuuuuucauguucggguggagaauccuguuuuguuucaagugcugccgccggacgagaggacuuuuuaaauaucgccaucugaaggaugacgaagagacaggcuaccggaagauuaucgaaagacugaacaauaaaaaggggaaaaacaagcuccuggauggagagcgccuugccgaccggaaaaucgcugagcuguucucuaccaagacccacauuggcuga

SEQ ID NO: 13698 - RNA, 5052 nt, Artificial Sequence
  derived and/or modified CDS sequence (opt5) from CCHFV(K340_6)__KX013475.1__GP
augcacacccugcucgugugcuucauccuguaccuucagcugagcggccucgggggagcccauguccaauccaacgcuacagagcacaauggcacgaacaccacaaccgcccccgggacaucucagagcccuaagccgcccgcguccaccacacugccucauacccccgaaucuagcacgguuaaaccuaccacacccaccuccgagacagaaggaucuggcgagaccacgccuccgcccaauacaacccaggggcuuccucccacaggaaccaccccugaaagaagcgcuacaacggccaccuccacaagcucuaccgacaacaugaacuccacaacccaggugacggauagcacacccaccucuaccguguccacaagcccgucuuccagcuccucuaugccuagcaccucccaaggcauucaccaucccguccggagccugcucucuguguccagcccuaagacaguuacgacccccacacccaugucuccuggcgagaugagcccggagaccuccucucagcacagcgccaugucccgcgugcccacacuguauaccgcuacgcaggucagcaccgaaaauacagacagaucuaccccucggcaguccgagagcucugugcaacccgccacacaguccccuaucaccagccccgcucagacgauucugcucauguccgccgcgccgaaagccauccaggauaugcacccuucucccacaaaucgcagcaagagaaaccuggaaguugagauuauccuuacccugucccaagggcucaaaaaguacuauggaaagauccugaaacuucugcaucucacacuggaggaagacaccgagggccugcucgaaugguguaagcggaaucuggggucuaacugcgaugacgauuucuuccagaaacgcauugaggaauuuuucaucaccggagagggcuacuuuaaugaggugcuucaguucaagacacugagcacgcucuccccuaccgaacccagccacgucagacugccuacagcugagcccuuuaaaucuuauuucgccaagggguuucuuuccauugacagcggauacuucucugcuaaguguuauccgcgguccagcaccucuggccugcaacucaucaacgugacacagcauccugcccgcauugcggaaacccccggccccaaaacgacaagccugaagaccaucaauugcauuaaccugagagccuccguguuuaaagagcaccgggaagucgagaucaauguucuccugccucagaucgcugugaaccuuagcaacugucacguggucauuaauucucaugugugcgauuacucccuggacaccgaugggccgguucgccuccccagaauccaccaugagggaacauucauuccuggcaccuacaagaucgugauugaccggaaaaacaagcugaaugaucgcuguagccuugucacaaacugcgugaucaaagggagagaaguucggaagggacaguccgugcugagacaauauaagacggagaucaaaauuggcaaggccucuaccgggagccgcaaacuccuguccgaggagcccggagacgacuguaucucucggacacagcugcucaagaccgaaacagcugagauucacgaugacaauuacggcggcccuggggauaaaaucaccauuugcaacggaagcacgaucgucgaccagagacugggcuccgagcuuggguguuauaccaucaaucgcgugaagucuuuuaagcugugcgaaaacagcacaaccggaaaaacaugcgagauugauuccacccccgucaagugucggcagggcuucugccucaaaaucacacaagaagggagaggccaugugaagcugagccgcggaucugagguugugcuggacgccugugauuccagcugcgagauuaugaucccuaaaggcaccggggacauucuugucgauuguucuggaggccagcagcacuuccucaaggacaaucugaucgaucuggggugcccccacauuccgccucucggaaagauggccaucuacaucugucggauguccaaccaucccagaacgacaauggcuuuucuguucugguuuagcuucggcuaugugauuaccugcaucuuuuguaaagcgcuuuucuacucucugauuaucauugggacccucggcaagaaaaucaagcaguaucgcgaacugaaaccucaaacaugcaccaucugugagacggcccccguuaaugcuauugacgccgaaaugcacgaccugaacugcuccuacaauaucugcccguacugugccagccggcuuacauccgauggacucgcuagacaugugacccagugcccuaagcgcaaggagaaagucgaagagacagagcuguaucugaaccucgaacggauucccuggaucgugagaaagcugcuucaggugagcgagucuaccggcguugcccugaaacggagcuccuggcucauuguccugcuggugcuucucacagugucucugagcccuguccaguccgcgcccguggggcacggaaagaccaucgaaacguaccaaacccgcgagggcuuuacaucuaucugucuguucaugcucgggagcauucuguuuaucguuuccugccuugugaaaggacuggucgacucugugagcgauuccuucuuucccggccucagcguuuguaagaccugcucuauuggguccaucaauggcuucgaaauugagagccacaaauguuauugcucucuguuuuguugcccuuacuguagacauugcuccgcugaccgggagauccaccagcugcaucuuagcaucugcaagaagagaaaaacaggauccaacgugaugcucgccgucuguaagcgcaugugcuucaaagccaccauugaggcuucucggagagcccugcugauccgcagcauuaucaacacgacauucgugauguguauucucacccuggcuaucugcguuguguccacaagcgccgucgaaauggaagaucuuccggcgggcaccugggagagagaagaggaccugaccaauuuuugucaccaggagugccaagugacagaaacggagugucucugccccuaugaagcccuggugcugcggaagccucuuucucuggauuccauugucaaagggaugaagaaccuccugaauagcaccucucucgagacaagccuguccaucgaggcucccuggggagccaucaacguucagucuaccuucaagccuacagugagcaccgcuaauauugcccuuuccuggucuagcguggaacaucgcggcaacaaaauccuggucacggggagauccgagagcauuaugaagcucgaggaacggacaggagugucuugggaccugggcguugaagaugcguccgagagcaaacugcuuaccguguccaucauggaccugucucagauguacagccccgucuuugaguaucucuccggggaucgccagguggaagaguggccuaaggccaccuguacaggcgacugcccggaaagauguggaugcaccucuagcacaugccugcacaaagaguggccccacucccggaauuggcgcuguaacccuacguggugcuggggcguugggaccggauguacaugcuguggcguggaugucaaggaccucuucaccgaccauauguuuauuaaguggaaaguggaauacaucaagacagaggcuaucguuugcguggagcugaccagccaagaaagacaguguucucuuauugaggccgggacgcgguucaaucugggacccgucaccaucacacucuccgaaccucgcaacauucagcagaaacugcccccggagaucauuacccugcacccuaagaucgaagagggcuuuuucgaucuuaugcaugugcaaaaagugcugagcgcuucuacagucugcaagcuccaguccuguacccacggcauccccggggaccugcagauuuaccauaucggaaaucuccugaagggcgauagaguuaacgggcaccuuauucacaaaaucgagccccauuuuaauacaagcuggaugucuugggacggaugcgaucuggacuauuacuguaacaugggcgauuggccuagcugcacguauaccggggugacacagcacaaucaugccgccuucgugaaccugcucaacauugaaaccgacuacaccaagacauuucacuuccacuccaaacgggucacggcucauggagauacaccccaacuggaccuuaaggcgagaccuaccuauggcgccggcgagaucaccgugcugguugaagugacagauauggagcuccacaccaaaaaggucgagauuucugggcugaaauuugcuagccucacgugcacaggauguuacgccugcuccagcggcaucuccuguaaggugcgcauccauguugacgaaccggaugagcugaccgugcacgucaagucuagcgaccccgacguggucgccgcuuccaccucucuuauggcccggaaacuggaauuugggacagauagcaccuucaaggcguuuuccgcuaugccuaaaacaucucugugcuucuauauuguggagagagaauacuguaagagcugcuccgaggacgauaccaaaaaguguguugacacgaagcucgagcagccccagagcauccugauugaacauaaaggaacaaucauuggcaagcaaaaugauaccugcacagccaaagccucuuguuggcuugaguccgucaagagcuuuuucuacgggcugaaaaacaugcucggaucuguguuuggcuccuucuuugugggcauccuccuguuccuggcuccuuuuguucuucuggugcuguucuuuauguucggguggaagauccucuucugcuuuaaguguugccgccggaccagaggacuguucaaauaucgccacuuuaaggacgaugaagagacgggcuaccggagaauuaucgaacgccuuaauagcaaaaaggggaaaaaccggcugcucgacggagagagacuggccgaucggaagauugcggaacucuucucuaccaagacacacaucggcuga

SEQ ID NO: 13699 - RNA, 5055 nt, Artificial Sequence
  derived and/or modified CDS sequence (opt5) from CCHFV(Hy13)__AY900145.1__GP
auguacacaccccugcucugcgccgugcugugucuucagcuguggagccucgagggcucccacgggcugucuaacaagacccaacauagcaauacguccaccacaaaagcuccugaagucucucaggaguucggacuuccgguuagcaccguguccacaaucaccucugaucccccuagcauuacauccgccgugagcgucucuggcuccgaagggagcggagauaccaacacgucucccuccgugaccacacagggccugacccucccugagacaacccuggaacugcucacgacaaccgacacagaugcgagcucuaccguuguggucgacguguccacccagacaguuaaggauacgcccaucagcaccacacacaccucccugccuucuacaccgagcgcuaccacgacaccccaagggacccaucacaccgccagaggacuucuguccgugacaagcaccaaaccugagggcgccucuacacaggcuaaucccgagaagauuuccauggaaacgaacagcccucggcucgccaucucugagacccccagcuuuuccccgacaacccaggcuccuacagaaaauucuaaccccauuaccagcaaacagcugaucuucuccgcccaaccugucacgcccaaucccgugaccccuccggugcagcccgcgcuuagccagucugacacauccaccgccauccaggauauucauccuagccccacaucucgcuccaagagaaaccuggagauggagaucauucucacccugagccaaggccugaagaaauauuacgggaagauccucaaacugcuugaccugacgcucgaagaggauacagaaggacugcuugaguggugcaagcggaaucugggccucgucugugacgcugacuuuuuccagaaacgcauugaagaguuuuuccugaccggggagggacacuuuaacgaaguucugcaguucaagacaccuuccacccucucucccaccggcccggccagaacagggagcccuacgguggagcccuuuaaguccuauuucgcuaaaggauuucugucuauggacagcggcuacuucuccgccaagugcuauccucgggcgagcaauucuggccuucaacugaucaacgugacccagcacuccacacgcauuaccgauacacccgggccuaaagucaccaaucucaagacgaucaacuguaucaaucugaaagccagcguguuuaaggaacauagagagauugaaaucaacguucuucugccccagguggcugucaaccucucuuccugccacgugcugauuaaaagccauguuugugacuacucucuggacaucgauggaccggugcggcucccucgcauucaccacgagggcacauucauccccgggaccuauaagcuggucaucgacaagaaaaauaagcagaacgauagaugcacccuuauuacaaauugugugaucaaaggacgggagauucgcaagggccaaagcguccugagacaguaccggaccgaaaucaaaauugggaaggccuccagcggaucucgcagacuccuguccgaggaaagcggcgacgauugcaucucccggacacagcugucuagaacggagaccgcugaaauccauagcgacaacuacggcgggcccggagauaagauuacaaucuguaauggcuccaccauuguggaccagcgccuugggucugagcucggaugcuauacaaucaaccggguuaagagcuucaagcugugcgaaaauuccgccaccggcaaaucuugugagauugauagcacgccuaucaagugcagacaaggguuuugucugaaaauuacccaggagggccgcggacacgugaagcucucccggggcagcgaagucgugcuggacgccugcgauucuuccugugagaucaugaucccgaaggggacaggagacauucuuguugacugcagcggcgggcagcagcauuuccugaaagauaaccucaucgaccugggaugucccaauauuccucugcuuggcaagauggcuaucuacauuugcagaaugucuaaccaccccaaaaccacaauggcguuucucuucugguuuuccuucggguaugugaucaccuguauccugugcaaggucaucuuuuaccugcucauuguggugggcacacuggggaaaaaguucaagcaauaucgcgagcuuaaaccucagaccuguacgauuugcgaaacaacccccguuaaugccaucgaugcugagaugcaugaccugaacugcagcuacaauauuuguccuuauugcgccucucggcucaccuccgauggccuggccagacacgucaugcagugucccaagcgcaaagaaaagguggaggaaacagagcuguaccuuaaccucgagcggaucccguggguggucagaaaacugcuccaggugagcgaauccaccgggguugcucugaagcgcagcucuuggcuggugguccuucuggugcuccugacgguuagccuguccccugugcaaucugcccccaucggacacggcaaaacagucgagaccuaccagacacgggaaggguauaccagcauuugccuuuuugugcucggauccauccuguucauuguuucuugucugaugaagggccucguggacagcgucggaaauuccuuuuucccuggcucuagcaucugcaagacauguuccauuggaagcaucaacggcuuugagaucgaaucucauaaaugcuacuguucccuguucugcugucccuauugcagacacugcagcgcggaucgggagauucauaaacuucaccugucuaucuguaaaaagcgcaaaaccggguccaacgugaugcucgcugugugcaagagaauguguuuccgggccacggucgagguuagcaauaaggcccugcugauuagaaacaucauuaauaccacauuuguggugugcauccuuauucuggcugucugugugguuuccaccucugccguggaaauggagagccucccggcuggaacaugggaacgcgaggaagaccugaccaacuucugccaccaggagugucaagccacggagacagaaugccucuguccuuacgaggcgcugguccuucggaaaccccuguuuuccgauagcaucgugaagggcaugaaaaaucuccugaacucuaccucccuggaaacaagccuuucuaucgaggccccuuggggagcuauuaauguucagagcaccuucaagcccaccguguccgccgcuaacaucgcccugucuuggagcuccgucgagcauagagggaauaaaauucucgugucuggccgcagcgaauccaucaugaagcuggaggaaagaacagggauuagcugggaccucggcguugaggaugcgucugaauccaagcugcuuacggugagcaucauggaccugucccagauguauucucccgucuuugaguaccucagcggagauagacagguggaggaauggccuaaagcuaccugcacaggcgacuguccggagcgcugcgggugcaccuccucuacaugucugcacaaggaauggccccauagcagaaacuggcggugcaauccuaccugguguuggggagugggcacggggugcacauguugcggacuggacgucaaagaucuuuucaccgaccacauguuuguuaaguggaaaguggaguauaucaagaccgaagccauugugugugucgagcugacaucccaagagcgccagugcagccucaucgaagccggcaccagauucaaccugggccccgugacaauuacgcucucugagccucggaauauccagcagaagcugcccccugaaauuguuacccuucauccgcgcaucgaggaaggguuuuucgaucugaugcacgugaaaaagguccuguccgcuagcacaguguguaaacuccaaucuugcacccacggaguucccggcgaccuucagguguaccauaucgggaaccugcugaagggagauaaagucaauggccaccucauucauaagaucgagccucacuuuaacacauccuggaugagcugggacgggugugaucuggacuacuauugcaacaugggagauuggcccucuugcagcuacaccggcgugacgcagcauaaucacgccgccuucgucaacaugcucaauauugagaccgacuauacaaaaaucuuucacuuccauuccaagagagugaccgcucacggcgauacaccucagcuggaccuuaaggcgcggcccaccuacggggccggagaaauuacaguucugguggaggucgcugauauggaacugcauacgaaaaagaucgagauuucuggccucaaauucgccagccugaccuguacagggugcuaugccuguuccagcggaaucuccugcaaggugcgcauccacguugacgagccggacgaacuuaccgugcacgucaaaucugaggauccugacauuguggcugccagcuccucucugauggcgagaaagcucgaauuuggcaccgauagcacauucaaggcuuuuuccgccaugcccaaaacgucucuguguuucuacaucguggagcgggaauauugcaagagcuguuccaaagaggacacccaaaagugcguuaacacaaaacucgagcagccccagagcauucugaucgaacauaaggggaccauuaucggaaagcaaaaugauacauguaccucuaaagccggcugcuggcuugaguccgucaagagcuuuuucuacggccugaaaaacaugcugucugggaucuuuggaaauguguucauuggcaucuuucucuuccuggcuccuuuuauucuucugauccucuucuucauguuuggguggcggauucuguucuguuuuaagugcugccgccggacgagaggacucuucaaauaccgccaccugaaggacgaugaagagacaggcuaucggaagaucaucgaaagacuuaacaauaaaaaggggaaaaacaagcugcuggacggagagcgccucgccgaucggaaaauugcggagcuguuuuccaccaagacccauaucggcuga

SEQ ID NO: 13700 - RNA, 5052 nt, Artificial Sequence
  derived and/or modified CDS sequence (opt5) from CCHFV(4574-ST-2008)__KR814870.1__GP
augcacacccugcucgugugcuucauccuguaccuucagcugcucggccccgggggagcccauggccaaccuaacgcuacagagcacaauagaacgaacaccacaaccgccccgagcacaucccagucucccaagccucccgucagcaccgcgccuccccaugcucuggaauccccuacaauuaaaucuaccacgccgaccagcgagacagaaggguccggagagaccacaucucccccuaauaccacgcagggccccagccuuccugaaacaacccccaagcggccggccacaaccgccaccuccacaccuagcacggacaacaccaauucuacaacccacguuacagauaacaaucccaccuccacgaucagcacaucuccuuccagcucucccuccacccccagcaccccucgcgggauucaucacccggcuagaaaccugcucuccgugucuagccccaaaacagccaccacaccuacgcccaccuccccuggagagaucagcucugagacauccagccugcacucugcuaugagccggaccuccacacuguauaccgccacgcaggcgucuaccgaaaaugccaaccauagcgcuccccgccaauccgagagcccggcccagccuacaaccacaucucucaugaccucccccgcucagagcauucuggugaugucugccgcgccuacggccauccagaauauccaccccuccccuacaaacagaagcaagcggaaucuugaaauggagauuauccugacccucucccaaggccugaaaaaguacuauggcaagauucuuaaacugcuccaucugacacuggaggaagacaccgaggggcuccuggaaugguguaagcgcaaccuuggaucuaauugcgaggaugacuuuuuccagaaaagaaucgaagaguuuuucaugaccggcgagggguacuuuaacgaaguccugcaguucaagacacucagcacgcugucccccaccgagccgucucacgcucggccucccacaguggaacccuuuaaaagcuauuucgccaagggauuucuuuccauugauagcggcuacuucucugcuaaguguuauccucgcuccagcaccucugggcugcagcucaucaacguuacacaacacccggccagaauugccgagacccccggaccuaaaacgacaucccugaagaccaucaauugcaucaaccugcgggcuagcguguuuaaagaacaucgcgagauugagaucaauguccuccugccccagauugcggugaaccuuucuaauugucacguugugaucaacagccaugucugcgacuacucccuggauaccgacggcccugugagacucccccacauuuaccaugaaggcacauucaucccugggaccuauaagaucgugauugauaaaaagaauaaacugaacgaccgguguacacuugucacgaauugcguuaucaagggacgcgaggugagaaagggccagagcgugcugcggcaauacaaaaccgaaauuaagaucgggaaagucucuacaggauccagaaagcuccugagcgaggaauccggcgaugacuguauuucucgcacccagcugcuccggacagagaccgccgagauccacgaugacaacuaugggggacccggcgacaaaaucacgauuugcaauggcagcaccaucguggaucagagacugggguccgaacuuggauguuacacaauuaaccgcguuaagucuuuuaagcugugcgagaauagcgcuaccggcaaaacaugcgaaaucgacuccaccccggugaagugucggcagggguucugccucaaaauuacacaagagggaagaggccacgucaagcugucucgcgggagcgaggugguucuggaugccugugacuccagcugcgaagugaugaucccuaaaggcaccggagauauucuugucgacuguucuggcgggcagcagcauuuccucaaggauaaccugaucgaccugggaugcccccacaucccucuccugggcaagauggccauuuauaucugucggauguccaaucaucccagaacgacaauggcuuuucuuuucugguuuagcuucggguacgugauuaccugccuguuuuguaaagcccucuucuauucucugaucauuaucggaacccugggcaagaaaaucaagcaguaccgcgagcuucggccgcaaacaugcaccauuugugaaacggcgccugucaacgcuaucgaugccgagaugcacgaccucaacugcuccuacaauauuugccccuauugugccagcagacugacaucugaugggcuggcucgccacgugccucagugccccaaacggaaggaaaagguugaggagaccgaacucuaccugaaccuugagagaauccccuggauugugcggaaacugcuccaggucuccgaaagcacaggcguggcccugaagcgcuccagcuggcugaucguucuucucgugcugcugaccgucucucucagcccugugcaguccgcuccggugggacauggcaaaacaaucgagaccuaucaaacgagagaaggguuuaccucuauuugucuguucaugcuuggaagcauccuguuucucguuuccugccuggucaagggccugguggacucugugagcgacuccuucuuucccgggcuuucugucuguaaaacaugcagcauuggauccaucaauggcuucgagauugagagccacaaguguuacugcucucuccuguguugcccuuauugucggcauugcuccgccgauagagaaauccaccagcugcaucucagcaucugcaaaaagcgcaagaccgggucuaacgugaugcuggcgguuuguaaacggaugugcuuuagagccacaauugaggcuucccgcagagcccuucugauccggagcauuaucaauaccacguucgugauuuguauccucacacugaccauuugcgucguguccacaucugcuguugaaauggagaaccugcccagcggcaccugggaaaaggaggaggaccuuaccaauuucugucaccaggaaugccaggugacagagacggaaugucugugcccuuacgaggcccucguccugcgcaaaccccucuuucuggauuccaucgugaagggaaugaaaaaccuucugaauagcaccucucucgagacaucccugagcaucgaagcgccuuggggcgccauuaacguucaaucuaccuucaagccgacagugagcaccgcuaauaucgcccuguccuggucuagcgucgagcacagagggaacaagauucuugugacgggacgguccgaaucuaucaugaaacuggaggaacgcacaggcgugagcugggaccucggggucgaggaugcuuccgagagcaagcugcucaccguuucuauuauggaccugucccagauguauagccccguguuugaauaccuuuccggagauagacagguggaggaauggccuaaagccaccuguacaggcgacugccccgagcggugugggugcaccucuagcacaugccugcauaaggaauggccucacucccgcaauuggagauguaaccccacguggugcuggggcgucggaaccggcuguacaugcugugggguggauguuaaagaccucuucaccgaucauauguuugugaaguggaaggucgaguacaucaaaacagaggccaucgugugcguugaacugaccucucaagagcggcaguguagccugauugaagcuggaacgcgcuucaaucuuggcccggugaccaucacacuguccgagccuagaaacauucagcagaagcucccucccgaaaucauuacccugcaccccaaagucgaggagggguuuuucgaccucaugcaugugcaaaagguucugagcgcgucuacagugugcaaacuucaguccuguacccacggaauccccggcgaucugcaggucuaucacaucggcaaccugcucaagggggaccgggugaauggacaucugauucacaagaucgaaccucauuuuaacacaagcuggaugucuugggacggcugcgaucuugacuacuauuguaauaugggggauuggccguccugcacguacaccggagugacacagcacaaccacgccgcuuucgucaaucugcucaacauugagaccgacuauaccaaaacauuucauuuccacagcaagagaguuacggcccauggcgauacaccccaacuggaccucaaagcccgcccuaccuacggggcuggagaaaucaccgugcugguggaggucgccgauauggagcuucacacaaagaaaguggaaauuucuggccugaaguuugcgagccuggcuugcaccggcuguuaugccugcuccucugggaucagcuguaaaguucggauucauguggacgagcccgaugaacucacgguccacgugaaguccagcgacccugauguuguggccgcuuccacaucucugauggccagaaaacuugaguucggaaccgacagcaccuucaaggcguuuuccgcuaugcccaagacaucucugugcuucuacaucgucgaacgcgaguacuguaaaagcugcuccgaggaagauacccagaaguguguggacacaaaacucgagcagccgcagucuauccugauugaacacaagggcaccaucauugggaagcaaaaugacacgugcacagccaaagccagcuguuggcucgaguccgucaagagcuuuuucuauggacugaaaaacaugcuuggcucuguguuugggaauuucuuuaucggcauucugcuguuccucgcuccuuuuguucugcuugugcuguucuuuauguucggauggaagauccucuucugcuuuaaauguugccggagagcccgcggccugcucaaguaccggcaucugaaggaugacgaagagaccggguauagaaaaaucauugagcgccuuaacaauaagaaaggaaagaaccggcugcuggauggcgaaagacucgcugaccggaaaaucgccgagcuguucuccacaaagacccacauuggguga

SEQ ID NO: 13701 - RNA, 5052 nt, Artificial Sequence
  derived and/or modified CDS sequence (opt5) from CCHFV(75-ST-2010)__KR814864.1__GP
augcacacccugcucgugugcuucauccuguaccuucagcugcucggccccgggggagcccauggccaaccuaacgcuacagagcacaauagaacgaacaccacaaccgccccgagcacaucccagucucccaagccucccgucagcaccgcgccuccccaugcucuggaauccccuacaauuaaaucuaccacgccgaccagcgagacagaaggguccggagagaccacacccccucccaauaccacgcagggcccuucucuucccgaaacaaccccggagcggccugccacaaccgccaccagcacacccuccacggacaacaccaauagcacaacccacguuacagauaacaauccuaccucuacgaucuccacaagccccucuuccagccccucuaccccuuccaccccgcgcgggauucaucaccccgcuagaaaccugcucagcguguccucuccuaagacagccaccacacccacgccuaccagccccggagagaucuccagcgaaacaucuucccugcacagcgcuaugucucggaccagcacacuguauaccgccacgcaggcguccaccgagaaugccaaccauucugcuccgcgccaaagcgaauccccugcccagcccacaaccacaagccucaugaccucuccugcucaguccauucuggugaugagcgccgcgcccacggccauccagaauauccacccuucucccacaaacagauccaaacggaaucuugagauggagauuauccugacccucagccaaggccugaagaaauacuauggcaagauucuuaagcugcuccaucugacacuggaagaggacaccgaagggcuccuggagugguguaaacgcaaccuuggauccaauugcgaugacgacuuuuuccagaagagaaucgaagaguuuuucaugaccggcgagggguacuuuaacgaaguccugcaguucaaaacacucucuacgcugagcccgaccgagccuucccacgcucggccucccacaguggaacccuuuaagucuuauuucgccaaaggauuucuuagcauugauuccggcuacuucagcgcuaaguguuauccgagaucuuccaccagcgggcugcagcucaucaacguuacacaacaccccgcccgcauugccgagaccccuggacccaagacgacaucucugaaaaccaucaauugcaucaaccugcgggcuuccguguuuaaggaacaucgcgagauugagaucaauguccuccugccucagauugcggugaaccuuagcaauugucacguugugaucaacucucaugucugcgauuacagccuggacaccgauggccccgugagacucccucacauuuaccaugaaggcacauucauccccgggaccuauaaaaucgugauugacaagaaaaauaagcugaacgaucgguguacacuugucacgaauugcguuaucaaaggacgcgaggugagaaagggccaguccgugcugcggcaauacaagaccgaaauuaaaaucgggaaggucagcacaggaucuagaaaacuccuguccgaggaaagcggcgacgauuguauuucccgcacccagcugcuccggacagagaccgccgagauccacgacgacaacuaugggggaccgggcgauaagaucacgauuugcaauggcucuaccaucguggaccagagacuggggagcgaacuuggauguuacacaauuaaccgcguuaaauccuuuaagcugugcgaaaauucugcuaccggcaagacaugcgagaucgauagcaccccugugaaaugucggcagggguucugccucaagauuacacaagagggaagaggccacgucaaacugucccgcgggucugaggugguucuggacgccugugauagcuccugcgaagugaugauccccaagggcaccggagacauucuugucgauuguagcggcgggcagcagcauuuccucaaagacaaccugaucgaucugggaugcccucacaucccccuccugggcaagauggccauuuauaucugucggaugucuaaucauccgagaacgacaauggcuuuucuuuucugguuuuccuucggguacgugauuaccugccuguuuuguaaggcccucuucuauagccugaucauuaucggaacccugggcaaaaagaucaaacaguaccgcgagcuucggccucaaacaugcaccauuugugaaacggcgcccgucaacgcuaucgacgccgagaugcacgaucucaacugcucuuacaauauuugcccuuauugugccuccagacugacaagcgacgggcuggcucgccacgugccccagugccccaagcggaaagaaaagguugaggagaccgaacucuaccugaaccuugagagaaucccuuggauugugcggaagcugcuccaggucucugaauccacaggcguggcccugaaacgcagcuccuggcugaucguucuucucgugcugcugaccgucagccucucuccggugcagagcgcucccgugggacauggcaagacaaucgagaccuaucaaacgagagaaggguuuaccuccauuugucuguucaugcuuggaucuauccuguuucucguuagcugccuggucaaaggccugguggacuccgugucugauagcuucuuuccugggcuuuccgucuguaagacaugcucuauuggaagcaucaauggcuucgagauugagucccacaaauguuacugcagccuccuguguugccccuauugucggcauugcucugccgacagagaaauccaccagcugcaucucuccaucugcaagaaacgcaagaccgggagcaacgugaugcuggcgguuuguaagcggaugugcuuuagagccacaauugaggcuucucgcagagcccuucugauccgguccauuaucaauaccacguucgugauuuguauccucacacugaccauuugcgucgugagcacauccgcuguugaaauggagaaccugccuucuggcaccugggaaaaagaggaggaucuuaccaauuucugucaccaggaaugccaggugacagagacggaaugucugugccccuacgaggcccucguccugcgcaagccucucuuucuggacagcaucgugaaaggaaugaagaaccuucucaauuccaccagccucgagacaucucuguccaucgaagcgccguggggcgccauuaacguucaaagcaccuucaaacccacagugucuaccgcuaauaucgcccugagcugguccucugucgagcacagagggaacaagauucuugugacgggacggagcgaauccaucaugaagcuggaggaacgcacaggcgugucuugggaucucggggucgaggacgcuagcgaguccaaacugcucaccguuagcauuauggaucugucucagauguauuccccuguguuugaauaccuuagcggagacagacagguggaggaauggcccaaggccaccuguacaggcgauugcccugagcggugugggugcaccuccucuacaugccugcauaaagaauggccccacagccgcaauuggagauguaacccgacguggugcuggggcgucggaaccggcuguacaugcugugggguggacguuaaggaucucuucaccgaccauauguuugugaaauggaaggucgaguacaucaagacagaggccaucgugugcguugaacugaccucccaagagcggcaguguucucugauugaagcuggaacgcgcuucaaucuuggcccugugaccaucacacugagcgagcccagaaacauucagcagaaacugcccccugaaaucauuacccugcaccccaaggucgaggagggguuuuucgaucucaugcaugugcaaaaaguucuguccgcgagcacagugugcaaacuucagucuuguacccacggaaucccuggcgaccugcaggucuaucacaucggcaaccugcucaaaggggaccgggugaauggacaucugauucacaagaucgaaccgcauuuuaacacauccuggaugagcugggauggcugcgaccuugauuacuauuguaauaugggggacuggcccucuugcacguacaccggagugacacagcacaaccacgccgcuuucgucaaucugcucaacauugagaccgauuauaccaagacauuucauuuccacuccaaaagaguuacggcccauggcgacaccccucaacuggaucucaaggcccgccccacauacggggcuggagaaaucaccgugcugguggaggucgccgacauggagcuucacacaaagaagguggaaauuagcggccugaaauuugcgucucuggcuugcaccggcuguuaugccugcagcuccgggaucucuuguaagguucggauucauguggaugagccugacgaacucacgguccacgugaaaagcuccgaucccgacguuguggccgcuagcacaucccugauggccagaaaacuugaguucggaaccgauucuaccuucaaggcguuuagcgcuaugccgaaaacaucccugugcuucuacaucgucgaacgcgaguacuguaagucuugcagcgaggaagacacccagaaauguguggacacaaagcucgagcagccucaguccauccugauugaacacaaaggcaccaucauugggaagcaaaaugauacgugcacagccaaggccucuuguuggcucgagagcgucaaauccuuuuucuauggacugaagaacaugcuuggcagcguguuugggaauuucuuuaucggcauucugcuguuccucgcucccuuuguucugcuugugcuguucuuuauguucggauggaaaauccucuucugcuuuaaguguugccggagagcccgcggccugcucaaauaccggcaucugaaggacgaugaagagaccggguauagaaagaucauugagcgccuuaacaauaaaaagggaaagaaccggcugcuggacggcgaaagacucgcugaucggaagaucgccgagcuguucucuacaaaaacccacauuggguga

SEQ ID NO: 13702 - RNA, 5052 nt, Artificial Sequence
  derived and/or modified CDS sequence (opt5) from CCHFV(37-R-2013)__KR814858.1__GP
augcacacccugcucgugugcuucauccuguaccuucagcugcucggccugggaggagcccauagacaaagcaacgcuacagagcacaauggcacgaacaccacaaccgcccccuccacaucucagagcccuaagccgcccgucuccaccgcgccuccccaugcuccugaaacaucuaccauuaaacccacgaccccugccagcgagacagaaggguccggagagaccacaccgcccccuaauaccacgcagggccccucuccucccgaagccacaccggagcggccugcuaccacaguuaccagcacccccuccacagacaacacgaauagcaccacacacgccaccgauaacaauccuacaucuaccaucuccacgagccccucuuccagccccucuacaccuuccaccccgcaggggauucaucaccccgcucgcaaccuucugagcguguccucuccuaagaccgccacaacccccacaccuacgagccccggagacaucuccagcgagaccucuucccuccacagcgcgaugucuagaacaccgacccugcauacagccacccaagcuagcacggaaaaugccaaccacuccgcuccucggcagucugagagcuccgcccagcagaccacaaccagccccaugacaucuccugcgcaacccauucuggugauguccgccgcuccuaccgccauccagaauauccaucccagcccgacgaaccgcucuaaaagaaaucucgaaauggagauuauccugacacuuucccagggccugaagaaauauuacggcaagauucucaagcugcuucaccugacccucgaggaagauacagaggggcugcuggaaugguguaaacggaaccucggaagcaauugcgacgaugacuuuuuccagaagcgcaucgaggaauuuuucaugaccggcgagggguauuuuaacgagguccugcaauucaaaacccuuuccacacugucuccuacggaacccagccacgcuagacccccuaccguggagccguuuaaguccuacuucgccaaaggauuucucucuauugauagcggcuauuucuccgccaaguguuacccccggcugacaaccagcgggcuucagcugaucaacguuacacagcauccugcucgcauugcggaaacccccggaccuaagacgacaucucucaaaaccaucaauugcaucaaccugagagccuccguguuuaaggagcaccgggaaauugagaucaauguccugcucccccaaauugcugugaaccugagcaauugucauguugugaucaacucucacgucugcgacuauucccuugauaccgacggcccugugcgccugccccauauuuaccacgagggcacauucaucccggggaccuacaaaaucgugauugauaagaaaaauaagcucaacgacagauguacacuggucacgaauugcguuaucaaaggacgggaagugcgcaagggccagagcgugcuuagacaguauaagaccgagauuaaaaucgggaaggccucuacaggaagccggaaacugcucuccgaagaaccuggcgaugacuguauuagcagaacccagcugcugcgcacagaaaccgccgagauccacgacgauaacuacgggggacccggcgacaagaucacgauuugcaauggcucuaccaucgucgaucaacggcucggguccgagcugggauguuauacaauuaacagagugaaauccuuuaaacuuugcgaaaauagcgcuaccggcaagacaugcgagaucgacucuaccccuguuaaaugucgccagggguucugccugaagauuacacaggaaggacggggccaugugaaacucagcagaggguccgaggucgugcuggaugccugugacaccucuugcgagguuaugauccccaagggcacgggagauauucugguggacuguagcggcgggcagcaacacuuccuuaaagauaaccucaucgaccugggaugcccgcauaucccucugcucggcaagauggcgauuuacaucugucgcauguccaaucacccccggacaaccauggcuuuucuguucugguuuucuuucggguaugucauuaccugcaucuuuuguaaggcccuuuucuacagccugauuaucaucggaacacucggcaaaaagauuaaacaguauagagaacugaagccucagaccugcacgaucugugagacagcccccgugaacgcuauugaugccgaaaugcacgaccugaacugcuccuacaauaucugccccuacugugcuagccgccuuaccucugacgggcucgcccggcaugucccucagugcccgaaaagaaaggagaagguggaagagacagagcuguaucugaaccucgaacgcauucccuggaucguucggaaacugcuucaaguguccgagagcaccggcgucgcgcugaagagaucuuccuggcucaucgugcugcugguucuucucacagugagccugucuccuguccaguccgcccccgugggacacggcaaaaccauugaaacguaccagacccgggagggguuuacaagcgugugucuguucaugcucggauccauccuguuucuuguuagcugccuggucaagggccucguggauucugugagcgacuccuucuuuccugggcugucugucuguaaaaccugcagcauuggauccaucaauggcuucgaaauugagucucauaaguguuauugcagccuguuuuguugccccuacugucgccacugcuccgcugauagagagauccaucagcuucaccucucuaucugcaaaaagcggaagauggggagcaacgugaugcuggccguuuguaaaagaaugugcuuccgcgcuacaauugaagccucccggagagcgcugcucauccgcagcauuaucaauaccacguucgugauuuguauccugacacuuaccauuugcgucgugucuacauccgccguugagauggaaaaccugccuagcggcaccugggagagagaagaggaccucaccaauuuuugucaccaagagugccaggugacagaaacggagugucugugcccguaugaagcucugguccuucggaagccccuguuccucgauucuaucgugaaaggaaugaagaaccugcucaauuccaccagccuggagacaucccuuucuaucgaggccccuuggggcgcuauuaacguucagagcaccuuuaaacccacaguguccaccgccaauaucgcccugagcuggucuuccgucgaacaucgcgggaacaagauucucgugacgggaagaagcgagucuaucaugaagcuggaggagcggacaggcgugagcugggaccugggggucgaugacgcuuccgaaucuaaacuucugaccguuagcauuauggaucucucccaaauguacucuccuguguucgaguaucugagcggagaccgccagguggaggaauggcccaaggcgaccuguacaggcgauugcccggagagaugugggugcaccuccagcacaugccuccacaaagaauggccucauucucggaauuggcgcuguaaccccacguggugcuggggcgucggaaccggcuguacaugcugugggguggacguuaaggaucuguuuaccgaccacauguucgugaaauggaaggucgaguacaucaagacagaagccaucgugugcguugagcuuaccucccaggagagacaguguagccugauugaagcuggaacgcgguuuaaucucggccccgugaccaucacacuguccgagccucgcaacauucaacagaaacugcccccugaaaucauuacccuucauccgaaggucgaggaaggguucuuugaccugaugcacgugcagaaaguucucucugccagcacagugugcaagcugcaguccuguacccacggaauccccggcgaucuccaagucuaccauaucggcaaccugcuuaaaggggacagagugaauggacaccugauucauaagaucgagccucacuucaacacaucuuggaugagcugggauggcugcgaccuggauuauuacuguaauaugggggacuggcccuccugcacguauaccggagugacacagcacaaccaugccgcuuuugucaaucuccugaacauugagaccgauuacaccaagacauuccacuuucauagcaaacggguuacggcccacggcgacaccccucagcuugaucugaaggcgagacccacauauggggcuggagaaaucaccgugcucguggaggucgccgacauggaacugcauacaaagaagguggagauuucuggccucaaauucgccucccuggcuugcaccggcuguuacgccugcagcucugggaucuccuguaagguucgcauucacguggaugagccggacgaacuuacgguccacgugaaaagcaaugauccugacguuguggcggcuucuacaagccugauggcccggaagcuggaguucggaaccgacuccaccuuuaaggccuucucugcuaugcccaaaacaagccucugcuuuuauaucgucgaaagagaguacuguaaguccugcagcgaagaggauacccagaaauguguggacacaaagcuggagcaaccucaguccauccuuauugaacauaaaggcaccaucauugggaagcagaacgucacgugcacagccaaggcuucuuguuggcuggagagcgugaaauccuucuuuuacggacucaagaauaugcugggcucuguuuucgggaacuuuuucaucgggauucuccuguuucuugcccccuucgugcugcugguccucuuuuucauguucggcuggaaaauccuguuuugcuucaaguguugccgccggaccagaggccuucugaaauaucgccuccugaaggaugacgaagagacaggguaccggagaaucauugaacgccucaauaacaagaaaggaaagaaucggcugcuugauggcgagagacuggcggaccggaaaaucgccgagcuguuuagcaccaagacgcacauuggguga

SEQ ID NO: 13703 - RNA, 5052 nt, Artificial Sequence
  derived and/or modified CDS sequence (opt5) from CCHFV(Kashmanov)__DQ211631.1__GP
augcacacccugcucgugugcuucauccuguaccuucagcugcucggccuugggggagcccauggccaaagcaacgcuacagagcacaaugggacgaacaccacaaccgcccccuccacaucucagagcccuaagccgcuugucuccaccgcgcccccucaugcucuggaaucuagcacaauuaaacccaccacgccugccuccgagaccgaaggaucuggcgagacaacacccccuccgaauacaacccaggggcccagcccucccgaaacgacaccugagagacccgccaccacagcuaccuccaccccgagcacagacaacaccaauucuaccacacacguuaccgauaacaauccuacauccaccaucagcacgucucccuccagcucuccuuccacacccagcacgccccagggcauucaucacccugcccggaaccuccuguccgugucuagcccgaagaccgcuacaacccccacaccuacgucccccggagagaucagcucugaagccuccagccugcacucugcgaugagccgcaccuccacacucuauaccgccacacaagugucuaccgagaaugcuaaccauagcgccccuagacaguccgaaagcucugcucagcccacgaccacauccccgaugaccagcccugcccagucuauucuggucauguccgcggcccccaucgcuauccaaaauauucacccuagccccacaaaccgguccaaacgcaaucuugagauggagaucauucugacccucucucagggccugaagaaauacuaugggaagauccuuaagcugcuccaucugacgcuggaagaggacacagaaggacuccuggagugguguaaaagaaaccuuggcagcaauugcgaugacgacuuuuuccagaagcggauugaagaguuuuucaugaccggggagggauacuuuaacgaagugcugcaguucaaaacacucuccacccugucuccuaccgagcccagccacgccggcccgccuacaguugaacccuuuaaguccuauuucgcuaaaggguuucuuagcaucgauucuggauacuucuccgccaaguguuauccccgcagcucuacguccggccugcaacucauuaacgugacccagcacccugccagaaucgcugagacaccgggccccaagaccacaagccugaaaaccaucaauugcauuaaccugcgggcgucugucuuuaaggaacaucgcgagaucgagauuaaugugcuccugccucagaucgccguuaaccuuagcaauugucacguggucauuaacucccaugugugcgauuacagccuggacacggaugggcccgugagacucccucacaucuaccaugaaggaacauucauccccggcaccuauaaaauugucaucgacaagaaaaauaagcugaacgaucgguguacccuuguuacaaauugcgugauuaaagggcgcgaggugagaaagggacaaucuguccugcggcaguacaagaccgaaaucaaaauuggcaaggcuuccacagggagccgcaaacuccuguccgaggaaccuggagacgauuguaucucuagaacgcagcugcuccggaccgagacagccgagauccacgacgacaacuauggcggccccggggauaagauuaccaucugcaauggaagcacaauuguggaccagagacugggcuccgaacuuggguguuacaccaucaaccgcguuaaaucuuuuaagcugugcgagaauagcgccacgggaaagaccugcgaaauugauuccacaccggugaaaugucggcaaggcuucugccucaagaucacccaggaggggagaggccacgucaaacugucucgcggaagcgaggugguucuggacgcuugugauuccagcugcgaagugaugauuccuaagggcacaggggacauccuugucgauuguucuggaggccagcagcauuuccucaaagacaaccugaucgaucuggggugcccccacauuccucuccugggaaagauggccaucuauauuugucggauguccaaucaucccagaaccacaauggcguuucuuuucugguuuagcuucggcuacgugauuaccugcaucuuuuguaaggcucuguucuauucucucaucaucauugggacgcugggcaaaaagaucaaacaauaccgcgagcugaagccgcagacaugcaccauuugugaaaccgccccugucaacgccaucgacgcugagaugcacgaucuuaacugcuccuacaauauuugccccuauugugccagccggcucacaucugacggacuggcuagacacgugccucagugccccaaacgcaaggaaaagguugaggagaccgaacuguaccucaaccuggagcggauccccuggaucgugagaaaacuucugcaggucuccgaaagcacgggcguggcccucaagcgcuccagcuggcugauuguucugcuugugcuccugacagucucucugagcccugugcaauccgcgccgguggggcauggaaaaaccaucgagacauaucagacccgggaaggcuuuacaucuauuugucucuucaugcuggggagcauccuuuuucugguuuccugccucgucaagggacugguggacucugugagcgauuccuucuuucccggccugucugucuguaaaaccugcacgauugggagcaucaauggcuucgagaucgagucccacaaguguuacugcagccuguuuuguugcccuuauuguagacauugcucugccgaccgggaaauucaccagcuccaucuguccaucugcaaaaagcgcaagaccggaagcaacgugaugcuggcuguuuguaaaagaaugugcuuccgggccacaauugaggcuucuagacgcgcccuccugauccgguccauuaucaauaccacauucgugauuuguauccuuacccugacgaucugcgucgugagcacauccgcgguugaaauggagaaccuccccucuggcaccugggaaagagaggaggaucugacaaauuuuugucaccaggaaugccaagugaccgagaccgaaugucugugcccuuacgaggcccuuguccugcgcaagccccucuuccuggacagcauugugaaagggaugaagaacucccucaauagcacaucucuggagacgucccuuagcaucgaagcuccuuggggagccauuaacguucagucuaccuuuaaaccgacagugagcaccgcuaauaucgcccuguccuggucuagcgucgagcacagaggcaacaagauucucgugacagggcgguccgaaucuaucaugaagcuggaggaacgcaccggagugagcugggaucugggcgucgaggacgccuccgagagcaaacuucugacgguuucuaucauggaucucucccagauguauagccccguguucgaauaccuguccggggacagacaaguggaggaauggccuaaggcuacauguaccggcgauugccccgagcgguguggaugcaccucuagcacaugccuccauaaagaauggccucacucccgcaauuggagauguaaccccaccuggugcuggggcgucgggacaggauguacgugcuguggcguggacguuaaggaucuguuuaccgaccauauguucgugaaauggaaggucgaguacauuaagacagaggcgaucgugugcguugaacuuaccucucaggagcggcaguguagccugauugaagccgggacacgcuuuaaucucggaccggugaccaucacgcuguccgagccuagaaacauucagcaaaaacugccucccgaaaucaucacccuucaccccaaggucgaggagggcuucuuugaucugaugcaugugcagaaaguucucagcgcuucuacagugugcaagcugcaguccuguacccacggcauucccggggaccuccaggucuaucacaucggaaaccugcuuaaaggcgaccggauuaaugggcaucugauccacaagauugaaccucauuucaacacaagcuggaugucuugggauggaugcgaccuggauuacuauuguaauaugggcgacuggccguccugcaccuacacaggggugacgcaacacaaccacgccgccuuugugaaucuccugaacaucgagaccgauuauacaaagaccuuccauuuucacagcaaacgcgucaccgcucauggagacacaccccagcuugaucugaaggccagaccuacguacggcgcgggcgaaauuaccguucucguggagguggcugacauggagcugcacaccaaaaaggucgaaaucucugggcucaaauucgccagccuggccugcaccggauguuaugcuugcuccucuggcaucagcuguaaggugcggauucauguugaugagcccgacgaacuuacagugcacgucaaauccagcgauccugacgugguugccgcguccaccucucugauggcuagaaagcuggaguucgggacggauagcacauuuaaggccuucuccgccaugcccaaaaccucucucugcuuuuacaucguggaacgcgaguacuguaagagcugcuccgaggaagacacccagaaaugugucgacacaaagcuggagcagccgcaaucuauucuuaucgaacacaaaggaaccauuaucggcaagcagaaugauacaugcaccgcuaaggccagcuguuggcuggaguccgugaaaucuuucuuuuaugggcucaagaacaugcugggaagcgucuucggcaacuuuuucaucggcauucuccuguuucuugcuccuuucgugcugcugguucucuuuuucauguucggguggaaaauccuguuuugcuucaaguguugccggagaacgcgcggacuucugaaauaccggcaucucaaggacgaugaagagacaggcuauagacgcauuaucgagcggcugaauaauaagaaagggaagaacagacuccuggacggagaacgccuugccgaucggaaaauugcggagcuguuuuccaccaagacacacaucggcuga

SEQ ID NO: 13704 - RNA, 5052 nt, Artificial Sequence
  derived and/or modified CDS sequence (opt5) from CCHFV(Haskovo-V46/13)__KR092379.1__GP
augcacacccugcucgugugcuucauccuguaccuucagcugcucggccuugggggagcccauggccaaagcaacacaacggagcacaaugggaccaacaauacaaccgcucccggaacaucccagucuccuaagccgcauaugagcaccacacccccucacgcccccgaauccucuaccauuaaaccuacgacccccacaagcgagaccgaaggcuccggggagacaaccccuccgucuaacacgacacagggacccagcccucccgaaaccacauccgagagaccugcgaccaccgcuaucagcacaucuuccacggacaauaugaaccccaccagccagaugacagauaauaccccgacaucuaccgucuccauuagcccuucuuccagccccuccacgccuucuacaccccaaggcaugcaucaccccgcccggagccuucuguccguuagcucuccuaagaccgccaccacaccgacccccacauccccuguggaggugggcagcgaaacgucuagccagcacuccgcuaugucuagcacccccacaccucauaccgccacacaggucuccaccgagaacacgaaucacagcacccccagacagucugaaccguccgcucaacagacaaccccuagccccaugccuucucccgcccaguccacacuccugaugagcgcggccccuaccgcugugcagaacacgcaucccuccccgacaaauagaucuaaacggaaccuggagauggagaucauucucacccugagccaagggcuuaagaaauauuacggaaagauccugaagcuccugcaccuuacacuggaagaggacaccgaaggccuccuggagugguguaaacgcaaucugggguccaacugcgaugacgacuuuuuccagaagagaaucgaagaguuuuucaugaccggagagggcuauuuuaaugaaguucuccaguucaaaacacugucuacgcuuagcccuauggagcccucccacgccgaacugcccaccgcugagccuuuuaagagcuacuucgccaaaggguuucucucuauugauuccggauauuucagcgcgaaguguuacccgcggucuuccacaagcggccugcaacuuaucaacgugacccagcaucccgcccgcauugcugaaacaccuggccccaagaccacgucucugaaagccaucaacugcauuaaucucagagcuagcgucuuuaaggagcaccgggagaucgaaauuaacgugcugcugccucagaucgccguuaaucucuccaacugucauguggucaucaauagccacgugugcgauuauucucuggacacagaugggcccgugcgccuuccucauauuuaccacgagggaaccuucauccccggcaccuacaaaauugucaucgacaagaaaaacaagcugaaugauagauguacacucguuaccaacugcgugauuaaagggcgggaagugcgcaagggacaguccguccugagacaauauaagacagagaucaaaaucggcaaggccagcacggggucccggaaacuucugucugaggaacucggagacgauuguauuagccgcacccagcugcugagaacagagaccgcugaaauccacgacgacaauuacggcggcccgggggauaagauuacaaucugcaacggauccaccauuguggaccagcggcucggcucugagcugggguguuauacgaucaauagaggaaagagcuuuaaacuuugcgaaaacuccgcgaccggcaagacaugcgagaucgauucuaccccuguuaaaugucgccagggguucugccugaagauuacacaagagggccggggacaugugaaacucagcagaggcuccgaagucgugcuggacgccugugauagcucuugcgagguuaugauccccaaggggaccggagacauucugguggauuguuccggcgggcagcagcacuuccuuaaagacaaucucaucgaucugggaugcccucauauuccccugcucggcaagauggcuaucuacauuugucgcaugagcaaccacccgcggacaaccauggccuuucuguucugguuuucuuucggguaugucaucacgugcaucuuuuguaaggcccuuuucuacucccugauuaucauuggcacacucgggaaaaagaucaaacaguauagagaacugaagccucaaaccugcaccauuugugagacaacccccgugaaugcuaucgacgccgaaaugcacgaucugaacugcagcuacaacaucugcccuuacugugcgucucgccuuacguccgacggccucgcucggcaugucacacagugccccaaaagaaaggagaagguggaggaaaccgagcuguaucugaaucucgaacgcauucccuggaucguucggaaacugcuucaggugagcgaguccacaggggucgcccugaagagaagcucuuggcucauugugcugcugguucuucucccugugagccuguccccgguccagucugcccccgugggacacggcaaaaccaucgaaacauaccaaacccgcgagggguuuacgagcauuugucuguucaugcucggauccauccuguuuaucgugucuugccuuguuaagggccuggucgacagcgugggggauuccuucuuuccuggccucucuguguguaaaaccugcagcauuggauccaucaacggcuucgagauugaaagccauaaguguuauugcucucuguuuuguugccccuacugucggcacugcuccgcugacagagagauccaucagcugcaccuuagcauuugcaaaaagcggaagacagggucuaaugucaugcucgccguguguaaacgcaugugcuucagagcuaccaucgaagccucccggagagcgcugcugauccgcagcauuaucaacacaaccuucgccauguguauucucacgcugacaaucugcguuguguccaccucugcugucgagauggaaaaucuuccugccggaacaugggagcgggaggaagaucugaccaacuuuugucaccaggagugccaagugaccgaaacagagugucucugccccuaugaggcucugguucugagaaagccucuuuuccuggacagcauugugaaaggcaugaagaaucuccugaacuccacgagccucgaaaccucucuguccaucgaggccccguggggagcgauuaauguccagagcacauuuaaacccaccgugucuacagccaacaucgcucuuagcugguccucuguugaacaucgcggaaauaagauccuggugaccggcagaagcgaguccauuaugaagcucgaggaacggacgggggucucuugggaucugggcguggaggacgccagcgaauccaaacugcuuacagugagcaucauggaucugucucagauguacuccccugucuucgaguaucucagcggagaccgccagguugaagaguggcccaaggcuaccuguaccggcgauugcccugaaagaugugggugcacauccucuaccugccugcacaaagaguggccccauagccggaacuggcgcuguaauccgacauggugcuggggagugggcacgggguguaccugcuguggaguggacgucaaggaucucuuuacagaccacauguucgugaaauggaagguugaguacauuaagaccgaagccaucgugugcgucgagcugacaucccaagaaagacaguguucucuuauugaggccggcacccgguuuaaccugggcccugugacgaucacccucagcgaaccccgcaauauccagcagaaacugcccccugagauuaucacacugcaucccaagauugaggaaggguucuuugaucuuaugcacguucaaaaagugcuguccgcuagcaccgucugcaagcuccagucuuguacacacggaaucccuggcgaccuccagguguaccauauugggaaccugcugaaaggagacagaguuaacggccaccuuauccauaagaucgagccgcacuucaauaccuccuggaugagcugggaugggugcgaccuggauuauuacuguaacaugggagacuggcccucuugcacauauacgggcgugacccagcacaaucaugcggccuuugucaaccugcucaauauugaaacagauuacaccaagaccuuccacuuucauuccaaacgggugacagcucacggcgacacgccucaacuggaucuuaaggcccgccccaccuauggggccggagagaucacagugcuggucgagguugcugacauggaacuccauaccaaaaagguggagauuagcggccugaaauucgccucucucacaugcaccggguguuacgcgugcagcuccggaaucucuuguaaggugcgcauucacgucgaugaaccugacgagcugacggugcacguuaaaagcuccgaucccgacguggucgcugccggcacaagccuuauggcccggaagcuggaguucgggaccgauuccaccuuuaaggcuuucucugccaugccgaaaacaagccugugcuuuuauaucguggaaagagaguacuguaaguccugcucugaagacgacacccagaaauguguugauacaaagcucgagcagccucaaagcauucugaucgaacauaaaggaaccaucauuggcaagcagaacgacacgugcacagcgcgcgcuuccuguuggcuugagucugucaagagcuucuuuuacggccugaaaaauaugcucggguccguguucggaaacuuucugaucggcauucuccuguuccuugcccccuuugugcugcugguccucuucuuuauguucggguggaagauccuguucugcuuuaaauguugccggagaacccgcggacuuuucaaguaucggcaccugaaagaugacgaagagacaggcuacagacgcauuaucgagcggcucaauagcaagaaggggaaaaacagacugcucgauggagaacgccuggccgaccggaagaucgcugagcuguuuucuaccaaaacgcauauuggcuga

SEQ ID NO: 13705 - RNA, 5052 nt, Artificial Sequence
  derived and/or modified CDS sequence (opt5) from CCHFV(Min)__KX013481.1__GP
augcacacccugcucgugugcuucauccuguaccuucagcugcucggccuugggggagcccauggccaaagcaacgcuacagagcacaaugggacgaacaccacaaccgcccccuccacaucucagagcccuaagccgcuugucuccaccgcgcccccucaugcucuggaaucuagcacaauuaaacccaccacgccugccuccgagaccgaaggaucuggcgagacaacacccccuccgaauacaacccaggggcccagcccucccgaaacgacaccugagagacccgccaccacagcuaccuccaccccgagcacagacaacaccaauucuaccacacacguuaccgauaacaauccuacauccaccaucagcacgucucccuccagcucuccuuccacacccagcacgccccaggggauucaucacccugcccggaaccuccuguccgugucuagccugaagaccgcuacaaccccgacacccacguccccuggcgagaucagcucugaaaccuccagccuccacucugccaugagccgcacauccacccuguauacagcgacccaagugucuacggagaaugccaaccauagcgcucccagacaguccgaaagcucugcccagccuaccacaaccucccccaugacaagcccggcucagucuauucuugucauguccgccgcgccuaucgccauccaaaauauucaccccagcccuaccaaccgguccaaacgcaaucuggagauggagaucauucucacgcugucucagggccuuaagaaauacuaugggaagauccugaagcuccugcaucugacacucgaagaggacaccgaaggacugcuugagugguguaaaagaaaccugggcagcaauugcgaugacgacuuuuuccagaagcggauugaagaguuuuucaugacaggggagggauacuuuaacgaagugcuccaguucaaaacccuguccacccuuucucccacagagccuagccacgcuagacccccgacgguugaaccuuuuaaguccuauuucgccaaaggcuuucugagcaucgauucuggguacuucuccgcuaaguguuaucccagaagcucuaccuccggacuccaacugauuaacgugacacagcaccccgcccggaucgccgagaccccuggcccgaagacaaccagccugaaaacgaucaauugcauuaaccuccgcgcuucugucuuuaaggaacauagagagaucgagauuaaugugcugcuuccccagaucgcgguuaaccugagcaauugucacguggucauuaacucccaugugugcgauuacagccucgacacagauggcccugugcggcugccccacaucuaccaugaagggaccuucaucccuggaaccuauaaaauugucaucgacaagaaaaauaaacuuaacgaucgcuguacacugguuaccaauugcgugauuaagggcagagaggugcggaaggggcaaucuguccuccgccaguacaagacagaaaucaaaauuggaaaggccuccacgggcagcagaaaacugcuguccgaggaacccggggacgauuguaucucucggacccagcuccugagaacagagaccgcugagauccacgacgacaacuauggaggcccuggcgauaagauuacaaucugcaaugggagcaccauuguggaccagcgccuuggauccgaacugggcuguuacacgaucaaccggguuaaaucuuuuaagcucugcgagaauagcgccaccgggaagacaugcgaaauugauuccacccccgugaaauguagacaaggauucugccugaagaucacacaggagggccgcgggcacgucaaacugucucggggcagcgaggugguucuugacgccugugauuccagcugcgaagugaugauuccgaagggaaccggcgacauccucgucgauuguucugggggacagcagcauuuccugaaagacaaccugaucgaucucggcugcccucacauuccccugcuugggaagauggcuaucuauauuuguagaauguccaaucauccucgcacaaccauggccuuucuguucugguuuagcuucggauacgugaucacgugcaucuuuuguaaggcucucuucuauucucugauuaucauuggcacacuggggaaaaagaucaaacaauaccgggagcuuaagccccagaccugcaccauuugugaaacagcgccggucaacgccaucgacgccgagaugcacgaucucaacugcuccuacaauauuugcccuuauugugcuagcagacugaccucugacggccuggcccgccacgugccccagugcccuaaacggaaggaaaagguugaggagacggaacucuaccugaaccuugagagaauccccuggaucgugcgcaaacugcuccaggucuccgaaagcacaggaguggcucugaagcgguccagcuggcugauuguucuucucgugcugcugaccgucucucucagccccgugcaauccgccccugugggccaugggaaaacaaucgagaccuaucagacaagagaaggauuuaccucuauuugucuguucaugcuuggcagcauccuguuucucguuuccugccuggucaaggggcugguggacucugugagcgauuccuucuuuccgggacuuucugucuguaaaacgugcaccauuggcagcaucaauggguucgagaucgagucccacaaguguuacugcagccucuuuuguugccccuauugucggcauugcucugcggaccgcgaaauucaccagcugcaucuguccaucugcaaaaagagaaagacaggcagcaacgugaugcucgccguuuguaaacggaugugcuucagagcuaccauugaggccucucgccgggcucugcuuaucagauccauuaucaauacaaccuucgugauuuguauccugacgcucacaaucugcgucgugagcaccuccgccguugaaauggagaaccugccuucuggaacaugggaacgcgaggaggaucugaccaauuuuugucaccaggaaugccaagugaccgagacagaaugucuuugccccuacgaggcgcugguccucagaaagccucuguuccucgacagcauugugaaaggcacgaagaaccugcuuaauuccaccagccuggagacaucucucuccaucgaagcccccuggggagcuauuaacguucagagcaccuuuaaaccuacagugucuaccgccaauaucgcucugagcugguccucugucgagcaccggggaaacaagauucuggugacgggccgcagcgaauccaucaugaaacuugaggaaagaacaggggugucuugggaucugggagucgaggacgccagcgaguccaagcuccugaccguuagcaucauggaucucucucagauguauuccccgguguucgaauaccugagcggcgaccggcaaguggaggaauggcccaaggccaccuguacaggggauugcccugagcgcuguggcugcaccuccucuacaugccuucauaaagaauggccccacagcagaaauuggcgguguaacccuacguggugcuggggagucggcaccggguguacaugcuguggaguggacguuaaggaucuguuuaccgaccauauguucgugaaauggaaggucgaguacauuaagacagaggcuaucgugugcguugaacucaccucccaggagcgccaguguucucugauugaagcgggcacgagauuuaaucuggggcccgugaccaucacacuuagcgagccgcggaacauucagcaaaaacugccucccgaaaucaucacccuccaccccaaggucgaggagggauucuuugaucugaugcaugugcagaaaguucucuccgccagcacagugugcaagcugcagucuuguacccacggcauuccuggcgaccuucaggucuaucacaucgggaaccugcugaaaggagaccgcauuaauggccaucucauccacaagauugaaccccauuucaacacauccuggaugagcugggaugggugcgaccuggauuacuauuguaauaugggagacuggccuucuugcacguacaccggcgugacacaacacaaccacgcugccuuugugaaucuucugaacaucgagaccgauuauaccaagacauuccauuuucacuccaaaagagucacggcccauggggacaccccgcagcucgaucugaaggcucggcccacauacggagccggcgaaauuaccguucucguggagguggcggacauggagcugcacaccaaaaaggucgaaaucagcggccuuaaauucgcuucucuggccugcaccggguguuaugccugcagcuccggaaucucuuguaaggugcgcauucauguugaugagccugacgaacugacggugcacgucaaaagcuccgaucccgacgugguugcugccagcacaucccucauggcgcgcaagcuggaguucggcaccgauucuaccuuuaaggcuuucagcgccaugccuaaaacaucccuuugcuuuuacaucguggaacgggaguacuguaagucuugcagcgaggaagacacccagaaaugugucgacacaaagcuggagcagccccaauccauucucaucgaacacaaagggaccauuaucggaaagcagaaugauacgugcacagccaaggcuucuuguuggcuggagagcgugaaauccuucuuuuauggccucaagaacaugcuggggagcgucuucggaaacuuuuucaucggcauucuucuguuucuggccccguucgugcuccugguucuguuuuucauguucggcuggaaaauccuguuuugcuucaaguguugcagacgcacccgggggcuccugaaauacagacaucucaaggacgaugaagagacaggauaucgccggauuaucgagagacugaauaauaagaaaggcaagaaccgccuucuggacggggaacggcuggcugauagaaaaauugccgagcucuuuucuaccaagacgcacaucggauga

SEQ ID NO: 13706 - RNA, 5052 nt, Artificial Sequence
  derived and/or modified CDS sequence (opt5) from CCHFV(Kosovo/9553/2001)__AY675511.1__GP
augcacacccugcucgugugcuucauccuguaccuucagcugcucggccugggaggagcccauggccaaagcaacgcuacagagcacaaugggacgaacaccacaaccgcccccggaacaucccagucuccuaagccgcccgcgagcaccacaccuucccaugcucccgaaucuagcaccauuaaacuuacgaccccuacauccgagaccgaaggcucuggggagacaacgcccccuaccagcacaacccagggauccccgccccuggaaacaaccccugagagaagcaccacaacggccaccucuacauccggcaccgacaauaugaacagcacaacccagaugacggauaauacacccacccucaccgccucuacauccccuagcuccucccccagcaccccguccacaucucaaggccugcacuauccuguccggagccugcucuccguuagcucucccaagacggugaccacaccuacccccaugucccccggggagaugagcucugaaacaagcucccagcauucugcuaugagccgcaccccuacgccgcacaccgccacacagguguccaccgagaacgcuaauagaagcacaucucggcaguccgaaagcucugcccaacccgcgacccaguccccugucacgagccccgcccaguccauccugcuuaugucugcuacaccuaccacaauucagaacauccaccccagcccgaccaaucgcuccaaaagaaaccuggagauggagauuauccucacccugucucaaggacuuaagaaauacuauggcaagauccugaagcuccugcaucugacacucgaagaggacacggaagggcugcuugagugguguaaacggaaucugggaagcaacugcgaugacgacuuuuuccagaagcgcauugaagaguuuuucaucaccggcgagggguacuuuaaugaagugcuccaguucaaaacacuguccaccccuagccccacagagccuucucacgccagacuucccaccgcugaaccuuuuaaguccuauuucgccaaaggauuucugagcauugauucuggcuacuucuccgcgaaguguuauccccggagcucuacgagcggccuccaacugaucaacguuacacagcauccggcccgcauugcugagaccccugggcccaagaucaccucccugaaaacaauuaauugcaucaaccucagagccagcguguuuaaggaacaccgggaggucgagaucaacgugcugcuuccccagauugcuguuaaucugucuaacugucacguggucaucaauucccaugugugcgauuacagccucgacaccgauggaccugugcgccugccgagaauuuaccacgaaggcacauucaugcccgggacguauaaaaucgucauugaccggaagaacaaacuuaaugaucgcuguacccugguuacaaacugcgugaucaagggaagagaggugcggaaaggccaguccguccucagacaauacaagaccgaaaucaagauugggaaagccccuacaggaucucgcaagcugcugagcgaggaacccggcgacgauuguaucucccggacccagcuccugagaacggagaccgccgagauucaugacgacaauuauggcgggccuggagauaaaaucacaauuugcaacggcucuaccaucguggaccagcgccuugggagcgaacugggauguuacacaaucaaucggguuaaguccuuuaaacucugcgagaacucugcuaccggcaagacaugcgaaauugauagcacccccgugaaguguagacagggguucugccugaaaaucacgcaagagggccgcggacacgucaagcugucccggggcagcgaggugguucuugacgcgugugauucuuccugcgaagugaugauuccuaaagggacaggagacauccucgucgauuguagcggcgggcagcagcauuuccugaaggacaaucugauugaucucggaugcccccacaucccgcugcuuggcaaaauggccauuuauaucgcuagaaugucuaaccacccuaagaccaccauggccuuucuguucugguuuucccucggguacgugaucacauguauucugugcaaggcccuguucuauagccuuaucauuaucggcacccucgggaaaaagauuaaacaguaccgcgagcugaagccccaaacguguacaaucugcgaaaccgcuccugucaaugccaucgacgcggagaugcaugaucugaacuguucuuacaauauuugccccuauugcgcuucccggcucacaagcgacggccuggccagacacgugaaacaguguccgaagcgcaaggaaaaaguugaggagaccgaacuuuaccugaaccucgagcggaucccuuggguggucagaaagcugcuccagguguccgaaagcacagggguugcccuuaaacggucuagcuggcucauugugcugcugguccuccugaccgugucccuuucucccgugcagagcgcuccuguuggacauggcaagacgaucgagaccuaucaaacacgcgaaggguuuaccuccauuugccuguucaugcucggaucuauccuguuuaucgucagcugucuggugaaaggccuuguggacuccgucucugauagcuucuuucccgggcucuccgugugcaagacauguagcauuggcucuaucaacggauucgagauugagucccacaaaugcuacuguagccuguuuugcugucccuauugcagacacuguucugccgaccgggaaauccaucagcugcaccucuccauuugcaagaagagaaaaaccggcagcaauguuaugcuggcugugugcaagcgcauguguuuccgggccacgaucgaggcguccagacgcgcccuucugaucagaucuauuaucaacacaaccuuugucauuugcauccucacacugaccauuuguguggcuagcaccuccgccguugaaauggagacacugccugcugccacgugggaacgggaggaggaucuuaccaauuucugccaucaggaaugucaagugccggagacagaaugccugugucccuacgaggcgcucguccugcgcaaaccucucuuccuggacagcaucgugaaggggaugaaaaaccuucucaauucuaccucccuggagacaagccugucuauugaagcccccuggggagcuaucaacguucagagcaccuuuaagccuacgguguccacagccaauaucgcucugucuuggagcuccgucgagcacagaggcaacaagauucuugugaccgggcggucugaaagcaucaugaaacuggaggaacgcaccggaguguccugggaucucggcgucgaggacgccagcgagucuaagcugcucacaguuuccauuauggaucugagccagauguauucccccguguucgaauaccuuucuggggacagacagguggaggaauggccuaaagcuaccugcacaggcgauuguccggagcggugcggauguacgagcucuaccugccugcauaaggaauggccccacucucgcaauuggagaugcaacccuacaugguguuggggcgucgggaccggaugcacauguugcggcguggacguuaaagaucucuuuaccgaccacauguucgugaaguggaaggucgaguacaucaaaacggaggccauuguguguguugaacugaccagccaagagcggcagugcucccugaucgaagcggggacacgcuuuaaucuuggacccgugaccaucacacugagcgagccuagaaacauucagcagaagcugcccccggaaaucauuacccugcauccuaaaaucgaggagggcuucuuugaucucaugcacguccaaaaggugcugucugccuccacaguuuguaaacuucagagcugcacgcauggcauucccggggaccuccagguguaucacaucggaaaucugcugaagggcgaccgggucaacgggcaucugauccacaagauugaaccccacuucaauaccucuuggauguccugggauggaugugaccuugauuacuauugcaacaugggcgacuggccuagcuguacauacaccggggugacccagcauaaccacgcugccuuugugaaucugcucaacaucgagacagauuauacgaaaaccuuccauuuucacucuaagagagucacagcccacggagacacaccccaacuggaucucaaagcucgcccuaccuacggcgccggcgaaauuaccguucugguggagguggcggacauggagcuucauacgaagaaagucgaaaucagcgggcugaaguucgcuucccuggccugcacaggaugcuaugccuguucuagcggcauuuccugcaaagugcggauccacguugaugagccggacgaacucaccgugcaugucaagagcuccgaucccgacgugguugcugccucuaccagccugauggcgagaaaacuugaguuugggacagauuccaccuucaaggcuuucucugccaugccuaagacaagccuguguuuuuacauuguggaaaaagaguacugcaaguccuguucugaggacgacaccaaaaagugcgucgauacgaagcucgaacagccccagagcauccugaucgagcaccgcggaacaauuaucggcaaaccuaaugacaccugucccgccaagacauccugcuggcucgaaagcgugaaaucuuucuuuuaugggcugaagaacaugcuuggauccgucuucggcaacuuuuucauuggcauccugcuguuucucgcuccguucuuucuguggaugcuuagcuucauguuuggguggaaaauucuguucuguuucaagugcugucggagaacccgcggacucuuuaaguaccggcaucugaaagaugacgaggaaacgggcuauagacgcaucaucgagcggcucaauaauaagaaagggaagaacagacugcuugauggagagcggcuggccgaccgcaaaauugcugaacuguucucuaccaagacacacaucggcuga

SEQ ID NO: 13707 - RNA, 5052 nt, Artificial Sequence
  derived and/or modified CDS sequence (opt5) from CCHFV(4495-ST-2008)__KR814869.1__GP
augcacacccugcucgugugcuucauccuguaccuucagcugcucggccccgggggagcccauggccaaccuaacgcuacagagcacaauagaacgaacaccacaaccgccccgagcacaucccagucucccaagccucccgucagcaccgcgccuccccaugcucuggaguccccuacaauuaaaucuaccacgccgaccagcgagacagaaggguccggagagaccacacccccucccaauaccacgcagggcccuucucccccggaaacaaccccugagcggcccgccacaaccgccaccagcacaccuuccacggacaacaccaauagcacaacccacguuacagauaacaaucccaccucuacgaucuccacaagccccucuuccagcccuucuaccccguccacaccccgcgggauucaucacccugcuagaaaccuucugagcguguccucucccaagaccgccaccacaccuacgcccaccagcccgggagagaucuccagcgaaacaucuucccuccacagcgcuaugucucggaccagcacacuguauaccgccacgcaggcguccaccgagaaugccaaccauucuacaccucgccaaagcgaaucccccgcucagccuaccacaaccagccugaugacgucucccgcccaguccauucucgugaugagcgcugccccuacagcgauccagaauauccaccccucuccgaccaacagauccaaacggaaucuggagauggagauuauccuuacacugagccaaggccucaagaaauacuauggcaagauucugaaacuucugcaucucacccuggaagaggacaccgaagggcugcucgagugguguaagcgcaaccugggauccaauugcgaugacgacuuuuuccagaagagaaucgaagaguuuuucaugacaggcgagggguacuuuaacgaaguccuucaguucaaaacgcugucuacccucagcccuacagagcccucccacgcccggcccccuaccguggaaccguuuaagucuuauuucgcuaaaggauuucugagcauugauuccggcuacuucagcgccaaguguuaucccagaucuuccacaagcgggcuucagcugaucaacguuacccaacacccugcucgcauugccgagacgcccggaccuaagacaaccucucucaaaaccaucaauugcaucaaccugcgggccuccguguuuaaggaacaucgcgagauugagaucaauguccugcucccccagauugcugugaaccugagcaauugucacguugugaucaacucucaugucugcgauuacagccuugacacagauggcccugugagacugccccacauuuaccaugaaggcaccuucaucccggggacauauaaaaucgugauugacaagaaaaauaagcucaacgaucgguguacgcuggucaccaauugcguuaucaaaggacgcgaggugagaaagggccaguccgugcuucggcaauacaagacagaaauuaaaaucgggaaggucagcaccggaucuagaaaacugcucuccgaggaaagcggcgacgauuguauuucccgcacacagcugcugcggaccgagacggcggagauccacgacgacaacuaugggggaccuggcgauaagaucaccauuugcaauggcucuacaaucguggaccagagacucgggagcgaacugggauguuacaccauuaaccgcguuaaauccuuuaaacuuugcgaaaauucugccacaggcaagaccugcgagaucgauagcacacccgugaagugucggcagggguucugccugaagauuacccaagagggaagaggccacgucaaacucucccgcgggucugaggugguucuggacgcuugugauagcuccugcgaagugaugaucccuaagggcacgggagacauucuggucgauuguagcggcgggcagcagcauuuccuuaaagacaaccucaucgaucugggaugcccccacaucccgcugcucggcaagauggccauuuauaucugucggaugucuaaucauccuagaacaaccauggccuuucuguucugguuuuccuucggguacgugauuaccugccuguuuuguaaggcucuuuucuauagccucaucauuaucggaacacugggcaaaaagaucaaacaguaccgcgagcugcggccccaaaccugcacgauuugugaaacagccccugucaacgcgaucgacgcugagaugcacgaucuuaacugcucuuacaauauuugccccuauugugccuccagacucaccagcgacgggcuggcccgccacgugccccagugcccuaagcggaaagaaaagguugaggagacagaacuguaccucaaccuggagagaaucccguggauugugcggaaacuucugcaggucucugaauccaccggcguggcucucaagcgcagcuccuggcugaucguucugcuugugcuccugacagucagccugucucccgugcagagcgccccugugggacauggcaagaccaucgagacguaucaaaccagagaaggguuuacauccauuugucucuucaugcugggaucuauccuuuuucugguuagcugccucgucaaaggccugguggacuccgugucugauagcuucuuucccgggcuguccgucuguaagaccugcucuauuggaagcaucaauggcuucgagauugagucccacaaauguuacugcagccuucucuguugcccuuauugucggcauugcucugcugacagagaaauccaccagcugcaucuguccaucugcaagaaacgcaagacagggagcaacgugaugcucgccguuuguaagcggaugugcuuuagagcgaccauugaggccucucgcagagcucugcuuauccgguccauuaucaauacgacauucgugauuuguauccugacccucacaauuugcgucgugagcaccuccgccguugaaauggagaaccugcccucuggcaccugggaaaaagaggaggaucugacaaauuucugucaccaggaaugccaggugacggagaccgaaugucuuugcccuuacgaggcucugguccuccgcaagccgcuguuucucgacagcaucgugaaaggaaugaagaaccugcuuaauuccacaagccuggagaccucucucuccaucgaagcccccuggggcgcgauuaacguucaaagcacauucaaaccuaccgugucuacggccaauaucgcucugagcugguccucugucgagcacagagggaacaagauucuggugacaggacggagcgaauccaucaugaaacuugaggaacgcaccggcauuucuugggaucuggggguggaggacgccagcgaguccaagcuccugaccgucagcaucauggaucucucucagauguauucccccguuuuugaauaccugagcggagacagacagguggaggaauggccuaaggcuacauguaccggcgauugccccgagcggugugggugcacauccucuacgugccuucauaaagaauggccgcacagccgcaauuggagauguaacccuaccuggugcuggggcgugggaacaggcuguaccugcuguggggucgacgugaaggaucuguucacagaccauauguuuguuaaauggaagguggaguacaucaagaccgaggccauugucugcguggaacucacgucccaagagcggcaguguucucugaucgaagccggaacccgcuucaaucugggccccguuacaauuacccuuagcgagcccagaaacauccagcagaaacugccucccgaaauuaucacacuccacccuaagguggaggagggguuuuucgaucugaugcauguccaaaaagugcucuccgcuagcaccguuugcaagcugcagucuuguacacacggaaucccgggcgaccuucagguguaucacauuggcaaccugcugaaaggggaccgggucaauggacaucucauccacaagauugaaccccauuuuaacacguccuggaugagcugggauggcugcgaccuggauuacuauuguaauaugggggacuggccuucuugcaccuacacaggagugacccagcacaaccacgcggccuucgugaaucuucugaacaucgagaccgauuauacaaagacguuucauuuccacuccaaaagagucaccgcucauggcgacacaccccaacucgaucugaaggcccgcccuaccuacggggccggagaaauuacaguucucguggagguggcugacauggagcugcacaccaaaaaggucgaaaucagcggccuuaaauuugccucucuggcgugcacgggcuguuaugcuugcagcuccgggauuucuuguaaggugcggauccauguugaugagcccgacgaacugacagugcacgucaaaagcuccgauccggacgugguugccgccagcaccucccucauggcuagaaagcuggaguucggaaccgauucuacauucaaggccuuuagcgcgaugccuaaaaccucccuuugcuucuacaucguggaacgcgaguacuguaagucuugcagcgaggaagacacacagcggugugucgacaccaaacuggagcagccccaguccauucucaucgaacacaagggcacgauuaucgggaaacaaaaugauacaugcaccgcuaaggccucuuguuggcuggagagcgugaaguccuuuuucuauggacucaaaaacaugcugggcagcgucuuugggaauuucuuuauuggaauccuucuguuccuggccccuuuugugcuccugguucuuuucuuuauguucggcuggaagauccuguucugcuuuaaauguugcagacgcgcucggggccuccugaaguacagacaucucaaagacgaugaagagacaggguaucgcaagauuaucgagcggcugaacaauaagaaaggaaagaacagacuucuggacggcgaacggcuggccgaucgcaaaauugcugaacucuucucuaccaagacgcacaucggguga

SEQ ID NO: 13708 - RNA, 5052 nt, Artificial Sequence
  derived and/or modified CDS sequence (opt5) from CCHFV(Mamon)__KX013478.1__GP
augcacacccugcucgugugcuucauccuguaccuucagcugcucggccuugggggagcccauggccaaagcaacacaacggagcacaaugggaccaacacaaccacagcucccuccaccucucagagcccuaagccgcuugucuccacagcgcccccucaugcccuggaaucuagcaccauuaaacccacgaccccugcuuccgagacagaaggaucuggcgagaccacacccccuccgaauaucacccaggggcccagcccucccgaaacgacaccugagagacccgccaccacagccaccuccaccccgagcacagacaacaccaauucuaccacacacguuaccgauaacaauccuacauccaccauuagcacgucucccuccagcucuccuuccacacccagcacgccccagggaauccaucacccugcucggaaccuccuguccgugucuagcccgaagaccgccacaacccccacaccuacgucccccggcgagauuagcucuaaaaccuccagccugcacucugcuaugagccgcacauccacccucuauacagccacccaagugucuacggaaaaugcgaaccauagcgccccuagacaguccgagagcucugcucagcccaccacaaccuccccgaugacaagcccugcccagucuauccuggucauguccgcugcccccaccgcgauccaaaauauucacccuagccccacgaaccgguccaagcgcaaucuugaaauggagaucauucugacacucucucagggccugaaaaaguacuaugggaagauccuuaaacugcuccaucugacccuggaggaagacacagagggacuccuggaaugguguaagagaaaccuuggcagcaauugcgaugacgacuuuuuccagaaacggauugaggaauuuuucaugaccggggagggauacuuuaacgaggugcugcaguucaagacccucuccacacugucuccuacggaacccagccacgcccgcccgccuaccguugagcccuuuaaauccuauuucgcuaagggcuuucuuagcaucgauucuggguacuucuccgccaaguguuaucccagaagcucuacauccggacugcaacucauuaacgugacccagcacccugcucggaucgccgaaacaccgggccccaaaaccacgagccugaagacaaucaauugcauuaaccugcgcgccucugucuuuaaagagcauagagaaaucgagauuaaugugcuccugccucagaucgcuguuaaccuuagcaauugucacguggucauuaacucccaugugugcgauuacagccuggacaccgauggccccgugcggcucccucacaucuaccaugaggggaccuucauccccggaacauauaagauugucaucgacaaaaagaauaaacugaacgaucgcuguacccuuguuacaaauugcgugauuaagggcagagaagugcggaaggggcaaucuguccugcgccaguacaaaacggagaucaagauuggaaaagcguccaccggcagcagaaagcuccuguccgaggaaccuggggacgauuguaucucucggacacagcugcucagaaccgaaacagccgagauccacgacgacaacuauggaggccccggcgauaaaauuaccaucugcaaugggagcacgauuguggaccagcgccugggauccgagcuuggcuguuacaccaucaaccggguuaagucuuuuaagcugugcgaaaauagcgcuacagggaaaaccugcgagauugauuccacaccggugaaguguagacaaggauucugccucaaaaucacccaggaaggccgcgggcacgucaagcugucucggggcagcgaggugguuuccgacgccugugauagcucuugcgaggugaugauuccuaaaggaacaggcgacauccuggucgauuguuccgggggacagcagcauuuccuuaaggacaaccucaucgaucugggcugcccccacauuccucugcucgggaagauggccaucuauauuuguagaaugagcaaucauccccgcaccacgguggcuuuucuguucugguuuucuuucggauacgucaucacaugcaucuuuuguaaagcccuuuucuauucccugauuaucauuggcacccucgggaagaaaaucaagcaauaccgggaacugaaaccgcagaccugcacaauuugugagaccgcgccugugaacgcuaucgacgccgaaaugcacgaucugaacugcagcuacaauauuugccccuauugugccucuagacuuacguccgacggccucgcucgccacguuccucagugccccaagcggaaggagaaaguggaagagacagagcuguaccugaaccucgaaagaauccccuggaucguccgcaagcugcuucaggugagcgaguccaccggaguugcccugaaacggagcucuuggcucauugugcugcugguccuucucacagugagccuguccccugugcaaucugcuccgguuggccaugggaagaccaucgaaacauaucagaccagagagggauuuacgagcauuugucuguucaugcucggcuccauccuguuucuugucucuugccuggugaaagggcucguggacagcgucuccgauucuuucuuucccggacugagcguguguaagaccugcuccauuggcagcaucaauggguucgaaaucgagucucacaaauguuacugcucccuguuuuguugcccuuauugucggcauugcagcgccgaccgcgagauucaccagcuucaucucucuaucugcaagaagagaaaaacaggcuccaacguuaugcuggcgguguguaagcggaugugcuucagagccaccauugaagcuagccgccgggcccugcucaucagauccauuaucaauacaaccuucgucauuuguauccugacgcuuacaaucugcgugguuucuaccagcgcuguggagauggaaaaccugcccuccggaacaugggagcgcgaagaggaucucaccaauuuuugucaccaggagugccaagucaccgaaacagagugucugugcccuuacgaagcccuggugcuuagaaaaccccuguuccucgacagcauuguuaagggcaugaaaaaccugcucaauucuacgucccuggagaccagccuuucuaucgaggcgccuuggggagccauuaacgugcagagcacauuuaagccgaccgucuccacagcuaauaucgcccugucuuggagcuccguggaacaccgggggaacaagauucucgugaccggccgcucugagagcaucaugaaacuggaagagagaacgggggucuccugggaucugggaguugaagacgcuagcgagucuaagcugcugacaguguccaucauggaucucagccagauguauucccccguguucgaguaccugucuggcgaccggcaagucgaagaguggccuaaagccaccuguaccggggauugccccgaacgcuguggcugcacaagcucuaccugccuccauaaggaguggccucacuccagaaauuggcgguguaaccccacauggugcuggggagugggcacgggguguaccugcuguggaguugacgugaaagaucuguuuacagaccauauguucgucaaguggaagguggaauacauuaaaaccgaggccaucguuugcguggagcuuacaagccaggaacgccaguguucccugauugaggcuggcaccagauuuaaucucgggccggucacgaucacccugagcgaaccucggaacauucagcaaaagcugccucccgagaucaucacacuucaccccaaaguggaagagggauucuuugaucugaugcauguucagaaggugcucucugcguccaccgucugcaaacugcagagcuguacacacggcauucccggcgaccuccagguguaucacaucgggaaccugcuuaagggagaccgcgugaauggccaucugauucacaagaucgagccucauuucaacaccucuuggauguccugggaugggugcgaccuggauuacuauuguaauaugggagacuggccgagcugcacauacacgggcgucacccaacacaaccacgccgcuuuuguuaaucuccugaacauugaaacagauuauaccaaaaccuuccauuuucacucuaagagagugacagcccauggggacacgccccagcuugaucugaaagcccggccuaccuacggagcuggcgagaucacagugcucgucgaaguggccgacauggagcugcacaccaagaaaguugagauuagcggccucaaguucgcgucccuggcuugcacaggguguuaugccugcucuagcggaaucuccuguaaagugagaauccaugucgaugaacccgacgagcuuaccgugcacguuaagagcuccgauccugacguggucgccgcuucuacgagccugauggcccgcaagcuggaguucggcacagauuccaccuuuaaagcguucucugcuaugcccaagaccagccucugcuuuuacauuguggaacgggaauacuguaaauccugcucugaggaggacacacagaagugugucgacaccaaacuggaacagccgcaaagcauccuuauugagcacaaggggacaaucauuggaaagcagaaugauaccugcacggccaaaacauccuguuggcuggaaagcgugaagucuuucuuuuauggccucaaaaacaugcugggguccguuuucggaaacuuuuucaucggcauccuccuguuucuugccccuuucgugcugcugguccucuuuuucauguucggcuggaagauucuguuuugcuucaaauguugcagacgcacccgggggcuucugaaguacagacaucucaaggacgaugaggaaacaggauaucgccggaucauugagagacugaauaauaaaaagggcaaaaaccgccuccuggacggggagcggcuugcugauagaaagaucgccgaacuguuuagcaccaaaacgcacauuggauga

SEQ ID NO: 13709 - RNA, 5052 nt, Artificial Sequence
  derived and/or modified CDS sequence (opt5) from CCHFV(81-R-2014)__KR814865.1__GP
augcacacccugcucgugugcuucauccuguaccuucagcugcucggccuugggggagcccauggccaaagcaacgcuacagagcacaaugggacgaacaccacaaccguccccuccacaucucagagcccuaagccgcuuguuuccaccacacccccucaugcccuggaaucuagcaccauuaaacccacgaccccuacauccgagaccgaaggaucuggcgagacagcgccccucccuaauaccacgcaggggccgcccccucccgaaacaaccccugagagacccgcuacaaccgugaccagcacaccguccacggacaacaccaauagcacaauccacgugaccgauaacaauccuacaucuaccauuuccacgagccccucuuccagcccuucuacacccuccacaccccagggaauccaucacccugcccggagccugcuguccgucucuagcccgaagaccgccacaacccccacaccuacgucccccggcgagauuaacagcgaaaccucuucccuccacagcgcuaugucucgcacaccuacccugcauacagccacccaagugagcacggagaaugcuaaccacuccgcccccagacagucugaaagcuccgcgcagccgaccacaaccagccuuaugacaucuccugcccaguccauccugcucaugagcgcugcccccaccgcuauccaaaauacgcauccuucucccacaaaccgguccaaacgcaaucuggagauggagauuauccuuacccugagccagggccucaagaaauauuacgggaagauucugaagcugcuccaccugacacuugaagaggacaccgaaggacugcucgagugguguaaaagaaaccugggcuccaauugcgaugacgacuuuuuccagaagcggaucggggaauuuuucaugaccggagagggcuauuuuaacgagguucuucaguucaaaacacugucuacgcucagcccuaccgaacccucccacgcccgccugccgacaguggagccuuuuaagucuuacuucgcgaaaggguuucugagcauugauuccggauauuucagcgccaaguguuaccccagaucuuccaccagcggccuccaacugaucaacgucacacagcaucccgcucggauugccgaaaccccuggcccgaagacgacaucucuuaaaaccaucaauugcaucaaccugcgcgcuuccguguuuaaggagcacagagaaauugagaucaauguucuccugccccagauugccgugaaccuuagcaauugucaugucgugaucaacucucacgugugcgauuauagccuggacaccgaugggccuguccggcucccccauauuuaccacgagggaacauucaucccuggcaccuacaaaaucguuauugacaagaaaaauaagcugaacgaucgcuguacacuggugacgaauugcgugaucaaagggagagaaguccggaagggacaauccgugcuccgccaguauaagaccgagauuaaaaucggcaaggccagcacagggucuagaaaacugcuuuccgaggaacccggagacgauuguauuagccggacccagcugcucagaacagaaaccgcugagauccacgacgacaacuacggcggcccuggggauaagaucacgauuugcaauggauccaccaucguugaccagcgccugggcucugagcugggguguuauacaauuaaccgggugaaauccuuuaagcugugcgaaaauagcgcgaccggaaagacaugcgagaucgauucuacccccgucaaauguagacaaggcuucugccucaagauuacacaggaagggcgcggccaugugaaacugagccggggauccgagguugugcuggacgccugugauucuagcugcgaggucaugaucccgaagggcaccggggacauucucguggauuguuccggaggccagcagcacuuccugaaagacaaccuuaucgaucuggggugcccucauaucccccuccugggaaagauggcuauuuacaucuguagaaugagcaaucacccucgcacgacaauggccuuucuguucugguuuucuuucggcuaugucauuaccugcaucuuuuguaaggcccuuuucuacucccucauuaucaucgggacccugggcaaaaagauuaaacaauaucgggaacugaagccccagacaugcaccaucugugagacggcuccggugaacgccauugacgcggaaaugcacgaucucaacugcagcuacaauaucugcccuuacugugcuucuagacugacauccgacggacuugcccgccauguuccccagugcccuaaacggaaggagaagguggaagagaccgagcuguaucucaaccuggaacgcauucccuggaucgucagaaaacugcuucaggugagcgagucuacaggcguugcccucaagcgguccagcuggcugaucgugcugcucguccugcuuaccgugucccugagccccgugcaaucugcuccuguugggcacggaaaaacaauugaaaccuaccagacgagagagggcuuuaccagcaucugucucuucaugcugggguccauucuguuucuugucucuugccucgugaagggacugguggacagcgucuccgauucuuucuuuccgggccugagcguguguaaaacaugcuccaucgggucuauuaauggcuucgaaaucgagagccauaaguguuauugcucccucuuuuguugccccuacugucggcacugcagcgccgaccgcgagauccaucagcugcaccuuucuauuugcaaaaagagaaagaccggauccaacguuaugcuggcuguguguaaacggaugugcuucagagccacaaucgaagcgagccgccgggcccuccugauuagaucuaucauuaauaccacguucgucaucuguauucugacacuuaccaucugcgugguuuccacaagcgcuguggagauggaaaaccugccugccggcaccugggagcgcgaagaggaucucaccaauuuuugucaccaggagugccaagucacagaaacggagugucugugccccuaugaagcucucgugcugagaaagccucuuuuccuggacuccaucguuaaagggaugaagaaccuccuuaauucuaccagccuggagacaucccugagcauugaggcccccuggggagcgaucaacgugcagucuaccuuuaaaccuacagucuccaccgccaauauugcucugagcuggucuagcguggaacaucggggcaacaagauccucgugacggggcgcuccgagucuauuaugaagcuggaagagagaacaggagucagcugggaucucggcguugaagacgccuccgagucuaaacugcuuaccgugagcaucauggaucugucccagauguacagcccgguguucgaguaucucucuggggaccggcaagucgaagaguggcccaaggcuaccuguacaggcgauugcccugaacgcuguggaugcaccuccagcacaugccugcacaaagaguggccccauuccagaaauuggcgguguaacccuacguggugcuggggcguggggaccggauguacaugcuguggcguugacgugaaggaucuguuuaccgaccacauguucgucaaauggaagguggaauacaucaagacagaggccauuguuugcguggagcuuaccucucaggaacgccaguguagccugaucgaggccgggacgagauuuaaucucggacccgucaccauuacacuguccgaaccgcggaacauccagcaaaaacucccucccgagauuaucacccugcaucccaagguggaagagggcuucuuugaucuuaugcacguucagaaagugcugucugcuagcacagucugcaagcugcaguccuguacccacggcaucccuggggaccuccagguguaccauauuggaaaccugcuuaaaggcgaccgcaucaaugggcaccugauucauaagaucgagccccacuucaacacaagcuggaugucuugggauggaugcgaccucgauuauuacuguaauaugggcgacuggccuuccugcacguauaccggggugacacaacacaaccaugcggccuuugucaaucugcucaacauugaaaccgauuacaccaagacauuccacuuucauagcaaaagaguuacggcucacggagacaccccgcagcuggaucuuaaggcccggcccacauauggcgccggcgagaucaccgugcugguggaagucgcugacauggagcugcauaccaaaaagguggagauuucugggcucaaauucgccucccuggcgugcaccggauguuacgcuugcagcucuggcaucagcuguaagguuagaauccacguggaugaaccugacgagcuuacgguccacgugaaauccucugaucccgacguuguggccgccagcacaucccugauggcucgcaagcucgaguucgggaccgauagcaccuuuaaggccuucuccgcgaugccuaaaacaucucugugcuuuuauauugucgaacgggaauacuguaagagcugcuccgaggaggacacccagaaauguguggacacaagacucgaacagccccaaucuauccugauugagcauaagggaaccaucauuggcaaacagaaugauacgugcacagcuaaggccagcuguuggcuugaauccgucaagucuuucuuuuacgggcugaaaaacaugcugggaagcguguucggcaacuuuuucaucggcauccuccuguuucuugccccguucguucugcucgugcuguuuuucauguucggguggaagauucucuuuugcuucaaauguugccgccggaccagaggacugcuuaaguaucgccaccugaaagacgaugaggaaacaggcuaccggagaaucauugagcgccugaauaauaagaaggggaaaaaccggcuccuggacggagagagacuugcugaucggaagaucgccgaacuguuuuccaccaaaacgcauauuggcuga

SEQ ID NO: 13710 - RNA, 5052 nt, Artificial Sequence
  derived and/or modified CDS sequence (opt5) from CCHFV(5180-R-2011)__KR814874.1__GP
augcacacccugcucgugugcuucauccuguaccuucagcugcucggccuugggggagcccauagacaaagcaacgcuacagagcacaauggcacgaacaccacaaccgcccccuccacaucucagagcccuaagccgcccgucuccaccgcgccucccuaugcuccugaaucuagcacaauuaaacccaccacgccugccuccgagaccgaagggucuggagagacaaccccgcccccuaauacaacccagggccccagcccucccgaagccacgccggagcggccugcuacaaccgccacauccacccccagcaccgacaacacaaauucuacgacccaugcuacagauaacaauccuaccuccacaaucagcaccucucccuccagcucucccuccacgccuagcacaccgcaggggauucaccaucccgcccgcaaccugcuguccguuucuagcccuaagaccgcgaccacacccaccccuacaucccccggagacaucagcucugagacguccagccuccacucugccaugagcagaaccccgacacugcacaccgcuacacaagccuccaccgaaaaugcuaaccauucugccccucggcagagcgaguccagcgcgcagcagacgaccacaucucccaugaccuccccugcccaacccauucuggugaugagcgcugccccuacagcuauccagaauauccaccccucuccgaccaaccgcuccaaaagaaaucucgaaauggagauuauccugacgcuuagccagggccugaagaaauacuauggcaagauucucaagcugcuucaucugacacucgaggaagauaccgaggggcugcuggaaugguguaaacggaaccucggauccaauugcgacgaugacuuuuuccagaagcgcaucgaggaauuuuucaugacaggcgagggguacuuuaacgaggugcugcaauucaaaacccuuucuacccugagcccuacagaacccucccacgccagacccccuacggucgagccguuuaagucuuauuucgccaaaggauuucucagcauugauuccggcuacuucagcgcuaaguguuauccccggcugucuaccuccgggcuucagcugaucaacgugacacagcacccugcgcgcauugccgaaacccccggaccuaagacaaccagccucaaaacgaucaauugcaucaaccugagagcuucuguuuuuaaggagcaucgggaaauugagaucaaugugcugcucccccaaauugccgucaaccuguccaauugucacgugguuaucaacagccaugugugcgacuacucucuugauacagacggcccuguccgccugccccacauuuaccaugagggcaccuucaucccggggaccuauaaaaucgugauugauaagaaaaauaagcucaacgacagauguacacuggugaccaauugcgucaucaaaggacgggaaauucgcaagggccagagcguucuuagacaguacaagacagagaucaaaauugggaaggccuccacgggaagccggaaacugcucucugaagaaccuggcgaugacuguaucuccagaacccagcugcugcgcacagaaaccgcugagauccacgacgauaacuaugggggacccggcgacaagauuacaaucugcaauggcagcaccauuguggaucaacggcucggguccgagcugggauguuacacgaucaacagagugaaaucuuuuaaacuuugcgaaaauagcgccaccggcaagacaugcgagauugacuccaccccugucaaaugucgccagggguucugccugaagaucacacaggaaggacggggccacgugaaacucucuagagggagcgagguugugcuggaugcgugugacaccuccugcgaggucaugauucccaagggcacaggagauauccugguggacuguucuggcgggcagcaacauuuccuuaaagauaaccucaucgaccugggaugcccgcacauuccucugcucggcaagauggcuaucuauauuugucgcaugagcaaucauccccggaccacgauggccuuucuguucugguuuuccuucggguacguuaucacaugcauuuucuguaaggcccuuuucuauagccugaucaucauuggaacccucggcaaaaagaucaaacaguacagagaacugaagccucagaccugcacaauuugugagaccgcucccgugaacgccaucgaugcugaaaugcacgaccugaacugcucuuacaauauuugccccuauugugccucccgccuuacgagcgacgggcucgcgcggcacgucccucagugcccgaaaagaaaggagaagguggaagagacagagcuguaccugaaccucgaacgcauccccuggaucguccggaaacugcuucaagugucugaguccaccggcguugcccugaagagaagcucuuggcucauugugcugcugguccuucucacagugucccugagcccuguucaguccgcucccgugggacauggcaaaaccaucgaaacauaucagacccgggagggguuuacgagcgucugucuguucaugcucggaucuauucuguuucuugugagcugccuggugaagggccucguugauuccgucucugacagcuucuuuccugggcuguccguguguaaaaccugcucuaucggaagcauuaauggcuucgaaaucgagucccacaaguguuacugcucucuguuuuguugccccuauugucgccauugcagcgccgauagagagauccaccagcuucaucucuccauuugcaaaaagcggaagauggggagcaacgugaugcuggcugucuguaaaagaaugugcuuccgcgccacaaucgaagcgucucggagagcccugcucauucgcuccaucauuaauaccacauucgugaucuguauucugacccuuacgaucugcguugugagcacaucugcugucgagauggaaaaccugccuuccggcaccugggagagagaagaggaccucacaaauuuuugucaccaagagugccaggugaccgaaaccgagugucugugcccguacgaagcccugguucuucggaagccccuguuccucgauagcaucgugaaaggaaugaagaaccugcucaauuccacaucucuggagacgagccuuuccauugaggcuccuuggggcgccaucaacguccagagcaccuuuaaacccacagugucuaccgccaauauugcucuguccuggagcucuguugaacaccgcgggaacaagauccucgugacaggaagaagcgaguccauuaugaagcuggaggagcggaccggcgucucuugggaccuggggguggaagaugcgagcgaguccaaacuucugacggugucuaucauggaccucagccaaauguauuccccugucuucgaguaccugagcggagaucgccagguugaagaguggcccaaggccacauguaccggcgacugcccggaaagaugugggugcaccucuuccacaugccuccauaaagaguggccucacagccggaauuggcgcuguaaccccaccuggugcuggggcgugggaacaggcuguacgugcugugggguggaugucaaggaccuguuuaccgaucauauguucgugaaauggaagguugaauacaucaagacagaggcuauugugugcgucgagcuuaccucccaggaaagacaguguucucugaucgaggccggaacacgguuuaaucucggccccgugaccauuacgcugagcgaaccucgcaacauccaacagaaacugcccccugagauuaucacccuucacccgaagguugaagagggguucuuugaccugaugcaugugcagaaaguccucuccgccucuacagugugcaagcugcagagcuguacccacggaauccccggcgaccuccaaguuuaucacauuggcaaccugcuuaaaggggauagagugaauggacaucugauccacaagauugagccucauuucaacacauccuggaugagcugggacggcugcgaucuggacuacuauuguaauaugggggauuggcccucuugcaccuacacaggagucacgcagcacaaccacgcugccuuugugaaucuccugaacaucgaaaccgacuauacaaagaccuuccauuuucacuccaaacgggugaccgcgcauggcgauacaccucagcuugaccugaaggcuagacccacguacggggccggagagauuaccguccucguugaaguggccgauauggagcugcacaccaaaaagguggagaucagcggccucaaauucgcuucucuggccugcacaggcuguuaugcgugcuccagcgggauuucuuguaagguccgcauccauguggacgaaccggaugagcuuacaguucacgugaaaagcaaugacccugaugucguggcugccuccaccucucugauggcccggaagcuggaauuuggaacggacagcacauuuaaggcuuucuccgccaugcccaaaaccagccucugcuuuuacaucguugagagagaauacuguaaguccugcucugaggaggacacccagaaauguguggauacaaagcuggaacaaccucagagcauucuuaucgagcacaaaggcaccauuaucgggaagcagaacgacacaugcaccgcuaaggccuccuguuggcuggaaucugucaagagcuucuuuuauggacucaagaauaugcugggcuccguguucgggaacuuuuucauuggaauccuccuguuucuugcgcccuucguccugcuggugcucuuuuucauguucggcuggaaaauccuguuuugcuucaaguguugccgccggacgagaggccuucugaaauaccgccuccugaaggaugacgaggaaacaggguaucggagaauuaucgagcgccucaauaacaagaaaggaaagaaucggcugcuugauggcgagagacuggccgaccggaaaauugcugaacuguuuucuaccaagacacauaucggguga

SEQ ID NO: 13711 - RNA, 5052 nt, Artificial Sequence
  derived and/or modified CDS sequence (opt5) from CCHFV(24-R-2012)__KR814856.1__GP
augcacacccugcucgugugcuucauccuguaccuucagcugcucggccugggaggagcccauagacaaagcaacgcuacagagcacaauggcacgaacaccacaaccgcccccuccacaucucagagcccuaagccgcccgucuccaccgcgccuccccaugcuccugaaucuagcacaauuaaacccaccacgccugccuccgagaccgaagggucuggagagacaaccccgcccccuaauacaacccagggccccagcccucccgaagccacgccggagcggacagcuaccacagccaccuccaccccuagcacagacaacaccaauucuaccacacacgcuaccgauaacaaucccacauccaccaucagcacgucuccuuccagcucucccuccacacccagcaccccucaggggauucaucacccggcccgcaaccuucuguccguuucuagccccaagaccgcgacaaccccuacacccacguccccuggagacaucagcucugagaccuccagccuccacucugccaugagcagaacacccacccugcauacagcuacccaagccuccacggaaaaugcuaaccacucugccccgcggcagagcgaguccagcgcgcagcagaccacaaccucuccuaugacaucccccgcccaaccuauucuggugaugagcgcugcccccaccgcuauccagaauauccauccuucucccacgaaccgcuccaaaagaaaucucgaaauggagauuauccugacacuuagccagggccugaagaaauauuacggcaagauucucaagcugcuucaccugacccucgaggaagauacagaggggcugcuggaaugguguaaacggaaccucggauccaauugcgacgaugacuuuuuccagaagcgcaucgaggaauuuuucaugaccggcgagggguauuuuaacgaggugcugcaauucaaaacccuuucuacacugagcccgacggaaccuucccacgccagaccucccaccgucgagcccuuuaagucuuacuucgccaaaggauuucucagcauugauuccggcuauuucagcgcuaaguguuacccgcggcugucuacauccgggcuucagcugaucaacgugacccagcaucccgcgcgcauugccgaaacaccuggacccaagaccacgagccucaaaacaaucaauugcaucaaccugagagcuucuguuuuuaaggagcaccgggaaauugagaucaaugugcugcucccucaaauugccgucaaccuguccaauugucaugugguuaucaacagccacgugugcgacuauucucuugauaccgacggccccguccgccugccucauauuuaccacgagggcaccuucauccccgggacauacaaaaucgugauugauaagaaaaauaagcucaacgacagauguacccuggugacaaauugcgucaucaaaggacgggaaguucgcaagggccagagcgugcuuagacaguauaagacggagauuaaaaucgggaaggccuccaccggaagccggaaacugcucucugaagaaccgggcgaugacuguauuuccagaacacagcugcugcgcaccgaaacagcugagauccacgacgauaacuacgggggaccuggcgacaagaucaccauuugcaauggcagcacgaucguggaucaacggcucggguccgagcugggauguuauaccauuaacagagucaaaucuuuuaaacuuugcgaaaauagcgccacaggcaagaccugcgagaucgacuccacacccgugaagugucgccagggguucugccugaagauuacccaggaaggacggggccauguuaaacucucuagagggagcgaggugguccuggaugcgugugacacauccugcgaggugaugaucccuaagggcaccggagauauucugguugacuguucuggcgggcagcaacacuuccuuaaagauaaccucaucgaccugggaugcccccauaucccgcugcucggcaagauggcuauuuacaucugucgcaugagcaaucacccucggacgacaauggccuuucuguucugguuuuccuucggguaugugauuaccugcaucuuuuguaaggcccuuuucuacagccugauuaucaucggaacccucggcaaaaagauuaaacaguauagagaacugaagccccagacaugcaccaucugugagacggcuccugucaacgccauugaugcugaaaugcacgaccugaacugcucuuacaauaucugccccuacugugccucccgccuuacaagcgacgggcucgcgcggcaugugccccagugcccuaaaagaaaggagaaggucgaagagaccgagcuguaucugaaccucgaacgcauuccguggaucgugcggaaacugcuucaaguuucugaguccacaggcguggcccugaagagaagcucuuggcucaucguccugcuggugcuucucaccguuucccugagccccgugcaguccgcuccugucggacacggcaaaacaauugaaaccuaccagacgcgggagggguuuaccagcgugugucuguucaugcucggaucuauccuguuucuugugagcugccugguuaagggccucgucgauuccgugucugacagcuucuuucccgggcuguccguguguaaaacaugcucuauuggaagcaucaauggcuucgaaauugagucccauaaguguuauugcucucuguuuuguugcccuuacugucgccacugcagcgccgauagagagauccaucagcuucaccucuccaucugcaaaaagcggaagauggggagcaacgucaugcuggcuguguguaaaagaaugugcuuccgcgccaccauugaagcgucucggagagcccugcucauccgcuccauuaucaauacaaccuucguuauuuguauccugacgcuuacaauuugcguggucagcaccucugcuguggagauggaaaaccugcccuccggcacaugggagagagaagaggaccucaccaauuuuugucaccaagagugccagguuaccgaaacagagugucugugcccuuaugaagcccuggugcuucggaagccgcuguuccucgauagcaucgucaaaggaaugaagaaccugcucaauuccacgucucuggagaccagccuuuccaucgaggcucccuggggcgccauuaacgugcagagcacauuuaaaccuaccguuucuacagccaauaucgcucuguccuggagcucuguggaacaucgcgggaacaagauucucgucaccggaagaagcgaguccaucaugaagcuggaggagcggacgggcgugucuugggaccuggggguggaagaugcgagcgaguccaaacuucugacagucucuauuauggaccucagccaaauguacucccccguuuucgaguaucugagcggagaucgccagguggaagaguggccuaaggccaccuguaccggcgacugccccgaaagaugugggugcacaucuuccacgugccuccacaaagaguggccgcauagccggaauuggcgcuguaacccuacauggugcuggggcgugggaacgggcuguaccugcuguggggucgaugugaaggaccuguuuacagaucacauguucguuaaauggaagguggaauacaucaagaccgaggcuaucgucugcguggagcuuacaucccaggaaagacaguguucucugauugaggccggaacccgguuuaaucucggccccguuacgaucacccugagcgaaccccgcaacauucaacagaaacugccucccgagaucauuacacuucauccuaagguggaagagggguucuuugaccugaugcacguccagaaagugcucuccgccucuaccguuugcaagcugcagagcuguacacacggaaucccgggcgaccuccaaguguaccauaucggcaaccugcuuaaaggggauagagucaauggacaccugauucauaagaucgagccccacuucaacaccuccuggaugagcugggacggcugcgaucuggacuauuacuguaauaugggggauuggccuucuugcacauauacgggagugacccagcacaaccaugcugccuuugugaaucuccugaacauugaaacagacuacaccaagaccuuccacuuucauuccaaacgggucacagcgcacggcgauacgccccagcuugaccugaaggcuagaccuaccuauggggccggagagaucacaguucucguggaaguggccgauauggagcugcauaccaaaaaggucgagauuagcggccucaaauucgcuucucuggccugcacaggcuguuacgcgugcuccagcgggaucucuuguaaggugcgcauucacguugacgaacccgaugagcuuaccgugcacgucaaaagcaaugacccggaugugguugcugccuccacgucucugauggcccggaagcuggaguucggaacagacagcaccuuuaaggcuuucuccgccaugccuaaaaccagccucugcuuuuauaucguggaaagagaauacuguaaguccugcucugaggaggacacacagaaaugugucgauaccaagcuggaacaaccccagagcauccuuauugagcauaaaggcacaaucauugggaagcagaacgauaccugcacggcuaaggccuccuguuggcuggaaucugugaaauccuucuuuuacggacucaagaauaugcugggcagcgucuucgggaacuuuuucaucgggauucuccuguuucuugcgccuuucgugcugcugguucucuuuuucauguucggcuggaaaauccuguuuugcuucaaguguugccgccggacaagaggccuucugaaauaucgccuccugaaggacgacgaggaaaccggguaccggagaaucauugagcgccucaauaacaagaaaggaaagaaucggcugcuugauggcgagagacuggccgaccggaaaaucgcugaacuguuuucuacaaagacccacauuggguga

SEQ ID NO: 13712 - RNA, 5052 nt, Artificial Sequence
  derived and/or modified CDS sequence (opt5) from CCHFV(46-ST-2012)__KR814860.1__GP
augcacacccugcucgugugcuucauccuguaccuucagcugcucggccuugggggagcccauggccaaagcaacgcuacagagcacaaugggacgaacaccacaaccguccccuccacaucucagagcccuaagccgcuuguuuccaccacacccccucaugcccuggaaucuagcaccauuaaacccacgaccccuacauccgagaccgaaggaucuggcgagacagcgccccucccuaauaccacgcaggggccgcccccucccgaaacaaccccugagagacccgcuacaaccgugaccagcacaccguccacggacaacaccagcucuacaauccacgugaccgauaauaacccuacauccaccauuagcacgucucccuccagcucuccuuccacacccagcacaccccagggaauccaucacccugcccggucccugcugucugucagcuccccgaagaccgccacaacccccacaccuacgagccccggcgagauuaauucugaaaccuccagccuccacucugcuaugagccgcacaccuacccugcauacagccacccaaguguccacggagaacgcuaaucacucugcccccagacagagcgaauccagcgcgcagccgaccacaaccucucuuaugacauccccugcccagagcauccugcucaugucugcugcccccaccgcuauccaaaacauucauccuucccccacgaaucggagcaaacgcaaccuggagauggagaucauucuuacacugucccagggccucaagaaauauuacgggaagauccugaagcugcuccaccugacccuugaagaggacacagaaggacugcucgagugguguaaaagaaaucugggcucuaacugcgaugacgacuuuuuccagaagcggauugaagaguuuuucaugaccggggagggauauuuuaaugaaguucuucaguucaaaacccugagcacacucuccccuacggagcccucucacgcccgccugccgaccguggaaccuuuuaagagcuacuucgcgaaaggcuuucuguccgucgauagcggguauuucucugccaaguguuaccccagauccagcacaucuggacuccaacugaucaacgugacccagcaucccgcucggauugccgagacaccuggcccgaagaccacgucccuuaaaacaaucaacugcaucaaucugcgcgcuagcguuuuuaaggaacacagagagauugagaucaacgugcuccugccccagauugccgucaaucuuucuaacugucauguggugaucaauagccacgucugcgauuauucccuggacaccgauggcccuguucggcucccccauauuuaccacgaagggaccuucaucccuggaacauacaaaaucgugauugacaagaaaaacaagcugaaugaucgcuguacccuggugacaaacugcgucaucaaaggcagagaggugcggaaggggcaaagcguucuccgccaguauaagacggaaauuaaaaucggaaaggccucuaccggcuccagaaaacugcuuagcgaggaacccggggacgauuguauuucccggacacagcugcucagaaccgagacagcugagauccacgacgacaauuacggaggcccuggcgauaagaucaccauuugcaacgggucuacgaucguggaccagcgccugggaagcgaacugggcuguuauaccauuaaucgggucaaauccuuuaagcugugcgagaacucugcgacagggaagaccugcgaaaucgauagcacacccgugaaauguagacaaggauucugccucaagauuacccaggagggccgcgggcauguuaaacugucccggggcucugaggugguccuggacgccugugauagcuccugcgaagugaugaucccgaagggaacaggcgacauucucgucgauuguagcgggggacagcagcacuuccugaaagacaaucuuaucgaucugggcugcccucauaucccccuccuggggaagauggcuauuuacaucuguagaaugucuaaccacccucgcaccacgauggccuuucuguucugguuuuccuucggauaugugauuacaugcaucuuuuguaaggcccuuuucuacagccucauuaucaucggcacccuggggaaaaagauuaaacaauaucgggagcugaagccccagaccugcacaaucugugaaaccgcuccgguuaaugccauugacgcggagaugcacgaucucaacugcucuuacaacaucugcccuuacugugcuuccagacugacgagcgacggccuugcccgccaugugccccagugcccuaaacggaaggaaaaggucgaggagacagaacuguaucucaaucuggagcgcauucccuggaucgugagaaaacugcuucagguuucugaauccaccggaguggcccucaagcggagcuccuggcugaucguccugcucgugcugcuuacagugagccugucucccguucaaagcgcuccugucggccacgggaaaaccauugagacauaccagaccagagaaggauuuacguccaucugucucuucaugcugggcucuauucuguuucuugugagcugccucgugaaggggcuggucgacuccgugucugauagcuucuuuccgggacuguccguuuguaaaaccugcucuaucggcagcauuaacggguucgagaucgagucccauaaguguuauugcagccucuuuuguugccccuacugucggcacugcucugccgaccgcgaaauccaucagcugcaccuuuccauuugcaaaaagagaaagacaggcagcaaugugaugcuggcugucuguaaacggaugugcuucagagccaccaucgaggcgucucgccgggcccuccugauuagauccaucauuaacgcuacauucgugaucuguauucugacccuuacgaucugcguugugagcacauccgccgucgaaauggagucucugccugcuggaaccugggaacgcgaggaggaucucacaaauuuuugucaccaggaaugccaagugaccgagaccgaaugucugugccccuaugaggcccucguucugagaaagccucuuuuccuggacagcaucgugaaaggcaugaagaaccuccuuaauuccacaagccuggagacgucucuguccauugaagcgcccuggggagccaucaacguccagagcaccuuuaaaccuacagugucuaccgcuaauauugcccugagcugguccucuguggagcaucgggggaacaagauccucgucacaggccgcagcgaauccauuaugaagcuggaggaaagaaccgggguuucuugggaucucggaguggaggacgcuagcgaguccaaacugcuuacggugagcaucauggaucugucucagauguacuccccggucuucgaauaucucagcggcgaccggcaaguggaggaauggcccaaggccacauguaccggggauugcccugagcgcuguggcugcaccuccucuacaugccugcacaaagaauggccccauagcagaaauuggcgguguaacccuaccuggugcuggggaguuggcacaggguguacgugcuguggaguggacgucaaggaucuguuuaccgaccacauguucgugaaauggaagguugaguacaucaagacagaggccauugugugcgucgaacuuaccucccaggagcgccaguguucucugaucgaagcuggcacaagauuuaaucucgggcccgugaccauuacgcugagcgagccgcggaacauccagcaaaaacucccucccgaaauuaucacccugcaucccaagguugaggagggauucuuugaucuuaugcacgugcagaaaguccuguccgcgagcacagugugcaagcugcagucuuguacccacggcaucccuggcgaccuccagguguaccauauugggaaucugcuuaaaggagaccgcaucaacggccaccugauucauaagaucgaaccccacuucaacacauccuggaugagcugggaugggugcgaccucgauuauuacuguaauaugggagacuggccuucuugcaccuauacaggcgucacgcaacacaaccaugccgcuuuuguuaaucugcucaacauugagaccgauuacacaaagaccuuccacuuucauuccaaaagagugaccgcccacggggacacaccgcagcuggaucuuaaggcccggcccacguauggagcuggcgaaaucaccgugcuggucgagguggccgacauggagcugcauaccaaaaagguugaaauuagcggccucaaauucgcgucucuggcuugcaccggguguuacgccugcagcuccggaaucucuuguaaggugagaauccacgucgaugagccugacgaacuuacagugcacguuaaaagcuccgaucccgacguggucgccgcuagcaccucccugauggcccgcaagcucgaguucggcacggauucuacauuuaaggcguucagcgcuaugccuaaaaccucccugugcuuuuauauuguggaacgggaguacuguaagucuugcagcgaggaagacacccagaaaugugucgacacaagacucgagcagccccaauccauccugauugaacauaaggggaccaucauuggaaaacagaaugauacaugcaccgccaaggccucuuguuggcuugagagcgugaaguccuucuuuuacggccugaaaaacaugcuggggagcguuuucggaaacuuuuucaucggcauccuccuguuucuugcuccguucgugcugcucguccuguuuuucauguucggcuggaagauucucuuuugcuucaaauguugccgccggacgagagggcugcuuaaguaucgccaccugaaagacgaugaagagacaggauaccggagaaucauugagcgccugaauaauaagaagggcaaaaaccggcuccuggacggggaaagacuugccgaucggaagaucgcugagcuguuuucuaccaaaacacauauuggauga

SEQ ID NO: 13713 - RNA, 5052 nt, Artificial Sequence
  derived and/or modified CDS sequence (opt5) from CCHFV(ROS/HUVLV-100)__DQ206448.1__GP
augcacacccugcucgugugcuucauccuguaccuucagcugcucggccuugggggagcccauagacaaagcaacgcuacagagcacaauggcacgaacaccacaaccgcccccuccacaucucagagcccuaagccgcuugucuccaccgcgcccccucaugcucuggaaucuagcacaauuaaacccaccacgccuguuuccgagaccgaagggucuggagagacaacgcccccuccgaauacaacccagggccccagcccucccgaagccacgccugagcggcccacaaccacagccaccuccaccccgagcacagacaacaccaauucuaccacacacgugaccgauaacaauccuacauccaccaucagcacgucucccuccagcucuccuuccacacccagcacaccccaggggauucaucacccugcucgcaaccuccuguccgugucuagcccgaagaccgccaccacccccacaccuacgucccccggagagaucagcucugaaaccuccagccugcacucugcuaugagcagaacauccacccucuauacagccacccaagucucuacggagaaugcgaaccauagcgccccucggcaguccgaaagcucugcucagcagaccacaaccucccccaugacaagcccggcccaaucuauucuggugauguccgcugccccuaccgcgauccagaauauccaccccagcccuacgaaccgcuccaaaagaaaucuugagauggagauuauccugacacucucucagggccugaagaaauacuauggcaagauucuuaagcugcuccaucugacccuggaagaggacacagaagggcuccuggagugguguaaacggaaccuuggaagcaauugcgaugacgacuuuuuccagaagcgcaucgaagaguuuuucaugaccggcgagggguacuuuaacgaaguucugcaauucaaaacccucuccacacugucucccacggagccuagccacgccagacccccgaccguggaaccuuuuaaguccuauuucgcuaaaggauuucuuagcauugauucuggcuacuucuccgccaaguguuauccccggcugagcacaucugggcuccagcugaucaacgucacccagcaccccgcucgcauugccgagacaccuggaccgaagaccacgucccugaaaacaaucaauugcaucaaccucagagccagcguguuuaaggaacaucgggagauugagaucaauguucugcuuccccaaauugcugugaaccugucuaauugucacgucgugaucaacagccaugugugcgauuacucccucgacaccgauggcccuguccgccugccccacauuuaccaugaaggcaccuucaucccugggacauauaaaaucguuauugacaagaaaaauaaacuuaacgauagauguacccuggugacaaauugcgugaucaagggacgggagguccgcaagggccagagcgugcucagacaguacaagacggaaauuaaaaucgggaaggcgucuaccggaucccggaaacugcugagcgaggaacccggcgacgauuguauuuccagaacacagcuccugcgcaccgagacagccgagauccacgacgacaacuaugggggaccuggcgauaagaucaccauuugcaauggcucuacgaucguugaccaacggcuugggagcgaacugggauguuacaccauuaacagagugaaauccuuuaagcucugcgaaaauucugcuacaggcaagaccugcgagaucgauagcacacccgucaaaugucgccagggguucugccugaagauuacccaggagggacggggccacgugaaacuguccagagggucugagguugugcuugacgccugugauagcuccugcgaagucaugaucccgaagggcacaggagacauucucguggauuguagcggcgggcagcaacauuuccugaaagacaaccugaucgaucucggaugcccucacaucccccugcuuggcaagauggccauuuauaucugucgcaugucuaaucauccucggaccacgauggcuuuucuguucugguuuuccuucggguacgucauuacaugcaucuuuuguaaggcccucuucuauagccugauuaucaucggaacccugggcaaaaagauuaaacaguacagagagcuuaagccccagaccugcacaaucugugaaaccgcgccggugaacgcuauugacgccgagaugcacgaucucaacugcucuuacaauaucugcccuuauugugccucccgccugacgagcgacgggcuggcucggcacguuccccagugcccuaaaagaaaggaaaagguggaggagacagaacucuaccugaaccuugagcgcauucccuggaucguccggaaacugcuccaagugucugaauccaccggcguugcccugaagagaagcuccuggcugaucgugcuucucguccugcugacagugagccucucucccgugcagagcgcuccuguuggacauggcaaaaccauugagacauaucagacccgggaaggguuuacguccaucugucuguucaugcuuggaucuauucuguuucucgucagcugccuggugaagggccugguggacuccgucucugauagcuucuuuccggggcuuuccguguguaaaaccugcucuaucggaagcauuaauggcuucgagaucgagucccacaaguguuacugcagccucuuuuguugccccuauugucgccauugcucugccgacagagaaauccaccagcugcaucuguccauuugcaaaaagcggaagacagggagcaacguuaugcucgcgguguguaaaagaaugugcuuccgcgccaccaucgaggcuucucggagagcccugcuuauucgcuccaucauuaauacaaccuucgucaucuguauucugacgcucacaaucugcgugguuagcaccuccgcuguggaaauggagaaccugccuucuggcacaugggaaagagaggaggaucugaccaauuuuugucaccaagaaugccaggucaccgagacagaaugucuuugccccuacgaggcccuggugcuccggaagccucuguuccucgacagcaucguuaaaggaaugaagaaccugcuuaauuccacgagccuggagaccucucucuccauugaagcgcccuggggcgccaucaacgugcagagcacauuuaaaccuaccgucucuacagcuaauauugcccugagcugguccucuguggagcaccgcgggaacaagauccuggugaccggaagaagcgaauccauuaugaaacuugaggaacggacgggcgucucuugggaucuggggguugaggacgcuagcgaguccaagcuccugacagugagcaucauggaucucucucaaauguauuccccgguguucgaauaccugagcggagaccgccaggucgaggaauggcccaaggccaccuguaccggcgauugcccugagagaugugggugcacauccucuaccugccuucauaaagaauggccccacagccggaauuggcgcuguaacccuacauggugcuggggcgugggaacgggcuguaccugcugugggguugacgugaaggaucuguuuacagaccauauguucgucaaauggaagguggaguacaucaagaccgaggccauuguuugcguggaacucacaucccaggagagacaguguucucugaucgaagcuggaacccgguuuaaucugggccccgucacgauuacccuuagcgagccgcgcaacauccaacagaaacugccucccgaaauuaucacacuccaccccaagguggaggagggguucuuugaucugaugcauguucagaaagugcucuccgcgagcaccgucugcaagcugcagucuuguacacacggaaucccuggcgaccuucaaguguaucacauuggcaaccugcugaaaggggacagagugaauggacaucucauccacaagauugaaccccauuucaacaccuccuggaugagcugggauggcugcgaccuggauuacuauuguaauaugggggacuggccuucuugcacauacacgggagucacccagcacaaccacgccgcuuuuguuaaucuucugaacaucgagacagauuauaccaagaccuuccauuuucacuccaaacgggugacagcccauggcgacacgccgcagcucgaucugaaggccagacccaccuacggggcuggagaaauuacagugcucgucgagguggccgacauggagcugcacaccaaaaagguugaaaucagcggccuuaaauucgcgucucuggcuugcacaggcuguuaugccugcagcuccgggauuucuuguaaggugcgcauccaugucgaugagccugacgaacugaccgugcacguuaaaagcuccgaucccgacguggucgccgcuagcacgucccucauggcccggaagcuggaguucggaacagauucuaccuuuaaggcguucagcgcuaugccuaaaaccucccuuugcuuuuacaucguggaaagagaguacuguaagucuugcagcgaggaagacacacagaaaugugucgacaccaagcuggagcaaccccaguccauucucaucgaacacaaaggcacaauuaucgggaagcagaaugauaccugcacggccaaggccucuuguuggcuggagagcgugaaauccuucuuuuauggacucaagaacaugcugggcagcguuuucgggaacuuuuucauuggaauccuucuguuucuggcuccguucgugcuccugguccuguuuuucauguucggcuggaaaauccuguuuugcuucaaguguugccgccggacaagaggccuccugaaauaccgccuccugaaggacgaugaagagaccggguaucggagaauuaucgagcgccuuaauaauaagaaaggaaagaaccggcugcuggacggcgaaagacucgccgaucggaaaauugcugagcuguuuucuacaaagacccauaucggguga

SEQ ID NO: 13714 - RNA, 5052 nt, Artificial Sequence
  derived and/or modified CDS sequence (opt5) from CCHFV(Saf)__KX013487.1__GP
augcacacccugcucgugugcuucauccuguaccuucagcugcucggccuugggggagcccauggccaaagcaacgcuacagagcacaaugggacgaacaccacaaccgcccccuccacaucucagagcccuaagccgcuugucuccaccgcgcccccucaugcucuggaaucuagcacaauuaaacccaccacgccugccuccgagaccgaaggaucuggcgagacaacgcccccuccgaauacaacccaggggcccagcccucccgaaacgacaccugagagacccgccaccacagcuaccuccaccccgagcacagacaacaccaauucuaccacacacguuaccgauaacaauccuacauccaccaucagcacgucucccuccagcucuccuuccacacccagcacaccccaggggauucaucacccugcccggaaccuccuguccgugucuagcccgaagaccgcuaccacccccacaccuacgucccccggcgagaucagcucugaaaccuccagccugcacucugccaugagccgcacauccacccucuauacagcgacccaagugucuacggagaaugccaaccauagcgcuccuagacaguccgaaagcucugcccagcccaccacaaccuccccgaugacaagcccugcucagucuauucuggucauguccgccgcgcccaccgccauccaaaauauccacccuagccccacgaaccgguccaaacgcaaucuugagauggagauuauccugacacucucucagggccugaagaaauacuaugggaagauucuuaagcugcuccaucugacccuggaagaggacacagaaggacuccuggagugguguaaaagaaaccuuggcagcaauugcgaugacgacuuuuuccagaagcggaucgaagaguuuuucaugaccggggagggauacuuuaacgaagugcugcaguucaaaacccucuccacacugucuccuacggagcccagccacgcucgcccgccuaccguugaacccuuuaaguccuauuucgccaaaggcuuucuuagcauugauucuggguacuucuccgcuaaguguuaucccagaagcucuacauccggacugcaacucaucaacgugacccagcacccugcccggauugccgagacaccgggccccaagaccacgagccugaaaacaaucaauugcaucaaccugcgcgcuucugucuuuaaggaacauagagagauugagaucaaugugcuccugccucagauugcgguuaaccuuagcaauugucacguggucaucaacucccaugugugcgauuacagccuggacaccgauggccccgugcggcucccucacauucaucacgaagggaccuucauccccggaacauacaaaaucgucauugacaaggagaauaaacugaacgaucgcuguacccuuguuacaaauugcgugaucaagggcagagaagugcggaaagggcaaucuguccugcgccaguauaagacggagauuaagaucggaaaagccuccaccggcagcagaaagcuccuguccgaggaaccuggggacgauuguauuucucggacacagcugcucagaaccgagacagcugaaauccacgacgacaacuacggaggccccggcgauaaaaucaccauuugcaaugggagcacgaucguggaccagcgccugggauccgagcuuggcuguuauaccauuaaccggguuaagucuuuuaaacugugcgaaaauagcgccacagggaagaccugcgagaucgauuccacaccggugaaguguagacaaggauucugccucaaaauuacccaggagggccgcgggcaugucaagcugucucggggcagcgaagugguucuggacgccugugauuccagcugcgaggugaugaucccuaaaggaacaggcgacauucuugucgauuguucugggggacagcagcacuaccucaaggacaaccugaucgaucugggcugcccccauaucccucuccuggggaaaauggcuauuuauaucuguagaauguccaaucacccccgcaccacgauggccuuccuguuuugguucagcuuuggauacgugauuacaugcaucuucuguaaggcgcuguuuuauucucucauuaucaucggcacccuggggaagaaaauuaagcaauaccgggaacugaaaccgcagaccugcacaaucugugagaccgcuccugucaacgccauugacgccgaaaugcacgaucuuaacugcuccuacaauaucugccccuauugugcuagcagacucacgucugacggccuggcccgccaugugccucagugccccaagcggaaagagaagguugaggaaacagagcuguaccucaaccuggaacgcauucccuggaucgugagaaaacuucugcaggucuccgagagcaccggaguggcucucaagcgguccagcuggcugaucguucugcuugugcuccugacagucucucugagcccugugcaauccgccccggugggccacgggaagaccauugaaacauaucagaccagagagggauucacgucuaucugucucuuuaugcugggcagcauucuuuuccugguuuccugccucgucaaagggcugguggacucugugagcgauuccuuuuuccccggacugucugucuguaagaccugcagcaucggcuccauuaauggguuugagaucgaaagccauaaauguuacugcucucuuuucuguugcccuuauugucggcacugcuccgcggaccgcgagauccaucagcuccaccugagcauuugcaagaaaagaaagacaggcucuaacgugaugcuggccguuuguaagcggaugugcuuuagagcuaccaucgaagccucccgccgggcucuccugauuagaagcaucauuaauacaaccuucgugaucuguauucuuacgcugacaaucugcgucguguccaccucugccguugagauggaaaaccuccccagcggaacaugggagcgcgaggaagaucugaccaauuucugucaccaggagugccaagugaccgaaacagagugucugugcccuuacgaggcgcuuguccugagaaaaccccucuuuuccgacagcaucgugaagggcaugaaaaaccugcucaauucuacgucccuggaaaccagccuuucuauugaggccccuuggggagcuaucaacguucagagcacauucaagccgaccguguccacagccaauauugcucugucuuggagcuccgucgaacaucggggaaacaaaauccucgugaccggccgcucugagagcauuaugaagcuggaagagagaacggggguguccugggaucugggagucgaggacgccagcgaaucuaaacuucugacaguuuccaucauggaucucagccagauguauucccccguguuugaguaccugucuggcgaccggcaaguggaagaguggccuaaggccaccuguaccggggauugccccgaacgcuguggcugcacaagcucuaccugccuccacaaggaguggccucauucuagaaauuggcgguguaaccccacauggugcuggggagucggcacgggguguaccugcuguggaguggacguuaaagaucuguucacagaccacauguuugugaaguggaaagucgaguacaucaagaccgaagcuauugugugcguugagcuuacaagccaggaacgccaguguucccugaucgaggcgggcaccagauucaaucucgggccggugacgauuacccugagcgaaccucggaacauccagcaaaagcugccucccgagauuaucacacuucaucccaaagucgaggaaggauuuuucgaucugaugcacgugcagaagguucucucugccuccaccgugugcaaacugcagagcuguacacacggcauccccggcgaccuccaggucuaucauauugggaaccugcuuaagggagaccgcgugaauggccaccugauccauaaaauugagccucacuuuaacaccucuuggauguccugggaugggugcgaccuggauuacuauuguaauaugggagacuggccgagcugcacauacacgggcgugacccaacacaaccaugcugccuucgucaaucuccugaacaucgaaacagauuauaugaagaccuuucacuuccauucuaagagaguuaccgcccacggggacacaccccagcuugaucugaaagcucggccuacguacggagccggcgagauuaccgugcucguggaggucgcggacauggaacugcauacaaagaaaguggagaucagcggccucaaguuuguuucccuggcuugcaccggguguuaugccugcucuagcggaauuuccuguaaagugagaauccacgucgaugaacccgacgagcuuacagugcacguuaagagcuccgauccugacguggucgccgcuucuaccagccugauggcccgcaaacuggaguucggcacggauuccacauucaaggcguuuucugcuaugcccaagaccagccucugcuucuacaucguggaacgggaguacuguaaauccugcucugaagaggacacccagaagugugucgacacaaaacuggaacagccgcaaagcauucuuaucgagcauaaggggaccauuaucggaaaacagaaugauacaugcaccgccaaggccuccuguuggcuggaaagcgugaaguccuuuuucuauggccucaaaaacaugcugggguccguuuuuggaaauuucuuuauuggcauccuccuguuccuugcuccuuuugugcugcugguccucuucuuuauguucggcuggaagauccuguucugcuuuaaauguugcagacgcacgcgggggcuucugaaguacagacaccucaaagacgaugaggagacaggauaucgccggauuaucgaaagacugaacaauaagaagggcaaaaaccgccuccuggacggggagcggcuugccgauagaaagauugcugaacuguucagcaccaaaacacauaucggauga

SEQ ID NO: 13715 - RNA, 5052 nt, Artificial Sequence
  derived and/or modified CDS sequence (opt5) from CCHFV(52-R-2014)__KR814862.1__GP
augcacacccugcucgugugcuucauccuguaccuucagcugcucggccugggaggagcccauagacaaagcaacgcuacagagcacaauggcacgaacaccacaaccgcccccuccacaucucagagcccuaagccgcccgucuccaccgcgccuccccaugcuccugaaucuagcacaauuaaacccaccacgccugccuccgagaccgaagggucuggagagacaaccccgcccccuaauacaacccagggccccagcccucccgaagccacgccggagcggccugcuacaaccgccacauccacccccagcaccgacaacacaaauucuacgacccacgcuacagauaacaauccuaccuccacaaucagcaccucucccuccagcucucccuccacgccuagcacaccgcaggggauucaucaccccgcccgcaaccuucuguccguuucuagcccuaagaccgcgaccacacccaccccuacaucccccggagacaucagcucugagacguccagccuccacucugccaugagcagaaccccgacacugcauaccgcuacacaagccuccaccgaaaaugcuaaccacucugccccucggcagagcgaguccagcgcgcagcagacgaccacaucucccaugaccuccccugcccaacccauucuggugaugagcgcugccccuacagcuauccagaauauccaucccucuccgaccaaccgcuccaaaagaaaucucgaaauggagauuauccugacgcuuagccagggccugaagaaauauuacggcaagauucucaagcugcuucaccugacacucgaggaagauaccgaggggcugcuggaaugguguaaacggaaccucggauccaauugcgacgaugacuuuuuccagaagcgcaucgaggaauuuuucaugacaggcgagggguauuuuaacgaggugcugcaauucaaaacccuuucuacccugagcccuacagaacccucccacgccagacccccuacggucgagccguuuaagucuuacuucgccaaaggauuucucagcauugauuccggcuauuucagcgcuaaguguuacccccggcugucuaccuccgggcuucagcugaucaacgugacacagcauccugcgcgcauugccgaaacccccggaccuaagacaaccagccucaaaacgaucaauugcaucaaccugagagcuucuguuuuuaaggagcaccgggaaauugagaucaaugugcugcucccccaaauugccgucaaccuguccaauugucaugugguuaucaacagccacgugugcgacuauucucuugauacagacggcccuguccgccugccccauauuuaccacgagggcaccuucaucccggggaccuacaaaaucgugauugauaagaaaaauaagcucaacgacagauguacacuggugaccaauugcgucaucaaaggacgggaaguucgcaagggccagagcgugcuuagacaguauaagacagagauuaaaaucgggaaggccuccacgggaagccggaaacugcucucugaagaaccuggcgaugacuguauuuccagaacccagcugcugcgcacagaaaccgcugagauccacgacgauaacuacgggggacccggcgacaagaucacaauuugcaauggcagcaccaucguggaucaacggcucggguccgagcugggauguuauacgauuaacagagucaaaucuuuuaaacuuugcgaaaauagcgccaccggcaagacaugcgagaucgacuccaccccugugaaaugucgccagggguucugccugaagauuacacaggaaggacggggccauguuaaacucucuagagggagcgaggugguccuggaugcgugugacaccuccugcgaggugaugauccccaagggcacaggagauauucugguugacuguucuggcgggcagcaacacuuccuuaaagauaaccucaucgaccugggaugcccgcaugugccucugcucggcaagauggcuaucuacauuugucgcaugagcaaucacccccggaccacgauggccuuucuguucugguuuuccuucggguaugucaucacaugcaucuuuuguaaggcccuuuucuacagccugauuauuaucggaacccucggcaaaaagaucaaacaguauagagaacugaagccucagaccugcacaauuugugagaccgcucccgugaacgccaucgaugcugaaaugcacgaccugaacugcucuuacaauauuugccccuacugugccucccgccuuacgagcgacgggcucgcgcggcaugucccucagugcccgaaaagaaaggagaagguggaagagacagagcuguaucugaaccucgaacgcauccccuggauuguucggaaacugcuucaagugucugaguccaccggcgucgcccugaagagaagcucuuggcucaucgugcugcugguucuucucacagugucccugagcccuguccaguccgcucccgugggacacggcaaaaccaucgaaacauaccagacccgggagggguuuacgagcgugugucuguucaugcucggaucuauucuguuucuuguuagcugccuggucaagggccucguggauuccgugucugacagcuucuuuccugggcuguccgucuguaaaaccugcucuaucggaagcauuaauggcuucgaaaucgagucccauaaguguuauugcucucuguuuuguugccccuacugucgccacugcagcgccgauagagagauucaucagcuucaccucuccaucugcaaaaagcggaagauggggagcaacgugaugcuggcuguuuguaaaagaaugugcuuccgcgccacaaucgaagcgucucggagagcccugcucauucgcuccaucauuaauaccacauucgugaucuguauucugacccuuacgaucugcgucgugagcacaucugcuguugagauggaaaaccugccuuccggcaccugggagagagaagaggaccucacaaauuuuugucaccaagagugccaggugaccgaaaccgagugucugugcccguaugaagcccugguccuucggaagccccuguuccucgauagcauugugaaaggaaugaagaaccugcucaauuccacaucucuggagacgagccuuuccaucgaggcuccuuggggcgccaucaacguucagagcaccuuuaaacccacagugucuaccgccaauauugcucuguccuggagcucugucgaacaucgcgggaacaagauccucgugacaggaagaagcgaguccauuaugaagcuggaggagcggaccggcgugucuugggaccugggggucgaugacgcgagcgaauccaaacuucugacgguuucuaucauggaucucagccaaauguacuccccuguguucgaguaucugagcggagaccgccagguggaggaauggcccaaggccacauguaccggcgauugcccggagagaugugggugcaccucuuccacaugccuccacaaagaauggccucauagccggaauuggcgcuguaaccccaccuggugcuggggcgucggaacaggcuguacgugcugugggguggacguuaaggaucuguuuaccgaccacauguucgugaaauggaaggucgaguacauuaagacagaagcuaucgugugcguugagcuuaccucccaggagagacaguguucucugaucgaagccggaacacgguuuaaucucggccccgugaccauuacgcugagcgagccucgcaacauccaacagaaacugcccccugaaauuaucacccuucauccgaaggucgaggaaggguucuuugaccugaugcacgugcagaaaguucucuccgccucuacagugugcaagcugcagagcuguacccacgggauucccggcgaucuccaagucuaccauaucggcaaccugcuuaaaggggacagagugaauggacaccugauccauaagauugagccucacuucaacacauccuggaugagcugggauggcugcgaccuggauuauuacuguaauaugggggacuggcccucuugcaccuauacaggagugacgcagcacaaccaugcugccuuugucaaucuccugaacaucgagaccgauuacacaaagaccuuccacuuucauuccaaacggguuaccgcgcacggcgacacaccucagcuugaucugaaggcuagacccacguauggggccggagaaauuaccgugcucguggaggucgccgacauggaacugcauacaaagaagguggagaucagcggccucaaauucgcuucucuggccugcaccggcuguuacgcgugcuccagcgggauuucuuguaagguucgcauccacguggaugagccggacgaacuuacaguccacgugaaaagcaaugauccugacguuguggcugccuccaccucucugauggcccggaagcuggaguucggaacggacagcacauuuaaggcuuucuccgccaugcccaaaaccagccucugcuuuuauauugucgaaagagaguacuguaaguccugcucugaagaggauacccagaaauguguggacacaaagcuggagcaaccucagagcauccuuaucgaacauaaaggcaccauuaucgggaagcagaacgauacaugcaccgcuaaggccggauguuggcuggaguccgucaaaucuuucuuuuacggccucaagaauaugcuggggagcguguucggaaacuuuuucauuggcauccuccuguuucuugcgcccuucguucugcuggugcucuuuuucauguucggcuggaaaauucuguuuugcuucaaguguugccgccggacgagagggcuucugaaauaucgccuccugaaggacgaugaagagacaggauaccggagaaucaucgaacgccucaauaacaagaaaggcaagaaucggcugcuugacggggagagacuggccgaucggaaaauugcugagcuguuuuccaccaagacacacaucggauga

SEQ ID NO: 13716 - RNA, 5052 nt, Artificial Sequence
  derived and/or modified CDS sequence (opt5) from CCHFV(Turkey-Kelkit06)__GQ337054.1__GP
augcacacaccccuggugugcuucauccucuaccugcagcuucugugucucggcggggcccauggacaacugaacgcuaccgagcacaauggcacgaacaauaccacagccccuggggcgagccaguccccgaagcccccuaugucuaccacacccccucaugcucccgaaagcuccaccauuaaaccuacaaccccgaucucugaggccgaaggaagcggcgagacgaccucucccccuaacacaacccaggggcuuucuagccccgaaacaaccuccgagagaccugccacgacaagcauuucuaccuccagcacagacucuaccaaucccaccacacagaugacggauaacaccccgacaccuaccgucuccacaagccccucuuccagcccuuccacccccucuacgccccaaggaauccaccauccugcucggagccugcucuccguuagcucuccgaagacagugaccacccccacaccuaccucccccggcgagaugagcucugaaacaagcucccagcacucugccaugagccgcauuccuacgccccacaccgcuacaagaguguccaccgagaucacaaaucaucggaccccgcgccagagcgaaucuuccgcccagcaaacgaccccuagccccaugacaucuccugcgcaguccauccugcugaugagcgccgcucccaccgccguccaggacauucacccuucccccacaaacagaucuaaacggaaucucgagaccgagaucauucugacgcuuagccagggccugaagaaauauuacgggaagauccucaagcugcuucaucugacacucgaacaagauaccgagggacugcuggaauggugcaaaggcaaccucggguccaauugugacgaugacuuuuuccagaagcgcauugaggaauuuuucaugacaggagagugcuauuuuaacgaggugcugcaguucaaaacccuuucuacccugagcccgacagaaccuucccacgcuagacuccccacggccgagcccuuuaagagcuacuucgcgaaaggcuuucugucuaucgauuccggguauuucagcgccaaguguuacccucggucuuccgcuagcggacuucaacugauuaauguuacccagcacccggcccgcaucgcugaaacacccggcccuaagaccacaucucucaaaaccaucaacugcauuaaucugagagccagcguguuuaaggagcaucgggaagucgagaucaacgugcugcucccccagauugccguuaaccuguccaauugucacguggucaucaacagccaugugugcgacuauucucuugauacggacggcccugugcgccugcccagaauuuaccacgaggggacauucaucccuggaaccuacaaaaucgucauugauaagaaaaauaagcucaacgaccgguguacccugguuacaaauugcgugaucaaaggccgcgaagugagaaaggggcaguccguccuucggcaauauaagaccgagauuaaaaucggaaaggcuagcacaggcuuuagaaaacugcucuccgaggaacccggggaugacuguauuucucgcacgcagcugcugcggaccgaaacagcggagauccaugacgauaacuacggaggcccgggcgacaagaucaccauuugcaaugggagcacaaucguggaucagagacucggauccgagcugggcugcuauaccauuaaccgcguuaaaucuuucaagcuguguaagaauagcgccacggggaaaaccugcgaaguggacuccacaccugucaagugucggcagggauucugccugaaaaucacccaagagggcagagggcacgugaagcucucucgcggcagcgaaguugugcuggaugcuugugacuccagcugcgaggucaugauucccaaaggaacaggcgauauccugguggacuguucugggggacagcagcacuuucuuaaggauaaccucauugaccugggcugcccucauaucccccugcucgggcggauggccaucuacauuuguagaauguccaaucacccgcgcaccacaauggccuuccuguuuugguucagcuuuggauaugucauuaccugcaucuucuguaaggcucuguuuuacucucugaucauuaucggcacgcucgggaaaaagaucaaacaguaucgggagcugaagccucaaacaugcaccauuugcgaaaccgcccccgugaacgcgaucgaugcugagaugcaugaccugaauuguuccuacaacauuugcccuuacugugccagcagacuuacaucugacggccucgcccgccacguuacccagugccccaaacggaaggaaaagguggaggaaacggagcuguaucugaaucucgagagaauccccuggauuguccggaaacugcuucagguguccgaaagcacaggaguugcucugaagcgcuccagcuggcucaucgugcugcugguccuucucaccgugucucugagcccugugcaguccgccccgguuggccacgggaaaacaaucgagauuuaccaaaccagagaaggauucgcuucuaucugucuguuuaugcucggcagcauucuguucaucgucuccugccuugugaaggggcugguggauucugucagcgaguccuuuuuccccggacucucuguguguaaaacaugcagcauuggcuccguuaacggguuugaaaucgagagccauaaguguuauugcucucuguucuguugcccuuacugccggcacuguuccgccgacagagagauccaucagcugcaccuuagcauuugcaaaaagcgcaagaccggcucuaacgugaugcucgcggucuguaaacggaugugcuucagagccacgaucgaggcuucccgcagagcccugcugauucggagcaucauuaauaccacauuugugaucuguauucucacccugacaaucugcguuguguccaccucugcugucgaaauggaaaaccuucccgccggaacgugggagcgcgaagaggaucugacaaauuucugucaucaggagugccaagugaccgaaacagagugucucugcccuuaugaagcgcugguucugagaaagccccuuuuucuggacagcaucgugaaaggcaugaagaaccuccuuaauuccaccagccucgagaccucucuguccauugaggccccuuggggagcuaucaacguccagagcacauucaaaccgacggugucuaccgccaauauugcucuuagcugguccucugugguccaccgggggaacaagauccugguuacaggccgcagcgaauccauuaugaagcucgaggaaagaaccggggugucuugggaucugggaguggaggacgccagcgaauccaaacugcuuacagucagcaucauggaucugucucagauguacucccccguguuugaguaucucagcggcgaccggcagguugaggaauggccuaaggccaccuguacgggggauugccccgagcgcugcggcuguacauccucuaccugccugcacaaagaauggagccauuccagaaauuggcgguguaacccuaccuggugcuggggagugggcacaggguguaccugcuguggagucgacgugaaggaucucuucacagaccacauguuuguuaaauggaagguggaguacaucaagacggaagcuauugucugcguggcgcugaccucucaagagcgccaguguagccuuaucgaggccggcacaagauucaaucuggggcccguuaccauuacacucuccgaaccgcggaacauccagcagaaacugccucccgagauuaucacccugcaucccaagaucgaagagggauuuuucgaucuuaugcacgugcaaaaaguccugagcgcuucuacggugugcaagcuccaguccuguacccauggcauuccuggcgaccuucagguguaccacaucgggaaucuccugaaaggagacagagucaacggccaccuuauucauaagaucgaaagccacuuuaauacaucuuggauguccugggaugggugcgaccuggauuauuacugcaacaugggagacuggcccagcuguaccuauacaggcguuacccagcauaaccacgccgccuucgugaaucugcucaacauugagacagauuacacgaagaccuuucacuuccauucuaaacgcgugacagcucacggggacaccccucaacuggaucuuaaggcccggccgaccuauggagcgggcggcaucacaguccugguggagguugcugacauggaacuccauacgaaaaagguggagauuagcgggcugaaauucgccucccucgccugcaccggauguuacgcuugcucuagcggcaucuccuguaaggucagaauccacguggaugaacccgacgagcugacaguucaugugaaaagcuccgauccugacgucguggccgcgucuaccagccuuauggcucgcaagcuggaguuugggacagauuccaccuucaaggccuuuucugccaugcccaaaacgagccugugcuucuauauugucgaacgggaguacuguaaguccugcucugaagacgacacacagaaauguguggauaccagacucgagcagccucaaagcauccugauugaacacaagggaaccaucauuggcaaacagaaugacacaugcaccgcuaaggccuccuguuggcuugagagcguuaaguccuuuuucuacgggcugaaaaacaugcucggauccguguuuggcaaucuguucaucggcauccuccuguuucuugcucccuucguccugcuggugcucuuuuucauguucggguggaagauucuguuuugcuucaaaugcugucgccggacaagaggacuuuuuaaguaucgccaccugaaagaugacgaggaaaccggcuaccggagaaucauugagcggcucaacagcaagaaggggaaaaaucgccugcucgauggagacagacuggccgaucggaagaucgcggaacuuuucucuacgaaaacacauauuggcuga

SEQ ID NO: 13717 - RNA, 5052 nt, Artificial Sequence
  derived and/or modified CDS sequence (opt5) from CCHFV(V42/81)__GU477490.1__GP
augcacacccugcucgugugcuucauccuguaccuucagcugcucggccuugggggagcccauguccaacccaacgcuacagagcacaauagaacgaacaccacaaccgccccuggcacaagccauucccuuaagccgcugguuucuaccacacccccucaggcgcccgaaagcuccaccauuaaaccuacgacccccacaucugagaccgaagggagcggagaggcuacaccucucuccaauaccauccaggccccgucuagccccgaaacgacauccgagcggccugccaccgcugugauuagcacaucuggcaccgacuccaccaacagcacaacgcagaccacagauaauaaccccaccacaaccguggggacgucuccuuccagcucucccuccacaccgagcaccccucaaggaauccaccaucacgcccgcucccugcugucugucaccagccccgagacagugaccacaccuaagcccacgucccccagagaaaugagcucugagaccuccaaucagcacagcgcuaugucucggacaccuacccaucacacaguuacccaggugagcacggaaaacaccucccauucuacaccgcgccagcccgagagcuccgcccaaccuaccagcagcucccccaugacaagcccugcgcagucuacccuccugauguccgccgcucccacggccguccagagcauucacccguccccuacaaauagaucuaaacggaaccuugagaccgaaaucauccugacacucagccagggccugaagaaauauuacggcaagauucuuaagcugcuccaccugacccuggaggaagacaccgaggggcuccuggaaugguguaaacgcaaucuuggauccaacugcgaugacgacuuuuuccaaaagagaaucgaggaguuuuucaugacaggcgaaggguauuuuaaugaggugcugcaguucaaaacgcccucuaccguuagcccuacagaacccucccaugcucggcucccuaccgccgagcccuuuaagagcuacuucgcgaaaggauuucugucuauugacuccggcuauuucagcgccaaguguuacucucgcuccagcacaucugggcuucagcugaucaacgugacccaacacccggcuagaauugccgaaacgccuggacccaagacaaccagccucaaaaccaucaauugcauuaaccugcgggcuuccgucuuuaaggagaaccgcgagaucgaaaucagcgugcugcucccccagauugccgugaaucugucuaacugucaugucguuaucaauucccacgugugcgauuauagccuugacacagauggcccugugagacugccgcggauuaaccaugagggcaccuucauccccgggacauacaaaauugucaucgacaagaaaaauaagcucaacgaucgcuguacgcuggugaccaauugcguuaucaaaggaagagaagugcggaagggccaguccguccuuagacaguacaagacagagauuaaaaucgggaaggccucuaccggaagccgcaaacugcucuccaaggaaccuggcgacgauuguauuucucggacacaacugaugagaaccgagacggcugagauccacgacgacaacuaugggggacccggcgauaaaauuaccaucugcaauggcagcacaaucguggaccagcgccugggguccgaacucggauguuacaccauuaaccggguuaagucuuuuaagcugugcgagaauagcgcgacaggcaaagccugcgaaguggauuccaccccugucaaguguagacagggguucugccuuaaaaucacacaggagggacgcggccacgugaagcugagccgggggucugaggucgugcucgacgcuugugauuccagcugcgaaguuaugauucccaaaggcaccggagacauccugguggauuguucuggcgggcaacagcauuuccugaaggacaaccuuauugaucucgagugcccucacaucccccugcugggaaagcucgccauuuauaucuguagaauguccaaucauccgcgcacgacaauggccuuucuguucugguuuggcuucggguacgucauuaccugcauccuuuguaaagcucuguuuuauagccucaucauuaucggaacccugggcaagaaaauuaagcaguaccgggaacugaaaccucagacaugcaccaucugugagacggcccccgugaacgcgaucgacgcugaaaugcacgaucuuaauugcucuuauaacauuugcccuuacugugccuccagacucacaagcgacgggcuggcccgccacguuacccaaugccccaagcggaaggagaaaguggaggaaacagagcuguaccucaaccuggaaagaaucccguggauuguccggaagcugcuccagguguccgagagcaccggcgugguucugaaacgcucuagcuggcugaucguccugcuugugcuccugacagugucccugucuccuguccagagcgcucccgugggacauggcaagaccauugaaacguaucagaccagagagggguucacauccaucugucucuuuaugcugggaucuauccuuuucauuguuagcugcaucgugaaaggccuggucgacuccgugucugauagcuuuuucccugggcucuccguuuguaagaccugcagcauuucuuccaucaauggauuugagauugaaagccacaaauguuacugcucucuguucuguugccccuauugucggcauugcuccgccgacagagagauccaccaacugcaucuuagcaucugccgcaagcggagaacaggcuccaacgugaugcucgcugucuguaagcgcaugugcuuuagagccaccauugaagugucucggcgcgcgcugcugaucagaagcauuaucaauacgacauucguuauuuguauccucacccugacaauuugcguggucuccaccagcgccguggagauggaaaaccuucccgcugggaccugggagcgggaggaagaucugacaaauuucugucaccaggagugccaggugacggaaaccgagugucucugcccuuacgaggcccugguccugcgcaaaccgcuuuuucuggacucuaucguuaagggcaaaaagaaccuccugaauagcacaagccucgaaaccucucugagcaucgaggcucccuggggagccauuaacauccaauccacauucaaaccuaccgugucugcggccaauauugcucuuagcugguccucuguggaacacagaggcaacaagauccuggucagcgggcgguccgagagcauuaugaagcucgaggaacgcacgggagugucuuggaaucugggcguugaggaugccuccgaaagcaaacugcuuacaguguccaucauggaccugucucagauguauagccccgucuuugaguaccucuccggggauagacagguggaagaguggccuaaggcuaccuguaccggagacugccccgaacgguguggcugcacaucuucuaccugccugcauaaagaguggccucacucccgcaacuggagauguaauccgacauggugcuggggcguugggacgggauguaccugcuguggcguggaugucaaggaccucuucaucgaucauauguuugugaaauggaagguugaguauauuaagacagaagccaucgugugcgucgagcugaccagccaggaacggcaauguucucuuauugaggccgggacaagauucaaccugggacccgugaccaucacgcucuccgaaccucgcaauauucagcagaaacugcccccugagaucaucacccugcaccccaagauugaggaaggcuuuuucgaccuuaugcaugugcagaaaguccugagcgcuucuacaguuugcaagcuccaauccuguacccacgggaucccgggagaucuccagguguaccacauuggcaaccugcugaaaggcgaccgggugaacgggcaucuuauccacaagauugagccucauuuuaauacaagcuggaugucuugggacggaugcgaucuggacuacuauuguaacaugggcgauuggcccagcugcaccuacacaggggucacgcagcacaaucacgcggccuucgugaaccugcucaauaucgaaaccgacuauacaaagaccuuucauuuccacuccaaaagaguuaccgcucauggagagacaccccagcuggaucuuaaggcccgcccugccuacggcgcuggggagauuacggugcuggucgaaguggccgacauggagcuccacaccaaaaagguugaaaucucuggacugaaauuugcgagccucgcuugcacaggcuguuaugccugcuccagcggcaucuccuguaaggugcggauucaugucgaugagcccgacgaacugaccgugcacgucaaaucuaacgauccugacgugguugccgcuagcacaucccuuauggccagaaagcuggagucugggaccgauagcacguucaaggcguucuccgcuaugccgaaaacaucucugugcuuuuacaucguggagcgcgaauauuguaagagcugcuccgaggacgauacccaaaaaugugucgaaaccaagcucgagcagccccagagcauucugaucgaacacaaaggaacaauuaucggcaagcaaaaugauaccugcacagccaaggccucuuguuggcuugaguccgugaaauccuucuuuuacgggcugaagaacaugcucggaucuguuuucggcaauuucuuuaucgggauucugcucuuucuggcuccuuucgugcuucugguccuguuuuucauguuuggauggaaaauccucuucugcuucaaguguugccggagaacccgcggccuguuuaaauaccggcaucuuaaggaggacgaagagacgggcuauagacggauuaucgaacgccugaacuccaagaaagggaagaauagacuccuggauggagagcggcucgccgaccgcaaaauugcugaacuguucagcacaaagacccacaucggcuga

SEQ ID NO: 13718 - RNA, 5052 nt, Artificial Sequence
  derived and/or modified CDS sequence (opt5) from CCHFV(75-R-2012)__KR814863.1__GP
augcacacccugcucgugugcuucauccuguaccuucagcugcucggccuugggggagcccauagacaaagcaacgcuacaggccacaaugggacgaacaccacaaccgcccccuccacaucucagagcccuaagccgcuugucuccaccgcgcccccucaugcucuggagucuagcauuaucaaacacacaacccccguuuccgaaacggagggaucuggcgaaaccacaccucccccuaauaccacacaggggccgagcccccucgagaccacgccugaacggcccgccacaaccgccacauccaccccuagcaccgacaacacaaauucuacgacccaugugacagauaacaaucccaccuccacaauuagcaccucuccguccagcucuccuuccacgcccagcacaccucagggaauccaccaccccgcucgcaaccugcuguccgugucuagccucaagaccgccaccacacccaccccuacauccccgggcgagauuagcucugagacguccagccugcauucugcuaugagcagaaccuccacacuuuauaccgccacacaagucucuaccgaaaaugcgaaccacagcgcuccccggcaguccgagagcucugcucagcagacgaccacauccccuaugaccagccccgcccaaucuauccuggugauguccgcugccccuacagcgauccagaauacccaucccagcccgacgaaccgcuccaaaagaaaucucgaaauggagauuauccugacacuuucucagggccugaagaaauacuaugggaagauucucaagcugcugcaccucacccuggaggaagacacagagggacuucuggaaugguguaaacggaaccucggcagcaauugcgaugacgauuucuuccagaagcgcaucgaggaauuuuucaugaccggggagggauacuuuaacgagguucugcaauucaaaacccuuuccacacagucuccuacggaacccagccacgccagaccucccaccguggagccuuuuaaguccuauuucgcuaaaggcuuucugagcauugacucuggguacuucuccgccaaguguuauccccggcucagcacaucuggacugcagcugaucaacgucacccaacauccggcucgcauugccgaaacaccuggccccaagaccacgucccucaaaacaaucaauugcaucaaccugagagccagcguguuuaaggagcaccgggaaauugagaucaauguucuucugccccagauugcugugaaccucucuaauugucaugucgugaucaacagccacgugugcgauuacucccuggacaccgauggcccuguccgccuuccgcauauuuaccacgaggggaccuucauccccggaacauauaaaaucguuauugacaagaaaaauaagcugaacgauagauguacccucgugacaaauugcgugaucaaaggccgggaaguccgcaaggggcagagcgugcugagacaguacaagacggagauuaaaaucggaaaggcgucuaccggcucccggaaacugcucagcgaggaaccuggggacgauuguauuuccagaacacaacugcuucgcaccgaaacagccgagauccacgacgacaacuauggaggccccggcgauaagaucaccauuugcaaugggucuacgaucguugaccagcggcugggaagcgagcucggcuguuacaccauuaacagagugaaauccuuuaagcugugcgaaaauucugcuacagggaagaccugcgagaucgauagcgccccugucaaaugucgccagggauucugccugaagauuacacaggaaggccgggggcaugugaaacuuuccagaggcucugagguugugcucgacgccugugauagcuccugcgaggucaugauccccaagggaaccggcgacauucugguggauuguagcgggggacaacagcacuuccugaaagacaaccucaucgaucugggcugcccucauaucccccuucuggggaagauggcuauuuauaucugucgcaugucuaaucacccgcggacaaccauggccuuucucuucugguuuuccuucggauacgucauuacgugcaucuuuuguaaggcgcuguucuauagccugauuaucaucggcacacuugggaaaaagauuaaacaguacagagaacucaagccucagaccugcaccaucugugagacagcucccgugaacgccauugacgccgaaaugcacgaucugaacugcucuuacaauaucugcccuuauugugcuucccgccugaccagcgacggccucgcccggcauguuccccaaugcccgaaaagaaaggagaagguggaagagacggagcuguaccuuaaccuggaacgcauuccuuggaucguccggaaacuccuucaggugucugaguccacaggaguugcucugaagagaagcuccuggcugaucgugcuccugguccugcucaccgugagccugucucccgugcagagcgccccuguuggccacgggaaaacaauugaaaccuaucagacacgggagggauuuaccuccaucugucuuuucaugcugggcucuauucucuuucuggucagcugccuggugaaggggcuugucaauuccgugucugacagcuucuuucccggacucuccguguguaaaacgugcucuaucggcagcauuaacggguucgaaaucgagucccauaaguguuacugcagccuguuuuguugccccuauugucgccacugcucugcggauagagagauccaucaacugcaccucuccauuugcaaaaagcggaagaccggcagcaauguuaugcuggccguguguaaaagaaugugcuuccgcgcuacaaucgaagccucucggagagcccuucugauucgcuccaucauuaacaccacauucgucaucuguauucucacccugacgaucugcgugguuagcacauccgccguggagauggaaaaucugccuucuggaaccugggagagagaagaggaccuuacaaacuuuugucaccaggagugccaggucaccgaaaccgagugucugugcccguacgaagcgcucgugcugcggaagccccucuuccuggauagcaucguuaaaggcaugaagaaucuucugaacuccacaagccucgagacgucucuguccauugaggccccuuggggagcuaucaaugugcaaagcaccuuuaaacccacagucucuaccgccaacauugcucugagcugguccucuguggaacaucgcgggaauaagauccuugugacaggcagaagcgaguccauuaugaagcuggaggaacggaccggggucucuugggaccucggaguugaagaugccagcgaguccaaacugcucacggugagcaucauggaccugucucagauguauuccccuguguucgaguaccuuagcggcgaucgccaggucgaagaguggcccaaggccacauguaccggggacugcccugaaagauguggcugcaccuccucuacaugccugcacaaagaguggccgcauagccggaacuggcgcuguaaucccaccuggugcuggggagugggcacaggguguacgugcuguggaguugaugugaaggaccucuuuaccgaucacauguucgucaaauggaagguggaauacaucaagacagaggcuauuguuugcguggagcugaccucccaggaaagacaauguucucugaucgaggcgggcacacgguuuaaccuugggccugucaccauuacgcugagcgaaccccgcaacauccagcagaaacucccucccgagauuaucacccugcauccgaagguggaagagggauucuuugaccucaugcacguucagaaagugcuguccgccagcacagucugcaagcugcaaucuuguacccacggcaucccuggcgaucuccagguguaucauauugggaaucugcugaaaggagacagagugaacggccaccugauccauaagauugagccccacuucaauacauccuggaugagcugggacgggugcgaucuugacuacuauuguaacaugggagauuggcccucuugcaccuacacaggcgucacgcagcacaaucaugcugccuuuguuaaccugcucaauaucgaaaccgacuauacaaagaccuuccacuuucauuccaaacgggugaccgcccacggggauacaccucagcuggaccucaaggcuagacccacguacggagccggcgagauuaccgugcuggucgaaguggcggauauggagcuucauacaaagaagguugagaucagcggccugaaauucgcuucucuggccugcaccggguguuaugccugcagcuccggaauuucuuguaaggugcgcauccacgucgacgaaccugaugagcucacagugcacguuaaaagcuccgacccggauguggucgcugccagcaccucccugauggcgcggaaacuugaauuuggcacggacucuacauuuaaggcuuucagcgccaugcccaaaaccucccugugcuuuuacaucguggagagagaauacuguaagucuugcagcgaggaggauacccaaaaaugugucgacacaaagcucgaacagccucaguccauucugaucgagcauaaagggaccauuaucggaaagcaaaacgacacaugcaccgccaaggcuucuuguuggcucgaaagcgugaaauccuuccuguauggccuuaagaauaugcuggggagcguuuuuggaaacuucuuuauuggcauccuccuguuccuggcccccuuugugcuucugguccucuucuuuauguucggcuggaaaauccuguucugcuuuaaguguugccgccggacgagagggcuccugaaauaccgccuucugaaggaugacgaggaaacaggauaucggagaauuaucgagcgccugaauaacaagaaaggcaagaaucggcuccuggauggggagagacuugcugaccggaaaauugccgaacuguucucuaccaagacacacaucggauga

SEQ ID NO: 13719 - RNA, 5052 nt, Artificial Sequence
  derived and/or modified CDS sequence (opt5) from CCHFV(VLG/TI29414)__AY179961.1__GP
augcacacccugcucgugugcuucauccuguaccuucagcugcucggccuugggggagcccauauucaaagcaacgcuacagagcacaauggcacgaacaccacaaccgcccccuccacaucucagagcccuaagccgcuugucuccaccgcgcccccucaugcucuggaaucuagcacaaucaaacccaccacgccuguuuccgagaccgaagggucuggaggcacaacacccccuccgaauacaacccaggggcccagcccucccgaggccacgccugaaagacccgccacaaccgcuacauccaccccgagcaccgacaacacaaauucuacgacccacgugacagauaacaauccuaccuccacaauuagcaccucucccuccagcucuccuuccacgcccagcacaccccagggaauccaucacccugcccggaaccuccuguccgugucuagcccgaagaccgcuaccacacccaccccuacaucccccggcgacauuagcucugagacguccagccugcacucugccaugagccgcaccuccacacucuauaccgcgacacaagucucuaccgagaaugccaaccauagcgcuccuagacaguccgaaagcucugcccagcagacgaccacaucccccaugaccagcccggcucaaccuauccuggugaugucugccgcgcccacagccauccagaauauucacccuucccccaccaaccggagcaaacgcaaucuugagauggaaaucauucugacgcucucccagggccugaagaaauacuaugggaagauccuuaagcugcuccaucugacacuggaggaggauaccgaaggacuccuggagugguguaaaagaucucuuggcagcaacugcgacgaugacuuuuuccagaagcggauugaagaguuuuucaugacaggggaaggauacuuuaaugagguucugcaauucaaaacccucuccacccugucuccuacagagcccagccacgcucgcccgccuacgguggaacccuuuaaguccuauuucgccaaaggcuuucuuagcaucgauucuggguacuucuccgcuaaguguuaucccagacugagcaccucuggacuccagcugauuaacgucacacagcacccugcccggaucgccgagaccccgggccccaagacaaccucccugaaaacgaucaacugcauuaaucuccgcgcuagcguguuuaaggaacauagagagaucgaaauuaacguucugcuuccucaaaucgcggugaaucugucuaacugucacgucgugauuaauagccaugugugcgacuacucccucgauacagacggccccguccggcugccucacaucuaccaugaggggaccuucauccccggaaccuauaaaauuguuaucgauaagaaaaacaaacuuaaugaccgcuguacacuggugaccaacugcgugauuaagggcagagagguccggaaggggcagagcgugcuccgccaguacaagacagaaaucaaaauuggaaaggccucuacgggcuccagaaaacugcugagcgaggaaccuggggaugacuguaucucccggacccagcuccugagagcugagcccgccgaaauccacgacgauaauuauggaggcccgggcgacaagauuacaaucugcaacgggucuaccauuguugaucaacgccuuggaagcgagcugggcuguuacacaaucaaucgggugaaauccuuuaagcucugcgagaacucugccaccgggaagacgugcgaaauugacagcaccccugucaaauguagacagggauucugccugaagaucacacaggagggccgcgggcacgugaaacugucccggggcucugaaguugugcuugaugcuugugacagcuccugcgaggucaugauucccaagggaaccggcgauauccucguggacuguagcgggggacagcaacauuuccugaaagauaaucugaucgaccucggcugcccucacauuccccugcuugggaagauggccaucuauauuuguagaaugucuaaccauccgcgcacaaccauggcguuucuguucugguuuuccuucggauacgucaucacaugcaucuuuuguaaggcucucuucuauagccugauuaucauuggcacccuggggaaaaagaucaaacaguaccgggagcuuaagccucagacgugcacaauuugugaaaccgcccccgugaaugccaucgaugcugagaugcacgaccucaacugcucuuacaacauuugcccuuauugugccuccagacugaccagcgacggccuggcucgccacguuccccagugccccaaacggaaggaaaagguggaggaaacagagcucuaccugaaucuugagagaaucccuuggaacguccgcaaacugcuccaagugucugaauccaccggaguugcccugaagcggagcuccuggcugaucgugcuucucguccugcugacggugagccucucuccggugcagagcgcgcccguuggccaugggaaaacaauugagaccuaucagacaagagaaggauuuaccuccaucugucuguucaugcuuggcucuauucuguuucucgucagcugccuggugaaggggcugguggauuccgucucugacagcuucuuuccuggacuuuccguguguaaaacaugcucuaucggcagcauuaauggguucgagaucgaaucccacaaguguuacugcagccucuuuuguugccccuauugucggcauugcucugccgaucgcgagauccaccagcugcaucuguccauuugcaaaaagagaaagaugggcagcaacguuaugcucgcuguguguaaacggaugugcuucagagccaccaucgaggcuucucgccgggcccugcuuauuagauccaucauuaauacgaccuucgucaucuguauucugacacucaccaucugcgugguuagcacauccgcgguggaaauggagaaccugccuucuggaaccugggaacgcgaggaagaccugacgaauuuuugucaccaagagugccaggucacagagaccgaaugucuuugccccuacgaggcccuggugcucagaaagccucuguuccucgauagcaucguuaaaggcaugaagaaccugcuuaauuccacaaaccuggaaaccagccucucuauugaggcuccguggggagccaucaaugugcaguccaccuuuaaacccacagucagcacggcuaacauugcccugucuuggagcuccguggagcaccgggggaauaagauccuggugaccggccgcucugaaagcauuaugaaacuugaggaaagaacaggggucuccugggaccugggaguugaggaugccucugaaagcaagcuccugaccguguccaucauggaccucagccaaauguauucuccuguguucgaguaccuguccggcgaucggcaggucgaggaauggcccaaggcuacauguaccggggacugcccugagcgcuguggcugcacgagcuccacaugccuucauaaagaauggccccacucuagaaacuggcgguguaauccgaccuggugcugggaggugggaaccggcuguacaugcuguggguggaacguuaaggaucuguuuaccgaccauauguucgugaaauggaaggucgaauacaucaagacagaggcgauugugugcguugagcucacgagccaggaacgccaguguucccugaucgaggccggaaccagauuuaaccugggcccugugacaauuacccuuucugaaccccggaauauccaacagaaacugcccccugagauuaucacacuccaccccaaggucgaagagggguucuuugaucugaugcaugugcagaaaguucucagcgcuuccaccgugugcaagcugcagagcuguacgcacggaaucccuggcgaccuucaagucuaucacauuggcaaccugcugaaaggggaccgcgugaauggacaucucauccacaagauugagccgcauuucaacaccucuuggauguccugggauggcugcgaccuggauuacuauuguaauaugggggacuggcccagcugcacauacaccggaaugacacagcacaaccacgccgccuuugugaaucuucugaacaucgaaaccgauuauacaaagacguuccauuuucacucuaaaagagucaccgcucauggcgacacaccucagcucgaucugaaggcccggcccaccuacggggcgggagagauuaccguucucguggaaguggcugacauggagcugcacaccaaaaaggucgagaucuccggccuuaaauucgccagccuggccugcacgggcuguuaugcuugcucuagcgggauuuccuguaaggugagaauccauguugaugaaccugacgagcugaccgugcacgucaaaucuaaugaucccgacgugaucgccgcgagcacaucccucauggcucgcaagcuggaguucggaaccgauagcacauuuaaggccuucuccgccaugccgaaaaccucucuuugcuuuuacauugcugaacgggaauacuguaagagcugcuccgaggaggacacgcagaaauguguugacacaaagcuggaacaaccucagucuauccucauugagcacaaaggcaccaucauugggaagcagaacgauaccugcacagccaaggcuagcuguuggcuggaauccgugaaaucuuucuuuuauggacucaagaauaugcugggcagcgucuucgggaacuuuuucaucggaauccuucuguuucuggcccccuucgugcuccugguccuguuuuucauguucggcuggaaaauucuguuuugcuucaaguguugcagacgcacccggggccuccugaaauacagacuccugaaggacgaugaggaaacaggguaucgccggaucauugagagacuuaauaacaagaaaggaaagaaucgccugcuggacggcgagcggcucgcggauagaaaaaucgccgaacuguuuuccaccaagacgcauauuggguga

SEQ ID NO: 13720 - RNA, 5055 nt, Artificial Sequence
  derived and/or modified CDS sequence (opt5) from CCHFV__KJ648916.1__GP
augcacaucagccugauguacgccauucucugccugcagcuuuguggccugggggagacccauggaucccacaacgaaacaagacauaauaagacggacaccaugacaacccccggcgauaacccuucuagcgagccgcccguguccacagcucucucuaucacccuggacccuagcacagucacccccacgaccccugccuccgggcuugaaggaucuggcgagguuuauacaucucccccuauuaccacagggucccugccgcucagcgaaaccacgcccgagcugccugugacaaccggaacagauacccugucugcgggcgacguggaucccuccacccagacagcuggcgggacgagcgccccuaccguccggacaucucuccccaauuccccgagcaccccuucuacaccccaggacacccaccauccugugcgcaaccugcuuuccguuacgagccccggacccgaugagacauccaccccuucuggcaccgggaaagaaagcuccgccacaagcucuccgcaccccguguccaauagaccucccaccccucccgcuacagcccagggaccgacggagaacgacagccacaaugcuaccgaacauccugagucucugacacagagcgccacccccggccucaugacauccccuacccaaaucguccacccccagucugcgacgccuauuaccgugcaggauacacaucccagcccgaccaacgccuccaaggcuaaucugaaaauggagaucauccuuacacugagccaggggcucaagaaauacuauggaaagauucugcggcugcuccaacugacccuugaagaggacacggaaggccugcucgaguggugcaagcgcaaccugggccuugauugugacgauacauucuuucagaaaagaaucgaagaguucuuuauuaccggggagggacacuucaaugaaguucugcaguuucggacaccuggcacccucucuaccacagaguccacgcccgccgggcugcccaccgcugaaccuuucaagagcuacuuugccaaaggauuccugucuaucgacuccggcuauuacagcgcgaagugcuauuccgggacaucuaacagcggacuccagcugauuaauaucacccgccacuccacaagaauuguggacaccccgggccccaaaaucacgaaccuuaagacaaucaauuguauuaaccugaaggccucuaucuuuaaagagcaucgggaagucgagauuaacgugcuccugccucaaguggcugucaaucuuagcaacugccacguugugaucaagucccaugugugugauuacagccuggacauugauggcgccguccgccucccccacaucuaccaugaggggguguucaucccuggaaccuauaaaauuguuaucgacaagaaaaauaagcugaacgauagaugcacccuguuuacagacugugugauuaaaggccgggaaguccgcaaggggcagucugugcucagacaguacaagaccgagauccggauuggaaaggcuuccacaggcagccgcagacugcuuucugaggaacccuccgaugacugcaucagccggacgcaacugcucagaaccgaaacagccgagauccacggggauaauuauggcggaccuggcgacaaaauuaccaucuguaacgggucuacaauuguugaucagcgccugggaagcgagcugggcugcuacaccaucaaucgggugagauccuucaaacuuugcgaaaacagcgccacggggaagaauugugagauugacucuguccccgugaaaugccgccagggauauugucuccggaucacccaggaaggcagagggcacgucaagcugucccgcggcagcgaggugguucuggacgcuugcgauacauccugugagauuaugaucccgaagggaaccggcgacauccucguggauugcucugggggacaacagcauuuucugaaagacaaccuuauugaucugggcuguccuaagaucccccuccuggggaaaauggcgauuuacaucugccggaugagcaaucacccuaagacaaccauggccuuccuguucugguuuuccuucggauaugucauuacauguauccuuugcaaagcuaucuuuuaccuccugauuaucgugggcacccuggggaagagacucaagcaguaccgcgaacugaaaccccagacguguacaauuugcgagaccaccccgguuaacgccaucgacgccgaaaugcaugaucuuaauugcucuuauaacauuuguccuuacugcgcuagccggcugacauccgacggccucgccagacacgugauccaaugucccaagcgcaaagagaaggucgaagagaccgagcuguaucugaaucuugaacggaucccuuggguggugagaaaacuccugcagguuucugagagcacgggagucgcgcugaagcgguccagcuggcucauugugcugcuugugcuguucacagucucucucucccccgugcagagcgcucccaucggccaggggaagaccauugaagccuaccgcgccagagagggauauacaucuaucugccuguuuguucugggcuccauucuuuucaucgugagcugucucaugaaagggcuggucgauucugugggaaacuccuuuuucccuggccugagcaucugcaagaccuguuccauuagcucuaucaacggguuugaaauugagagccacaaaugcuacuguucccucuucugcuguccguauugccggcauugcucuacagacaaggagauccacaaacugcaucuuagcauuuguaagaaaagaaagaagggcuccaauguuaugcuggcugugugcaaacucauguguuuucgcgccaccauggaagucucuaaccgggcucuguucaucagaagcauuaucaauacgaccuuugugcugugcauccuuauucuggccguuuguguggucuccacaucugcgguggagauggaaaaccuccccgccggaaccugggagcgcgaagaggaucugacaaauuucugccaccaagagugucaggugaccgaaacggagugccucuguccuuacgaagcucugguccuuagaaagccccuguuccucgacagcacagccaaaggcaugaagaaccugcuuaauuccaccagccuggagacaucucuguccaucgaggcuccuuggggagccauuaacguucagagcaccuacaaacccaccgugucuacagcgaauaucgcccucuccuggagcuccguggaacaucgggggaacaagauucuggucucuggccgcagcgaguccaucaugaagcucgaagagagaacggggaucagcugggaucugggaguggaagacgcuucugaguccaaacuucugaccguuagcgugauggaccucucucagauguauagcccugucuuugaguaccuguccggcgaucggcaagugggcgaauggccgaaggccacaugcaccggggacugucccgagcgcugcggaugcacaucuagcaccugucugcacaaagaauggccucacuccagaaauuggcggugcaaccccacgugguguuggggcguugggacaggaugcaccuguugcggccuugaugugaaggaccuguucaccgauuauauguuugucaaauggaagguggaguacauuaagacagaagcuaucguuuguguggagcucaccucucaggagcgccagugcagccugauugaagccgggacaagauucaaucucggaccugucacgaucacccuguccgagccccggaacauucaacagaaacuuccgccugaaaucaucacacugcauccccgcauugaggaaggcuuuuucgaccugaugcacgugcagaaggugcucagcgccucuaccgucuguaaacugcaguccugcacacauggcguucccggggaucuucaaguguaucacaucggaaaucugcucaagggcgacaaagugaacgggcaucugauucacaagaucgagccucacuuuaacaccagcuggauguccugggauggaugugaccucgauuacuauugcaauaugggcgacuggcccucuugcacguacaccggggucacacagcauaaccacgcuagcuucgugaaucugcuuaacauugagaccgauuacacaaagaauuuucauuuccacuccaaaagaguuaccgcgcacggagacacaccucagcuggaccugaaggcccggccgacguauggcgcuggcgaaaucaccgugcucgucgagguggccgauauggaacugcauaccaaaaagauugagaucucugggcuuaaauuugccagccuggcuuguacaggaugcuacgccuguuccagcggcaucucuugcaagguucgcauucacguggacgagcccgaugaacucaccguccaugugaaauccgacgauccugacgucguggcggcuucuagcucccugauggccagaaagcucgaguucgggacagauagcacguuuaaggccuucucugcuaugcccaaaaccagccuguguuucuauaucguugaacgggagcacugcaaguccuguucugaagaggacaccaaaaagugcgugaacacaaaacuugagcagccucaaagcauucugaucgaacauaagggaacaauuaucggcaagcaaaauuccaccuguacggccaaagcgagcugcuggcuggaguccgucaagagcuuuuucuacgggcucaaaaacaugcugagcggaaucuuuggcaauguguucaugggcauuuuucuuuuccuggcucccuuuauccuccugauucucuucuuuauguucggguggagaauccuguuuuguuucaagugcugccgccggacaagaggacuuuucaaauaucgccaccugaaggaugacgaagagaccggcuaccggagaauuaucgaaaagcugaacaauaaaaaggggaaaaacaagcuccuggauggagagcgccuugccgaccggagaaucgccgagcuguuuuccaccaaaacacacauuggcuga

SEQ ID NO: 13721 - RNA, 3495 nt, Artificial Sequence
  derived and/or modified CDS sequence (opt5) from CCHVF(CCHVF 10200)__U39455.2__Gn-NSm-Gc
agcgaggaacccuccgacgauugcgugucuagaacccagcugcuccggacagagacggccgaaauccacggcgacaacuacgggggaccuggcgauaagauuaccaucuguaaugggagcacaauugucgaccaacgccugggauccgagcuuggcugcuauaccaucaacagaguucggucuuucaaacugugugaaaauagcgcuacagggaagaacugcgagauugauuccgugccggugaaaugucgccagggauacugccucagaaucacccaggagggccggggccaugucaagcugucucgcgggagcgaagugguucuugacgccugugauacauccugcgagaucaugauucccaaaggaaccggcgacauccugguggauuguagcgggggacagcaacacuuucucaaggacaaucugauugaucugggcugcccuaagaucccccuccuggggaaaauggcgauuuauaucuguagaaugucuaaccauccuaagacgaccauggcuuuccuguuuugguucuccuuuggauacgucauuacaugcauccugugcaaagccaucuucuaucuccugauuaucgugggcacccuuggccggcgccugaagcaguacagagaacucaaaccccagacauguaccauuugcgagacgacaccuguuaaugccaucgacgcugagaugcacgaucugaacuguagcuauaauauuugcccguacugugccucucggcugaccuccgacgggcucgcucgccaugugauccagugccccaagagaaaggaaaaagucgaggaaacagagcuguaccuuaaccuggaacggaucccuuggguggugcgcaagcuccugcaagucagcgagucuaccggaguugcccuuaaaagauccagcuggcugauugugcuccuggugcuguuuaccgucucccucucucccgugcagagcgcgccuaucggccaggggaagacaauugaggccuaucgggcuagagaaggauacacguccaucugucuguucguucuuggcagcauucuguuuaucgugucuugccucaugaaagggcuggucgacuccgugggaaauagcuucuuucccggccuuucuaucuguaagaccugcagcauuuccucuaucaacggcuucgagauugaaagccacaaauguuauugcucccuguuuugcuguccguacugccgccacuguagcacagauaaggagauccauaagcuccaccugucuauuugcaaaaagcggaaaaccggguccaauguuaugcuggccguguguaagcucaugugcuucagagcuacaauggaagucagcaaccgcgcccuguucauccggucuauuaucaauaccacguuugugcuuuguauccugauucucgcggucugcgugguuuccacaagcgccguggagauggagaaccugccugcuggaaccugggaaagagaggaagaccugaccaacuucugucaucaggagugccaagucacagaaaccgagugucuuugccccuaugaggcccucgugcugcgcaaaccucuguuucucgauuccacagcuaagggcaugaagaaucugcuuaacucuacgagccuggaaaccucccucucuaucgaggcccccuggggagccauuaauguucagagcacauacaaacccaccguguccacagcuaacaucgcgcugagcuggucuuccgucgaacaccgggggaauaagauucuggugagcggcagaucugaguccaucaugaaacuugaggaacgcaccgggaucagcugggaccucggcguggaggaugccucugaaagcaagcugcugacgguuuccgucauggaccucagccagauguauucuccuguguucgaguaccuguccggagaucggcaaguggaagaguggccgaaagcuaccugcacaggcgacugucccgagagaugcggguguaccagcuccacaugccuucacaaggaauggccucauucucgcaacuggcgguguaaucccaccuggugcuggggagucggcacgggguguacaugcuguggacuggaugugaaggaccucuuuaccgauuacauguucguuaaauggaagguggaguauauuaaaacagaagccaucgucugcguggagcugaccagccaggaaagacaguguucccugauugaggccggcacccgguuuaaccuugggccuguuacaaucacgcucucugagccccgcaauauucagcaaaagcugccgccugaaaucaucacccugcaccccagaauugaggaaggcuucuuugaccucaugcaugugcagaaaguccugagcgcuuccacagugugcaaacuucagucuugcacccacggaguuccuggcgaccuucagguguaccauaucgggaaccuccugaagggagauaaagucaauggccaccugauucacaagaucgagccccauuucaacacaagcuggauguccugggacgggugugaucuugacuauuacugcaauaugggagauuggccuagcuguaccuauacgggcgugacacaacacaaccaugccucuuuugugaaucuccugaacauugaaaccgacuacaccaaaaacuuccacuuucacuccaagcgggucacagcgcauggggauacaccccagcuggaccucaaagcuagaccgaccuauggcgccggagagaucacgguucugguggagguggccgauauggaacuucacaccaagaaaaucgagauuagcggccugaaguucgcuucucucgccugcacaggguguuacgcuugcuccagcucuaucuccuguaagguccgcauucauguggacgaaccugaugagcugaccguucacgugaaaagcgacgaucccgacgucguggccgcguccagcucucugauggcccggaaacuugaguucggaacagacagcaccuuuaaggcuuucuccgccaugcccaagacgucucugugcuuuuacaucguugaaagagagcauuguaaaagcugcuccgaagaggauaccaagaagugugugaauacaaaacucgaacagccucagucuauucugaucgagcacaagggcaccauuaucgggaaacaaaacagcacaugcaccgcuaaggccuccugcuggcucgagucugucaagagcuucuuuuauggacugaagaauaugcuuuccggcaucuucgggaacguguuuaugggcauuuuccuguuucucgcgccguucauccugcugauucuguuuuucauguuuggauggcgcauccuuuucuguuucaagugcuguagacggacacgcggccucuuuaaauacagacaccugaaggacgaugaagagaccggguaucggcgcauuaucgaaaaacucaauaacaagaaaggaaagaauaagcugcuugacggcgagagacuggccgaugggcggaucgcugaacucuucagcacgaaaacacauauugga

SEQ ID NO: 13722 - RNA, 3495 nt, Artificial Sequence
  derived and/or modified CDS sequence (opt5) from CCHVF(CCHVF IbAr10200)__AF467768.2__Gn-NSm-Gc
agcgaggaacccuccgacgauugcaucucuagaacccagcugcuccggacagagacggccgaaauucacggcgacaacuacgggggaccuggcgauaagaucaccauuuguaaugggagcacaaucguggaccaacgccugggauccgagcuuggcugcuauaccauuaacagaguccggucuuucaaacugugugaaaauagcgcuacagggaagaacugcgagaucgauuccguuccggugaaaugucgccagggauacugccucagaaucacccaggagggccggggccaugugaagcugucucgcgggagcgaagucgugcuugacgccugugauacauccugcgagauuaugauccccaaaggaaccggcgacauucugguugauuguagcgggggacagcaacacuuucucaaggacaaucugaucgaucugggcugcccuaagauuccccuccuggggaaaauggcgaucuauauuuguagaaugucuaaccauccuaagacgaccauggcuuuccucuuuugguucuccuuuggauacgugaucacaugcauccugugcaaagccauuuucuaucuccugaucauugucggcacccuuggcaagcggcugaaacaguaccgcgaacucaagccccagacauguaccaucugcgagacgacaccugugaaugccauugacgcugagaugcacgaucugaacuguagcuauaauaucugcccguacugugccucuagacugaccuccgacgggcucgcucggcauguuauccagugccccaagcgcaaagaaaagguggaggaaacagagcuguaccuuaaccuggaacggauuccuugggucgugagaaaacuccugcaagugagcgagucuaccggagucgcccuuaagcgcuccagcuggcugaucguucuccuggugcuguuuaccgugucccucucucccguccagagcgcgccuauuggccaggggaaaacaaucgaggccuauagagcucgggaaggauacacguccauuugucuguucgugcuuggcagcauccuguuuaucguuucuugccucaugaaggggcugguggacuccgucggaaauagcuucuuucccggccuuucuauuuguaaaaccugcagcaucuccucuauuaacggcuucgagaucgaaagccacaaguguuauugcucccuguuuugcuguccguacugcagacacuguagcacagauaaggagauucauaaacuccaccugucuaucugcaagaaacgcaagaaaggguccaaugugaugcuggccguuuguaagcucaugugcuuccgggcuaccauggaagugagcaacagagcccuguucauucgcucuaucaucaauacaaccuuuguccuuuguauucugauccucgcggugugcgucguguccacgagcgccguugagauggagaaccugccugcuggaacaugggaacgggaggaagaccugaccaacuucugucaucaggagugccaagugaccgaaacagagugucuuugccccuaugaggcccucguccugagaaagccucuguuucucgauuccaccgcuaaaggcaugaagaaucugcuuaacucuacaagccuggaaacgucccucucuauugaggcccccuggggagccaucaaugugcagagcaccuacaaacccacaguuuccaccgcuaacauugcgcugagcuggucuuccguggaacaccgcgggaauaagauccuggucagcggccggucugaguccaucaugaaacuugaggaaagaacagggauuagcugggaccucggcguggaggaugccucugaaagcaagcugcugaccguguccguuauggaccucagccagauguauucuccugucuucgaguaccuguccggagaucgccaagugggcgaauggccgaaggcuacgugcaccggggacugucccgagcggugcggauguacaagcucuaccugccuucacaaagaguggccucauuccagaaacuggcgcuguaaucccacauggugcuggggcguggggaccggauguacgugcuguggccuggaugucaaggaccucuuuacagauuacauguucgugaaauggaagguugaauauaucaaaaccgaggccauugugugcgucgaacugacaagccaggagcggcaguguucccugaucgaagccgggaccagauuuaaccuuggcccugugaccauuacacucucugagccccggaauauccagcaaaagcugccgccugagaucauuacgcugcacccccgcaucgaagagggauucuuugaccucaugcauguucagaaggugcugagcgcuuccaccgucugcaaacuucagucuugcacacacggcgugccuggggaccugcagguuuaccauauuggaaaccuccugaagggcgauaaagugaaugggcaccugauccacaagauugaaccccauuucaacaccagcuggauguccugggacggaugugaucuugacuauuacugcaauaugggcgauuggccuagcuguacauauaccggggucacgcaacacaaccaugccucuuuugugaaucuccugaacaucgagacagacuacaccaaaaacuuccacuuucacuccaagagagugaccgcgcauggcgauacaccccagcuggaccucaaagcucggccgaccuauggagccggcgaaaucacaguccugguugagguggccgauauggagcuucacacgaagaagauugaaaucagcgggcugaaauucgcuucucucgccugcaccggauguuacgcuugcuccagcggcauuucuuguaaggugagaauccaugucgacgagccugaugaacugacagugcacguuaaauccgacgaucccgacguggucgccgcgagcuccagccugauggcccgcaaacuugaguucgggaccgacucuacauuuaaggcuuucagcgccaugcccaagaccucccugugcuuuuacauuguggagcgggaacauuguaagucuugcagcgaggaagauacgaaaaaguguguuaauaccaaacucgagcagccucaguccauccugauugaacacaagggaacaaucaucggcaaacaaaacucuaccugcacagcuaaggccagcugcuggcucgaguccgugaagucuuucuuuuaugggcugaaaaauaugcuuagcggcauuuucggaaacgucuuuaugggcaucuuccuguuucucgcgccguucauucugcugauccuguuuuucauguuuggguggcgcauucuuuucuguuucaagugcuguagaagaacccggggacucuuuaaauaccgccaccugaaggacgaugaggaaacaggcuauagacggaucaucgagaaacucaauaacaagaaggggaaaaauaagcugcuugacggagaacgccuggccgauagacggauugcugagcuuuucuccaccaaaacgcauaucggc

SEQ ID NO: 13723 - RNA, 3495 nt, Artificial Sequence
  derived and/or modified CDS sequence (opt5) from CCHVF(CCHVF Turkey-Kelkit06)__GQ337054.1__Gn-NSm-Gc
agcgaggaacccggcgacgauugcaucuccagaacccagcugcuccggacagagacggccgaaauucacgacgauaacuacgggggaccuggcgacaagaucaccauuuguaaugggucuacaaucguggaucaacgccugggaagcgagcuuggcugcuauaccauuaacagagucaaauccuucaagcuguguaaaaauucugcuacagggaagaccugcgaaguugacagcacaccggugaaaugucggcagggauuuugccucaagaucacccaggagggccgcggccaugugaagcuguccagagggucugaggucgugcuugaugccugugacagcuccugcgaaguuaugauccccaaaggaacgggcgauauucugguggacuguagcgggggacagcaacacuuccucaaggauaaccugaucgaccugggcugcccucauauuccccuccuggggcggauggcgaucuacauuugucgcaugucuaaucacccuagaaccacaauggcuuuucuuuucugguuuuccuucggauaugucauuaccugcaucuuuugcaaagcccuguucuacagccucaucaucauuggcacacugggcaagaaaaucaagcaguaucgggagcuuaagccccagaccuguacgauuugcgaaacagccccugugaacgcuaucgaugccgagaugcaugaccugaauuguucuuacaacauuugcccguauugugcuucccgccucaccagcgacgggcuggccagacacguuacacagugccccaaacggaaggagaaaguggaagagaccgaacuguaccucaaucuggagcgcaucccuuggaucgucagaaaacuucugcaagugucugaauccaccggaguggcgcucaaacggagcuccuggcugauuguccuucugguucuccugacagugucucugagccccgugcaguccgccccugucggccacgggaagacgaucgagauuuaccagacccgcgagggauuugcuagcaucugucucuucaugcugggcucuauucuuuuuaucguguccugccugguuaaagggcucguggauagcgucucugagagcuucuuucccggacuguccguguguaagacaugcucuaucggcagcguuaacggcuucgaaauugaaucccauaaguguuauugcagccuuuucugcuguccguacugcagacacuguucugccgaccgggagauccaucagcugcaccucuccauuugcaaaaagagaaaaaccgggagcaaugugaugcuggcugucuguaagcgcaugugcuuucgggccacaaucgaagcgucuagacgcgcccugcucauucgguccaucauuaacaccacguucgugaucuguauccugacacuuaccauuugcgucgugagcaccuccgcuguugagauggagaaucugccugccggaacaugggaaagagaggaagaucucaccaacuuuugucaccaagagugccaggugacagaaacggagugucugugccccuaugaggcucugguccuucgcaaaccucucuuccuggacucuaucgugaagggcaugaagaaucugcucaacagcaccucccuggaaacaucucuuagcauugaggcccccuggggagccaucaacguucaguccaccuuuaaacccacagugagcaccgcuaauauugcgcugucuugguccagcgucgugcaucggggaaacaagauccucgugacgggcagaucugaauccaucaugaaacuggaggagcgcaccgggguuagcugggaucugggcgucgaagacgccucugagagcaaacuucucacaguguccauuauggaucugagccaaauguacucuccuguguucgaauaucuguccggagaccggcaggucgaggaauggccgaaggcuaccugcacaggcgauugucccgagagaugcggguguaccagcuccacgugccuccacaaggaguggucucauagccgcaauuggcgguguaacccuacauggugcuggggagugggcaccggguguacaugcuguggaguugacgugaaggaucuguuuaccgaccacauguucgucaaauggaagguggaauacaucaaaaccgaggccauuguuugcguggcccuuacaucccaggaaagacaguguucucugaucgaggcuggcacgcgguuuaaucucgggcccgucaccauuacacugagcgaaccucgcaacauccaacagaagcugcccccggagaucauuacccuucauccuaaaaucgaggaaggcuucuuugaccucaugcacgugcagaagguucuguccgccucuacagugugcaagcugcagagcugcacccacgggauucccggcgaucuccaagucuaucauaucgggaaucugcuuaaaggagacagagugaacggccaccugauucauaagaucgagucccacuucaauacgagcuggaugucuugggaugggugugaccucgauuacuacugcaacaugggagacuggccuuccuguacauauaccggcgugacccagcacaaucaugcggcuuuugucaaccugcugaauaucgaaacagauuacaccaaaacauuccacuuccauagcaagcggguuacggcccacggggacacaccccagcuugaucucaaagccagaccuaccuauggcgcuggaggcauuaccgugcugguggaggucgccgacauggaacugcauacaaagaaaguggagaucucugggcucaaguuugcuucccuggccugcaccggauguuacgcgugcagcucuggcauuuccuguaagguucgcauccacguggaugagcccgacgaacuuacgguccacgugaaaagcuccgauccggacguuguggccgcuagcaccucucugauggcccggaagcucgaguucgggacagacagcaccuuuaaggcuuucuccgccaugccuaagacaucucugugcuuuuauauugucgaaagagaguacuguaaaagcugcuccgaggaugacacccagaaguguguggauacacgccuggaacaaccccagucuauccuuauugagcauaagggaaccaucaucggcaaacagaacgacacgugcacagcgaaggccagcugcuggcuggaauccguuaaaucuuucuuuuaugggcucaagaauaugcugggcagcguguucggaaaccucuuuauuggcauccugcuuuuccuggcucccuuuguccuccuggugcuguucuuuauguucggguggaaaauucuuuucuguuuuaagugcuguagacggacccgcggacuguucaaguacagacaccucaaagaugacgaggaaaccggcuaccggcgcaucauugagagacugaacuccaagaaagggaagaaucggcuccuggauggagaccgccuugccgauagaaaaaucgcugagcuguuuagcacaaagacccauaucggc

SEQ ID NO: 13724 - RNA, 3498 nt, Artificial Sequence
  derived and/or modified CDS sequence (opt5) from CCHVF(CCHVF SR3)__AJ538199.1__Gn-NSm-Gc
agcgaggaauccggcgacgauugcaucucuagaacccagcugcuccggacagagacggccgaagugcacggggacaacuacggaggccccggggauaagauuaccaucuguaauggaagcacagucguugaccaacgccugggcuccgagcuugggugcuauaccauuaacagagugcggucuuucaaacugugugaaaauagcgcuacaggaaaguccugcgagaucgauucuauuccugugaaauguaagcagggcuacugccucaaaaucacccaggagggccgcgggcaugucaagcugagcagaggauccgaagugguucuugacgugugugauagcucuugcgaggucaugaucccgaagggcacaggggacauucugguggauuguuccggaggccagcaacacuuucucaaagacaaccugguugaucuggggugccccaagaucccucuccugggaaaaauggccauuuauaucugucggaugagcaaucaucccaagaccacgauggcguuccuguuuugguucucuuuuggcuacgugauuaccugcauccugugcaaagcuauuuucuuucuccugaucaucuucggcacacuugggaagcgcuuuaagcaguauagagaacugaaaccucagaccuguacaauuugcgagaccacgcccgucaacgccaucgacgccgagaugcacgaucucaauuguuccuacaacauuugcccuuauugugcuagccggcugacaucugacggacuggcccgccaugugacccagugcccgagacggaaggaaaaaguggaggaaacagagcucuaccugaaucuugaacgcauccccugggucguuagaaagcugcuccaaguguccgagagcaccggcaccgugcugaaacgguccucuuggcuuauuguccugcucgugcuguucacaguuagccuguccccugugcagagcgcucccaucgggcacggaaagacgaucgagaccuaccgcgucagagaagaguauacaucuauuugucucuuugugcugggcuccauccuuuucauuguuagcuuucugaugaaagggcucguggacggagucggcaacaucuucuucccuggccugucugugugcaagaccuguagcauuggguccaucaauggauuugaaaucgagucucacaagugcuacuguagccuuuucugcugccccuauugucggcauugcuccgccgauggcgaaauucaccagcugcaucucagcaucuguaaaaagagaaaaacagggucuaacgucaugcuggcggugugcaagcgcauguguuuucgggccaccauggagguuuccaauaaagcucuguucauuagaagcaucauuaacacgacauuugugaugugcauccucaagggagaguucgccgcugucaagucuauucacccgaucgaaauggagucccugccugccggcaccugggaacgcgaggaagaccuuaccaauuuuugucaccaggagugccaagugacagagaccgaaugucugugccccuacgaggcgcucguucugcggagaccucuguuccuugauagcaucgugaaagggaugaagaaccuccugaacuccacaucucuggaaacgagccucuccauugaggcccccuggggcgcuaucaauguccagucuaccuauaaacccacagugagcaccgccaacauugcucuguccuggagcucuguggagcaucgcggaaauaagguucuugucuccggccggagcgaaucuaucaugaaacuggaggaaagaacagggauuuccugggaccucggaguggaggaugccagcgaaucuaagcugcugaccgugagcgucauggaccuuucccagauguacagcccuguguuugaguaucucucuggcgaucgccaaguugaggaauggccgaaggccacguguaccggggacugccccgagcggugcggauguacauccucuaccugccugcacaaagaauggccucauuccagaaacuggcgcuguaaucccacauggugcuggggcguggggaccggcuguacgugcuguggacuggaugucaaggaccucuucacagauuacauguuugugaaauggaagguugaguacaucaaaaccgaagcuaucgugugcgucgagcugacaucucaggagcggcaguguagccuuauugaagcgggcaccagauucaaccugggguccgugaccaucacacucucugagccucggaauauucagcaaaagcugcccccggaaaucauuacgcugcacccuaagaucgaggaaggauuuuucgaccuuaugcauguucagaaagugcucagcgccuccaccgucugcaagcugcagucuuguacacacggcgugcccggggaccuucagguguaucacaucggaaaccuccugaaaggcgaucgcgucaaugggcaucuuauucacaagaucgagcaacauuucaacaccagcuggauguccugggacggcugcgaucuggacuacuauugcaauaugggagauuggccuagcuguacauacaccggcguuacgcagcacaaccacgcuucuuuugugaaucuccugaacauugagacagacuauaccaaaaccuuccauuuucacuccaagagagugacagcccauggggauacaccccagcuggaccuuaaagcccggccuaccuacggagcuggcgaaaucacgguccucguggagguugccgauauggaacugcacaccaagaagauugagaucagcgggcugaaauucgcgggacucacaugcaccggcuguuaugcuugcagcuccgggaucagcuguaaggugcgcauucaugucgacgagcccgaugaacugacagugcacguuaaaucugacgauccggacguggucgccgccuccagcucccuuauggcuagaaagcuggaguuuggcaccgacagcacguucaaagccuuuucugcuaugccuaagaccagccucugcuucuacaucguggaacgggaguacuguaaguccugcaauaaagaagauacacagaaguguguuaacaccaaacuggagcaaccccagucuauucugaucgagcacaagggaacaauuaucggcaaacagaacaauaccugcacagccaaggcgagcuguuggcuugaauccgugaagucuuucuuuuaugggcugaaaaacaugcucggaggcauuuuugggaaugucuucaucggaaucuuuaccuuccugacgcccuucauucuccugauccuguuuuucauguuuggcuggcgcauucuuuucugcuuuaagugcuguagaagaacacggggccucuucaaauaccgccaucugaaggacgaugaggaaaccggguauagaaaaaucauugagcggcugaacaauaagaagggcaaaaaccgccuucuggacggagaaagacucgccgaucggaagaucgcugagcuguuuagcaccaaaacacacaucggg

SEQ ID NO: 13725 - RNA, 3498 nt, Artificial Sequence
  derived and/or modified CDS sequence (opt5) from CCHVF(CCHVF UCCR4413)__KY484038.1__Gn-NSm-Gc
agcgaguccucugccagcggcugcaucuccagaacccagaugauuaagucugaaacagcugagauccacgacgauauuuacgggggacccggcgaaaaacugacgaucuguaacgggaccacaguggucgaccaacggcucggaagcgagcugggcugcuauaccauuaaucgcaucaagacauacaaacuuugugaaaacuccguuaaggagaaaaccugcgagaucgauucugugccugugaaguguagacaggggcugugccucaagauuacacaggaaggacggggccaugucaaacugagccgcggcuccgagaucgugcuugacauuugugauagcucuugcgaacugaugaucccgaaggggaccggagacauucucguugauuguuccggcgggcagcaacacuuccugcaggacaaucugguggaucucggaugccccaacaucccucugcuuggcaaagucgccauuuauaucuguagaaugagcaaucaucccaagacgaccauggcguuucuguucugguuuucuuucggguacgugaucacaugcauucucugcaaaauccuguuuuaucuucugauuaucaccggaacacucggcaagaagcugaaacaguaccgggagcugaagccucagaccuguacgauuugcgaguccacacccguuaacgcuaucgacgccgaaaugcacgaucucaauuguagcuauaacaucugcccuuacugugccucucgccugaccuccgacggccuuauuagacaugugaaucugugcccgaaacggaaggagaaagucgaagagacagaacucuaccugaaccuugagcgcauccccugguucgugagaaagcugcuccaagugagcgaguccaccggggucgcucugaaacggucuagcuggcugcucauucugguuauccuucugaccguguccaugagcccugugcagucugcccccauuaaucagcagcgcgcugucgaagccuaucaagcgagagagggauacacaggcaucugucucuuuauccugggguccgugcuuuucaugacgagcuggcugaccaagggacucauugauucuaucggcgacagcuuuuucccugggcuguuuguuugcaagacauguuccauuggaucuaucaacggcuucgaaauugagagccaccggugcuauuguucccugcucugcugccccuacuguagaaccugcagcgccgacaaagauucucaccagcugcaucuuuccaucuguaagaaaaagaaagcuggcagcaaugugaugcuggccgucugcaagcgcauguguuuuaaggcuacaauugaagccucuaaccgggugcuccugaucagauccaucauuaauaccacguucaucauuugcaugcugauccuuguugugugugucauuagcacauccgcgguggagauggaggaccucccggccgggaccugggaacgcgaggaagaucugaccaacuucugccaccaggagugucaagucacagaaaccgagugccuguguccuuaugaggcuuuugugcuccggaaaccccuguuccuuucuagcaucguuaaggggaaaaagaaccugcucaauuccgccucucuggaaacaagccuguccaucgaggcuccuuggggcgccauuaacgcccagagcacguuuaaacccaccaucucuacagcuaauauugcgcuuuccuggagcucuguggaacauagagggaacaagguccucguguccggacgcagcgagucuaucaugaagcuggaggaacggaccggcauuagcuggaaucuggggguugaggacgccuccgaaagcagaaugcucacagugucugucauggaucugucccagauguaccuucccguguucgaguaucugagcggcgaccgccagguggaagaguggccuaaagcuaccugcacgggagauugcccggagcgguguggcugcaccuccucuacaugucuccacaaggaauggccccacagcagaaacuggcgcugcaauccuaccugguguuggggaguuggaacaggcugcaccuguugcgggcuggacgucaaagaucuguuuacggacuacauguucgugaaguggaaaguggaguacaucaagacagaagccaucgucuguguggagcuuaccucccaagaacggcagugcucucucauugaggccggaacaagauuuaaccugggccccguuaccaucacccugagcgagccucgcaauauucagcagaagcuccccuccgaaaucgugacacugcauccgaaaauugaggaaggguucuuugaucuuaugcacguccaaaaggugcugucugcuagcacgguuuguaaacuccaguccugcacccauggcguggccggagaccugcaggucuaucacgugggcaaccugcuuaagggggacaaaaucaauggacauagcauccacaagauugagccucaccucaacacaucuuggauguccugggauggcugcgaccuggauuacuauuguaauaugggggacuggcccagcugcaccuacacaggaguuacccagcauaaccacgcggcuuucgugaaucugcucaacaucgaaacggauuauacaaaaucuuuucauuuccacuccaagcgggucaccgcccacggcgacaccccucaacuggaucuuaaggccagacccauguacggggcuggcgagauuacagugcugguggaggucgccgacauggaacuccauagcaaaaacaucgagauuucuggacugaaguuugcuucccugaccuguagcggcugcuaugccuguuccagcgggaucucuugcaaaguucggauucacguggaugaaccugacgagcuugcggugcaugucaagagcgaugaccuggaugugguugccgcuuccucuagccucauggcccgcaaaaucgaguucggaacagacuccacguucaaggcuuuuucuagcaugcccaaggaaucccuguguuucuacaucguggagagagacuuuugcaaaucuugugccgcggaagauacccagaagugcgucaaagccaagcucgagcagccgcagagcauucugaucgaacacaaaggcacaauuaucgggaagcaaaaugacaccuguuccacaaagaccagcugcuggcuugagucuuucaaauccuuuuucuacggacugaagaacaugcucagcggcguguuugggucugcuauuaugggcauccugcuguuccuugccccuuuuauccugcucauucuguucuuuuucuuuggauggcggauccucuucugccugagauguugccgccggacgagaggccuuuucaaauauaagcauauuaaagaugacgaggaagcuggguacaagaagaucauugagaaacugaauaacaagaaaggaggcaccuccaagcuccuggauggggaacgccuggccgacagaaaaaucgccgagcuuuuuagcacaaaggcucacaucgga

SEQ ID NO: 13726 - RNA, 3495 nt, Artificial Sequence
  derived and/or modified CDS sequence (opt5) from CCHVF(CCHVF 66019)__AB069669.1__Gn-NSm-Gc
agcgaggaauccggcgacgauugcaucucuagaacccagcugcuccggacagagacggccgaagugcacggggacaacuacggaggccccggggauaagauuaccaucuguaauggaagcacaauugucgaccaacgccugggcuccgagcuugggugcuauaccaucaacagaguuaaaucuuucaagcugugugaaaauagcggaacaggcaaauccugcaagauugauaacaccccugugaaaugucggcagggcuuuugccucaagaucacacaggaggggcgcggacaugugaagcugucuagaggcagcgaggucgugcuugacgcuugugauuccagcugcgaaaucaugauuccgaaagggaccggagacauccugguugauuguucuggcgggcagcaacacuuccucaaggacaaucugguggaucugggaugccccaacauuccucuccugggcaaaauggccaucuacauuugucggauguccaaucaucccaagacgaccauggcguuucuuuucugguuuagcuucggcuaugucaucacaugcaucuuuugcaaaauuaucuucuaccugcucauugugguugggacccugggaaagaaguuuaaacaguaucgcgagcuuaagccucagacauguaccaucugcgaaacgacacccaccaacgcuauugacgccgagaugcacgaucugaaauguucuuacaauaucugcccuuauugugccuccagacucacaagcgacggccuggcucggcaugugacccagugcccgaagcgcaaagagaaggucgaagagaccgaacuguaccucaaccuggagcggauucccuggaucgugagaaaacuucugcaagugucugaauccacaggggucgcccucaagcgcagcuccuggcugaucguucuucuggugcuccugacggugucucugagcccuguccaguccgcucccauuggacacggcaagaccaucgaggccuaccagacaagagagggguauaccagcgugugucucuucaugcugggaggcauucuuuuuguugugucuugccugaugaaaggccucgucgacuccgugagcaauucuuucuuuccugggcugagcaucuguaagacaugcuccauuggaucuguuaacggcuucgaaaucgagagccacaaauguuacugcucccuucugugcugucucuauugccggcauuguagcgcggaucgcgaaauccaccagcugcaucugucuauuugcaagaaaagacgggccgggggaaaugugaugcucgcugucuguaagagaaugugccugcgcgccaccauggagguguccaacaagguccuuuucauccggagcauuaucaauacgacauuugugauuuguauccugguucucgcugugugcauugucucuaccuccgccguggaaauggagagccugcccgcgggcaccugggagagagaagaggaccugacaaacuucugucaccaagaaugccagguuaccgagacagaaugucuuugcccguacgaggcccucgugcugcgcaaaccucuguuuuccgauucuaucgucaaggggaugaaaaaccuccugaauagcacgucccuugagaccucucugagcaucgaagcucccuggggcgccauuaacgugcaguccacauucaagccuaccgugagcacagcuaauaucgcccucucuugguccagcguugagcaccggggaaacaaaauucuggucucuggcagauccgaaagcaucaugaagcuggaggagcgcaccgggauuucuugggaccuuggaguggaagaugccagcgaguccaagcuccugacggugagcgucauggaccugucucaaauguauucccccguguuugaauaccucagcggcgaucggcagguugaggaauggcccaaagcuaccugcacagggaauuguccugacagaugcggauguaccuccucuacaugccugcauaaggaguggccgcacagccgcaacuggcgguguaaucccaccuggugcuggggcguggggacgggcuguacaugcuguggacuugaugucaaagaccuguucaccgauuauauguuugugaaguggaaaguugaguacaucaagacagaagcgaucgugugcgucgagcucaacucccaggaaagacaguguucucugauugaggccggcacccgcuucaaucuggggccugugaccaucacacuuagcgaaccccggaacauucaacagaagcucccuuccgagaucauuacgcugcaucccagaaucgaggaaggauuuuucgaccugaugcacguucagaaagugcucucugcuagcaccgucugcaagcugcaguccugcacacauggcgugccgggggaccuucaaaucuaccacauuggaaaucugcucaaaggcgaucgggugaacgggcaccugauccauaagauugagccucacuuuaauaccagcuggaugucuugggacggcugugaucuggacuauuacugcaacaugggagauuggcccuccuguacauauaccggcgucacgcagcauaaucacgccgccuucguuaaccuucucaacaucgaaacagacuacaccaaaaauuuucacuuccauagcaagcgcgugaccgcucacggggauacaccucagcuggaccugaaagccagacccaccuauggagcgggcgagauuacagugcucgucgaaguggcugauauggagcugcauacgaagaagaucgccaucucugggcuuaaauucgccucccugaccugcacaggauguuacgcuugcagcucuggcauuuccuguaagguucggauccacguggacgagccugaugaacucaccguccaugugaaaagcgaggaccccgauauuguugccgcuuccagcucucugauggccagaaagcuggaauuugggacagacagcaccuucaaagcguuuuccgccaugccgaagacgucucuuugcuucuauaucguggagcgcgaguacugugaaagcugcuccaaggaggacacccagaaaugugucaacacaaagcuggaacaaccucagucuauucucaucgagcacaaaggcaccauuaucggaaagcagaaugauacaugcaccgcuaaagccagcugcuggcuggaauccgugaagucuuucuuuuacggccucaagaacaugcugagcgggaucuuuggaaauguuuucauuggcaucuuucuuuuccuggcucccuuuauucuccugauccuguucuuuauguucggguggcggauucuuuucuguuuuaaaugcuguagacgcacaagaggacuguucaaguaucgguaccucaaagacgaugaggaguccggcuaucgcagaaucaucgaacggcugaacaauaagaaaggcaagaacaagcuccuggacggggagcgccuugccgauagacggauugcggaacuguuuagcaccaaaacgcacaucgga

SEQ ID NO: 13727 - RNA, 3495 nt, Artificial Sequence
  derived and/or modified CDS sequence (opt5) from CCHVF(CCHVF 7001)__AB069670.1__Gn-NSm-Gc
gccgagggcgggagcuccgacugcaucucuagaacccagcuggugaagacagaagucgcugagauucacgaagauagcuacggaggccccggggagaaaaucacgauuuguaacggauccaccaucguugaccaacggcucggcucugaacuggggugcuauacaauuaaucgcgugagaagcuacaaacuuugugagaacuccgccucuggaaaaagcugcgagaucgauuccaucccugugaaguguaaacagggcuucugccugaagauuacccaggaaggccgggggcaugucaagcucagccgcggaacagagaucgugcuggacguuugugauucuuccugcgaacuuaugauuccgaaaggcaccggggacauccugguggauuguagcggaggccagcaacacuuucuccagaauaaccugauugaccuggggugccccaaugucccucuccugggaaagauggcgaucuauguguguagaaugucuaaccaucccaaaacaaccauggcuuuccuguuuugguucuccuuuggcuacguuauuacgugcaucgccugccgggugcuuuucuaucuccugaucgccauuggcaccgucgggaagaaacuuaagcaguaccgcgagcugaagccucagacauguaucgugugcgagagcgugcccgucaaugcuauugaugccgaaaugcacgagcucaacuguucuuauaauaucugcccuuacugugcuuccagacugagcaccgacggacugauucggcauguuacacaaugcccgaaacgcagagaaaagguggaggaaaccgagcucuuucugaaccuugagcggauccccuggcuggugcgcaaacuccugcaggucuccgaaucuacgggcauggcccuuaagagaagcuguuggaugaucacacugcucauucugcugcucguguccaucagcccuguucagucugcgcccguggggaaagagcgggccauugaaaccuaccaggcucgcgagacauauaccggaaucugccuguucguccuuggcuccgugcuguuugccguuagcuggcucaccaaggcucugauugaugggaucggaaauucuuucuuuccuggccuuagcguguguaaaacaugcuccaucggcucuauuaacggguucgaaaucgagagccacaaguguuacugcucccuguuuugcugucccuauugcagagccuguagcucugacaagaauacgcaccggaugcaucucaacgucugcaaaaagagaaaaaugggauccaaugugaugcuggcggucuguaagcgcaugugcuuccgggccaccauugaggcuagcaacaaagcccugcucaucagaucuauuaucaacuccacauucgugauuuguauccugauccuuaccauuugcguugugagcacauccgcugucgauauggaaaaucugccggccggcaucugggagaaggaagaggaccucaccaacuuuugucaccaagaaugccaggugacggagacagagugucugugcccuuacgaagccaugguucugcgcaagccccuuuuccucgacaauauugcuaaagggaugaagucucugcugaacagcaccucccucgagaccucucugagcaucgaagcgccuuggggagccauuaaugugcaguccacauuuaaacccaccgucagcgcugccaacaucgcccuuucuugguccagcguggagcaucggggcaauaagauccuggugucugggagauccgagagcauuaugaaacucgaggaacgcacaggcguuucuuggaaccugggagucgaagaugcuagcgaguccaagacgcugaccgugagcgugauggaccuuucucaaauguauucccccgucuucgaauaccucagcggcgauagacagguggaggaguggccuaaggccacaugcaccggggacuguccggaaagaugcggauguacauccucuaccugccugcacaaagaguggccccacagccgcaauuggcgguguaacccuacguggugcuggggcguugggaccggauguacaugcuguggccuggaugugaaggacuuuuucaccgauuauaugcucgucaaauggaagguggaauacaucaaaacagaggcgauuguuugcguggaacugaccucccaggagagacaguguucucuuaucgaggcugggacgcgcuuuaaucugggccccgucacaauuacccucagcgaaccucggaacgugcaacagagacugcccccggagaucguuacacugcauccuaagaucgaagagggauucuuugaccuuaugcacgugcagaagauucucuccgccucuaccgucugcaaacugcagagcugcacccauggcgugcccggggauuuccaaguguaccacgucggaaaucugcuccggggcgacaagguuaacgggcauuccauccacaaaauugaaccucacuuuaauacaagcuggaugucuugggauggaugugaccuggacuauuucugcaacaugggcgauuggcccuccuguacguacaccggggugacacagcauaaccgcgccgcuuuuaucaauaugcuuaacauugagaccgacuauacaaagaccuuccacuuccauagcaaaagagugacggcccacggcgauacaccucagcuggaccucaaggcucggcccgccuacggagcgggcgaggucaccgugcugguugaaguggccgaucuggagcuucacaccaaaaagcucgaagucucugggcugaagaucgcuucccugacaugcagcggauguuaugccuguucuuccggcaucagcugcaaagugcggauucauguuaaugagccggacgaguuuaccgugcacguccgcuccagcgauccugacgugguugcugccgggucuagccucauggcgcggaagaucgaguucggagccgauuccacauuuaaggcuuucucuagcaugcccaaggacucccugugcuuuuacauuguggaaaaagauuauuguucuagcugcacggacgaugacacccagaagugugucaacacaaaacuugaccauccccaauccauccugauugaacacaagggcaccaucauugggaagcagaaugauacaugcucuaccaaaacgagcugcuggcucgaguccgugaagggcuucuuuuacggacugaaaaacaugcugagcggcaucuucgggaauguguuucuuggaaucuuccuguuucucgccccuuucguccugcucaucuuuuucuucuuuuucggcuggagacugcuguuuugucuuaagugcugucgcagaacccgggggcuccugaaguacaaacaucugaaggacgaagaggaggcuggauauaaaaagauuauugaacgccuuaacggcaaaaagggcaagucucagcuguucgauggggagagacucgccgaccggaaaaucgccgaacuguuuuccacaaagauucacaucgga

SEQ ID NO: 13728 - RNA, 3495 nt, Artificial Sequence
  derived and/or modified CDS sequence (opt5) from CCHVF(CCHVF 75024)__AB069671.1__Gn-NSm-Gc
agcgaggaauccggcgacgauugcaucucuagaacccagcugcuccggacagagacggccgaaauucacggggacaacuacggaggccccggggauaagaucaccauuuguaauggaagcacaaucguggaccaacgccugggcuccgagauggggugcuauaccauuaacagagucaaaucuuucaaacuuugugaaaauagcgcuacaggaaaguccugcgagaucgauucuaucccuguuaagugucggcagggcuacugccugaaaauuacccaggagggccgcgggcaugugaagcucagcagaggauccgaagugguccuggacgccugugauagcucuugcgaggugaugaucccgaagggcacaggggacauucuuguugauuguuccggaggccagcaacacuuucugaaagacaaccucaucgaucuggggugccccagcauuccucugcucggaaagauggcgaucuauauuugucggaugucuaaucaucccaaaaccacgauggcuuuccuguuuugguucuccuuuggcuacgugauuaccugcauccuuugcaaggccauuuucuaucugcucaucauugucggcacacuggggaaacgcuuuaagcaguacagagaacuuaagccucagaccuguacaaucugcgagaccacgcccgccaacgcuauugacgccgagaugcacgaucugaauuguagcuauaacaucugcccuuacugugcuucucggcucacauccgacggacuggcccgccaugugacccagugcccgaaaagaaaggaaaaaguugaggaaacagagcuguaccucaaucuggaacggauccccugggugguccgcaaacuucugcaagugagcgaguccaccggcguggcgcucaagagaucuagcuggcugauuguccuucugguucucuucgccaucucccugagcccugugcagucugcucccauugggcacggaaagaccaucgagacauaucaggcccgggaagaguacacguccauuugucuguuugugcucggcagcauccuguucaucgucucuugccuuaugaaagggcugguggacagcauuggaaacaucuuuuucccuggccucuccauuuguaagaccugcucuaucggcagcauuaauggguuugaaaucgagucccacaaguguuauugcagccugcuuugcugucccuacugccgccauuguucugcugauagagaaauucaccagcugcaucucuccaucugcaaaaagcggaaaacaggaagcaacguuaugcuggccguguguaagagaaugugcuuccgcgcgaccauggaggucucuaauaaagcccugcucauccgguccauuaucaacacaaccuucgugguuuguauucugauccuugcugugugcgucgugagcacguccgccgucgagauggaaucucugccggcuggcacaugggagagagaagaggaccucaccaauuuuugucaccaagaaugccaggugaccgagacagagugucugugcccuuaugaagcccugguucuucgccggccccucuuccuggauagcauugugagagggaugaagaaccagcugaacuccaccucucucgagacaagccuguccaucgaagccccuuggggagcuaucaauguccaaagcacguacaagcccaccgugucuacagcgaacauugcccuuuccuggagcucuguugagcaccgcggcaauaaaauccugguguccgggcggagcgagucuauuaugaagcucgaagagagaaccggcaucagcugggaccugggagucgaagaugcuuccgagagcaaacugcuuacagugucugugauggaccucucccagauguauagccccguuuuugaauaccuguccggcgaucgccaggucgaggaguggccuaaggcuaccugcacgggggacuguccggaacggugcggauguaccacaucuaccugccugcauaaagaguggccccacagcagaaacuggcgcuguaauccuacauggugcuggggcguggggaccggauguacgugcuguggccucgaugugaaggaccuguucacagauuacaugauugucaaguggaaaguggaauauaucaagaccgaggccaucguuugcguggaacuuacaucccaggagcggcaauguucucugauugaggccgggaccagauuuaaccucggcagcgucaccaucacacuguccgaaccccggaauauucagcagaaacugccucccgagaucauuacgcuucauccgcgcaucgaagagggauucuuugaccucaugcacgugcagaagguucugucugccagcaccgugugcaaacugcaauccugcacacauggcgucccuggggaccuccagguguaccacguuggaaaccugcuuaagggcgauaaggugaaugggcaccugauccauaaaauugaaccccaccucaacaccagcuggaugucuugggacggaugugaucuggacuauuacugcaauaugggcgauuggccuuccuguacauauaccggggucacgcagcauaaccacgcgagcuucgugaaucugcuuaacaucgagacagacuacaccaagucuuuucacuuccauuccaaaagagugaccgcucacggcgauacaccccagcucgaccugaaggcccggccuaccuauggagccggcgagauuacaguccugguugaaguggcugauauggaguuuacgcccaaaaagaucgaaauuagcgggcucaaauucgccucucugaccugcacaggauguuacgcuugcuccagcggcaucuccuguaaggugagaauccaugucgacgagccggaugagcuuaccgugcacguuaagagcgacgauccugacguggucgccgcgucuagcucccugauggcccgcaaacucgaauuugggacagacucuaccuucaaggcuuucagcgccaugcccaaaacgucccugugcuuuuacaucguggagcgggaauauuguaagucuugcagcaaagaggauacccaaaaguguguuaauacaaagcuggaacagccccaguccauccuuauugagcauaaaggaaccaucauuggcaagcagaacaacacaugcaccgcuaaagccucuugcuggcuggagagcgugaaguccuucuuuuacgggcucaaaaauaugcugagcggcaucuucggaaaccucuuuaugggcauuuuccuguuucuugcgccuuucauccugcucauccuguuuuucauguuuggguggcgcauucuguucuguuuuaagugcuguagaagaacacggggacuuuucaaguaucgccaccugaaagacgaugaagagaccggcuacagacggaucauugaacgccucaauaacaagaaagggaagaauaaacugcucgacggagagagacuggccgaucggcgcaucgcugaacuuuucucuacgaagacacacauuggc

SEQ ID NO: 13729 - RNA, 3495 nt, Artificial Sequence
  derived and/or modified CDS sequence (opt5) from CCHVF(CCHVF 7803)__AB069672.1__Gn-NSm-Gc
agcgaggaauccggcgacgauugcaucucuagaacccagcugcuccggacagagacggccgaaauucacggggacaacuacggaggccccggggauaagaucaccauuuguaauggaagcacaaucguggaccaacgccugggcuccgagauggggugcuauaccauuaacagagugaaaucuuucaaacuuugugaaaauagcgcuacaggaaaguccugcgagaucgauucuaucccuguuaagugucggcagggcuacugccugaaaauuacccaggagggccgcgggcaugugaagcucagcagaggauccgaagugauccuggacgccugugauagcucuugcgaggucaugauuccgaagggcacaggggacauccuuguggauuguuccggaggccagcaacacuuucugaaagacaaccucauugaucuggggugccccagcaucccucugcucggaaagauggcgauuuauaucugucggaugucuaaucaucccaaaaccacgauggcuuuccuguuuugguucuccuuuggcuacguuauuaccugcauucuuugcaaggccaucuucuaucugcucauuaucgugggcacacuggggaaacgcuuuaagcaguacagagaacuuaagccucagaccuguacaauuugcgagaccacgcccgccaacgcuaucgacgccgagaugcacgaucugaauuguagcuauaacaucugcccuuacugugcuucucggcucacauccgacggacuggcccgccaugucacccagugcccgaaaagaaaggaaaaaguggaggaaacagagcuguaccucaaucuggaacggauucccuggguugugcgcaaacuucugcaagucagcgaguccaccggcguggcgcucaagagaucuagcuggcugaucgugcuucugguccucuucgccauuucccugagcccuguucagucugcucccaucucccacgggaagaccauugagacauaucaggcccgggaagaguacacgagcaucugucuguuugugcucggaucuauccuguucauugugagcugccuuaugaaaggccuggucgacuccaucgggaacaucuuuuucccuggacucucuaucuguaagaccugcagcauuggcuccaucaauggcuuugaaauugagagccacaaguguuauugcucucugcuuugcugucccuacugccgccauuguuccgcugauagagaaauccaccagcugcaucucagcaucugcaaaaagcggaaaacagggucuaacgugaugcuggccgcguguaagagaaugugcuuccgcgccaccauggagguuuccaauaaagcucugcucauucggagcaucauuaacacaaccuucguggucuauauccugauucuugccguguguguuguguccacgucugcugucgagauggaaagccugccggccggaacaugggagagagaagaggaccucaccaauuuuugccaccaagaaugucaggugaccgagacagagugccuguguccuuacgaagcccugguccuucgccggccccucuuccuggauuccaucgugagaggcaugaagaacccucugaacucuaccagccucgagacaucccugagcaucgaagcucccuggggagcgauuaauguucagucuacguauaagcccaccguguccacagccaacaucgcucuuagcuggucuuccgucgagcaccgcgggaauaaaauucuggugagcggccggucugagagcaucaugaagcucgaagagagaaccgggauuuccugggaccugggcguugaagaugccagcgagucuaaacugcuuacaguguccgucauggaccucagccaaauguacuccccuguguuugaauaccugucuggagaucgccagguggaggaguggccgaaggcuaccugcacgggcgacugccccgaacggugugggugcaccacaagcaccugucugcauaaagaguggccucacuccagaaacuggcgcugcaaucccacaugguguuggggaguuggcaccgggugcacguguugcggacucgaugucaaggaccuguucacagauuauaugaucgugaaguggaaaguggaauacaucaagacccggggcauugucuguguggagcuuacaucucaggaaagacagugcagccugaucgaggccgggacccgguuuaaccucggcuccguuaccauuacacugucugagccucgcaauauccaacagaaacugcccccggaaauuaucacgcuucauccuagaaucgaggaaggauucuuugaccucaugcacgugcagaagguccugagcgccuccaccguguguaaacugcagagcugcacacauggcguucccggggaccuccaaguguaucacgucggaaaccugcuuaagggcgauaaggugaaugggcaccugauucauaaaaucgagccucaccucaacaccucuuggauguccugggacggaugcgaucuggacuacuauuguaauaugggcgauuggcccagcugcacauacaccgggguuacgcagcauaaccacgcgucuuucgugaaucugcuuaacauugaaacagacuauaccaaguccuuucacuuccauagcaaacgggucaccgcucacggcgauacaccucagcucgaccugaaggccagacccaccuacggagccggcgagaucacagugcugguggaggucgcugauauggaauuuacgccgaaaaagauugagaucucugggcucaaauucgccucccugaccuguacaggaugcuacgcuuguagcuccggcauuagcugcaagguucgcauccauguggacgaaccugaugagcuuaccgugcacgucaagucugacgaucccgacgugguugccgcgagcuccucucugauggcccggaaacucgaguuugggacagacagcaccuucaaggcuuucuccgccaugcccaaaacgucucuguguuuuuauaucguggaaagagaguacugcaagagcuguuccaaagaagauacccagaagugcgucaauacaaagcuggagcaaccucagucuauucuuaucgaacauaaaggaaccauuaucggcaagcagaacaacacauguaccgcuaaagccagcugcuggcuggaguccgucaagagcuucuuuuaugggcucaaaaauaugcugucuggcauuuucggaaacuuuuucaugggcaucuuucucuuccuggcgccguuuauccuucugauucucuucuuuauguucggguggcgcauccuguuuugcuucaaguguugcagacggacacgcggacuguucaaguacagacaccuuaaagacgaugaggaaaccggcuaucggcgcauuaucgagagacugaauaacaagaaagggaagaauaaacuccuggacggagaacggcucgccgaucgcagaauugcugagcuguuuuccacgaagacacacaucggc

SEQ ID NO: 13730 - RNA, 3495 nt, Artificial Sequence
  derived and/or modified CDS sequence (opt5) from CCHVF(CCHVF 79121)__AB069673.1__Gn-NSm-Gc
gccgagggcgggagcuccgacugcaucucuagaacccagcuggugaagacagaagucgcugagauucacgaagauagcuacggaggccccggggagaaaaucacgauuuguaacggauccaccaucguugaccaaggccucgggucugaacugggaugcuauacaauuaaucgggugcgcagcuacaaacuuugugagaacuccgccucuggcaaaagcugcgagaucgauuccaucccugugaaguguaaacagggcuucugccugaagauuacccaggaagggagaggacaugucaagcucagccggggcacagagaucgugcuggacguuugugauucuuccugcgaacuuaugauuccgaaagggaccggagacauccugguggauuguagcggcgggcagcaacacuuucuccagaauaaccugauugaccugggaugccccaaugucccucuccugggcaagauggcgaucuaugugugucgcaugucuaaccaucccaaaacaaccauggcuuuccuguuuugguucuccuuuggcuacguuauuacgugcaucgccugcagagugcuguucuaucuccugaucgccauugggaccgucggaaagaaacuuaagcaguaccgggagcugaagccucagacauguaucgugugcgagagcgugcccgucaaugcuauugaugccgaaaugcacgagcucaacuguucuuauaauaucugcccuuacugugcuucccgccugagcaccgacggccugauuagacauguuacacaaugcccgaaacggcgcgaaaagguggaggaaaccgagcucuuucugaaccuugagagaauccccuggcuggugcggaaacuccugcaggucuccgaaucuacggggauggcccuuaagcgcagcuguuggaugaucacacugcucauucugcugcucguguccaucagcccuguucagucugcgcccgugggaaaagagagagccauugaaaccuaccaggcucgggagacauauaccggcaucugccuguucguccuuggguccgugcuguuugccguuagcuggcucaccaaggcucugauugauggaaucggcaauucuuucagcccuggccuuuccguguguaaaacaugcucuaucgggagcauuaacggauuugaaaucgagucccacaaguguuacugcagccuguucugcugucccuauugccgcgccuguucuuccgacaagaauacgcacagaaugcaucucaacgucugcaaaaagcggaaaaugggcagcaaugugaugcuggcggucuguaagagaaugugcuuucgcgccaccauugaggcuucuaacaaagcccugcucauccgguccauuaucaacagcacauucgugauuuguauccugauccuuaccauuugcguuguguccacaucugcugucgauauggaaaaucugccggccgggaucugggagaaggaagaggaccucaccaacuucugucaccaagaaugccaggugacggagacagagugucugugcccuuacgaagccaugguucugagaaagccccuuuuucucgacagcaccgcuaaaggaaugaagucccugcuuaauucuaccagccucgagacaucccugagcauugaagcgccuuggggcgccaucaacgugcagucuaccuucaaacccacagucuccgcugccaauauugcccuuagcuggucuuccguggagcaucgcgggaacaagauccuggugagcggccggucugagagcaucaugaaacucgaagagagaacgggaguuuccuggaaucugggcgucgaagaugcuagcgagucuaagacccugacaguguccgugauggaccuuagccaaauguauucccccgucuuugaauaccucucuggggaucgccagguggaggaguggccuaaggcgaccugcacaggagacuguccggaacggugcggcuguaccagcuccacgugccugcacaaagaguggccccacucuagaaacuggcgcuguaauccuaccuggugcuggggaguugggacaggcuguaccugcugugggcuggaugugaaggacuucuuuacagauuauaugcucgucaaauggaagguggaauacauuaaaaccgaggccaucguuugcguggaacugacgagccaggagcggcaguguucccuuauugaggcuggcacaagauucaaccugggacccgucaccaucacacucucugaaccucgcaaugugcaacagcggcugcccccggagauuguuacccugcauccuaagaucgaagagggcuuuuucgaccuuaugcacgugcagaagauccucagcgccuccaccgucugcaaacugcagagcugcacacauggggugcccggagauuuucaaauuuaccacgugggcaaccugcucagaggggacaaggucaauggacauucuauccacaaaauugaaccucacuucaacacguccuggaugagcugggauggcugugaccuggacuauuuuugcaauaugggggauuggcccucuuguaccuacacaggcguuacccagcauaaccgggccgcuuucaucaacaugcuuaauauugagacagacuauaccaagacguuucacuuccauuccaaacgcgugacagcccacggagauaccccucagcuggaccucaaggcuagacccgccuacggcgcgggggaggugaccguccugguggaaguugccgaucuggagcuucacacaaagaaccucgaagugagcggacugaagaucgcuucucugaccugcuccggcuguuaugccugcagcuccgggaucagcuguaagguccggauucaugugaaugagccggacgaguucacaguucacgugagaucuagcgauccugacgucguggcugccggauccucucucauggcgcgcaaaaucgaauuuggcgccgauagcacguucaaggcuuuuuccucuaugcccaaagacagccugugcuucuacauuguugagaaggauuauuguuccucuugcaccgacgaugacacacagaaaugugugaacaccaaacuugaccauccccaaagcauccugauugaacacaaggggacaaucauuggcaagcagaaugauaccugcuccacgaagaccagcugcuggcucgagucugucaaaggauuuuucuacggccugaagaacaugcuguccgggaucuuuggaaauguguuccuuggcaucuuucuguuccucgccccuuuugugcugcucauuuucuuuuucuucuuuggguggcggcugcuuuucugucugaaaugcuguagacgcacaagaggacuccugaaguacaagcaucugaaagacgaagaggaggcuggcuauaagaaaaucauugaacggcuuaacggcaagaaaggaaagagccagcuguuugauggggagcgccucgccgacagaaagaucgccgaacuguucucuaccaaaauucacaucggc

SEQ ID NO: 13731 - RNA, 3495 nt, Artificial Sequence
  derived and/or modified CDS sequence (opt5) from CCHVF(CCHVF 8402)__AB069674.1__Gn-NSm-Gc
agcgaggaauccggcgacgauugcaucucuagaacccagcugcuccggacagagacggccgaaauucacaacgacaauuacgggggacccggcgauaagaucaccauuuguaacgggagcacaguggucgaccaacgccugggauccgagcuuggcugcuauaccaucaauagaguuaaaucuuucaagcugugugaaaacagcgcuacagggaaauccugcgagauugauucuaccccugugaagugucggcagggauuuugccucaaaaucacacaggagggccgcggccaugugaagcugagcagaggguccgaagucgugcuugacgccugugauagcucuugcgagaucaugauuccgaagggaaccggcgacauccugguugauuguuccgggggacagcaacacuuccucaaagacaaucugauugaucugggcugccccaacaucccucuccuggggaagauggcgauuuacaucugucggaugagcaaucaucccaaaacgaccauggcuuuucuuuucugguuuucuuucggauauguggucacaugcauucugugcaaggugaucuuuuaccuccugaucguugugggcacccuuggcaaaaaguucaagcaguaucgcgaacugaaaccucagacauguaccauuugcgagacgacacccgucaacgccaucgacgccgagaugcacgaucucaauuguuccuacaacauuugcccuuauugugcuagcagacugaccucugacgggcuggcccggcaugugaugcagugcccgaagcgcaaagaaaagaucgaggaaacagagcucuaccugaaucuugaacggauucccuggguggucagaaaacugcuccaaguuuccgagagcaccggaguggcucugaagcgcuccucuuggcuugugguccugcucgugcugcugaccguuagccucuccccugugcagagcgcccccaucggccacgggaaaacagucgagacguaccagaccagagaaggauauacaucuaucugucuguuugugcuuggcuccauucuguucaucguuagcugccucaugaaggggcugguggacucugucggaaacagcuuuuucccuggccuuuccauuuguaagaccugcucuaucggcagcgugaauggguuugagauugaaucccacaaauguuacugcagccuguucugcugucccuauugccggcauuguucugcggaucgcgagauccacagacuccaucuguccaucugcaagaaacggaagacaggaagcaacgucaugcuggccguguguaaaagaaugugcuuccgcgcuaccguugaagugucuaauaaggcccuccugauucggaacaucauuaacacgacauuuguccuuuguauccugauucucgcugugugcguuguguccaccagcgccgucgagauggagucccugccggcgggcaccugggaaagagaggaagaccugacaaauuucugucaccaggagugccaagugaccgaaacagagugucuuugcccuuacgaggcccucgugcugcgcaagccccuguuuucugauagcaucguuaaagggaugaagaaccuccucaauuccacgucucuugaaaccagccuguccauugaggcuccuuggggagccaucaacguccagagcacauucaaacccaccgugucugcugccaauaucgcccucuccuggagcucuguggaacaccggggcaacaagauucuggucuccgggagaagcgagucuaucaugaaacuggaggaacgcacaggcauuagcugggaccuuggaguggaggaugcuuccgaaagcaagcuccugaccguuucugugauggaccugucccagauguauagccccgucuuugaguaccucuccggcgaucggcaaguggaagaguggccuaaggcgacgugcaccggggacuguccggagagaugcggauguacaucuagcacaugccugcauaaagaauggccccacucccgcaauuggcgguguaacccuaccuggugcuggggcguugggaccggauguacgugcuguggccuugaugugaaggaccuguucacagauuauauguuuaucaaauggaaggucgaguacauuaaaaccgaagccaucgugugcguugagcucacaucucaggaaagacaguguacccugaucgaggcugggacccgcuucaaucugggccccgugacaauuacgcuuagcgagccucggaacauccagcaaaagcugcccccggaaauugucacccugcauccuagaaucgaggaaggauuuuucgaccugaugcacgugcagaaggugcucuccgccucuacagucugcaaacugcagagcugcacccauggcguucccggggaccuucagguguaccacauuggaaaucugcucaagggcgauaaagugaacgggcaccugauccauaagaucgagccucacuuuaauacauccuggaugagcugggacggaugugaucuggacuauuacugcaacaugggcgauuggcccucuuguaccuauacgggggucacacaacauaaucacgccgcuuucgugaacaugcuuaacauugaaaccgacuacaccaaaaauuuucacuuccauuccaagcggguuacagcccacggcgauaccccucagcucgaccugaaagcgcgccccacauauggagcuggcgagaucacggugcuggucgagguggccgauauggaacuccauaccaagaagauugagaucagcgggcugaaauucgccucucuuacaugcaccggauguuacgcuugcuccagcggcauuucuuguaagguuagaauccacguggacgaaccggaugagcugacaguccaugugaaauccgaggacccugauaucguugccgcuagcuccagccucauggcccggaagcuggaauuugggaccgacucuacguucaaagcguuuagcgccaugcccaagaccucccugugcuucuauauuguggagagagaauacuguaagucuugcagcaaagaggacacacagaagugugucaacaccaaacuugaacagccccaauccauccugauugagcacaagggaacaaucauuggcaaacagucuaauaccugcacagcuaaggccagcugcuggcucgaguccgugaagucuuucuuuuacgggcugaaaaacaugcucagcggcaucuuuggaaauguguucauuggcgucuuucuguucuuugcuccuuucauccuucugauccucuuuuucauguucggguggcgcauucuguuuuguuucaagugcugucggagaacccgcggacuguuuaaauauagacaccuuaaggaugacgaagagacgggcuaccggaaaaucauugaacgccugaacaauaagaaggggaaaaacaagcuccuggauggagagagacucgccgaccggaaaaucgcggaacuguucuccacaaagacccauauuggc

SEQ ID NO: 13732 - RNA, 3495 nt, Artificial Sequence
  derived and/or modified CDS sequence (opt5) from CCHVF(CCHVF 88166)__AB069675.1__Gn-NSm-Gc
agcgaggaauccggcgacgauugcaucucuagaacccagcugcuccggacagagacggccgaaauucacagcgacaacuacgggggacccggcgauaagaucaccauuuguaauggguccacaguggucgaccaacgccugggaucugagcuuggcugcuauaccaucaacagaguuaagagcuucaaacugugugaaaauuccgcuacagggaaaucuugcgagauugauagcaccccugugaagugucggcagggauuuugccucaaaaucacacaggagggccgcggccaugugaagcuguccagagggagcgaagucgugcuugacgccugugauucuuccugcgagaucaugauuccgaagggaaccggcgacauccugguugauuguagcgggggacagcaacacuuccucaaagacaaccugauugaucugggcugccccaauaucccucuccuggggaagauggcgauuuacaucugucggaugucuaaccaucccaaaacgaccaugggauuucuuuucugguuuuccuucggcuauguggucacaugcauucugugcaaggugaucuuuuaccuccugaucguugugggcacccuugggaaaaaguucaagcaguaucgcgaacugaaaccucagacauguaccauuugcgagacgacacccgucaaugcuaucgacgccgagaugcacgaucucaacuguagcuacaauauuugcccuuauugugccucuagacugaccuccgacggacuggcucggcaugugaugcagugcccgaagcgcaaagaaaagaucgaggaaacagagcucuaccugaaccuugaacggauucccuggguggucagaaaacugcuccaaguuagcgaguccaccggcguggcccugaagcgcucuagcuggcuugugguccugcucgugcugcugaccguuucccucagcccugugcagucugcucccaucgggcacggaaaaacagucgagacguaccagaccagagaaggcuauacauccaucugucuguuugugcuugggagcauucuguucaucguuucuugccucaugaagggacugguggacagcgucggcaauuccuuuuucccuggccuuucuauuuguaagaccugcagcaucggguccgugaacggauuugagauugaaagccacaaauguuacugcucucuguucugcugucccuauugccggcauuguuccgccgaucgcgagauccacagacuccaucugagcaucugcaagaaacggaagacauggucuaaugucaugcuggcgguguguaaaagaaugugcuuccgcgccaccguugaaguguccaacaaggcucuccugauucggaauaucauuaacacgacauuuguccuuuguauccugauucucgccgugugcguugugagcaccuccgcugucgagauggagucucugccggccggcaccugggaaagagaggaagaccugacaaacuucugucaccaggagugccaagugaccgaaacagagugucuuugcccuuacgaggcgcucgugcugcgcaagccccuguuuagcgauuccaucguuaaagggaugaagaaucuccugaacucuacgagccuugaaaccucccugagcauugaggccccuuggggagcuaucaauguccagucuacauucaaacccaccauguccgccgcuaacaucgcccucagcuggucuuccguggaacaccggggcaauaagauucuggugagcgggagaucugagagcaucaugaaacuggaggaacgcacaggcauuuccuggaaccuuggagucgaggacgccagcgaaucuaagcuccugaccguguccguuauggaucugagccagauguauucccccguguuugaguaccucucuggcgaccggcaagucgaagaguggccuaaggcuacgugcaccggggauuguccggagagaugcggauguacaagcucuaccugccugcauaaagaauggccccacucucgcaauuggcgguguaacccuacauggugcuggggcguggggaccggauguacgugcuguggccuugacguuaaggaucuguucacagacuauauguuuaucaaauggaagguggaguacauuaaaaccgaagcgaucgucugcguggagcucacaagccaggaaagacaguguacccugaucgaggccgggacccgcuucaaucugggccccguuacaauuacgcuuuccgagccucggaacauccagcaaaagcugcccccggaaauugugacccuccauccuagaaucgaggaaggauuuuucgaucugaugcacguccagaaggugcucucugcuagcacagugugcaaacugcaguccugcacccauggcguccccggggaccuucagguuuaccacauuggaaaucugcucaagggcgacaaagugaacgggcaccugauccauaagaucgagccucacuuuaauacaagcuggaugucuugggauggaugugaccuggauuauuacugcaacaugggcgacuggcccuccuguaccuauacgggggugacacaacauaaucacgccgccuucgucaacaugcuuaacauugaaaccgauuacaccaaaaauuuucacuuccauagcaagcgggugacagcucacggcgacaccccucagcucgaucugaaagcccgccccacauauggagcgggcgagaucacgguucugguggaggucgcugacauggaacuccauaccaagaagauugagaucucugggcugaaauucgccucccuuacaugcaccggauguuacgccugcagcucuggcauuuccuguaaggugagaauccacguugaugaaccggacgagcugacagugcaugucaaaagcgaggauccugaccucguggcugccuccagcucucugauggcucggaagcuggaauuugggaccgauagcacguucaaagccuuuuccgcgaugcccaagaccucucuuugcuucuauaucguugagagagaauacuguaagagcugcuccaaagaggacacacagaagugugugaacaccaaacuggaacagccccaaucuauucucaucgagcacaagggaacaauuaucggcaaacagaauaauaccugcacagccaaggcuagcugcuggcuggaguccgucaaguccuuuuucuacgggcucaaaaacaugcugagcggcauuuuuggaaacguguucaucggcguguuucuuuucuuugccccuuucauucugcucauccuguuuuucauguucggguggcgcauccuguuuuguuucaagugcugucggagaacccgcggacuuuuuaaauauagacaccugaaggacgaugaagagacgggcuaccggaaaauuaucgaacgccucaauaacaagaaggggaaaaauaagcugcucgacggagagagacuggcugaucggaaaauugccgaacuuuucuccacaaagacccauaucggc

SEQ ID NO: 13733 - RNA, 3495 nt, Artificial Sequence
  derived and/or modified CDS sequence (opt5) from CCHVF(CCHVF BA88166)__AF338470.1__Gn-NSm-Gc
agcgaggaauccggcgacgauugcaucucuagaacccagcugcuccggacagagacggccgaaauucacagcgacaacuacgggggacccggcgauaagaucaccauuuguaauggguccacaguggucgaccaacgccugggaucugagcuuggcugcuauaccaucaacagaguuaagagcuucaaacugugugaaaauuccgcuacagggaaaucuugcgagauugauagcaccccugugaagugucggcagggauuuugccucaaaaucacacaggagggccgcggccaugugaagcuguccagagggagcgaagucgugcuugacgccugugauucuuccugcgagaucaugauuccgaagggaaccggcgacauccugguugauuguagcgggggacagcaacacuuccucaaagacaaccugauugaucugggcugccccaauaucccucuccuggggaagauggcgauuuacaucugucggaugucuaaccaucccaaaacgaccaugggauuucuuuucugguuuuccuucggcuauguggucacaugcauucugugcaagggcaucuuuuaccuccugaucgugguugggacccuugggaaaaaguucaagcaguaucgcgaacugaaaccucagacauguaccauuugcgagacgacacccgugaaugcuaucgacgccgagaugcacgaucucaacuguagcuacaauauuugcccuuauugugccucuagacugaccuccgacggccuggcucggcaugucaugcagugcccgaagcgcaaagaaaagaucgaggaaacagagcucuaccugaaccuugaacggauucccuggguggugagaaaacugcuccaagucagcgaguccaccgggguugcccugaagcgcucuagcuggcuuguggugcugcucguccugcugaccgugucccucagcccuguucagucugcucccaucggacacggcaaaacaguggagacguaccagaccagagaaggguauacauccaucugucuguuuguccuuggaagcauucuguucaucgugucuugccucaugaagggccugguugacagcgugggcaauuccuuuuucccugggcuuucuauuuguaagaccugcagcaucggauccgucaacggcuuugagauugaaagccacaaauguuacugcucucuguucugcugucccuauugccggcauuguuccgccgaucgcgagauccacagacuccaucugagcaucugcaagaaacggaagacauggucuaaugugaugcuggcggucuguaaaagaaugugcuuccgcgccaccguggaaguuuccaacaaggcucuccugauucggaauaucauuaacacgacauuugugcuuuguauccugauucucgccgucugcgugguuagcaccuccgcuguggagauggagucucugccggccgggaccugggaaagagaggaagaccugacaaacuucugucaccaggagugccaagucaccgaaacagagugucuuugcccuuacgaggcgcucgugcugcgcaagccccuguaucucgauagcaucgugaaaggaaugaagaaucugcuuaacuccacgucucuggaaaccagccucuccauugaggccccuuggggcgcuaucaauguucagagcacauuuaaacccaccaugucugccgcuaacaucgcccuguccuggagcucugucgaacaccgggggaauaagauucugguguccggcagaagcgagucuaucaugaaacuugaggaacgcacaggaauuagcuggaaccucggcguggaggacgccuccgaaagcaagcugcugaccgucucugugauggaucucucccagauguacagccccguuuucgaguaucuguccggggaccggcaaguggaagaguggccuaaggcuacgugcaccggagauuguccggagagaugcggcuguacaucuagcacaugccuucauaaagaauggccccacucccgcaauuggcgguguaacccuaccuggugcuggggagucggaaccggcuguacgugcugugggcuggacgugaaggaucucuuuacagacuacauguucaucaaauggaagguugaguacauuaaaaccgaagcgaucgugugcgucgagcugacaucucaggaaagacaguguacccugaucgaggccggcacccgcuuuaaucuuggacccgugauuaucacacucagcgagccucggaacauucagcaaaagcugcccccggaaaucguuacgcugcauccuagaauugaggaaggcuucuuugaucucaugcacgugcagaagguccuguccgcuucuaccgugugcaaacuucagagcugcacacauggggugcccggagaccugcaggucuaucacaucggcaaucuccugaagggggacaaaguuaacggacaccugauccauaagauugagccucacuucaauaccuccuggaugagcugggauggcugugaccuugauuacuauugcaacaugggggacuggcccucuuguacauacaccggcgugacgcaacauaaucacgccgccuuugugaacaugcucaacaucgaaacagauuauaccaaaaauuuccacuuucauuccaagcgggucaccgcucacggagacacaccucagcuggaucugaaagcccgccccaccuacggcgcgggggagauuacagugcucguugagguggcugacauggaacugcauacgaagaagaucgagauuagcggacuuaaauucgccucucugaccugcacaggcuguuaugccugcuccagcgggaucucuuguaaggucagaauccacguggaugaaccggacgagcucaccguucaugugaaauccgaggauccugacauugucgcugccagcuccagccugauggcucggaagcuggaauuuggaacagauucuaccuuuaaagccuucagcgcgaugcccaagacgucccuuugcuuuuacaucguggagagagaauacuguaagucuugcagcaaagaggacacccagaaguguguuaacacaaaacuggaacagccccaauccauucucaucgagcacaagggcaccauuaucgggaaacagaauaacacaugcaccgccaaggcuucuugcuggcuggagagcgugaaguccuucuuuuauggccucaaaaauaugcugucuggaauuuucggcaacgucuuuaucgggguguuccuuuucuucgccccuuuuauccugcucauucuguucuuuauguucggauggcgcauccuguucuguuuuaagugcugucggagaacacgcggccuuuucaaauacagacaccugaaggacgaugaagagaccggguaucggaaaauuaucgaacgccucaauaacaagaagggcaaaaauaagcugcucgacggagagagacuggcugaucggaaaauugccgaacuuuuuagcacgaagacacauaucggc

SEQ ID NO: 13734 - RNA, 3495 nt, Artificial Sequence
  derived and/or modified CDS sequence (opt5) from CCHVF(CCHVF BA66019)__AF350448.1__Gn-NSm-Gc
agcgaggaauccggcgacgauugcaucucuagaacccagcugcuccggacagagacggccgaagugcacggggacaacuacggaggccccggggauaagauuaccaucuguaauggaagcacaauugucgaccaacgccugggcuccgagcuugggugcuauaccaucaacagaguuaaaucuuucaagcugugugaaaauagcggaacaggcaaauccugcaagauugauaaacauccugugaagugucggcagggcuuuugccucaagaucacccaggaggggcgcggacacgugaaacugucuagaggcagcgaggucgugcuugacgcuugugauuccagcugcgaaaucaugauuccgaaggggacaggagacauccugguugauuguucuggcgggcagcaacauuuccucaaagacaaccugguggaucugggaugccccaauauuccucuccugggcaagauggccaucuacauuugucggauguccaaccaccccaaaaccacgauggcguuucuuuucugguuuagcuucggcuaugucauuaccugcaucuuuugcaagaucaucuucuaccugcucauugugguugggacacugggaaagaaauuuaagcaguaucgcgagcuuaaaccucagaccuguacaaucugcgaaaccacgcccacaaaugcuauugacgccgagaugcaugaucugaaguguucuuacaacaucugcccuuauugugccuccagacucaccagcgacggccuggcucggcacgugacacagugcccgaaacgcaaggagaaagucgaagagaccgaacuguaccucaaucuggagcggauucccuggaucgugagaaaacuucugcaagugucugaauccaccggggucgcccucaagcgcagcuccuggcugaucguucuucuggugcuccugacagugucucugagcccuguccaguccgcucccauuggacacggcaagacgaucgaggccuaccagaccagagagggguauacaagcgugugucucuucaugcugggaggcauucuuuuuguugugucuugccugaugaagggccucgucgacuccgugagcaacucuuucuuuccugggcugagcaucuguaaaaccugcuccauuggaucuguuaauggcuucgaaaucgagagccauaaguguuacugcucccuucugugcugucucuauugccggcacuguagcgcggaucgcgaaauccaucagcugcaccugucuauuugcaaaaagagacgggccgggggaaacgugaugcucgcugucuguaagagaaugugccugcgcgccacaauggagguguccaauaaaguccuuuucauccggagcauuaucaacaccacguuugugauuuguauccugguucucgcugugugcauugucucuacauccgccguggaaauggagagccugcccgcgggcaccugggagagagaagaggaccugaccaauuucugucaccaagaaugccagguuacagagaccgaaugucuuugcccguacgaggcccucgugcugcgcaagccucuguuuuccgauucuaucgucaaagggaugaagaaccuccugaacagcacaucccuugagacgucucugagcaucgaagcucccuggggcgccauuaaugugcaguccaccuucaaaccuacagugagcaccgcuaacaucgcccucucuugguccagcguugagcaucggggaaauaagauucuggucucuggcagauccgaaagcaucaugaagcuggaggagcgcacagggauuucuugggaccuuggaguggaagaugccagcgaguccaaacuccugaccgugagcgucauggaccugucucaaauguauucccccguguuugaauaccucagcggcgaucggcagguugaggaauggcccaaggcuacgugcaccggggacuguccugauagaugcggauguacauccucuaccugccugcacaaagaguggccgcauagccgcaacuggcgguguaaucccacauggugcuggggcguggggaccggcuguacgugcuguggacuugacgucaaggaucuguucacagacuauauguuugugaaauggaagguugaguacaucaagaccgaagcgaucgugugcgucgagcucaacucccaggaaagacaguguucucugauugaggccggcacacgcuucaaucuggggccugugaccaucacccuuagcgaaccccggaacauucaacagaaacucccucccgagaucauuacacugcacccgagaaucgaggaaggauuuuucgaccugaugcauguucagaaggugcucuccgcuucuacggucugcaaacugcagagcugcacccacggcgugccuggggaucuucaaaucuaccacauuggaaaucugcucaagggcgaccgggugaacgggcaucugauccacaaaauugagccccauuuuaauacauccuggaugagcugggauggcugugaccuggauuauuacugcaacaugggagacuggccuucuuguaccuauacaggcgucacccagcacaaucacgccgccuucguuaaccuucucaauaucgaaacggauuacacaaagaacuuucauuuccacuccaaacgcgugaccgcucauggggacacaccccagcuggaucugaaggccagaccuaccuauggagcgggcgagauuaccgugcucgucgaaguggcugacauggagcugcacacaaagaaaaucgccaucagcgggcuuaaguucgccucucugacgugcaccggauguuacgcuugcuccagcggcauuucuuguaaaguucggauccauguggaugagcccgacgaacucacaguccacgugaaguccgaggauccggacauuguugccgcuagcuccagccugauggccagaaaacuggaauuugggaccgacucuacauucaaggcguuuagcgccaugccuaagaccucccuuugcuucuauaucguggagcgcgaguacugugaaucuugcagcaaagaggauacgcagaagugugucaacaccaaacuggaacaaccccaguccauucucaucgagcacaagggcacaauuaucggaaaacagaaugauaccugcacagcuaaggccucuugcuggcuggaaagcgugaaguccuuuuucuacggccucaaaaacaugcugucugggaucuuuggaaauguuuucauuggcaucuuucuuuuccuggcucccuuuauucuccugauccuguucuuuauguucggguggcggauucuuuucuguuuuaagugcuguagacgcaccagaggacuguucaaauaucgguaccucaaggacgacgaggagagcggcuaucgcagaaucaucgaacggcugaacaauaaaaagggcaagaacaaacuccuggauggggagcgccuugccgacagacggauugcggaacuguuuuccacaaagacccauaucgga

SEQ ID NO: 13735 - RNA, 3495 nt, Artificial Sequence
  derived and/or modified CDS sequence (opt5) from CCHVF(CCHVF BA8402)__AF350449.1__Gn-NSm-Gc
agcgaggaguccggcgacgauugcaucucuagaacccagcugcuccggacagagacggccgaaauucacaacgacaauuacgggggacccggcgauaagaucaccauuuguaacgggagcacaguggucgaccaacgccugggauccgagcuuggcugcuauaccaucaauagaguuaacucuuucaaucugugugaaaacacagcuaccgggaaaagcugcgagauugauuccacaccugugaagugucggcagggauuuugccucaaaaucacccaggagggccgcggccaugugaagcugucuagagggagcgaagucgugcuugacgccugugaguccagcugcgaaaucaugauuccgaaaggaacgggcgauauccugguugacuguucugggggacagcaacacuuccucaaggauaaucugauugaccugggcugccccaacaucccucuccuggggaagauggcgauuuacaucugucggauguccaaucaucccaaaaccacaauggcuuuucuuuucugguuuagcuucggauauguggugaccugcauucugugcaaggucaucuuuuaccuccugaucguugugggcacacuuggcaaaaaguucaaacaguaucgcgagcugaagccucagaccuguacgauuugcgagacaacccccgucaacgccaucgaugccgaaaugcacgaccucaauuguucuuacaacauuugcccuuauugugcuuccagaccgacaagcgaugggcuggcccggcaugugaugcagugccccaagcgcaaagagaagaucgaagagaccgcucuguaccucaaucuggaacggauuccuuggguggucagaaaacuucugcaaguuucugaguccaccggaguggcccucaagcgcagcuccuggcuggugguccuucuggugcuccugacaguuucucugagccccgugcaguccgcgccuaucggccacgggaaaacggucgagaccuaccagacaagagaaggauauaccagcaucugucucuuugugcugggcucuauucuuuucaucguuuccugccugaugaaggggcucguggacagcgucggaaacagcuuuuuccccggccugucuauuuguaaaacaugcuccaucggcucugugaauggguuugagauugaaagccacaaguguuacugcucccuuuucugcuguccguauugccggcauuguagcgccgaccgcgagauccacagacugcaucucucuaucugcaagaaacggaagaccggauccaacgucaugcuggcuguguguaaaagaaugugcuuccgcgccacgguugaagugagcaacaaggcucugcucauucggaauaucauuaacacaaccuuuguccuguguauccuuauucuggccgugugcguugugucuaccuccgcggucgagauggagagccucccugccggcacaugggaaagagaggaagaucugaccaauuucugucaccaggagugccaagugacagaaacggagugucugugccccuacgaggcucuugugcuccgcaaaccucuguuuuccgacucuaucguuaaggggaugaagaaccugcucaauagcaccucccuggaaacaucucuuagcauugaggcccccuggggagcuaucaacguccaguccaccuucaaacccacagugagcgccgccaauaucgcucugucuugguccagcguggaacaccggggcaacaagauucucgucucugggagauccgagagcaucaugaaacuggaggaacgcaccggcauuucuugggaucugggaguggaggacgcgagcgaauccaagcugcucacgguuagcgugauggaucugucucagauguauuccccugucuuugaguaccugagcggcgaccggcaaguggaagaguggccgaaagcuaccugcacaggggauugucccgagagaugcggauguaccuccucuacaugccuccauaaggaauggccucacagccgcaauuggcgguguaaccccaccuggugcuggggcguugggacgggauguacaugcuguggccuggacgugaaggaucuuuucaccgacuauauguuuaucaaauggaaggucgaguacauuaaaacagaagcuaucgugugcguugagcugaccucccaggaaagacaguguacccucaucgaggccgggacacgcuucaaucugggcccugugacgauuacccugucugagccccggaacauccagcaaaaacuuccgccugaaauugucacacuccaucccagaaucgaggaaggauuuuucgaucugaugcacgugcagaaagugcugagcgccuccaccgucugcaagcuccagucuugcacacauggcguuccuggggaccuucagguguaccacauuggaaaucuucugaagggcgacaaagugaacgggcaccucauccauaagaucgagccccacuuuaauaccagcuggauguccugggauggaugugaccugcauuauuacugcaacaugggcgauuggccuagcuguacguauacaggggucacccaacacaaccacgcugccuucgugaauaugcugaacauugaaaccgacuacacaaagaauuuucauuuccacucuaagcggguuaccgcgcauggcgauacaccccagcuugaccucaaagcucgcccgacguauggagccggcgagaucaccgugcuggucgagguggccgauauggaacugcacacaaagaaaauugagaucuccgggcucaaguucgcuagccugaccugcacaggauguuacgccuguucuuccggcauuagcugcaagguuagaauccauguggacgaaccugaugagcuuaccguccacgugaaaucugaggaccccgauaucguugcugccuccagcucccugauggcgcggaagcucgaauuugggacggacagcaccuucaaagccuuuucugcuaugcccaagacaagccugugcuucuauauuguggagagagaauacugugaguccugcucuaaagaagauacccagaagugugucaacacaaagcuggagcagccucaaagcauccuuauugagcacaaaggaaccaucauuggcaagcaguccaauacaugcaccgccaaagccucuugcuggcuggaaagcgugaaguccuuuuucuacgggcucaaaaacaugcugucuggcaucuuuggaaauguguucauuggcgucuuucucuucuuugccccguucauccugcuuauccuguuuuucauguucggguggcgcauucucuuuuguuucaagugcugucggagaacgcgcggacuguuuaaguauagacaucugaaagacgacgaggaaacaggcuaccggaagaucauugagcgccuuaacaauaaaaaggggaaaaacaagcugcucgauggagaaagacuggcggaccggaagaucgccgaacucuucagcaccaaaacccacauuggc

SEQ ID NO: 13736 - RNA, 3495 nt, Artificial Sequence
  derived and/or modified CDS sequence (opt5) from CCHVF(CCHVF Matin)__AF467769.2__Gn-NSm-Gc
agcgaggaauccggcgacgauugcaucucuagaacccagcugcuccggacagagacggccgaaauucacagcgacuccuacgggggacccggcgauaagaucaccauuuguaacgggucuacaguggucgaccaacgccugggaagcgagcuuggcugcuauaccaucaauagaguuaaauccuucaagcugugugaaaacucugcuacagggaaaagcugcgagauugauuccaccccugugaagugucggcagggauuuugccucaaaaucacacaggagggccgcggccaugugaagcugagcagagggucugaagucgugcuugacgccugugauuccagcugcgagaucaugauuccgaagggaaccggcgacauccugguugauuguucugggggacagcaacacuuccucaaagacaaucugauugaucugggcugccccaacaucccucuccuggggaagauggcgauuuacaucugucggauguccaaucaucccaaaacgaccaugguguuucuuuucugguuuagcuucggauaugucauuacaugcauccugugcaaggugaucuuuuaccuccugauuguugugggcacccuuggcaaaaaguucaagcaguaucgcgaacugaaaccucagacauguaccaucugcgagacgacacccgucaacgcuauugacgccgagaugcacgaucucaauuguucuuacaacaucugcccuuauugugccuccagacugaccagcgacgggcuggcucggcaugugaugcagugcccgaagcgcaaagaaaagauugaggaaacagagcucuaccugaaucuugaaagaauccccugggugguccggaaacugcuccaaguuuccgagucuaccggaguggcccugaagcgcagcuccuggcuugugguccugcucgugcugcugaccguuagccucucuccugugcaguccgcucccaucggccacgggaaaacagucgagacguaccagauuagagaaggauauaccagcgugugucuguuuguucuuggcucuauccuguucauugugagcugccucaugaaggggcuggucgacuccgauggaaacagcuuuuucccuggccuuagcaucuguaagacaugcuccauuggcagcaucaauggguuugagaucgaaucucacaaauguuacugcucccuguucugcugucccuauugccggcauuguagcaccgaccgcgagauucacaagcuccaucugucuaucugcaaaaagagaaaaacaggauccaacgugaugcuggccgucuguaagcggaugugcuucagagcgaccguggaaguuagcaauaaggcccuccugauucgcuccaucauuaacacgacauuuguggucuguauccuuauucuggcugugugcguugugucuaccagcgccgucgagauggagucccucccggcuggcaccugggaacgggaggaagaucugaucaauuucugucaccaggagugccaagugacagaaaccgagugucugugcccuuacgaggcccuugugcucagaaaaccccuguuucuggacucuaucauuaaggggaugaaaaaccuccugaacagcacaucccuugaaacgagccugucuaucgaggcgccuuggggagccauuaauguucaguccaccuucaagcccacaaugagcgcugccaacaucgcucucucuugguccagcgucgaacaccgcggcaauaaaauucuggugucugggcggagcgaguccaucaugaagcuggaggaaagaaccggcaucagcugggaucuuggaguggaggacgccucugaauccaagcuccugacagucagcgugauggaucugucccagauguauucucccguuuuugaguaccucagcggcgaccgccaaguggaagaguggccuaaagcuaccugcacgggggauuguccggagcggugcggauguaccuccucuacaugccugcauaaggaauggccccacagcagaaacuggcgcuguaauccuaccuggugcuggggcgucgggacaggauguaccugcuguggccuugacgugaaagaucuguucacggacuauauguuuguuaaguggaaaguggaguacauuaagacagaagucaucgugugcguugagcucaccucccaggaacggcaguguucucugauugaggccgggacaagauucaaccugggccccgugaccaucacccuuagcgagccucgcaauauucagcaaaagcugcccccggaaaucgucacacuccauccucggaucgaggaaggauuuuucgaccugaugcacgugcagaaagugcucuccgcgagcacggucugcaagcugcagucuugcacccauggcguucccggggaucuucagguguaccacauuggaaaccugcucaaaggcgacaaggugaaugggcaccugauccauaaaauugagccucacuuuaacacauccuggaugagcugggauggaugugaccuggauuauuacugcaauaugggcgacuggcccucuuguuccuauaccggggucacacaacauaaccacgccgcuuucgugaauaugcuuagcaucgaaaccgauuacacgaagaacuuucacuuccauucuaaaagaguuacagcccacggcgacaccccucagcucgaucugaaggcccggcccaccuauggagcuggcgagauuacagugcuggucgagguggccgacauggaacuccauaccaagaaaaucgagaucuccgggcugaaguucgcgagccuuacaugcacgggauguuacgcuugcuccagcggcauuucuuguaaaguucgcauccacguggaugaaccggacgagcugaccguccaugugaagucugaggauccugacauuguugccgccuccucuagccucauggcuagaaaacuggaauuugggacagacuccaccuucaaggccuuuucugcuaugcccaagacaagccugugcuucuauaucguggagcgggaauacuguaaauccugcucuaaggaggauacccagaaaugugucaauacgaaacuugaacagccccaaagcauucugaucgagcacaagggaaccauuaucggcaagcagaacgacacaugcaccgccaaggcguccugcuggcucgagagcgugaaauccuuuuucuacgggcugaagaacaugcucucuggcaucuuuggaaauguguucauuggcaucuuucuguuccuugccccuuuugcucugcucauucuguucuuuauguucggguggagaauccuguucuguuuuaaaugcugucgccggacaagaggacuuuucaaguaucgccaccugaaagaugacgaagagaccggcuacagaaagauuaucgaacggcucaacaauaagaaagggaagaacaaacugcucgauggagagcgccuggccgacagaaagaucgcugaacuuuuuagcacaaaaacccaugucggc

SEQ ID NO: 13737 - RNA, 3495 nt, Artificial Sequence
  derived and/or modified CDS sequence (opt5) from CCHVF(CCHVF Baghdad 12)__AJ538197.2__Gn-NSm-Gc
agcgaggaauccggcgacgauugcaucucuagaacccggcugcuccgcacagagacggccgaaauucacggggacagcuacggaggccccggggauaagaucaccauuuguaacggauccacaaucguggaccagagacugggcucugagauggggugcuauaccauuaaucgggucaagagcuucaagcugugugaaaacuccgcuacaggaaaaucuugcaagaucgauagcaucccuguuaaaugucgccaaggcuacugccugaagauuacccaggagggcagagggcaugugaagcucucccggggaagcgaggugguccuggacgccugugauucuuccugcgaagugaugaucccgaaaggcacaggggacauucuuguugauuguagcggaggccagcagcacuuucugaaggacaaucucaucgaucuggggugccccaacauuccucugcucggaaaaauggcgaucuauauuugucgcaugucuaaucaucccaagaccacgauggcuuuccuguuuugguucuccuuuggcuacgugauuaccugcauccuuugcaaagccaucuucuaucugcucaucauugucggcacacuggggaagagauuuaagcaauaccgggagcuuaaaccucagaccuguacaaucugcgaaaccacgcccgugaacgccauugacgcugagaugcacgaucugaauuguagcuauaacaucugcccuuacugugccucucgccucacauccgacggacuggcuagacauguuacccagugcccgaagcggaaagagaagguggaagagacagaacuguaccucaaucuggagcgcauccccugggucgugagaaaacuucuucaggugagcgaauccaccggcgucgcccucaagcggucuagcuggcugauuguucuucuggugcuccuggcgguguccagcucuccuguccaauccgcccccaucggguauggaaaaaccauugagacauaccaggcucgcgagggcuauacgagcaucugucuguucgugcucgggucuauucuguuuaucguuagcugccuuaccaagggacugguggacuccaucggcaacauuuucuuuccuggccucucuaucuguaagacaugcagcauuggguccaucaauggauucgaagucgagagccacaaauguuacugcucucugcuuugcugucccuauugcagacacuguuccgccgaucgggaaauucaucagcugcaccucagcaucugcaagaaaagaaagaccgggucuuccgugaugcuggcuguuuguaaacgcaugugcuuucgggccacaauggaggugagcaacaaggcgcugcucauuagauccaucaucaauaccacguucgucguguguauucugacacuugccgucugcgugguuucuaccagcgcuguggaaauggagucccugccggccgggaccugggagcgcgaagaggaccucacaaacuucugucaucaggaaugccaagucaccgagacagaaugucugugcccuuacgaggcucuggugcuucggaagccccucuuucuggauucuaucguuaaaggaacgaagaaucugcucaacagcaccucccuggagacaagccuuucuauugaagccccuuggggcgccaucaacgugcaguccaccuauaaacccacagucagcaccgcuaauauugcgcugucuugguccagcguggagcacagagggaacaagauccucgugucuggccgcagcgaauccaucaugaaacuggaggagcggacgggaauuagcugggaccugggcguugaagaugccucugaguccaaacuucucaccgucagcgugauggaccugucccagauguacucucccguguucgaauaccugagcggggauagacaagucgaggaauggccuaaggcuacaugcaccggagacuguccggagcgcugcggcuguacaaccuccacgugccuccacaaagaguggccccauucucggaauuggagauguaacccuacauggugcuggggcgugggaaccggcuguacaugcugugggcuggauguuaaggaccuuuuuaccgauuauauguucgugaaauggaaggucgaauacaucaaaaccgacgccauugugugcguugagcugacaagccaggaacgccaguguucccucaucgaggccggcacgcgguuuaaucugggaucugugaccauuacacugagcgaacccagaaacauccagcaaaaacuuccucccgagaucauuacccuccacccgcggaucgaggaaggcuucuuugaccugaugcauguccagaaggugcuguccgcuagcacaguuugcaaacuccagucuugcacccacggggugccuggagaucugcaggucuaucauauuggcaaucuucugaagggggacaaagugaacggacaccucauccacaagauugagccccauuucaauacguccuggaugagcugggauggcugugaccuggauuacuauugcaacaugggggacuggccuucuuguacauacaccggcgugacccaacacaaucaugccuccuuugucaaccugcuuaauaucgaaacagauuauaccaagagcuuccacuuucacucuaagcgcguuacagcgcauggagacacgccccagcucgaucugaaagugagaccuaccuacggcgcuggggagaucacagugcuggucgaaguggccgacauggagcuccacaccaagaagauugagaucuccggacugaaauucgccagccuuacaugcaccggcuguuacgcuugcuccagcgggauuucuuguaagguucggauccauguggaugaacccgacgagcugacgguccacgugaaaagcgaugacccggacguuguggccgcuuccucuagccucauggccagaaagcuggaauuuggaaccgauuccacauucaaagcguucucugccaugccuaagaccagccugugcuuuuauauugucgagcgcgaguacuguaaguccugcucuaaagaagacacacagaagugugugaacaccaaacuugagcagccccaaagcauccugauugaacauaagggcacaaucaucgggaaacagaauaauaccugcacggcuaagacauccugcuggcucgagagcguuaagucuuucuuuuauggccugaaaaacaugcucuccggaauuuucggcaacuuuuucauggggaucuuucuguuccuugcccccuuuauucugcucauccuguucuuuauguucggauggcggauucuguuuuguuucaagugcuguagacgcaccagaggccuuuucaaauaccggcaccugaaggaugacgaagagaccggguaucgcagaaucaucgagcggcucaacaauaaaaagggaaagaacaaacugcucgauggcgaacgccuggcugacagacggauugccgagcuuuuuagcacaaagacccacaucggc

SEQ ID NO: 13738 - RNA, 3495 nt, Artificial Sequence
  derived and/or modified CDS sequence (opt5) from CCHVF(CCHVF VLG/TI29414)__AY179961.1__Gn-NSm-Gc
agcgaggaacccggcgacgauugcaucuccagaacccagcugcuccgggccgagccugcugaaauucacgacgauaacuacgggggaccgggcgacaagaucacaauuuguaaugggucuacgaucguggaucaacgccugggaagcgagcuuggcugcuauaccauuaacagagucaaauccuucaagcugugugaaaauucugccacagggaaaaccugcgagaucgacagcacacccguuaagugucggcagggauuuugccucaaaaucacccaggagggccgcggccaugugaagcuguccagagggucugaagugguccuugaugcgugugacagcuccugcgaggugaugauuccuaagggaacaggcgauauccugguugacuguagcgggggacagcaacacuuccucaaagauaaccugauugaccugggcugcccccauaucccucuccuggggaagauggcuauuuacaucugucggaugucuaaucacccccgcaccacgauggccuuucuuuucugguuuuccuucggauaugugauuaccugcaucuuuugcaaagcccuguucuacagccucaucauuaucggcacacugggcaagaaaauuaagcaguauagagaacuuaagccucagaccuguacaaucugcgagaccgcuccggucaacgccauugaugcugagaugcaugaccugaauuguucuuacaacaucugccccuauugugccucccggcucacgagcgacgggcuggcgcgccacgugccucagugccccaaaagaaaggaaaaaguugaggaaacagagcuguaccucaaucuggaacggaucccuuggaacgugcgcaaacuucugcaagucucugaguccaccggaguggcccucaaaagaagcuccuggcugauugugcuucugguccuccugacaguuucucugagccccgugcaguccgcuccggugggccacgggaagaccaucgagaccuaccagacacgggaaggauuuacgagcauuugucucuucaugcugggcucuauccuuuuucuggucuccugccucgugaaagggcugguugauagcgugucugacagcuucuuuccuggacuuuccgucuguaagaccugcucuauuggcagcaucaauggcuucgagaucgaaucccauaaguguuauugcagccuguucugcugucccuacugccgccacuguucugccgauagagagauucaucagcuccaccuguccaucugcaaaaagcggaaaauggggagcaacgugaugcuggcuguuuguaagagaaugugcuuucgcgccacaauugaagcgucucggagagcccuccugauccgcuccauuaucaauaccacauucgugauuuguauccuuacccugacgaucugcgucgugagcacauccgcugucgagauggagaaccucccuucuggaaccugggaacgggaggaagaccugaccaauuuuugucaccaagagugccaggugacagaaaccgagugucugugccccuaugaggcccuuguucucagaaaaccccuguuccuggauagcauugugaagggcaugaagaaccuccugaacuccacaaaucuugaaacgucucugagcaucgaggcuccuuggggagccauuaacguccaguccaccuuuaaaccgacagugagcaccgccaauaucgcucucucuugguccagcguugaacaucgcggaaacaagauucuggugacaggccggucugaguccaucaugaaacuggaggaaagaaccggggucagcugggaccuuggcguggaggaugcgucugaaagcaagcuccugacgguguccaucauggaccugagccaaauguacucucccguuuucgaguaucucuccggagaucgccaggucgaagaguggccuaaagcuaccugcacaggcgacugucccgagcggugcggguguaccagcuccacaugccugcacaaggaauggccucauucuagaaauuggcgcuguaaccccaccuggugcugggaggugggaacgggcuguacaugcuguggguggaaugugaaggaucuuuuuaccgaccacauguucgucaaauggaagguggaauacauuaaaacagaggccaucguuugcguggaacugaccagccaggagcggcaguguucccucauugaggccggaaccagauuuaaccugggcccggucacaaucacgcugucugaaccucggaauauucaacagaaacuucccccugagaucaucacccuccaucccaagguggaagagggguucuuugaccugaugcacguucagaaggugcugagcgccuccacagucugcaagcuccagucuugcacccacggcauuccuggagaucugcaaguguaucauaucggcaaccuucugaaaggggaccgcguuaauggacaccucauucauaagaucgaaccccacuucaacacaagcuggauguccugggauggcugugaccuggauuacuacugcaauaugggggacuggccgagcuguaccuauacgggaaugacacagcacaaccaugcugccuuugugaaucugcuuaacauugagaccgauuacaccaaaacauuccacuuccauucuaagagagucaccgcgcacggcgacacaccucagcucgaucugaaagcucggcccacguauggggccggcgagaucaccgugcugguggaagucgccgacauggagcuccauacaaagaaaguugaaaucuccggacugaaguuugcuagccuugccugcaccggcuguuacgcuuguucuuccgggauuagcugcaaggugagaauccacguggaugagcccgacgagcugacaguccacgugaaaucuaacgauccugacguuauugccgcguccaccagccucauggcccgcaagcuggaauuuggaacggacuccaccuuuaaggcuuucagcgccaugccgaagacaucucugugcuuuuauaucgcugagcgggaauacuguaaaagcugcuccgaggaagauacccagaaguguguggacacaaaacuugagcaaccccagucuauucugaucgagcauaagggcaccauuaucgggaagcagaaugauacaugcaccgccaaagcgagcugcuggcucgaauccgucaagucuuucuuuuauggacugaaaaacaugcucggcagcguguucgggaauuucuucaucggcauucugcuuuuucuggccccuuucguucuccuggugcuguuuuucauguucggauggaagauccuguuuuguuucaagugcuguagacgcacgagaggccuucucaaauaccggcugcucaaggacgaugaggaaacaggguaccgcagaauuaucgagcggcugaacaauaaaaaggggaaaaaccgccuucuggacggcgaaagacucgcugaucggaagauugccgagcuguuuuccaccaagacccacaucggg

SEQ ID NO: 13739 - RNA, 3495 nt, Artificial Sequence
  derived and/or modified CDS sequence (opt5) from CCHVF(CCHVF TADJ/HU8966)__AY179962.1__Gn-NSm-Gc
agcgaggaauccggcgacgauugcaucucuagaacccagcugcuccggacagagacggccgaaauucacggggacgauuacggaggccccggggacaagaucaccauuuguaacggaagcacaaucguggaucaacgccugggcuccgagcuugggugcuauaccauuaauagagucaaaucuuucaagcugugugaaaacagcgcuacaggaaagaauugcgagaucgacuccguuccugugaagugucggcagggcuacugccucaaaaucacccaggagggccgcgggcaugugaagcugucuagaggaagcgaagucgugcuugaugccugugacuccagcugcgagguuaugauuccgaagggcacaggggauaucucuguggacuguuccggaggccagcaacacuuucugaaagauaaccucauugaccuggggugccccaagaucccucugcucggaaaaauggcgauuuauaucugucggaugagcaaucaucccaagaccacgauggcuuuccuguuuugguucucuuuuggcuacgucauuacccgcauccuuugcaaagccaucuucuaucugcucauuaucgugggcacacuggggaagagauuuaagcaguaccgggaacuuaaaccucagaccugcacaauuugugagaccacgcccgccaacgcuaucgaugccgagaugcacgaccugaauugcuccuauaacauuuguccuuacugcgcuagccgccucacaucugacggacuggccagacauguuacccaguguccgaagcggaaagaacgcguggaggaaacagagcuguaccucaaucuggaaagaauccccuggaucguccggaaacuucugcaaguguccgagagcaccggcguggcgcucaaacgcuccucuuggcugauuguccuucugguucucuucaccgugagccuguccccugugcagagcgcccccaucggguauggaaacacaauugagacguaccaggcuagagaagaguauaccucuaucugccuguuuguccucggcuccauucuguucaucgugagcugucuuaugaaggggcugguugauucuaucggaaauauuuucuucccuggccucacaaucugcaaaaccuguagcauuggcuccaucaacggguuugaaauugagucucacaagugcuacuguagccugcuuugcugccccuauugucggcacugcuccgccgacagagaaauccaucagcugcaccucagcauuuguaagaaacgcaagacaggaucuaaugugaugcuggcugucugcaaacggauguguuucagagccaccauggagguguccaacaaggcgcugcucauccgcagcaucauuaauacgacauucguugugugcauccugauucuugccgucuguaucgugucuaccuccgcugucgagauggaaagccugccggccggcaccugggagcgggaagaggaucucacaaacuuuugccaucaagaaugucaggugaccgagacagagugccuguguccuuacgaagcucugguucuuagacgcccccucuuccuggacuccauugugaaagggaugaagaacccucugaacucuacgagccucgagaccucccugucuaucgaagcccccuggggagccaucaacguccagagcacauauaagcccaccguguccacagcuaauauugcgcuuagcuggucuuccaucgagcaccggggcaacaauauucugguuagcgggagaucugaguccaucaugaaacucgaggaacgcaccggcauuagcggagaucugggcguggaagacgccucugagagcaagcugcuuacggucuccgugauggaucucagccaaauguacucuccuguguuugaauaccuguccggggaccggcagguugaggaguggccgaaagcuaccugcacaggagauugccccgaaagauguggcugcaccagcuccacaugucugcacaaggaguggccucauucucgcaacuggcggugcaaucccaccugguguuggggagucggaacgggcugcacauguugcgggcucgacgugaaagaucuguucaucgacuauauguuugugaaguggaaggucgacuacaucaaaaccgaagccauuguguguguugagcuuacaagccaggaaagacagugcucccugguggaggccggcacccgguucaaccucggaccugucaccaucacacugucugagccccgcaauauucaacagaagcugccgccugaaaucauuacgcuucaccccagaaucgaggaaggcuuuuucgaucucaugcaugugcagaaaguucugagcgcuuccaccguguguaagcugcagucuugcacacacggggucccuggagaccuccaaguguaucauaucggcaaccugcuuaaaggggauaaggagaauggacaccugauucacaagaucgaaccccauuuuaacaccagcuggauguccugggacggcugcgaucucgacuacuauuguaauaugggggauuggccuagcugcacauacaccggcguuacgcagcacaaccaugccucuuucgugaaucugcugaacauugagacagacuauaccaaauccuuucacuuccacagcaagcgggucaccgcgcauggagauacaccccagcuugaccucaaagcuagaccgaccuacggcgccggggagaucacagugcugguggaagucgccgauauggagcugcacacgaagaaaauugaaaucaccggacucaaguuugcuucucugacauguaccggcugcuacgccuguuccagcgggauuucuugcaaaguucgcauccauguggacgagccugaugagcuuacagugcacgucaaguccgacgaccccgaugugguugcugccagcuccagccugauggcgcggaagcucgaauuuggaaccgacucuacguucaaagccuuuagcgcuaugcccaagaccucccuguguuucuauaucguggagagagaauaccgcaaaucuugcagcaaggaggauacacagaaaugugucaacaccaagcuggaacaaccucaguccauucuuaucgagcauaagggcacaauuaucgggaaacagaauaauaccugcacagccaaggcuucuuguuggcuggagagcgugaaauccuuuuucuauggccucaagaauaugcugucuggaauuuuuggcaacguuuucguggggaucuuucucuuccuggccccguuuauccuucugauucucuucuuuauguucggauggagaauccugagcugcuuuaaaugcugucggcgcaccagaggccugcuuaagcaccggcaccugaaggacgaugaagagacgggguaccgcagaauuaucgaacggcucaauaacaaaaaggggaaaaauaagcugcucgacggcgagcgccuggcggauagacggauugccgaacuuuucuccacaaaaacccauaucggc

SEQ ID NO: 13740 - RNA, 3495 nt, Artificial Sequence
  derived and/or modified CDS sequence (opt5) from CCHVF(CCHVF Hodzha)__AY223476.1__Gn-NSm-Gc
agcgaggaauccggcgacgauugcaucucuagaacccagcugcuccggacagagacggccgaaauucacggggacgauuacggaggccccggggacaagaucaccauuuguaacggaagcacaaucguggaucaacgccugggcuccgagcuugggugcuauaccauuaauagagucaaaucuuucaagcuguguaaaaacagcgcuacaggaaaguccugcgaaaucgacucuaccccuguuaaaugucggcagggcuacugccucaagaucacacaggagggccgcgggcaugugaagcugagcagaggauccgaggugguccuugaugccugugacagcucuugcgaagugaugauuccgaaaggcaccggggauauccugguugacuguuccggaggccagcaacacuuucucaaggauaaucugauugaccuggggugcccccggaucccucuccugggaaaaauggcgauuuauaucugucgcaugagcaaccaucccaagacgaccauggcuuuccuuuucugguucucuuuuggcuacgugauuacaugcauccugugcaaagccaucuucuaucuccugauuaucgucggcacccuugggaagagauuuaagcaguaccgggagcugaaaccucagacauguaccauuugcgaaacgacacccgccaaugcuaucgaugccgagaugcacgaccucaacuguuccuauaauauuugcccuuacugugcuagccgccugaccucugacggacuggccagacaugugacacagugcccgaagcggaaagagaagguugaagagaccgaacucuaccugaaccuugagcgcauccccuggaucgugagaaaacugcuccaagucuccgaaagcaccggcguggcgcugaagcgguccucuuggcuuauugugcugcucguccuguucgccguuagccuguccccugugcagagcgcucccaucgggcacggaaaaacaauugagacguaucaggcccgcgaggauuacaccucuaucugucucuuugugcugggcuccauucuuuucaucgucagcugccugaugaaggggcucguggacucuaucggaaauaucuuuuucccuggccugacaauuuguaagaccugcagcauuggcuccaucaacggguuugaaauugagucucacaaauguuauugcagccuucugugcugucccuacugcagacauuguuccgcugaucgggaaauccaccagcuccaucugagcauuugcaagaaaagaaagacaggaucuaauguuaugcuggccguguguaaacgcaugugcuuccgggcgaccauggaggucuccaacaaggcccuccugaucagaagcaucauuaauacgacauucgugguuuguauccuuauucuggcugugugcgucgugucuaccuccgccgucgaaauggagagccucccggcuggcaccugggagcgcgaagaggaccugacaaacuuuugucaccaagaaugccaggugaccgagacagaaugucugugcccuuaugaggcccuuguucuccggagaccccuguuccuggauuccaucgugaaggggacgaaaaaucuccugaacucuaccagccuugagacaucccugucuauugaagccccuuggggagcuaucaacguccagagcaccuacaagcccacaguguccaccgcgaauaucgcccucagcuggucuuccguugagcaccgcggcaacaaaauucuggugagcgggcggucugaauccaucaugaagcuggaggagagaacgggcauuagcugggaccuuggagucgaagaugcuucugagagcaaacuccugaccguguccgugauggaccugagccaaauguauucucccguuuuugaauaccucuccggcgaucgccaggucgaggaauggccuaaggccacaugcaccggggacuguccggagcggugcggauguacaagcucuaccugccugcauaaggaguggccccacuccagaaauuggcgcuguaacccuacguggugcuggggcguggggacaggauguaccugcuguggccuugaugugaaagaccuguucacagacuacauguuugucaaguggaaaguggauuauaucaagaccgaagccauuguuugcguggagcucaccagccaggaacggcaguguucccuggucgaggcugggacaagauucaaucugggccccgugacgaucacccuuucugaaccucggaacauccaacagaaacuucccccggagauuaucacacugcauccucgcauugaggaaggauuuuucgaccugaugcacguucagaaggugcucagcgccuccaccgucugcaagcugcagucuugcacacauggcgugcccggggaucuucaaguuuaccacaucggaaaucugcucaaaggcgacaaggugaacgggcaccugauucauaaaaucgagccucacuuuaauaccagcuggauguccugggauggaugugaccuggauuauuacugcaacaugggcgacuggcccagcuguacguauacaggggucacccagcauaaucacgcgucuuucgugaaccuucucaauaucgaaaccgauuacacaaaguccuuucacuuccauagcaaaagagugaccgcucacggcgacacaccucagcuggaucugaaggcccggcccacguauggagccggcgagauuaccguccucguugaaguggcugacauggagcugcauaccaaaaagaucgagauuacagggcuuaaguuugccucucugacaugcaccggauguuacgcuugcuccagcggcaucucuuguaaagugcgcauucacgucgaugaaccggacgagcucacggugcauguuaaguccgacgauccugacguggucgccgcgagcuccagccugauggccagaaaacuggaauuugggaccgauucuacauucaaggcuuuuagcgccaugcccaaaaccucccuuugcuucuacaucguggagcgggaguauuguaagucuugcagcaaggaagacacacagaaauguguuaacaccaagcuggagcaaccccaguccauucucaucgaaagaaaaggaacaaucauuggcaagcagaauaauaccugcacggcuaaagccucuugcuggcuggagagcgugaaguccuuuuucuacgggcucaagaacaugcugucuggcaucuuuggaaacgucuucgugggcauuuuucuuuuccuggcgccuuuuauccuccugauucuguucuuuauguucggguggcgcauccucuuuuguuucaaaugcuguagacggacacgcggacuguucaaguauaaacaccucaaggaugacgaagagaccggcuacagacggaucauugagcgccugaacaauaaaaaggggaagaacaaacuccuggauggagaaagacuugccgaccggcgcaucgcugagcuguuuagcaccaagacacacauuggc

SEQ ID NO: 13741 - RNA, 3495 nt, Artificial Sequence
  derived and/or modified CDS sequence (opt5) from CCHVF(CCHVF Kosovo/9553/2001)__AY675511.1__Gn-NSm-Gc
agcgaggaacccggcgacgauugcaucuccagaacccagcugcuccggacagagacggccgaaauucacgacgauaacuacgggggaccuggcgacaagaucaccauuuguaaugggucuacaaucguggaucaacgccugggaagcgagcuuggcugcuauaccauuaacagagucaaauccuucaagcugugugaaaauucugcuacagggaaaaccugcgagaucgacagcacaccgguuaagugucggcagggauuuugccucaaaaucacccaggagggccgcggccaugugaagcuguccagagggucugaagugguccuugaugccugugacagcuccugcgaggugaugauucccaagggaacgggcgauauccugguugacuguagcgggggacagcaacacuuccucaaagauaaccugauugaccugggcugcccucauaucccccuccuggggaagauggcgauuuacaucgcucggaugucuaaucacccuaaaaccacaauggccuuucuuuucugguuuucccugggauaugugauuaccuguauccucugcaaggcccuguucuacagccuuaucauuaucggcacacugggcaaaaagauuaagcaguaucgcgaacucaaaccccagaccugcacgaucugugagacagcuccugucaacgccauugaugcugagaugcaugaccugaauugcucuuacaacaucuguccguauugcgccuccagacugaccagcgacgggcucgcgcggcacgugaagcagugucccaaacgcaaggaaaaaguugaggaaacagagcuguaccuuaaucuggaaagaaucccuugggugguccggaagcuccugcaagugucugaguccaccggaguggcccuuaaacgcagcuccuggcugauuguccuccugguucugcucaccgugucucugagccccgugcaguccgcuccugucggccacgggaagacaaucgagacguaccagaccagagaaggauuuacaagcauuugccuuuucaugcugggcucuauccucuuuauuguguccugucugguuaaggggcuuguggauagcgucucugacagcuucuuucccggacuguccgugugcaaaaccuguucuaucggcagcaucaacggcuucgagauugaaucccauaagugcuauuguagccucuuuugcugcccguacugucggcacugcucugccgaucgcgagauccaucagcugcaccuguccauuuguaaaaagagaaaaacagggagcaauguuaugcucgcugugugcaagcggauguguuucagagccaccaucgaagcgucucgccgggcccugcuuauuagauccaucauuaacacgacauucgucaucugcauccugacccucaccauuuguguggcuagcacauccgccgucgagauggagacccugccugcugccacaugggaacgcgaggaagaccugacgaauuuuugccaccaagagugucaggugcccgaaaccgagugccuuuguccuuaugaggcccucguucugcggaagccccuguuccucgauucuaucgugaaaggaaugaagaaccugcuuaauagcacaucccuggaaaccucucucagcauugaggcucccuggggcgcgaucaacguccaguccacauuuaaaccuaccgugagcacggccaacauugcucugucuugguccagcguugaacauagagggaauaagauccuggugaccggacgcucugaguccaucaugaaacuugaggaacggacaggcgucagcugggaccucgggguggaggaugccucugaaagcaagcugcugaccguguccauuauggaccucagccaaauguacucuccgguuuucgaguaucuguccggcgauagacaggucgaagaguggcccaaggccacaugcaccggagacugcccugagcgcuguggcugcacgagcuccacaugucuucacaaagaauggccccauucucggaacuggagaugcaauccuaccugguguuggggagugggaacaggcugcaccuguugcgggguggaugucaaggaccuguuuaccgaccacauguucgugaaauggaagguugaguacaucaaaacagaagcuauugugugugucgagcucacgagccaggaacgccagugcucccugaucgaggccggaacccgguuuaaccugggccccgugacaauuacccuuucugagccgagaaauauccaacagaagcucccucccgaaaucauuacacugcauccuaagaucgaggaaggguucuuugaucugaugcacguucagaaagugcucagcgcguccaccgucuguaagcugcagucuugcacgcacggcauucccggagaccuucaaguguaucauaucggcaaccugcucaaaggggaucggguuaauggacaccugauucauaagaucgagccucacuucaacacaagcuggauguccugggacggcugcgaucuggacuacuacuguaauaugggggauuggcccagcugcaccuauaccggagugacacagcacaaccaugcugccuuugucaaucuucucaacaucgaaaccgacuacacaaaaacguuccacuuucauucuaagcgcgugaccgcccacggcgauacaccgcagcuggaccugaaagcuagaccuaccuauggggccggcgagauuacagugcucgucgagguugcugauauggaacugcauaccaagaagguggagaucuccggacuuaaauucgccagccuggcguguacgggcugcuacgccuguucuuccgggauuagcugcaaggugcggauccacgucgacgaacccgaugagcucaccgugcacguuaaaucuuccgaccccgacguggucgcugccagcacaucccugauggcuagaaagcuggaguucggaaccgauagcacauuuaaagccuucucugcgaugccuaagaccagccuuuguuuuuauauuguggaaaaggaguacugcaaauccuguucugaagacgauacaaagaaaugcguugacaccaagcuggagcagccgcaaagcauccucauugaacaucgcggcacgaucaucgggaaacccaaugauacauguccugccaagaccuccugcuggcuggagucugucaagagcuucuuuuauggacucaaaaacaugcugggcuccguguucgggaacuuuuucauuggcauccuucuguuucucgcucccuucuuucuguggaugcugucuuucauguuuggauggaagauucuuuucugcuucaaauguugccggagaacccgcggccuguuuaaguacagacaccucaaagacgaugaggaaacaggguaccggcgcaucauugagagacugaauaacaagaaggggaaaaaucggcuccuggacggcgaacgccuugccgauagaaagaucgcugagcuguucagcaccaaaacgcauaucggg

SEQ ID NO: 13742 - RNA, 3495 nt, Artificial Sequence
  derived and/or modified CDS sequence (opt5) from CCHVF(CCHVF SPU41/84)__AY900142.1__Gn-NSm-Gc
agcgaggaauccucugacgauugcaucagcagaacccagcugcuccggacagagacggccgaaauucacggcgacaacuacgggggacccggcgauaagaucaccauuuguaauggguccacaguggucgaccaacgccugggaucugagcuuggcugcuauaccaucaacagaguuaaaacauucaagcugugugaaaauagcgcuaccgggaaauccugcgagauugauucugugccugugaagugucggcagggauacugccucaaaaucacacaggagggccgcggccaugucaagcugagcagaggguccgaagugguucuugacgccugugauaccagcugcgaggugaugaucccgaagggaacgggcgacauucuggucgauuguucugggggacagcaacacuuucucaaagacaaccugaucgaucugggcugccccaagauuccucuccuggggaaaauggcgaucuauauuugucggauguccaaucaucccaagaccacaauggcuuuccucuuuugguucagcuuuggauacgugauuaccugcaucaucugcaaaguuaucuucuaucugcucauuaucgugggcacacugggcaagcgcuuuaagcaguacagagaacuuaaaccucagaccuguacgauuugcgagacaacccccgucaacgccaucgacgccgagaugcacgaucugaauuguucuuauaacauuugcccuuacugugcuucccggcucacaagcgacgggcuggcccgccaugugacccagugcccgaagagaaaagaaaagguggaggaaaccgagcuguaccucaaucuggaacggauccccugggucguucgcaaacuucugcaagugucugaguccacaggaguggcucucaagagaagcuccuggcuggucgugcuucugguucuccugacggugucucugagcccuguccaguccgcccccaucagccacggcaaaaccguggaggcguaucgggcccgcgaaggguacacaucuaugugucucuucguucugggauccgugcuuuuucuggucagcugccucaugaagggccugguggacucugucgggaacaccuucuuuccuggacuuagcauuuguaagacaugcuccaucucuagcauuaauggcuucgagaucgaaucccacagauguuauugcagccuguuuugcugucccuacugccggcauuguucugcuaacaaagagauucaccagcuccaucuguccaucugcaagaaaagaaaggccggcagcaaugugaugcuggcuguuuguaaacgcaugugcuuccgggccaccauggaagugucuaacagagcgcuuuucauccgcuccauuaucaauacgacauuuguccuguguauucuuauccuggccgcuugcgugguuagcaccuccgccguggagauggagucucucccggcugggaccugggaacgggaggaagaucugacaaacuucugucaccaggagugccaagucgccgacaccgaaugucugugcccuuaugaggcccuugugcucagacgcccccuguuucuggauagcauugugaagggaaugaagaaccuccucaauuccacaucucuugagacgagccuguccaucgaagcuccuuggggcgcgauuaacguucagagcaccuacaaacccacagucucuaccgccaauaucgcucucuccuggagcucuguggagcaccgggggaacaagauccugguguccggaagaagcgaaucuauuaugaaacuggaggagcgcacaggcaucagcugggaccuuggggucgaagaugccuccgagagcaagcuccugaccgugucuguuauggaccugucccagauguauagccccguguucgaauaccucuccggcgaucggcaagucgaggaauggccuaaagccacgugcaccggagacuguccggagagaugcggcuguacaucuucuaccugccugcauaaggaguggccccacucccgcaauuggcgguguaacccuacauggugcuggggaguggggaccggcuguacgugcugugggcuugauguuaaggaccuguuuacagauuacauguucgugaaauggaaggucgaauauauuaaaaccgaggcuaucgugugcguugaacucacaucucaggagagacaguguagccugauugaagccggaacccgguuuaaucugggccccgugaccaucacacuuuccgagccucgcaacauccagcaaaagcugcccccggagauuaucacgcugcauccuagaauugaagagggguucuuugaccugaugcacguccagaaagugcucucugcgagcaccgugugcaagcugcaguccugcacacauggcguccccggagaccuucagguuuaccacaucggcaaucugcucaagggggauaaagugaacggacaccuggugcauaagauugaaccucacuucaauaccagcuggaugucuugggacggcugugaucuggacuauuacugcaacaugggggauuggcccuccuguacauauaccggagucacgcaacauaaucacgcuagcuuugugaacaugcuuaauaucgagacagacuacaccaaaaacuuccacuuucauucuaagcggguuaccgcccacggcgauacaccucagcucgaccugaaagccagacccaccuauggggcuggcgaaaucacagugcuggucgagguggccgauauggagcuccauacgaagaaaauugaaaucuccggacugaaguucaccagccuuacaugcaccggcuguuacgcuugcagcuccgggauuagcuguaagguucgcauccacguggacgagccggaugaacugacaguccaugugaaauccgaggacccugauguuguggccgcgagcucuagccucauggcccggaagcuggaguucggaaccgacuccacguuuaaggcuuucucugccaugcccaagaccagccugugcuuuuacauugucgaaagagaguauuguaaauccugcucugaagaggacacacagaagugugugaacaccaaacuugaacagccccaaagcauccugaucgagcgcaaaggcacaauuaucgggaagcagaauaauaccugcaaagcuaaggccggaugcuggcucgaguccgugaaaucuuucuuuuacggccugaagaacaugcucagcgggauuuucggcaacgucuuuaucggaauuuuccuguuucuugcgccuuucauccugcucauucuguuuuucauguuuggcuggagaauccuguucuguuucaagugcugucggcgcacaagagggcuuuuuaaauaucggcaccugaaggaugacgaagagaccggauaccgcaaaaucauugaaagacucaauaacaagaaaggcaagaauaagcugcucgauggggagcggcuggccgaccgcagaaucgcugaacuuuucuccacgaaaacacacauugga

SEQ ID NO: 13743 - RNA, 3495 nt, Artificial Sequence
  derived and/or modified CDS sequence (opt5) from CCHVF(CCHVF UG3010)__AY900143.1__Gn-NSm-Gc
gccgagggcgugagcaacgacugcgucuccagaacccagcugaucaagacagaaguugcugagauucacgaagauucuuacgggggacccggcgagaaaaucacgauuuguaaugggagcaccaucguggaccaacggcucggauccgaacugggcugcuauacaauuaaccgcgugaagaccuacaaacuuugugaaaauucugccacagagaaggggugcgaaaucgauagcgucccugugaaauguaagcagggauucugccugaagguuacccaggagggcagaggccaugugaaacucucccgggggacagaaaucguccuggacgugugugauaccucuugcgagcuuaugauuccgaagggaacgggcgacauccugguugauuguagcgggggacagcaacacuuucuccaggacaaccugauugaucugggcugccccaaugugccucuccuggggaaaauggcgaucuauauuugucgcauguccaaccaucccaagaccacaauggcuuuccuguuuugguucagcuuuggauacgucauuaccugcaucgugugcaaagugcuguucuaucuccugaucgucaucggcacacuuucuaagaagcugaaacaguacagagagcucaagccucagaccuguauuguuugcgaauccacgcccgugaaugccaucgacgccgagaugcacgaacugaacuguaauuauaacauuugcccuuacugugcuagccggcugacaucugauggccucgugcgccaugucaaucaaugcccgaaaagaaaggagaaaguggaagagaccgagcuguaccuuaaccuggaacggauccccuggcucguucgcagacugcuucagguguccgagagcacagggauggcccugaagcggucuuguuggaugaccacccuccugauucugcucgucgugucccugagcccuguucaguccgcucccgugggacagggcaaagccgucgaaguguaucgcgucagagagucuuacacaagcaucugccuuuuugugcugggguccguucucuucgcggugagcuggcugaucaagggacuuauugacggcaucggaaauucuuucuucccugggcuguccgucuguaagacgugcagcauuggcucuaucaacggcuuugaaauugagagccacaaauguuauugcucccucuucugcugucccuacugccgggccuguucuagcgauaagaucacccaccgcaugcaucugaaugugugcaaaaagagaaaagcuggguccaacguuaugcuggccguguguaagcggaugugcuuuaaggcuacagucgaggccagcaacaccgcgcuccugaucagaggaauuaucaauucuacauucgugauuugugugcuuauccugguuauuugcgucguguccaccagcgccguggacauggaaaaccucccggcuggcaucugggagcgcgaagaggaccugacgaauuucugucaccaagaaugccaggucacagagaccgagugucugugcccuuaugaagcccuuauucuccggaaaccccuguaccuggauucuaucgcuaaggggaugaaaucccuccugaacagcaccaaucuugagacaucccugucuaucgaagccccuuggggagccauuaacgugcagagcaccuuuaagcccacaguuuccgcugcgaauaucgcccucucuuggagcuccguggagcauagaggcaacaaaauucuggucagcgggcgcucugaguccaucaugaagcuggaggagcggacgggcauuagcuggucucuuggaguggaagacgcuuccgagagcaagacccucacaguuucugugauggaucugagccaaauguauucccccgucuucgaauaccugagcggcgacagacagguggaggaguggccuaaagcuaccugcacaggggauugucaggaacgcugcggauguaccucuuccacgugccuccacaaggaguggccgcacagccggaauuggagauguaaccccaccuggugcuggggcguugggacaggauguaccugcuguggccuggacgugcgcgaucuuuuuacagacuacaugauggucaaauggaagguggaauaugugaaaaccgaggccaucaugugcgucgaacugacgucccaggagcggcaauguucucucaucgaggcugggacaagauucaaucugggcccuguuaccauuacacugagcgaaccccgcaacauccagcagcggcuuccuuccgagauugugacccuccaucccaagaucgaagagggauuuuucgaucugaugcacgugcagaagguccugucugccagcaccgugugcaaacuccaauccugcacacauggcguuccgggggaccuucagguguaccacgucggaaaucuucugaagggcgauaaagugaacgggcauucuauucacaagaucgaaagccacuuuaauacguccuggaugagcugggacggaugugaccucgauuauuucugcaacaugggcgacuggccuucuuguaccuacacagggguuacccagcauaacagagcggcuuuuaucaauaugcugaacauugagacagauuauaccaaaacguuccacuuucauuccaagcgggugacagcccacggcgacacaccccagcuggaucuuaaagcccgcccuaccuacggagcuggcgaggucaccgugcucguugaaguggccgaccuggagcugcacaccaagaagaucgaagucagcgggcucaaauucgcuucucugacaugcuccggauguuaugccugcagcucuggcauuuccuguaaggugagaauccaugugaaugagcccgaugaguuuacgguccacguuaaaagcuccgacccugaugugguggcggccgggagcucucuuauggcucggaagauugaauuuggagccgacagcaccuucaaagccuuuuccucuaugcccaagaacagccugugcuucuacaucgucgagagagauuacuguuccucuugcacaaaugacgauacccaaaaguguguggacacaaaacucgaacauccgcagagcauccugauugagcacaagggcaccaucauugggaaacagaacgacacgugcuccaccaagacaucuugcuggcuggaaagcguuaaauccuuuuucuauggccuuaagaauaugcugggaggcaucuuugggaacguguuccucggaauuuuucuguuccucgccccuuuugcgcugcuuaucuucuuuuucuuuuucggcuggcgccuccuguucugucugaagugcugucggagaacccgcgggcugcuuaaauacaagcagcugaaagaugaggaggaagccggauauaagaaaauuaucgagagacucaaugacaagaagggcaaaagccggcuguuugauggcgaacgccucgcugacagaaagaucgccgagcuguucucuacaaaaacccauauuggg

SEQ ID NO: 13744 - RNA, 3495 nt, Artificial Sequence
  derived and/or modified CDS sequence (opt5) from CCHVF(CCHVF Hy13)__AY900145.1__Gn-NSm-Gc
agcgaggaauccggcgacgauugcaucucuagaacccagcugagccggacagagacggccgaaauucacuccgacaacuacgggggacccggcgauaagaucaccauuuguaaugggucuacaaucguggaccaacgccucggaagcgagcugggcugcuauaccauuaacagagucaaauccuucaaacuuugugaaaauucugcuacagggaaaagcugcgagaucgauuccaccccuaucaagugucggcagggauuuugccugaaaauuacacaggagggccgcggccauguuaagcucagcagagggucugaaguggugcuggacgccugugauuccagcugcgagaucaugauuccgaagggaaccggcgacauccuugucgauuguucugggggacagcaacacuuccugaaagacaaccucauugaucugggcugccccaauaucccucugcucgggaagauggcgauuuacaucugucggauguccaaccaucccaaaacgaccauggcuuuucuguucugguuuagcuucggauaugugaucacaugcauucuuugcaagguuaucuuuuaccugcucauuguggucggcacccugggcaaaaaguucaagcaguaucgcgaacuuaaaccucagacauguaccaucugcgagacgacacccgugaaugccauugacgccgagaugcacgaucugaacuguucuuacaauaucugcccuuauugugcuuccagacucaccagcgacgggcuggcccggcauguuaugcagugcccgaagcgcaaagaaaagguggaggaaacagagcuguaccucaaccuggaaagaauccccugggucgugcggaaacuucugcaaguguccgagucuaccggagucgcucucaagcgcagcuccuggcugguugugcuucuggugcuccugaccgucagccugucuccugugcaguccgcccccauuggccacgggaaaacaguugagacguaccagaccagagaaggauauacaagcaucugucucuuugugcugggcucuauucuuuucaucgucagcugccugaugaaggggcucguggacuccguuggaaauagcuuuuucccuggcagcuccauuuguaagaccugcagcaucggcucuaucaacggguuugagauugaaucccacaaauguuacugcagccuguucugcugucccuauugccggcauuguucugcggaucgcgagauccacaaacuucaucuguccauuugcaaaaagagaaaaacaggaagcaaugugaugcucgccgucuguaagcggaugugcuucagagcuaccguggaagucuccaacaaggcccugcugauccgcaauauuaucaacacgacauuugugguuuguauucucauccuggcugugugcgucgugucuaccagcgccguugagauggagucccuuccggcgggcaccugggaacgggaggaagaccugacaaacuucugucaccaggagugccaagccaccgaaacagagugucucugcccuuacgaggcucuggugcugagaaaaccccuguuuucugauagcaucgucaaggggaugaaaaaucuccugaacuccacgagccuggaaaccucucucuccauugaggccccuuggggagcuaucaaugugcagagcacauucaagcccaccgugucugccgccaacauugcucuguccuggagcucuguugaacaccgcggcaauaaaauccuugucagcgggcgguccgagagcauuaugaagcuggaggaaagaacaggcaucucuugggaccucggaguggaggaugcguccgaaagcaagcugcugaccguguccaucauggaccuuucucagauguauagccccgucuuugaguaccucuccggcgaucgccaaguggaagaguggccuaaagccacgugcaccggggacuguccggagcggugcggauguacaucuucuaccugccugcauaaggaauggccccacuccagaaacuggcgcuguaauccuacauggugcuggggcguugggaccggauguacgugcuguggccuggaugugaaagaccucuucacagaucauauguuugucaaguggaaaguggaguauauuaagaccgaagcuaucguuugcguggagcugacaucucaggaacggcaguguagccuuauugaggccgggaccagauucaaccugggccccgucaccaucacacucuccgagccucgcaauauucagcaaaagcugcccccggaaaucgugacgcugcacccucggaucgaggaaggauuuuucgaccuuaugcauguuaaaaaggugcucagcgccucuaccgucugcaaacugcaguccugcacacacggcgugcccggggaccuucagguguaccacauuggaaaccuccugaagggcgauaaagucaaugggcaucuuauccacaagauugagccucauuuuaacaccagcuggaugucuugggacggaugugaucuggacuacuauugcaauaugggcgauuggcccuccuguagcuacacagggguuacccagcacaaccacgcugccuucgugaauaugcucaacaucgaaacggacuauacaaaaauuuuucauuuccacucuaagagagugaccgcgcauggcgauaccccucaacuggaccugaaggcucggcccacauacggagccggcgagaucaccguccuuguggagguugccgauauggaacuccacacaaagaagaucgagauuuccgggcugaaauucgcuagccugacgugcaccggauguuaugccugcuccagcggcaucucuuguaaggugcgcauucaugucgacgaaccggaugagcucacagugcacguuaaaagcgaggacccugauaucguggcugccuccucuagccugauggcgagaaaacuugaauuugggaccgacuccacauucaaggccuuuucugcuaugcccaagaccagccugugcuucuacauugucgagcgggaauauuguaaguccugcucuaaagaggacacgcagaagugugugaacaccaaacucgaacagccccagagcauccugauugagcacaagggaacaaucaucggcaagcaaaaugauaccugcacauccaaagccgggugcuggcuggagagcguuaaguccuuuuucuacggccuuaaaaacaugcugucuggaauuuuuggcaauguguucaucgggauuuuucucuuccuggcuccuuuuauccuccugauucuuuucuuuauguucggauggagaauccuguucuguuuuaagugcugucgccggaccagaggccucuucaaauaccgccaucugaaggacgaugaagagacaggguauagaaagaucauugaacggcugaacaauaaaaagggaaagaacaaacuucuggacggcgagcgccucgccgauagaaagaucgcggaacuguuuagcaccaagacgcacauuggc

SEQ ID NO: 13745 - RNA, 3495 nt, Artificial Sequence
  derived and/or modified CDS sequence (opt5) from CCHVF(CCHVF Semunya)__DQ094832.1__Gn-NSm-Gc
gccgagggcgugagcaacgacugcgucuccagaacccagcuuaucaagacagaaguugcugagauucacgaagauucuuacgggggacccggcgagaaaaucacgauuuguaaugggagcaccaucguggaccaacggcucggauccgaacugggcugcuauacaauuaaccgcgugaagaccuacaaacuuugugagaauagcgccacagagaaggggugcgaaaucgauagcgucccugugaaauguaagcagggauucugccugaagguuacccaggagggcagaggccaugugaaacucucccgggggacagaaaucguccuggacgugugugauaccucuugcgagcuuaugauuccgaagggaacgggcgacauccugguugauuguagcgggggacagcaacacuuucuccaggacaaccugauugaucugggcugccccaaugugccucuccuggggaaaauggcgaucuauauuugucgcauguccaaccaucccaagaccacaauggcuuuccuguuuugguucagcuuuggauacgucauuaccugcguggugugcaaaguccuguucuaucuccugaucguuaucggcacacuuggcaagaagcugaaacaguacagagagcucaagccucagaccuguaucgugugcgaaucuauucccgugaaugccaucgacgccgagaugcacgaacugaacuguaauuauaacauuugcccuuacugugcuucccggcugacgagcgaugggcucguccgccaugugacacaaugcccgaaaagaaaggagaaaguugaagagaccgagcuguaccuuaaucuggaacggauccccuggcucgugcgcagacugcuucaggucucugaguccacaggaauggcccugaagcggagcuguuggaugaccacccuccugauucugcucgugguuucucuguccccugugcagagcgcucccgucggccaggaaaaagccaucgagguguaucaaguccgcgaauccuacacaucuaucugccuuuuugugcuggggagcguucucuucgcgguguccuggcuggucaagggacuuauugacggcaucgggaacagcuuuuucccuggacugucuguguguaagacgugcuccauuggcagcaucaauggcuuugagauugagucucacaaauguuauugcagccucuucugcugucccuacugcagagccuguuccucugauaagaucacccaccggaugcaucugaacaucugcaaacgcagaaagguugggagcaaugugaugcuggcugucuguaaacggaugugcuuuaaggccacaguggaggcuuccaacagcgcccuccugauuagaucuaucauuaacuccaccuucgugaucuguguucuuauucuggucaucugcguggugagcacaucugcggucgacauggaaaaucucccggccggaauuugggaacgcgaggaagaccugaccaacuucugucaccaggagugccaggugacggagacagaaugucugugcccuuaugaggcucuuauccuccggaagccccuguuucuggauuccaucgccaaaggcaagaaaagccuccuuaauuccaccaaccuugaaaccucucugagcauugaggcuccuuggggagccaucaauguucaauccacauucaagcccaccgugucugccgcuaacauugcgcucagcugguccagcgucgagcauagagggaauaaaauccuggugucuggccgcuccgaaagcauuaugaagcuggaggaacggacagggaucucuuggucccuuggcguugaggacgccagcgaaucuaagacgcucaccgugagcgucauggaucugucccagauguacagccccguguuugaguaucugucuggagacagacagguugaggaauggccuaaagcuacaugcaccggcgauuguccggagcgcugcggguguacauccucuaccugccuccacaaggaauggccccacucccggaacuggagauguaauccuacguggugcuggggagugggcaccggguguacaugcuguggacuggacguccgcgaucuuuucaccgacuacaugauggugaaauggaagguggaguacgucaaaacagaagccaucaugugcguugagcugaccucucaggagcggcaauguagccucauugaagccggcacgagauuuaaccuggggcccgugacaaucacccuguccgagccucgcaaugugcagcagcggcuucccucugaaauugucacacuccauccgaagaucgaggaaggcuucuuugaucugaugcacgugcagaagguucuguucugcaaauauagccuccaagcuaccuccugcacccauggagugccuggcgaccugcaggucuaccacguggggaaccuucugaagggagauaaaguuaauggccauucuauucacaagaucgagagccacuuuaacacauccuggaugagcugggacgggugugaccucgauuauuucugcaauaugggagacuggcccucuuguacguacaccggcgugacacagcauaacagagccgcguuugucaacaugcugaauaucgagaccgauuauacaaaaaccuuccacuuucauuccaagcgggugacggcucacggggacacaccucagcuggaucuuaaagcccgccccaccuacggcgccggagaaguuaccgugcucgucgagguggcugaccuggaacugcacacaaagaagauugaggugagcggccucaaauucgccucucugaccugcuccggguguuaugcuugcagcucuggaaucuccuguaagguccggauucauguuaacgagccugaugaauuuacagugcacgugaaaagcaaugaccccgaugucguggccgcgggcuccagccuuauggcccggaagaucgaguuuggggcugacucuacguucaaagccuuuagcuccaugccgaagaacucucugugcuucuacauuguugaaagagauuacuguagcuccugcaccgacgaugacacacaaaagugugugaauaucaaacucgagcauccucagucuauccugauugaacacaagggaaccaucauuggcaaacagaacgacacaugccccaccaagacgagcugcuggcuggaguccgucaaaucuuucuucuaugggcuuaagaauaugcugggcggaaucuuuggcaacguguuccucgggauuuuucuguuccucgcucccuuugcccugcuuauccuguucuuuuucuucggauggcgccuccuguuuugucugaagugcugucggagaacccgcggccuucugaaauacaagcagcucaaagaugaggaagaggcgggguauaagaaaauuaucgaaagacugaaugacaagaagggaaaaagcagacucuucgauggcgagcgccuggccgacagaaagaucgcuaaacuguuuuccacaaagacccauauuggc

SEQ ID NO: 13746 - RNA, 3495 nt, Artificial Sequence
  derived and/or modified CDS sequence (opt5) from CCHVF(CCHVF SPU128/81/7)__DQ157174.1__Gn-NSm-Gc
agcgaggaacccuccgacgauugcaucucuagaacccagcugcuccggacagagacggccgaaauucacggcgacaacuacgggggaccuggcgauaagaucaccauuuguaaugggagcacaaucguggaccaacgccugggauccgagcuuggcugcuauaccauuaacagagucaaaucuuucaagcugugugaaaauagcgcuacagggaaauccugcgagaucgagucuguuccggugaagugucggcagggauacugccuccgcaucacccaggaaggcagaggccaugugaaacugagccggggguccgaggucgugcuugaugccugugacacaagcugcgaaauuaugauccccaagggaaccggcgauauucugguugacuguucugggggacagcaacacuuucucaaggauaaccugaucgaccugggcugcccuaaaauuccccuccuggggaagauggcgaucuauauuugucgcauguccaaucauccuaaaacgaccauggcuuuccuguuuugguucagcuuuggauacgugaucacaugcauccuuugcaaggccauuuucuaucuccugaucauuaucggcacccuuggcaaaagauuuaagcaguaccgggagcugaagccccagacauguaccauuugcgagacgacaccugucaacgccaucgaugcugaaaugcacgaccucaauuguucuuauaacaucugcccguacugugccucccgccugaccagcgaugggcuggcuagacaugugacacagugccccaaacggaaggagaaaguugaagagaccgaacucuaccugaaucuugagcgcauuccuuggguggucagaaagcugcuccaagugucugaguccaccggaguggcccugaaacggagcuccuggcuuaucguccugcucguucuguucacagugucucugagccccgugcaguccgcgccuauuggccacgggaagacgaucgaagccuaucgcgcuagagagggauacaccagcauuugucucuuuguccugggcucuauccuuuucaucguguccugccugaugaaagggcucguugacagcgugggaaacagcuuuuuccccggccugucuauuuguaagacaugcuccaucucuagcauuaauggcuuugaaaucgagucccacaaguguuauugcagccuuuucugcuguccguacugccggcauuguucugccgacaaagaaauucacaagcugcaucucuccaucugcaaaaagagaaaaaccgggagcaacgucaugcuggcuguguguaagcgcaugugcuuccgggccacaauggagguuucuaauagagcgcuguuuauucgcuccaucaucaacaccacguucgugcucuguauucugauccuugccgucugcguggucagcacauccgcuguggagauggaaaaucugccugccggaaccugggagcgggaagaggaucucaccaacuuuugucaccaggaaugccagguuacagagaccgagugucugugccccuaugaagcucuggugcuuagaaagccucucuuccuggacucuauugucaaaggcaugaagaaccugcucaauagcacaucccuggagacgucucuuagcaucgaagcccccuggggagccauuaacgugcaauccaccuacaaacccacaguuagcaccgcuaauaucgcgcugucuugguccagcguggagcaccgcgggaacaagauccucgucucuggccgguccgagagcauuaugaaacuggaagagagaacagggaucucuugggaucugggcguggaagacgccagcgaguccaaacuucucaccgugagcguuauggaucugucucagauguauuccccugucuuugaauaccugagcggagaccgccagguggaggaguggccgaaggcuacgugcaccggcgauugucccgaacggugcggguguacauccucuaccugccuccauaaggaguggccucacagcagaaauuggcgcuguaaccccacauggugcuggggagugggcaccggguguacgugcuguggacuggacgucaaggaucuuuucacagacuacauguuugugaaauggaagguugaauauauuaaaaccgaggccaucgugugcgucgaacugacaucccaagagcggcaguguucucucauugaggccggcaccagauucaaucuggggccugugaccaucacacugagcgaaccccggaacauccagcagaaacuuccgccugagauuaucacgcuccauccccgcauugaagagggcuuuuucgaucugaugcacguucaaaaggugcuguccgcuucuaccgucugcaagcuccagagcugcacacauggagugccuggcgaccugcagguuuaccacaucgggaaucuucugaagggagacaaagugaacggccaccucauucauaagaucgaaccccacuuuaauaccuccuggaugagcugggaugggugugaccuggauuauuacugcaacaugggagacuggccuucuuguacauauaccggcgucacgcagcauaaucacgccuccuucgugaaccugcuuaauaucgagacagauuacaccaaaaacuuucacuuccauagcaagagagugaccgcgcacggggacacaccccaacucgaucugaaagcucggccgaccuauggcgccggagagauuacaguccugguugaaguggccgacauggagcuccauacgaagaagaucgaaauuucuggccugaaauucgcuucccuuaccugcacaggguguuacgccugcagcucuggaaucuccuguaaggugcgcauucacgucgaugagccugacgagcugaccgugcauguuaaaagcgaugaccccgauguggucgcugccuccagcucucucauggcgagaaagcuggaauuuggcacagacagcaccuucaaagccuuuuccgcuaugcccaagacgucucugugcuucuacaucguggagcgggaacacuguaagagcugcuccgaggaagacaccaaaaaguguguuaacacaaaacuugagcagccucagucuauucugaucgagcacaaggggaccaucauuggaaaacagaauagcacaugcaccgccaaggcuuccugcuggcucgaaucugucaagagcuuuuucuauggccugaaaaacaugcucuccgggaucuuuggcaauguguucauuggaaucuuucuguuccuuggcccguuuauucugcucauccuguucuuuauguucggguggagaauccuguucuguuuuaagugcugucgcagaacacggggacuucugaaauaccgccaucucaaggaggaugaagagaccggcuauagacggauuaucgaacgccugaacaauaaaaaggggaagaacaaacuccuggacggagagagacuugccgaucggcgcauugcggagcuguucagcacgaagacacacaucggc

SEQ ID NO: 13747 - RNA, 3495 nt, Artificial Sequence
  derived and/or modified CDS sequence (opt5) from CCHVF(CCHVF ROS/HUVLV-100)__DQ206448.1__Gn-NSm-Gc
agcgaggaacccggcgacgauugcaucuccagaacccagcugcuccggacagagacggccgaaauucacgacgauaacuacgggggaccuggcgacaagaucaccauuuguaaugggucuacaaucguggaucaacgccugggaagcgagcuuggcugcuauaccauuaacagagucaaauccuucaagcugugugaaaauucugcuacagggaaaaccugcgagaucgacagcacaccgguuaagugucggcagggauuuugccucaaaaucacccaggagggccgcggccaugugaagcuguccagagggucugaagugguccuugaugccugugacagcuccugcgaggugaugauucccaagggaacgggcgauauccugguugacuguagcgggggacagcaacacuuccucaaagauaaccugauugaccugggcugcccucauaucccccuccuggggaagauggcgauuuacaucugucggaugucuaaucacccucgcaccacaauggcuuuucuuuucugguuuuccuucggauaugugauuaccugcaucuuuugcaaagcccuguucuacagccucaucauuaucggcacacugggcaagaaaauuaagcaguauagagaacuuaagccccagaccuguacgaucugcgagacagccccugucaacgcuauugaugccgagaugcaugaccugaauuguucuuacaacaucugcccguauugugcuucccggcucaccagcgacgggcuggcccgccacgugccccagugcccuaaaagaaaggaaaaaguugaggaaacagagcuguaccucaaucuggaacggauccccuggauugugcgcaaacuucugcaagucucugaguccaccggaguggcgcucaaaagaagcuccuggcugaucgugcuucugguccuccugaccguuucucugagcccugugcaguccgcccccgugggccacgggaagacaauugagacguaccagacccgggaaggauuuacaagcaucugucucuucaugcugggcucuauucuuuuucuggucuccugccucgugaaagggcugguugauagcgugucugacagcuucuuuccgggacuuuccgucuguaagaccugcucuaucggcagcaucaacggcuucgagauugaaucccauaaguguuauugcagccuguucugcuguccuuacugccgccacuguucugcugauagagagauccaucagcuccaccuguccauuugcaaaaagcggaaaacagggagcaaugugaugcuggccguuuguaagagaaugugcuuucgcgcuaccaucgaagccucucggagagcgcuccugauucgcuccaucauuaacacgacauucgugaucuguauccuuacccugaccauuugcgucgugagcacauccgccgucgagauggagaaucuccccucuggaaccugggaacgggaggaagaccugacaaacuuuugucaccaagagugccaggugacggaaaccgagugucugugcccuuaugaggcucuuguucucagaaaaccccuguuccuggauagcaucgugaagggcaugaagaaucuccugaacuccacaucucuugaaaccagccuguccauugaggcccccuggggagcuaucaacguccagagcacauuuaaaccuaccgugucuacggccaauauugcccucuccuggagcucuguugaacaucgcggaaacaagauccuggugaccggccgguccgagagcaucaugaaacuggaggaaagaacaggggucucuugggaccuuggcguggaggaugcuagcgaauccaagcuccugaccgugagcauuauggaccugucucaaauguacuccccgguuuucgaguaucucagcggagaucgccaggucgaagaguggcccaaagcgacaugcaccggcgacuguccugagcggugcggguguacguccucuacaugccugcacaaggaauggccccauagcagaaauuggcgcuguaacccuaccuggugcuggggagugggcacaggguguaccugcuguggaguggaugucaaggaccuuuuuaccgaccacauguucgugaaauggaagguugaguacaucaaaacagaagccauugugugcgucgagcugacgucccaggaacggcaguguucucucaucgaggcuggcaccagauuuaaucuggggcccgugacaauuacccugagcgagccgcggaacauccaacagaaacuuccucccgaaaucauuacacuccauccuaagguugaggaaggcuucuuugaucugaugcacgugcagaagguccuguccgccucuaccgugugcaagcuccagagcugcacgcacggaauccccggcgaccugcaaguuuaucauauugggaaucuucugaaaggagaucgcgugaacggccaccucauccauaagauugagccucacuucaauacauccuggaugagcugggacgggugugaucuggacuacuacugcaacaugggagauuggcccucuuguaccuauaccggcgucacacagcacaaucaugccgcuuuugugaaccugcuuaauaucgaaaccgacuacacaaaaacguuccacuuccauuccaagagagugaccgcccacggggauacaccgcagcucgaccugaaagcgcggccuaccuauggcgcuggagagaucacaguccugguugagguggccgauauggaacuccauaccaagaaaguggagauuagcggccugaaguuugccucucuugcuugcacgggguguuacgccugcuccagcggaaucucuuguaagguccgcauucacguggacgaacccgaugagcugaccguucacgugaaauccagcgaccccgacgucguggcugccuccacaagccucauggcgagaaagcuggaguucggcaccgauucuacauuuaaagccuucagcgcuaugccuaagaccucccugugcuuuuauaucguugaacgggaguacuguaaaucuugcagcgaagaggacacacagaaguguguggauaccaaacuugaacaaccgcaguccauucugaucgagcauaaggggacgauuaucggaaagcagaacgacacaugcaccgccaaggcuucuugcuggcucgagagcgucaaguccuucuuuuauggccugaaaaauaugcucgggucuguguucggcaacuuuuucaucgggauucugcuuuuucuggcccccuucguucuccuggugcuguuuuucauguucggcuggaagauccuguuuuguuucaagugcuguagacgcaccagagggcuucucaaauaccggcugcucaaggaugacgaagagacaggauaccgcagaauuaucgaacggcugaacaauaaaaagggcaaaaaccgccuucuggauggggagagacucgcggaccggaagauugccgaacuguuuagcaccaagacgcacaucgga

SEQ ID NO: 13748 - RNA, 3495 nt, Artificial Sequence
  derived and/or modified CDS sequence (opt5) from CCHVF(CCHVF AP92)__DQ211625.1__Gn-NSm-Gc
agcgagggcggggacggaggcugcaucuccagaacccagcugauuaagacagaaacggccgaggugcacggggaugacuacggaggccccggggagaaaaucaccauuuguaacggaucuacaaucgucgaucaacggcucggcagcgagcugggcugcuauaccauuaaucgcaucaaguccuucaaacuuugugaaaacucugcucaggggaagaauugcgagaucgacagcgccccuguucaguguagacagggauacugccugaaaauuucccaagagggccgggggcaugugaagcucucucgcggaagcgaaaucgugcuggaugucugugacacauccugcgagauuaugaucccgaagggcaccggggauauucuuguggacuguagcggaggccagcagcacuuucugcagucuaaccucguugaucugggcugccccaauaucccucugcucgggaaaauggcgauuuauaucuguagaauguccaaccaucccaagacaaccauggcuuuccuguuuugguucagcuuuggauacgugaucacgugcauucuuugcaaaacccuguucuauauccucauuaucauuggcacacuggggaagaaacuuaagcaauaccgggaacugaagccucagaccuguacaaucugcgagucuguccccgugaaugccaucgacgccgagaugcacgaucucaacuguuccuauaauauuugcccuuacugugcuagccgccugaccucugaaggacugacgagacauguuaaccagugcccgaaacggaaggagaaaguggaagagacagaacucuaccugaaucuugagcgcauccccuggauugucagaaagcugcuccagguguccgagagcaccggcguggcccugaaacgguccucuuggaugaucguccuucugauucuccugaucguuagcauguccccugugcaaagcgcucccaucucucaggaacgcacaguggcccuguaucaguccagagaggacuacauggggauuugucucgucaucaugggaagcgugcugcuugcgguuucucugcucgugcggggccugauugauagcaucuccucuaccuuuuucccuggccuuagcgucugccgcaccugucacauuggguccaucaacggauuugaaauugagagccacaagugcuauuguggccugcucugcugccccuacuguagagccugcucuacagaccaagacgcucaucaguuccaccuguccguguguaaaaagcggaaggccgggagcaauguuaugcuggcugugugcaaaagaauguguuuuaaggccaucaucgaagcgucuaacaaaguccucuucauucgcaaugugaucaacacgaccuuugucgugugcauucugguuaugguggccuguaucgcuuccagcgccgcugucgagauggagaaccuuccggccggaacaugggaacgggaggaagaacugaccaauuucugccaucaggaaugucaggugacagagaccgagugccucuguccuuaugaauccuucauucugagaaagccccuguuucuugauucuaucgccaaaggcguuaagaaccuccugaauagcacgucccuggagacaucucucagcaucgaagcuccuuggggcgcgauuaacgcccaauccaccuacaagcccaccgcuagcucugccaauaucgcccugacaugguccagcguggagcaccgcgggaacaaaauucuugucucuggacgguccgagagcaucaugaagcuggaagagagaaccggcauuucuuggaaucucgggguggaagacgcuagcgagucccgcacacugacgaucagcgugauggaucugucucagauguauucccccguuuucgaauaccuuagcggagaccggcaggucgaggaguggccuaaagcuaccugcacaggcaacugcccggaaagaugugggugcaccuccucuacaugucucuacaaggaguggccccacagccgcaauuggcggugcaacccuaccugguguuggggagugggcacggggugcaccuguugcggccuggaugugaaagaacuguuuacagaccauaugcucgucaaguggaagguggaguauaucaaaaccgaagcgauuguuuguguggagcugacaucccaggagagacaaugcucucuuaucgaagcuggaacccgcuucagccugggccccgucacgauuacacucuccgagccucggaauauccagcagaagcugcccccggaacugauuacccuucacccuaaaaucgaggauggguacuuugaccucaugcaugugcagaagguuaugucugccagcacaguguguaaacugcaauccugcacccacggaguccccggcgaucugcagaucuaucauguggggaaccuccugaagggagacagaguuaauggccaccuuauucacaagguggaaccucaucugaacaccagcuggaugucuugggaugggugcgaccucgacuacuucuguaauaugggcgauuggcccuccugcacauauacgggagucacccagcacaaccaugccgcuuuugccaaccugcugaauaucgagacagacuacaccaaaacauuccacuuucacagcaagcgggugaccgcucauggcgauacgccucagcuugaccucaaagcccgccccagauauggggcgggagagauuacagugcuggucgaaguugccgauauggagcugcacaccaagaaaguggaagugaccggccucaaguucgcuucucugacauguuccgggugcuacgccuguagcucuggaaucuccugcaaaguccggauucauguggacgagccggaugagcuuaccguucacgucaagagcuccgacccugauaucguggcugccagcucuagccugauggcgagaaagauugaauuuggcguggacuccacauucaaagccuuuucuagcaugcccaaggauucccucuguuucuacaucguugagcgcgacuauugcaacucuuguaaaaaugaagagacgcaacggugcgugaacgcuaagcuggaacagccccagagcauccugauugagcauaccgggacaaucauuggcaaacaaaaugauaccuguggauccagaacaucuugcuggcuugacagcuucaaguccuuuuucuacggccucaagagcaugcucucugggaucuuuggaaacgucuuccugggcauuuuucucuuccuggccccuuuugcccuucugcuguucuuuuucuuuuucggguggcgcauccuguuuugcuucaaauguugcagacggacccgcggacuguucaaguauagacacaucaaagacgaugaggaagugggcuacaagaaaauuaucgagcggcuuaauaacaagaagggcaaacaccgccugcucgacggggaaagacuggccgaucggaagauugccgagcucuuuuccacgaaaacccauaucgga

SEQ ID NO: 13749 - RNA, 3495 nt, Artificial Sequence
  derived and/or modified CDS sequence (opt5) from CCHVF(CCHVF ArD8194)__DQ211626.1__Gn-NSm-Gc
gccgagggcgggagcaacgacugcguguccagaacccagcuggucaagacagaaguugcugagauccacgaagauucuuacggaggccccggggagaaaauuacgaucuguaauggaagcaccauuguggaccaacggcucggcuccgaacuggggugcuauacaaucaaccgcgugagaaccuacaagcugugugaaaauucugccacagagaaaagcugcgagauugauuccgucccugugaaguguaaacagggauucugccuuaagaucacccaggagggccggggccauguuaagcucucucgcgggacagaaaucgugcuggacgucugugauaccagcugcgagcuuaugauuccgaaaggaacgggcgacauccugguggauuguuccgggggacagcaacacuuucuccaggacaaccugauugaucugggcugccccaauaucccucuccuggggagaaccgcgauuuauguuugucggaugagcaaccaucccaagacaaccauggcuuuccuguuuugguucucuuuuggauacgugaucacaugcgucgugugcaaagugcuuuucuaucuccugauugucaucggcacccuuggcaagcgccugaaacaguacagagagcucaagccucagacguguaucguuugcgaauccauucccgugaaugccaucgacgccgagaugcacgaucugaacuguaauuauaacauuugcccuuacugugcuagccggcugacaucugacgggcucgugcgccaugucacccaaugcccgaagagaaaagaaaagguggaggaaacagagcuguaccuuaaucuggagcggauccccuggcucguucgcaaacugcuucagguguccgaaagcaccggagucgcccugaagagaucuuguuggaugauuacccuccugauccugcucacaguguccaugagcccuguucaguccgcucccgugggccacaaacgggccgucgagguguaucagaugcgcgaaucuuacacggggaucugccuguuuguccuuggaagcgugcuguucgcgguuuccuggcucgugaaggcccugauugauagcaucggcaacuccuuuuucccugggcuuucuauuuguaaaaccugcagcaucggaucuauuaauggcuuugagaucgaaagccacaaguguuauugcucccuguucugcugucccuacugcagagcuuguucuagcgacaagaucacacaucggaugcaccucaacgucugcaaaaagagaaaagugggcuccaauguuaugcuggccguguguaagcgcaugugcuuuaaagcuaccauugaggccagcaaccgggcgacauucaucagaaacauuaucaauucuaccuucgucauuuguauccugauucucgugaucugcgugguuuccacgagcgccgucgacauggagaaccugccggcugggaucugggaaaaggaggaagaucuuacaaauuuuugucaucaagagugccaggugaccgaaaccgagugucugugcccuuaugaggcccucaugcugcgcaagccccuguuccuugaccggauugcuaaaggaaugaagucucuccugaacuccacaagccuggaaaccucccucucuaucgaggccccuuggggcgccauuaaugugcagagcacauuuaaacccacggucuccgcugcgaacaucgcccugucuuggagcuccguggaacacaaggggaauaaaauucuuguuagcggaagaucugaguccaucaugaagcuggaggaacgcaccggcaucagcuggugccucgggguggaggaugcuucugaauccaagacacugaccgucagcgugauggaccugucucaaauguacagccccguuuucgaguaucuuuccggcgauagacagguggaagaguggccuaaagccacauguaccggagacugcccggagcgguguggcugcacgagcucuaccugucuccacaaggaauggccccauucccgcaacuggcggugcaauccuacaugguguuggggagucgggaccggcugcacauguugcgggcuggaugugaaagaccuguuuaccgauuacaugcucguuaaguggaaaguggaguacauuaagacggaagccaucauuugugucgagcugacaagccaggaaagacagugcucccuuaucgaggcuggaacccgcuucaaccugggccccgugacaauuacccucucugagccucggaaugugcaacagagacugcccccggaaaucaucacccugcacccuaagauugaggaaggguuuuucgaccuuaugcauguccagaaaguuaugagcgccuccacagugugcaagcuccagucuuguacgcacggcgugcccggagaucugcaagucuaucaugugggcaaccugcucaaaggggacaagguuaauggacacagcauccacaaaauugagucccaucugaacaccucuuggaugagcugggacggcugcgaucuugacuacuuuuguaauaugggggauuggccuuccugcacauauaccggagugacacagcacaaccaugcggcuuucaucaacaugcugaauauugaaaccgacuacacgaagacauuucacuuccacagcaaacgggucaccgcccauggcgauacaccccagcucgaccugaaggcccgcccugcuuauggggccggcgagaucaccgugcugguugagguggcugaucuugaacuccacaccaagaaaaucgaggucucuggacugaaguuugccucccugagcuguucuggcugcuacgcguguuccagcgggauuucuugcaaagugagaauccauguuaacgaacccgacgaguucacagugcacgucaaguccaaugauccggacgugguggccgcuggaagcucccucauggcccggaaaauugagagcggcgcugauucuacguucaaggccuuuagcuccaugccuaagaacucucuguguuucuauaucgucgaaagagacuacugcagcuccuguaccgaugacgacacacagaaaugcguugauauuaaacuugagcauccccaaucuauccugauugaacacaaggggaccaucaucggaaagcagaaugacacaugccccaccaaaacgagcuguuggcucgaguccauuaagagcuuuuucuacggccugaagaacaugcugucugggaucuuuggcaauguguuccuuggaaugcugcucuuucuggcgccuuucauucuccugauccuguuuuucuuuuucggcuggcgccuucucuuuugccugaaauguugccggagaacccgcaagcugcuuaaauauaagcaccugagagaugaagaggaguccggguacaaaaagauuaucgaacggcucaacgacaagaaaggaaagagccgccuguucgauggcgagagacucgccgaccggaaaaucgcugaacuguucucuacaaagacccauauuggg

SEQ ID NO: 13750 - RNA, 3495 nt, Artificial Sequence
  derived and/or modified CDS sequence (opt5) from CCHVF(CCHVF ArD15786)__DQ211627.1__Gn-NSm-Gc
gccgagggcgggagcaacgacugcguguccagaacccagcuggucaagacagaaguuacggagauccacgaagauucuuacggaggccccggggagaaaauuaccaucuguaauggaagcacaauuguggaccaacggcucggcuccgaacuggggugcuauaccaucaaccgcgugagaacauacaagcucugugaaaauucugcuaccgagaaaagcugcgagauugauuccgucccugugaaguguaaacagggauucugccugaagaucacacaggagggccggggccauguuaagcucucucgcgggaccgaaaucgugcuggacgucugugauacgagcugcgagcuuaugauuccgaaaggaaccggcgacauccugguggauuguuccgggggacagcaacacuuucuccaggacaaccugauugaucugggcugccccaauaucccucuccuggggcagacagccauuuauguuuguagaaugagcaaccaucccaagaccacaauggcguuccuguuuugguucucuuuuggauacgugauuaccugcgucgugugcaaagugcuguucuaucuccugaucgucaucggcacgcuuggcaagcggcugaaacaguaccgcgagcucaagccucaaacauguaucguuugcgaauccauucccgugaaugcuaucgacgccgagaugcacgaucugaacuguaauuauaacauuugcccuuacugugccagcagacugaccucugacgggcucgugcggcaugucacacagugcccgaagcgcaaagaaaagguggaggaaaccgagcuguaccuuaaucuggagagaauccccuggcucguucggaaacugcuucagguguccgaaagcaccggagucgcucugaagcgcucuuguuggauuaucacacuccugauccugcucacgguguccaugagcccuguucaguccgcccccgugggccacaaaagagcugucgagguguaucaaauucgggaaucuuacaccgggaucugccuguuuguccuuggaggcgugcuguucgccguuagcuggcucgugaaggcgcugauugauuccaucgggaacagcuuuuucccuggacuuucuauuuguaaaacaugcuccaucggcagcaucaauggcuuugagauugaaucucacaaguguuauugcagccugcucugcugucccuacugccgcgccuguuccucugacaagaucacccauagaaugcaccugaacgucugcaaaaagcggaaaguggggagcaauguuaugcuggcuguguguaagagaaugugcuucaaagccacaauugaggcuaacaaccgcgccaccuuuauccggaauauuaucaacuccacguucgucauuuguauccucauccuggugauuugcgugguuagcacaucugcggucgacauggagaaucuuccggccggaaucugggaaaaggaggaagaucugaccaacuucugucaucaggagugccaggugaccgaaacagagugucucugcccuuaugaggcucugaugcugagaaagccccuuucccucgacagcauugccaaaggcaugaagucucugcuuaauuccaccagccucgaaacaucccugucuaucgaggcuccuuggggagccauuaacgugcaaagcacguuuaaacccaccaucuccgccgcuaauaucgcgcuuucuuggagcuccgucgaacacaaggggaacaaaauucuggugagcggccgcucugaguccaucaugaagcucgaggaacggacagggauuagcuggugccugggcguugaggaugccucugaauccaagacccugacagugagcgucauggaccuuucucagauguacagccccguguucgaguaucucuccggagauagacagguugaagaguggccuaaagcuaccuguacgggcgacugcccggagcgcugugggugcaccagcucuacaugucugcacaaggaauggccccauucccggaauuggagaugcaacccuaccugguguuggggagugggcacagggugcaccuguugcggacuggaugucaaagaccucuuuacggauuacaugcuggugaaguggaaaguugaguacaucaagacagaagccauuaucuguguggagcuuaccagccaggaacgccaaugcucccugaucgaggccggcacacgguucaaucucgggcccgucaccauuacccugucugagccuagaaacgugcagcagcgccugcccccggaaaucauuacacuucacccuaagaucgaggaaggcuuuuucgaccucaugcaugugcagaaagucaugagcgcuuccacgguuugcaagcugcaaucuuguacccacggagugcccggcgaucuucagguguaucaugucgggaaucuccugaaaggagacaaggugaacggccacagcauucacaaaaucgagucccaucuuaauacaucuuggaugagcugggacgggugcgaucuggacuacuuuuguaacaugggagauuggccuuccugcaccuauacaggcguuacccagcacaaccgggccgcguucaucaauaugcucaacauugaaacggacuacacaaagaccuuucauuuccacagcaaaagagugaccgcucacggggauacaccccagcuggaccugaaggcccggccuaccuauggcgccggagagaucacaguccuuguggagguugcugaucucgaacugcauacgaagaaaauugaggugucuggccugaaguuugccucccucaccuguagcgggugcuacgcuuguucuuccggaaucagcugcaaaguccgcauucacgugaaugaacccgacgaguucacaguucaugugaagucuaacgauccggacgucguggccgcgggcuccagccugauggccagaaaaaucgaguccggggcugauagcaccuuuaaggccuucucuagcaugccuaaaaauucccuuuguuucuauauuguggaacgggacuacugcucuagcuguacagaugacgacacccaaaagugcgucgauaucaagcuggagcacccccaguccauccucauugaacauaaaggaacgaucauuggcaagcagaacgauaccugccccacaaaaaccucuuguuggcuggagagcaucaaguccuuuuucuacgggcugaagaauaugcuuucuggcauuuuuggaaacaucuuccugggcaugcuccuguuucucgcuccuuucguucugcuuauccuguuuuucuuuuucggguggagacuccuguuuugccugaaauguugccgccggacaagaaagcugcugaaauauaagcaccuccgcgacgaagaggagagcggauacaaaaagauuaucgaaagacugaaugacaagaaaggcaagucccggcuuuucgauggggagcgccuggccgacagaaaaauugcggaacuuuuuagcaccaagacacacguggga

SEQ ID NO: 13751 - RNA, 3495 nt, Artificial Sequence
  derived and/or modified CDS sequence (opt5) from CCHVF(CCHVF ArD39554)__DQ211628.1__Gn-NSm-Gc
agcgaguccaacaauaacgacugcgugucuagaacccagcugaucaagacagaaaaugccgagauucacggcgaugacuacgggggacccggcgagaaaaucacgauuuguaacgggagcaccaucgucgagcaacggcucggauccgaacugggcugcuauacaauuaaucgcaucaagucuuucaaacuuugugagaacagcgcuuccgggaagggaugcgagaucgauucuaccccuguuaaauguaagcagggcuuuugccugaagauuacacaggaaggcagagggcaugugaaacucagccggggauccgagaucauucuggacgugugugauagcucuugcgaaaugaugaucccgaagggcuccggggacauucuugucgauuguagcggaggccagcaacacuuccugcaggacaaucucguggaucuggggugccccaacguuccucugcucggaaaaauggccaucuacauuugucgcaugucuaaucaucccaagaccacaauggcguuucuguucugguuuuccuucggcuaugugauuaccugcaucuuuugcaaagucaucuucuacgugcuuaucauuaucggcacgcuggggaagagaauuaagcaguaucgggagcucaaaccucagaccuguacaaucugcgaggcuacccccguuaacgccaucgacgccgaaaugcacgaucugaauuguagcuacaacauuugcccuuauugugcuucucgccuuacauccgagggacuggugagacaugucacccaaugcccgaagcggaaagaaaagaucgaggaaacggagcucuaccugaaucuggagcgcauucccugguuugugagaaaacuccuucaggugagcgaauccacaggcgucgcccugaagcggucuagcuggcugguuacccuccuggugcuucugacagugucccucagcccuguccagucugcucccaucgggcaggagcgcaccgugguuaccuaccaagugagagaauccuauacaggaaugugucuguucauucugggcagcguccucuuugccaucucuuggcugacgaaagggcuuguggacagcguuggaaacaucuucuuuccuggccuguccgugugcaagaccuguucuauuggcagcaucaauggguucgagauugaaucccacaagugcuacuguagccucuucugcugccccuauugucgguacugcucugcggaucgcggagcccaccagucccaucugagcgucuguaaaaagagaaaaacaggcucuaacgugaugcuugcugucugcaagcggauguguuuuagagccacccugaaaguguccagcgaggcucucaucauucgcuccaucauuaacacaaccuucguugugugcauccugauccuggucguguguguugugucuacgagcgccgucgagauggaaaaucucccggcggggacaugggagaaggaagaggaccugaccaacuuuugccaccaggaaugucaagugaccgagacagagugccuuuguccuuaugaagccuucgugcugcggaagccccucuuucuggacuccaccgcuaaaucuaugaagucccugcuuaauuccacaagccucgagacgucucuguccauugaagccccuuggggagcuaucaacguucagagcaccuucaaacccacagccucuaccgccaauauugcucuguccuggagcucugucgagcauagaggcaacaagauccucgugacagggcgcagcgaguccauuaugaaacuggaagaacggaccggcaucagcuggaaucuuggaguggaagaugcgucugaguccaagacgcugaccgucagcgugauggaccucucccagauguacucuacaguuuuugaauaucugagcggcgauagacagguggaggaguggcccaaggcuaccugcacaggggacugcccugaacgcuguggaugcaccuccucuacgugucugcacaaagccuggccgcacagccggaacuggagaugcaaucccacaugguguuggggcgucgggaccggaugcacauguugcggccuugaugugaagaaccucuucaccgacuacaugcugaucaaauggaagguugaguuuauuaaaaccgaagccaucgugugugucgagcugacaucccaagaacgccagugcucucucauugaggccgggacgcgguucaaucugggcccugugaccaucacacuuagcgagcccagaaacauucagcagaagcugccucccgaacucguuacccugcauccgcgcguggaggaaggauuuuucgaucugaugcacguccaaaaggugcuuuccgcuagcacaguguguaaacuccagucuugcacccauggcgucccuggggaccugcagguuuaccacgugggaaaucugcucaagggcgauaaaaucaacgggaauagcuuucauaagaucgagcccaaccugaacacgagcuggaugucuugggacggaugcgaucuugacuauuacuguaauaugggcgacuggccuuccugcacauauaccggggugacccagcacaaccacgccgcguucgucaaucugcucaacauugaaacagauuacaccaaaaauuuccauuuucacagcaagcgggugacagcucauggcgagacgccccaacuggaccugaaagccagaccuaaguauggagccggcgagguuaccgugcuugucgaaguggcugauauggagcuccacacaaagaaaaucgaaauuucugggcugaaguucgccucccugaccuguacaggaugcuacgcuuguagcuccggcaucagcugcaaaguucggcuccacguggacgagcccgaugagcugaccguccaugugaagucugacgauccggacguuguggccgcgagcuccucucuuauggcccgcaaaauugaauuugggacggauagcaccuucaaggcuuuuuccucuaugccuaaggacaaacuguguuucuauaucgucgagagagauuacugcagcuccuguucuaaggaagacacacagaaaugcgugaacgccaagcucgagcagccccagagcauccugauugaacacaaaggaaccaucauuggcaagcaaaaugauacauguaccgugaaggcuuccugcuggcuggagagcgucaaauccuuuuucuacgggcuuaagaacaugcugggcggaaucuuuggcaauguuauucucgggaucauuauguuccuggcccccuuugcgcuccugcuucuguucuuucucuucggauggcggauccuguucugccugagauguugccgccggacaagaggccuuuuuaaauauaagcauaucaaagacgacgaggaaucuggguacaagcgcauuaucgagagacugaacaauaagaaaggaaagaacaaacucuucgauggcgaacggcuggccgacaagaaaauugcugagcucuuuagcaccaagacgcacaucggc

SEQ ID NO: 13752 - RNA, 3495 nt, Artificial Sequence
  derived and/or modified CDS sequence (opt5) from CCHVF(CCHVF C-68031)__DQ211629.1__Gn-NSm-Gc
agcgaggaauccggcgacgauugcaucucuagaacccagcugagccggacagagacggccgaaauucacuccgacaacuacgggggacccggcgauaagaucaccauuuguaaugggucuacaaucguggaccaacgccucggaagcgagcugggcugcuauaccauuaacagagucaaauccuucaaacuuugugaaaauucugcuacagggaaaagcugcgagaucgauuccaccccuaucaagugucggcagggauuuugccugaaaauuacacaggagggccgcggccauguuaagcucagcagagggucugaaguggugcuggacgccugugauuccagcugcgagaucaugauuccgaagggaaccggcgacauccuugucgauuguucugggggacagcaacacuuccugaaagacaaccucauugaucugggcugccccaauaucccucugcucgggaagauggcgauuuacaucugucggauguccaaccaucccaaaacgaccauggcuuuucuguucugguuuagcuucggauaugugaucacaugcauucuuugcaagguuaucuuuuaccugcucauuguggucggcacccugggcaaaaaguucaagcaguaucgcgaacuuaaaccucagacauguaccaucugcgagacgacacccgugaaugccauugacgccgagaugcacgaucugaacuguucuuacaauaucugcccuuauugugcuuccagacucaccagcgacgggcuggcccggcauguuaugcagugcccgaagcgcaaagaaaagguggaggaaacagagcuguaccucaaccuggaaagaauccccugggucgugcggaaacuucugcaaguguccgagucuaccggagucgcucucaagcgcagcuccuggcugguugugcuucuggugcuccugaccgucagccugucuccugugcaguccgcccccauuggccacgggaaaacaguugagacguaccagaccagagaaggauauacaagcaucugucucuuugugcugggcucuauucuuuucaucgucagcugccugaugaaggggcucguggacuccguuggaaauagcuuuuucccuggccugucuauuuguaagaccugcuccaucggcagcaucaacggguuugagacagaaucucacaaauguuacugcucccuuuucugcugucccuauugccggcauuguagcgcggaucgcgagauucacaagcugcaucucucuaucugcaaaaagagaaaaaccggauccaaugugaugcuggccgucuguaagcggaugugcuucagagcuacgguggaagucagcaacaaggcccugcucauucgcaauaucauuaacacaaccuuugugguuuguauccugauucuugcugugugcgucguguccaccucugccguugagauggagagccugccggcgggcacaugggaacgggaggaagaccucaccaacuucugucaccaggagugccaagugacagaaacggagugucugugcccuuacgaggcccugguccuuagaaaaccccucuuuuccgauucuaucgugaaggggaugaaaaaucugcugaacagcaccucccucgaaacaagccugucuaucgaggcuccuuggggagccauuaaugugcaguccaccuucaagcccacaguuagcgcugccaacaucgcccuuucuugguccagcgucgaacaccgcggcaauaaaauucuggugucugggcggagcgaguccaucaugaagcucgaggaaagaaccggcauuagcugggaccugggaguggaggaugcuucugaauccaagcugcuuacggucagcaucauggaccucucccagauguauucucccguguuugaguaccugagcggcgaucgccaaguugaagaguggccuaaagcgaccugcacaggggacuguccggagcggugcggauguaccuccucuacaugccugcauaaggaauggccccacagcagaaacuggcgcuguaauccuaccuggugcuggggcguggggacgggauguacaugcuguggccucgaugucaaagaccuguucaccgauuauauguuugugaaguggaaaguugaguacaucaagacagaagccauugugugcgucgagcuuaccucccaggaacggcaguguucucugaucgaggcugggaccagauucaaccucggccccgugacaauuacgcugagcgagccucgcaauauccagcaaaagcugcccccggaaauuguuacccuucauccucggaucgaggaaggauuuuucgaccucaugcacgugaaaaagguccuguccgccagcacagugugcaaacugcagucuugcacccauggcgugcccggggaccuccaggucuaccacaucggaaaccugcuuaagggcgauaaaguuaaugggcaccugauucauaagaucgagccucacuuuaacacauccuggaugagcugggacggaugugaucucgacuauuacugcaauaugggcgauuggcccucuuguuccuauaccggggugacgcagcauaaccacgccgcuuucgugaauaugcugaacauugaaacagacuacaccaaaaucuuucacuuccauagcaagagagucaccgcccacggcgauacaccucaacuggaccuuaaggcgcggcccaccuauggagcuggcgagauuacagugcucguugagguggccgauauggaacugcauacgaaaaagaucgagaucucugggcugaaauucgccucccugaccugcacaggauguuacgcuugcagcuccggcauuagcuguaagguccgcauccacguggacgaaccggaugagcucaccguucaugugaaaucugaggacccugauauugucgccgcuagcuccucucuuauggccagaaagcuggaauuugggacagacagcaccuucaaggcguuuuccgccaugcccaaaacgucucucugcuucuauaucguggagcgggaauacuguaagagcugcuccaaagaggacacccagaaguguguuaacacaaaacuggaacagccccagucuauucugaucgagcacaagggaaccauuaucggcaagcaaaaugauacaugcaccagcaaagcugggugcuggcuugaguccgucaagagcuuuuucuacggccugaaaaacaugcucucuggaaucuuuggcaauguguucauugggaucuuucuguuccucgccccuuuuauucugcuuauccuguucuuuauguucggauggcgcauucucuucuguuuuaagugcuguagacggacaagaggccuguucaaauaucgccaccugaaggacgaugaagagaccggguacagaaagaucaucgaacggcuuaacaauaaaaagggaaagaacaagcugcucgacggcgagcgccuggcugauagaaaaauugccgaacucuuuuccacgaagacacauaucggc

SEQ ID NO: 13753 - RNA, 3495 nt, Artificial Sequence
  derived and/or modified CDS sequence (opt5) from CCHVF(CCHVF Drosdov)__DQ211630.1__Gn-NSm-Gc
agcgaggaacccggcgacgauugcaucuccagaacccagcugcucaagacagagacggccgaaauucacgacgauaacuacgggggaccuggcgacaaaaucaccauuuguaaugggucuacaaucguggaucaacggcugggaagcgagcuuggcugcuauaccauuaaccgcgucaaguccuucaaacugugugaaaauucugcuacagggaagaccugcgagaucgacagcacaccgguuaaauguagacagggauuuugccucaagaucacccaggagggccggggccaugugaagcugucccgcgggucugaagugguccuugaugccugugacagcuccugcgaggugaugauucccaaaggaacgggcgauauccugguugacuguagcgggggacagcaacacuuccucaaggauaaccugauugaccugggcugcccucauaucccccuccuggggaaaauggcgauuuacaucuguagaaugucuaaucacccucggaccacaauggcuuuucuuuucugguuuuccuucggauaugugauuaccugcaucuuuugcaaggcccuguucuacagccucaucauuaucggcacacugggcaaaaagauuaagcaguaucgcgaacuuaaaccccagaccuguacgaucugcgagacagccccugucaacgcuauugaugccgagaugcaugaccugaaguguucuuacaauaucugcccguauugugcuuccagacucaccagcgacgggcuggcccggcacgugacacagugccccaaacgcaaggaaaaaguugaggaaaccgagcuguaccucaaccuggaaagaaucccuuggauugugcggaaacuucugcaagucucugaguccaccggaguggcgcucaagcgcagcuccuggcugaucgugcuucugguccuccugacaguuucucugagccccgugcaguccgccccugugggccacgggaagacgauugagaccuaccagacaagagaaggauuuaccagcaucugucucuucaugcugggcucuauucuuuuuaucgucuccugccuggugaaggggcucguugauagcgugucugacagcuucuuucccggacuguccgucuguaaaacaugcucuaucggcagcauuaauggcuucgagaucgaaucccauaaguguuauugcagccuuuucugcuguccguacugccggcacuauucugcugaucgcgagauucaucagcugcaccucuccaucuguaaaaagagaaaaaccgggagcaacgugaugcuggccguuugcaagcggauguguuuuaaggcuacgauugaagccucuagacgcgcgcugcucauccgguccauuaucaauacaaccuucgugaucugcauucugauccuugccauuugugucgugagcaccuccgcugucgagauggagaaccugccugccggaacaugggaaagagaggaagaccucaccaauuuuugccaccaagagugucaggugacagaaacggagugccugugucccuacgaggcucugguucuucgcaaaccucucuuccuggauucuaccgugaagggcaugaaaaaccugcucaauagcacaucccuggaaaccucucuuagcaucgaggcccccuggggagccauuaacguccaguccacauuuaagcccaccgugagcacggcuaacaucgcgcugucuugguccagcguugaacaucggggaaauaaaauccucgugaccggcagaucugaguccauuaugaagcuggaggaacgcacaggggucagcugggaccugggcguggaggaugccucugaaagcaaacuucucaccguguccaucauggaccugagccaaauguauucuccuguuuucgaguaccuguccggagaucggcaggucgaagaguggccgaaggcuacaugcaccggcgacugccccgagagaugugggugcacgagcuccacaugucuccacaaggaauggccucauucucgcaacuggcggugcaaucccaccugguguuggggagugggcacagggugcaccuguugcggaguggaugucaaagaccuguuuaccgaccacauguucgugaaguggaaaguugaguauaugaagacagaagccauugugugugucgagcuuacgagccaggaaagacagugcucccugaucgaggccggcacccgcuuuaaccucgggccugugacaauuacccugucugagccccggaauauccaacagaagcugccgccugaaaucauuacacuucaucccaaaaucgaggaaggcuucuuugaucucaugcacguucagaaggugcugagcgcuuccaccgucuguaaacugcagucuugcacgcacgggauuccuggcgaccuccaaaucuaccauauugggaaccugcuuaagggagauagagugaauggccaccugauccauaaaaucgagccccacuucaacacaagcuggauguccugggacgggugcgaucucgacuacuauuguaauaugggaaacuggccuagcugcaccuacaccggcguuacacagcacaaucaugccgcguuugugaaccugcugaauauugaaaccgauuauacaaagacguuccacuuccauucuaaacgggucaccgcucacggggacacaccccagcuugaucucaaggcccgcccgaccuacggcgccggagagaucacagugcugguggaggucgcugacauggaacugcauaccaagaaaguugagauuuccggccucaaguuugccagccugguguguacggggugcuaugcuuguucuuccggaaucagcugcaaagugcggauucacgucgaugaaccugacgagcuuaccgugcacguuaagucuuccgaucccgacguggucgccgcgagcacaucccugauggccagaaaacucgaguucggcaccgacagcaucuuuaaggcuuucucugccaugcccaagacaagccuguguuuuuacauuguggaaagagaguauugcaaauccuguucugaagaugacaccaagaaaugcguugauacaaagcuggagcagccucaaagcauccuuaucgaacauaaagggaccauuaucggaaagcagaacgacacguguacagcuaaggccuccugcuggcuggagucugugaaauccuucuuuuacggccucaagaauaugcuggggagcgucuucggcaacuuuuucgugggcauucuccuguuucuugcgccguucguucugcucgugcuguuuuucauguucggauggaaaauccuguuuugcuucaaguguugccgccggaccagagggcuuuuuaaauaccgccaccugaaggaugacgaggaaaccggauauagacggauuaucgagcgccucaacucuaagaaaggcaagaauagacugcucgauggggaacggcuggccgaccgcaaaaucgcugagcuuuucagcacaaagacccauauugga

SEQ ID NO: 13754 - RNA, 3495 nt, Artificial Sequence
  derived and/or modified CDS sequence (opt5) from CCHVF(CCHVF Kashmanov)__DQ211631.1__Gn-NSm-Gc
agcgaggaacccggcgacgauugcaucuccagaacccagcugcuccggacagagacggccgaaauucacgacgauaacuacgggggaccuggcgacaagaucaccauuuguaaugggucuacaaucguggaucaacgccugggaagcgagcuuggcugcuauaccauuaacagagucaaauccuucaagcugugugaaaauucugcuacagggaaaaccugcgagaucgacagcacaccgguuaagugucggcagggauuuugccucaaaaucacccaggagggccgcggccaugugaagcuguccagagggucugaagugguccuugaugccugugacagcuccugcgaggugaugauucccaagggaacgggcgauauccugguugacuguagcgggggacagcaacacuuccucaaagauaaccugauugaccugggcugcccucauaucccccuccuggggaagauggcgauuuacaucugucggaugucuaaucacccucgcaccacaauggcuuuucuuuucugguuuuccuucggauaugugauuaccugcaucuuuugcaaagcccuguucuacagccucaucauuaucggcacacugggcaagaaaauuaagcaguauagagaacuuaagccccagaccuguacgaucugcgagacagccccugucaacgcuauugaugccgagaugcaugaccugaauuguucuuacaacaucugcccguauugugcuucccggcucaccagcgacgggcuggcccgccacgugccccagugcccuaaaagaaaggaaaaaguugaggaaacagagcuguaccucaaucuggaacggauccccuggauugugcgcaaacuucugcaagucucugaguccaccggaguggcgcucaaaagaagcuccuggcugaucgugcuucugguccuccugaccguuucucugagcccugugcaguccgcccccgugggccacgggaagacaauugagacguaccagacccgggaaggauuuacaagcaucugucucuucaugcugggcucuauucuuuuucuggucuccugccucgugaaagggcugguugauagcgugucugacagcuucuuuccgggacuuuccgucuguaagaccugcacaaucggcucuaucaacggcuucgagauugaaagccauaaguguuauugcucccuguucugcuguccuuacugccgccacuguagcgcugauagagagauccaucagcuccaccugucuauuugcaaaaagcggaaaaccggguccaaugugaugcuggccguuuguaagagaaugugcuuucgcgcuacgaucgaagccagccggagagcgcuccugauucgcucuaucauuaacacaaccuucgugaucuguauccuuacccugacaauuugcgucguguccaccagcgccgucgagauggagaaucuccccuccggaacaugggaacgggaggaagaccugacgaacuuuugucaccaagagugccaggugaccgaaacagagugucugugcccuuaugaggcucuuguucucagaaaaccccuguuccuggauucuaucgugaagggcaugaagaauagccucaacuccaccucucuggaaacaagccuuuccauugaggcccccuggggagcuaucaacguccagagcaccuuuaaaccuacggugucuaccgccaauauugcccuguccuggagcucuguugaacaucgcgggaacaagauccucgugacaggccgguccgagagcaucaugaaacuggaggaaagaaccggggucucuugggaccugggcguggaggaugcuagcgaauccaaacuucucacagugagcauuauggaccugucucaaauguacuccccgguuuucgaguaucugagcggagaucgccaggucgaagaguggcccaaggcgaccugcacgggcgacuguccugagcggugcggguguacauccucuaccugccuccacaaggaauggccccauagcagaaauuggcgcuguaacccuacauggugcuggggagugggcaccggguguaccugcuguggaguggaugucaaggaccuguuuacagaccacauguucgugaaauggaagguugaguacaucaaaacggaagccauugugugcgucgagcuuaccucccaggaacggcaguguucucugaucgaggcuggcacaagauuuaaucucgggcccgugaccauuacacugagcgagccgcggaacauccaacagaagcugccucccgaaaucauuacccuucauccuaaaguugaggaaggcuucuuugaucucaugcacgugcagaagguccuguccgccucuacggugugcaagcugcagagcugcacacacggaauccccggcgaccuccaaguuuaucauauugggaaucugcuuaaaggagaucgcaucaacggccaccugauucauaagaucgagccucacuucaauaccuccuggaugagcugggacgggugugaucucgacuacuacugcaacaugggagauuggcccucuuguaccuauacaggcgugacccagcacaaucaugccgcuuuugucaaccugcugaauaucgaaacagacuacacgaaaaccuuccacuuccauuccaagagagugacagcccacggggauaccccgcagcuugaccucaaagcgcggccuacauauggcgcuggagagauuaccgugcuggucgagguugccgauauggaacugcauacgaagaaaguggagaucagcggccucaaguuugccucucuggcuugcaccggguguuacgccugcuccagcggaauuucuuguaaggugagaauccacgucgacgaacccgaugagcuuacagugcacguuaaauccagcgaccccgacguggucgcugccuccaccagccugauggcgcgcaagcucgaguucggcacagauucuaccuuuaaagccuucagcgcuaugccuaagacaucccugugcuuuuauauuguggaacgggaguacuguaaaucuugcagcgaagaggacacccagaaguguguugauacgaagcuggaacaaccgcaguccauccuuauugagcauaaagggacaaucaucggaaagcagaacgauaccugcaccgccaaggcuucuugcuggcuggagagcgugaaguccuucuuuuauggccucaaaaauaugcuggggucugucuucggcaacuuuuucauuggaauccuccuguuucuugcccccuucgugcugcucguucuguuuuucauguucggcuggaagauucuguuuuguuucaagugcuguagacgcacaagagggcuucugaaauaccggcaccucaaggacgacgaagagaccggauaccgcagaaucauugaacggcugaacaauaaaaagggcaaaaaccgccuccuggauggggagagacuugcggaccggaagaucgccgaacuguuuagcacgaagacacauaucgga

SEQ ID NO: 13755 - RNA, 3495 nt, Artificial Sequence
  derived and/or modified CDS sequence (opt5) from CCHVF(CCHVF Oman)__DQ211632.1__Gn-NSm-Gc
agcgaggaauccggcgaggacugcaucucuagaacccagcugcuccggacagaaacggccgagauucacggggauaacuacggaggccccggggacaagaucaccauuuguaauggaagcacaaucguggaucaacgccugggcuccgaacuugggugcuauaccauuaacagagucaaaucuuucaagcugugugagaauagcgcuacaggaaaauccugcgagaucgacaacaccccuguuaaguguaaacagggcuuuugccucaagaucacacaggaaggccgggggcaugugaagcugucucgcgauagcgaggugguccuugacgccugugauuccagcugcgaaauuaugaucccgaaaggaaccggcgacauucugguggauuguucugggggacagcaacacuuccucaaggacaaucugaucgaucugggcugccccaacauuccucuccuggggaaaauggcgaucuacauuuguagaauguccaaucaucccaagacgaccauggcuuuucuuuucugguuuagcuucggauauguuaucacaugcauccugugcaaagugaucuuuuaccuccugauugucgugggcacccuuggcaagaaguucaaacaguaucgggagcugaagccucagacauguaccauuugcgagacgacacccguuaacgccaucgacgccgaaaugcacgaucucaauuguucuuacaacauuugcccuuauugugcuucccgccugaccagcgacgggcuggccagacaugugaugcagugcccgaaacggaaggagaaaaucgaagagacagaacucuaccugaaucuugagcgcauccccugggucgugagaaagcugcuccaagugucugaguccaccggagucgcucugaaacggagcuccuggcuuauuguucugcucgugcugcugaccgugucucucagcccuguccaguccgcccccaucggccacgggaagacaauugaaacguaccagacccgcgagggauauacaagcaucugucuguuugugcuuggcucuauucuguucaucguuucccaccucaugaaggggcugguggacagcgucggaaacagcuuuuucccuggccuuucuaucugcaaaaccuguuccauuggcucuaucaauggguuugaaauugagagccauaagugcuucuguucccuguucugcugccccuacuguagacacugcagcgcggauaaagaaauccauaagcuccaccugucuauuuguaaaaagcggaaggccggauccaacgugaugcuggcuguuugcaaacgcauguguuuuagagccacaauggaggugagcaauaaggcucuccugauccggucugucauuaacaccacguucguggucugcauccuuauccuggccguguguguuguguccacaagcgcggucgagauggaaucccucccggccggcaccugggagagagaagaggaccugaccaacuuuugccaccaggaaugucaagugacagagaccgagugccuguguccuuaugaagcucuuguucuccgcaaaccccuguuccuggauucuauugccaaggggaugaaaaaucuccugaacagcacaucccuugagacgucucugagcaucgaagcuccuuggggagccauuaaugugcaguccaccuuuaagcccacagucagcaccgccaacaucgcucucucuugguccagcguggagcaucggggcaauaagauucuggugucugggagauccgagagcaucaugaaacuggaggaacgcacaggcaucucuugggaccuuggaguugaagaugcgagcgaguccaagcuccugaccgucagcgugauggaccugucucagauguacucccccguguucgaauaucucagcggcgaucggcaagucgaggaguggccuaaagccacgugcaccggggacugcccggaaagauguggaugcacauccucuaccugucugcacaaggaguggccccauagccgcaacuggcggugcaauccuacaugguguuggggcguggggaccggaugcacguguugcggccuugauguuaaagaccuguuuacagauuacauguucgugaaguggaaggucgaauauauuaaaaccgaggcuaucguguguguugaacucacaucccaggagagacagugcucucugauugaggccgggacccgcuuuaaccugggccccgugaccaucacacuuagcgaaccucggaauauucagcaaaagcucccgcccgagaucgucacgcugcacccuagaaucgaagagggauucuuugaccugaugcaugugcagaaaguucucuccgccucuaccguguguaagcugcagagcugcacacacggcguccccggggaccuucagguguaccacauuggaaaccugcucaaaggcgauaaggugaaugggcaucugauccacaaagucgaaccucauuucaacaccuccuggaugagcugggacggaugcgaucuggacuacuauuguaauaugggcgauuggcccucuugcacauacaccgggguuacgcaacacaaccacgcugccuuugugaaucuucucaacauugagacagacuauaccaagaacuuccauuuccacuccaagcgcgugaccgcgcauggcgauacaccucagcuggaccugaaagcucggcccaauuacggagccggcgaggucaccgugcucguugaaguggccgauauggagcugcacacaaagaaaaucgaaauuagcgggcuuaaguuugcuucucugacguguaccggaugcuaugccuguuccagcggcaucucuugcaaagucagaauccauguggacgagccggaugagcucacaguucacgugaaguccgaagacccugauauugucgcugccagcuccagccugauggcgcggaagcuggaguucgggaccgacucuacauuuaaagccuucagcgcuaugcccaagaccucccuuuguuuuuacaucguggaacgcgaguauugcaaaucuuguagcaaggaagacacgcagaaaugcguuaacgccaagcuggagagaccccaguccauucucaucgagcacaagggaaccauuaucggcaaacaaaaugauacauguaccgcuaaggccucuugcuggcuggaaagcgugaaauccuucuuuuacgggcucaagaacaugcugucuggcauuuucggaaaugucuuuaucggcaucuuccuuuuucuggcgccuuucauucuccugauccuguuuuucauguucggguggcggauucuguuuugcuucaaauguugcagacgcacacggggacuuuuuaaguacagacaucucaaggacgaugaggaaaccggcuaucgcaaaaucauugagagacugaacaauaagaaagggaagaacaaacuccuggacggagaacggcuugccgaucgcaagaucgcugagcuguucagcacaaaaacccacaucggc

SEQ ID NO: 13756 - RNA, 3495 nt, Artificial Sequence
  derived and/or modified CDS sequence (opt5) from CCHVF(CCHVF SPU97/85)__DQ211633.1__Gn-NSm-Gc
agcgaggaauccgacggcgauugcaucucuagaacccagcugcuccggacagagacggccgaaauucacagcgacaacuacgggggacccggcgauaagaucaccauuuguaauggguccacaaucguggaccaacgccugggaucugagcuuggcugcuauaccauuaacagagucaagagcuucaaacugugugaaaauuccgcuacagggaaaucuugcgagaucgauagcaccccuguuaagugucggcagggauuuugccucaaaaucacacaggagggccgcggccaugugaagcuguccagagggagcgaaauugugcuugacgccugugauucuuccugcgagaucaugauuccgaagggaaccggcgacauccuggucgauuguagcgggggacagcaacacuuccucaaagacaaccugauugaucugggcugccccaauaucccucuccuggggcggauggcgauuuacaucugucgcaugucuaaccaucccaagacgaccauggcuuuucuuuucugguuuuccuucggauaugugaucacaugcauucugugcaaaguuaucuuuuaccuccugauuguggccggcaccgucggcaagaaauucaagcaguauagagaacuucggccucagacauguaccaucugcgagacgacacccgugaaugccauugacgcugagaugcacgaucugaacuguagcuacaauaucugcccuuauugugccucucgccucaccuccgacgggcuggcuagacauguuaugcagugcccgaagcggaaagaaaagaucgaggaaacagagcuguaccucaaccuggaacgcauucccuggguggucagaaaacuucugcaagugagcgaguccaccggaguggcccucaagcggucuagcuggcugaccguccuucugguucuccugaucgugucccugagcccugugcagucugcgcccauuggccacgggaaaacaaucgagacguaccaggcccgcgaaggauauaccuccuuuugucucuucauucugggcagcauccuuuuuaucgucucuugccuggugaaggggcucauugacagcguuggaaauuccuucuuuccuggccugucuaucuguaaaacaugcagcauuggcuccgugaacggguucgagaucgaaagccacaaguguuacugcucucuuuucugcugucccuauugcagacauuguuccgcugaucgggagauucacaagcugcaucucagcaucugcaaaaagagaaaaaccggaucuaaugucaugcuggccguguguaagcgcaugugcuuucgggcuacaauugaaguuuccaacagagcccugcucauccgcagcaucauuaauaccacguucgcgguguguauccugacacuugccgucugcguggucuccaccucugcuguggagauggagagccugccggccggcaccugggaacgggaggaagaccucacaaacuuuugucaccaggagugccaaguuaccgaaacagagugucugugcccuuacgaggcucuggugcuuagaaaaccccucuuccuggauuccauugucaaggggaagaaaaaccugcucaauucuacgagccuggaaaccucccuuagcaucgaggccccuuggggagccauuaacgugcagucuacauuuaagcccaccguuuccgcugcgaauaucgcccugagcuggucuuccguggaacaccgcggcaacaaaauccucgucagcgggcggucugagagcauuaugaagcuggaggaaagaacaggcaucuccugggaccugggaguggaggaugcuagcgaaucuaaacuucucaccguguccguuauggaccugagccagauguauucccccgucuucgaguaccugucuggcgaucgccaaguggaagaguggccuaaggccacgugcaccggggacuguccggagcggugcggauguacaagcucuaccugccuccauaaggaauggccccacuccagaaauuggcgcuguaacccuacauggugcuggggcguggggaccggauguacgugcuguggccuggaugucaaagaccuuuuuacagauuauauguucgugaaguggaaaguugaguacauuaagaccgaagccaucgugugcgucgagcugacaagccaggaacggcaguguucccucauugaggcugggaccagauuuaaucugggccccgugaccaucacacugucugagccucggaacauccagcaaaaacuucccccggaaauuaucacgcuccauccucgcauugaggaaggauucuuugaccugaugcacguucagaaggugcugagcgccuccaccgucugcaagcuccagagcugcacacauggcgugcccggggaccugcagguuuaccacaucggaaaucuucugaaaggcgauaaggugaacgggcaccucauucauaaaaucgagccucacuucaauaccucuuggauguccugggacggaugugaucuggacuauuacugcaacaugggcgauuggcccagcuguacauauaccggggucacgcaacauaaucacgcggcuuuugugaaccugcuuaauaucgaaacagacuacaccaagaacuuccacuuccauucuaaaagagugaccgcccacggcgauacaccucagcucgaccugaaggcccggcccaccuauggagcuggcgaggucacaguucugguggagguggccgauauggaacuccauacgaaaaagauugagaucuccgggcugaaguuugcuagccuuucuugcaccggauguuacgccugcuccagcggcauuuccuguaaagucagaauccacguggacgaaccggaugagcugacaguucaugucaagagcgaggacccugauauuguggcggccgggucuagccucauggcucgcaaacuggaguucggagccgacuccaccuuuaaggcuuucucugccaugcccaaaacaagccugugcuuuuauaucguggaacgggaauacuguaaguccugcucuagagaggacacccagaaguguguuaacacgaaacuugaacgcccccagagcauucugaucgagcacaagggcaccaucauugggaaacaaaaugauacaugcaccgcgaaggccuccugcuggcucgagucugucaagagcuucuuuuacggccugaaauccaugcucagcggaaucuucggcaacguguuuauugggaucuuccuguuuauugcuccuuucgugcuucugauccucuuuuucauguucggauggagaauccuguuuuguuucaagugcugucggcgcacaagaggccuguuuaaauaucggcaccuuaaggacgaugaagagaccggguaccgcaaaauuaucgaaagacugaauaacaagaaaggaaagaauaagcuccuggacggcgagcggcucgccgaucgcaaaauugcugaacuguucucuacaaagucccauaucggc

SEQ ID NO: 13757 - RNA, 3495 nt, Artificial Sequence
  derived and/or modified CDS sequence (opt5) from CCHVF(CCHVF SPU103/87)__DQ211634.1__Gn-NSm-Gc
agcgaggaauccucugacgauugcaucagcagaacccagcugcuccggacagagacggccgaaauucacggcgacaacuacgggggacccggcgauaagaucaccauuuguaauggguccacaaucguggaccaacgccugggaucugagcuuggcugcuauaccauuaacagagucaaaacauucaagcugugugaaaauagcgcuaccgggaaauccugcgagaucgauucuguuccugugaagugucggcagggauacugccucaaaaucacacaggagggccgcggccaugugaagcugagcagaggguccgaagucgugcuugacgccugugauaccagcugcgagguuaugauuccgaagggaacgggcgacauccugguggauuguucugggggacagcaacacuuucucaaagacaaccugauugaucugggcugccccaagaucccucuccuggggaaaauggcgauuuauaucugucggauguccaaucaucccaagaccacaauggcuuuccucuuuugguucagcuuuggauacgucauuaccugcgugcugugcaaagccaucuucuaucuccugaucauuguuggcacacuuggcaagcgccugaagcaguacagagaacucaaaccucagaccuguacgaucugcgagacaacccccgugaacgccauugacgcugagaugcacgaucugaauuguucuuauaacaucugcccuuacugugccucccggcugacaagcgacgggcucgcucgccaugucacccagugcccgaagagaaaagaaaagguggaggaaaccgagcuguaccuuaaucuggaacggauucccugggugguccgcagacuccugcaaguuucugaguccacaggaguggcccuuaaacggagcuccuggcugaucgugcuccugguccuguuuacggugucucucagcccuguucaguccgcgcccaucagccacggcaagaccguggaggccuaucaggcucgcgaaggguacacaggaaugugucuguucguccuuggcucuauucuguuucucguguccugccugaugaaagggcuuguugacagcgugggaaacaccuucuuuccuggccugucuaucuguaagacaugcagcauuuccucuaucaauggcuucgagauugaaagccacagauguuauugcucccucuuuugcugucccuacugccggcauuguagcgccaacaaggagauccaccagcugcaucugucuaucugcaaaaagagaaaaaccggguccaaugucaugcucgcuguguguaagcgcaugugcuuccgggccacgauggaagucagcaacagagcgcuguucauucgcucuaucauuaauacaaccuuugugcuuuguauccugauucucgccguuugcguggucuccaccagcgcuguggagauggagucccugccggccggaacaugggaacgggaggaagaucugaccaacuucugucaccaagagugccagguuacagacacggaaugucuuugcccuuaugaggcucucgugcugagacgcccccuguuucucgauaacaucgucaaaggcaugaagaaucugcuuaacucuaccagccuggagacaucccucucuauugaagccccuuggggagccaucaaugugcagagcaccuacaagcccacaguguccaccgcuaacaucgcgcugagcuggucuuccguugagcaccgggggaauaaaauucuggucagcggcagaucugaauccaucaugaaacuugaggagcgcacggggauuagcugggaccucggcguggaagaugccucugagagcaaacugcugaccguguccgucauggaccucagccaaauguauucucccguguucgaauaccuguccggagaucggcagguugaggaauggccuaaggcuacaugcaccggcgacuguccggagagaugcggguguacaagcucuaccugccuucauaaagaguggccccacucccgcaacuggcgguguaauccuacguggugcuggggagugggcacaggguguaccugcuguggacuggaugucaaggaccucuuuacagauuacauguucgugaaguggaaaaucgaauauauuaagaccgaggccaucguuugcguggaacugaccagccaggagagacaguguucccugaucgaagccggcacacgguuuaaccuugggcccgucacgauuacccucucugagccucgcaauauccaacagaaacugcccagcgagauuaucacacugcauccgagaauugaagagggcuucuuugaccucaugcacgugcagaagguucuguccgcuucuaccgugugcaaacuucagagcugcacacauggagucccuggcgaccugcaaguguaccacaucgggaaccuccugaagggagauaaggugaauggccaccugguccauaaaaucgaaccccacuucaacaccuccuggaugagcugggacgggugugaucuugacuauuacugcaauaugggagauuggccuucuuguacguauacaggcguuacccagcauaaccacgccuccuuugugaaucuccugaacauugagaccgacuacacaaagaacuuccacuuucauagcaaacgggugaccgcgcacggggauacaccccagcuggaccucaaggcuagaccuacguauggcgccggagaaaucaccguccugguggagguugccgauauggagcuucauacaaagaagauugaaaucucuggccugaaauucaccucccucacaugcaccggguguuacgcuugcagcucuggaauuuccuguaaggugcgcauccacgucgacgagcccgaugaacugacggugcauguuaagagcgacgauccggacguggucgccgcuuccagcucucugauggcccggaaacuugaguucggcaccgacagcacauuuaaggcguucuccgccaugccuaaaaccucucugugcuuuuacaucguggagagagaauauuguaagagcugcuccgaggaagauacacagaaauguguuaauaccaagcucgagcaaccccagucuauucugaucgaacacaaggggacaauuaucggaaaacagaacaauaccugcaaggcucgcgccggcugcuggcucgagagcgugaaauccuucuuuuacgggcugaagaacaugcuuucuggcauuuucggaaaugucuuuaucggcauuuuccuguuucucgcucccuucauccugcugauccuguuuuucauguuuggguggcggauucuuuucuguuucaaaugcuguagacgcacgagaggacucuuuaaguaucggcaccugaaggacgaugaggaaacaggcuaccgcaaaaucauugagagacucaacaauaagaaagggaagaacaaacugcuugacggagaacggcuggccgaucgcagaaucgcggagcuuuucagcaccaagacccauauuggc

SEQ ID NO: 13758 - RNA, 3495 nt, Artificial Sequence
  derived and/or modified CDS sequence (opt5) from CCHVF(CCHVF SPU415/85)__DQ211635.1__Gn-NSm-Gc
agcgaggaauccgacggcgauugcaucucuagaacccagcugcuccggacagagacgaccgaaauucacagcgacaacuacgggggacccggcgauaagaucacaauuuguaauggguccaccaucguggaccaacgccugggaucugagcuuggcugcuauacaauuaacagagucaagagcuucaagcugugugaaaauuccgccaccgggaaaucuugcgagaucgauagcacaccuguuaagugucggcagggauuuugccucaaaaucacccaggagggccgcggccaugugaagcuguccagagggagcgaaauugugcuugacgcuugugauucuaacugcgagaucaugauuccgaagggaacgggcgacauccuggucgauuguuccgggggacagcaacacuuccucaaagacaaucugauugaucugggcugccccaacaucccucuccuggggaagauggccauuuacaucugucggaugagcaaucaucccaaaaccacaauggcguuucuuuucugguuuucuuucggauaugugauuaccugcauccugugcaagguuaucuuuuaccuccugauuguggcuggcacagucggcaaaaaguucaagcaguaucgcgaacuuagaccucagaccuguacgaucugcgagacaauucccgugaacgccaucgacgccgagaugcacgaucugaauuguuccuacaacaucugcccuuauugugcuagccggcucaccucugacgggcuggcccgccauguuaugcagugcccgaaaagaaaggaaaaaguggaggaaacagagcuguaccucaaucuggaacggauucccugggucgugcgcaaacuucugcaaguguccgagagcaccggagucgcucucaaaagauccucuuggcugaccguucuucuggugcuccugaucgugagccuguccccuguccagagcgcccccauuggccacgggaagacaaucgagacguaccaggcgcgggaaggauauaccucuuuuugucucuucauucugggcuccauccuuuuugugguuagcugccuggugaaagggcucaucgacucugucggaaacagcuucuuuccuggccuguccauuuguaagacaugcucuaucggcagcauuaauggguucgagaucgaaucccacaaguguuacugcagccuuuucugcugucccuauugccgccauuguucugccgauagagagauucacaaacugcaucucuccaucugcaagaaacggaagaccggaagcaacgugaugcuggcuguuuguaaaagaaugugcuuucgcgccacaauugaagugucuaaucgggcucugcucaucagaaacaucauuaacaccacguucgucguguguauccugacacuugccgucugcgugguuuccaccagcgcgguggagauggagucccugccggccggcaccugggaaaaggaggaagaccucacaaauuuuugucaccaggagugccaagucaccgaaacagagugucugugcccuuacgaggcucuggugcuucgcaagccccucuuccuggauucuauuguuaaagggaugaagaaccugcucaauagcacgucccuggaaaccucucuuagcaucgaggccccuuggggagcuauuaacgugcaguccacauuuaaacccaccgucagcgccgccaauaucgcucugucuugguccagcguggaacaccggggcaacaagauccucgugucugggagauccgagagcauuaugaaacuggaggaacgcacaggcaucucuugggaccugggaguugaggaugcgagcgaauccaaacuucucaccgucagcgugauggaccugucucagauguauucccccguguucgaguaccugagcggcgaucggcaagucgaagaguggccuaaggccacgugcaccggggacuguccggagagaugcggauguacauccucuaccugccuccauaaagaauggccccacagccgcaauuggcgguguaacccuacauggugcuggggcguggggaccggauguacgugcuguggccuggauguuaaggaccuuuuuacagauuauauguucgugaaauggaaggucgaguacauuaaaaccgaagcuaucgugugcguugagcugacaucccaggaaagacaguguucucucauugaggccgggacccgcuuuaaucugggccccgugaccaucacacugagcgagccucggaacauccagcaaaaacuucccccggaaauuaucacgcuccauccuagaauugaggaaggauucuuugaccugaugcacguccagcgggugcuguccgccucuaccguuugcaagcuccagagcugcacacauggcgugcccggggaccugcaggucuaccacaucggaaaucuucugaagggcgauaaggugaacgggcaccucauucauaaaaucgagccucacuucaauaccuccuggaugagcugggacggaugugaucuggacuauuacugcaacaugggcgauuggcccucuuguacauauaccggggugacgcaacauaaucacgcugccuuugucaaccugcuuaacaucgaaacagacuacaccaagaauuuccacuuccauuccaaacgcguuaccgcgcacggcgauacaccucagcucgaccugaaggcuagacccaccuauggagccggcgaggugacagugcuggucgagguggccgauauggaacuccauacgaaaaagauugagaucagcgggcugaaguuugcuucucuuaccugcacaggauguuacgccugcuccagcggcauuucuuguaaaguuaagauccacguggacgaaccggaugagcugaccguccaugugaaauccgaggacccugauauuguugcugccgggagcucccucauggcgcggaagcuggaguucggagccgacagcacauuuaaggcuuucucugccaugcccaagaccagccugugcuuuuauaucguggaaagagaauacuguaaguccugcucucgcgaggacacgcggaaaugugucaacaccaaacuugauagaccccagagcauucugaucgaacacaagggcacaaucauugggaagcagaauaauaccugcacagcuaaagccuccugcuggcucgagucuguuaagagcuucuuuuacggccugaagaacaugcucuccggaaucuucggcaacguguuuauugggaucuuccuguuuauugcgccuuucgugcuucugauccucuuuuucauguucggauggcgcauccuguuuuguuucaaaugcuguagacggacccgcggccuguuuaaguauagacaccuuaaagacgaugaggaaacaggguaccggaagauuaucgagcgccugaauaacaaaaagggaaagaauaaacuccuggacggcgaaagacucgccgaucggaagauugcugagcuguucucuaccaaaagccauaucggc

SEQ ID NO: 13759 - RNA, 3495 nt, Artificial Sequence
  derived and/or modified CDS sequence (opt5) from CCHVF(CCHVF Turkey200310849)__DQ211636.1__Gn-NSm-Gc
agcgaggaacccggcgacgauugcaucuccagaacccagcugcuccggacagagacggccgaaauucacgacgauaacuacgggggaccuggcgacaagaucaccauuuguaaugggucuacaaucguggaucaacgccugggaagcgagcuuggcugcuauaccauuaacagagucaaauccuucaagcugugugaaaauucugcuacagggaaaaccugcgagguugacagcacaccggugaagugucggcagggauuuugccucaaaaucacccaggagggccgcggccaugugaagcuguccagagggucugaagucgugcuugaugccugugacagcuccugcgagguuaugauccccaagggaacgggcgauauucugguggacuguagcgggggacagcaacacuuccucaaagauaaccugaucgaccugggcugcccucauauuccccuccuggggaagauggcgaucuacauuugucggaugucuaaucacccucgcaccacaauggcuuuucuuuucugguuuuccuucggauaugucauuaccugcaucagcugcaaagcccuguuuuacucucucaucaucauuggcacacugggcaagaaaaucaagcaguauagagaacuuaagccccagaccuguacgauuugcgagacagccccugugaacgcuaucgaugccgagaugcaugaccugaauuguuccuacaacauuugcccguauugugcuagccggcucaccucugacgggcuggcccgccacguuacacagugccccaaaagaaaggaaaaaguggaggaaaccgagcuguaccucaaucuggaacggaucccuuggaucguccgcaaacuucugcaaguguccgagagcaccggaguggcgcucaaaagauccucuuggcugauuguccuucugguucuccugacagugagccugucccccgugcagagcgccccugucggccacgggaagacgaucgagauuuaccagacccgggaaggauucgcuucuaucugucucuuuaugcugggcuccauucuuuucaucgugagcugccugguuaaagggcucguggauucugucagcgacuccuuuuuccccggacugucuguguguaagacaugcagcaucggcuccguuaacggcuuugagauugaaagccauaaguguuauugcucucuuuucugcuguccguacugccgccacuguuccgccgauagagagauccaucagcugcaccucagcauuugcaaaaagcggaaaaccgggucuaaugugaugcuggcugucuguaagagaaugugcuuccgcgccacaaucgaagcgucccggagagcccugcucauucgcagcaucauuaacaccacguuugugaucuguauccugacacuuaccauuugcgucguguccaccucugcuguugagauggagaaucugccugccggaacaugggaacgggaggaagaccucaccaacuucugucaccaagagugccaggugacagaaacggagugucugugccccuaugaggcucugguccuuagaaaaccucucuuucuggauagcaucgugaagggcaugaagaaucugcucaacuccaccucucuggaaacaagccuuuccauugaggcccccuggggagccaucaacguucagagcaccuucaaacccgcugugucuacagcgaauauugcccuguccuggagcucugucgaacaucgcggaaacaagauccucgugaccggccgguccgagagcaucaugaaacuggaggaaagaacgggggugucuugggaccugggcguugaggaugcuagcgaauccaaacuucucaccgucagcauuauggaccugucucaaauguacuccccuguguuugaguaucugagcggagaucgccagguggaagaguggccgaaggccacaugcaccggcgacugucccgagcggugcggguguacauccucuaccugccuccacaaggaauggccucauagcagaaauuggcgcuguaaccccacguggugcuggggagucggcacaggguguaccugcuguggaguggauguuaaggaccuguucacagaccacauguuugugaaauggaaggucgaguacaucaaaaccgaagccauugugugcguugagcuuaccucccaggaacggcaguguucucugaucgaggcuggcacaagauucaaucucgggccugugacgauuacccugagcgagccccggaacauccaacagaagcugccgccugaaaucauuacacuucaucccaaaaucgaggaaggcuuuuucgaucucaugcacguccagaaggugcuguccgccucuaccguuugcaagcugcagagcugcacacacgggauuccuggcgaccuccaaguguaucauaucgggaaucugcuuaaaggagaucgcgucaacggccaccugauucauaagaucgagucccacuuuaauaccagcuggaugucuugggacgggugugaucucgacuacuacugcaacaugggagauuggcccuccuguacguauacaggcgugacccagcacaaucaugcggcuuucgugaaccugcugaauaucgaaaccgacuacacaaaaaccuuucacuuccauagcaagagagucacagcccacggggauacgccucagcuugaccucaaagcccggcccaccuauggcgcuggagagauuacaguucugguggagguggccgauauggaacugcauaccaagaaagucgagaucucuggccucaaguucgcuucccuggccugcacaggguguuacgcgugcagcucuggaauuuccuguaaggugagaauccacguugacgaaccggaugagcuuaccgugcacgucaaaagcuccgacccugacgugguugccgcuagcacgucucugauggcccgcaagcucgaguuuggcaccgauagcacauucaaggcuuuuuccgccaugcccaagaccucucugugcuucuauauuguggaacgggaguacuguaaaagcugcuccgaagacgauacacagaagugugucgacaccagacuggagcaaccccagucuauccuuauugaacauaaggggacaaucaucggaaaacagaacgauaccugcacggcgaaggccagcugcuggcuggaguccgugaaaucuuucuuuuauggccucaagaauaugcuggggagcguuuuuggcaaccucuucauuggaauccugcuuuuucuggcuccuuucgugcuccugguccuguuuuucauguuuggcuggaaaauucuuuucuguuucaagugcugucgcagaacacgggggcuguuuaaguaccgccaccucaaagacgaugaggaaaccggauacagacggaucauugagcgccugaacuccaagaaaggcaagaauagacuccuggacggggaucggcuugccgaccgcaaaaucgcugaacuguucagcaccaagacacauaucgga

SEQ ID NO: 13760 - RNA, 3495 nt, Artificial Sequence
  derived and/or modified CDS sequence (opt5) from CCHVF(CCHVF Iran-52)__DQ446215.1__Gn-NSm-Gc
agcgaggaguccggcgacgauugcaucucuagaacccagcugcuccggacagagacggccgaagugcacggggacaacuacggaggccccggggauaagauuaccaucuguaauggaagcacagucguugaccaacgccugggcuccgagcuugggugcuauaccauuaacagagugcggucuuucaaacugugugaaaauagcgcuacaggaaaguccugcgagaucgauucuauuccugugaaauguaagcagggcuacugccucaaaaucacccaggagggccgcgggcaugucaagcugagcagaggauccgaagugguucuugacgugugugauagcucuugcgaggucaugaucccgaagggcacaggggacauucugguggauuguuccggaggccagcaacacuuucucaaagacaaccugguugaucuggggugccccaagaucccucuccugggaaaaauggccauuuauaucugucggaugagcaaucaucccaagaccacgauggcguuccuguuuugguucucuuuuggcuacgugauuaccugcauccugugcaaagcuauuuucuuucuccugaucaucuucggcacacuugggaagcgcuuuaagcaguauagagaacugaaaccucagaccuguacaauuugcgagaccacgcccgucaacgccaucgacgccgagaugcacgaucucaauuguuccuacaacauuugcccuuauugugcuagccggcugacaucugacggacuggcccgccaugugacccagugcccgagacggaaggaaaaaguggaggaaacagagcucuaccugaaucuugaacgcauccccugggucguuagaaagcugcuccaaguguccgagagcaccggcaccgugcugaaacgguccucuuggcuuauuguccugcucgugcuguucacaguuagccuguccccugugcagagcgcucccaucgggcacggaaagacgaucgagaccuaccgcgucagagaagaguauacaucuauuugucucuuugugcugggcuccauccuuuucauuguuagcuuucugaugaaagggcucguggacggagucggcaacaucuucuucccuggccugucugugugcaagaccuguagcauuggguccaucaauggauuugaaaucgagucucacaagugcuacuguagccuuuucugcugccccuauugucggcauugcuccgccgauggcgaaauucaccagcugcaucucagcaucuguaaaaagagaaaaacagggucuaacgucaugcuggcggugugcaagcgcauguguuuucgggccaccauggagguuuccaauaaagcucuguucauuagaagcaucauuaacacgacauuuguggucugcauccucauucuggccguguguguugugucuaccuccgcugucgagauggaaagccuuccggccggaaccugggagcgcgaagaggaccugacaaauuucugccaccaggaaugucaagugaccgagacagagugccucuguccuuacgaagcgcuggugcugcggagaccccuuuuucucgauuccaucguuaagggcaugaagaaccugcugaacucuacgagccucgagaccucccugucuaucgaagccccuuggggcgcuauuaauguccagagcacauauaaacccaccguguccacagccaacaucgcucuuagcuggucuuccguggagcaccgcgggaauaagguccuggugagcggacggucugaguccauuaugaaacucgaagagagaaccggcaucagcugggaccuggggguugaagaugccucugagagcaagcugcuuacgguguccgucauggaccucagccagauguacucucccguguucgaauaucuguccggagaucgccaaguugaggaguggccuaaagcuaccugcacaggcgacugcccggaacggugugggugcaccagcuccacaugucugcauaaggaguggccccacucuagaaacuggcgcugcaauccuaccugguguuggggagugggcacggggugcacauguugcggccucgaugucaaggaccuguuuaccgauuacauguucgugaaauggaagguugaauacauuaaaacagaggccaucgugugugucgaacuuaccagccaggagcggcagugcucccugaucgaggcgggaaccagauuuaaccucggcucugugacaauuacgcugagcgaaccccggaauauccagcaaaagcugccucccgagauuaucacccuucauccgaaaauugaagagggguucuuugaccucaugcacgugcagaagguccuguccgccucuacaguuuguaagcugcagagcugcacccauggagugccuggcgaccuccagguguaucacaucgggaaccugcuuaaaggagaucgcgucaauggccaccugauccauaagauugaacaacacuucaacacauccuggaugagcugggacgggugcgaucucgacuacuauuguaauaugggcgauuggcccucuugcaccuacacgggagugacacagcauaaccacgcuuccuucguuaaucugcugaacaucgagaccgacuauaccaaaacauuucacuuccauagcaagagagugaccgcccacggcgauacaccucagcuugaccucaaagcccggcccacguacggggcuggagagauuaccguccugguggaaguugccgauauggagcugcauacaaagaaaaucgaaauuucuggccucaaguuugcggggcugaccuguacaggaugcuaugcuuguuccagcggcaucucuugcaaggugagaauccacgucgaggagccugacgaacuuaccgugcauguuaaauccgaugaccccgauguggucgccgccagcuccagccugauggcucgcaagcucgaguucgggacggacucuaccuuuaaagccuucagcgcuaugccgaagacaucccuguguuuuuacauuguggaacgggaguacugcaaaucuuguagcaaggaagacacccagaagugcgugaauacaaaacuggagcaaccucaguccauccuuauugagcacaagggcaccaucauuggaaaacagaacaacacauguaccgccaaggcgucuugcuggcuggaaagcgucaaauccuucuuuuauggccucaagaauaugcuugggggaaucuucggcaacguuuuuauugggaucuucacguuucucacacccuucauccugcuuauucuguucuuuauguucggauggagaauccucuuuugcuucaaguguugccgcagaacccggggccuguuuaaauaccgccaccugaaggaugacgaggaaaccggcuauagaaaaauuaucgagcggcuuaauaacaagaaagggaagaaucgccugcucgauggagaaagacuggccgaccggaagauugcugaacucuucucuacaaaaacccauaucggc

SEQ ID NO: 13761 - RNA, 3495 nt, Artificial Sequence
  derived and/or modified CDS sequence (opt5) from CCHVF(CCHVF Iran-53)__DQ446216.1__Gn-NSm-Gc
agcgaggaauccggcgacgauugcaucucuagaacccagcugcuccggacagagacggccgaagugcacggggacaacuacggaggccccggggauaagauuaccaucuguaauggaagcacagucguugaccaacgccugggcuccgagcuugggugcuauaccauuaacagagugcggucuuucaaacugugugaaaauagcgcuacaggaaaguccugcgagaucgauucuauuccugugaaauguaagcagggcuacugccucaaaaucacccaggagggccgcgggcaugucaagcugagcagaggauccgaagugguucuugacgugugugauagcucuugcgaggucaugaucccgaagggcacaggggacauucugguggauuguuccggaggccagcaacacuuucucaaagacaaccugguugaucuggggugccccaagaucccucuccugggaaaaauggccauuuauaucugucggaugagcaaucaucccaagaccacgauggcguuccuguuuugguucucuuuuggcuacgugauuaccugcauccugugcaaagcuauuuucuuucuccugaucaucuucggcacacuugggaagcgcuuuaagcaguauagagaacugaaaccucagaccuguacaauuugcgagaccacgcccgucaacgccaucgacgccgagaugcacgaucucaauuguuccuacaacauuugcccuuauugugcuagccggcugacaucugacggacuggcccgccaugugacccagugcccgagacggaaggaaaaaguggaggaaacagagcucuaccugaaucuugaacgcauccccugggucguuagaaagcugcuccaaguguccgagagcaccggcaccgugcugaaacgguccucuuggcuuauuguccugcucgugcuguucacaguuagccuguccccugugcagagcgcucccaucgggcacggaaagacgaucgagaccuaccgcgucagagaagaguauacaucuauuugucucuuugugcugggcuccauccuuuucauuguuagcuuucugaugaaagggcucguggacggagucggcaacaucuucuucccuggccugucugugugcaagaccuguagcauuggguccaucaauggauuugaaaucgagucucacaagugcuacuguagccuuuucugcugccccuauugucggcauugcuccgccgauggcgaaauucaccagcugcaucucagcaucuguaaaaagagaaaaacagggucuaacgucaugcuggcggugugcaagcgcauguguuuucgggccaccauggagguuuccaauaaagcucuguucauuagaagcaucauuaacacgacauuuguggucugcauccucauucuggccguguguguugugucuaccuccgcugucgagauggaaagccuuccggccggaaccugggagcgcgaagaggaccugacaaauuucugccaccaggaaugucaagugaccgagacagagugccucuguccuuacgaagcgcuggugcugcggagaccccuuuuucucgauuccaucguuaagggcaugaagaaccugcugaacucuacgagccucgagaccucccugucuaucgaagccccuuggggcgcuauuaauguccagagcacauauaaacccaccguguccacagccaacaucgcucuuagcuggucuuccguggagcaccgcgggaauaagguccuggugagcggacggucugaguccauuaugaaacucgaagagagaaccggcaucagcugggaccuggggguugaagaugccucugagagcaagcugcuuacgguguccgucauggaccucagccagauguacucucccguguucgaauaucuguccggagaucgccaaguugaggaguggccuaaagcuaccugcacaggcgacugcccggaacggugugggugcaccagcuccacaugucugcauaaggaguggccccacucuagaaacuggcgcugcaauccuaccugguguuggggagugggcacggggugcacauguugcggccucgaugucaaggaccuguuuaccgauuacauguucgugaaauggaagguugaauacauuaaaacagaggccaucgugugugucgaacuuaccagccaggagcggcagugcucccugaucgaggcgggaaccagauuuaaccucggcucugugacaauuacgcugagcgaaccccggaauauccagcaaaagcugccucccgagauuaucacccuucauccgaaaauugaagagggguucuuugaccucaugcacgugcagaagguccuguccgccucuacaguuuguaagcugcagagcugcacccauggagugccuggcgaccuccagguguaucacaucgggaaccugcuuaaaggagaucgcgucaauggccaccugauccauaagauugaacaacacuucaacacauccuggaugagcugggacgggugcgaucucgacuacuauuguaauaugggcgauuggcccucuugcaccuacacgggagugacacagcauaaccacgcuuccuucguuaaucugcugaacaucgagaccgacuauaccaaaacauuucacuuccauagcaagagagugaccgcccacggcgauacaccucagcuugaccucaaagcccggcccacguacggggcuggagaggucaccgugcugguugaaguggccgauauggagcugcauacaaagaaaauugaaaucucuggccucaaguuugcggggcugaccuguacaggaugcuaugcuuguuccagcggcauuucuugcaaggucagaauccacguggacgagccugaugagcuuaccguucaugugaaauccgacgaucccgacgucguggccgccagcuccagccugauggcucgcaagcucgaguucgggacggacucuaccuuuaaagccuucagcgcuaugccgaagacaucccuguguuuuuacaucguggaacgggaauacugcaaaucuuguagcaaggaggauacccagaagugcgucaauacaaaacuggaacaaccucaguccauucuuaucgagcacaagggcaccauuaucggaaaacagaacaacacauguaccgccaaggcgucuugcuggcuggagagcguuaaauccuucuuuuauggccucaagaauaugcuugggggaauuuucggcaacguguuuaucgggauuuucacguuucucacacccuucauccugcuuauccuguucuuuauguucggauggcgcauucucuuuugcuucaaguguugcagaagaacccggggccuguuuaaauaccgccaccugaaggacgaugaagagaccggcuauagaaaaaucauugaacggcuuaauaacaagaaagggaagaaucgccugcucgacggagagagacuggccgaucggaagaucgcugaacucuucucuacaaaaacccauauuggc

SEQ ID NO: 13762 - RNA, 3495 nt, Artificial Sequence
  derived and/or modified CDS sequence (opt5) from CCHVF(CCHVF Kosova Hoti)__EU037902.1__Gn-NSm-Gc
agcgaggaacccggcgacgauugcaucuccagaacccagcugcuccggacagagacggccgaaauucacgacgauaacuacgggggaccuggcgacaagaucaccauuuguaaugggucuacaaucguggaucaacgccugggaagcgagcuuggcugcuauaccauuaacagagucaaauccuucaagcugugugaaaauucugcuacagggaaaaccugcgagaucgacagcacaccgguuaagugucggcagggauuuugccucaaaaucacccagaagggccgcggccaugugaagcuguccagagggucugaggugguccuugaugccugugacagcaacugcgaagugaugauucccaaaggaacgggcgauauccugguugacuguuccgggggacagcaacacuuccucaaggauaaucugauugaccugggcugcccucauaucccccuccuggggaaaauggcgauuuacaucugucggaugagcaaccacccuaagaccacaauggcuuuucuuuucugguuuucuuucggauaugugauuaccugcaucuuuugcaaagcccuguucuacucccucaucauuaucggcacacugggcaagaagauuaaacaguaucgcgagcuuaagccccagaccuguacgaucugcgaaacagccccugucaaugcuauugaugccgagaugcaugaccugaacuguagcuacaauaucugcccguauugugcuucuagacucaccuccgacgggcuggcccggcacgugaaacagugccccaagcgcaaagagaagguugaagagacagaacuguaccucaaccuggagagaaucccuugggugguccggaaacuucugcaagugagcgaaucuaccggaguggcgcucaagcgcuccagcuggcugauuguccuucugguucuccugaccgugucccugucucccgugcagagcgccccugucggccacgggaagacaaucgagacguaccagaccagagagggauuuacauccauuugucucuucaugcugggcagcauccuuuuuauugugucuugccugguuaaagggcucguggauuccgucagcgacucuuucuuucccggacugagcguguguaagaccugcuccaucggcucuaucaauggcuucgaaauugagagccauaaauguuauugcucccuuuucugcuguccguacugccggcacuguagcgcugaucgcgaaauccaucagcugcaccucaacauuugcaagaaaagaaagacagggucuaauguuaugcuggccguguguaagcggaugugcuuuagagcuaccaucgaggccucccgccgggcgcugcucauuagaagcaucauuaacacgacauucgucaucuguauccugacccuuaccauuugcguggucucuacauccgccguggaaauggagaaucugccugcuggaaccugggagcgcgaagaggaccucacaaacuuuugucaccaagaaugccagguuacggagaccgaaugucugugccccuaugaggcccuggugcuucggaaaccucucuuccuggauagcaucgucaagggcaugaaaaaccugcucaauuccacaucucuggagaccagccuuuccauugaagcucccuggggagccaucaacgugcagucuacauuuaagcccaccguuagcacggccaauauugcucuguccuggagcucuguggagcauagagggaacaaaauccucgucaccggccgcuccgaaagcaucaugaagcuggaggagcggacagggauuucuugggaccugggcguggaagaugcguccgagagcaaacuucucaccgugucuaucauggaccugagccaaauguacuccccuguuuucgaauaucugagcggagauagacaggucgaggaauggccgaaagccacaugcaccggcgacuguccccagcgcugcggguguacgucuuccacaugccuccacaaggaguggccucauagccggaauuggagauguaaccccaccuggugcuggggagugggcacaggguguaccugcuguggaguggaugucaaagaccuguuuaccgaccacauguucgugaaguggaaaguugaguacauuaagacagaagcuaucgugugcgucgagcuuacgucccaggaacgccaauguucucugauugaggccggcacccgguuuaaucucgggccugugacaaucacccugagcgaacccagaaacauccagcagaagcugccgccugagauuaucacacuucaucccaaaauugaggaaggcuucuuugaucucaugcacguucagaaggugcuguccgccucuaccgucugcaaacugcaaagcugcacgcacggaaucccuggcgaccuccagguguaucauauugggaaucugcuuaagggagaucggguuaacggccaccugauccauaaaaucgagccccacuucaauacauccuggaugucuugggacgggugugaucucgacuacuacugcaacaugggagauuggccuagcuguaccuauaccggcgugacacagcacaaucaugcugccuuugucaaccugcugaauauugaaaccgacuacacaaagacguuccacuuccauuccaaacgcgugaccgcgcacggggauacaccccagcuugaccucaaggcuagaccgaccuauggcgccggagagaucacagugcuggucgaaguugccgauauggagcugcauaccaagaaaguggagauuagcggccucaaguuugcuucucuggccugcacgggguguuacgcuugcuccagcggaaucucuuguaaagugcggauucacgucgacgaaccugaugagcuuaccgugcacguuaaguccagcgaccccgacguggucgccgcgggcacaucucugauggccagaaaacucgaauuugggaccgauuccacauuuaaggcuuucagcgccaugcccaagaccucccugugcuuuuauaucguggagaaagaguacuguaagagcugcucugaagacgauacaaagaaguguguugacaccaaacuggagcaaccucagagcauucuuaucgaacaucgcggaacgaucauuggcaagcagaacgauacaugcaccgcuaaggccuccugcuggcuggagucugugaaauccuucuuuuaugggcucaagaacaugcugggcagcgucuucggaaauuucuucaucggcauucuccuguuucuugcgccguucgugcugcucguucuguuuuucauguucggguggaaaauccuguuuuguuucaagugcugucggagaacccgcggacuuuuuaaauacagacaccugaaggacgaugaagagacaggcuaccggcgcauuaucgagagacucaacaauaagaaagggaagaaccggcugcucgacggagaacgccuggccgauagaaaaaucgcugagcuuuucucuaccaagacgcauauuggc

SEQ ID NO: 13763 - RNA, 3495 nt, Artificial Sequence
  derived and/or modified CDS sequence (opt5) from CCHVF(CCHVF YL04057)__FJ562094.1__Gn-NSm-Gc
gccgagggcgggagcuccgacugcaucucuagaacccagcuggugaagacagaagucgcugagauucacgaagauagcuacggaggccccggggagaaaaucacgauuuguaacggauccaccaucguugaccaacggcucggccgcgaacuggggugcuauacaauuaauagagugcggucuuacaagcugugugagaacagcgccuccggaaaaucuugcgagaucgauagcaucccugugaaguguaaacagggcuucugccugaagauuacccaggaaggccgcgggcaugucaagcucuccagaggaacagagaucgugcuggacguuugugauagcucuugcgaacuuaugauuccgaaaggcaccggggacauccugguggauuguuccggaggccagcaacacuuucuccagaauaaccugauugaccuggggugccccaaugucccucuccugggaaagauggcgaucuaugugugucggaugagcaaccaucccaaaacaaccauggcuuuccuuuucugguucucuuuuggcuacguuauuacgugcaucgccugccgcgugcuguucuaucuccugaucgccauuggcaccgucgggaagaaacuuaagcaguacagagagcugaagccucagacauguaucgugugcgaguccgugcccgucaaugcuauugaugccgaaaugcacgagcucaacuguagcuauaauaucugcccuuacugugcuucucggcuguccaccgacggacugauucgccauguuacacaaugcccgaaaagacgggaaaagguggaggaaaccgagcucuuucugaaccuugagcgcauccccuggcuggugagaaaacuccugcaggucagcgaauccacgggcauggcccuuaagcggucuuguuggaugaucacacugcucauucugcugcucgugagcaucuccccuguucagagcgcgcccguggggaaagagcgcgccauugaaaccuaccaggcuagagagacauauaccggaaucugccuguucguccuuggcucugugcuguuugccguuuccuggcucaccaaggcucugauugaugggaucggaaauagcuucuuuccuggccuuucuguguguaaaacaugcagcaucggcuccauuaacggguucgaaaucgagucucacaaguguuacugcagccuguuuugcugucccuauugccgggccuguuccagcgacaagaauacgcacagaaugcaucucaacgucugcaaaaagcgcaaaaugggaucuaaugugaugcuggcggucuguaagcggaugugcuucagagccaccauugaggcuuccaacaaagcccugcucauccgcagcauuaucaacucuacauucgugauuuguauccugauccuuaccauuugcguuguguccacaagcgcugucgauauggaaaaucugccggccggcaucugggagaaggaagaggaccucaccaacuuuugucaccaagaaugccaggugacggagacagagugucugugcccuuacgaagccaugguucugcggaagccccuuuuccucgacuccauugcuaaagggaagaaaucucugcugaauagcaccucccucgagaccucucugagcaucgaagcgccuuggggagccauuaacgugcaguccacauuuaagcccaccgucagcgcugccaauaucgcccuuucuugguccagcguggagcauagaggcaacaaaauccuggugucugggcgcuccgagagcauuaugaagcucgaggaacggacaggcguuucuuggaaucugggagucgaagaugcuagcgaguccaagacgcugaccgugagcgugauggaccuuucucaaauguauucccccgucuucgaauaccucagcggcgauagacagguggaggaguggccuaaagccacaugcaccggggacuguccggaacgcugcggauguacauccucuaccugccugcacaaggaguggccccacagccggaacuggagauguuccccuacguggugcuggggcguugggaccggauguacaugcuguggccuggaugugaaagacuuuuucaccgauuauaugcucgucaaguggaaaguggaauacaucaagacagaggcgauuguuugcguggaacugaccucucaggagcgccaguguagccuuaucgaggcugggacgcgguuuaaucugggccccgucacaauuacccucuccgaaccuagaaacgugcaacagcggcugcccccggagaucguuacacugcauccuaagaucgaagagggauucuuugaccuuaugcacgugcagaaaauucucucugccagcaccgucugcaagcugcaguccugcacccauggcgugcccggggauuuccaaguguaccacgucggaaaucugcuccgcggcgacaaaguuaacgggcauagcauccacaagauugaaccucacuuuaauacaucuuggauguccugggauggaugugaccuggacuauuucugcaacaugggcgauuggcccagcuguacguacaccggggugacacagcauaauagagccgcuuuuaucaacaugcuuaacauugagaccgacuauacaaaaaccuuccacuuccauucuaagcgggugacggcccacggcgauacaccucagcuggaccucaaagcuagacccgccuacggagcgggcgaggucaccgugcugguugaaguggccgaucuggagcuucacaccaagaagcucgaagucuccgggcugaaaaucgcuagccugacaugcucuggauguuaugccugcuccagcggcaucuccuguaaggugcgcauucauguuaaugagccggacgaguuuaccgugcacguccggagcucugauccugacgugguugcugccgggagcucccucauggcgagaaaaaucgaauuuggagccgauucuacauuuaaggcuuucagcuccaugcccaaagacucucugugcuuuuacauuguggagaaggauuauuguagcuccugcacggacgaugacacccagaagugugucaacacaaaacuugaccauccccaaucuauccugauugaacacaagggcaccaucauugggaaacagaaugauacaugcagcaccaagacguccugcuggcucgagagcgugaaaggcuucuuuuacggacugaagaacaugcugucuggcaucuucgggaauguguuucuuggaauccuucucuuccuggccccuuuuguccuccugauuuucuuuuucuucuuuggcuggcgccuucuguucugucucaagugcuguagacggacccgcgggcugcugaaauacaagcaucuuaaagacgaagaggaggcuggauauaagaaaaucauugaaagacugaacggcaagaagggcaaaucccagcucuuugauggggagcggcuggccgaccgcaagaucgccgaacucuucagcacaaaaauucacaucgga

SEQ ID NO: 13764 - RNA, 3495 nt, Artificial Sequence
  derived and/or modified CDS sequence (opt5) from CCHVF(CCHVF V42/81)__GU477490.1__Gn-NSm-Gc
agcaaggagcccggcgacgauugcaucuccagaacccagcugaugcggacagaaacggccgagauucacgacgauaacuacgggggaccuggcgacaaaaucaccauuuguaaugggucuacaaucguggaucaacgccucggaagcgaacugggcugcuauaccauuaacagagucaaguccuucaaacuuugugaaaauucugcuacagggaaggccugcgagguugacagcaccccggugaaaugucggcagggauuuugccugaagaucacacaggagggccgcggccaugugaagcucuccagagggucugaggucgugcuggaugcgugugacagcuccugcgaaguuaugauccccaaaggaaccggcgauauucuuguggacuguagcgggggacagcaacacuuccugaaggauaaccucaucgaccuggagugcccucauauuccccugcucggcaaacuggcuaucuacauuugucggaugucuaaucacccucgcacgaccauggccuuucuuuucugguuuggguucggauaugucaucacaugcauucugugcaaggcccucuuuuacucccugaucaucauuggcacccuuggcaaaaagaucaagcaguauagagaacugaaaccccagacauguaccauuugcgagacggcuccugugaacgccaucgaugcugagaugcaugaccucaauuguagcuacaacauuugcccguauugugccucucggcugacauccgacgggcuggcgcgccacguuacccagugccccaagagaaaagaaaagguggaggaaacagagcucuaccugaaucuugaacggaucccuuggaucguccgcaaacugcuccaagugagcgagucuaccggagugguccugaagagauccagcuggcuuauuguucugcucgugcugcugaccgugucccucucucccguccagagcgccccugugggccacgggaaaacaaucgagacguaccagacccgggaaggauucacauccauuugucuguuuaugcuuggcagcauccuguucauuguuucuugcaucgugaaggggcucgucgauuccgugagcgacagcuuuuuccccggacugucuguuuguaagaccugcuccaucucuagcauuaacggcuuugagaucgaaucccauaaauguuauugcagccuuuucugcuguccguacugccgccacuguucugcugauagagagauucaucagcugcaccucuccaucugccggaagagacgcacaggcagcaaugugaugcuggccgucuguaaacggaugugcuucagagcuaccauugaagugucucgccgggcccugcucaucagauccauuaucaacacgacauuugucaucuguauucugacccuuaccaucugcgugguuagcacauccgcgguggagauggagaaucugccugccgggaccugggaacgcgaggaagaccucacaaacuucugucaccaagagugccaggucacggaaaccgagugucugugccccuaugaggcucuggugcuucggaagccucucuuucuggauucuauuguuaaaggaaagaagaaucugcucaacagcacaucccuggaaaccucucuuagcaucgaggcccccuggggcgcuauuaacauccaguccacauucaaacccaccgugagcgccgccaauaucgcucugucuugguccagcgucgaacauagagggaacaagauucucgugucuggacgcuccgagagcaucaugaaacuggaggaacggacgggcgugucuuggaaucuggggguugaggacgcgagcgaauccaaacuucucaccgucagcauuauggaucugucucaaauguacuccccuguguuugaguaucugagcggcgacagacagguggaagaguggccgaaggccacaugcaccggagauugucccgagcgcugcggcuguacauccucuaccugccuccacaaggaauggccucauagccggaacuggagauguaaucccacguggugcuggggagucggaacaggcuguaccugcugugggguggacguuaaggaucuguucaucgaccacauguuugugaaauggaaggucgaguacauuaaaacagaagcuaucgugugcguugagcuuaccucccaggaacggcaguguucucugaucgaggccggaacccgcuucaaccucggcccugugacaauuacgcugagcgagcccagaaauauccaacagaagcugccgccugaaauuaucacccuucaucccaaaauugaggaaggguuuuucgaccucaugcacguccagaaggugcuguccgccucuacaguuugcaagcugcagagcugcacccacggcaucccuggagaucuccaaguguaucauaucggcaaccugcuuaaaggggaccgggucaauggacaccugauucauaagaucgagccccacuuuaacacauccuggaugagcugggauggcugugaccucgauuacuacugcaauaugggggacuggccuucuuguaccuauacgggagugacacagcacaaccaugcugccuucgugaaucugcugaacauugaaaccgauuacaccaaaacauuucacuuccauuccaagagagucaccgcgcacggcgagacaccccagcuugaccucaaagcucgcccggccuauggggccggcgagaucacgguucugguggaaguggcugauauggagcugcauaccaagaaagucgaaauuagcggacucaaguucgccucucuggcuugcacaggcuguuacgccugcuccagcgggaucucuuguaaggugcggauucacguugacgagccugaugagcuuaccgugcacgucaaauccaaugaccccgaugugguugcggccagcacaucccugauggcuagaaagcucgaaagcggaaccgacucuacguuuaaagccuucagcgcuaugcccaagaccucccugugcuuuuauaucguggagcgcgaauacuguaaaucuugcagcgaggacgauacacagaagugugucgaaaccaagcuggagcaaccucaguccauccuuauugagcauaaaggcacaaucauugggaagcagaacgauaccugcacagccaaagcgucuugcuggcuggaaagcgugaaguccuucuuuuauggacucaaaaacaugcugggcucuguuuucgggaacuuuuucaucggcauucuccuguuucuugccccguucgugcugcucguccuguuuuucauguuuggauggaagauccuguucuguuucaagugcuguagacggacccgcggccuuuuuaaauacagacaccugaaggaggacgaagagacgggguaccggcgcaucauugaaagacucaauagcaaaaaggggaaaaaucggcugcucgacggcgagcgccuggcugauagaaagaucgccgagcuuuucuccacaaagacccauauuggg

SEQ ID NO: 13765 - RNA, 3495 nt, Artificial Sequence
  derived and/or modified CDS sequence (opt5) from CCHVF(CCHVF 79121M18)__GU477493.1__Gn-NSm-Gc
gccgagggcgggagcuccgacugcaucucuagaacccagcuggugaagacagaagucgcugagauucacgaagauagcuacggaggccccggggagaaaaucacgauuuguaacggauccaccaucguugaccaaggccucgggucugaacugggaugcuauacaauuaaucgggugcgcagcuacaaacuuugugagaacuccgccucuggcaaaagcugcgagaucgauuccaucccugugaaguguaaacagggcuucugccugaagauuacccaggaagggagaggacaugucaagcucagccggggcacagagaucgugcuggacguuugugauucuuccugcgaacuuaugauuccgaaagggaccggagacauccugguggauuguagcggcgggcagcaacacuuucuccagaauaaccugauugaccugggaugccccaaugucccucuccugggcaagauggcgaucuaugugugucgcaugucuaaccaucccaaaacaaccauggcuuuccuguuuugguucuccuuuggcuacguuauuacgugcaucgccugcagagugcuguucuaucuccugaucgccauugggaccgucggaaagaaacuuaagcaguaccgggagcugaagccucagacauguaucgugugcgagagcgugcccgucaaugcuauugaugccgaaaugcacgagcucaacuguucuuauaauaucugcccuuacugugcuucccgccugagcaccgacggccugauuagacauguuacacaaugcccgaaacggcgcgaaaagguggaggaaaccgagcucuuucugaaccuugagagaauccccuggcuggugcggaaacuccugcaggucuccgaaucuacggggauggcccuuaagcgcagcuguuggaugaucacacugcucauucugcugcucguguccaucagcccuguucagucugcgcccgugggaaaagagagagccauugaaaccuaccaggcucgggagacauauaccggcaucugccuguucguccuuggguccgugcuguuugccguuagcuggcucaccaaggcucugauugauggaaucggcaauucuuucagcccuggccuuuccguguguaaaacaugcucuaucgggagcauuaacggauuugaaaucgagucccacaaguguuacugcagccuguucugcugucccuauugccgcgccuguucuuccgacaagaauacgcacagaaugcaucucaacgucugcaaaaagcggaaaaugggcagcaaugugaugcuggcggucuguaagagaaugugcuuucgcgccaccauugaggcuucuaacaaagcccugcucauccgguccauuaucaacagcacauucgugauuuguauccugauccuuaccauuugcguuguguccacaucugcugucgauauggaaaaucugccggccgggaucugggagaaggaagaggaccucaccaacuucugucaccaagaaugccaggugacggagacagagugucugugcccuuacgaagccaugguucugagaaagccccuuuuucucgacagcaccgcuaaaggaaugaagucccugcuuaauucuaccagccucgagacaucccugagcauugaagcgccuuggggcgccaucaacgugcagucuaccuucaaacccacagucuccgcugccaauauugcccuuagcuggucuuccguggagcaucgcgggaacaagauccuggugagcggccggucugagagcaucaugaaacucgaagagagaacgggaguuuccuggaaucugggcgucgaagaugcuagcgagucuaagacccugacaguguccgugauggaccuuagccaaauguauucccccgucuuugaauaccucucuggggaucgccagguggaggaguggccuaaggcgaccugcacaggagacuguccggaacggugcggcuguaccagcuccacgugccugcacaaagaguggccccacucuagaaacuggcgcuguaauccuaccuggugcuggggaguugggacaggcuguaccugcugugggcuggaugugaaggacuucuuuacagauuauaugcucgucaaauggaagguggaauacauuaaaaccgaggccaucguuugcguggaacugacgagccaggagcggcaguguucccuuauugaggcuggcacaagauucaaccugggacccgucaccaucacacucucugaaccucgcaaugugcaacagcggcugcccccggagauuguuacccugcauccuaagaucgaagagggcuuuuucgaccuuaugcacgugcagaagauccucagcgccuccaccgucugcaaacugcagagcugcacacauggggugcccggagauuuucaaauuuaccacgugggcaaccugcucagaggggacaaggucaauggacauucuauccacaaaauugaaccucacuucaacacguccuggaugagcugggauggcugugaccuggacuauuuuugcaauaugggggauuggcccucuuguaccuacacaggcguuacccagcauaaccgggccgcuuucaucaacaugcuuaauauugagacagacuauaccaagacguuucacuuccauuccaaacgcgugacagcccacggagauaccccucagcuggaccucaaggcuagacccgccuacggcgcgggggaggugaccguccugguggaaguugccgaucuggagcuucacacaaagaagcucgaagugagcggacugaagaucgcuucucugaccugcuccggcuguuaugccugcagcuccgggaucagcuguaaaguccggauucaugugaacgagccggacgaguucacaguucacgugagaucuagcgauccugacgucguggcugccggauccucucucauggcgcgcaagaucgaauuuggcgccgauagcacguucaaggcuuuuuccucuaugcccaaggacagccugugcuucuacauuguugagaaagauuauuguuccucuugcaccgacgaugacacacagaagugugugaauaccaaacuugaccauccccaaagcauccugauugaacacaaagggacaaucauuggcaagcagaacgauaccugcuccacgaaaaccagcugcuggcucgagucugucaagggauuuuucuacggccugaaaaauaugcuguccgggaucuuuggaaacguguuccuuggcaucuuucuguuccucgccccuuuugugcugcucauuuucuuuuucuucuuuggguggcggcugcuuuucugucugaagugcuguagacgcacaagaggacuccugaaguacaaacaucugaaggacgaagaggaggcuggcuauaaaaagaucauugaacggcuuaauggcaaaaagggaaagagccagcuguuugauggggagcgccucgccgacagaaaaaucgccgaacuguucucuaccaagauucacaucggc

SEQ ID NO: 13766 - RNA, 3495 nt, Artificial Sequence
  derived and/or modified CDS sequence (opt5) from CCHVF(CCHVF Afg09-2990)__HM452306.1__Gn-NSm-Gc
agcgaggaauccggcgacgauugcaucucuagaacccagcugcuccggacagagacggccgaagugcacggggacaacuacggaggccccggggauaagauuaccaucuguaauggaagcacagucguugaccaacgccugggcuccgagcuugggugcuauaccauuaacagagugcggucuuucaaacugugugaaaauagcgcuacaggaaaguccugcgagaucgauucuauuccugugaaauguaagcagggcuacugccucaaaaucacccaggagggccgcgggcaugucaagcugagcagaggauccgaagugguucuugacgugugugauagcucuugcgaggucaugaucccgaagggcacaggggacauucugguggauuguuccggaggccagcaacacuaucucaaagacaaccugguugaucuggggugccccaagaucccucuccugggaaaaauggccauuuacaucugucggaugagcaaucaucccaagaccacgauggcguuucuuuucugguuuucuuucggcuaugugauuaccugcauccugugcaaagcuaucuuuuuccuccugauuaucuuuggcacacuugggaagcgcuucaagcaguacagagaacugaaaccucagaccuguacaauuugcgagaccacgcccgucaacgccaucgacgccgagaugcacgaucucaauuguuccuauaacauuugcccuuacugugcuagccggcugacaucugacggacuggcccgccaugugacccagugcccgagacggaaggaaaaaguggaggaaacagagcucuaccugaaucuugaacgcauccccugggucguuagaaagcugcuccaaguguccgagagcaccggcaccgugcugaaacgguccucuuggcuuauuguccugcucgugcuguuuacaguuagccuguccccugugcagagcgcucccaucgggcacggaaagacgaucgagaccuaucgcgucagagaagaguacacaucuauuugucucuucgugcugggcuccauccuuuuuauuguuagcuuccugaugaaagggcucguggacggagucggcaacaucuuuuucccuggccugucugugugcaagaccuguagcauuggguccaucaauggauucgaaaucgagucucacaagugcuauuguagccuguuuugcugccccuacugucggcauugcuccgccgauggcgaaauucaccagcugcaucucagcaucuguaaaaagagaaaaacagggucuaacgucaugcuggcggugugcaagcgcauguguuuccgggccaccauggagguuuccaauaaagcucuguuuauuagaagcaucauuaacacgacauucguggucugcauccucauucuggccguguguguugugucuaccuccgcugucgagauggaaagccuuccggccggaaccugggagcgcgaagaggaccugacaaauuuuugccaccaggaaugucaagugaccgagacagagugccucuguccuuaugaagcgcuggugcugcggagaccccuuuuccucgauuccaucguuaagggcaugaagaaccugcugaacucuacgagccucgagaccucccugucuaucgaagccccuuggggcgcuauuaauguccagagcacauacaaacccaccguguccacagccaacaucgcucuuagcuggucuuccguggagcaccgcgggaauaagguccuggugagcggacggucugaguccauuaugaaacucgaagagagaaccggcaucagcugggaccuggggguugaagaugccucugagagcaagcugcuuacgguguccgucauggaccucagccagauguauucucccguguuugaauaccuguccggagaucgccaaguugaggaguggccuaaagcuaccugcacaggcgacugcccggaacggugugggugcaccagcuccacaugucugcauaaggaguggccccacucuagaaacuggcgcugcaauccuaccugguguuggggagugggcacggggugcacauguugcggccucgaugucaaggaccuguucaccgauuacauguuugugaaauggaagguugaauauauuaaaacagaggccaucgugugugucgaacuuaccagccaggagcggcagugcucccugaucgaggcgggaaccagauucaaccucggcucugugacaauuacgcugagcgaaccccggaauauccagcaaaagcugccucccgagauuaucacccuucauccgaaaauugaagagggguuuuucgaccucaugcacgugcagaagguccuguccgccucuacaguuuguaagcugcagagcugcacccauggagugccuggcgaccuccagguguaccacaucgggaaccugcuuaaaggagaucgcgucaauggccaccugauccauaagauugaacaacacuuuaacacauccuggaugagcugggacgggugcgaucucgacuauuacuguaauaugggcgauuggcccucuugcaccuauacgggagugacacagcauaaccacgcuuccuucguuaaucugcugaacaucgagaccgacuacaccaaaacauuccacuuucauagcaagagagugaccgcccacggcgauacaccucagcuugaccucaaagcccggcccacguauggggcuggagagauuaccguccugguggaaguugccgauauggagcugcauacaaagaaaaucgaaauuucuggccucaaguucgcggggcugaccuguacaggaugcuacgcuuguuccagcggcaucucuugcaaggugagaauccacgucgacgagccugaugagcuuaccgugcauguuaaauccgacgaucccgacguggucgccgccagcuccagccugauggcucgcaagcucgaauuugggacggacucuaccuucaaagccuuuagcgcuaugccgaagacaucccuguguuucuacauuguggagcgggaauauugcaaaucuuguagcaaggaggauacccagaagugcgugaauacaaaacuggaacaaccucaguccauccuuauugagcacaagggcaccaucauuggaaaacagaacaacacauguaccgccaaggcgucuugcuggcuggagagcgucaaauccuuuuucuacggccucaagaauaugcuugggggaaucuuuggcaacguuuucauugggaucuuuacguuccucacacccuuuauccugcuuauucuguucuucauguuuggauggagaauccucuucugcuuuaaguguugccgcagaacccggggccuguucaaauaucgccaccugaaggacgaugaagagaccggcuacagaaaaauuaucgaacggcuuaauaacaagaaagggaagaaucgccugcucgacggagagagacuggccgaucggaagauugcugaacucuuuucuacaaaaacccauaucggc

SEQ ID NO: 13767 - RNA, 3495 nt, Artificial Sequence
  derived and/or modified CDS sequence (opt5) from CCHVF(CCHVF Sudan Al-Fulah 3-2008)__HQ378184.1__Gn-NSm-Gc
agcgaggaacccuccgacgauugcaucucuagaacccagcugcuccggacagagacggccgaaauucacggcgacaacuacgggggaccuggcgauaagaucaccauuuguaaugggagcacaaucguggaccaacgccugggauccgagcuuggcugcuauaccauuaacagagucaaaucuuucaagcugugugaaaauagcgcuacagggaaauccugcguuaucgauucugugccggugaagugucggcagggauacugccuccgcaucacccaggagggcagaggccaugucaaacugagccggggguccgaggugguucuugacgccugugauacaagcugcgaaauuaugauccccaagggaaccggcgacauucugguggauuguucugggggacagcaacacuuucucaaggacaaccuggucgaucugggcugcccuaaaaucccccuccuggggaagauggcgauuuauaucugucgcauguccaaucauccuaaaacgaccauggcuuuccuguuuugguucagcuuuggauacgugauuacaugcauccuuugcaaggccaucuucuaucuccugauuaucauuggcacccuuggcaaaagauuucggcaguaccgcgagcugaagccccagacauguaccaucugcgaaacgacaccuguuaacgccauugacgcugagaugcacgaucucaauuguucuuauaacaucugcccguacugugccuccagacugaccagcgacgggcuggcucggcaugugacacagugccccaagcgcaaagagaaggucgaagagaccgaacucuaccugaaucuugagagaaucccuuggguggugcggaaacugcuccaagucucugaauccaccggaguugcccugaagcgcagcuccuggcuuauugugcugcucgugcuguucacagucucucugagccccgugcaguccgcgccuaucggccacgggaaaacgauugaggccuauagagcucgggagggauacaccagcaucugucucuuuguucugggcucuauucuuuucaucguguccugccugaugaaggggcucgucgacagcgugggaaacagcuuuuuccccggccugucuaucuguaaaacaugcuccauuucuagcaucaauggcuuugaaauugagucccacaaguguuauugcagccuuuucugcuguccguacugcagacauuguucugccgauaaggaaauccacaaacugcaucucuccauuugcaagaaacgcaagaccgggagcaacguuaugcuggcuguguguaaacggaugugcuucagagccacaauggaggucucuaaucgcgcgcuguuuauccgguccauuaucaacaccacguucgugcucuguauccugauucuugccgucugcgugguuagcacauccgcuguggaaauggagaaucugccugccggaaccugggagagagaagaggaccucaccaacuuuugucaccaggaaugccaggucacagagaccgaaugucugugccccuaugaggcucuggugcuucgccggccucucuuccuggauucuaucguuaagggcaugaagaaccugcucaauagcacaucccuggagacgucucuuagcauugaagcccccuggggagccaucaacgugcaauccaccuacaaacccacagucagcaccgcuaauauugcgcugucuugguccagcguggagcacagagggaacaagauccucgugucuggccgcuccgaaagcaucaugaaacuggaggagcggacagggauuucuugggaccugggcguugaagaugccagcgaguccaaacuucucaccgucagcgugauggaccugucucagauguauuccccuguguuugaauaccugagcggagauagacaggucgaggaauggccgaaggcuacgugcaccggcgacugucccgagcgcugcggguguacauccucuaccugccuccauaaggaguggccucacagccggaauuggagauguaaccccacauggugcuggggagugggcaccggguguacgugcuguggacuggauguuaaggaccuuuucacagauuacauguuugugaaauggaaggucgaauauaucaaaaccgaggccauugugugcguugaacugacaucccaagagcggcaguguucucucaucgaagccggcacccgcuucaaucuggggccugugaccauuacacugagcgagcccagaaacauccagcagaaacuuccgccugagaucauuacgcuccauccccggaucgaagagggcuuuuucgaccugaugcacguccaaaaggugcuguccgcuucuaccguuugcaagcuccagagcugcacacauggagugccuggcgaccugcaggucuaccacauugggaaucuucugaagggagauaaagugaacggccaccucauccauaagauugaaccccacuuuaauaccuccuggaugagcugggacgggugugaucuggacuauuacugcaacaugggagauuggccuucuuguacauauaccggcgugacgcagcauaaucacgccuccuucgucaaccugcuuaauaucgagacagacuacaccaaaaacuuucacuuccauagcaagagaguuaccgcgcacggggauacaccccaacucgaccugaaagcucgcccgaccuauggcgccggagaaaucacagugcugguggaggucgccgauauggagcuccauacgaagaaaauugaaaucucuggccugaaguucgcuucccuuaccugcacaggguguuacgccugcagcucuggaauuuccuguaaggugcggauccacguugacgagccugaugaacugaccgugcaugucaaaagcgacgaucccgacgugguugcugccuccagcucucucauggcgagaaagcuggaguuuggcacagacagcaccuucaaagccuuuuccgcuaugcccaagacgucucugugcuucuacauuguggagaaagaauauuguaagagcugcuccgaggaagauaccaagaaaugugucaacacaaaacuugagcagccucagucuauccugauugaacacaaggggaccaucaucggaaagcagaauagcacaugcaccgccaaaguguccugcuggcucgagucugcuaagagcuuuuucuacggccugaaggacaugcucuccgggauuuuuggcaacguuuucaucggaauuuuucuguuccuugccccguuugugcugcucguccuguucuuuauguucggcuggcgcauccugcuuuguuucagaugcugucggcgcacaagagggcuguuuaaauaucggcaccucaaggaugacgaggaaaccggauaccgcagaauuaucgagcggcugaauaacaaaaagggcaaaaauaagcuccuggauggggaacgccuugcggacagaaagaucgccgagcuguucagcacgaaaacacauauugga

SEQ ID NO: 13768 - RNA, 3495 nt, Artificial Sequence
  derived and/or modified CDS sequence (opt5) from CCHVF(CCHVF Sudan AB1-2009)__HQ378187.1__Gn-NSm-Gc
agcgaggaacccuccgacgauugcaucucuagaacccagcugcuccggacagagacggccgaaauucacggcgacaacuacgggggaccuggcgauaagaucaccauuuguaaugggagcacaaucguggaccaacgccugggauccgagcuuggcugcuauaccauuaacagagucaaaucuuucaagcugugugaaaauagcgcuacagggaaaaacugcgagaucgauuccguuccggugaagugucggcagggauacugccuccgcaucacccaggagggcagaggccaugugaaacugucucgggggagcgaagucgugcuugacgccugugauacauccugcgagauuaugauccccaagggaaccggcgacauucugguugauuguagcgggggacagcaacacuuucucaaggacaaucugaucgaucugggcugcccuaaaauuccccuccuggggaagauggcgaucuauauuugucgcaugucuaaccauccuaaaacgaccauggcuuuccucuuuugguucuccuuuggauaccugaucacaugcauccucugcaaggccauuuucuaucugcuuaucauuaucggcacccugggcaaaagacucaagcaguaccgggaacugaagccccagacauguaccauuugcgagacgacaccugugaaugccaucgacgcugagaugcacgaucugaacuguagcuauaauaucugcccguacugugccucucgccucaccuccgacgggcuggcuagacaugucauucagugccccaaacggaaggaaaaaguggaggaaacagagcuuuaccugaaccucgaacgcaucccuuggguugugagaaagcugcuucaagucagcgagucuaccggaguggcccugaaacgguccagcuggcucauugugcugcugguccucuuuaccguuucccugucucccgugcagagcgcgccuaucggccaggggaagacaauugaggccuaucgcgcuagagaaggauacacguccaucugucuuuucgugcugggcagcauccucuuuauugucucuugccugaugaaagggcuuguggacuccguuggaaauagcuucuuucccggccugucuaucuguaagaccugcagcauuuccucuaucaacggcuucgagauugaaagccacaaguguuauugcucccucuuuugcuguccguacugccggcacuguagcacagauaaagagauccauaagcugcaccugucuauuugcaaaaagagaaaaaccggguccaaugugaugcucgccgucuguaagcgcaugugcuuccgggcuacaauggaagugagcaacagagcccuguucauccgcucuaucauuaauaccacguuuguucuuuguauccugauucucgcggugugcgucguguccacaagcgccgucgagauggagaaccugccugcuggaaccugggaacgggaggaagaccugaccaacuucugucaucaggagugccaagugacagaaaccgagugucuuugccccuaugaggcccucguucugagaaagccucuguuucucgauuccaucgcuaaaggcaugaagaaucugcuuaacucuacaagccuggaaacgucccucucuauugaggcccccuggggagccaucaaugugcagagcaccuacaaacccacagucuccaccgcuaacaucgcgcugagcuggucuuccguggaacaccgcgggaauaagauucugguuagcggccggucugaguccaucaugaaacuugaggaaagaacagggauuagcugggaccucggcguggaggaugccucugaaagcaagcugcugaccgucuccgugauggaccucagccagauguauucuccuguguucgaguaccuguccggagaucgccaaguugaagaguggccgaaggcuacgugcaccggcgacugucccgagcggugcggguguacaagcucuaccugccuucacaaagaauggccucauuccagaaacuggcgcuguaaucccacauggugcuggggagucggcaccggguguacgugcuguggacuggaugugaaggaccucuuuacagauuacauguucgugaaauggaaggucgaguauaucaaaaccgaagccauugugugcguugagcugacaagccaggaacggcaguguucccugaucgaggccggcaccagauuuaaccuugggccugugaccaucacacucucugagccccggaauauucagcaaaagcugccgccugaaaucauuacgcugcacccccgcaucgaggaaggcuucuuugaccucaugcauguccagaaggugcugagcgcuuccaccguuugcaaacuucagucuugcacacacggagugccuggcgaccugcaggucuaccauauugggaaccuccugaagggagauaaagugaauggccaccugauccacaagaucgagccccauuucaacaccagcuggauguccugggacgggugugaucuugacuauuacugcaauaugggagauuggccuagcuguacauauaccggcguuacgcaacacaaccaugccucuuuugugaaucuccugaacauugaaacagacuacaccaaaaacuuccacuuucacuccaagagagucaccgcgcauggggauacaccccagcuggaccucaaagcucggccgaccuauggcgccggagagaucacagugcugguggaggucgccgauauggaacuucacacgaagaagauugagaucagcggccugaaauucgcuucucuuaccugcacaggguguuacgccugcuccagcggaauuucuuguaagguuagaauccauguggacgaaccugaugagcugaccgugcacgucaaauccgacgaucccgacgugguugcugccagcuccagccugauggcgcgcaaacuugaguucggcacagacucuaccuuuaaggccuucagcgcuaugcccaagacgucccugugcuuuuacauuguggaacgggagcauuguaagucuugcaaugaagaggauaccaaaaagugugucaacacaaaacucgaacagccucagagcauccugaucgagcacaaggggaccauuaucggaaaacaaaauuccacaugcaccgccagagcuucuugcuggcucgagagcgugaaguccuucuuuuauggccugaagaacaugcuuucugggauuuucggcaauguuuuuaugggaaucuuccuguuucucgccccguucauucugcugauccuguuuuucauguuuggcuggcgcauccuuuucuguuucaaaugcuguagacggacacgcgggcucuuuaaguacagacaccugaaagacgaugaagagaccggauaucggcgcauuaucgaaagacucaacaauaagaaaggcaagaacaagcugcuugacggggagcggcuggcggaucgcagaauugccgaacucuucagcacgaaaacacauaucgga

SEQ ID NO: 13769 - RNA, 3495 nt, Artificial Sequence
  derived and/or modified CDS sequence (opt5) from CCHVF(CCHVF NIVA 118595)__JN572083.1__Gn-NSm-Gc
agcgaggaauccggcgacgauugcaucucuagaacccagcugcuccggacagagacggccgaagugcacggggacaacuacggaggccccggggauaagauuaccaucuguaauggaagcacagucguugaccaacgccugggcuccgagcuugggugcuauaccauuaacagagugaaaucuuucaagcugugugaaaauagcgcuacaggaaaauccugcgagaucgauucuauuccugugaagugucggcagggcuacugccucaaaaucacccaggagggccgcgggcaugucaagcugagcagaggauccgaagugguucuugacgccugugauagcucuugcgaggugaugaucccgaagggcacaggggacauucuggucgauuguuccggaggccagcaacacuuucucaaagacaaccugaucgaucuggggugccccaagauuccucuccugggaaaaauggcgaucuauauuugucggaugagcaaucaucccaagaccacgauggcuuuccuguuuugguucucuuuuggcuacgugauuaccugcauccuuugcaaaguuaucuucuaucuccugaucauuuuuggcacacuugggaagcgcuucaagcaguacagagaacugaaaccucagaccuguacaaucugcgagaccacgcccgugaacgccauugacgccgagaugcacgaucucaauuguuccuauaacaucugcccuuacugugcuagccggcugacaucugacggacuggcccgccaugucacccagugcccgaagagaaaagaaaagguggaggaaacagagcucuaccugaaucuugaacggauucccugggugguccgcaaacugcuccaaguuuccgagagcaccggcaucgcucugaagagauccucuuggcuuaucgugcugcucgugcuguuuaccgucagcauuacaccugugcaguccgcccccaucgggcacggaaaaacgauugaggcguaucgggcccgcgaagaguacaccagcaucugucuguucguucucggcucugugcuguuugucguguccugccuuaugaaggggcugguugacagcgugggaaacauuuucuuuccuggccucuucaucuguaagacaugcucuaucggcagcauuaauggguucgaaaucgagucccacaaauguuauugcucucuguuuugcugucccuacugcagacauuguagcgcugaucgggaaauucaccagcuucaucuguccaucugcaagaaaagaaagaccggaagcaacgucaugcucgccguguguaaacgcaugugcuuccggacaaccauggaggucucuaauaaggcucuguuugugagauccauuaucaacacgacauucguuguguguauucugauccucgccgucugcgugguuagcaccucugcgguggagauggaaucccugccggccggcaccugggagcgcgaagaggaccuuacaaauuuuugucaccaggaaugccaagucaccgagacagagugucugugcccuuaugaagcucucgugcugcggagaccccuguuccuugauagcaucgugaaggggaugaaaaaccuccugaacuccacgucucuggagaccagccucuccauugaagccccuuggggagcuaucaauguucagucuacauacaagcccaccgucagcgccgccaacauugcucuguccuggagcucuguggagcaccgcggcaauaaaauccuuguguccgggcggagcgagucuauuaugaagcuggaagagagaacaggcaucuccugggaccucggagucgaagaugcgagcgagucuaaacugcugaccgugagcguuauggaccuuucccagauguauagccccguguuugaauaccucucuggcgaucgccaagucgaggaguggccuaaggccacgugcaccggggacuguccggaacggugcggauguacauccagcacaugccugcauaaggaguggccccacuccagaaacuggcgcuguaauccuaccuggugcuggggcguggggaccggauguacgugcuguggccuggauguuaaagaccucuucacagauuacauguuugugaaguggaaagucgaauauaucaagaccgaggcuauugugugcguugaacugacaucucaggagcggcaguguagccuuaucgaggccgggaccagauucaaccugggcuccgugaccauuacacucucugaaccccggaauauccagcaaaaacugccucccgagauuaucacgcugcauccgcgcaucgaagagggauuuuucgaccuuaugcacguccagaaggugcucagcgccuccaccgugugcaagcugcagucuugcacacauggcgucccuggggaccugcagguuuaccacauuggaaaccuccugaaaggcgauagagugaaugggcaccuuauccauaagauugaacaacaccugaacaccagcuggauguccugggacggaugugaucucgacuauuacugcaauaugggcgauuggcccagcuguacauauaccggggugacgcagcauaaccacgcuucuuuugucaaucugcugaacaucgagacagacuacaccaaaaccuuccacuuccauuccaagcgggugacagcccacggcgauaccccucagcuugaccucaaagcgagacccacauauggagcuggcgagauuacgguucugguggaagucgccgauauggagcugcauaccaagaaaaucgaaaucagcgggcucaaguuugccucucuguccugcacaggauguuacgcuugcagcucuggcauuuccuguaaggugcgcauccacguugacgagccugaugagcuuaccgugcaugucaaaagcgacgaucccgacgugguugccgcuuccagcucucugauggcccggaagcucgaaagcgggacagacuccaccuucaaagcguuuucugccaugccgaagacgagccugugcuucuacauuguggagagagaauauuguaaaggaugcuccaaggaggauacccagaagugugucaauacaaaacuggaacaaccucagucuauccuuauugagcacaagggcaccaucauugggaaacagaacaacacaugcaccgcuaaggccagcugcuggcuggaguccgugaaaucuuucuuuuacggccucaagaauaugcugagcggaaucuuuggcaacguguuccucgggaucuuuuccuuccuggcucccuuuguccuucugauucucuucuuuauguucggauggcgcauccuguucuguuuuaagugcuguagacggacacgcggccuguucaaauauagacaccuuaaggacgaugaagagaccggguaccggaaaauuaucgaacgccugaauaacaagaaaggaaagaauaagcuccuggacggcgagagacucgccgaucggaaaauugcggaacuguuuagcacgaagacacauaucggc

SEQ ID NO: 13770 - RNA, 3495 nt, Artificial Sequence
  derived and/or modified CDS sequence (opt5) from CCHVF(CCHVF NIV 112143)__JN572085.1__Gn-NSm-Gc
agcgaggaauccggcgacgauugcaucucuagaacccagcugcuccggacagagacggccgaagugcacggggacaacuacggaggccccggggauaagauuaccaucuguaauggaagcacagucguugaccaacgccugggcuccgagcuugggugcuauaccauuaacagagugaaaucuuucaagcugugugaaaauagcgcuacaggaaaauccugcgagaucgauucuauuccugugaagugucggcagggcuacugccucaaaaucacccaggagggccgcgggcaugucaagcugagcagaggauccgaagugguucuugacgccugugauagcucuugcgaggugaugaucccgaagggcacaggggacauucuggucgauuguuccggaggccagcaacacuuucucaaagacaaccugaucgaucuggggugccccaagauuccucuccugggaaaaauggcgaucuauauuugucggaugagcaaucaucccaagaccacgauggcuuuccuuuucugguucucuuuuggcuacgugauuaccugcauccugugcaaaguuaucuucuaucuccugaucauuuuuggcacacuugggaagcgcuucaagcaguacagagaacugaaaccucagaccuguacaaucugcgagaccacgcccgugaacgccauugacgccgagaugcacgaucucaauuguuccuauaacaucugcccuuacugugcuagccggcugacaucugacggacuggcccgccaugucacccagugcccgaagagaaaagaaaagguggaggaaacagagcucuaccugaaucuugaacggauucccugggugguccgcaaacugcuccaaguuuccgagagcaccggcaucgcucugaagagauccucuuggcuuaucgugcugcucgugcuguuuaccgucagcauuacaccugugcaguccgcccccaucgggcacggaaaaacgauugaggcguaucgggcccgcgaagaguacaccagcaucugucuguucguucucggcucugugcuguuugucguguccugccuuaugaaggggcugguugacagcgugggaaacauuuucuuuccuggccucuucaucuguaagacaugcucuaucggcagcauuaauggguucgaaaucgagucccacaaauguuauugcucucuguuuugcugucccuacugcagacauuguagcgcugaucgggaaauucaccagcuucaucuguccaucugcaagaaaagaaagaccggaagcaacgucaugcucgccguguguaaacgcaugugcuuccgggcuacaauggaggucucuaauaaggcccuguuugugagauccauuaucaacaccacguucguuguguguauucugauccucgcgaucugcgucgugagcacaucugccguugagauggaaucccugccggcuggcaccugggagcgcgaagaggaccuuaccaauuuuugucaccaggaaugccaagugacagagaccgagugucugugcccuuaugaagcccucguccugcggagaccccuguuccuugauagcauugugaaggggaugaaaaaccuccugaacuccacaucucuggagacgagccucuccaucgaagcuccuuggggagccauuaaugugcagucuaccuacaagcccacaguuagcgccgcuaacaucgcgcuguccuggagcucugucgagcaccgcggcaauaaaauucuuguguccgggcggagcgagucuaucaugaagcuggaagagagaaccggcaucuccugggaccucggaguggaagaugccagcgagucuaaacugcugacagucagcgugauggaccuuucccagauguauagccccguuuuugaauaccucucuggcgaucgccaaguggaggaguggccuaaggcuaccugcacgggggacuguccggaacggugcggauguaccuccagcacaugccugcauaaggaguggccccacuccagaaacuggcgcuguaauccuaccuggugcuggggcgucgggacaggauguaccugcuguggccuggaugugaaagaccucuucacggauuacauguuuguuaaguggaaaguggaauauauuaagacagaggccaucgucugcguggaacugaccucucaggagcggcaguguagccuuauugaggccgggacaagauucaaccugggcuccguuaccaucacccucucugaaccccggaauauucagcaaaaacugccucccgagaucaucacacugcauccgcgcauugaagagggauuuuucgaccuuaugcacgugcagaagguccucagcgcuuccacggugugcaagcugcagucuugcacccauggcgugccuggggaccugcaggucuaccacaucggaaaccuccugaaaggcgauagaguuaaugggcaccuuauucauaagaucgaacaacaccugaacacaagcuggauguccugggacggaugugaucucgacuauuacugcaauaugggcgauuggcccagcuguaccuauacaggggugacccagcauaaccacgccucuuuugugaaucugcugaacauugagacggacuacacaaaaaccuuccacuuccauuccaagcgggucaccgcgcacggcgauacaccucagcuugaccucaaagcuagacccaccuauggagccggcgagaucacagugcugguugaaguggccgauauggagcugcauacgaagaaaaucgaaauuagcgggcucaaguuugcuucucuguccugcaccggauguuacgccugcagcucuggcaucuccuguaagguccgcauucacguggacgagccugaugagcuuacaguucaugugaaaagcgacgaucccgacgucguggcugccuccagcucucugauggcgcggaagcucgaauuugggaccgacagcacauuuaaagccuucuccgcuaugccgaagaccucucugugcuuuuacaucguugagagagaauauuguaaaggaugcagcaaggaggauacgcagaagugugugaauaccaaacuggaacaaccucaguccauucuuaucgagcacaagggcacaauuaucgggaaacagaacaauaccugcacagccaaggcuucuugcuggcuggagagcgucaaauccuucuuuuacggccucaagaacaugcugucuggaaucuucggcaacguguuucucgggauuuucagcuuucuggcccccuucgugcuucugauccucuuuuucauguucggauggcgcauucuguuuuguuucaagugcuguagacggacccgcggccuguuuaaauauagacaccuuaaggacgaugaagagacaggguaccggaaaaucauugaacgccugaauaacaagaaaggaaagaauaagcuccuggacggcgagagacucgcggaucggaaaaucgccgaacuguucuccaccaagacgcauaucggc

SEQ ID NO: 13771 - RNA, 3495 nt, Artificial Sequence
  derived and/or modified CDS sequence (opt5) from CCHVF(CCHVF SCT ex Afghanistan)__KC344856.1__Gn-NSm-Gc
agcgaggaauccggcgacgauugcaucucuagaacccagcugcuccggacagagacggccgaagugcacaacgacaauuacgggggacccggcgauaagauuaccaucuguaacgggagcacaauugucgaccaacgccugggauccgagcuuggcugcuauaccaucaauagaguuaaaucuuucaagcugugugaaaacagcgcuacagggaaauccugcaagauugauucuaccccugugaaaugucggcagggauuuugccucaagaucacacaggagggccgcggccaugugaagcugagcagaggguccgaggucgugcuugacgccugugauagcucuugcgaaaucaugauuccgaaaggaaccggcgacauccugguugauuguuccgggggacagcaacacuuccucaaggacaaucugauugaucugggcugccccaacaucccucuccuggggaaaauggcgauuuacaucugucggaugagcaaucaucccaagacgaccauggcuuuucuuuucugguuuucuuucggauaugugauuacaugcaucuuuugcaaagucaucuucuaccugcucauugugguuggcacccugggcaagaaguuuaaacaguaucgcgagcuuaagccucagacauguaccaucugcgaaacgacacccaccaacgccauugacgccgagaugcacgaucugaauuguuccuacaacaucugcccuuauugugcuagcagacucacaucugacgggcuggcccggcaugugacccagugcccgaaacgcaaggagaaagucgaagagaccgaacuguaccucaaucuggagcggauucccuggaucgugcggaaacuucugcaaguguccgaaagcacaggagucgcucucaaacgcuccucuuggcugaucguucuucuggugcuccugacggugagccuguccccuguccagagcgcccccauuggccacgggaagaccaucgagacauaccagaccagagagggauauauuucugugugucucuucguucugggcgggauccuuuuuguggucuccugccugauuaagggacucguggacagcguuggcaacucuuucuuuccuggccugagcaucuguaaaacaugcuccaucgggucugugaauggauucgaaauugagagccacaaguguuacugcucccuucugugcugucccuauugccggcauuguagcaccgaucgcgaaauccaccagcuccaucugucuauuugcaaaaagagacggacgggcgggaacgucaugcuggcgguguguaaaagaaugugcuuccgcgccacaauggaggucuccaauaaggugcucuuuauccggaacauuaucaacaccaccuucguuauuuguauccugauccuugcugugugcgucgugagcacaucugccguugaaauggagucccugccggcuggaaccugggagagagaagaggaccucacaaauuuuugucaccaagaaugccaggugacggagaccgaaugucugugcccuuacgaggcccugguccuucgcaagccccucuuccugaacagcauugugaaaggcaugaagaaucugcucaacuccacaaaucuggagaccucucuuagcaucgaagcgccuuggggcgccauuaacgugcaguccacauuuaaacccaccguuucuacggcuaauaucgcccugagcugguccagcgucgagcaccgggggaacaagauucucgugucuggaagauccgaaagcaucaugaaacuggaggagcgcaccggcaucucuugggaucuggggguggaagacgcuuccgagagcaagucucuuacagucagcgugauggaucucucccaaauguauagccccguuuucgaauaccugucuggagacagacagguggaggaauggccuaaggcuaccugcacaggcgauuguccggagagaugcggguguaccuccagcacgugccugcauaaagaguggccccacucccgcaauuggcgguguaacccuacauggugcuggggagucggcaccggguguacaugcuguggccucgacgugaaggaucuguuuaccgacuauauguucguuaaauggaagguggaauacauuaaaaccgaggccaucgucugcguggaacuuacaucucaggagagacaguguagccugauugaagccggaacgcgcuuuaaucucggccccguuaccaucacacuguccgagccucggaacauucaacagaagcugcccccggagaucaucacccuucauccuagaauugaagagggguucuuugaucucaugcacgugcagaagguccugucugcgagcacagugugcaaacugcaguccugcacccauggagugcccggcgaccuccaagucuaccacaucgggaaucugcuuaagggagacaaacugaacggccacaugauucauaagaucgaaccucacuucaauacgucuuggaugagcugggaugggugugaccucgauuauuacugcaacaugggcgacuggcccuccuguacauauaccggaguuacccagcauaaccacgccgcuuuugugaaucugcugaacauugagacagauuacaccaaaaauuuccacuuccauagcaagcgggugacagcccacggcgacacgccucagcuugaucucaaagcccgccccaccuauggggcuggagaaaucacaguccugguggagguugccgacauggagcugcauaccaagaagaucgauauuucuggccucaaauuugcgucccugacaugcgcuggguguuacgccugcagcucuggaaucuccuguaaggugcggauucacgucgacgaaccggaugagcuuaccgugcauguuaaaagcgaagacccugauaucguggccgcuucuacgucccugauugccagaaagcucgagcugggcaccgacagcacauucaaggcuuuuuccgccaugcccaagaccagccugugcuucuauaucgucgagagagaauacuguaagucuugcagcaaagaggacacacagaagugugugaacaccaaacuugaacacccccaagggauucugaucgagcacaagggcacaaucauuggaaaacagaaugauaccugcacggcgaaggccggcugcuggcucgaauccguuaagagcuuuuucuacgggcugaaaaacaugcucucuggaaucuuuggcaauguguucauugggaucuuucuguuccuugcuccuuuuguccugcucauucuguucuuuauguucggauggcgccugcuuuucuguuuuaagugcugucggagaacacgcggccuguucaaauauagacaucucaaggaggacgaggaauccggcuaccggcgcaucaucgagagacugaacaauaaaaaggggaagaacaaacuccuggauggagaacggcuugccgaccgcagaauugcugagcuguuuucuaccaagacccacaucggc

SEQ ID NO: 13772 - RNA, 3495 nt, Artificial Sequence
  derived and/or modified CDS sequence (opt5) from CCHVF(CCHVF Zahedan 2007)__KC867273.1__Gn-NSm-Gc
agcgaggaauccggcgacgauugcaucucuagaacccagcugcuccggacagagacggccgaagugcacggggacaacuacggaggccccggggauaagauuaccaucuguaauggaagcacagucguugaccaacgccugggcuccgagcuugggugcuauaccauuaacagagugcggucuuucaaacugugugaaaauagcgcuacaggaaaguccugcgagaucgauucuauuccugugaaauguaagcagggcuuuugccucaaaaucacccaggagggccgcgggcaugucaagcugagcagaggauccgaagugguucuugacgugugugauagcucuugcgaggucaugaucccgaagggcacaggggacauucugguggauuguuccggaggccagcaacacuuccucaaagacaaccugguugaucuggggugccccaagaucccucuccugggaaaaauggccauuuacaucugucggaugagcaaucaucccaagaccacgauggcguuucuuuucugguuuucuuucggcuaugugauuaccugcauccugugcaaagcuaucuuuuuccuccugauuaucuuuggcacacuugggaagcgcuucaagcaguacagagaacugaaaccucagaccuguacaauuugcgagaccacgcccgucaacgccaucgacgccgagaugcacgaucucaauuguuccuauaacauuugcccuuacugugcuagccggcugacaucugacggacuggcccgccaugugacccagugcccgagacggaaggaaaaaguggaggaaacagagcucuaucugaaucuugaacgcauccccugggucguuagaaagcugcuccaaguguccgagagcaccggcaccgugcugaaacgguccucuuggcuuauuguccugcucgugcuguuuacaguuagccuguccccugugcagagcgcucccaucgggcacggaaagacgaucgagaccuaccgcgucagagaagaguacacaucuauuugucucuucgugcugggcuccauccuuuuuauuguuagcuuccugaugaaagggcucguggacggagucggcaacaucuucuuuccuggccugucugugugcaagaccuguagcauuggguccaucaauggauucgaaaucgagucucaccggugcuauuguagccuguuuugcugccccuacuguagacauugcuccgccgauggcgaaauucaccagcuucaucucagcaucuguaagaaacgcaagacagggucuaacgucaugcuggcggugugcaaacggauguguuucagagccaccauggagguuuccaauaaggugcuguuuauucgcagcaucauuaacacgacauucgucgugugcauccucauucuggcuguuuguguggucucuaccuccgccguggagauggaaagccuuccggcuggaaccugggagcgggaagaggaccugacaaauuuuugccaccaggaaugucaagugaccgagacagagugccucuguccuuaugaagcccugguucugagacgcccccuuuuccucgauuccaucgucaaagacaugaagaaccugcugaacucuacgagccucgagaccucccugucuaucgaagcgccuuggggcgccauuaaugugcagagcacauacaagcccaccguguccacagcuaacaucgcccuuagcuggucuuccgucgagcaccgggggaauaaagugcugguuagcggcagaucugaguccauuaugaagcucgaggaacgcaccggaaucagcugggaucugggcguggaagacgcuucugagagcaaacugcuuacggucuccgugauggaucucagccagauguauucucccguuuuugaauaccuguccggggaccggcaaguggaggaguggccuaaggccacaugcacaggagauugcccggaaagauguggcugcaccagcuccacaugucugcauaaagaguggccccacucucgcaacuggcggugcaauccuaccugguguuggggagucgggacgggcugcacauguugcgggcucgacgugaaggaucuguucaccgacuauauguuuguuaaguggaaaguggaauacauuaagacagaggccaucgucuguguggaacuuaccagccaggagagacagugcucccugaucgaggcuggcacccgguucaaccucggaucugugacaauuacgcugagcgaaccccgcaauauccagcaaaaacugccucccgagauuaucacccuucauccgaagauugaagagggcuuuuucgaccucaugcacguccagaaaguucuguccgcgucuacaguguguaagcugcagagcugcacccauggggugccuggagaucuccaggucuaccacaucggcaaccugcuuaagggggacagagugaauggacaccugauccauaaaauugaacaacacuucaacacauccuggaugagcugggauggcugcgaccucgauuauuacuguaauaugggggacuggcccucuugcaccuauacgggcguuacacagcauaaccacgccuccuuugugaaucugcugaacaucgagaccgauuacaccaagacauuccacuuucauagcaaacgggucaccgcucacggagacacaccucagcuugaucucaaggccagacccacguauggcgccggggagauuaccgugcugguugaaguggcugacauggagcugcauaccaaaaagaucgaaauuucuggacucaaauucgccggccugaccuguacagggugcuacgcguguuccagcggaaucucuugcaagguccgcauccacguggaugagccugacgagcuuaccguucaugugaaguccgaugaccccgacgucguggcugccagcuccagccugauggcccggaaacucgaauuuggcacggauucuaccuucaaggcuuuuagcgccaugccgaaaacaucccuguguuucuauauuguggagagagaauacugcaagucuuguagcaaagaggacacccagaagugcgucaauacaaagcuggaacaaccucaguccauccuuauugagcacaaagggaccaucauuggcaagcagaacaacacauguaccgcuaaagccucuugcuggcuggagagcguuaaguccuuuuucuacggacucaaaaauaugcugggcgggaucuuuggaaacguguucauuggcaucuuuacguuccucacacccuucauccugcuuaucuuuuucuuuauguucggguggcgcauucuguuuugcuucaaguguugcagacggacccgcggacucuuuaaguauagacaccugaaagaugacgaagagaccggcuaccggaagauuaucgaacgccugaauaacaaaaagggcaaaaauagacuucuggauggggagcggcucgcggaccgcaagauugccgaacuguucucuacaaagacccauaucgga

SEQ ID NO: 13773 - RNA, 3495 nt, Artificial Sequence
  derived and/or modified CDS sequence (opt5) from CCHVF(CCHVF SPU 44/08)__KJ682805.1__Gn-NSm-Gc
agcgaggaauccaacgacgauugccugucuagaacccagcuccugcggacagagaaugccgaaauccacagcgacaacuacggcgggcccggagauaagauuacgaucuguaauggcuccaccauuguggaccaacgccuugggucugagcugggaugcuauacaaucaacagagucaaaucuuucaagcucugugaaaauuccgcuaccggcaaaucuugcgagauugauagcacaccuguucggugucgccagggguuuugccugaagaucacccaggagggaagaggccaugugaaacuuucccggggcagcgaagugguccuggacgccugugauucuuccugcgagaucaugauuccgaaggggacaggagacauccucguggauuguagcggcgggcagcaacacuuccugaaggacaaccugguugaucucggaugccccaauauuccucugcuuggcaaaauggcgaucuacauuugucgcaugucuaaccaucccaagaccacgauggcuuuucuguucugguuuuccuucggguaugugauuaccugcauccucugcaaagccaucuuuuaccugcuuaucgucgugggaacacugggcaagaaauucaagcaguauagagaacucaagccucagaccuguacaauuugcgagaccaaucccguuaacgccaucgacgcugagaugcacgaucugaauuguagcuacaacauuugcccuuauugugccucucggcugacguccgacggccucgcucgccaugugaugcagugcccgaaaagaaaggagaaaaucgaagaaacagagcuguaccuuaaucuggaacggauucccugggucgugcgcaagcuccugcaagugagcgaguccaccggggucgcccuuaaaagaucuagcuggcugguuauccuccuggugcugcucacagugucccugagcccuguccagucugcgcccaucucccacggagagaccguggaaguuuaccagacccgggagggcuauacaagcauuugucuuuuugugcuggggucuauccucuuccuggucagcugccuuaugcgcggacugguggacuccguuucuaacagcuuuuucccuggccucuccauuuguaagacgugcagcaucgggucuauuaauggauuugaaaucgagucccacaaauguuacugcagccuguucugcugucccuauugcagacauuguucugccgauaucgaaauucacaagcugcaucucuccaucugcaagaaacggaagaccggcagcaacgugaugcuggcugucuguaaaagaaugugcuuccgcgccacaguggaggucuccaacaaggcccuucugauucggaauaucauuaacaccacauuugugguuuguauccucauucuggccgugugcgucgugucuaccagcgcgguugagauggaaaaucugccggccggcacgugggagaaagaagaggaccuuacaaacuucugucaccaggaaugccaagugaccgagaccgagugucucugcccuuacgaagcucugguccugagaaagccccucuuucuggauuccaucgugaaggggaugaaaaaucuucugaacucuacaagccucgagaccucccugagcaucgaagccccuuggggagcuauuaaugugcagucuacauucaagcccacgguuuccgccgccaacaucgcucugagcuggucuuccgucgagcaccgcggcaauaaaauucuugugagcgggcggucugagagcaucaugaagcucgaagagagaaccggaauuuccugggaccugggcguggaagaugcgagcgagucuaaacugcucacagucuccgugauggaccugagccagauguauucccccguuuuugaauaccuuucuggggaucgccaaguggaggaguggccuaaggcuaccugcacaggcgacuguccggaacggugcggauguaccagcuccacgugccugcauaaggaguggccccacucuagaaacuggcgcuguaauccuaccuggugcuggggcgucgggacaggauguaccugcuguggccucgaugugaaagaccuguucacagauuauauguuuguuaaguggaaaguggacuacaucaagaccgaagcuaucgucugcguggagcugacgagccaggaacggcaguguucccuuauugaggccgggacaagauucaaccucggacccguuaccaucacacugucugagccucgcaauauucagcaaaaacugcccccggaaaucgugacccuccauccucggauugaggaaggcuuuuucgaccugaugcacauccagaagguccuuagcgccuccaccgugugcaagcugcagagcugcacacauggggugcccggcgaucuccagaucuaccacauuggaaaccugcugaaaggcgacaaggucaaugggcaccuuauccauaaaauugagccucacuuuaacacgucuuggauguccugggauggaugugaccucgauuauuacugcaacaugggcgacuggcccagcuguucuuauaccgggguuacacaacauaaucacgcugccuucgugaacaugcugaauaucgaaaccgauuacacaaagaacuuucacuuccauuccaaaagagugaccgcgcacggagacacgccucagcuggaucucaaggcucggcccacauauggcgccggggagauuaccguccugguggagguugccgacauggaacuucauaccaaaaagaucgagaucagcggccugaaguucgcuucucucacaugcaccggauguuacgccugcuccagcggcauuuccuguaaagugcgcauccacgucgaugaaccggacgagcugacagugcauguuaagagcgaggauccugacauuguggcugccucuagcucccugauggcgagaaaacuugaauuugggacggacucuaccuucaaggccuuuagcgcuaugcccaaaacaucccugugcuucuauaucgucgagcgggaauacuguaagucuugcagcaaggaggauacccagaaaugugugaauacaaagcucgaacagccccaauccauucugaucgagcacaaaggaaccauuaucggcaagcagaacgacacgugcaccgccaaagcuagcugcuggcucgagagcaucaaguccuuuuucuacgggcugaagaauaugcuuagcggaauuuuuggcaacguuuucaucgggauuuuucuguuccucgccccuuuuaucaugcugauucuguucuuuauguucggcuggagaauccuuuucuguuuuaaaugcugucgccggacaagaggacuguucaaguaucgccaccucaaagaugacgaagagaucggcuacagaaagauuaucgaacggcugaauaacaaaaaggggaagaauaaacuccuggauggagagcgccuugcggacagaaagauugccgaacuguuuucuaccaaaacacauaucggc

SEQ ID NO: 13774 - RNA, 3495 nt, Artificial Sequence
  derived and/or modified CDS sequence (opt5) from CCHVF(CCHVF SPU 383/87)__KJ682806.1__Gn-NSm-Gc
agcgaggaauccaacgacgauugccugucuagaacccagcuccugcggacagagaaugccgaaauccacagcgacaacuacggcgggcccggagauaagauuacgaucuguaauggcuccaccauuguggaccaacgccuugggucugagcugggaugcuauacaaucaacagagucaaaucuuucaagcucugugaaaauuccgcuaccggcaaaucuugcgagauugauagcacaccuguucggugucgccagggguuuugccugaagaucacccaggagggaagaggccaugugaaacuuucccggggcagcgaagugguccuggacgccugugauucuuccugcgagaucaugauuccgaaggggacaggagacauccucguggauuguagcggcgggcagcaacacuuccugaaggacaaccugguugaucucggaugccccaauauuccucugcuuggcaaaauggcgaucuacauuugucgcaugucuaaccaucccaagaccacgauggcuuuucuguucugguuuuccuucggguaugugauuaccugcauucucugcaaagucaucuuuuaccugcuugugguugugggaacacugggcaagaaauucaagcaguauagagaacucaagccucagaccuguacaaucugcgagaccaaucccgucaacgccauugacgccgagaugcacgaucugaauuguagcuacaacaucugcccuuauugugcuucucggcugacguccgacggccucgcccgccaugugauucagugcccgaaaagaaaggagaaaaucgaagaaacagagcuguaccuuaaucuggaacggauucccugggugguccgcaagcuccugcaaguuagcgaguccaccgggguggcucuuaaaagaucuagcuggcuggugauccuccugguccugcucacagugucccugagcccuguucagucugcccccaucucccacggagagaccguggaagucuaccagacccgggagggcuauacaagcauuugucuuuuugugcuggggucuauccucuuccugguuagcugccuuaugaagggacugguggacuccgucggcaacagcuuuuucccugggcucagcauuuguaaaacgugcuccaucggaagcauuaauggcuuugaaaucgagucucacaaguguuacugcucccuguucugcugucccuauugccgccauuguagcgcggauaucgaaauucacagacugcaucucucuaucugcaagaaacggaagaccggcuccaacgugaugcuggccgucuguaaaagaaugugcuuccgcgcuacaguggagguuagcaacaaggcccuucugauucggaauaucauuaacaccacauuuguggucuguauccucauucuggcugugugcguuguguccaccucugccgucgagauggaaaaucugccggcggggacgugggagaaagaagaggaccuuacaaacuucugucaccaggaaugccaagugaccgagaccgagugucucugcccuuacgaagcccuggugcugagaaagccccucuuucuggauagcaucguuaagggaaugaaaaaucuucugaacuccacaucucucgagaccagccuguccaucgaagcuccuuggggcgccauuaauguccagagcacauucaagcccacggugucugcugccaacaucgcccuguccuggagcucuguggagcaccgcgggaauaaaauucuugucuccggacggagcgagucuaucaugaagcucgaagagagaaccggcauuagcugggaccuggggguggaagaugcuuccgagagcaaacugcucacaguuucugugauggaccugucccagauguauagccccgucuuugaauaccuuuccggcgaucgccaaguggaggaguggccuaaggcgaccugcacaggagacuguccggaacggugcggcuguaccucuagcacgugccugcauaaggaguggccccacuccagaaacuggcgcuguaauccuaccuggugcuggggaguugggacaggcuguaccugcugugggcucgaugugaaagaccuguucacagauuauauguuugucaaguggaaaguggacuacaucaagaccgaagccaucguuugcguggagcugacgucucaggaacggcaguguagccuuauugaggcuggaacaagauucaaccucggccccgucaccaucacacuguccgagccucgcaauauucagcaaaaacugcccccggaaaucgugacccuccauccucggauugaggaaggguuuuucgaccugaugcacauccagaaggugcuuucugccagcaccgucugcaagcugcaguccugcacacauggcguucccggagaucuccagaucuaccacauuggcaaccugcugaaaggggacaaggugaauggacaccuuauccauaaaauugagccucacuuuaacacgagcuggaugucuugggauggcugugaccucgauuauuacugcaacaugggggacuggcccuccuguagcuauaccggagugacacaacauaaucacgccgcuuucgucaacaugcugaauaucgaaaccgauuacacaaagaacuuucacuuccauucuaaaagagugaccgcccacggcgacacgccucagcuggaucucaaggcgcggcccacauauggggcuggcgagauuaccguucugguggaggucgccgacauggaacuucauaccaaaaagaucgagaucuccggacugaaguucgccagccucacaugcaccggcuguuacgcuuguucuuccgggauuagcugcaaagugcgcauccacguugaugaaccggacgagcugacagugcaugucaaguccgaggauccugacauuguggccgcuagcucuagccugauggccagaaaacuugaauuuggaacggacuccaccuucaaggcguuuucugccaugcccaaaacaagccugugcuucuauaucguugagcgggaauacuguaaguccugcucuaaggaggauacccagaaaugugugaauacaaagcucgaacagccccaaagcauucugaucgagcacaaaggcaccauuuuugggaagcagaacgacacgugcaccgcuaaagccuccugcuggcucgagucugucaagagcuucuuuuacggacugaagaauaugcuuuccggcaucuucgggaacguguuuaucggcguguuccuguuucucgcuccuuucauuaugcugauccuguuuuucauguucggauggagaauccuguuuuguuucaaaugcugucgccggacaagaggccuuuuuaaguaucgccaccucaaagaugacgaagagaucggguacagaaagauuaucgaacggcugaauaacaaaaagggaaagaauaaacuccuggauggcgagcgccuugccgacagaaagaucgcggaacuguucagcaccaaaacacauauuggg

SEQ ID NO: 13775 - RNA, 3495 nt, Artificial Sequence
  derived and/or modified CDS sequence (opt5) from CCHVF(CCHVF SPU 130/89)__KJ682807.1__Gn-NSm-Gc
agcgaggaacccaacuacgacugccuguccagaacccagcuccugcggacagagaaugccgaaauccacucugauaacuauggcgggccuggagacaagauuacgaucuguaauggcagcaccauuguggaucaacgccuuggguccgagcugggaugcuacacaaucaacagagucaaaucuuucaagcucugugaaaauagcgcuaccggcaaauccugcgagauugacucuacaccgguucggugucgccagggguuuugccugaagaucacccaggagggaagaggccaugugaaacuuagccggggcuccgaagugguccuggaugccugugacagcucuugcgagaucaugauucccaaggggacaggagauauccucguggacuguuccggcgggcagcaacacuuccugaaggauaaccugguugaccucggaugcccuaauauuccccugcuuggcaaaauggcgaucuauauuugucgcaugagcaaccauccuaagaccacgauggcuuuucuguucugguuuucuuucggguacgugaucacaugcauucucugcaaagucaucuuuuaucugcuuaucgugguuggaacacugggcaagaaauucaagcaguacagagaacucaagccccagaccuguacaauuugcgagaccaauccugugaacgccaucgaugccgagaugcacgaccugaauuguuccuauaacauuugcccguacugugcuagccggcugacgucugauggccucgcccgccaugucaugcagugccccaaaagaaaggaaaagaucgaggaaacagagcuguaccuuaaucuggaacggauuccuuggguggugcgcaagcuccugcaagucuccgagagcaccgggguugcucuuaaaagauccucuuggcugguggugcuccugguccugcucacagugagccugucccccguucagagcgccccuaucucucacggagagaccguggaagucuaucagacccgggagggcuacacauccaucugucuuuuugugcuggggagcauucucuuccugguuucuugccuuaugaagggacugguggacagcgucggcaacuccuuuuuccccgggcucucuaucuguaaaacgugcagcauuggauccaucaauggcuuugaaauugagagccacaaguguuauugcucucuguucugcuguccguacugccgccauuguuccgcggacaucgaaauccacaagcugcaucucagcauuugcaaaaagagaaaaaccggcucuaacgugaugcuggccgucuguaagcggaugugcuucagagcuacaguggagguuuccaacaaagcccuucugauccgcaauauuaucaacaccacauuuguggucuguauucucauccuggcugugugcguugugagcaccuccgccgucgagauggaaaaucugccugcggggacgugggagaaggaagaggaucuuacaaacuucugucaccaggaaugccaagugaccgagaccgagugucucugccccuaugaagcccuggugcugcggaagccucucucucuggacagcauuguuaaaggaaugaagaaucuucugaacuccacaucucucgagaccagccuguccaucgaagcucccuggggcgccaucaauguccagagcacauuuaaacccacggugucugcugccaacauugcccuguccuggagcucuguggagcacagagggaauaagauccuugucuccggacgcagcgagucuauuaugaaacucgaagaacggaccggcaucagcugggaucuggggguggaagacgcuuccgagagcaagcugcucacaguuucugugauggaucugucccagauguacagcccugucuucgaauaucuuuccggcgacagacaaguggaggaguggccgaaggcgaccugcacaggagauugucccgaacgcugcggcuguaccucuagcacgugccugcauaaagaguggccucacucccggaacuggagauguaaucccaccuggugcuggggaguugggacaggcuguaccugcugugggcucgacgugaaggaucuguuuacagacuacauguucgucaaauggaagguggauuacauuaaaaccgaagccaucguuugcguggagcugacgucucaggaacgccaguguagccuuaucgaggcuggaacacgguuuaaccucggcccugucaccauuacacuguccgagcccagaaauauccagcaaaagcugccgccugaaauugugacccuccauccccgcaucgaggaaggguucuuugaccugaugcacauucagaaggugcuuucugccagcaccgucugcaaacugcaguccugcacacauggcguuccuggagaccuccagaucuaucacaucggcaaccugcugaagggggauaaagugaauggacaccuuauucauaagaucgagccccacuucaacacgagcuggaugucuugggacggcugugaucucgacuacuauugcaacaugggggauuggccuuccuguagcuacaccggagugacacaacauaaucacgccgcuuuugucaacaugcugaauauugaaaccgacuauaccaaaaacuuccacuuucauucuaagcgggugaccgcccacggcgauacgccccagcuggaccucaaagcgagaccgacauacggggcuggcgagaucaccguucugguggaggucgccgauauggaacuucauaccaagaagguggagauuuccggacugaaauucgccagccucacaugcaccggcuguuaugcuuguucuuccgggaucagcugcaagguucggauccacguggacgaaccugaugagcugacaguccaugugaaauccgaggaccccgauauuguugccgcuagcucuagccugauggcccgcaaacuugaguucggaacggacuccaccuuuaaagcguucucugccaugcccaagacaagccugugcuuuuacaucguggagagagaacacuguaaguccugcucuaaagaggacacccagcggugugucaauacaaagcucgaacagccucaaagcauucugaucgagcacaaaggcaccauuaucgggaagcagaacgauacgugcaccgcuaaagccuccugcuggcucgagucuauuaagagcuucuuuuacggacugaagaauaugcuuuccggcaucuucgggaacguguuuaucggcguguuccuguuucucgcuccguucauuauccugauucuguuuuucauguuuggauggagaauccuuuucuguuucaaaugcugucgccggacaagaggccugcucaaguaucgccaucugaaagacgaugaagagauuggguacagaaagaucaucgaacggcucaauaacaaaaagggaaagaauaaacugcuugacggcgagcgccuggccgauagaaagauugcggaacucuuuagcaccaaaacacacaucggg

SEQ ID NO: 13776 - RNA, 3495 nt, Artificial Sequence
  derived and/or modified CDS sequence (opt5) from CCHVF(CCHVF SPU 497/88)__KJ682808.1__Gn-NSm-Gc
agcgaggaauccaacgacgauugccugucuagaacccagcuccugcggacagagaaugccgaaauccacagcgacaacuacggcgggcccggagauaagauuacgaucuguaauggcuccaccauuguggaccaacgccuugggucugagcugggaugcuauacaaucaacagagucaaaucuuucaagcucugugaaaauuccgcuaccggcaaaucuugcgagauugauagcacaccuguucggugucgccagggguuuugccugaagaucacccaggagggaaaaggccaugugaagcuguccagaggcagcgaagugguccuggacgccugugauucuuccugcgagaucaugauuccgaaggggacaggagacauccucguggauuguagcggcgggcagcaacacuuccugaaagacaaccugguugaucucggaugccccaauauuccucugcuuggcaagauggcgaucuacauuugucggaugucuaaccaucccaaaaccacgaugguguuucuguucugguuuuccuucggguaugucauuaccugcauucucugcaaggugaucuuuuaccugcuuaucguugugggaacacugggcaaaaaguucaagcaguaucgcgaacucaaaccucagaccuguacaauuugcgagaccaaucccgucaacgcuaucgacgccgagaugcacgaucugaauuguagcuacaacauuugcccuuauugugccucuagacugacguccgacggccucgcucggcaugugaugcagugcccgaagcgcaaagaaaagaucgaggaaacagagcuguaccuuaaucuggaaagaauccccugggugguccggaaacuccugcaaguuagcgaguccaccgggguggcccuuaagcgcucuagcuggcuggugauccuccugguccugcucacagugucccugagcccuguucagucugcucccaucucccacggagagaccguggaagucuaccagaccagagagggcuauacaagcauuugucuuuuugugcuugggggaauccucuuccugguuucuugccuuaugaaaggccugguggacagcgucgggaacuccuuuuucccuggacucucuauuuguaagacgugcagcaucggcuccauuaauggcuuugaaaucgagagccacaaguguuacugcucucuguucugcugucccuauugccggcauuguuccgccgauaucgaaauucacaaacugcaucucagcaucugcaagaaacgcaagaccuggucuaacgugaugcuggcggucuguaaaagaaugugcuuccgggccacaguggagguuuccaacaaggcccuucugauuagaaauaucauuaacaccacauuuguggucuguauccucauucuggcuaucugcgugguuagcaccuccgcuguggagauggaaaaucugccggccgggacgugggagaaggaagaggaccuuacaaacuucugucaccaggaaugccaagucaccgagaccgagugucucugcccuuacgaagcgcuggugcugcgcaaaccccucuuucuggauucuaucgugaagggaaugcggaaucuucugaacagcacaucccucgagaccucucugagcauugaagccccuuggggcgcuaucaauguucaguccacauucaaacccacggucagcgccgcuaacauugcccugucuugguccagcguggagcacagagggaauaagauccuugugucuggacgcuccgagagcauuaugaaacucgaggaacggaccggcaucucuugggaccugggggucgaagaugccagcgaguccaagcugcucacagugagcguuauggaccugucucagauguauucccccguguuugaauaccuuagcggcgauagacaagucgaggaguggccuaaggcuaccugcacaggagacuguccggaacgcugcggcuguaccuccucuacgugccugcauaaagaguggccccacagccggaacuggagauguaauccuaccuggugcuggggaguggggacaggcuguaccugcugugggcucgauguuaaggaccuguucacagauuauauguuugugaaauggaaggucgacuacaucaaaaccgaagcgauugugugcguugagcugacgucccaggaacgccaguguucucuuaucgaggccggaacacgguucaaccucggccccgugaccauuacacugagcgagccuagaaauauccagcaaaagcugcccccggaaauugucacccuccauccucgcaucgaggaaggguuuuucgaccugaugcacauccagaaggugcuuuccgcuucuaccgugugcaaacugcagagcugcacacauggcguccccggagaucuccagauuuaccacaucggcaaccugcugaagggggacaaaguuaauggacaccuuauucauaagaucgagccucacuuuaacacguccuggaugagcugggauggcugugaccucgauuauuacugcaacaugggggacuggcccucuuguuccuauaccggagugacacaacauaaucacgccgccuucgugaacaugcugaauauugaaaccgauuacacaaagaacuuucacuuccauagcaagcgggucaccgcucacggcgacacgccucagcuggaucucaaagccagacccacauauggggcgggcgagaucaccgugcugguugagguggcugacauggaacuucauaccaagaagaucgagauuucuggacugaaauucgccucccucacaugcaccggcuguuacgccugcagcucugggaucuccuguaagguccggauucacguggaugaaccggacgagcugacaguucaugugaaaagcgaggauccugacaucgucgcugccuccagcucucugauggcucgcaaacuugaauuuggaacggacagcaccuucaaagccuuuuccgcgaugcccaagacaucucugugcuucuauauuguggagagagaauacuguaagagcugcuccaaagaggauacccagaaguguguuaauacaaaacucgaacagccccaaucuauccugauugagcacaagggcaccaucaucgggaaacagaacgacacgugcaccgcccgggcuagcugcuggcucgaguccauuaagagcuuuuucuacggacugaagaauaugcuuagcggcaucuuugggaacguguucauuggcaucuuucuguucuuugccccuuucauuaugcucauccuguuuuucauguucggauggagaauccuguuuuguuucaaaugcugucgccggacaagaggccuuuuuaaguaucgccaccugaaagaugacgaagaggucggguacagaaagauuaucgaacggcucaauaacaaaaagggaaagaauaaacugcucgauggcgagcgccuggcugacagaaagauugccgaacuuuucuccaccaaaacacauaucggg

SEQ ID NO: 13777 - RNA, 3495 nt, Artificial Sequence
  derived and/or modified CDS sequence (opt5) from CCHVF(CCHVF SPU 18/88)__KJ682810.1__Gn-NSm-Gc
agcgaggaauccaacgacgauugccugucuagaacccagcuccugcggacagagaaugccgaaauccacagcgacaacuacggcgggcccggagauaagauuacgaucuguaauggcuccaccauuguggaccaacgccuugggucugagcugggaugcuauacaaucaacagagucaagagcuucaaacucugugaaaauuccgcuaccggcaaaucuugcgagauugauagcacaccuguucggugucgccagggguuuugccugaagaucacccaggagggaagaggccaugugaaacuuucccggggcagcgaagugguccuggacgccugugauucuuccugcgagaucaugauuccgaaggggacaggagacauccucguggauuguagcggcgggcagcaacacuuccugaaggacaaccugguugaucucggaugccccaauauuccucugcuuggcaaaauggcgaucuacauuugucgcaugucuaaccaucccaagaccacgaugggguuucuguucugguuuuccuucggauaugugauuaccugcauccucugcaaagucaucuuuuaccugcuuaucgugguuggcacacugggcaagaaauucaagcaguauagagaacucaagccucagaccuguacaauuugcgagaccaaucccgugaacgcuaucgacgccgagaugcacgaucugaauuguagcuacaacauuugcccuuauugugccucucggcugacguccgacgggcucgcucgccaugucaugcagugcccgaaaagaaaggagaaaaucgaggaaacagagcuguaccuuaaucuggaacggauucccuggguggugcgcaagcuccugcaagucagcgaguccaccggaguugcccuuaaaagaucuagcuggcuggugauccuccuggugcugcucacagucucccugagcccugugcagucugcucccaucucccacggcgagaccguugaaguguaccagacccgggagggguauacaagcauuugucuuuuuguccugggaucuauccucuuccuggugagcugccuuaugaagggccugguugacuccguggggaacucuuuuagcccuggacucuccauuuguaaaacgugcagcaucggcucuauuaauggcuucgaaaucgagucccacaaguguuacugcagccuguuuugcugucccuauugccgccauuguucugccgauaucgaaauucacaagcugcaucucuccaucugcaaaaagagaaaaaccgggagcaacgucaugcuggcgguguguaagcggaugugcuucagagccacagucgagguguccaacaaagcccuucugauucgcaauaucauuaacaccacauucguuguguguauccucauucuggcugucugcgugguuucuaccagcgcuguggagauggaaaaucugccggccggaacgugggagaaggaagaggaccuuacaaacuuuugucaccaggaaugccaagucaccgagaccgagugucucugcccuuacgaagcgcuggugcugcggaagccccucuuccuggauuccaucgugaaaggcaagaaaaaucuucugaacucuacaagccucgagaccucccugagcaucgaagccccuuggggagcuauuaauguucagucuacauuuaagcccacggucuccgccgcuaacaucgcccugagcuggucuuccguggagcacagaggaaauaaaauucuugugagcggccgcucugagagcaucaugaagcucgaagaacggaccgggauuuccugggaccugggcgucgaagaugccagcgagucuaagcugcucacaguguccguuauggaccugagccagauguauucccccguguucgaauaccuuucuggagauagacaagucgaggaguggccuaaagcuaccugcacaggcgacuguccggaacgcugcggguguaccagcuccacgugccugcauaaggaguggccccacucucggaacuggagauguaauccuaccuggugcuggggagugggcacaggguguaccugcuguggacucgauguuaaagaccuguuuacagauuauauguucgugaaguggaaagucgacuacaucaagaccgaagcgaucgugugcguugagcugacgagccaggaacgccaguguucccuuauugaggccggcacacgguuuaaccucgggcccgugaccaucacacugucugagccuagaaauauucagcaaaagcugcccccggaaaucgucacccuccauccucgcauugaggaaggcuucuuugaccugaugcacauccagaaagugcuuagcgcuuccaccgugugcaagcugcagagcugcacacauggaguccccggcgaucuccagaucuaccacauugggaaccugcugaaaggagacaagguuaauggccaccuuauccauaaaauugagccucacuucaacacgucuuggauguccugggaugggugugaccucgauuauuacugcaacaugggagacuggcccagcuguucuuauaccggcgugacacaacauaaucacgccgccuuugugaacaugcugaauaucgaaaccgauuacacaaagaacuuccacuuucauuccaaacgggucaccgcucacggggacacgccucagcuggaucucaaggccagacccacauauggcgcgggagagauuaccgugcugguugagguggcugacauggaacuucauaccaagaaaaucgagaucagcggccugaaguucgccucucucacaugcaccggguguuacgccugcuccagcggaauuuccuguaaaguccggauccacguggaugaaccggacgagcugacaguucaugucaagagcgaggauccugacauuguggcugccucuagcucccugauggcucgcaaacuugaguucggcacggacucuaccuuuaaggccuucagcgcgaugcccaagacaucccugugcuuuuauaucguggaaagagaauacuguaaaucuugcagcaaggaggauacccagaaauguguuaauacaaagcucgaacagccccaauccauucugaucgagcacaaagggaccauuaucggaaagcagaacgacacgugcaccggcaaggccgggugcuggcucgagucuaucaagagcuucuuuuacggccugaaaaauaugcuuuccggaauuuucggcaacguguuuaucgggauuuuccuguuucucgcuccuuucaucaugcugauucuguuuuucauguuuggauggcggauccuuuucuguuucaaaugcuguagacgcacacggggccuguuuaaguauagacaccucaaagaugacgaagagaucggguaccgcaagauuaucgaaagacugaagaauaaaaaggggaaaaacaagcuccuggauggcgagcggcuugccgaccgcaaaauugcugaacuguucagcaccaagacacauaucggc

SEQ ID NO: 13778 - RNA, 3495 nt, Artificial Sequence
  derived and/or modified CDS sequence (opt5) from CCHVF(CCHVF SPU 556/87)__KJ682811.1__Gn-NSm-Gc
agcgaggaauccgacggcgauugcaucucuagaacccagcugcuccggacagagacggccgaaauucacagcgacaacuacgggggacccggcgauaagaucaccauuuguaauggguccacaaucguggaccaacgccugggaucugagcuuggcugcuauaccauuaacagagucaagagcuucaaacugugugaaaauuccgcuacagggaaaucuugcgagaucgauagcaccccuguuaagugucggcagggauuuugccucaaaaucacacaggagggccgcggccaugugaagcuguccagagggagcgaaauugugcuugacgccugugauucuuccugcgagaucaugauuccgaagggaaccggcgacauccuggucgauuguagcgggggacagcaacacuuccucaaagacaaccugauugaucugggcugccccaauaucccucuccuggggcggauggcgauuuacaucugucgcaugucuaaccaucccaagacgaccauggcuuuucuuuucugguuuuccuucggauaugugaucacaugcauucugugcaaaguuaucuuuuaccuccugauuguggccggcaccgucggcaagaaauucaagcaguauagagaacuucggccucagacauguaccaucugcgagacgacacccgugaaugccauugacgcugagaugcacgaucugaacuguagcuacaauaucugcccuuauugugccucucgccucaccuccgacgggcuggcuagacauguuaugcagugcccgaagcggaaagaaaagaucgaggaaacagagcuguaccucaaccuggaacgcauucccuggguggucagaaaacuucugcaagugagcgaguccaccggaguggcccucaagcggucuagcuggcugaccguccuucugguucuccugaucgugucccugagcccugugcagucugcgcccauuggccacgggaaaacaaucgagacguaccaggcccgcgaaggauauaccuccuuuugucucuucauucugggcagcauccuuuuuaucgucucuugccuggugaaggggcucauugacagcguuggaaauuccuucuuuccuggccugucuaucuguaaaacaugcagcauuggcuccgugaacggguucgagaucgaaagccacaaguguuacugcucucuuuucugcugucccuauugcagacauuguuccgcugaucgggagauucacaagcugcaucucagcaucugcaaaaagagaaaaaccggaucuaaugucauguccgccguguguaagcgcaugugcuuucgggcuacaauugaaguuagcaacagagcccugcugauccgcuccaucauuaauaccacguucgcgguguguauccucacacuggccgucugcguggucucuaccagcgcuguggagauggagucccuuccggccggcaccugggaacgggaggaagaccugacaaacuuuugucaccaggagugccaaguuaccgaaacagagugucucugcccuuacgaggcucuggugcugagaaaaccccuuuuccucgauucuauugucaaggggaagaaaaaccugcugaauagcacgucccucgaaaccagccugucuaucgaggccccuuggggagccauuaacgugcaguccacauuuaagcccaccguuagcgcugcgaauaucgcccuuucuugguccagcguggaacaccgcggcaacaaaauccuggucucugggcggagcgaguccauuaugaagcucgaggaaagaacaggcaucagcugggaccugggaguggaggaugcuucugaauccaaacugcuuaccgugagcguuauggaccucucccagauguauucucccgucuucgaguaccugagcggcgaucgccaaguggaagaguggccuaaggccacgugcaccggggacuguccggagcggugcggauguacauccucuaccugccugcauaaggaauggccccacagcagaaauuggcgcuguaacccuacauggugcuggggcguggggaccggauguacgugcuguggccucgaugucaaagaccuguuuacagauuauauguucgugaaguggaaaguugaguacauuaagaccgaagccaucgugugcgucgagcuuacaucccaggaacggcaguguucucugauugaggcugggaccagauuuaaucucggccccgugaccaucacacugagcgagccucggaacauccagcaaaaacugcccccggaaauuaucacgcuucauccucgcauugaggaaggauucuuugaccucaugcacguucagaaggugcuguccgccagcaccgucugcaagcugcagucuugcacacauggcgugcccggggaccuccagguuuaccacaucggaaaucugcuuaaaggcgauaaggugaacgggcaccugauucauaaaaucgagccucacuucaauaccuccuggaugagcugggacggaugugaucucgacuauuacugcaacaugggcgauuggcccucuuguacauauaccggggucacgcaacauaaucacgcggcuuuugugaaccugcugaauaucgaaacagacuacaccaagaacuuccacuuccauuccaaaagagugaccgcccacggcgauacaccucagcuugaccucaaggcccggcccaccuauggagcuggcgaggucacaguucugguggagguggccgauauggaacugcauacgaaaaagauugagaucagcgggcucaaguuugcuucucuguccugcaccggauguuacgccugcagcuccggcauuagcuguaaagucagaauccacguggacgaaccggaugagcuuacaguucaugugaagucugaggacccugauauugucgcggccgggagcucccugauggcucgcaaacucgaguucggagccgacucuaccuuuaaggcuuucagcgccaugcccaaaacaucccugugcuuuuauaucguggaacgggaauacuguaagucuugcagcagagaggacacccagaaguguguuaacacgaaacuggaacgcccccaguccauucuuaucgagcacaagggcaccaucauugggaaacaaaaugauacaugcaccgcgaaggccucuugcuggcuggagagcgugaaauccuucuuuuacggccucaagagcaugcugucuggaaucuucggcaacgucuuuauugggaucuuccucuuuauugcuccuuucgugcugcuuauccuguuuuucauguucggauggagaauccucuuuuguuucaagugcugucggcgcacaagaggccuguuuaaauaucggcaccugaaggacgaugaagagaccggguaccgcaaaauuaucgaaagacuuaauaacaagaaaggaaagaauaagcugcucgacggcgagcggcuggccgaucgcaaaauugcugaacucuucuccacaaagagccauaucggc

SEQ ID NO: 13779 - RNA, 3495 nt, Artificial Sequence
  derived and/or modified CDS sequence (opt5) from CCHVF(CCHVF SPU 431/85)__KJ682812.1__Gn-NSm-Gc
agcgaggaauccgacggcgauugcaucucuagaacccagcugcuccggacagagacgaccgaaauucacagcgacaacuacgggggacccggcgauaagaucacaauuuguaauggguccaccaucguggaccaacgccugggaucugagcuuggcugcuauacaauuaacagagucaagagcuucaagcugugugaaaauuccgccaccgggaaaucuugcgagaucgauagcacaccuguuaagugucggcagggauuuugccucaaaaucacccaggagggccgcggccaugugaagcuguccagagggagcgaaauugugcuugacgcuugugauucuaacugcgagaucaugauuccgaagggaacgggcgacauccuggucgauuguuccgggggacagcaacacuuccucaaagacaaucugauugaucugggcugccccaacaucccucuccuggggaagauggccauuuacaucugucggaugagcaaucaucccaaaaccacaauggcguuucuuuucugguuuucuuucggauaugugauuaccugcauccugugcaagguuaucuuuuaccuccugauuguggcuggcacagucggcaaaaaguucaagcaguaucgcgaacuuagaccucagaccuguacgaucugcgagacaauucccgugaacgccaucgacgccgagaugcacgaucugaauuguuccuacaacaucugcccuuauugugcuagccggcucaccucugacgggcuggcccgccauguuaugcagugcccgaaaagaaaggaaaaaguggaggaaacagagcuguaccucaaucuggaacggauucccugggucgugcgcaaacuucugcaaguguccgagagcaccggagucgcucucaaaagauccucuuggcugaccguucuucuggugcuccugaucgugagccuguccccuguccagagcgcccccauuggccacgggaagacaaucgagacguaccaggcgcgggaaggauauaccucuuuuugucucuucauucugggcuccauccuuuuugugguuagcugccuggugaaagggcucaucgacucugucggaaacagcuucuuuccuggccuguccauuuguaagacaugcucuaucggcagcauuaauggguucgagaucgaaucccacaaguguuacugcagccuuuucugcugucccuauugccgccauuguccggccgauagagagauucacaaacugcaucucucuaucugcaagaaacggaagaccggauccaacgugaugcuggcuguuuguaaaagaaugugcuuucgcgccacaauugaagugagcaaucgggcucugcucaucagaaacaucauuaacaccacguucgucguguguauccugacacuugccgucugcgugguuucuaccuccgcgguggagauggagagccugccugccggcaccugggaaaaggaggaagaccucacaaauuuuugucaccaggagugccaagucaccgaaacagagugucugugccccuacgaggcucuggugcuucgcaagccucucuuccuggauuccauuguuaaagggcggaagaaccugcucaauucuacgagccuggaaaccucccuuucuaucgaggcccccuggggagcuauuaacgugcagagcacauuuaaacccaccgucuccgccgccaauaucgcucugagcuggucuuccguggaacacagaggcaacaagauccucgugagcgggcgcucugaguccauuaugaaacuggaggaacggacaggcaucagcugggaccugggaguugaggaugcgucugaaagcaaacuucucaccgucuccgugauggaccugagccagauguauucuccuguguucgaguaccuguccggcgauagacaagucgaagaguggccgaaggccacgugcaccggggacugucccgagcgcugcggauguacaagcucuaccugccuccauaaagaauggccucacucucggaauuggagauguaaccccacauggugcuggggcguggggaccggauguacgugcuguggccuggauguuaaggaccuuuuuacagauuauauguucgugaaauggaaggucgaguacauuaaaaccgaagcuaucgugugcguugagcugacaagccaggaacgccaguguucccucauugaggccgggacccgguuuaaucugggcccugugaccaucacacugucugagcccagaaacauccagcaaaaacuuccgccugaaauuaucacgcuccauccccggauugaggaaggauucuuugaccugaugcacguccagcgcgugcugagcgccuccaccguuugcaagcuccagucuugcacacauggcgugccuggggaccugcaggucuaccacaucggaaaucuucugaagggcgauaaggugaacgggcaccucauucauaaaaucgagccccacuucaauaccagcuggauguccugggacggaugugaucuggacuauuacugcaacaugggcgauuggccuagcuguacauauaccggggugacgcaacauaaucacgcugccuuugucaaccugcuuaacaucgaaacagacuacaccaagaauuuccacuuccauucuaaaagaguuaccgcgcacggcgauacaccccagcucgaccugaaggcucggccgaccuauggagccggcgaggugacagugcuggucgagguggccgauauggaacuccauacgaaaaagauugagaucuccgggcugaaguuugcuagccuuaccugcacaggauguuacgccugcuccuccggcauuagcuguaaaguuaagauccacguggacgaaccugaugagcugaccguccaugugaaaucugaggaccccgauauuguugcugccggguccagccucauggcgagaaagcuggaguucggagccgacuccacauuuaaggcuuucagcgccaugcccaagaccucucugugcuuuuauaucguggaacgcgaauacuguaagagcugcucccgggaggacacgagaaaaugugucaacaccaaacuugaucgcccucagucuauucugaucgaacacaagggcacaaucauugggaagcagaauaauaccugcacagcuaaagccagcugcuggcucgaguccgugaagucuuucuuuuacggccugaagaacaugcucagcggaaucuucggcaacguuuuuauugggaucuuccuguuuauugcgccguucgugcuucugauccucuuuuucauguucggauggagaauccuguuuuguuucaaaugcugucggcgcaccagaggccuguuuaaguaucggcaccuuaaagacgaugaggaaacaggguaccgcaagauuaucgagagacugaauaacaaaaagggaaagaauaaacuccuggacggcgaacggcucgccgaucgcaagauugcugagcuguucuccaccaaaucucauaucggc

SEQ ID NO: 13780 - RNA, 3495 nt, Artificial Sequence
  derived and/or modified CDS sequence (opt5) from CCHVF(CCHVF SPU 48/90)__KJ682813.1__Gn-NSm-Gc
agcgaggaacccuccgacgauugcaucucuagaacccagcugcuccggacagagacggccgaaauucacggcgacaacuacgggggaccuggcgauaagaucaccauuuguaaugggagcacaaucguggaccaacgccugggauccgagcuuggcugcuauaccauuaacagagucaaaucuuucaagcugugugaaaauagcgcuacagggaaauccugcguuaucgauucugugccggugaagugucggcagggauacugccuccgcaucacccaggagggcagaggccaugucaaacugagccggggguccgaggugguucuugacgccugugauacaagcugcgaaauuaugauccccaagggaaccggcgacauucugguggauuguucugggggacagcaacacuuucucaaggacaaccugaucgaucugggcugcccuaaaauuccccuccuggggaagauggcgaucuauauuugucgcauguccaaucauccuacgaccacaauggcuuuccuguuuugguucagcuuuggauacgucauuaccugcauccuuugcaaagccauuuucuaucuccugaucauuaucggcacacuuggcaagagauuucggcaguaccgcgagcugaaaccccagaccuguacgauuugcgaaacaaccccugugaacgccaucgacgcugagaugcacgaucucaauuguucuuauaacaucugcccguacugugccuccagacugacaagcgacgggcuggcucggcauguuacccagugccccaagcgcaaggagaaaguggaagagaccgaacucuaccugaaucuugagagaaucccuugggucgugcggaagcugcuccaagugucugaauccacaggagucgcccugaaacgcagcuccuggcuuaucguucugcucgugcuguucacggugucucugagccccguccaguccgcgccuauuggccacgggaagaccaucgaggccuauagagcucgggagggauacacaagcauuugucucuuugugcugggcucuauccuuuucguuguguccugccugaugaaaagacucgucgacagcguggggaacagcuuuuuccccggacugagcaucuguaagaccugcuccauuucuagcaucaauggcuuugaaauugagucccacaaauguuauugcagccuuuucugcuguccguacugccgccauuguucugccgauaaggaaauccacaagcugcaucucuccauuugcaaaaagcggaaaacaggcagcaacguuaugcuggcuguguguaagagaaugugcuuccgcgccaccauggaggucucugaccgggcgcuguuuaucagauccauuaucaauacgacauucgugcucuguauccugauucuugccgucugcgugguuagcaccuccgcuguggaaauggagaaccugccugccgggaccugggagcgcgaagaggaucucacaaauuuuugucaccaggaaugccaggucaccgagacagaaugucugugccccuaugaggcucuggugcuucggaaaccucucuucagagacucuaucguuaagggaaugaagaaccugcugaacagcacgucccucgagaccucucugagcauugaagcccccuggggcgccaucaaugugcaauccacauacaaacccaccgucagcacagcuaacauugcgcuuucuugguccagcguggagcaccgcgggaauaagauccuggugucuggacgguccgaaagcaucaugaaacucgaggagagaaccggcauuucuugggaucuggggguugaagacgccagcgaguccaagcugcuuacggucagcgugauggaucucucucagauguauuccccuguguuugaauaccugagcggcgaccgccaggucgaggaauggccgaaagcuaccugcacaggagauugucccgagcggugcggcuguaccuccucuacaugccugcauaaggaguggccucacagcagaaacuggcgguguaaucccaccuggugcuggggaguggggacgggcuguacaugcugugggcucgacguuaaggaucuguucaccgacuacauguuugugaaauggaaggucgaauauaucaaaacagaggccauugugugcguugaacuuaccucccaagagcgccaguguucucugaucgaagccggaaccagauucaaccucggcccugugacaauuacgcugagcgagccccggaauauccagcagaagcugccgccugagaucauuacccuucaucccagaaucgaagagggguuuuucgaccucaugcacguccaaaaagugcuguccgcuucuacaguuugcaagcugcagagcugcacccauggcgugccuggagaucuccaggucuaccacauuggcaaccugcuuaagggggacaaagugaauggacaccugauccauaagauugaaccccacuuuaacacauccuggaugagcugggauggcugugaccucgauuauuacugcaauaugggggacuggccuucuuguaccuauacgggagugacacagcauaaccgcgccuccuucgucaaucugcugaacaucgagaccgauuacaccaaaaauuuucacuuccacagcaagcggguuacagcgcauggcgacacaccccaacuugaucucaaagcuagaccgaccuauggggccggcgaaaucacggugcugguggaggucgccgacauggagcugcacaccaagaaaauugaaaucucuggacucaaguucgcuucccugacaugcaccggcuguuacgccugcagcucugggauuuccuguaaggugcgcauccauguugaugagccugacgaacuuacagugcacgucaaaagcgaugaccccgacgugguugcugccuccagcucucugauggcgagaaagcucgaguuuggaaccgauagcacguucaaagccuuuuccgcuaugcccaagaccucucugugcuucuacauuguggagaaagaauauuguaagagcugcuccgaggaagacacaaagaaaugugucaacaccaagcuggagcagccucagucuauccuuauugaacauaaaggcacaaucaucgggaagcagaacucuaccugcacagccaaaguguccugcuggcuggagucugcuaagagcuuuuucuacggacucaaggauaugcuguccggcauuuuugggaauguuuucaucggcauuuuucucuuccuggccccguuuauccuucugauucucuucuuuauguucggauggcggauccugcuguguuucaaaugcugucgcagaacccggggccuuuuuaaguaucgccaccugaaagacgaugaggaaacgggguacagacggaucauugagcgccucaacaauaagaaaggaaagaacaagcugcucgacggcgaaagacuggcggaucggcgcaucgccgagcuuuucagcacaaaaacccacauuggg

SEQ ID NO: 13781 - RNA, 3495 nt, Artificial Sequence
  derived and/or modified CDS sequence (opt5) from CCHVF(CCHVF SPU 187/90)__KJ682814.1__Gn-NSm-Gc
agcgaggaacccuccgacgauugcaucucuagaacccagcuucuccggacagagacggccgaaauucacggcgacaacuacgggggaccuggcgauaagaucaccauuuguaaugggagcacaaucguggaccagcgccugggauccgagcuuggcugcuauaccauuaacagagucaaaucuuucaagcugugugaaaauagcgcuacagggaaauccugcgagaucgauucuguuccggugaagugucggcagggauacugccuccgcaucacccaggagggcagaggccaugugaaacugagccggggguccgaagucgugcuugacgccugugauacaagcugcgagauuaugauccccaagggaaccggcgacauucugguugauuguucugggggacagcaacacuuucucaaggacaaccugaucgaucugggcugcccuaaaauuccccuccuggggaagauggcgaucuauauuugucgcauguccaaucauccuaaaacgaccauggcuuuccuguuuugguucagcuuuggauacgugaucacaugcauccugugcaaggccauuuucuaucuccugaucauuaucggcacccuuggcaaaagauuuaagcaguaccgggaacugaagccccagacauguaccauuugcgagacgacaccugucaacgccaucgacgcugagaugcacgaucucaauuguucuuauaacaucugcccguacugugccucccgccugaccagcgacgggcuggcuagacaugugacacagugccccaaacggaaggaaaaaguugaggaaaccgagcucuaccugaaucuugaacgcauuccuuggguggucagaaagcugcuccaagugucugaguccaccggaguggcccugaaacggagcuccuggcuuaucguccugcucguucuguucacagugucucugagccccgugcaguccgcgccuauuggccacgggaagacgaucgaggccuaucgcgcuagagaaggauacaccagcauuugucucuuuguccugggcucuauccuuuucgugguuuccugccugaugaaagggcucguggacagcgucggaaacuccuuuuuccccggccugagcaucuguaagacaugcuccauuggcucuaucaauggguuugagauugaaagccacaaguguuauugcucccuuuucugcuguccguacugccggcauuguagcgccgauaaagagauccacaagcugcaucucucuauuugcaaaaagagaaaaaccggauccaacgugaugcuggcuguuuguaagcgcaugugcuuccgggccacaauggaagugagcaauagagcgcuguuuauccgcucuauuaucaacaccacguucguccucuguauccugauucuugccgugugcgucguguccacaagcgcuguugagauggagaaucugccugccggcaccugggaacgggaggaagaccucaccaacuuuugucaccaggagugccaggugacagaaaccgagugucugugccccuaugaggcucugguccuuagacgcccucucuuccuggauuccaucgugaaggggaugaaaaaccugcucaauucuacaagccuggaaacgucccuuucuauugaggcccccuggggagccaucaacguucaaagcaccuacaagcccacaguguccaccgcuaauauugcgcugagcuggucuuccgucgaacaccggggcaacaaaauccucgugagcgggagaucugaguccaucaugaagcuggaggaacgcacaggcauuagcugggaccugggaguggaggaugccucugaaagcaaacuucucaccguuuccgucauggaccugagccagauguauucuccuguguuugaguaccuguccggcgauagacagguggaagaguggccgaaggcuacgugcaccggggacugucccgagcggugcggauguacaagcucuaccugccuccauaaggaauggccucacucucgcaauuggcgguguaaccccacauggugcuggggcgucgggaccggauguacgugcuguggccuggaugugaaagaccuuuucacagauuacauguuuguuaaguggaaaguggaguauaucaagaccgaagccauugucugcguggagcugacaagccaagaaagacaguguucccucaucgaggccgggacccgguucaaucugggcccuguuaccauuacacugucugagccccgcaacauccagcagaaacuuccgccugaaaucauuacgcuccaucccagaaucgaggaaggauuuuucgaccugaugcacgugcaaaagguccugagcgcuuccaccgugugcaagcuccagucuugcacacauggcguuccuggggaccuucagguguaccacauuggaaaucuucugaaaggcgauaaggucaacgggcaccucauccauaaaauugagccccacuuuaauaccagcuggauguccugggacggaugugaucuggacuauuacugcaacaugggcgauuggccuagcuguacauauaccggggugacgcagcauaaucacgccucuuucgugaaccugcuuaauaucgaaacagacuacaccaagaacuuucacuuccauuccaaacgggucaccgcgcacggcgauacaccccaacucgaccugaaggcuagaccgaccuauggagccggcgagaucacaguucugguggagguggccgauauggaacuccauacgaaaaagauugagaucagcgggcugaaguucgcuucucuuaccugcacaggauguuacgccugcuccagcggcauuucuuguaaaguccgcauccacguggacgaaccugaugagcugaccguucaugugaaguccgacgaucccgacgucguggcugccagcuccagccucauggcgcggaaacuggaguuugggacagacucuauuuucaaggccuuuagcgcuaugcccaaaaccucccugugcuucuacaucguugaaagagagcacuguaagucuugcagcgaagaggauacgaagaaaugugugaacaccaaacuugaacagccucaguccauucugaucgagcacaagggaacaaucauuggcaagcaaaauucuaccugcacagccaaaaccagcugcuggcucgaguccgucaagagcuuuuucuaugggcugaagaacaugcucucuggcaucuuuggaaauguguucauuggcaucuuucuguuccuugcuccguuuauucugcucauccuguucuuuauguucggguggcgcauccuguucuguuuuaaaugcuguagacggacacgcggacuuuucaaguacagacaucugaaagacgaugaagagaccggcuaucggcgcauuaucgaaagacucaacaauaagaaagggaagaacaagcugcucgacggagagcggcuggccgaucgcagaauugcggaacuguuuuccacgaaaacacacaucggc

SEQ ID NO: 13782 - RNA, 3495 nt, Artificial Sequence
  derived and/or modified CDS sequence (opt5) from CCHVF(CCHVF Haskovo-V46/13)__KR092379.1__Gn-NSm-Gc
agcgaggaacugggcgacgauugcaucuccagaacccagcuccugcggacagagacggccgaaauucacgacgauaacuacgggggacccggcgacaagaucaccauuuguaaugggucuacaaucguggaucaacgccuuggaagcgagcugggcugcuauaccauuaacagagggaaauccuucaagcucugugaaaauucugcuacaggaaaaaccugcgagaucgacagcacaccugucaagugucggcagggcuuuugccugaaaaucacccaggagggccgcgggcauguuaagcucuccagaggaucugaaguggugcuggaugccugugacagcuccugcgaggucaugauuccgaagggcacgggggauauccucguggacuguagcggaggccagcaacacuuccugaaagauaaccugauugaccucgggugcccccauaucccucugcuuggaaagauggcgauuuacaucugucggaugucuaaucacccccgcaccacaauggcuuuucuguucugguuuuccuucggcuauguuauuaccugcaucuuuugcaaagcccucuucuacagccugaucauuaucggcacacuugggaagaaaauuaagcaguauagagaacugaagccucagaccuguacgaucugcgagacaacccccgugaacgccauugaugcugagaugcaugaccucaauuguucuuacaacaucugcccuuauugugccucccggcugacaagcgacggacuggcucgccacgucacccagugcccgaaaagaaaggaaaaaguggaggaaaccgagcucuaccugaaucuugaacggauccccuggauuguucgcaagcugcuccaagugucugaguccacaggcgucgcccugaaaagaagcuccuggcuuaucgugcugcucgugcugcugccugucucucucagccccguucaguccgcgccuguggggcacggaaagacgauugagaccuaccagacacgggaaggcuuuaccagcaucugucuguucaugcuugggucuauucuguuuaucguguccugccucgucaaaggacugguggauagcguuggcgacucuuucuuucccggccuuagcguguguaagacaugcuccaucgggucuauuaacggauucgagaucgaaagccauaaguguuauugcucccuguucugcuguccguacugccgccacuguagcgccgauagagagauucaucagcuccaccugucuaucugcaaaaagcggaaaaccggcuccaaugucaugcuggcuguguguaagagaaugugcuuucgcgccacgauugaagcuagccggagagcccuccugauccgcucuauuaucaacacaaccuucgcgauguguauccuuacccugacaauuugcguuguguccaccagcgccgucgagauggagaaucucccugcugggacaugggaacgggaggaagaccugacgaacuuuugucaccaagagugccaggugaccgaaacagagugucugugccccuaugaggcccuuguccucagaaaaccucuguuccuggauuccaucgugaagggaaugaagaaucuccugaacucuaccagccuugaaacaucccugucuauugaggcucccuggggcgccaucaacguucagagcaccuuuaaacccacgguguccaccgccaauauugcucucagcuggucuuccgucgaacaucgcgggaacaagauccuggugacaggccggagcgagucuaucaugaaacuggaggaaagaaccggaguuuccugggaccuuggcguggaggaugcgagcgaaucuaagcuccugacagucagcauuauggaccugucccaaauguacagcccuguguucgaguaucucucuggggaucgccagguggaagaguggccgaaagcuaccugcacgggagacugucccgagcggugcggcuguacauccagcacaugccugcacaaggaauggccucauuccagaaauuggcgcuguaaccccaccuggugcuggggaguugggaccggcuguaccugcuguggggucgaugugaaggaccuuuuuacagaccacauguucgugaaauggaaggucgaguacaucaaaacggaagccauugugugcguugagcugaccucucaggaacggcaguguagccucaucgaggccggcacaagauuuaaucugggaccugugaccauuacacuguccgagccccggaacauccaacagaaacuuccgccugaaaucauuacccuccaucccaagaucgaggaaggcuucuuugaucugaugcacguccagaaggugcugucugccagcacgguuugcaagcuccaguccugcacacacgggauuccuggagaccugcaaguguaucauaucggcaaucuucugaaaggggaucgcgucaacggacaccucauucauaagaucgagccccacuucaauaccucuuggaugagcugggacggcugugaucuggacuacuacugcaacaugggggauuggccuuccuguaccuauacaggcgugacccagcacaaucaugcugccuuuguuaaccugcuuaauaucgaaacagacuacacgaaaaccuuccacuuccauagcaagagagugacagcgcacggagauacaccccagcucgaccugaaagcucggccgaccuauggcgccggggagauuaccguccugguggagguggccgauauggaacuccauacgaagaaagucgagaucucuggacugaaguuugcuucccuuaccugcacaggcuguuacgccugcagcucugggauuuccuguaagguuagaauccacguggacgaaccugaugagcugaccgugcacgucaaaagcucugaccccgacgugguugcugccggaacaucccucauggcgcgcaagcuggaguucggcaccgauagcacauuuaaagccuucuccgcuaugcccaagaccagccugugcuuuuauauuguggaacgggaguacuguaaaucuugcagcgaagacgauacgcagaagugugucgacacaaaacuugagcaaccucaguccauccugauugaacauaaggggaccaucaucggcaagcagaacgauaccugcacagccagagcuucuugcuggcucgagagcgugaaauccuucuuuuauggacugaagaauaugcucggcucuguuuucgggaacuuucugauuggaauccuucuguuccucgccccguuugugcugcugguccuuuucuuuauguucggcuggaaaauucuguucuguuuuaagugcugucgcagaacccgggggcuuuucaaguaccgccaccugaaagacgaugaggaaacgggauacagacggaucauugagcgccucaacagcaagaaaggcaagaauagacugcuugacggcgaacggcuggcggaucgcaaaaucgccgagcucuuuuccacaaagacccauaucggg

SEQ ID NO: 13783 - RNA, 3495 nt, Artificial Sequence
  derived and/or modified CDS sequence (opt5) from CCHVF(CCHVF 24-R-2012)__KR814856.1__Gn-NSm-Gc
agcgaggaacccggcgacgauugcaucuccagaacccagcugcuccggacagagacggccgaaauucacgacgauaacuacgggggaccuggcgacaagaucaccauuuguaaugggucuacaaucguggaucaacgccugggaagcgagcuuggcugcuauaccauuaacagagucaaauccuucaagcugugugaaaauucugcuacagggaaaaccugcgagaucgacagcacaccgguuaagugucggcagggauuuugccucaaaaucacccaggagggccgcggccaugugaagcuguccagagggucugaagugguccuugaugccugugacacgagcugcgaggugaugauucccaagggaaccggcgauauccugguugacuguuccgggggacagcaacacuuccucaaagauaaccugauugaccugggcugcccucauaucccccuccuggggaagauggcgauuuacaucugucggaugagcaaucacccucgcacaaccauggcuuuucuuuucugguuuucuuucggauaugugauuacaugcaucuuuugcaaagcccuguucuacucccucaucauuaucggcacccugggcaagaaaauuaagcaguauagagaacuuaagccccagacguguacaaucugcgagaccgccccugucaacgcuauugaugccgagaugcaugaccugaauuguagcuacaacaucugcccguauugugcuucucggcucacauccgacgggcuggcccgccacgugccccagugcccuaaaagaaaggaaaaaguugaggaaaccgagcuguaccucaaucuggaacggauccccuggauugugcgcaaacuucugcaagucagcgagucuaccggaguggcgcucaagagauccagcuggcugaucgugcuucugguccuccugacaguuucccugucuccugugcagagcgcccccgugggccacgggaagacgauugagaccuaccagacacgggaaggauuuaccuccgucugucucuucaugcugggcagcauccuuuuucuggugucuugccucguuaaagggcugguggauuccgucagcgacucuuucuuuccgggacuuagcguguguaagacaugcuccauuggcucuaucaacggcuucgagaucgaaagccauaaguguuauugcucccuguucugcuguccuuacugccgccacuguagcgcugauagagagauucaucagcuccaccugucuaucugcaaaaagcggaaaaugggguccaauguuaugcuggccguguguaagagaaugugcuuucgcgcuaccauugaagccagccggagagcgcuccugauccgcucuauuaucaacacgacauucgucauuuguauccuuacccugaccaucugcguggucuccacaagcgccguggagauggagaaucuccccuccggaaccugggaacgggaggaagaccugacaaacuuuugucaccaagagugccagguuacggaaaccgagugucugugcccuuaugaggcucuugugcucagaaaaccccuguuccuggauucuauugucaagggcaugaagaaucuccugaacagcacaucccuugaaaccucucugagcaucgaggcccccuggggagcuauuaacgugcaguccacauuuaaaccuaccguuagcacggccaauaucgcccucucuugguccagcguggaacaucgcggaaacaagauucuggucaccggccggucugaguccaucaugaaacuggaggaaagaacaggggugagcugggaccuuggcguggaggaugcuucugaaagcaagcuccugaccguuuccaucauggaccugagccaaauguacucuccggucuucgaguaucucuccggagaucgccagguggaagaguggcccaaagcgacaugcaccggcgacuguccugagcggugcggguguacgagcuccacaugccugcacaaggaauggccccauucuagaaauuggcgcuguaacccuaccuggugcuggggagugggcacaggguguaccugcuguggagucgaugugaaggaccuuuuuaccgaccacauguucguuaaauggaagguggaguacauuaaaacagaagccaucgucugcguggagcugacgagccaggaacggcaguguucccucauugaggcuggcaccagauuuaaucuggggcccguuacaaucacccugucugagccgcggaacauucaacagaaacuuccucccgaaaucaucacacuccauccuaagguggaggaaggcuucuuugaucugaugcacguccagaaggugcugagcgccuccaccguuugcaagcuccagucuugcacgcacgggauucccggcgaccugcaaguguaucauaucgggaaucuucugaaaggagaucgcgucaacggccaccucauucauaagaucgagccucacuucaauacaagcuggauguccugggacgggugugaucuggacuacuacugcaacaugggagauuggcccagcuguaccuauaccggcgugacacagcacaaucaugccgcuuuugugaaccugcuuaauauugaaaccgacuacacaaaaacguuccacuuccauucuaagagagucaccgcccacggggauacaccgcagcucgaccugaaagcgcggccuaccuauggcgcuggagagaucacaguucugguggagguggccgauauggaacuccauaccaagaaagucgagaucuccggccugaaguuugccagccuugcuugcacgggguguuacgccuguucuuccggaauuagcugcaaggugagaauccacguugacgaacccgaugagcugaccgugcacgucaaaucuaacgaccccgacgugguugcugccuccacaagccucauggcgcgcaagcuggaguucggcaccgauuccacauuuaaagccuucagcgcuaugccuaagaccucucugugcuuuuauauuguggaacgggaguacuguaaaagcugcuccgaagaggacacacagaagugugucgauaccaaacuugaacaaccgcagucuauccugauugagcauaaggggacgaucauuggaaagcagaaugacacaugcaccgccaaagcuagcugcuggcucgaguccgugaagucuuucuuuuauggccugaaaaacaugcucgggagcguuuucggcaacuuuuucaucggaauccugcuuuuucuggcccccuucgugcuccugguccuguuuuucauguucggcuggaagauucuguuuuguuucaagugcuguagacgcaccagagggcuucucaaauaccggcugcucaaggaugacgaagagacaggauaccgcagaaucauugaacggcugaauaacaaaaagggcaaaaaucgccuucuggauggggagagacucgcggaccggaagaucgccgaacuguuuuccaccaagacgcacauugga

SEQ ID NO: 13784 - RNA, 3495 nt, Artificial Sequence
  derived and/or modified CDS sequence (opt5) from CCHVF(CCHVF 36-ST-2014)__KR814857.1__Gn-NSm-Gc
agcgaggaacccggcgacgauugcaucuccagaacccagcugcucaagacagagacggccgaaauucacgacgauaacuacgggggaccuggcgacaaaaucaccauuuguaaugggucuacaaucguggaucaacggcugggaagcgagcuuggcugcuauaccauuaaccgcgucaaguccuucaaacugugugaaaauucugcuacagggaagaccugcgagaucgacagcacaccgguuaaauguagacagggauuuugccucaagaucacccaggagggccggggccaugugaagcugucccgcgggucugaagugguccuugaugccugugacagcuccugcgagauuaugauccccaaaggaacgggcgauauucugguggacuguagcgggggacagcaacacuuccucaaggauaaccugaucgaccugggcugcccucauauuccccuccuggggaaaauggcgaucuacauuuguagaaugucuaaucacccucggaccacaauggcuuuucuuuucugguuuuccuucggauauguuauuaccugcaucuuuugcaaggcccuguucuacagccucauuaucauuggcacacugggcaaaaagaucaagcaguaucgcgaacuuaaaccccagaccuguacgauuugcgagacagccccugugaacgcuaucgaugccgagaugcaugaccugaauuguucuuacaacaucugcccguauugugcuuccagacucaccagcgacgggcuggcccggcacgucacacagugccccaagcgcaaagaaaagguggaggaaaccgagcuguaccucaaucuggaaagaaucccuuggaucguucggaaacuucugcaagugucugaguccaccggagucgcgcucaagcgcagcuccuggcugauugugcuucuggugcuccugacagucucucugagccccguucaguccgccccugugggccacgggaaaacgaucgagaccuaccagacaagagaaggauuuaccaacauuugucucuucaugcugggcagcauccuuuuuaucgugucuugccuggucaaggggcucguggauuccguuagcgacucuuucuuucccggacugagcguguguaagacaugcuccauuggcucuaucaauggcuucgagauugaaagccauaaauguuauugcucccuuuucugcuguccguacugccggcacuguagcgcugaucgcgagauccaucagcugcaccucgggauuugcaagaaaagaaagaccggaucuaacgucaugcuggccguguguaaacggaugugcuuuaaggcuacgaucgaagccuccagacgcgcgcugcucauucggagcaucaucaauacaaccuucguuauuuguauccugacccuugccauuugcguggucucuacauccgcuguggagauggagaaccugccugccggcaccugggaaagagaggaagaccucacaaauuuuugucaccaagagugccaggucagcgaaacggagugucugugccccuaugaggcucuggugcuucgcaagccucucuuccuggauuccaucguuaaagggaugaagaaccugcucaacucuaccagccuggaaacaucccuuucuauugaggcccccuggggagccaucaaugugcagagcaccuuuaaacccacagucuccaccgcuaacaucgcgcugagcuggucuuccguggaacaucggggcaauaagauucucguuacggggagaagcgagucuaucaugaaacuggaggaacgcaccggcguguccugggaccugggagucgaggaugccagcgaaucuaaacuucucacagugagcauuauggaccugucccaaauguacagcccuguguucgaguaucugucuggcgaucggcagguugaagaguggccgaaggcuaccugcacaggggacugucccgagagaugcggauguaccuccagcacgugccuccacaaggaauggccucauucccgcaacuggcgguguaaucccacauggugcuggggcgucgggaccggauguacaugcuguggcguggaugugaaggaccuguuuaccgaccacauguucaucaaauggaaggucgaguacauuaaaaccgaagccaucgugugcguugagcuuacaucucaggaaagacaguguagccugaucgaggccgggacgcgcuuuaaccucggcccugugaccauuacacuguccgagccccggaauauccaacagaagcugccgccugaaauuaucacccuucaucccaagauugaggaaggauucuuugaucucaugcacguccagaaagugcugucugcuagcacaguuugcaagcugcaguccugcacccacggcaucccuggggaccuccaaaucuaucauauuggaaaccugcuuaaaggcgauagacugaaugggcaccucauccauaagauugagccccacuucaacacgucuuggaugagcugggacggaugugaucuggacuacuacugcaauaugggcgauuggccuuccuguacauauaccggggugacccagcacaaccaugccgcguuugucaaucugcuuaacaucgaaacagacuacaccaaaacauuccacuuccauagcaagcgggugacggcucacggcgauacaccccagcucgaccugaaagcccgcccgaccuauggagccggcgagauuaccguucugguggaggucgcugauauggaacuccauacaaagaagguggagaucucugggcugaaauuugccucccuugcuugcaccggauguuacgccugcagcucuggcauuuccuguaaggugagaauccacgucgacgaaccugaugagcugacgguucacgugaaaagcucugaccccgacguggucgcggccuccaccagccucauggcucggaagcuggaguucgggacagauuccaccuuuaaagccuucagcgcuaugcccaagacaucucugugcuuuuauaucguggaaagagaguacuguaagagcugcuccgaagacgauaccaaaaaguguguugacacaaaacuugaucagccucaaucuauucugaucgagcauaagggaaccauuaucggcaaacagaaugacacgugcacagccaaggcgagcugcuggcucgaauccgugaagucuuucuuuuaugggcugaaaaacaugcucggcagcgucuucggaaacuuuuucgugggcauucugcuuuuucuggccccguucguucuccuggugcuguuuuucauguguggguggaaguuccuguuuugcuucaaauguugccgccggaccagaggacuguuuaaguaccgccaccucaaagaugacgaggagaccggcuacagacggaucaucgaacgccuuaauuccaagaaggggaaaaacagacuccuggauggagagcggcuugcugaccgcaagauugccgaacuguucucuacaaaaagccauaucggc

SEQ ID NO: 13785 - RNA, 3495 nt, Artificial Sequence
  derived and/or modified CDS sequence (opt5) from CCHVF(CCHVF 37-R-2013)__KR814858.1__Gn-NSm-Gc
agcgaggaacccggcgacgauugcaucuccagaacccagcugcuccggacagagacggccgaaauucacgacgauaacuacgggggaccuggcgacaagaucaccauuuguaaugggucuacaaucguggaucaacgccugggaagcgagcuuggcugcuauaccauuaacagagucaaauccuucaagcugugugaaaauucugcuacagggaaaaccugcgagaucgacagcacaccgguuaagugucggcagggauuuugccucaaaaucacccaggagggccgcggccaugugaagcuguccagagggucugaagugguccuugaugccugugacacgagcugcgaggugaugauucccaagggaaccggcgauauccugguugacuguuccgggggacagcaacacuuccucaaagauaaccugauugaccugggcugcccucauaucccccuccuggggaagauggcgauuuacaucugucggaugagcaaucacccucgcacaaccauggcuuuucuuuucugguuuucuuucggauaugugauuacaugcaucuuuugcaaagcccuguucuacucccucaucauuaucggcacccugggcaagaaaauuaagcaguauagagaacuuaagccccagacguguacaaucugcgagaccgccccugucaacgcuauugaugccgagaugcaugaccugaauuguagcuacaacaucugcccguauugugcuucucggcucacauccgacgggcuggcccgccacgugccccagugcccuaaaagaaaggaaaaaguugaggaaaccgagcuguaccucaaucuggaacggauccccuggauugugcgcaaacuucugcaagucagcgagucuaccggaguggcgcucaagagauccagcuggcugaucgugcuucugguccuccugacaguuucccugucuccugugcagagcgcccccgugggccacgggaagacgauugagaccuaccagacacgggaaggauuuaccuccgucugucucuucaugcugggcagcauccuuuuucuggugucuugccucguuaaagggcugguggauuccgucagcgacucuuucuuuccgggacuuagcguguguaagacaugcuccauuggcucuaucaacggcuucgagaucgaaagccauaaguguuauugcucccuguucugcuguccuuacugccgccacuguagcgcugauagagagauucaucagcuccaccugucuaucugcaaaaagcggaaaaugggguccaauguuaugcuggccguguguaagagaaugugcuuucgcgcuaccauugaagccagccggagagcgcuccugauccgcucuauuaucaacacgacauucgucauuuguauccuuacccugaccaucugcguggucuccacaagcgccguggagauggagaaucuccccuccggaaccugggaacgggaggaagaccugacaaacuuuugucaccaagagugccagguuacggaaaccgagugucugugcccuuaugaggcucuugugcucagaaaaccccuguuccuggauucuauugucaagggcaugaagaaucuccugaacagcacaucccuugaaaccucucugagcaucgaggcccccuggggagcuauuaacgugcaguccacauuuaaaccuaccguuagcacggccaauaucgcccucucuugguccagcguggaacaucgcggaaacaagauucuggucaccggccggucugaguccaucaugaaacuggaggaaagaacaggggugagcugggaccuuggcguggaugacgcuucugagagcaagcuccugaccguuuccaucauggaucugagccaaauguacucuccggucuucgaauaucucuccggagaccgccagguggaggaauggcccaaagcgacaugcaccggcgauuguccugagcggugcggguguacgagcuccacaugccugcacaaggaguggccccauucuagaaauuggcgcuguaacccuaccuggugcuggggagugggcacaggguguaccugcuguggagucgacgugaaggaccuuuuuaccgaucacauguucguuaaauggaagguggaauacauuaaaacagaggccaucgucugcguggaacugacgagccaggagcggcaguguucccucauugaagcuggcaccagauuuaaucuggggcccguuacaaucacccugucugagccgcggaacauucaacagaaacuuccucccgagaucaucacacuccauccuaagguggaagagggcuucuuugaccugaugcacguccagaaggugcugagcgccuccaccguuugcaagcuccagucuugcacgcacgggauucccggcgaucugcaaguguaucauaucgggaaucuucugaaaggagaccgcgucaacggccaccucauucauaagaucgaaccucacuucaauacaagcuggauguccugggaugggugugaccuggauuacuacugcaacaugggagacuggcccagcuguaccuauaccggcgugacacagcacaaucaugccgcuuuugugaaccugcuuaauauugagaccgauuacacaaaaacguuccacuuccauucuaagagagucaccgcccacggggacacaccgcagcucgaucugaaagcgcggccuaccuauggcgcuggagaaaucacaguucugguggagguggccgacauggagcuccauaccaagaaagucgaaaucuccggccugaaguuugccagccuugcuugcacgggguguuacgccuguucuuccggaauuagcugcaaggugagaauccacguugaugagcccgacgaacugaccgugcacgucaaaucuaacgaccccgaugugguugcugccuccacaagccucauggcgcgcaagcuggaguucggcaccgacuccacauuuaaagccuucagcgcuaugccuaagaccucucugugcuuuuauauuguggagcgggaauacuguaaaagcugcuccgaggaagauacacagaagugugucgacaccaaacuugagcaaccgcagucuauccugauugaacauaaggggacgaucauuggaaagcagaaugugacaugcaccgccaaagcuagcugcuggcucgaguccguuaagucuuucuuuuauggccugaaaaacaugcucgggagcguguucggcaacuuuuucaucggaauccugcuuuuucuggcccccuucguccuccuggugcuguuuuucauguucggcuggaagauucuguuuuguuucaagugcuguagacgcaccagagggcuucucaaauaccggcugcucaaggaugacgaggaaacaggauaccgcagaaucauugagcggcugaauaacaaaaagggcaaaaaucgccuucuggauggggaaagacucgcggaccggaagaucgccgagcuguuuuccaccaagacgcacauugga

SEQ ID NO: 13786 - RNA, 3495 nt, Artificial Sequence
  derived and/or modified CDS sequence (opt5) from CCHVF(CCHVF 44-ST-2010)__KR814859.1__Gn-NSm-Gc
agcgaggaacccggcgacgauugcaucuccagaacccagcugcucaagacagagacggccgaaauucacgacgauaacuacgggggaccuggcgacaaaaucaccauuuguaaugggucuacaaucguggaucaacggcugggaagcgagcuuggcugcuauaccauuaaccgcgucaaguccuucaaacugugugaaaauucugcuacagggaagaccugcgagaucgacagcacaccgguuaaauguagacagggauuuugccucaagaucacccaggagggccggggccaugugaagcugucccgcgggucugaagugguccuugaugccugugacagcuccugcgagauuaugauccccaaaggaacgggcgauauucugguggacuguagcgggggacagcaacacuuccucaaggauaaccugaucgaccugggcugcccucauauuccccuccuggggaaaauggcgaucuacauuuguagaaugucuaaucacccucggaccacaauggcuuuucuucugugguucuccuuuggauauguuauuaccugcaucuucugcaaggcccucuuuuacagccugauuaucauuggcacacuuggcaaaaagaucaagcaguaucgcgaacugaaaccccagaccuguacgauuugcgagacagccccugugaacgcuaucgaugccgagaugcaugaccucaauuguucuuacaacaucugcccguauugugcuuccagacugaccagcgacgggcuggcccggcacgucacacagugccccaagcgcaaagaaaagguggaggaaaccgagcucuaccugaaucuugaaagaaucccuuggaucguucggaaacugcuccaagugucugaguccaccggagucgcgcugaagcgcagcuccuggcuuauugugcugcucgugcugcugacagucucucucagccccguucaguccgccccugugggccacgggaaaacgaucgagaccuaccagacaagagaaggauucaccaacauuugucuguuuaugcuuggcagcauccuguucaucgugucuugccucgucaaggggcugguggauuccguuagcgacagcuuuuuccccggacuuucuguguguaagacaugcuccuuuggcucuauuaauggcuucgagaucgaaagccauaaauguuauugcucccuguucugcuguccguacugccggcacuguagcgcugaucgcgagauucaucagcuccaccuggggaucugcaagaaaagaaagaccggaucuaacgucaugcuggccguguguaaacggaugugcuuuaaggcuacgauugaagccuccagacgcgcgcuccugauccggagcauuaucaauacaaccuucguuaucuguauucuuacccuggccaucugcguggucucuacauccgcuguggagauggagaaccucccugccggcaccugggaaagagaggaagaccugacaaauuuuugucaccaagagugccaggucagcgaaacggagugucugugccccuaugaggcucuugugcuccgcaagccucuguuccuggauuccauuguuaaagggaugaagaaccuccugaacucuaccagccuugaaacaucccugucuaucgaggcccccuggggagccauuaaugugcagagcaccuuuaaacccacagucuccaccgcuaacaucgcgcucagcuggucuuccguggaacaucggggcaauaagauccugguuacggggagaagcgagucuauuaugaaacuggaggaacgcaccggcguguccugggaccuuggagucgaggaugccagcgaaucuaagcuccugacagugagcaucauggaccugucccaaauguacagcccuguguucgaguaucucucuggcgaucggcagguugaagaguggccgaaggcuaccugcacaggggacugucccgagagaugcggauguaccuccagcacgugccugcacaaagaauggccucauucccgcaacuggcgguguaaucccacauggugcuggggcgucgggaccggauguacaugcuguggcguggaugugaaggaccuuuuuaccgaccacauguucauuaaauggaaggucgaguacaucaaaaccgaagccauugugugcguugagcugacaucucaggaaagacaguguagccucaucgaggccgggacgcgcuuuaaccugggcccugugaccaucacacuguccgagccccggaauauucaacagaaacuuccgccugaaaucauuacccuccaucccaagaucgaggaaggauucuuugaucugaugcacguccagaaggugcugucugcuagcacaguuugcaagcuccaguccugcacccacggcauuccuggggaccugcaaaucuaucauaucggaaaccuucugaaaggcgauagacucaaugggcaccugauucauaagaucgagccccacuucaacacgucuuggaugagcugggacggaugugaucuggacuacuacugcaauaugggcgauuggccuuccuguacauauaccggggugacccagcacaaccaugccgcguuugucaaucuucucaacauugaaacagacuacaccaaaacauuccacuuccauagcaagcgggugacggcucacggcgauacaccccagcuggaccugaaagcccgcccgaccuauggagccggcgagaucaccguucucguggaggucgcugauauggaacugcauacaaagaagguggagauuucugggcuuaaauuugccucccuggcuugcaccggauguuacgccugcagcucuggcaucuccuguaaggugcggauucacgucgacgaaccugaugagcucacgguucacgugaaaagcucugaccccgacguggucgcggccuccaccagccugauggcuagaaagcuggaguucgggacagauuccaccuuuaaagccuucagcgcuaugcccaagacaucucuuugcuuuuauaucguggaaagagaguacuguaagagcugcuccgaagacgauaccaaaaaguguguugacacaaaacuggaucagccucaaucuauccucauugagcauaagggaaccaucauuggcaaacagaaugacacgugcacagccaaggcgagcugcuggcuggaauccgugaagucuuucuuuuaugggcucaaaaacaugcugggcagcgucuucggaaacuuuuucgugggcauccuucuguuucucgccccguucguucugcuggugcuguuuuucauguguggguggaagauucuuuucugcuuuaaauguugccgccggaccagaggacucuucaaguaccgccaccugaaagaugacgaggagaccggcuacagacggaucaucgaacgccucaauuccaagaaggggaaaaacagacugcuugauggagagcggcuggcugaccgcaagauugccgaacucuuuucuacaaaaagccauaucggc

SEQ ID NO: 13787 - RNA, 3495 nt, Artificial Sequence
  derived and/or modified CDS sequence (opt5) from CCHVF(CCHVF 46-ST-2012)__KR814860.1__Gn-NSm-Gc
agcgaggaacccggcgacgauugcaucuccagaacccagcugcuccggacagagacggccgaaauucacgacgauaacuacgggggaccuggcgacaagaucaccauuuguaaugggucuacaaucguggaucaacgccugggaagcgagcuuggcugcuauaccauuaacagagucaaauccuucaagcugugugaaaauucugcuacagggaaaaccugcgagaucgacagcacaccgguuaagugucggcagggauuuugccucaaaaucacccaggagggccgcggccaugugaagcuguccagagggucugaagugguccuugaugccugugacagcuccugcgaggugaugauucccaagggaacgggcgauauccugguugacuguagcgggggacagcaacacuuccucaaagauaaccugauugaccugggcugcccucauaucccccuccuggggaagauggcgauuuacaucugucggaugucuaaucacccucgcaccacaauggcuuuucuuuucugguuuuccuucggauaugugauuaccugcaucuuuugcaaagcccuguucuacagccucaucauuaucggcacacugggcaagaaaauuaagcaguauagagaacuuaagccccagaccuguacgaucugcgagacagccccugucaacgcuauugaugccgagaugcaugaccugaauuguucuuacaacaucugcccguauugugcuucccggcucaccagcgacgggcuggcccgccacgugccccagugcccuaaaagaaaggaaaaaguugaggaaacagagcuguaccucaaucuggaacggauccccuggauugugcgcaaacuucugcaagucucugaguccaccggaguggcgcucaagagaagcuccuggcugaucgugcuucugguccuccugaccguuucucugagcccugugcaguccgcccccgugggccacgggaagacaauugagacguaccagacccgggaaggauuuacaagcaucugucucuucaugcugggcucuauucuuuuucuggucuccugccucgugaaagggcugguugauagcgugucugacagcuucuuuccgggacuuuccgucuguaagaccugcucuaucggcagcaucaacggcuucgagauugaaucccauaaguguuauugcagccuguucugcuguccuuacugccgccacuguucugcugauagagagauccaucagcuccaccuguccauuugcaaaaagcggaaaacagggagcaaugugaugcuggccguuuguaagagaaugugcuuucgcgcuaccaucgaagccucucggagagcgcuccugauucgcuccaucauuaacgccacguucgugaucuguauccuuacacugaccauuugcgucgugagcaccuccgcugucgagauggagucucuccccgccggaacaugggaacgggaggaagaccugaccaauuuuugucaccaagagugccaggugacagaaacggagugucugugcccuuaugaggcucuuguucucagaaaaccccuguuccuggauagcaucgugaagggcaugaagaaccuccuuaauuccaccucucuugaaacaagccuguccauugaggcccccuggggagccaucaacguccagagcaccuuuaaaccuacagugucuaccgcuaacauugcgcucuccuggagcucuguugaacaucgcgggaauaagauccuggugacgggccgguccgagagcaucaugaaacuggaggaaagaaccggggucucuugggaccuuggcguggaggaugccagcgaauccaagcuccugacagugagcauuauggaccugucucaaauguacuccccgguuuucgaguaucucagcggagaucgccaggucgaagaguggcccaaagcuaccugcacaggcgacuguccugagcggugcggguguaccuccucuacgugccugcacaaggaauggccccauagcagaaacuggcgcuguaauccuacauggugcuggggagugggcaccggguguacaugcuguggaguggaugucaaggaccuuuuuaccgaccacauguucgugaaauggaagguugaguacaucaaaaccgaagccauugugugcgucgagcugacaucccaggaacggcaguguucucucaucgaggccggcacgagauuuaaccuggggcccgugaccauuacacugagcgagccgcggaauauccaacagaaacuuccucccgaaaucauuacccuccauccuaagguugaggaaggcuucuuugaucugaugcacgugcagaagguccuguccgcuucuacagugugcaagcuccagagcugcacccacggaauccccggcgaccugcaaguuuaucauauugggaaccuucugaaaggagaucgcaucaauggccaccucauucauaagaucgagccucacuucaacacguccuggaugagcugggacgggugugaucuggacuacuacugcaauaugggagauuggcccucuuguacauauaccggcgugacccagcacaaccaugccgcguuugucaaucugcuuaacaucgaaacagacuacaccaaaacauuccacuuccauuccaagagagugacggcucacggggauaccccgcagcucgaccugaaagcccggccuacauauggcgccggagagauuaccgugcuggucgagguugcugauauggaacuccauacaaagaaaguggagaucagcggccugaaguuugccucucuugcuugcaccggguguuacgccugcuccagcggaauuucuuguaaggugagaauccacgucgacgaacccgaugagcugacggugcacguuaaauccagcgaccccgacguggucgcggccuccaccagccucauggcucgcaagcuggaguucggcacagauucuaccuuuaaagccuucagcgcuaugccuaagacaucccugugcuuuuauauuguggaacgggaguacuguaaaucuugcagcgaagaggacacccagaaguguguugauacaagacuugaacaaccgcaguccauccugauugagcauaaggggaccaucaucggaaaacagaaugacacgugcacagccaaggcgucuugcuggcucgagagcgugaaauccuucuuuuauggccugaagaacaugcucgggucugucuucggcaacuuuuucauuggaauccugcuuuuucuggcccccuucgugcuccugguucuguuuuucauguucggcuggaaaauucuguuuuguuucaagugcugucgcagaacccgggggcugcucaaguaccgccaccugaaagaugacgaagagaccggauacagacggaucauugaacgccucaauaacaagaaaggcaagaauagacugcuugauggggagcggcuggcugaccgcaaaaucgccgaacucuuuagcacaaagacccauaucgga

SEQ ID NO: 13788 - RNA, 3495 nt, Artificial Sequence
  derived and/or modified CDS sequence (opt5) from CCHVF(CCHVF 47-ST-2013)__KR814861.1__Gn-NSm-Gc
agcgaggaacccggcgacgauugcaucuccagaacccagcugcucaagacagagacggccgaaauucacgacgauaacuacgggggaccuggcgacaaaaucaccauuuguaaugggucuacaaucguggaucaacggcugggaagcgagcuuggcugcuauaccauuaaccgcgugaaguccuucaaacuguguaaaaauucugcuacagggaagaccugcgaaaucgacagcacaccgguuaaguguagacagggauuuugccucaagaucacccaggagggccggggccaugugaaacugucccgcgggucugaggugguccuugaugccugugacagcuccugcgaaauuaugauccccaagggaacgggcgauauucugguggacuguagcgggggacagcaacacuuccucaaagauaaccugaucgaccugggcugcccucauauuccccuccuggggaagauggcgaucuacauuuguagaaugucuaaucacccucggaccacaauggcuuuucuuuucugguuuuccuucggauauguuauuaccugcaucuuuugcaaagcccuguucuacagccucauuaucauuggcacacugggcaagaagaucaaacaguaucgcgagcuuaagccccagaccuguacgauuugcgaaacagccccugugaacgcuaucgaugccgagaugcaugaccugaauuguucuuacaacaucugcccguauugugcuuccagacucaccagcgacgggcuggcccggcacgucacacagugccccaaacgcaaggagaaaguggaagagaccgaacuguaccucaaucuggagagaaucccuuggaucguucggaagcugcugcaagugucugaauccaccggagucgcgcucaaacgcagcuccuggcugauugugcuucuggugcuccugacagucucucugagccccguucaguccgccccugugggccacgggaagacgaucgagaccuaccagacaagagagggauuuaccagcauuugucucuucaugcugggcucuauccuuuuuaucguguccugccuggucaaggggcucguggauagcguuucugacagcuucuuucccggacuguccgugugucggacaugcucuauuggcagcaucaacggcuucgaaauugagucccauaaauguuauugcagccuuuucugcuguccguacugccgccacuguucugcugauagagaaauccaucagcugcaccucuccauuugcaagaaacggaagaccgggagcaaugucaugcuggccguguguaaaagaaugugcuuuaaggcuacgaucgaggccucucgccgggcgcuguucauuagauccaucaucaacacaaccuuuguuaccuguauucucacacuggccaucugcguggucagcaccuccgcuguggaaauggaggaccuuccugccggaacaugggagcgcgaagaggaucugacgaauuucugucaccaagaaugccaggucaccgagacagaaugucucugccccuaugaggcucuggugcugcggaagccucuuuuucucgacucuauuguuaaaggcaugaagaaccugcugaauagcaccucccucgagacaucucugagcaucgaagcccccuggggagccauuaacgugcaguccaccuucaaacccacggucagcaccgcuaacaucgcgcuuucuugguccagcguggagcauagaggaaauaagauccugguuacaggccgcucugaauccauuaugaaacucgaggagcggaccggggugagcugggaucugggcgucgaagacgccucugagagcaagcugcuuacaguguccaucauggaucucagccaaauguacucuccuguguuugaauaucuguccggagacagacagguugaggaauggccgaaggcuaccugcacgggcgagugucccgagcgcugcggguguacaagcucuaccugccugcacaaagaauggccucauucucggaacuggagauguaaucccacauggugcuggggagucggcaccggguguaccugcuguggaguggaugugaaggaccucuucacagaccacauguuuauuaaauggaaggucgaguacaucaaaacggaagccauugugugcguugagcugaccagccaggaacgccaguguucccuuaucgaggccggcacacgguucaaccuggggccugugaccaucacacucucugagcccagaaauauucaacagaagcugccgccugaaaucauuacccugcaucccaagaucgaggaaggcuuuuucgaucuuaugcacguccagaaagugcucagcgcuuccacgguuugcaagcugcagucuugcacacacgggauuccuggcgaccugcaaaucuaucauaucgggaaccuccugaaaggagaucgggugaauggccaccuuauucauaagaucgagccccacuuuaacaccagcuggauguccugggacgggugugaucuggacuacuacugcaauaugggagauuggccuagcuguaccuauacaggcgucacccagcacaaccaugccgcguucgugaaucuccugaacauugaaacagacuacacgaaaaccuuccacuuucauucuaagcgcguuacagcucacggggauacaccccagcuggaccuuaaagccagaccgaccuauggcgccggagagaucaccgugcucgucgagguggcugauauggaacugcauacgaagaagguggaggucuccggccugaaauucgccagccucgcuugcaccggguguuacgccugcuccuccggaauuagcuguaagguucggauccacguggacgaaccugaugagcugacagugcacgucaaaucuuccgaccccgacgugguugcggccagcaccucccuuauggcuagaaagcuggaguuuggcacagauagcaccuucaaagccuuuucugcuaugcccaagacaagccucugcuucuauauuguggaacgcgaguacuguaaguccugcucugaagacgauaccaaaaagugugucgacacgaaacuggagcagccucaaagcauccugaucgaacauaaggggacaauuaucggaaaacagaaugauaccugcaccgccaaggcguccugcuggcuugagucuguuaagagcuuuuucuauggccugaaaaacaugcucggguccguguuuggcaauuucuuugugggcauucuucucuuccuggccccguuuguccuucugguccucuucuucauguuuggauggaagauccuguucuguuuuaaaugcugucggagaacacgcgggcuguucaaguacagacaccuuaaagacgaugaggaaaccggauaccggcgcauuaucgagagacugaacucuaagaagggcaaaaaccggcuccuggacggggaacgccucgcugauagaaagaucgccgagcuguuuagcacgaaaacacauauugga

SEQ ID NO: 13789 - RNA, 3495 nt, Artificial Sequence
  derived and/or modified CDS sequence (opt5) from CCHVF(CCHVF 52-R-2014)__KR814862.1__Gn-NSm-Gc
agcgaggaacccggcgacgauugcaucuccagaacccagcugcuccggacagagacggccgaaauucacgacgauaacuacgggggaccuggcgacaagaucaccauuuguaaugggucuacaaucguggaucaacgccugggaagcgagcuuggcugcuauaccauuaacagagucaaauccuucaagcugugugaaaauucugcuacagggaaaaccugcgagaucgacagcacaccgguuaagugucggcagggauuuugccucaaaaucacccaggagggccgcggccaugugaagcuguccagagggucugaagugguccuugaugccugugacacgagcugcgaggugaugauucccaagggaaccggcgauauccugguugacuguuccgggggacagcaacacuuccucaaagauaaccugauugaccugggcugcccucaugugccccuccuggggaagauggcgaucuacauuugucggaugagcaaucacccucgcacaaccauggcuuuucuuuucugguuuucuuucggauaugucaucacaugcaucuuuugcaaagcccuguucuacucccucauuaucauuggcacccugggcaagaaaaucaagcaguauagagaacuuaagccccagacguguacaauuugcgagaccgccccugugaacgcuaucgaugccgagaugcaugaccugaauuguagcuacaacauuugcccguauugugcuucucggcucacauccgacgggcuggcccgccacguuccccagugcccuaaaagaaaggaaaaaguggaggaaaccgagcuguaccucaaucuggaacggauccccuggaucguccgcaaacuucugcaagugagcgagucuaccggaguggcgcucaagagauccagcuggcugauuguccuucugguucuccugacagugucccugucuccugugcagagcgcccccgucggccacgggaagacgaucgagaccuaccagacacgggaaggauuuaccuccgugugucucuucaugcugggcagcauucuuuuucugguuucuugccucgugaaagggcuggucgauuccgugagcgacucuuucuuuccgggacuuagcguuuguaagacaugcuccaucggcucuauuaacggcuucgagaucgaaagccauaaguguuauugcucccuguucugcuguccuuacugccgccacuguagcgcugauagagagauccaucagcuccaccugucuauuugcaaaaagcggaaaaugggguccaaugugaugcuggccgucuguaagagaaugugcuuucgcgcuaccaucgaagccagccggagagcgcuccugauucgcucuaucauuaacacgacauucgugaucuguauucuuacccugaccaucugcgucguguccacaagcgccguugagauggagaaucuccccuccggaaccugggaacgggaggaagaccugacaaacuuuugucaccaagagugccaggugacggaaaccgagugucugugcccuuaugaggcucuuguccucagaaaaccccuguuccuggauucuaucgugaagggcaugaagaaucuccugaacagcacaucccuugaaaccucucugagcauugaggcccccuggggagcuaucaacguucaguccacauuuaaaccuaccgugagcacggccaauauugcccucucuugguccagcgucgaacaucgcgggaacaagauccuggugaccggccggucugaguccauuaugaaacuggaggaaagaacaggggugagcugggaccuuggcguugaugacgcuucugagagcaagcuccugaccgucuccaucauggaucugagccaaauguacucuccgguguucgaauaucucuccggagaccgccagguggaggaauggcccaaagcgacaugcaccggcgauuguccugagcggugcggguguacgagcuccacaugccugcacaaggaguggccccauucuagaaauuggcgcuguaacccuaccuggugcuggggagucggcacaggguguaccugcuguggaguggacguuaaggaccuuuuuaccgaucacauguucgugaaauggaaggucgaauacaucaaaacagaggccauugugugcguugaacugacgagccaggagcggcaguguucccucaucgaagcuggcaccagauuuaaucuggggcccgugacaauuacccugucugagccgcggaacauccaacagaaacuuccucccgagauuaucacacuccauccuaaggucgaagagggcuucuuugaccugaugcacgugcagaagguucugagcgccuccaccgugugcaagcuccagucuugcacgcacggaauccccggcgaucugcaagucuaucauauugggaaucuucugaaaggagaccgcgugaacggccaccucauccauaagauugaaccucacuucaauacaagcuggauguccugggaugggugugaccuggauuacuacugcaacaugggagacuggcccagcuguaccuauaccggcgugacacagcacaaucaugccgcuuuugucaaccugcuuaauaucgagaccgauuacacaaaaacguuccacuuccauucuaagagaguuaccgcccacggggacacaccgcagcucgaucugaaagcgcggccuaccuauggcgcuggagaaauuacagugcugguggaggucgccgacauggagcuccauaccaagaaaguggaaaucuccggccugaaguuugccagccuugcuugcacgggguguuacgccuguucuuccggaaucagcugcaagguucgcauucacguggaugagcccgacgaacugaccguccacgugaaaucuaacgaccccgauguuguggcugccuccacaagccucauggcgagaaagcuggaguucggcaccgacuccacauuuaaagccuucagcgcuaugccuaagaccucucugugcuuuuauaucgucgagcgggaauacuguaaaagcugcuccgaggaagauacacagaaguguguggacaccaaacuugagcaaccgcagucuauucugaucgaacauaaggggacgauuaucggaaagcagaaugauacaugcaccgccaaagcuggcugcuggcucgagagcguuaaguccuucuuuuaugggcugaaaaacaugcucggcucuguguucggaaacuuuuucauuggcauccugcuuuuucuggcccccuucguccuccuggugcuguuuuucauguucggguggaagauccuguuuuguuucaagugcuguagacgcaccagaggacuucucaaauaccggcugcucaaggacgaugaggaaacaggcuaccgcagaauuaucgagcggcugaauaacaaaaaggggaaaaaucgccuucuggacggagaaagacucgcggaucggaagauugccgagcuguuuagcaccaagacgcacaucggc

SEQ ID NO: 13790 - RNA, 3495 nt, Artificial Sequence
  derived and/or modified CDS sequence (opt5) from CCHVF(CCHVF 75-R-2012)__KR814863.1__Gn-NSm-Gc
agcgaggaacccggcgacgauugcaucuccagaacccagcugcuccggacagagacggccgaaauucacgacgauaacuacgggggaccuggcgacaagaucaccauuuguaaugggucuacaaucguggaucaacgccugggaagcgagcuuggcugcuauaccauuaacagagucaaauccuucaagcugugugaaaauucugcuacagggaaaaccugcgagaucgacagcgccccgguuaagugucggcagggauuuugccucaaaaucacacaggagggccgcggccaugugaagcuguccagagggucugaagugguccuugaugcgugugacagcuccugcgaggugaugauucccaagggaaccggcgauauccugguugacuguagcgggggacagcaacacuuccucaaagauaaccugauugaccugggcugcccucauaucccccuccuggggaagauggcuauuuacaucugucggaugucuaaucacccucgcacgaccauggccuuucuuuucugguuuuccuucggauaugugauuacaugcaucuuuugcaaagcccuguucuacagccucaucauuaucggcacccugggcaagaaaauuaagcaguauagagaacuuaagccccagacauguaccaucugcgagacggcuccugucaacgccauugaugcugagaugcaugaccugaauuguucuuacaacaucugcccguauugugccucccggcucacaagcgacgggcuggcgcgccacgugccccagugcccuaaaagaaaggaaaaaguugaggaaaccgagcuguaccucaaucuggaacggauccccuggauugugcgcaaacuucugcaagucucugaguccacaggaguggcccucaaaagaagcuccuggcugaucgugcuucugguccuccugaccguuucucugagcccugugcaguccgcucccgugggccacgggaagaccauugagacauaccagacgcgggaaggauuuaccagcaucugucucuucaugcugggcucuauucuuuuucuggucuccugccucgugaaagggcugguuaacagcgugucugauagcuucuuuccgggacuuuccgucuguaagacaugcucuaucggcagcaucaauggcuucgagauugaaucccauaaguguuauugcagccuguucugcuguccuuacugccgccacuguucugccgacagagagauccaucagcuccaccuguccauuugcaaaaagcggaaaaccgggagcaacgugaugcuggcuguuuguaagagaaugugcuuucgcgccacaaucgaagcgucucggagagcccuccugauucgcuccaucauuaauaccacguucgugaucuguauccuuacacugaccauuugcgucgugagcaccuccgcugucgagauggagaaccuccccucuggaacaugggaacgggaggaagaucugaccaauuuuugucaccaagagugccaggugacagaaacggagugucugugcccuuaugaggcccuuguucucagaaaaccccuguuccuggacagcaucgugaagggcaugaagaaccuccugaacuccaccucucuugaaacaagccuguccauugaggcucccuggggagccaucaauguccagagcaccuuuaaaccuacagugucuaccgccaacauugcucucuccuggagcucuguugaacaucgcggaaauaagauccuggugacgggccgguccgagagcaucaugaaacuggaggaaagaaccggggucucuugggaucuuggcguggaggacgcgagcgaauccaagcuccugacagugagcauuauggaucugucucaaauguacuccccgguuuucgaguaucucagcggagaccgccaggucgaagaguggcccaaagcuaccugcacaggcgauuguccugagcggugcggguguaccuccucuacgugccugcacaaggaauggccccauagcagaaacuggcgcuguaauccuacauggugcuggggagugggcaccggguguacaugcuguggaguggacgucaaggaucuuuuuaccgaccacauguucgugaaauggaagguugaguacaucaaaaccgaagccauugugugcgucgagcugacaucccaggaacggcaguguucucucaucgaggccggcacgagauuuaaccuggggcccgugaccauuacacugagcgagccgcggaauauccaacagaaacuuccucccgaaaucauuacccuccauccuaagguugaggaaggcuucuuugaccugaugcacgugcagaagguccuguccgccucuacagugugcaagcuccagagcugcacccacggaauccccggcgaucugcaaguuuaucauauugggaaccuucugaaaggagaccgcgugaauggccaccucauccauaagauugagccucacuucaacacguccuggaugagcugggaugggugugaccuggauuacuacugcaauaugggagacuggcccucuuguacauauaccggcgucacccagcacaaccaugcugccuuugugaaucugcuuaacaucgaaacagauuacaccaaaacauuccacuuccauuccaagagagugacggcgcacggggacaccccgcagcucgaucugaaagcucggccuacauauggcgccggagagaucaccguccugguugagguggccgacauggaacuccauacaaagaaaguggagauuagcggccugaaguuugcuucucuugccugcaccggguguuacgcuugcuccagcggaaucucuuguaagguccgcauucacguggaugaacccgacgagcugacgguucacgugaaauccagcgaucccgacgucguggccgcguccaccagccucauggccagaaagcuggaguucggcacagacucuaccuuuaaggcuuucagcgccaugccuaagacaucccugugcuuuuauaucguugaacgggaguacuguaaaucuugcagcgaagaggauacccagaaguguguggacacaaaacuugaacaaccgcaguccauucugaucgagcauaaggggaccauuaucggaaagcagaaugauacgugcacagcuaaagccucuugcuggcucgagagcgucaaguccuuccuguauggccucaaaaacaugcuggggucuguguuuggcaacuucuuuaucgggauucuucuguuccucgcgcccuuuguucugcuggugcuuuucuuuauguucggcuggaagauccuguucuguuuuaagugcuguagacgcaccagagggcuccugaaauaccggcuccugaaggacgaugaagagaccggauaccgcagaauuaucgaacggcuuaauaacaaaaagggcaaaaaucgccugcucgacggggagagacuggccgaucggaagauugcugaacuguucagcacaaagacccacaucgga

SEQ ID NO: 13791 - RNA, 3495 nt, Artificial Sequence
  derived and/or modified CDS sequence (opt5) from CCHVF(CCHVF 75-ST-2010)__KR814864.1__Gn-NSm-Gc
agcgaggaauccggcgacgauugcaucucuagaacccagcugcuccggacagagacggccgaaauucacgacgauaacuacgggggacccggcgacaagaucaccauuuguaaugggagcacaaucguggaucaacgccugggauccgagcuuggcugcuauaccauuaacagagucaaaucuuucaagcugugugaaaauagcgcuacagggaaaaccugcgagaucgacuccacaccuguuaagugucggcagggauuuugccucaaaaucacccaggagggccgcggccaugugaagcugucuagagggagcgaagugguccuugaugccugugacuccagcugcgaggugaugauuccgaagggaacgggcgauauccugguugacuguucugggggacagcaacacuuccucaaagauaaccugauugaccugggcugcccccauaucccucuccuggggaagauggcgauuuacaucugucggauguccaaucacccccgcaccacaauggcuuuucuuuucugguuuagcuucggauaugugauuaccugccuguuuugcaaagcccucuucuacucucugaucaucauuggcacacuuggcaagaaaaucaagcaguauagagaacugcggccucagaccuguacgauuugcgagacagcccccgucaacgcuaucgaugccgagaugcaugaccucaauuguuccuacaacauuugcccuuauugugcuagccgccugaccucugacgggcuggccagacacgugccgcagugccccaagcggaaagaaaagguugaggaaacagagcucuaccugaaucuugaacgcaucccuuggaucgugagaaaacugcuccaagucuccgagagcaccggaguggcgcugaagcgguccucuuggcuuauugugcugcucguccugcugaccguuagccucucccccgugcagagcgccccugugggccacgggaaaacaaucgagacguaccagacccgcgaaggauuuacaucuauuugucuguucaugcuuggcuccauccuguuucucgucagcugccuggugaaggggcuuguugauucugugagcgacuccuucuuucccggacugucugucuguaaaaccugcagcauuggcuccaucaacggcuucgagaucgaaagccauaaguguuauugcucucuccugugcuguccguacugcagacacuguuccgcugaucgggagauucaucagcugcaccucagcaucugcaagaaaagaaagacagggucuaaugugaugcuggccguuuguaaacgcaugugcuuccgggcuaccauugaagccuccagacgcgcgcuucugauccggagcauuaucaacacgacauuugugauuuguauccucacccugaccaucugcgucguguccacaucugccgucgagauggagaaucugccuagcggaaccugggaaaaggaggaagaccuuacaaacuucugucaccaagagugccaggugacggaaaccgagugucucugccccuaugaggcucugguucugagaaaaccucucuuucuggauuccauugugaagggcaugaagaaucuucugaacucuacaagccucgaaaccucccugagcaucgaggcccccuggggagcuauuaacguccagucuacauucaaacccaccguguccacggccaauaucgcccugagcuggucuuccguugaacaucgcggaaacaagauucuugugaccggccggagcgagucuaucaugaaacucgaggaaagaacaggggucagcugggaccugggcguggaggaugcuuccgaaagcaagcugcucaccgugucuaucauggaccugucccaaauguacagcccuguuuuugaguaucuuuccggagaucgccaggucgaagaguggccgaaagcgacaugcaccggcgacugucccgagcggugcggguguacgucuagcacaugccugcacaaggaauggccucauuccagaaauuggcgcuguaaccccaccuggugcuggggagugggcacaggguguaccugcuguggaguggaugucaaggaccucuucaccgaccacauguuugugaaauggaagguugaguacauuaaaacagaagccaucgugugcgucgagcugacgucucaggaacggcaguguagccugauugaggcuggcaccagauucaaucuugggccugugacaaucacccucuccgagccccggaacauucaacagaagcugccgccugaaaucaucacacugcaucccaaaguugaggaaggcuuuuucgaucucaugcacgugcagaagguccugucugccagcaccgugugcaagcugcaguccugcacgcacgggauuccuggcgaccugcaaguuuaucauaucgggaaucuccugaaaggagaucgcgugaacggccaccugauucauaagaucgagccccacuuuaauacaagcuggaugucuugggacgggugugaucuugacuacuacugcaacaugggagauuggccuuccuguaccuauaccggcgucacacagcacaaucaugccgcuuucgugaaccuccugaauauugaaaccgacuacacaaaaacguuucacuuccauagcaagagagugaccgcccacggggauacaccccagcuggaccucaaagcgcggccgaccuauggcgcuggagagaucacaguccugguugagguggccgauauggaacuucauaccaagaaaguggagaucucuggccugaaguucgccucccucgcuugcacgggguguuacgccugcagcucuggaauuuccuguaaggucagaauccacguggacgaaccugaugagcugaccguucacgugaaaagcuccgaccccgacgucguggcugccagcacaucucugauggcgcgcaaacuugaguuuggcaccgauagcacauucaaggccuuuuccgcuaugcccaagaccucucugugcuucuauauuguugaacgggaguacuguaaaagcugcuccgaagaggacacacagaaguguguggauaccaagcucgaacaaccucagucuauccugauugagcauaaagggacgaucauuggaaagcagaacgacacaugcaccgccaaagcuagcugcuggcucgaguccgucaagagcuuuuucuauggccugaaaaauaugcuugggucuguguuuggcaacuucuuuaucggaauccuucucuuccuggccccguuuguucugcuugugcuguucuuuauguucggcuggaagauucucuucuguuuuaagugcuguagacgcgcgagagggcugcucaaauaccggcaccugaaggaugacgaagagaccggauaccgcaaaaucauugaaagacuuaacaauaagaaaggcaagaaccggcugcucgauggggagcgccuggccgacagaaagaucgcugaacuguucuccacaaaaacccauauugga

SEQ ID NO: 13792 - RNA, 3495 nt, Artificial Sequence
  derived and/or modified CDS sequence (opt5) from CCHVF(CCHVF 81-R-2014)__KR814865.1__Gn-NSm-Gc
agcgaggaacccggcgacgauugcaucuccagaacccagcugcuccggacagagacggccgaaauucacgacgauaacuacgggggaccuggcgacaagaucaccauuuguaaugggucuacaaucguggaucaacgccugggaagcgagcuuggcugcuauaccauuaacagagucaaauccuucaagcugugugaaaauucugcuacagggaaaaccugcgagaucgacagcacaccgguuaagugucggcagggauuuugccucaaaaucacccaggagggccgcggccaugugaagcuguccagagggucugaagugguccuugaugccugugacagcuccugcgaggugaugauucccaagggaacgggcgauauccugguugacuguagcgggggacagcaacacuuccucaaagauaaccugauugaccugggcugcccucauaucccccuccuggggaagauggcgauuuacaucugucggaugucuaaucacccucgcaccacaauggcuuuucuuuucugguuuuccuucggauaugugauuaccugcaucuuuugcaaagcccuguucuacagccucaucauuaucggcacacugggcaagaaaauuaagcaguauagagaacuuaagccccagaccuguacgaucugcgagacagccccugucaacgcuauugaugccgagaugcaugaccugaauuguucuuacaacaucugcccguauugugcuucccggcucaccagcgacgggcuggcccgccacgugccccagugcccuaaaagaaaggaaaaaguugaggaaacagagcuguaccucaaucuggaacggauccccuggauugugcgcaaacuucugcaagucucugaguccaccggaguggcgcucaaaagaagcuccuggcugaucgugcuucugguccuccugaccguuucucugagcccugugcaguccgcccccgugggccacgggaagacaauugagacguaccagacccgggaaggauuuacaagcaucugucucuucaugcugggcucuauucuuuuucuggucuccugccucgugaaagggcugguugauagcgugucugacagcuucuuuccgggacuuuccgucuguaagaccugcucuaucggcagcaucaacggcuucgagauugaaucccauaaguguuauugcagccuguucugcuguccuuacugccgccacuguucugcugauagagagauccaucagcuccaccuguccauuugcaaaaagcggaaaacagggagcaaugugaugcuggccguuuguaagagaaugugcuuucgcgcuaccaucgaagccucucggagagcgcuccugauucgcuccaucauuaacacgacauucgugaucuguauccuuacccugaccauuugcgucgugagcacauccgccgucgagauggagaaucuccccgcuggaaccugggaacgggaggaagaccugacaaacuuuugucaccaagagugccaggugacggaaaccgagugucugugcccuuaugaggcccuuguucucagaaaaccccuguuccuggauucuaucgugaagggcaugaagaaucuccugaacagcacaucccuugaaaccucucugagcauugaggcucccuggggagccaucaacguccaguccacauuuaaaccuaccgugagcacggccaauauugcucucucuugguccagcguugaacaucgcgggaacaagauccuggugaccggccggucugaguccaucaugaaacuggaggaaagaacaggggucagcugggaccuuggcguggaggaugcgucugaaagcaagcuccugaccguguccauuauggaccugagccaaauguacucuccgguuuucgaguaucucuccggagaucgccaggucgaagaguggcccaaagccacaugcaccggcgacuguccugagcggugcggguguacgagcuccacaugccugcacaaggaauggccccauucuagaaauuggcgcuguaacccuaccuggugcuggggagugggcacaggguguaccugcuguggaguggaugucaaggaccuuuuuaccgaccacauguucgugaaauggaagguugaguacaucaaaacagaagcuauugugugcgucgagcugacgagccaggaacggcaguguucccucaucgaggccggcaccagauuuaaucuggggcccgugacaauuacccugucugagccgcggaacauccaacagaaacuuccucccgaaaucauuacacuccauccuaagguugaggaaggcuucuuugaucugaugcacgugcagaagguccugagcgccuccaccgugugcaagcuccagucuugcacgcacggaauccccggcgaccugcaaguuuaucauauugggaaucuucugaaaggagaucgcaucaacggccaccucauucauaagaucgagccucacuucaauacaagcuggauguccugggacgggugugaucuggacuacuacugcaacaugggagauuggcccagcuguaccuauaccggcgugacacagcacaaucaugcugccuuugucaaccugcuuaauaucgaaaccgacuacacaaaaacguuccacuuccauucuaagagagugaccgcgcacggggauacaccgcagcucgaccugaaagcucggccuaccuauggcgccggagagauuacagugcuggucgagguugccgauauggaacuccauaccaagaaaguggagaucuccggccugaaguuugcuagccuugccugcacgggguguuacgcuugcagcuccggaauuagcuguaaggugagaauccacgucgacgaacccgaugagcugaccgugcacguuaaaucuuccgaccccgacguggucgccgcgagcacaucccucauggcccgcaagcuggaguucggcaccgauagcacauuuaaggcuuucucugccaugccuaagaccagccugugcuuuuauauuguggaacgggaguacuguaaauccugcucugaagaggacacacagaaguguguugauaccagacuugaacaaccgcagagcauccugauugagcauaaggggacgaucaucggaaaacagaacgacacaugcaccgcuaaggccuccugcuggcucgagucugugaaaucuuucuuuuauggccugaagaauaugcucggguccgucuucggcaacuuuuucauuggaauccugcuuuuucuggcgcccuucgugcuccugguucuguuuuucauguucggcuggaaaauucuguuuuguuucaagugcugucgcagaacccgggggcuucucaaguaccgccaccugaaagaugacgaagagacaggauacagacggaucauugaacgccucaacaauaagaaaggcaagaacagacugcuugauggggagcggcuggccgaccgcaaaaucgcugaacucuuuucuaccaagacgcauaucgga

SEQ ID NO: 13793 - RNA, 3495 nt, Artificial Sequence
  derived and/or modified CDS sequence (opt5) from CCHVF(CCHVF 3756-ST-2007)__KR814866.1__Gn-NSm-Gc
agcgaggaacccggcgacgauugcaucuccagaacccagcugcucaagacagagacggccgaaauucacgacgauaacuacgggggaccuggcgacaaaaucaccauuuguaaugggucuacaaucguggaucaacggcugggaagcgagcuuggcugcuauaccauuaaccgcgucaaguccuucaaacugugugaaaauucugcuacagggaagaccugcgagaucgacagcacaccgguuaaauguagacagggauuuugccucaagaucacccaggagggccggggccaugugaagcugucccgcgggucugaagugguccuugaugccugugacagcuccugcgagauuaugauccccaaaggaacgggcgauauucugguggacuguagcgggggacagcaacacuuccucaaggauaaccugaucgaccugggcugcccucauauuccccuccuggggaaaauggcgaucuacauuuguagaaugucuaaucacccucggaccacaauggcuuuucuuuucugguuuuccuucggauauguuauuaccugcaucuuuugcaaggcccuguucuacagccucauuaucauuggcacacugggcaaaaagaucaagcaguaucgcgaacuuaaaccccagaccuguacgauuugcgagacagccccugugaacgcuaucgaugccgagaugcaugaccugaauuguucuuacaacaucugcccguauugugcuuccagacucaccagcgacgggcuggcccggcacgucacacagugccccaagcgcaaagaaaagguggaggaaaccgagcuguaccucaaucuggaaagaaucccuuggaucguucggaaacuucugcaagugucugaguccaccggagucgcgcucaagcgcagcuccuggcugauugugcuucuggugcuccugacagucucucugagccccguucaguccgccccugugggccacgggaaaacgaucgagaccuaccagacaagagaaggauuuaccagcauuugucucuucaugcugggcucuauccuuuuuaucguguccugccuggucaaggggcucguggauagcguuucugacagcuucuuucccggacuguccguguguaagacaugcucuauuggcagcaucaacggcuucgagauugaaucccauaaauguuauugcagccuuuucugcuguccguacugccggcacuguucugcugaucgcgagauccaucagcugcaccucuccauuugcaagaaaagaaagaccgggagcaaugucaugcuggccguguguaaacggaugugcuuuaaggcuacgaucgaagccucuagacgcgcgcugcucauucgguccaucaucaacacaaccuucguuauuuguauccugacccuugccauuugcguggucagcacauccgcuguggagauggaggaccugccugccggaaccugggaaagagaggaagaucucacaaauuuuugucaccaagagugccaggucacggaaaccgagugucugugccccuaugaggcucuggugcuucgcaagccucucuuccuggacucuaucguuaaaggcaugaagaaccugcucaauagcacaucccuggaaaccucucuuagcauugaggcccccuggggagccaucaacgugcaguccacauuuaaacccaccgucagcacggcuaacaucgcgcugucuugguccagcguggaacaucggggaaauaagauucucguuaccggcagaucugaguccaucaugaaacuggaggaacgcacaggggugagcugggaucugggcgucgaggacgccucugaaagcaaacuucucaccguguccauuauggaucugagccaaauguacucuccuguguucgaguaucuguccggagaccggcagguugaagaguggccgaaggcuacaugcaccggcgauugucccgagagaugcggguguacgagcuccacaugccuccacaaagaauggccucauucucgcaacuggcgguguaaucccaccuggugcuggggagucggcacaggguguaccugcuguggaguggacgugaaggaccuguuuaccgaucacauguucaucaaauggaaggucgaguacauuaaaacagaagccaucgugugcguugagcuuacgagccaggaaagacaguguucccugaucgaggccggcacccgcuuuaaccucgggccugugacaauuacccugucugagccccggaauauccaacagaagcugccgccugaaauuaucacacuucaucccaagauugaggaaggcuucuuugaccucaugcacguccagaaagugcugagcgcuuccaccguuugcaagcugcagucuugcacgcacggaaucccuggcgaucuccaaaucuaucauauugggaaccugcuuaaaggagacagagugaauggccaccugauccauaagauugagccccacuucaacacaagcuggauguccugggaugggugugaccucgauuacuacugcaauaugggagacuggccuagcuguaccuauaccggcgucacacagcacaaccaugccgcguuugugaaucugcugaacaucgaaaccgauuacacaaaaacguuccacuuccauucuaagcggguuaccgcucacggggacacaccccagcuugaucucaaagcccgcccgaccuauggcgccggagagauuacagugcuggucgagguggcugacauggaacugcauaccaagaagguggagaucuccggccucaaauuugccagccugacgugcaccggguguuacgcuuguucuuccggaauuagcugcaaggucagaauccacguugaugaaccugacgagcuuacagugcacgugaaaucuuccgaccccgaugucguggccgcgagcaccucccugauggcccggaagcucgaguucggcacagacagcaccuuuaaggcuuucucugccaugcccaagacaagccugugcuuuuauaucguugaaagagaguacuguaaguccugcucugaagaugacaccaaaaaguguguggauacgaaacuggagcagccucaaagcauucuuaucgaacauaaggggacaauuaucggaaaacagaaugauaccugcaccgcuaaggccuccugcuggcuggagucugucaagagcuucuuuuauggccucaaaaacaugcugggguccguguucggcagcuuuuucguugggauucuccuguuucuuacaccguucgugcugcucguccuguuuuucauguucggcuggaagauccuguuuuguuucaaaugcugucgccggaccagagggcuuuuuaaguaccgccaccugaaagacgacgaggaaacgggauacagacggaucauugagcgccucaauucuaagaagggcaaaaacagacugcucgauggggaacggcuggcggaccgcaagaucgccgagcuuuucuccacaaaaacccauauugga

SEQ ID NO: 13794 - RNA, 3495 nt, Artificial Sequence
  derived and/or modified CDS sequence (opt5) from CCHVF(CCHVF 3809-ST-2007)__KR814867.1__Gn-NSm-Gc
agcgaggaacccggcgacgauugcaucuccagaacccagcugcuccggacagagacggccgaaauucacgacgauaacuacgggggaccuggcgacaagaucaccauuuguaaugggucuacaaucguggaucaacgccugggaagcgagcuuggcugcuauaccauuaacagagucaaauccuucaagcugugugaaaauucugcuacagggaaaaccugcgagaucgacagcacaccgguuaagugucggcagggauuuugccucaaaaucacccaggagggccgcggccaugugaagcuguccagagggucugaagugguccuugaugccugugacagcuccugcgaggugaugauucccaagggaacgggcgauauccugguugacuguagcgggggacagcaacacuuccucaaagauaaccugauugaccugggcugcccucauaucccccuccuggggaagauggcgauuuacaucugucggaugucuaaucacccucgcaccacaauggcuuuucuuuucugguuuuccuucggauaugugauuaccugcaucuuuugcaaagcccuguucuacagccucaucauuaucggcacacugggcaagaaaauuaagcaguauagagaacuuaagccccagaccuguacgaucugcgagacagccccugucaacgcuauugaugccgagaugcaugaccugaauuguucuuacaacaucugcccguauugugcuucccggcucaccagcgacgggcuggcccgccacgugccccagugcccuaaaagaaaggaaaaaguugaggaaacagagcuguaccucaaucuggaacggauccccuggauugugcgcaaacuucugcaagucucugaguccaccggaguggcgcucaaaagaagcuccuggcugaucgugcuucugguccuccugaccguuucucugagcccugugcaguccgcccccgugggccacgggaagacaauugagacguaccagacccgggaaggauuuacaagcaucugucucuucaugcugggcucuauucuuuuucuggucuccugccucgugaaagggcugguugauagcgugucugacagcuucuuuccgggacuuuccgucuguaagaccugcucuaucggcagcgugaacggcuucgagaucgaaucccauaaguguuauugcagccuguucugcuguccuuacugccgccacuguucugcugauagagagauucaucagcuccaccuguccguuugcaaaaagcggaaaacagggagcaaugugaugcuggccgucuguaagagaaugugcuuucgcgcuaccaucgaagccucucggagagcgcuccugauucgcuccaucauuaacacgacauucgugaucuguauucuuacccugaccaucugcgucgugagcacauccgccguugagauggagaaucuccccgcuggaaccugggaacgggaggaagaccugacaaacuuuugucaccaagagugccaggugacggaaaccgagugucugugcccuuaugaggcccuuguccucagaaaaccccuguuccuggauucuaucgugaagggcaugaagaaucuccugaacagcacaucccuugaaaccucucugagcauugaggcucccuggggagccaucaacguucaguccacauuuaaaccuaccgugagcacggccaauauugcucucucuugguccagcgucgaacaucgcgggaacaagauccuggugaccggccggucugaguccauuaugaaacuggaggaaagaacaggggugagcugggaccuuggcguugaggaugcgucugaaagcaagcuccugaccgucuccaucauggaccugagccaaauguacucuccgguguucgaguaucucuccggagaucgccagguggaagaguggcccaaagccacaugcaccggcgacuguccugagcggugcggguguacgagcuccacaugccugcacaaggaauggccccauucuagaaauuggcgcuguaacccuaccuggugcuggggagucggcacaggguguaccugcuguggaguggauguuaaggaccuuuuuaccgaccacauguucgugaaauggaaggucgaguacaucaaaacagaagcuauugugugcguugagcugacgagccaggaacggcaguguucccucaucgaggccggcaccagauuuaaucuggggcccgugacaauuacccugucugagccgcggaacauccaacagaaacuuccucccgaaauuaucacacuccauccuaaggucgaggaaggcuucuuugaucugaugcacgugcagaagguucugagcgccuccaccgugugcaagcuccagucuugcacgcacggaauccccggcgaccugcaagucuaucauauugggaaucuucugaaaggagaucgcgugaacggccaccucauccauaagauugagccucacuucaauacaagcuggauguccugggacgggugugaucuggacuacuacugcaacaugggagauuggcccagcuguaccuauaccggcgugacacagcacaaucaugcugccuuugucaaccugcuuaauaucgaaaccgacuacacaaaaacguuccacuuccauucuaagagaguuaccgcgcacggggauacaccgcagcucgaccugaaagcucggccuaccuauggcgccggagagauuacagugcugguggaggucgccgauauggaacuccauaccaagaaaguggagaucuccggccugaaguuugcuagccuugccugcacgggguguuacgcuuguucuuccggaaucagcugcaagguucgcauucacguggacgaacccgaugagcugaccguccacgugaaaucuuccgaccccgacguuguggccgcgagcacaucccucauggccagaaagcuggaguucggcaccgauagcacauuuaaggcuuucucugccaugccuaagaccagccugugcuuuuauaucgucgaaaaagaguacugucgguccugcucugaagaggacacacagaaguguguggauaccaaacuugaacaaccgcagagcauucugaucgagcauaaggggacgauuaucggaaagcagaacgacacaugcaccgcuaaagccuccugcuggcucgagucuguuaagagcuucuuuuauggccugaaaaauaugcucggguccguguucggcaacuuuuucauuggaauccugcuuuuucugacccccuucguccuccuggugcuguuuuucauguucggcuggaagauccuguuuuguuucaagugcuguagacgcacaagagggcuucucaaauaccggcaccugaaggaugacgaagagaccggauaccgcagaauuaucgaacggcucaacaauaaaaagggcaaaaaccgccugcuugauggggagagacuggcggaccggaagauugccgaacucuuuucuacgaagacacauaucgga

SEQ ID NO: 13795 - RNA, 3495 nt, Artificial Sequence
  derived and/or modified CDS sequence (opt5) from CCHVF(CCHVF 3820-ST-2007)__KR814868.1__Gn-NSm-Gc
agcgaggaacccggcgacgauugcaucuccagaacccagcugcucaagacagagacggccgaaauucacgacgauaacuacgggucuccuggagacaaaaucaccauuuguaauggcagcacaaucguggaucaacggcugggguccgagcuuggaugcuauaccauuaaccgcgucaagucuuucaaacugugugaaaauagcgcuacaggcaagaccugcgagaucgacuccacaccgguuaaauguagacagggguuuugccucaagaucacccaggagggacggggccaugugaagcugucucgcggcagcgaagugguccuugaugccugugacuccagcugcgagauuaugauccccaaagggacgggagauauucugguggacuguucuggcgggcagcaacacuuccucaaggauaaccugaucgaccugggaugcccucauauuccccuccugggcaaaauggcgaucuacauuuguagaauguccaaucacccucggaccacaauggcuuuucuuuucugguuuagcuucggguauguuauuaccugcaucuuuugcaaggcccuguucuacucucucauuaucauuggaacacugggcaaaaagaucaagcaguaucgcgaacuuaaaccccagaccuguacgauuugcgagacagccccugugaacgcuaucgaugccgagaugcaugaccugaauuguuccuacaacaucugcccguauugugcuagcagacucaccucugacggccuggcccggcacgucacacagugccccaagcgcaaagaaaagguggaggaaaccgagcuguaccucaaucuggaaagaaucccuuggaucguucggaaacuucugcaaguguccgagagcaccggggucgcgcucaagcgcuccucuuggcugauugugcuucuggugcuccuggccgucagccugucccccguucagagcgcuccugugggacacggcaaaacaaucgagacguaccagaccagagaaggguuuacaucuauuugucucuucaugcugggauccauccuuuuuaucgugagcugccuggucaagggccucguggauucuguuagcgacuccuucuuucccgggcugucuguguguaagaccugcagcauuggauccaucaacggcuucgagauugaaagccauaaauguuauugcucucuuuucugcuguccguacugccggcacuguuccgccgaucgcgagauccaucagcugcaccucagcauuugcaagaaaagaaagacaggcucuaaugucaugcuggcuguguguaaacggaugugcuuuaaggccaccaucgaagcguccagacgcgcccugcucauucggagcaucaucaacacgacauucguuauguguauucugacccuugcuaucugcguggucuccaccucugccguggagauggaggaccugccugcugggacaugggaaagagaggaagaucucaccaauuuuugucaccaagagugccaggucacagaaacggagugucugugccccuaugaggcccuggugcuucgcaagccucucuuccuggacagcauuguuaaaggaaugaagaaccugcucaauuccaccucucuggaaacaagccuuuccaucgaggcccccuggggcgcuauuaacgugcagagcaccuuuaaacccacagucucuaccgcgaacaucgcccuguccuggagcucuguggaacaucgggggaauaagauccucguuacgggaagauccgagagcauuaugaaacuggaggaacgcaccggcgugucuugggaucugggggucgaggacgcuagcgaauccaaacuucucacagugagcaucauggaucugucucaaauguacuccccuguguucgaguaucugagcggcgaccggcagguugaagaguggccgaaggcuaccugcacaggagauugucccgagagaugcggcuguaccuccucuacgugccuccacaaggaauggccucauagccgcaacuggcgguguaaucccacauggugcuggggagucggaaccggcuguacaugcugugggguggacgugaaggaccuguuuaccgaucacauguucauuaaauggaaggucgaguacaucaaaaccgaagccauugugugcguugagcuuacaucccaggaaagacaguguucucugaucgaggccggaacgcgcuuuaaccucggcccugugaccaucacacugagcgagccccggaauauucaacagaagcugccgccugaaaucauuacccuucaucccaagaucgaggaaggguucuuugaccucaugcacguccagaaagugcuguccgccucuacaguuugcaagcugcagagcugcacccacggcauuccuggagaucuccaaaucuaucauaucggcaaccugcuuaaaggggacagagugaauggacaccugauucauaagaucgagccccacuucaacacguccuggaugagcugggauggcugugaccucgauuacuacugcaauaugggggacuggccuucuuguacauauaccggagucacccagcacaaccaugcggcuuuugugaaucugcugaacauugaaacagauuacaccaaaacauuccacuuccauuccaagcggguuacggcccacggcgacacaccccagcuugaucucaaagcccgcccgacauauggggcuggcgagaucaccgugcuggucgagguggccgacauggaacugcauacaaagaagguggagauuagcggacucaaauuugcuucucugaccugcacgggcuguuacgccugcuccagcgggaucucuuguaagguccggauucacguugaugaaccugacgagcuuaccgugcacgugaaauccagcgaccccgaugucguggcggccuccacaagccugauggcuagaaagcucgaguucggaaccgacucuacauuuaaagccuucagcgcuaugcccaagaccucccugugcuuuuauaucguugaaagagaguacuguaagucuugcagcgaagaugacaccaaaaaguguguggauaccaaacuggagcagccucaauccauccuuauugaacauaagggcacgaucauugggaaacagaaugacacaugcaccgccaaggcgucuugcuggcuggagagcgucaaguccuucuuuuauggacucaaaaacaugcugggcucuguguucgggagcuuuuucguuggcauccuccuguuucuugccccguucgugcugcucguccuguuuuucauguucggauggaagauucuguuuuguuucaaaugcugucgccggaccagaggccuuuuuaaguaccgccaccugaaagaugacgaggaaacaggguacagacggaucaucgagcgccucaauuccaagaaggggaaaaacagacugcucgauggcgaacggcuggcugaccgcaagauugccgagcuuuucagcaccaaaacgcauaucggg

SEQ ID NO: 13796 - RNA, 3495 nt, Artificial Sequence
  derived and/or modified CDS sequence (opt5) from CCHVF(CCHVF 4495-ST-2008)__KR814869.1__Gn-NSm-Gc
agcgaggaauccggcgacgauugcaucucuagaacccagcugcuccggacagagacggccgaaauucacgacgauaacuacgggggacccggcgacaagaucaccauuuguaaugggagcacaaucguggaucaacgccugggauccgagcuuggcugcuauaccauuaacagagucaaaucuuucaagcugugugaaaauagcgcuacagggaaaaccugcgagaucgacuccacaccuguuaagugucggcagggauuuugccucaaaaucacccaggagggccgcggccaugugaagcugucuagagggagcgaagugguccuugaugccugugacuccagcugcgaggugaugauuccgaagggaacgggcgauauccugguugacuguucugggggacagcaacacuuccucaaagauaaccugauugaccugggcugcccccauaucccucuccuggggaagauggcgauuuacaucugucggauguccaaucacccccgcaccacaauggcuuuucuuuucugguuuagcuucggauaugugauuaccugccuguuuugcaaagcccucuucuacucucugaucaucauuggcacacuuggcaagaaaaucaagcaguauagagaacugcggccucagaccuguacgauuugcgagacagcccccgucaacgcuaucgaugccgagaugcaugaccucaauuguuccuacaacauuugcccuuauugugcuagccgccugaccucugacgggcuggccagacacgugccgcagugccccaagcggaaagaaaagguugaggaaacagagcucuaccugaaucuugaacgcaucccuuggaucgugagaaaacugcuccaagucuccgagagcaccggaguggcgcugaagcgguccucuuggcuuauugugcugcucguccugcugaccguuagccucucccccgugcagagcgccccugugggccacgggaaaacaaucgagacguaccagacccgcgaaggauuuacaucuauuugucuguucaugcuuggcuccauccuguuucucgucagcugccuggugaaggggcuuguugauucugugagcgacuccuucuuucccggacugucugucuguaaaaccugcagcauuggcuccaucaacggcuucgagaucgaaagccauaaguguuauugcucucuccugugcuguccguacugcagacacuguuccgcugaucgggagauucaucagcugcaccucagcaucugcaagaaaagaaagacagggucuaaugugaugcuggccguuuguaaacgcaugugcuuccgggcuaccauugaagccuccagacgcgcgcuucugauccggagcauuaucaacacgacauuugugauuuguauccucacccugaccaucugcgucguguccacaucugccgucgagauggagaaucugccuagcggaaccugggaaaaggaggaagaccuuacaaacuucugucaccaagagugccaggugacggaaaccgagugucucugccccuaugaggcucugguucugagaaaaccucucuuucuggauuccauugugaagggcaugaagaaucuucugaacucuacaagccucgaaaccucccugagcaucgaggcccccuggggagcuauuaacguccagucuacauucaaacccaccguguccacggccaauaucgcccugagcuggucuuccguugaacaucgcggaaacaagauucuugugaccggccggagcgagucuaucaugaaacucgaggaaagaacagggaucagcugggaccugggcgucgaggaugcuuccgaaagcaagcugcucaccgugucuauuauggaccugucccaaauguacagcccuguguuugaguaucuuuccggagaucgccagguugaagaguggccgaaagcgacaugcaccggcgacugucccgagcggugcggguguacgucuagcacaugccugcacaaggaauggccucauuccagaaauuggcgcuguaaccccaccuggugcuggggagucggcacaggguguaccugcuguggaguggaugugaaggaccucuucaccgaccacauguuugucaaauggaagguggaguacaucaaaacagaagccauuguuugcguggagcugacgucucaggaacggcaguguagccugaucgaggcuggcaccagauucaaucuugggccugucacaauuacccucuccgagccccggaacauccaacagaagcugccgccugaaaucauuacacugcaucccaaaguggaggaaggcuuuuucgaucucaugcacguucagaaggugcugucugccagcaccgucugcaagcugcaguccugcacgcacggaaucccuggcgaccugcaaguguaucauauugggaaucuccugaaaggagaucgcguuaacggccaccugauccauaagauugagccccacuuuaauacaagcuggaugucuugggacgggugugaucuugacuacuacugcaacaugggagauuggccuuccuguaccuauaccggcgugacacagcacaaucaugccgcuuucgucaaccuccugaauaucgaaaccgacuacacaaaaacguuucacuuccauagcaagagagugaccgcccacggggauacaccccagcuggaccucaaagcgcggccgaccuauggcgcuggagagaucacagugcuggucgagguugccgauauggaacuucauaccaagaaaguggagauuucuggccugaaguucgccucccucgcuugcacgggguguuacgccugcagcucuggaaucuccuguaaggugcgcauucacgucgacgaaccugaugagcugaccgugcacguuaaaagcuccgaccccgacguggucgcugccagcacaucucugauggcgagaaaacuugaguuuggcaccgauagcacauucaaggccuuuuccgcuaugcccaagaccucucugugcuucuauaucguggaacgggaguacuguaaaagcugcuccgaagaggacacacagagauguguugauaccaagcucgaacaaccucagucuauucugaucgagcauaaggggacgauuaucggaaaacagaacgacacaugcaccgccaaggcuagcugcuggcucgaguccgugaaaucuuucuuuuauggccugaagaauaugcuugggagcgucuuuggcaacuucuuuaucgggauucuucucuuccuggccccguuugugcugcuuguucuguucuuuauguucggcuggaaaauccucuucuguuuuaagugcugucgcagagcgcgggggcugcucaaguaccgccaccugaaagaugacgaagagaccggauacagaaagauuaucgaacggcuuaacaauaaaaagggcaaaaaccgccugcucgauggggagagacuggccgaccggaagauugcugaacuguucuccacaaagacccauaucgga

SEQ ID NO: 13797 - RNA, 3495 nt, Artificial Sequence
  derived and/or modified CDS sequence (opt5) from CCHVF(CCHVF 4691-ST-2009)__KR814871.1__Gn-NSm-Gc
agcgaggaacccggcgacgauugcaucuccagaacccagcugcucaagacagagacggccgaaauucacgacgauaacuacgggggaccuggcgacaaaaucaccauuuguaaugggucuacaaucguggaucaacggcugggaagcgagcuuggcugcuauaccauuaaccgcgucaaguccuucaaacugugugaaaauucugcuacagggaagaccugcgagaucgacagcacaccgguuaaauguagacagggauuuugccucaagaucacccaggagggccggggccaugugaagcugucccgcgggucugaagugguccuugaugccugugacagcuccugcgagauuaugauccccaaaggaacgggcgauauucugguggacuguagcgggggacagcaacacuuccucaaggauaaccugaucgaccugggcugcccucauauuccccuccuggggaaaauggcgaucuacauuuguagaaugucuaaucacccucggaccacaauggcuuuucuuuucugguuuuccuucggauauguuauuaccugcaucuuuugcaaggcccuguucuacagccucauuaucauuggcacacugggcaaaaagaucaagcaguaucgcgaacuuaaaccccagaccuguacgauuugcgagacagccccugugaacgcuaucgaugccgagaugcaugaccugaauuguucuuacaacaucugcccguauugugcuuccagacucaccagcgacgggcuggcccggcacgucacacagugccccaagcgcaaagaaaagguggaggaaaccgagcuguaccucaaucuggaaagaaucccuuggaucguucggaaacuucugcaagugucugaguccaccggagucgcgcucaagcgcagcuccuggcugauugugcuucuggugcuccugacagucucucugagccccguucaguccgccccugugggccacgggaaaacgaucgagaccuaccaggcuagagaaggauuuacaagcauuugucucuucaugcugggcucuauccuuuuuaucguguccugccuggucaaggggcucguggauagcguuucugacagcuucuuucccggacuguccguguguaagaccugcucuauuggcagcaucaacggcuucgagauugaaucccauaaauguuauugcagccuuuucugcuguccguacugccggcacuguucugccgaucgcgagauccaucagcugcaccucuccauuugcaagaaaagacggacagggagcaaugucaugcuggcuguguguaagagaaugugcuuuaaagccaccaucgaagcgucucgccgggcccugcucauuagauccaucaucaacacgacauucguuauuuguauccugacccuugcuauuugcguggucagcaccuccgccguggagauggagaaucugccugcuggaacaugggaacgcgaggaagaccucaccaacuuuugucaccaagagugccaggucacagaaacggagugucugugccccuaugaggcccuggugcuucggaagccucucuuccuggauucuaucguuaagggcaugaaaaaucugcucaacagcaccucccuggaaacaucucuuagcauugaggcccccuggggagcuaucaacgugcaguccaccuuuaagcccgcggucagcacagccaauaucgcucugucuugguccagcguggaacauagaggaaacaaaauucucguuaccggccgcucugaguccaucaugaagcuggaggaacggacgggggugagcugggaccugggcgucgaggaugccucugaaagcaaacuucucaccguguccauuauggaccugagccaaauguacucuccuguguucgaguaucuguccggagauagacagguugaagaguggccgaaggccacaugcaccggcgacugucccgagcgcugcggguguacaagcucuaccugccuccacaaggaauggccucauucucggaauuggagauguaaccccacguggugcuggggagucggcacaggguguaccugcuguggaguggaugugaaagaccuguuuacagaccacauguucaucaaguggaaagucgaguacauuaagaccgaagcuaucgugugcguugagcuuaccagccaggaacgccaguguucccugaucgaggccggcacacgguuuaaucucgggccugugacgauuacccugucugagcccagaaacauccaacagaaacugccgccugaaauuaucacacuucaucccaagauugaggaaggcuucuuugaucucaugcacguccagaaggugcugagcgcguccaccguuugcaaacugcagucuugcacacacggaaucccuggcgaccuccaaaucuaucauauugggaaucugcuuaagggagaucgggugaacggccaccugauccauaaaauugagccccacuucaauaccagcuggauguccugggacgggugugaucucgacuacuacugcaacaugggagauuggccuagcuguacguauacaggcgucacccagcacaaucaugcugccuuugugaaccugcugaauaucgaaaccgacuacacaaagaccuuccacuuccauucuaaacgcguuacagcccacggggauacgccccagcuugaccucaaggcuagaccgaccuauggcgccggagagauuacagugcuggucgagguggcugauauggaacugcauaccaaaaagguggagaucuccggccucaaguuugccagccuggcgugcacaggguguuacgccugcuccuccggaauuagcuguaaaguccggauccacguugacgaaccugaugagcuuaccgugcacgugaagucuuccgaccccgacgucguggcugccagcacgucccugauggcuagaaaacucgaguucggcaccgauagcacauuuaaggccuucucugcgaugcccaaaaccagccugugcuuuuauaucguugaacgcgaguacuguaaguccugcucugaagacgauacaaagaaauguguggacaccaagcuggagcagccucaaagcauucuuaucgaacauaaagggacaauuaucggaaagcagaacgauaccugcacggccaaagccuccugcuggcuggagucugucaagagcuucuuuuauggccucaagaauaugcugggguccguguucggcaacuuuuucguugggauucuccuguuucuugcuccguucgugcugcucguccuguuuuucauguucggcuggaaaauccuguuuuguuucaagugcugucggagaacacgcgggcuuuuuaaauacagacaccugaaggacgaugaggaaaccggauaccggcgcaucauugagagacucaacucuaaaaagggcaagaaucggcugcucgacggggaacgccuggcugauagaaaaaucgccgagcuuuucagcaccaagacacauauugga

SEQ ID NO: 13798 - RNA, 3495 nt, Artificial Sequence
  derived and/or modified CDS sequence (opt5) from CCHVF(CCHVF 4701-ST-2009)__KR814872.1__Gn-NSm-Gc
agcgaggaacccggcgacgauugcaucuccagaacccagcugcucaagacagagacggccgaaauucacgacgauaacuacgggggaccuggcgacaaaaucaccauuuguaaugggucuacaguggucgaucaacggcugggaagcgagcuuggcugcuauaccaucaaccgcguuaaguccuucaaacugugugaaaauucugcuacagggaagaccugcgagauugacagcacaccggugaaauguagacagggauuuugccucaagaucacccaggagggccggggccaugugaagcugucccgcgggucugaagucgugcuugaugccugugacagcuccugcgagaucaugauucccaaaggaacgggcgauauccugguugacuguagcgggggacagcaacacuuccucaaggauaaccugauugaccugggcugcccucauaucccccuccuggggaaaauggcgauuuacaucuguagaaugucuaaucacccucggaccacaauggcuuuucuuuucugguuuuccuucggauaugugauuaccugcaucuuuugcaaggcccuguucuacagccucaucauuaucggcacacugggcaaaaagauuaagcaguaucgcgaacuuaaaccccagaccuguacgaucugcgagacagccccugucaacgcuauugaugccgagaugcaugaccugaauuguucuuacaacaucugcccguauugugcuuccagacucaccagcgacgggcuggcccggcacgugacacagugccccaagcgcaaagaaaagguugaggaaaccgagcuguaccucaaucuggaaagaaucccuuggauugugcggaaacuucugcaagucucugaguccaccggaguggcgcucaagcgcagcuccuggcugaucgugcuucugguccuccugacaguuucucugagccccgugcaguccgccccugugggccacgggaaaacgauugagaccuaccagacaagagaaggauuuaccagcaucugucucuucaugcugggcucuauucuuuuuaucgucuccugccuggugaaggggcucguugauagcgugucugacagcuucuuucccggacuguccgucuguaagacaugcucuaucggcagcauuaacggcuucgagaucgaaucccauaaauguuauugcagccuuuucugcuguccguacugccggcacuguucugcugaucgcgagauucaucagcugcaccucuccaucugcaagaaaagaaagaccgggagcaaugugaugcuggccguuuguaaacggaugugcuuuaaggcuacgauugaagccucuagacgcgcgcugcucauccgguccauuaucaacacaaccuucgugauguguauccugacccuugccauuugcgucgugagcacauccgcugucgagauggaggaccugccugccggaaccugggaaagagaggaagaucucacaaauuuuugucaccaagagugccaggugacggaaaccgagugucugugccccuaugaggcucugguucuucgcaagccucucuuccuggacucuaucgugaaaggcaugaagaaccugcucaauagcacaucccuggaaaccucucuuagcauugaggcccccuggggagccaucaacguccaguccacauuuaaacccaccgugagcacggcuaacauugcgcugucuugguccagcguugaacaucgggggaauaagauccucgugaccggcagaucugaguccaucaugaaacuggaggaacgcacaggggucagcugggaucugggcguggaggacgccucugaaagcaaacuucucaccguguccauuauggaucugagccaaauguacucuccuguuuucgaguaucuguccggagaccggcaggucgaagaguggccgaaggcuacaugcaccggcgauugucccgagagaugcggguguacgagcuccacaugccuccacaaagaauggccucauucucgcaacuggcgguguaaucccaccuggugcuggggagugggcacaggguguaccugcuguggaguggacgucaaggaccuguuuaccgaucacauguucaucaaauggaagguggaguacauuaaaacagaagccaucguuugcguggagcuuacgagccaggaaagacaguguucccugauugaggccggcacccgcuuuaaccucgggccugucacaaucacccugucugagccccggaauauccaacagaagcugccgccugaaauuaucacacuucaucccaagauugaggaaggcuucuuugaccucaugcacgugcagaaaguucugagcgcuuccaccgugugcaagcugcagucuugcacgcacggaaucccuggcgaucuccaaauuuaucauaucgggaaccugcuuaaaggagacagagucaauggccaccugauccauaagauugagccccacuucaacacaagcuggauguccugggaugggugugaccucgauuacuacugcaauaugggagacuggccuagcuguaccuauaccggcgugacacagcacaaccaugccgcguuuguuaaucugcugaacaucgaaaccgauuacacaaaaacguuccacuuccauucuaagcgggugaccgcucacggggacacaccccagcuugaucucaaagcccgcccgaccuauggcgccggagagauuacaguccugguggagguggcugacauggaacugcauaccaagaaggucgagaucuccggccucaaauuugccagccugacgugcaccggguguuacgcuugcagcuccggaauuagcuguaagguuagaauccacguggaugaaccugacgagcuuacagugcacgucaaaucuuccgaccccgaugugguugccgcgagcaccucccugauggcccggaagcucgaguucggcacagacagcaccuuuaaggcuuucucugccaugcccaagacaagccugugcuuuuauauuguggaaagagaguacuguaaguccugcucugaagaugacaccaaaaagugugucgauacgaaacuggagcagccucaaagcauccuuaucgaacauaaggggacaauuaucggaaaacagaaugauaccugcaccgcuaaggccuccugcuggcuggagucugugaagucuuucuuuuauggccucaaaaacaugcugggguccguuuucggcggauuuuucgugggcauucuccuguuucuugcgccguucguccugcucgugcuguuuuucauguucggguggaagauccuguuuuguuucaaaugcugucgccggacaagaggacuuuuuaaguaccgccaccugaaagacgacgaggaaaccggcuacagacggauuaucgagcgccucaauucuaagaaggggaaaaacagacugcucgauggagaacggcuggccgaccgcaagaucgcugagcuuuucagcacgaaaacacauauuggc

SEQ ID NO: 13799 - RNA, 3495 nt, Artificial Sequence
  derived and/or modified CDS sequence (opt5) from CCHVF(CCHVF 5170-R-2011)__KR814873.1__Gn-NSm-Gc
agcgaggaacccggcgacgauugcaucuccagaacccagcugcucaagacagagacggccgaaauucacgacgauaacuacgggggaccuggcgacaaaaucaccauuuguaaugggucuacaaucguggaucaacggcugggaagcgagcuuggcugcuauaccauuaaccgcgucaaguccuucaaacugugugaaaauucugcuacagggaagaccugcgagaucgacagcacaccgguuaaauguagacagggauuuugccucaagaucacccaggagggccggggccaugugaagcugucccgcgggucugaagugguccuugaugugugugacagcuccugcgagauuaugauccccaaaggaacgggcgauauucugguugacuguagcgggggacagcaacacuuccucaaggauaaccugaucgaccugggcugcccucauauuccccuccuggggaaaauggccaucuacauuuguagaaugucuaaucacccucggaccacaauggcguuucuuuucugguuuuccuucggauaugugauuaccugcaucuuuugcaaggcucuguucuacagccucauuaucauuggcacacugggcaaaaagaucaagcaguaucgcgaacuuaaaccccagaccuguacgauuugcgagacagccccugucaacgccaucgaugcugagaugcaugaccugaauuguucuuacaacaucugcccguauugugccuccagacucaccagcgaagggcuggcucggcacgugacacagugccccaagcgcaaagagaagguugaagagaccgaacuguaccucaaucuggagagaaucccuuggaucgugcggaaacuucugcaagucucugaguccaccggaguggcccucaagcgcagcuccuggcugauugugcuucugguccuccugacaguuucucugagccccgugcaguccgcgccugugggccacgggaaaacgaucgaaaccuaccagacaagagagggauuuaccagcauuugucucuucaugcugggcucuauccuuuuuaucgucuccugccuggugaaggggcucguugacagcgugucugauagcuucuuucccggacuguccgucuguaagacaugcucuauuggcagcaucaacggcuucgaaauugagucccauaaauguuauugcagccuuuucugcuguccguacugccggcacuguucugccgaccgcgaaauccaucagcugcaccucuccauuugcaagaaaagaaagaccgggagcaaugugaugcuggcuguuuguaaacggaugugcuuuaaggccacgaucgaggcuucuagacgcgcccugcucauucgguccaucaucaacacaaccuucgugauuuguauccugacccuugcgauuugcgucgugagcacauccgccgucgagauggaagaucugccugcuggaaccugggagagagaagaggaccucacaaauuuuugucaccaagaaugccaggugacggagaccgagugucugugccccuaugaagcccugguucuucgcaagccucucuuccuggauucuaucgugaaaggcaugaagaaccugcucaauagcacaucccuggagaccucucuuagcauugaagcucccuggggagccaucaacguccaguccacauuuaaacccaccgugagcacggccaacaucgcucugucuugguccagcguugagcaucggggaaauaagauucucgugaccggcagaucugaguccaucaugaaacuggaggaacgcacaggggucagcugggaccugggcguggaagaugcgucugagagcaaacuucucaccguguccauuauggaccugagccaaauguacucuccuguuuucgaauaucuguccggagaucggcaggucgaggaguggccgaaggccacaugcaccggcgacugucccgaaagaugcggguguacgagcuccacaugccuccacaaggaguggccucauucucgcaacuggcgguguaaucccaccuggugcuggggagugggcacaggguguaccugcuguggaguggaugucaaggaccuguuuaccgaccacauguucaucaaauggaagguggaauacauuaaaacagaggcuaucguuugcguggaacuuacgagccaggagagacaguguucccugaucgaggccggcacccgcuuuaaccucgggccugucacaauuacccugucugaaccccggaauauccaacagaagcugccgccugagauuaucacacuucaucccaagauugaagagggcuucuuugaucucaugcacgugcagaaaguucugagcgccuccaccgugugcaagcugcagucuugcacgcacggaaucccuggcgaccuccaaaucuaucauauugggaaccugcuuaaaggagauagagucaauggccaccugauccauaagauugaaccccacuucaacacaagcuggauguccugggacgggugugaucucgacuacuacugcaauaugggagauuggccuagcuguaccuauaccggcgugacacagcacaaccaugcugccuuuguuaaucugcugaacaucgagaccgacuacacaaaaacguuccacuuccauucuaagcgggugaccgcgcacggggauacaccccagcuugaccucaaagcucgcccgaccuauggcgccggagagauuacaguccugguggaaguggccgauauggagcugcauaccaagaaggucgaaaucuccggccucaaauuugcuagccugacgugcaccggguguuacgccuguucuuccggaauuagcugcaagguuagaauccacguggacgagccugaugagcuuacagugcacgucaaaucuuccgaccccgacgugguugcugccagcaccucccugauggcgcggaagcucgaauuuggcacagauagcaccuuuaaagccuucucugcuaugcccaagacaagccugugcuuuuauaucguggagagagaauacuguaaguccugcucugaggacgauaccaaaaagugugucgacacgaaacuggaacagccucaaagcauucuuaucgagcauaaggggacaauuaucggaaaacagaaugauaccugcaccgccaaggcuuccugcuggcuggagucuguuaagagcuucuuuuauggccucaaaaacaugcugggguccguguucggcucuuucuucguggggauucuccuguuucuugccccguucguccugcucgugcuguuuuucauguucggcuggaagauccuguuuuguuucaaaugcugucgccggacaagagggcuuuuuaaguaccgccaccugaaagacgaugaagagaccggauacagacggaucauugaacgccucaauagcaagaagggcaaaaacagacugcucgacggggagcggcuggcggaucgcaagaucgccgaacuuuucuccacgaaaacacauauugga

SEQ ID NO: 13800 - RNA, 3495 nt, Artificial Sequence
  derived and/or modified CDS sequence (opt5) from CCHVF(CCHVF Oman-199809166)__KR864901.1__Gn-NSm-Gc
agcgaggaauccggcgaggacugcaucucuagaacccagcugcuccggacagaaacggccgagauucacggggauaacuacggaggccccggggacaagaucaccauuuguaauggaagcacaaucguggaucaacgccugggcuccgaacuugggugcuauaccauuaacagagucaaaucuuucaagcugugugagaauagcgcuacaggaaaauccugcgagaucgacaacaccccuguuaaguguaaacagggcuuuugccucaagaucacacaggaaggccgggggcaugugaagcugucucgcgauagcgaggugguccuugacgccugugauuccagcugcgaaauuaugaucccgaaaggaaccggcgacauucugguggauuguucugggggacagcaacacuuccucaaggacaaucugaucgaucugggcugccccaacauuccucuccuggggaaaauggcgaucuacauuuguagaauguccaaucaucccaagacgaccauggcuuuucuuuucugguuuagcuucggauauguuaucacaugcauccugugcaaagugaucuuuuaccuccugauugucgugggcacccuuggcaagaaguucaaacaguaucgggagcugaagccucagacauguaccauuugcgagacgacacccguuaacgccaucgacgccgaaaugcacgaucucaauuguucuuacaacauuugcccuuauugugcuucccgccugaccagcgacgggcuggccagacaugugaugcagugcccgaaacggaaggagaaaaucgaagagacagaacucuaccugaaucuugagcgcauccccugggucgugagaaagcugcuccaagugucugaguccaccggagucgcucugaaacggagcuccuggcuuauuguucugcucgugcugcugaccgugucucucagcccuguccaguccgcccccaucggccacgggaagacaauugaaacguaccagacccgcgagggauauacaagcaucugucuguuugugcuuggcucuauucuguucaucguuucccaccucaugaaggggcugguggacagcgucggaaacagcuuuuucccuggccuuucuaucugcaaaaccuguuccauuggcucuaucaauggguuugaaauugagagccauaagugcuacuguucccuguucugcugccccuauuguagacacugcagcgcggauaaagaaauccauaagcuccaccugucuauuuguaaaaagcggaaggccggauccaacgugaugcuggcuguuugcaaacgcauguguuucagagccacaauggaggugagcaauaaggcucuccugauccggucugucauuaacaccacguuuguggucugcauccuuauccuggccguguguguuguguccacaagcgcggucgagauggaaucccucccggccggcaccugggagagagaagaggaccugaccaacuucugccaccaggaaugucaagugacagagaccgagugccuguguccuuacgaagcucuuguucuccgcaaaccccuguuucuggauucuauugccaaggggaugaaaaaucuccugaacagcacaucccuugagacgucucugagcaucgaagcuccuuggggagccauuaaugugcaguccaccuucaagcccacagucagcaccgccaacaucgcucucucuugguccagcguggagcaucggggcaauaagauucuggugucugggagauccgagagcaucaugaaacuggaagagagaacaggcaucucuugggaccuuggaguugaagaugcgagcgaguccaagcuccugaccgucagcgugauggaccugucucagauguauucccccguguuugaauaccucagcggcgaucggcaagucgaggaguggccuaaagccacgugcaccggggacugcccggaaagauguggaugcacauccucuaccugucugcacaaggaguggccccauagccgcaacuggcggugcaauccuacaugguguuggggcguggggaccggaugcacguguugcggccuugauguuaaagaccuguucacagauuauauguuugugaaguggaaggucgaauacauuaaaaccgaggcuaucguguguguugaacucacaucccaggagagacagugcucucugauugaggccgggacccgcuucaaccugggccccgugaccaucacacuuagcgaaccucggaauauucagcaaaagcugcccccggagaucgucacgcuccacccuagaaucgaagagggauuuuucgaccugaugcaugugcagaaaguucucuccgccucuaccguguguaagcugcagagcugcacacacggcguccccggggaccuucagguguaccacauuggaaaccugcucaaaggcgauaaggugaaugggcaucugauccacaaagucgaaccucauuuuaacaccuccuggaugagcugggacggaugcgaucuggacuauuacuguaauaugggcgauuggcccucuugcacauauaccgggguuacgcaacacaaccacgcugccuucgugaaucuucucaacauugagacagacuacaccaagaacuuucauuuccacuccaagcgcgugaccgcgcauggcgauacaccucagcuggaccugaaagcucggcccaauuauggagccggcgagaucaccguccucguggaaguugccgauauggagcugcacacaaagaaaauugaaaucagcgggcuuaaguucgcuucucugacguguaccggaugcuacgccuguuccagcggcaucucuugcaaagugcgcauucaugucgacgagccggaugagcucacagugcacguuaaguccgaagacccugauaucguggcugccagcuccagccugauggcgcggaagcuggaguuugggaccgacucuacauucaaagccuuuagcgcuaugcccaagaccucccuuuguuucuauauugucgaacgcgaguacugcaaaucuuguagcaaggaagacacgcagaaaugcgugaacgccaagcuggagagaccccaguccauccucauugagcacaagggaaccaucauuggcaaacaaaaugauacauguaccgcuaaggccucuugcuggcuggaaagcguuaaauccuuuuucuacgggcucaagaacaugcugucuggcaucuuuggaaauguguucaucggcauuuuucuuuuccuggcgccuuuuauccuccugauucuguucuuuauguucggguggcggauccuuuucugcuuuaaauguugcagacgcacacggggacuguucaaguauagacaucucaaggacgaugaggaaaccggcuaccgcaaaauuaucgagagacugaacaauaagaaagggaagaacaaacuccuggacggagaacggcuugccgaucgcaagaucgcugagcuguuuagcacaaaaacccacauuggc

SEQ ID NO: 13801 - RNA, 3495 nt, Artificial Sequence
  derived and/or modified CDS sequence (opt5) from CCHVF(CCHVF 200406546-Turkey)__KR864902.1__Gn-NSm-Gc
agcgaggaacccggcgacgauugcaucuccagaacccagcuucuccggacagagacggccgaaauucacgacgauaacuacgggggaccuggcgacaagaucaccauuuguaaugggucuacaaucguggaucaacgccugggaagcgagcuuggcugcuauaccauuaacagagucaaauccuucaagcugugugaaaauucugcuacagggaaaaccugcgagaucgacagcacaccgguuaagugucggcagggauuuugccucaaaaucacccaggagggccgcggccaugugaagcuguccagagggucugaagugguccuugaugugugugacagcuccugcgagguuaugauucccaagggaacgggcgauauccugguggacuguagcgggggacagcaacacuuccucaaagauaaccugauugaccugggcugcccucaugucccccuccuggggcggauggccaucuacauuugucgcaugucuaaucacccuagaaccacaauggcguuucuuuucugguuuuccuucggauaugugauuaccugcaucuuuugcaaggcucuguucuacagccucaucaucauuggcacacugggcaaaaaguuuaaacaguaucgggaacuuaagccccagaccuguacgaucugcgagacagccccuguuaacgccauugaugcugagaugcaugaccugaauuguucuuacaacaucugcccguauugugccucccgccucaccagcgacgggcuggcuagacacgugccccagugcccuaagcggaaagaaaaggucgaggaaacagagcuguaccucaaucuggaacgcauucccuggaucgugagaaaacuucugcaagugucugaguccaccggagucgcccucaagcggagcuccuggcugaucguucuucuggugcuccugaccgugucucugagcccuguccaguccgcgcccgugggccacgggaaaacaauugagacguaccagacccgcgaaggauucacaagcaucugucucuuuaugcugggcucuauucuuuucaucguuuccugccuggugaaggggcucgucgauagcgugucugacagcuuuuucccgggacuguccguuuguaaaaccugcucuauuggcagcaucaacggcuucgagaucgaaucccauaaguguuauugcagccuguuuugcuguccuuacugcagacacuguucugccgaucgggagauucaucagcuucaccucuccaucugcaagaaaagaaagacagggagcaaugugaugcuggcugucuguaaacgcaugugcuuccgggccaccauugaggcuucuagacgcgcccugcucauccgguccauuaucaacacgacauuugugauuuguauccugacccuuaccaucugcgucgugagcacauccgcgguugaaauggagaaucugcccgccggaaccugggaaagagaggaagaccucacaaacuucugucaccaagagugccaggugacggaaaccgagugucugugcccuuaugaggcucugguccuucgcaagccccucuuucuggauucuauugugaaaggcaugaagaaucugcucaacagcacaucccuggaaaccucucuuagcaucgaggcccccuggggagcuauuaacguucaguccacauucaagccuaccgugagcacggccaauaucgcccugucuugguccagcauugaacaucggggaaacaaaauccucgucaccggcagaucugaguccaucaugaagcuggaggaacgcacaggggugagcugggaccugggcguggaggaugcuucugaaagcaaacuucucaccguuuccauuauggaccugagccaaauguacucuccggucuuugaguaucuguccggagauagacagguggaagaguggcccaaggcgacaugcaccggcgacuguccugagcggugcggguguacgagcuccacaugccuccacaaagaauggccccauucucgcaauuggcgguguaacccuaccuggugcuggggagugggcacaggguguaccugcuguggagucgaugugaaggaccuguucaccgaccacauguuuguuaaguggaaaguggaguacaucaagacagaagccauugucugcguggagcuuacgagccaggaaagacaguguucccugaucgaggcuggcacccgguucaaucucgggcccguuacaauuacccugucugagccgcgcaacauccaacagaaacugccucccgaaaucauuacacuucauccuaagguggaggaaggcuuuuucgaucucaugcacguccagaaagugcugagcgccuccaccguuugcaagcugcagucuugcacgcacggaauccccggcgaccuccaaguguaucauauugggaaucugcuuaagggagauagagucaacggccaccugauccauaaaauugagccucacuuuaauacaagcuggauguccugggacgggugugaucucgacuacuacugcaacaugggagauuggcccagcuguaccuauaccggcgugacacagcacaaucaugccgcuuucgugaaccugcugaauaucgaaaccgacuacacaaagacguuccacuuucauucuaaacgggucaccgcccacggggauacaccgcagcuugaccucaaggcgagaccuaccuauggcgcuggagagaucacaguucugguggagguggccgauauggaacugcauaccaaaaaggucgagauuuccggccucaaauucgccagccuggcuugcacgggguguuacgccuguucuuccggaaucagcugcaaggugcgcauucacguugacgaacccgaugagcuuaccgugcacgucaagucuuccgaccccgacgugguugcugccagcacaucccugaccgcgcggaaacucgaguuuggcacagauagcaccuucaaggccuuuucugcuaugccuaaaacaagccugugcuucuauaucguggaaaaggaguacuguaaauccugcaacgaagacgauacccagaagugugucgacacgaagcuggagcaaccgcagucuauucuuaucgaacauaaagggacaauuaucggaaagcagaaugauaccugcaccgccaaagcuagcugcuggcuggaguccgugaagucuuucuuuuauggccucaaaaacaugcuggggagcguuuuuggcaacuucuuuaucgggauucuccuguuccuugcccccuuugugcugcucguccuguucuucauguuuggcuggaagauccuguucuguuuuaagugcuguagacgcacaagagggcuuuucaaauaccggcaccugaaggacgaugaggaaaccggauacaaacgcauuaucgagagacucaauaacaagaaaggcaagaaucggcugcucgacggggaacgccuggcggauagaaagauugccgagcuguuuuccacgaaaacacauaucgga

SEQ ID NO: 13802 - RNA, 3495 nt, Artificial Sequence
  derived and/or modified CDS sequence (opt5) from CCHVF(CCHVF 1-CR/HU-2015)__KU161584.1__Gn-NSm-Gc
agcgaggaacccggcgacgauugcaucuccagaacccagcugcuccggacagagacggccgaaauucacgacgauaacuacgggggaccuggcgacaagaucaccauuuguaaugggucuacaaucguggaucaacgccugggaagcgagcuuggcugcuauaccauuaacagagucaaauccuucaagcugugugaaaauucugcuacagggaaaaccugcgagaucgacagcacaccgguuaagugucggcagggauuuugccucaaaaucacccaggagggccgcggccaugugaagcuguccagagggucugaagugguccuugaugccugugacagcuccugcgaggugaugauucccaagggaacgggcgauauccugguugacuguagcgggggacagcaacacuuccucaaagauaaccugauugaccugggcugcccucauaucccccuccuggggaagauggcgauuuacaucugucggaugucuaaucacccucgcaccacaauggcuuuucuuuucugguuuuccuucggauaugugauuaccugcaucuuuugcaaagcccuguucuacagccucaucauuaucggcacacugggcaagaaaauuaagcaguauagagaacuuaagccccagaccuguacgaucugcgagacagccccugucaacgcuauugaugccgagaugcaugaccugaauuguucuuacaacaucugcccguauugugcuucccggcucaccagcgacgggcuggcccgccacgugacacagugccccaaaagaaaggaaaaaguugaggaaaccgagcuguaccucaaucuggaacggaucccuuggauugugcgcaaacuucugcaagucucugaguccaccggaguggcgcucaagagaagcuccuggcugaucgugcuucugguccuccugacaguuucucugagccccgugcaguccgccccugugggccacgggaagacgauugagaccuaccagacacgggaaggauuuaccagcaucugucucuucaugcugggcucuauucuuuuuaucgucuccugccuggugaaagggcucguugauagcgugucugacagcuucuuucccggacuguccgucugucgcacaugcucuaucggcagcauuaacggcuucgagaucgaaucccauaaguguuauugcagccuuuucugcuguccguacugcagacacuguucugcugaucgggagauucaucagcugcaccucuccaucugcaagaaaagaaagaccgggagcaaugugaugcuggccguuuguaaacgcaugugcuuucgggcuacgauggaagccucuagacgcgcgcugcucauucgguccaucauuaacacaaccuucgugaucuguauccugacccuuacaauuugcgucgugagcaccuccgccgucgagauggagaaucugccugcuggaacaugggaaagagaggaagaccucacgaacuuuugucaccaagagugccaggugaccgaaacagagugucugugccccuaugaggcccugguucuucgcaagccucucuuccuggauucuaucgugaaaggcaugaagaaucugcucaacagcaccucccuggaaacaucucuuagcauugaggcucccuggggagccaucaacguccaguccaccuuuaagcccacggugagcaccgccaauauugcucugucuugguccagcguugaacaucggggaaacaaaauccucgugacaggcagaucugaguccaucaugaagcuggaggaacgcaccggggucagcugggaccugggcguggaggaugcgucugaaagcaaacuucucacaguguccauuauggaccugagccaaauguacucuccuguuuucgaguaucuguccggagaucggcaggucgaagaguggccgaaggcuaccugcacgggcgacugucccgagagaugcggguguacaagcucuaccugccuccacaaagaauggccucauucucgcaauuggcgguguaaccccacauggugcuggggagugggcaccggguguaccugcuguggaguggaugucaaggaccuguuuacagaccacauguucgugaaguggaaaguugaguacaucaagacggaagccauugugugcgucgagcuuaccagccaggaaagacaguguucccugaucgaggccggcacacgguuuaaucucgggccugugaccauuacacugucugagccccgcaacauccaacagaaacugccgccugaaaucauuacccuucaucccaagaucgaggaaggcuucuuugaucucaugcacguucagaaagugcugagcgccuccacggucugcaagcugcagucuugcacacacgggauuccuggcgaccuccaaguguaucauaucgggaaucugcuuaagggagauagaguuaacggccaccugauucauaaaaucgagccccacuucaauaccagcuggauguccugggacgggugugaucucgacuacuacugcaacaugggagauuggccuagcuguaccuauacaggcgugacccagcacaaucaugcugccuuugucaaccugcugaauaucgaaacagacuacacgaagaccuuccacuuccauucuaaacgggugacagcgcacggggauacaccccagcuugaccucaaggcuagaccgaccuauggcgccggagagauuaccgugcuggucgagguugccgauauggaacugcauacgaaaaagguggagaucuccggccucaaauuugcuagccuggccugcaccggguguuacgcuugcuccuccggaauuagcuguaaggugcgcauccacgucgacgaaccugaugagcuuacagugcacguuaagucuuccgaccccgacguggucgccgcgagcaccucccugauggcccggaaacucgaguucggcacagauagcaccuuuaaggcuuucucugccaugcccaaaacaagccugugcuuuuauauuguggaaagagaguacuguaaguccugcucugaagacgauaccaaaaaguguguugacacgaagcuggagcagccucaaagcauccuuauugaacauaaagggacaaucaucggaaagcagaacgauaccugcaccgcuaaagccuccugcuggcuggagucugucaagagcuucuuuuauggccucaaaaauaugcugggguccguguucggcaacuuuuucauuggaauccuccuguuucuugcgccguucgugcugcucguucuguuuuucauguucggcuggaagauucuguuuuguuucaagugcugucgcagaacacgggggcuuuuuaaauaccgccaccugaaggacgaugaggaaaccggauacagacggaucauugagcgccucaacaauaaaaagggcaaaaacagacugcucgacggggaacggcuggccgaucgcaagaucgcugagcuuuucucuacgaagacacauaucgga

SEQ ID NO: 13803 - RNA, 3495 nt, Artificial Sequence
  derived and/or modified CDS sequence (opt5) from CCHVF(CCHVF 1231-CR/TI-2015)__KU161585.1__Gn-NSm-Gc
agcgaggaacccggcgacgauugcaucuccagaacccagcugcuccggacagagacggccgaaauucacgacgauaacuacgggggaccuggcgacaagaucaccauuuguaaugggucuacaaucguggaucaacgccugggaagcgagcuuggcugcuauaccauuaacagagucaaauccuucaagcugugugaaaauucugcuacagggaaaaccugcgagaucgacagcacaccgguuaagugucggcagggauuuugccucaaaaucacccaggagggccgcggccaugugaagcuguccagagggucugaagugguccuugaugccugugacagcuccugcgaggugaugauucccaagggaacgggcgauauccugguugacuguagcgggggacagcaacacuuccucaaagauaaccugauugaccugggcugcccucauaucccccuccuggggaagauggcgauuuacaucugucggaugucuaaucacccucgcaccacaauggcuuuucuuuucugguuuuccuucggauaugugauuaccugcaucuuuugcaaagcccuguucuacagccucaucauuaucggcacacugggcaagaaaauuaagcaguauagagaacuuaagccccagaccuguacgaucugcgagacagccccugucaacgcuauugaugccgagaugcaugaccugaauuguucuuacaacaucugcccguauugugcuucccggcucaccagcgacgggcuggcccgccacgugacacagugccccaaaagaaaggaaaaaguugaggaaaccgagcuguaccucaaucuggaacggaucccuuggauugugcgcaaacuucugcaagucucugaguccaccggaguggcgcucaagagaagcuccuggcugaucgugcuucugguccuccugacaguuucucugagccccgugcaguccgccccugugggccacgggaagacgauugagaccuaccagacacgggaaggauuuaccagcaucugucucuucaugcugggcucuauucuuuuuaucgucuccugccuggugaaagggcucguugagagcgugucugauagcuucuuucccggacuguccgucugucgcacaugcucuaucggcagcauuaacggcuucgaaaucgagucccauaaguguuauugcagccuuuucugcuguccguacugcagacacuguucugcugaccgggaaauucaucagcugcaccucuccaucugcaagaaaagaaagaccgggagcaaugugaugcuggccguuuguaaacgcaugugcuuucgggcuacgauggaggccucuagacgcgcgcugcucauucgguccaucauuaacacaaccuucgugaucuguauccugacccuuacaauuugcgucgugagcaccuccgccgucgagauggaaaaucugccugcuggaacaugggagagagaagaggaucucacgaacuuuugucaccaagaaugccaggugaccgagacagagugucugugccccuaugaagcccugguucuucgcaagccucucuuccuggacucuaucgugaaaggcaugaagaaucugcucaacagcaccucccuggagacaucucuuagcauugaagcucccuggggagccaucaacguccaguccaccuuuaagcccacggugagcaccgccaauauugcucugucuugguccagcguugagcaucggggaaacaaaauccucgugacaggcagaucugaguccaucaugaagcuggaagaacgcaccggggucagcugggaucugggcguggaagacgcgucugagagcaaacuucucacaguguccauuauggaucugagccaaauguacucuccuguuuucgaauaucuguccggagaccggcaggucgaggaguggccgaaggcuaccugcacgggcgauugucccgaaagaugcggguguacaagcucuaccugccuccacaaagaguggccucauucucgcaauuggcgguguaaccccacauggugcuggggagugggcaccggguguaccugcuguggaguggacgucaaggaucuguuuacagaccacauguucgugaaguggaaaguugaauacaucaagacggaggccauugugugcgucgaacuuaccagccaggagagacaguguucccugaucgaggccggcacacgguuuaaucucgggccugugaccauuacacugucugaaccccgcaacauccaacagaaacugccgccugagaucauuacccuucaucccaagaucgaagagggcuucuuugaccucaugcacguucagaaagugcugagcgccuccacggucugcaagcugcagucuugcacacacgggauuccuggcgaucuccaaguguaucauaucgggaaucugcuuaagggagacagaguuaacggccaccugauucauaaaaucgaaccccacuucaauaccagcuggauguccugggaugggugugaccucgauuacuacugcaacaugggagacuggccuagcuguaccuauacaggcgugacccagcacaaucaugcugccuuugucaaccugcugaauaucgagacagauuacacgaagaccuuccacuuccauucuaaacgggugacagcgcacggggacacaccccagcuugaucucaaggcuagaccgaccuauggcgccggagagauuaccgugcuggucgaaguugccgacauggagcugcauacgaaaaagguggaaaucuccggccucaaauuugcuagccuggccugcaccggguguuacgcuugcuccuccggaauuagcuguaaggugcgcauccacgucgaugagccugacgagcuuacagugcacguuaagucuuccgaucccgacguggucgccgcgagcaccucccugauggcccggaaacucgaguucggcacagacagcaccuuuaaggcuuucucugccaugcccaaaacaagccugugcuuuuauauuguggagagagaauacuguaaguccugcucugaggaugacaccaaaaaguguguugauacgaagcuggaacagccucaaagcauccuuauugagcauaaagggacaaucaucggaaagcagaacgauaccugcaccgcuaaagccuccugcuggcuggagucugucaagagcuucuuuuauggccucaaaaauaugcugggguccguguucggcaacuuuuucauuggaauccuccuguuucuugcgccguucgugcugcucguucuguuuuucauguucggcuggaagauucuguuuuguuucaagugcugucgcagaacacgggggcuuuuuaaauaccgccaccugaaggacgacgaagagaccggauacagacggaucauugaacgccucaacaauaaaaagggcaaaaacagacugcucgauggggagcggcuggccgaccgcaagaucgcugaacuuuucucuacgaagacacauaucgga

SEQ ID NO: 13804 - RNA, 3495 nt, Artificial Sequence
  derived and/or modified CDS sequence (opt5) from CCHVF(CCHVF Gaib)__KX013445.1__Gn-NSm-Gc
agcgaggaauccucugacgauugcaucagcagaacccagcugcuccggacagagacggccgaaauucacaacgacaauuacggcgggcccggagauaagaucaccauuuguaacggcuccacaaucguggaccaacgccuggggucugagcuuggaugcuauaccauuaauagagucaagagcuucaagcugugugaaaacuccgcuacaggcaaaucuugcgagaucgauagcaucccuguuaagugucggcagggguuuugccucaaaauuacccaggagggacgcggccaugugaagcuguccagaggcagcgaagugguccuugacgccugugauucuuccugcgagaucaugauuccgaaggggacaggagacauccugguggauuguagcggcgggcagcaacacuuccucaaagacaaucugauugaucugggaugccccaacaucccucuccugggcaagauggcgauuuacaucugucggaugucuaaucaucccaaaaccacgauggcuuuucuuuucugguuuuccuucggguauguuauuaccugcaucuuuugcaaggccaucuucuaccugcucauuaucgugggaacacugggcaaaaaguuuaagcaguaucgcgaacuuaaaccucagaccuguacaauuugcgagaccacgcccgucaacgccaucgacgcugagaugcacgaucugaauuguagcuacaacaucugcccuuauugugccucuagacucacauccgacggccuggcucggcaugugguucacugcccgaagcgcaaagaaaagauugaggaaaccgagcuguaccucaaucuggaaagagugcccugggucgugcggaaacuucuccaggugagcgaguccacaggggucgcccugaagcgcucuagcuggcugaucguucuucuggugcuccugaccgugucccugagcccuguccaaucugcgcccauuggacacggcaaaaccaucgagacauaccagacgagagaaggguauaccuccauuugucucuucgugcugggaggcauccuuuuuaucguuagcugccugaugaaggggcucguggacucugucggaaacaauuucuuuccuggccugacaauuuguaagaccugcagcaucuccucuauuaacggcuucgagaucgaaagccauaaauguuacugcucccuucugugcugucccuauugccggcacuguagcgccgaucgcgagauucaucagcuccaccugucuaucugcaagaaaagaaagacaggguccaaugugaugcuggcuguuuguaaacggaugugccucagagugaccacggaagucagcaaccgcgcccuguucauucggucuaucaucaacacaaccuuugugauuuguauccuuauucuggcugucugcgugaucuccaccagcgccguugagauggagaaucucccggcgggaacaugggaaagagaggaagaccugaccaacuucugucaccaggagugccaagugacagaaacggagugucugugcccuuacgaggcccuuguccuccgcaagccccuguuuuccgauucuauugugaagggcaugaaaaaucugcucaacagcaccucccuggaaacaucucuuagcaucgaggcuccuuggggagccaucaauguucaguccaccuucaagcccacagugagcaccgcuaacauugcccugucuugguccagcaucgaacaucgggggaauaaaauucucgucucuggcagauccgagagcaucaugaagcuggaggaacgcacggggauuucuugggaccugggcguggaggaugccagcgaaucccggcuucucaccgugagcguuauggaccugucucagauguauucccccgucuuugaguaccugagcggagauagacaaguggaagaguggccuaaagcuacaugcaccggcgacuguccggagcgcugcggguguacauccucuaccugccuccacaaggaauggccccauagccggaacuggagauguaauccuacguggugcuggggagugggcacaggguguaccugcuguggacuggaugucaaggaccuuuucacagauuauauguuugugaaauggaagguugaguacaucaaaaccgaagcgaucgugugcgucgagcugaccucccaggaacgccaguguucucucauugaggccggcacacgguucaaccuggggcccgugacgaucacccugagcgagccuagaaauauucagcaaaaacuucccccggaaaucauuacacuccacccucggaucgaggaaggcuuuuucgaccugaugcauguucagaaagugcuguccgcuucuaccgucugcaagcuccagagcugcacacacggagugcccggcgaccugcagguuuaccacaucgggaaccuucugaagggagauaaagugaauggccaucucauucacaagaucgagccucauuuuaacaccuccuggaugagcugggacgggugugaucuggacuauuacugcaauaugggagauuggcccucuuguacguauacaggcgucacccaacacaaccacgccgccuucgugaaccugcuuaauauugaaaccgacuacacaaagaacuuucauuuccacuccaagcgcgugaccgcucauggggauacaccucagcucgaccugaaagccagacccacguauggcgcgggagagaucaccguccugguugagguggcugauauggaacuccacacaaagaaaauugagaucagcggccugaaguucgccucucuuaccugcacaggguguuacgccugcuccagcggaauuucuuguaaggugcggauccaugucgacgaaccggaugagcugaccgugcacguuaaauccgaggacccugauaucguggcugccagcuccagccucauggcuagaaagcuggaauuuggcacggacucuaccuucaaagccuuuagcgcgaugcccaagacaucccugugcuucuauauugucgagcgcgaauacuguaaaucuugcagccgggaggacacccagaaguguguguccacaaaacuugaacagccccaaucuauccugauugagcacaaagggaccaucauuggaaagcagaauaacacaugcaccacgaaaacaaccugcuggcucgagagcguuaaguccuuuuucuacggccugaaaaauaugcucucuagcaucuuugggaacguguucgucggcaucuuuuccuuccuggccccuuuuauucuucugauccucuucuuuauguucggauggcgcauucuguucuguuuuaagugcuguagaagaacccggggccuguucaaguaucgccaucuuaaagaugacgaagagacaggguacagacggaucauugaacgccugaauaacaagaaaggaaagagcaaacuccuggauggcgagagacucgcugaccggaagaucgccgaacuguuuucuaccaagacgcacaucggg

SEQ ID NO: 13805 - RNA, 3495 nt, Artificial Sequence
  derived and/or modified CDS sequence (opt5) from CCHVF(CCHVF Hodzha)__KX013448.1__Gn-NSm-Gc
agcgaggaauccggcgacgauugcaucucuagaacccagcugcuccggacagagacggccgaaauucacggggacgauuacggaggccccggggacaagaucaccauuuguaacggaagcacaaucguggaucaacgccugggcuccgagcuugggugcuauaccauuaauagagucaaaucuuucaagcugugugaaaacagcgcuacaggaaaauccugcgagaucgacucuaccccuguuaagugucggcagggcuacugccucaaaaucacacaggagggccgcgggcaugugaagcugagcagaggauccgaagugguccuugaugccugugacagcucuugcgaggugaugauuccgaagggcaccggggauauccugguugacuguuccggaggccagcaacacuuucucaaagauaaucugauugaccuggggugcccccggaucccucuccugggaaagauggcgauuuauaucugucgcaugagcaaccaucccgaaacgaccauggcuuuccuuuucugguucucuuuuggcuacgugauuacaugcauccugugcaaagccaucuucuaucuccugauuaucgucggcacccuugggaagagauuuaaacaguaccgggagcugaagccucagacauguaccauuugcgagacgacacccgccaaugcuaucgaugccgaaaugcacgaccucaacuguuccuauaauauuugcccuuacugugcuagccgccugaccucugacggacuggccagacaugugacacagugcccgaagcggaaagagaagguugaagagaccgaacucuaccugaaccuugagcgcauccccuggaucgugagaaaacugcuccaagucuccgagagcaccggcguggcgcugaagcgguccucuuggcuuauugugcugcucguccuguucgccguuagccuguccccugugcagagcgcucccaucgggcacggaaaaacaauugaaacguaucaggcccgcgaggaauacaccucuaucugucucuuugugcugggcuccauucuuuucaucgucagcugccugaugaaggggcucguggauucuaucggaaauaucuuuuucccuggccugacaauuuguaaaaccugcagcauuggcuccaucaacggguuugagauugaaucucacaaguguuauugcagccuucugugcugucccuacugcagacauuguccggcugaccgggagauccaccagcuccaucuguccauuugcaagaaaagaaagacaggaagcaauguuaugcuggccguguguaaacgcaugugcuuccgggcgaccauggaggucucuaacaaggcccuccugaucagauccaucauuaauacgacauucgugguuuguauccuuauucuggcugugugcgucgugagcaccucugccgucgaaauggagucccucccugcuggcaccugggaacgcgaggaagaucugacaaacuuuugucaccaagagugccaggugaccgagacagaaugucugugccccuaugaggcccuuguucuccggagaccucuguuccuggacagcaucgugaaagggaagaagaaucuccugaacuccacgucucuugaaaccagccuguccauugaggcccccuggggagcuaucaacguccagucuacauacaaacccaccgugagcacagcgaauaucgcccucuccuggagcucuguugagcaccgcggcaacaagauucugguguccgggcggagcgaaucuaucaugaaacuggaggaaagaaccggcauuuccugggaucuuggagucgaggacgcuagcgaaucuaagcuccugacggugagcgugauggaucugucccaaauguauagcccuguuuuugaguaccucucuggcgaccgccaggucgaggaauggccgaaagcuaccugcacaggggauuguuccgagcggugcggauguaccagcuccacaugccugcauaaggaauggccccacucuagaaauuggcgcuguaacccuaccuggugcuggggcguggggacgggauguacaugcuguggccuugacgugaaggaucuguucaccgacuacauguuugucaaauggaagguggacuauaucaaaacagaggccauuguuugcguggaacucaccagccaggagcggcaguguucccuggucgaggcugggaccagauucaaucugggccccgugacaaucacgcuuucugaaccucggaacauccaacagaagcucccgcccgagauuaucacccugcauccucgcauugaagagggauuuuucgaucugaugcacguucagaaagugcucagcgccuccacagucugcaagcugcagucuugcacccauggcgugcccggggaccuucaaguuuaccacaucggaaaucugcucaagggcgauaaagugaacgggcaccugauucauaagaucgaaccucacuuuaauacaagcuggauguccugggacggaugugaucuggacuauuacugcaacaugggcgauuggcccagcuguaccuauacgggggucacacagcauaaucacgcgucuuucgugaaccuucucaauaucgagaccgacuacaccaaauccuuucacuuccauagcaagagagugacagcucacggcgauaccccucagcuggaccugaaagcccggcccacauauggagccggcgagauuacgguccucguugaaguggcugauauggagcugcauaccaagaaaaucgaaauuacagggcuuaaguuugccucucugaccugcacaggauguuacgcuugcuccagcggcaucucuuguaaggugcgcauucacgucgacgagccggaugagcucaccgugcauguuaaauccgacgacccugauguggucgccgcgagcuccagccugauggccagaaagcuggaauuugggacggacucuaccuucaaagccuuuagcgccaugcccaagacaucccuuugcuucuacaucguggagcgggaauauuguaaaucuugcagcaaggaggauacccagaaguguguuaacacaaaacuggaacaaccccaguccauucucaucgagcagaagggaaccaucauuggcaaacagaauaacacaugcaccgcuaaggccucuugcuggcuggagagcgugaaauccuuuuucuacgggcucaagaacaugcugucuggcaucuuuggaaaugucuucgugggcauuuuucuuuuccuggcgccuuuuauccuccugauucuguucuuuauguucggguggagaauccuguuuuguuucaagugcugucgcagaacgcggggacuuuucaaauauaagcaccucaaagacgaugaagagacaggcuaccgcagaaucauugaacggcugaacaauaagaaagggaagaacaagcuccuggacggagagcgccuugccgauagacggaucgcugaacuguuuagcaccaaaacccacauuggc

SEQ ID NO: 13806 - RNA, 3495 nt, Artificial Sequence
  derived and/or modified CDS sequence (opt5) from CCHVF(CCHVF IbAn7620)__KX013451.1__Gn-NSm-Gc
agcgaggaacccuccgacgauugcaucucuagaacccagcugcuccggacagagacggccgaaauucacggcgacaacuacgggggaccuggcgauaagaucaccauuuguaaugggagcacaaucguggaccaacgccugggauccgagcuuggcugcuauaccauuaacagagucaaaucuuucaagcugugugaaaauagcgcuacagggaaaaacugcgagaucgauuccguuccggugaagugucggcagggauacugccuccgcaucacccaggagggcagaggccaugugaaacugucucgggggagcgaaauuguccuugacgccugugauacauccugcgagaucaugauucccaagggaaccggcgacauccugguggauuguagcgggggacagcaacacuuucucaaggacaaucugauugaucugggcugcccuaaaaucccccuccuggggaagauggcgauuuauaucugucgcaugucuaaccauccuaaaacgaccauggcuuuccuguuuugguucuccuuuggauacguuaucacaugcauucuuugcaaggccaucuucuaucuccugauuaucauuggcacccuuggcaaaagacugaagcaguaccgggaacucaagccccagacauguaccaucugcgagacgacaccugugaaugccaucgacgcugagaugcacgaucugaacuguagcuauaauauuugcccguacugugccucucgccugaccuccgacgggcucgcuagacaugucauccagugccccaaacggaaggaaaaaguggaggaaacagagcuguaccuuaaccuggaacgcauuccuuggguugugagaaagcuccugcaagucagcgagucuaccggaguggcccuuaaacgguccagcuggcugaucgugcuccugguccuguuuaccguuucccucucucccgugcagagcgcgccuauuggccaggggaagacaacggaggccuaucgcgcuagagaaggauacaccuccaucugucuguucgugcuuggcagcauccuguuuauugucucuugccucaugaaagggcugguggacuccguuggaaauagcuucuuucccggccuuucuaucuguaagacaugcagcauuuccucuaucaacggcuucgagauugaaagccacaaguguuauugcucccuguuuugcuguccguacugccggcacuguagcaccgauaaagagauccauaagcuccaccugucuauuugcaaaaagagaaaaacaggguccaaugugaugcuggccgucuguaagcgcaugugcuuccgggcuaccauggaagugagcaacagagcccucuucauccgcucuaucauuaauacgacauuuguucuguguauccuuauucuggcggugugcgucguguccaccagcgccgucgagauggagaaccucccugcuggaaccugggaacgggaggaagaccugacaaacuucugucaucaggagugccaagugaccgaaacagagugucugugccccuaugaggcccuuguucucagaaagccucuguuucuggauuccaucgcuaaaggcaugaagaauccccucaacucuacgagccuggaaaccucccuuucuauugaggcccccuggggagccaucgacgugcagagcacauacaaaccuaccgucuccacagcuaauaucgcgcugagcuggucuuccguggaacaccgcgggaacaagauucucguuagcggccggucugaguccaucaugaaacuggaggaaagaaccgggauuagcugggaucugggcguggaggacgccucugaaagcaaacuucucacggucuccgugauggaucugagccagauguauucuccgguguucgaguaccuguccggagaccgccaaguugaagaguggcccaaggcuaccugcacaggcgauuguccugagcggugcggguguaccagcuccacaugccuccacaaagaauggccccauucuagaaauuggcgcuguaacccuaccuggugcuggggagucggcacgggguguacaugcuguggacuggacgugaaggaucuuuuuaccgacuacauguucgugaaauggaaggucgaguauaucaaaacagaagccauugugugcguugagcugaccagccaggaacggcaguguucccucaucgaggccggcaccagauuuaaucuggggcccgugacaaucacgcugucugagccgcggaacauucagcaaaaacuuccucccgaaaucauuacccuccacccucgcaucgaggaaggcuucuuugaccugaugcauguccagaaggugcugagcgcuuccacaguuugcaagcuccagucuugcacccacggagugcccggcgaucugcaggucuaccauauugggaaucuucugaagggagacaaagugaacggccaccucauccacaagaucgagccucauuucaauacaagcuggauguccugggaugggugugaccuggauuauuacugcaacaugggagacuggcccagcuguaccuauacgggcguuacacaacacaaucaugccucuuuugugaaccugcuuaauauugaaaccgauuacaccaaaaacuuccacuuucacuccaagagagucacagcgcauggggacaccccgcagcucgaucugaaagcucggccuacauauggcgccggagagaucacggugcugguggaggucgccaacauggaacuccacaccaagaagauugagaucagcggccugaaauucgcuucucuuacaugcaccggguguuacgccugcuccagcggaauuucuuguaagguuagaauccauguggacgaacccgaugagcugacagugcacgucaaauccgacgaucccgacgugguugcugccagcuccagccucauggcgcgcaagcuggaguucggcaccgacucuacguuuaaagccuucagcgcuaugccuaagaccucccugugcuuuuacauuguggaacgggagcauuguaagucuugcagcgaagaggauacaaagaagugugucaauaccaaacuugaacagccgcaguccauccugaucgagcacaaggggacaauuaucggaaaacaaaacucuaccugcacagccaaggcuagcugcuggcucgaguccgugaagucuuucuuuuauggccugaaaaauaugcucagcgggauuuucggcaacguuuuuaugggaaucuuccuguuucuugcccccuucauucugcucauccuguuuuucauguuuggcuggagaauccuguucuguuucaagugcugucgcagaacccgggggcuuuuuaaauaccgccaccugaaggacgaugaagagacgggauauagacggauuaucgaacgccucaauaacaaaaagggcaagaauaaacugcucgacggggagagacuggcggaucggcgcauugccgaacuuuucuccacaaagacccauaucgga

SEQ ID NO: 13807 - RNA, 3495 nt, Artificial Sequence
  derived and/or modified CDS sequence (opt5) from CCHVF(CCHVF K128_76)__KX013454.1__Gn-NSm-Gc
agcgacgaguccggcgaugacugcaucucuagaacccagcugcuccggacagaaacggccgagauucacggggauaacuacggaggccccggggacaagaucaccauuuguaauggaagcacaaucguggaucaacgccugggcuccgaacuugggugcuauaccauuaacagagucaaaucuuucaagcugugugagaauagcgcuacaggaaaauccugcgaaaucgacucuaucccuguuaagugucggcagggcuacugccucaaaauuacccaggagggccgcgggcaugugaagcugagcagaggauccgaggugguccuugaugccugugacagcucuugcgaagugaugaucccgaagggcacaggggauauucugguugacuguuccggaggccagcaacacuuucucaaagauaaccugaucgaccuggggugccccaagauuccucuccugggaaaaauggcgaucuauauuugucggaugagcaaucaucccaagaccacgauggcuuuccucuuuugguucucuuuuggcuacgugauuaccugcaucgucugcaaagccauuuucuaucugcucaucauugugggcacacuggggaagcgcuuuaagcaguacagagagcuuaaaccucagaccuguacaaucugcgaaaccacgcccacaaacgccauugaugcugagaugcacgaccugaauuguuccuauaacaucugcccuuacugugccagccggcucaccucugacggacuggcucgccauguuacacacugcccgaagagaaaagagaagguggaagagaccgaacuguaccucaaucuggagcggauccccugggucgugcgcaaacuucuccagguguccgaaagcaccggcgucgcccucaagagauccucuuggcugauuguucuucuggugcuuuucgcggugagccuguccccuguccaaagcgcccccaucucucacgggaaaacaauugagacguaucaggugcgggaggaauacaccuccaucugucuguuuguucucggaagcauucuguucaucgugucuugccuuaugaagggccuggucaacagcguggggaauaucuuuuucccuggacucuccauuuguaagacaugcucuaucggcagcauuaacggcuuugagaucgaaucccauaaauguuauugcagccugcuuugcugucccuacugccgccacuguucugcugauagagagauucaucagcugcaccucuccaucugcaagaaacggaagaccgggagcaauguuaugcuggccguguguaaaagaaugugcuuccgcgcuacaauggaagucucuaacaaggcccuguucauucgguccaucaucaauaccacguuuguggucuguauucucauccuggcggugugcguugugagcacauccgccgucgagauggagucucuuccggcuggaaccugggaaagagaggaagaccugaccaacuucugucaccaggagugccaagugacagaaaccgagugucucugcccuuaugaggcccugguucugcgccggccccuuuuucaggauagcauugugaagggcaugaaaaaccuccugaauagcacaucucuggaaacgagccucuccaucgaggcuccuuggggagccauuaacguccagagcaccuacaagcccgccgugucugcugcgaauaucgcccuguccuggagcucuguggaacauagaggguccaaaauccuuguuagcggccgcucugagagcauuaugaagcuggaggaacggacagggaucuccugggaccucggcgucgaggaugcuagcgaaucuaaacugcugaccguguccgugauggaccuuagccaaauguauucccccgucuucgaguaccucucuggagauagacagguggaagaguggccuaaggccacaugcaccggcgacuguccggagcgcugcggguguacgagcucuaccugccugcacaaggaauggccccauucccggaacuggagauguaauccuacauggugcuggggaguuggcaccggguguacaugcuguggacuggaugugaaagaccucuuuaccgauuacauguucgucaaguggaaaguggaguauauuaagacggaagccaucguuugcguggagcugacaagccaggaacgccaguguucccuuauugaggcuggcacccgguuuaaccuggggcccgucacaaucacccucucugagccuagaaauauccaacagaaacugcccccggaaauuaucacccugcacccucggauugaggaaggcuucuuugaccuuaugcaugugcagaagguucucagcgccuccacagugugcaagcugcagagcugcacgcacggaguccccggcgaccugcaaguguaccacaucgggaaccuccugaaaggagaucgcgugaauggccaucuuauucacaagaucgagccucauuucaacaccucuuggauguccugggacgggugugaucuggacuauuacugcaauaugggagauuggcccagcuguacauauaccggcgucacacagcacaaccacgcgucuuuuguuaaucuccugaacaucgaaaccgacuacacgaaauccuuccauuuucacagcaagagagugacagcucauggggauaccccucagcuggaccuuaaagcccggcccaauuauggcgccggagagauuaccgugcucgucgagguggcugauauggaacugcacacaaagaaaaucgagauuucuggccugaaguucgccucccugaccugcacaggguguuacgcuugcagcuccggaaucagcuguaagguuagaauccauguggacgaaccggaugagcugacgguccacgugaaaucugacgauccugacguuguggccgcgagcuccucucuuauggcccgcaagcuggaguucggcaccgacagcacauuuaaggcuuucuccgccaugcccaaaaccucucucugcuuuuacaucgucgaacgggaguauuguaaaagcugcuccaaggaagauacacagaagugugugaacaccaaacuggagcaaccccagucuauucugaucgaacacaaggggacgaucauuggaaaacagaacaauaccugcacagcuaagaccagcugcuggcuugaguccguuaaauccuucuuuuacggccugaagaacaugcucucugggaucuucggcaauguguuugucggaauuuuccuguuucucgccccuuucauccugcuuauucuguuuuucauguuuggcuggagaauccucuucuguuucaagugcugucgcagaacacgggggcuguuucgcuauaaacaucuggagaacgacgaagagaccggauacagacggaucauugaacgccuuaauaacaagaaaggcaagaauaaacugcucgauggggagagacuggcggaccggcgcaucgccgaacucuucuccacaaagacccacauugga

SEQ ID NO: 13808 - RNA, 3495 nt, Artificial Sequence
  derived and/or modified CDS sequence (opt5) from CCHVF(CCHVF K168_40)__KX013457.1__Gn-NSm-Gc
agcgacgaguccggcgaugacugcaucucuagaacccagcugcuccggacagaaacggccgagauucacggggauaacuacggaggccccggggacaagaucaccauuuguaauggaagcacaaucguggaucaacgccugggcuccgaacuugggugcuauaccauuaacagagucaaaucuuucaagcugugugagaauagcgcuacaggaaaauccugcgaaguugacucuaucccugugaagugucggcagggcuacugccucaaaaucacccaggagggccgcgggcaugugaagcugagcagaggauccgaggucgugcuugaugccugugacagcucuugcgaaguuaugauuccgaagggcacaggggauauccugguggacuguuccggaggccagcaacacuuucucaaagauaaccugauugaccuggggugccccaagaucccucuccugggaaaaauggcgauuuauaucugucggaugagcaaucaucccaagaccacgauggcuuuccucuuuugguucucuuuuggcuacgucauuaccugcaucgugugcaaagccaucuucuaucugcucauuaucguuggcacacuggggaagcgcuuuaagcaguacagagagcuuaaaccucagaccuguacaauuugcgaaaccacgcccacaaacgccaucgaugcugagaugcacgaccugaauuguuccuauaacauuugcccuuacugugccagccggcucaccucugacggacuggcucgccaugugacacacugcccgaagagaaaagagaaggucgaagagaccgaacuguaccucaaucuggagcggauccccuggguggugcgcaaacuucugcaggucuccgaaagcaccggcguugcccucaagagauccucuuggcugaucgugcuucuggugcuuuucgcggucagccuguccccugugcaaagcgcccccauugggcacggaaaaacaaucgagacguaucagguucgggaggaauacaccucuauuugucuguuugugcucggcuccauccuguucauugucagcugccuuaugaaggggcuggugaacucuguuggaaauaucuuuuucccuggccucagcaucuguaagacaugcuccauuggcucuaucaacggguuugagauugaaagccauaaauguuauugcucccugcuuugcugucccuacugccgccacuguagcgcugauagagagauccaucagcugcaccucucuauuugcaagaaacggaagaccggauccaaugugaugcuggccgucuguaaaagaaugugcuuccgcgcuacaguggaagucagcaacaaggcccugucuauccgguccauuaucaauaccacguucgugguuuguauccucauucuggcggugugcgucgugagcacauccgccguugagauggagucucuuccggcuggcaccugggaaagagaggaagaccugaccaacuuuugucaccaggagugccaagugacagaaaccgagugucucugcccuuaugaggcccugguccugcgccggccccuuuuccucgaugggaucgugaagggaaugaaaaaccugcugaauagcacaucccucgaaacgucucugagcauugaggcuccuuggggcgccaucaacgugcaguccaccuacaagcccacaguuagcgccgcuaauauugcgcuuucuugguccagcgucgaacauagagggaacaaaauccuggugucuggccgcuccgagagcaucaugaagcucgaggaacggaccggaauuucuugggaccugggcguggaggaugccagcgaauccaaacugcuuacagucagcgugauggaccucucucagauguauucccccguuuuugaguaccugagcggggauagacaaguggaagaguggccuaaggcuaccugcacgggagacuguccggagcgcugcggcuguaccuccucuacaugccugcacaaggaauggccccauagccggaauuggagauguaacccuaccuggugcuggggagucggaacaggcuguaccugcugugggcucgaugugaaagaccuguucacggauuacauguuuguuaaguggaaaguggaguauaucaagacagaagccauugucugcguggagcuuaccucccaggaacgccaguguucucugaucgaggccggcacacgguucaaucucggacccguuaccauuacccugagcgagccuagaaacauccagcaaaaacugcccccggaaaucauuacacuucacccucggaucgaggaaggcuuuuucgaccucaugcaugugcagaagguccuguccgcuucuacggugugcaagcugcagagcugcacccacggggugcccggagaccuccaggucuaccacauuggcaaucugcuuaaaggggauaagguuaacggacaucugauccacaaaauugagccucauuuuaauacauccuggaugagcugggacggcugugaucucgacuauuacugcaacaugggggauuggcccucuuguaccuauacaggcgugacccaacacaaucacgccuccuucaucaaccugcugaauaucgaaacggacuacacaaagagcuuucauuuccacucuaaacgcgugaccgcgcauggagauaccccucagcuugaccucaaggcuagacccaacuauggcgccggggagauuacaguccugguggagguugccgauauggaacugcacaccaaaaagaucgagauuuccggacucaaguuugcuagccugacaugcacgggcuguuacgccugcucuagcgggaucagcuguaaagugcggauucaugucgacgaaccggaugagcuuaccgugcacguuaaguccgacgauccugacguggucgcugccagcucuagccugauggcgagaaaacucgaguucggaacagacuccaccuucaaggccuuuucugcuaugcccaaaacaagccugugcuucuacaucguggaacgcgaguauuguaaguccugcucuaaggaagauacccagaaauguguuaacacgaagcuggagcacccccagagcauucuuaucgaacauaaaggcaccaucauugggaagcaaaauaacacaugcaccgccaaaacauccugcuggcuggagucugugaaguccuuuuucuacggccucaagaauaugcuguccggaaucuuuggcaacgucuucguggggauuuuucucuuccuggcuccuuuuauccuucugauucucuucuuuauguucggauggcggauccuguuuuguuucaaaugcuguagacgcaccagaggccuguuccgguauaagcaccuugaggacgaugaagagacaggguaccgcagaaucauugaacggcugaauaacaaaaaggggaaaaauaagcuccuggacggcgagcgccucgccgauagacggaucgcggaacuguuuagcaccaagacgcauauuggc

SEQ ID NO: 13809 - RNA, 3495 nt, Artificial Sequence
  derived and/or modified CDS sequence (opt5) from CCHVF(CCHVF K168_125)__KX013460.1__Gn-NSm-Gc
agcgacgaguccggcgaugacugcaucucuagaacccagcugcuccggacagaaacggccgagauucacggggauaacuacggaggccccggggacaagaucaccauuuguaauggaagcacaaucguggaucaacgccugggcuccgaacuugggugcuauaccauuaacagagucaaaucuuucaagcugugugagaauagcgcuacaggaaaauccugcgaaguugacucuaucccugugaagugucggcagggcuacugccucaaaaucacccaggagggccgcgggcaugugaagcugagcagaggauccgaggucgugcuugaugccugugacagcucuugcgaaguuaugauuccgaagggcacaggggauauccugguggacuguuccggaggccagcaacacuuucucaaagauaaccugauugaccuggggugccccaaggucccucuccugggaaaaauggcgaucuauauuugucggaugagcaaucaucccaagaccacgauggcuuuccuguuuugguucucuuuuggcuacgugauuaccugcauuguuugcaaagccaucuucuaucugcucaucauugugggcacacuggggaagcgcuuuaagcaguacagagagcuuaaaccucagaccuguacaaucugcgaaaccacgcccacaaacgccauugaugcugagaugcacgaccugaauuguuccuauaacaucugcccuuacugugccagccggcucaccucugacggacuggcucgccaugucacacacugcccgaagagaaaagagaagguggaagagaccgaacuguaccucaaucuggagcggauucccugggugguccgcaaacuucugcagguuuccgaaagcaccggcguggcccucaagagauccucuuggcugaucgugcuucugguccucuucgcggugagccuguccccuguucaaagcgcccccaucgggcacggaaaaacaauugagacguaucaggugcgggaggaauacaccucuaucugucuguuuguccucggcuccauucuguucaucgugagcugccuuaugaaggggcugguuaacucugugggaaauaucuuuuucccuggccucagcaucuguaagacaugcuccaucggcucuauuaacggguuugagaucgaaagccauaaauguuauugcucccugcuuugcugucccuacugccgccacuguagcgcugauagagagauucaucagcugcaccucucuaucugcaagaaacggaagaccggauccaaugucaugcuggccguguguaaaagaaugugcuuccgcgcuacagucgaagugagcaacaaggcccugucuauucgguccaucauuaauaccacguucguuguguguauccucauccuggcggucugcgugguuagcacauccgccguggagauggagucucuuccggcuggcaccugggaaagagaggaagaccugaccaacuuuugucaccaggagugccaagucacagaaaccgagugucucugcccuuaugaggcccuggugcugcgccggccccuuuuccucgauagcauugugaaggggaaaaagaaccugcuuaauuccacaucucucgaaacgagccuguccaucgaggcuccuuggggagccauuaacguucagagcaccuacaaacccacagucucugccgcuaauaucgcgcuuuccuggagcucuguggaacauagaggcaacaagauucugguguccgggcgcagcgagucuaucaugaaacucgaggaacggaccggcaucagcugggaccugggagucgaggaugccuccgaaagcaagcugcuuacagugucuguuauggaccucucccagauguauagccccguguuugaguaccuguccggcgauagacaagucgaagaguggccuaaggcuaccugcacgggggacuguccggagcgcugcggauguaccucuagcacaugccugcacaaagaauggccccauucccggaauuggagauguaacccuaccuggugcuggggcguggggacaggauguaccugcuguggccucgauguuaaggaccuguucacggauuacauguuugugaaauggaaggucgaguauauuaaaacagaagccaucgugugcguugagcuuaccucucaggaacgccaguguagccugauugaggccgggacacgguucaaucucggccccgugaccaucacccuguccgagccuagaaacauucagcaaaagcugcccccggaaaucaucacacuucacccucggauugaggaaggauuuuucgaccucaugcauguccagaaggugcugucugcuagcacggugugcaaacugcaguccugcacccacggcguccccggggaccuccagguuuaccacaucggaaaucugcuuaagggcgauaaagugaacgggcaucugauucacaagaucgagccucauuuuaauacaagcuggaugucuugggacggaugugaucucgacuauuacugcaacaugggcgauuggcccuccuguaccuauacaggggugacccaacacaaucacgccagcuucauuaaccugcugaauaucgaaacggacuacacaaaaucuuuucauuuccacuccaagcgcgucaccgcgcauggcgauaccccucagcuugaccucaaagcuagacccaacuauggagccggcgagaucacagugcugguugagguggccgauauggaacugcacaccaagaagauugagaucagcgggcucaaauuugcuucucugacaugcacgggauguuacgccugcuccagcggcauuuccuguaagguccggauccauguggacgaaccggaugagcuuaccguucacgugaaaagcgacgauccugacgucguggcugccucuagcucccugauggcgagaaagcucgaguucgggacagacucuaccuucaaagccuuuagcgcuaugcccaagacaucccugugcuucuacauuguugaacgcgaguauuguaagucuugcagcaaagaagauacccagaagugugugaacacgaaacuggagcacccccaguccauccuuauugaacauaagggaaccaucaucggcaaacaaaauaacacaugcaccgccaagacaucuugcuggcuggagagcgucaaguccuuuuucuacgggcucaaaaauaugcugagcggcauuuuuggaaacguguucgugggcaucuuucucuuccuggcuccuuuuauucuucugauccucuucuuuauguucggguggcggauucuguuuuguuucaagugcuguagacgcaccagaggacuguuccgguauaaacaccuugaggacgaugaagagacaggcuaccgcagaaucaucgaacggcugaauaacaagaaagggaagaauaagcuccuggacggagagcgccucgccgauagacggauugcggaacuguuuucuaccaaaacgcauaucggc

SEQ ID NO: 13810 - RNA, 3495 nt, Artificial Sequence
  derived and/or modified CDS sequence (opt5) from CCHVF(CCHVF K229_194)__KX013463.1__Gn-NSm-Gc
agcgaggaacccggcgacgauugcaucuccagaacccagcugcucaagacagagacggccgaaauucacgacgauaacuacgggggaccuggcgacaaaaucaccauuuguaaugggucuacaaucguggaucaacggcugggaagcgagcuuggcugcuauaccauuaaccgcgucaaguccuucaaacugugugaaaauucugcuacagggaagaccugcgagaucgacagcacaccgguuaaauguagacagggauuuugccucaagaucacccaggagggccggggccaugugaagcugucccgcgggucugaagugguccuugaugccugugacagcuccugcgagauuaugauccccaaaggaacgggcgauauucugguggacuguagcgggggacagcaacacuuccucaagggcaaccugaucgaucuggggugcccucauauuccccuccugggaaaaauggcgaucuacauuuguagaaugucuaaucacccucggaccacaauggcuuuucuuuucugguuuuccuucggcuauguuauuaccugcaucuuuugcaaggcccuguucuacagccucauuaucauuggcacacuggggaaaaagaucaagcaguaucgcgaacuuaaaccccagaccuguacgauuugcgagacagccccugugaacgcuaucgacgccgagaugcaugaucugaauuguucuuacaacaucugcccguauugugcuuccagacucaccagcgacggacuggcccggcacgucacacagugccccaagcgcaaagaaaagguggaggaaaccgagcuguaccucaaucuggaaagaaucccuuggaucguucggaaacuucugcaagugucugaguccaccggcgucgcgcucaagcgcagcuccuggcugauugugcuucuggugcuccugacagucucucugagccccguucaguccgccccuguggggcacggaaaaacgaucgagaccuaccagacaagagaaggcuuuaccaacauuugucucuucaugcuggggagcauccuuuuuaucgugucuugccuggucaagggacucguggacuccguuagcgauucuuucuuucccggccugagcguguguaagacaugcuccauuggcucuaucaauggguucgagauugaaagccauaaauguuauugcucccuuuucugcuguccguacugccggcacuguagcgcugaccgcgagauccaucagcugcaccucggaauuugcaagaaaagaaagaccggcucuaacgucaugcuggccguguguaaacggaugugcuuuaaggcuacgaucgaagccuccagacgcgcgcugcucauucggagcaucaucaauacaaccuucguuauuuguauccugacccuugccauuugcguggucucuacauccgcuguggagauggagaaccugccugccgggaccugggaaagagaggaagaucucacgagcuuuugucaccaagagugccaggucacagaaaccgagugucugugccccuaugaggcucuggugcuucgcaagccucucuuccuggacuccaucguuaaaggaaagaaaaaucugcucaacucuacaagccuggaaaccucccuuucuauugaggcccccuggggcgccaucaacgugcagagcacauuuaagcccaccgucuccacggcuaauaucgcgcugagcuggucuuccguggaacaucgggggaacaaaauucucguuaccggcagaagcgagucuaucaugaagcuggaggaacgcacaggaguguccugggaucugggcgucgaggacgccagcgaaucuaaacuucucaccgugagcauuauggaucugucccaaauguacagcccuguguucgaguaucugucuggggaccggcagguugaagaguggccgaaggcuacaugcaccggagauugucccgagagaugcggcuguacguccagcacaugccuccacaaggaauggccucauucccgcaauuggcgguguaaccccaccuggugcuggggagucggaacaggcuguaccugcugugggguggacgugaaagaucuguuuaccgaccacauguucaucaaguggaaagucgaguacauuaagacagaagccaucgugugcguugagcuuacgucucaggaaagacaguguagccugaucgaggccggcacccgcuuuaaucucggaccugugacaauuacccuguccgagccccggaacauccaacagaagcugccgccugaaauuaucacacuucaucccaaaauugaggaaggcuucuuugaccucaugcacguccagaaggugcugucugcuagcaccguuugcaaacugcaguccugcacgcacgggaucccuggagaucuccaaaucuaucauauuggcaaucugcuuaagggggacagacugaacggacaccucauccauaaaauugagccccacuucaauacaucuuggaugagcugggauggcugugaccuggauuacuacugcaacaugggggacuggccuuccuguaccuauaccggcgugacacagcacaaucaugccgcguuugucaaccugcuuaauaucgaaaccgauuacacaaagacguuccacuuccauagcaaacgggugaccgcucacggagacacaccccagcucgaucugaaggcccgcccgaccuauggcgccggggagauuacaguucugguggaggucgcugacauggaacuccauaccaagaaaguggagaucucuggacugaaguuugccucccuugcuugcacgggcuguuacagcugcagcuccgggauuagcuguaaagugagaauccacgucgaugaaccugacgagcugaccguucacgugaagucuuccgaucccgacguggucgccgcgagcacaucccucauggcccggaaacuggaguucggaaccgacagcacauuuaaggcuuucucugccaugcccaagaccagccugugcuuuuauaucguggaaagagaguacuguaaauccugcucugaagaugacacaaagaaauguguugauaccaaacuugagcagccucaaagcauucugaucgaacauaagggcacgauuaucgggaagcagaacgacacaugcaccgcuaaggccuccugcuggcucgagucugugaaaucuuucuuuuauggccugaagaauaugcucggauccgucuucggcaacuuuuucguggggauucugcuuuuucuggcgccguucguucuccuggugcuguuuuucauguucggauggaaaauccuguuuuguuucaagugcugucgccggaccagaggccuuuuuaaauaccgccaccucaaggaugacgaggaaacaggguacagaaagaucauugagcggcugaacucuaaaaaggggaaaaaucgccuccuggauggcgaaagacuugccgaccggaagaucgcugagcuguucagcaccaaaacgcauauuggc

SEQ ID NO: 13811 - RNA, 3495 nt, Artificial Sequence
  derived and/or modified CDS sequence (opt5) from CCHVF(CCHVF K229_243)__KX013466.1__Gn-NSm-Gc
agcgaggaacccggcgacgauugcaucuccagaacccagcugcuccggacagagacggccgaaauucacgacgauaacuacgggggaccuggcgacaagaucaccauuuguaaugggucuacaaucguggaucaacgccugggaagcgagcuuggcugcuauaccauuaacagagucaaauccuucaagcugugugaaaauucugcuacagggaaaaccugcgagaucgacagcacaccgguuaagugucggcagggauuuugccucaaaaucacccaggagggccgcggccaugugaagcuguccagagggucugaagugguccuugaugccugugacagcuccugcgaggugaugauucccaagggaacgggcgauauccugguugacuguagcgggggacagcaacacuuccucaaagauaaccugauugaccugggcugcccucauaucccccuccuggggaagauggcgauuuacaucugucggaugucuaaucacccucgcaccacaauggcuuuucuuuucugguuuuccuucggauaugugauuaccugcaucuuuugcaaagcccuguucuacagccucaucauuaucggcacacugggcaagaaaauuaagcaguauagagaacuuaagccccagaccuguacgaucugcgagacagccccugucaacgcuauugaugccgagaugcaugaccugaauuguucuuacaacaucugcccguauugugcuucccggcucaccagcgacgggcuggcccgccacgugccccagugcccuaaaagaaaggaaaaaguugaggaaacagagcuguaccucaaucuggaacggauccccuggauugugcgcaaacuucugcaagucucugaguccaccggaguggcgcucaaaagaagcuccuggcugaucgugcuucugguccuccugaccguuucucugagcccugugcaguccgcccccgugggccacgggaagacaauugagacguaccagacccgggaaggauuuacaagcaucugucucuucaugcugggcucuauucuuuuucuggucuccugccucgugaaagggcugguugauagcgugucugacagcuucuuuccgggacuuuccgucuguaagaccugcucuaucggcagcaucaacggcuucgagauugaaucccauaaguguuauugcagccuguucugcuguccuuacugccgccacuguucugcugauagagagauccaucagcuccaccuguccauuugcaaaaagcggaaaacagggagcaaugugaugcuggccguuuguaagagaaugugcuuucgcgcuaccaucgaagccucucggagagcgcuccugauucgcuccaucauuaacacgacauucgugaucuguauccuuacccugaccauuugcgucgugagcacauccgccgucgagauggagaaucuccccgcuggaaccugggaacgggaggaagaccugacaaacuuuugucaccaagagugccaggugacggaaaccgagugucugugcccuuaugaggcccuuguucucagaaaaccccuguuccuggauucuaucgugaagggcaugaagaaucuccugaacagcacaucccuugaaaccucucugagcauugaggcucccuggggagccaucaacguccaguccacauuuaaaccuaccgugagcacggccaauauugcucucucuugguccagcguugaacaucgcggaaacaagauccuggugaccggccggucugaguccaucaugaaacuggaggaaagaacaggggucagcugggaccuuggcguggaggaugcgucugaaagcaagcuccugaccguguccauuauggaccugagccaaauguacucuccgguuuucgaguaucucuccggagaucgccaggucgaagaguggcccaaagccacaugcaccggcgacuguccugagcggugcggguguacgagcuccacaugccugcacaaggaauggccccauucuagaaauuggcgcuguaacccuaccuggugcuggggagugggcacaggguguaccugcuguggaguggaugucaaggaccuuuuuaccgaccacauguucgugaaauggaagguugaguacaucaaaacagaagcuauugugugcgucgagcugacgagccaggaacggcaguguucccucaucgaggccggcaccagauuuaaucuggggcccgugacaauuacccugucugagccgcggaacauccaacagaaacuuccucccgaaaucauuacacuccauccuaaaguugaggaaggcuucuuugaucugaugcacgugcagaagguccugagcgccuccaccgugugcaagcuccagucuugcacgcacggaauccccggcgaccugcaaguuuaucauauugggaaucuucugaaaggagaucgcgugaacggccaccucauccauaagauugagccucacuucaauacaagcuggauguccugggacgggugugaucuggacuacuacugcaacaugggagauuggcccagcuguaccuauaccggcgucacacagcacaaucaugcugccuuugugaaccugcuuaauaucgaaaccgacuacacaaaaacguuccacuuccauucuaagagagugaccgcgcacggggauacaccgcagcucgaccugaaagcucggccuaccuauggcgccggagagaucacaguccugguugagguggccgauauggaacuccauaccaagaaaguggagauuuccggccugaaguuugcuagccuugccugcacgggguguuacgcuuguucuuccggaaucagcugcaagguccgcauucacguggacgaacccgaugagcugaccguucacgugaaaucuuccgaccccgacgucguggccgcgagcacaucccucauggccagaaagcuggaguucggcaccgauagcacauuuaaggcuuucucugccaugccuaagaccagccugugcuuuuauaucguugaaaaagaguacuguaaguccugcucugaagaggacacacagaaguguguggauaccaaacuugaacaaccgcagagcauucugaucgagcauaaggggacgauuaucggaaaacagaacgacacaugcaccgcuaaggccuccugcuggcucgagucugucaagagcuucuuuuauggccugaagaauaugcucggguccguguucggcaacuuuuucaucgggauucugcuuuuucugacccccuucguucuccuggugcuguuuuucauguucggcuggaagauccuguuuuguuucaaaugcugucggagaacacgcgggcuucucaaguacagacaccugaaagaugacgaagagaccggauaccggcgcauuaucgaaagacucaacaauaagaaaggcaagaaccggcugcuugauggggagcgccuggcggacagaaagauugccgaacucuuuucuacgaaaacacauaucgga

SEQ ID NO: 13812 - RNA, 3495 nt, Artificial Sequence
  derived and/or modified CDS sequence (opt5) from CCHVF(CCHVF K315_14)__KX013469.1__Gn-NSm-Gc
agcgaggaacccggcgacgauugcaucuccagaacccagcugcucaagacagagacggccgaaauucacgacgauaacuacgggggaccuggcgacaaaaucaccauuuguaaugggucuacaguggucgaucaacggcugggaagcgagcuuggcugcuauaccaucaaccgcguuaaguccuucaaacuguguaaaaauucugcuacagggaaaaccugcgaaauugacagcacaccggugaaguguagacagggauuuugccucaagaucacccaggagggccggggccaugugaaacugucccgcgggucugaggucgugcuugauguuugugacagcuccugcgaaaucaugauucccaagggaacgggcgauauccugguggacuguagcgggggacagcaacacuuccucaaagauaaccugauugaccugggcugcccucauaucccccuccuggggaagauggccauuuacaucuguagaaugucuaaucacccucggaccacaauggcguuucuuuucugguuuuccuucggauaugucauuaccugcaucuuuugcaaagcucuguucuacagccucaucauuaucggcacacugggcaagaagauuaaacaguaucgcgagcuuaagccccagaccuguacgaucugcgaaacagccccugugaacgccauugaugcugagaugcaugaccugaauuguucuuacaacaucugcccguauugugccuccagacucaccagcgaggggcuggcucggcacguuacacagugccccaaacgcaaggaaaaaguggaggaaaccgagcuguaccucaaucuggaaagaaucccuuggauuguccggaaacuucugcaagugucugaguccaccggaguggcccucaagcgcagcuccuggcugaucguccuucugguucuccugacagugucucugagccccgugcaguccgcgccugucggccacgggaagacgauugagaccuaccagacaagagaaggauuuaccagcaucugucucuucaugcugggcucuauucuuuuuaucguguccugccugguuaaggggcucguguauagcgucucugacagcuucuuucccggacuguccguguguaaaacaugcucuaucggcagcauuaacggcuucgagaucgaaucccauaaguguuacugcagccuuuucugcuguccguauugccggcacuguucugccgaucgcgagauucaucagcugcaccucuccaucugcaaaaagagaaaaaccgggagcaauguuaugcuggcuguguguaagcggaugugcuuuaaggccacgauugaggcuucuagacgcgcccugcucauccgguccauuaucaacacaaccuucgucaucuguauucugacccuugcgaucugcguggucagcacauccgccguggaaauggaggaccugccugcuggaaccugggaaagagaggaagaucucacaaauuuuugucaccaagagugccagguuacggaaaccgagugucugugccccuacgaggcccuggugcuucgcaaaccucucuuccuggacucuauugucaagggcaugaaaaagcugcucaacagcacaucccuggaaaccucucuuagcaucgaggcucccuggggagccauuaaugugcaguccacauuuaaacccaccguuagcacggccaacaucgcucugucuugguccagcguggaacaucggggaaacaagauccucgucaccggcagaucugaguccauuaugaagcuggaggaacgcacaggggugagcugggaucugggcguggaggacgcgucugaaagcaaacuucucaccguuuccaucauggaucugagccaaauguauucuccugucuucgaguaccuguccggagacagacagguggaagaguggccgaaggccacaugcaccggcgauugucccgagagaugcggguguacgagcuccacaugccuccacaaagaauggccucauucucgcaauuggcgguguaaccccaccuggugcuggggagugggcacaggguguaccugcuguggagucgacgugaaggaucuguuuaccgaccacauguucauuaaauggaagguugaguauaucaagacagaagcuauugugugcgucgagcuuacgagccaggaaagacaguguucccugaucgaggccggcacccgcuuuaaucucgggccugugacaaucacccugucugagccccggaacauucaacagaaacugccgccugaaaucauuacacuucaucccaagaucgaggaaggcuucuuugaccucaugcacguucagaaagugcugagcgccuccaccgucugcaagcugcagucuugcacgcacgggauuccuggcgaucuccaaaucuaccauaucgggaaucugcuuaaaggagacagagugaacggccaccugauucauaagaucgagccccacuucaauacaagcuggauguccugggaugggugugaccucgauuacuauugcaacaugggagacuggccuagcuguaccuacaccggcguuacacagcacaaucaugcugccuuugugaaccugcugaauauugaaaccgauuauacaaaaacguuccacuuccauucuaagcgggucaccgcgcacggggacacaccccagcuugaucucaaggcucgcccgaccuacggcgccggagagaucacagugcugguggaggucgccgacauggaacugcauaccaaaaagguugagauuuccggccucaaauuugcuagccugacgugcaccggguguuaugccuguucuuccggaaucagcugcaaggugcggauucacguggaugaaccugacgagcuuacaguccacgugaaaucuuccgaucccgacguuguggcugccagcaccucccugauggcgcggaagcucgaguucggcacagacagcaccuuuaaggccuucucugcuaugcccaaaacaagccugugcuuuuacaucgucgaaagagaguauuguaaguccugcucugaagaugacaccaaaaaguguguggauacgaaacuggagcagccucaaagcauccuuauugaacauaaggggacaaucauuggaaagcagaacgauaccugcaccgccaaggcuuccugcuggcuggagucuguuaagagcuucuuuuacggccucaaaaauaugcugggguccguguucggcagcuuuuucgucggaauccuccuguuucuugccccguucgugcugcucguucuguuuuucauguucggcuggaagauucuguuuuguuucaaaugcugucgccggacaagagggcuuuuuaaguaccgccaccugaaggacgacgaggaaaccggauauagacggaucaucgagcgccucaacucuaaaaagggcaaaaauagacugcucgauggggaacggcuggcggaccgcaagauugccgagcuuuucuccacgaaaacacauaucgga

SEQ ID NO: 13813 - RNA, 3495 nt, Artificial Sequence
  derived and/or modified CDS sequence (opt5) from CCHVF(CCHVF K323_27)__KX013472.1__Gn-NSm-Gc
agcgaggaacccggcgacgauugcaucuccagaacccagcugcucaagacagagacggccgaaauucacgacgauaacuacgggggaccuggcgacaaaaucaccauuuguaaugggucuacaaucguggaucaacggcugggaagcgagcuuggcugcuauaccauuaaccgcgucaaguccuucaaacugugugaaaauucugcuacagggaagaccugcgagaucgacagcacaccgguuaaauguagacagggauuuugccucaagaucacccaggagggccggggccaugugaagcugucccgcgggucugaagugguccuugaugccugugacagcuccugcgagauuaugauccccaaaggaacgggcgauauucugguggacuguagcgggggacagcaacacuuccucaaggauaaccugaucgaccugggcugcccucauauuccccuccuggggaaaauggcgaucuacauuuguagaaugucuaaucacccucggaccacaauggcuuuucuuuucugguuuuccuucggauauguuauuaccugcaucuuuugcaaggcccuguucuaccuccugauuaucauuggcacacuuggcaaaaagaucaagcaguaucgcgaacugaaaccccagaccuguacgauuugcgagacagccccugugaacgcuaucgaugccgagaugcaugaccucaauuguagcuacaacaucugcccguauugugcuucuagacugaccuccgacgggcuggcccggcacgucacacagugccccaagcgcaaagaaaagguggaggaaaccgagcucuaccugaaucuugaaagaaucccuuggaucguucggaaacugcuccaagugagcgagucuaccggagucgcgcugaagcgcuccagcuggcuuacagugcugcucgugcugcugacggucucccucucucccguucagagcgccccugugggccacgggaacaccauugagacauaccagaccagagaaggauuuacauccaucugucuguucaugcuuggcagcauucuguuuaucgugucuugccucgucaaagggcugguggauuccguuagcgacucuuucuuucccggacuuagcguguguaagaccugcuccaucggcucuauuaauggcuucgagaucgaaagccauaaguguuauugcucccuguucugcuguccgcacugccggcaucgcagcgcugauagagagauucaccagcuccaccugucuaucuguaaaaagcggaaaacgggguccaacgucaugcuggccgugugcaagagaauguguccuaaagcuacaauugaagccagccgccgggcgcuccccaucagaucuauuaucaauaccacccugguuaugugcauccuuacacuggccauuuguguggucuccaccagcgcuguggagauggaggaccucccugccggaacaugggaacgcgaggaagaucugacgaacuuuugccaucaagagugucaggucaccgaaacagagugccugugucccuacgaggcucuugugcuccggaagccccuguuccuggacuccaucgccaagggcaugaaaaaucuccugaacucuaccagccuugaaacaucccugucuauugaggccccuuggggagcuaucaacguucagagcaccuuuaagccgacgguguccaccgcgaauauugcccucagcuggucuuccgucgaacacagaggaaacaaaauccuggugacaggccgcagcgagucuaucaugaagcuggaggaacggaccgggguuuccugggaucuuggcguggaggacgcuagcgaaucuaaacuccugacagucagcauuauggaucugucccaaauguauagccccguguucgaguaccucucuggagacagacagguggaagaguggccuaaggcuaccugcacgggcgauugccccgagcgcugugggugcacauccagcaccugucugcauaaggaauggccucacucccggaauuggagaugcaaccccacaugguguuggggaguuggcaccgggugcaccuguugcggagucgacgugaaagaccuuuuuacagaucauauguucaucaaguggaaaguggaguauauuaagacggaagccaucgucuguguggagcugaccggccaggaacgccagugcucucucauugaggccgggacacgguuuaaucugggcccgguuaccaucacacugagcgagccuagaaacauccaacagaaacuucccccugaaauuaucacccuccaccccaagauugaggaaggauucuuugaccugaugcacgugcagaagguccuguccgccucuacgguguguaaacuccagagcugcacacauggcaucccuggggaucugcaaauuuaccacaucggaaaucuucugaagggcgaccggguuaacgggcaucucauccacaaaauugagccccacuucaauaccuccuggaugucuugggauggaugcgaccuggauuauuacuguaacaugggcgacuggccgagcugcaccuacacaggggugacccagcauaaucacgcggcuuuugucaaccugcuuaauaucgaaacagauuauacgaagaccuuccauuuucacuccaaacgcgugacagcccauggcgacaccccucagcucgaucugaaggccagacccacauacggagcuggcgagauuaccguucugguggaggucgccgacauggaacuccacacgaaaaagguggagaucagcgggcugaaguucgcuucucuuaccuguacaggaugcuaugccuguuccagcggcauuucuugcaaagugcggauccacgucgaugaacccgacgagcugaccguucaugugaaguccagcgacccugauguggucgcggccucuacaucccucauggcuagaaaacuggaguucgggaccgacagcacauuuaaggccuucuccgcuaugccgaaaaccagccuguguuuuuacauuguggaacgcgaguauugcaagucuuguagcgaagaugacacgaagaaaugcguugauacaaaacuugagcagccccaauccauccugaucgaacacaagggaaccauuaucggcaagcagaacgacaccuguacagccaaagcgucuugcuggcucgagagcgugaaguccuucuuuuacgggcugaagaauaugcucggcucugucuucgggagcuuuuucgugggcauucugcuuuuucuggccccuuucguucuccuggugcuguuuuucauguuuggguggaaaauccuuuucugcuucaaguguugccggagaacccgcggacuguuuaaauauagacaucucaacgaugacgaggaaacgggcuaccggcgcauuaucgagagacugaacuccaagaaagggaagaaucggcuccuggauggagaacgccuugcugacagaaagaucgccgagcuguucucuacaaaaacccacauuggc

SEQ ID NO: 13814 - RNA, 3495 nt, Artificial Sequence
  derived and/or modified CDS sequence (opt5) from CCHVF(CCHVF K340_6)__KX013475.1__Gn-NSm-Gc
agcgaggaacccggcgacgauugcaucuccagaacccagcugcucaagacagagacggccgaaauucacgacgauaacuacgggggaccuggcgacaaaaucaccauuuguaaugggucuacaaucguggaucaacggcugggaagcgagcuuggcugcuauaccauuaaccgcgucaaguccuucaaacugugugaaaauucuacaaccgggaagacaugcgagaucgacagcaccccgguuaaauguagacagggauuuugccucaagaucacgcaggagggccggggccaugugaagcugucccgcgggucugaagugguccuugaugcuugugacagcuccugcgagauuaugauccccaaaggaaccggcgauauucugguggacuguagcgggggacagcaacacuuccucaaggauaaccugaucgaccugggcugcccucauauucccccucucgggaaaauggccaucuacauuuguagaaugucuaaucacccccggacaaccauggcguuucuguucugguuuuccuucggauauguuaucacaugcaucuuuugcaaggcucuuuucuacagccugauuaucauuggcacccucggcaaaaagaucaagcaguaucgcgaacugaaaccucagacguguacaauuugcgagaccgccccggugaacgccaucgaugcugagaugcaugaccuuaauuguucuuacaacaucugccccuauugugccuccagacugacaagcgacgggcucgcucggcacgucacccagugcccuaagcgcaaagaaaagguggaggaaaccgagcuguaccugaaucucgaacggauucccuggaucguuagaaaacugcuucaagugucugaguccacaggagucgcccugaagcgcagcuccuggcucauugugcugcuugugcugcucacggucucucugagcccuguucaguccgcgcccgugggccacgggaaaaccaucgagacauaccagaccagagaaggauuuacaagcauuugucuguucaugcucggcucuauccuguuuaucguguccugccuugucaaggggcugguggauagcguuucugacagcuucuuuccgggacucuccguguguaagaccugcucuauuggcagcaucaacggcuucgagauugaaucccauaaauguuauugcagccuguucugcuguccuuacugccggcacuguucugccgaucgcgagauccaucagcuucaccuguccauuugcaagaaaagaaagacggggagcaaugucaugcucgcuguguguaaacggaugugcuuuaaggccacaaucgaggcuucuagacgcgcccugcugauucgguccaucaucaacaccaccuucguuauguguauucucacacuggcgaucugcguggucagcaccuccgccguggagauggaggaccuucccgcuggaacaugggaaagagaggaagaucugacgaauuuuugucaccaagagugccaggucaccgaaacagagugucucugcccuuaugaggcccuggugcugcgcaagccccuuucucucgacagcauuguuaaaggcaugaagaaccugcucaauuccaccucucucgaaacaagccuguccaucgaggcucccuggggagccauuaacgugcagagcaccuucaaaccuacggucucuaccgccaacaucgcucuuuccuggagcucuguggaacaucggggaaauaagauccugguuacaggcagauccgagagcauuaugaaacucgaggaacgcaccggggugucuugggaucugggcgucgaggacgcgagcgaauccaagcugcuuacagugagcaucauggaucucucucaaauguacuccccgguguuugaguaucugagcggagaccggcagguugaagaguggcccaaggcuaccugcacgggcgauuguccugagagaugcggguguacauccucuaccugccugcacaaagaauggccccauagccgcaacuggcgguguaauccuacauggugcuggggagucggcaccggguguaccugcuguggaguggacgugaaggaccucuucacagaucacauguuuauuaaauggaaggucgaguacaucaaaacggaagccauugugugcguugagcugaccucccaggaaagacaguguucucuuaucgaggccggcacacgcuucaaccuggggcccgugaccaucacacucagcgagccgcggaauauucaacagaagcugccucccgaaaucauuacccugcauccuaagaucgaggaaggcuuuuucgaccuuaugcacguccagaaagugcucuccgccucuacgguuugcaagcugcagagcugcacacacgggauucccggcgaucugcaaaucuaucauaucgggaaccuccugaaaggagacagagugaauggccaccuuauucauaagaucgagccucacuuuaacaccuccuggaugagcugggaugggugugaccuggauuacuacugcaauaugggagacuggcccucuuguaccuauacaggcgucacccagcacaaccaugcugccuucgugaaucuccugaacauugaaacagauuacacgaaaaccuuucacuuccauuccaagcggguuacagcgcacggggacaccccgcagcuggaucuuaaagcucgcccuacauauggcgccggagagaucaccgugcucgucgaggugacggacauggaacugcauaccaagaagguggagauuagcggccugaaauucgccucucucacaugcaccggguguuacgcuugcuccagcggaaucucuuguaagguccggauucacguugaugaacccgacgagcugacagugcacgugaaauccagcgaccccgaugucguggccgcuuccaccagccuuauggccagaaagcuggaguuuggcacagacucuaccuucaaagcguuuagcgccaugccuaagacgucccucugcuucuauaucguugaaagagaguacuguaagucuugcagcgaagaugacaccaaaaaguguguggauacaaaacuggagcagccgcaauccauccugauugaacauaaggggaccaucauuggaaaacagaaugacacaugcaccgcuaaggccucuugcuggcuugagagcgucaaguccuuuuucuauggccugaaaaacaugcucgggucuguguuuggcagcuucuuuguuggaauccugcuguuccuggcucccuuugugcuucugguccucuucuuuauguucggcuggaagauucuguucuguuuuaaaugcugucgccggacgagagggcuguucaaguaccgccacuuuaaagaugacgaggaaacaggauacagacggaucaucgagcgccuuaauuccaagaagggcaaaaacagacugcucgauggggaacggcuggccgaccgcaagauugcggaacucuucagcaccaaaacacauaucgga

SEQ ID NO: 13815 - RNA, 3495 nt, Artificial Sequence
  derived and/or modified CDS sequence (opt5) from CCHVF(CCHVF Mamon)__KX013478.1__Gn-NSm-Gc
agcgaggaacccggcgacgauugcaucuccagaacccagcugcuccggacagagacggccgaaauucacgacgauaacuacgggggaccuggcgacaagaucaccauuuguaaugggucuacaaucguggaucaacgccugggaagcgagcuuggcugcuauaccauuaacagagucaaauccuucaagcugugugaaaauucugcuacagggaaaaccugcgagaucgacagcacaccgguuaagugucggcagggauuuugccucaaaaucacccaggagggccgcggccaugugaagcuguccagagggucugaaguggucagcgaugccugugacuccagcugcgaggugaugauucccaagggaacgggcgauauccuuguugacuguucugggggacagcaacacuuccugaaagauaaccucauugaccugggcugcccucauaucccccugcucgggaagauggcgauuuacaucugucggauguccaaucacccucgcaccacaguggcuuuucuguucugguuuagcuucggauaugucauuaccugcaucuuuugcaaagcccuuuucuacucucugaucauuaucggcacacucggcaagaaaauuaagcaguauagagaacugaagccccagaccuguacgaucugcgagacagccccugugaacgcuauugaugccgagaugcaugaccuuaauuguuccuacaacaucugcccguauugugcuagccggcugaccucugacgggcucgcccgccacguuccccagugcccuaaaagaaaggaaaaaguggaggaaacagagcuguaccugaaucucgaacggauccccuggauuguccgcaagcugcuucaaguguccgagagcaccggaguggcgcugaaaagauccucuuggcucaucguccugcuuguucugcucaccgugagccuguccccugugcagagcgcccccgucggccacgggaagacaauugagacguaccagacccgggaaggauuuacaucuaucugucuguucaugcucggcuccauucuguuucuugugagcugccugguuaaagggcucguggauucugucagcgacuccuucuuuccgggacugucuguguguaagaccugcagcaucggcuccaucaacggcuucgagauugaaagccauaaguguuauugcucucuuuucugcuguccuuacugccgccacuguuccgcugauagagagauccaucagcugcaccucagcauuugcaaaaagcggaaaacagggucuaauguuaugcuggccguguguaagagaaugugcuuucgcgcuaccaucgaagccucccggagagcgcugcucauucgcagcaucauuaacacgacauucgucaucuguauccugacccuuaccauuugcguggucuccacaucugccguggagauggagaaucugcccagcggaaccugggaacgggaggaagaccucacaaacuuuugucaccaagagugccagguuacggaaaccgagugucugugcccuuaugaggcucuggugcuuagaaaaccccucuuccuggauuccaucgucaagggcaugaagaaucugcucaacucuacaagccuggaaaccucccuuagcauugaggcccccuggggagcuaucaacgugcagucuacauuuaaaccuaccguuuccacggccaauauugcccugagcuggucuuccguggaacaucgcggaaacaagauccucgucaccggccggagcgagucuaucaugaaacuggaggaaagaacaggggugagcugggaccugggcguggaggaugcuuccgaaagcaaacuucucaccguuucuauuauggaccugucccaaauguacagcccggucuucgaguaucuguccggagaucgccagguggaagaguggcccaaggcgacaugcaccggcgacuguccugagcggugcggguguacgucuagcacaugccuccacaaggaauggccccauuccagaaauuggcgcuguaacccuaccuggugcuggggagugggcacaggguguaccugcuguggagucgaugugaaggaccuguuuaccgaccacauguucguuaaauggaagguggaguacaucaaaacagaagccauugucugcguggagcuuacgucucaggaacggcaguguagccugaucgaggcuggcaccagauuuaaucucgggcccguuacaauuacccuguccgagccgcggaacauccaacagaagcugccucccgaaaucauuacacuucauccuaaaguggaggaaggcuucuuugaucucaugcacguccagaaggugcugucugccagcaccguuugcaagcugcaguccugcacgcacggaauccccggcgaccuccaaguguaucauauugggaaucugcuuaaaggagaucgcgucaacggccaccugauccauaagauugagccucacuucaauacaagcuggaugucuugggacgggugugaucucgacuacuacugcaacaugggagauuggcccuccuguaccuauaccggcgugacacagcacaaucaugccgcuuuugugaaccugcugaauaucgaaaccgacuacacaaaaacguuccacuuccauagcaagagagucaccgcccacggggauacaccgcagcuugaccucaaagcgcggccuaccuauggcgcuggagagaucacaguucugguggagguggccgauauggaacugcauaccaagaaagucgagauuucuggccucaaguuugccucccuggcuugcacgggguguuacgccugcagcucuggaaucuccuguaaggugcgcauucacguugacgaacccgaugagcuuaccgugcacgucaaaagcuccgaccccgacgugguugcugccagcacaucucugauggcgagaaagcucgaguucggcaccgauagcacauuuaaagccuucuccgcuaugccuaagaccucucugugcuuuuauaucguggaacgggaguacuguaaaagcugcuccgaagaggacacacagaagugugucgauaccaagcuggaacaaccgcagucuauucuuaucgagcauaaagggacgauuaucggaaagcagaacgacacaugcaccgccaaaaccagcugcuggcuggaguccgugaagucuuucuuuuauggccucaaaaauaugcuggggagcguuuucggcaacuuuuucaucgggauucuccuguuucuugcucccuucgugcugcucguccuguuuuucauguucggcuggaagauccuguuuuguuucaagugcuguagacgcacaagagggcuucugaaauaccggcaccucaaggaugacgaagagaccggauaccgcagaauuaucgaacggcugaacaauaaaaagggcaaaaaccgccuccuggauggggagagacuugccgaccggaagauugcggaacuguuuuccacgaagacacauaucgga

SEQ ID NO: 13816 - RNA, 3495 nt, Artificial Sequence
  derived and/or modified CDS sequence (opt5) from CCHVF(CCHVF Min)__KX013481.1__Gn-NSm-Gc
agcgaggaacccggcgacgauugcaucuccagaacccagcugcuccggacagagacggccgaaauucacgacgauaacuacgggggaccuggcgacaagaucaccauuuguaaugggucuacaaucguggaucaacgccugggaagcgagcuuggcugcuauaccauuaacagagucaaauccuucaagcugugugaaaauucugcuacagggaaaaccugcgagaucgacagcacaccgguuaagugucggcagggauuuugccucaaaaucacccaggagggccgcggccaugugaagcuguccagagggucugaagugguccuugaugccugugacagcuccugcgaggugaugauucccaagggaacgggcgauauccugguugacuguagcgggggacagcaacacuuccucaaagauaaccugauugaccugggcugcccucauaucccccuccuggggaagauggcgauuuacaucugucggaugucuaaucacccucgcaccacaauggcuuuucuuuucugguuuuccuucggauaugugauuaccugcaucuuuugcaaagcccuguucuacagccucaucauuaucggcacacugggcaagaaaauuaagcaguauagagaacuuaagccccagaccuguacgaucugcgagacagccccugucaacgcuauugaugccgagaugcaugaccugaauuguucuuacaacaucugcccguauugugcuucccggcucaccagcgacgggcuggcccgccacgugccccagugcccuaaaagaaaggaaaaaguugaggaaacagagcuguaccucaaucuggaacggauccccuggauugugcgcaaacuucugcaagucucugaguccaccggaguggcgcucaaaagaagcuccuggcugaucgugcuucugguccuccugaccguuucucugagcccugugcaguccgcccccgugggccacgggaagacaauugagacguaccagacccgggaaggauuuacaagcaucugucucuucaugcugggcucuauucuuuuucuggucuccugccucgugaaagggcugguugauagcgugucugacagcuucuuuccgggacuuuccgucuguaagaccugcacaaucggcucuaucaacggcuucgagauugaaagccauaaguguuauugcucccuguucugcuguccuuacugccgccacuguagcgcugauagagagauccaucagcuccaccugucuauuugcaaaaagcggaaaaccggguccaaugugaugcuggccguuuguaagagaaugugcuuucgcgcuacgaucgaagccagccggagagcgcuccugauucgcucuaucauuaacacaaccuucgugaucuguauccuuacccugacaauuugcgucguguccaccagcgccgucgagauggagaaucuccccuccggaacaugggaacgggaggaagaccugacgaacuuuugucaccaagagugccaggugaccgaaacagagugucugugcccuuaugaggcucuuguucucagaaaaccccuguuccuggauucuaucgugaagggcaccaagaaucuccugaacagcacaucccuugaaaccucucugagcauugaggcccccuggggagcuaucaacguccaguccacguuuaaaccuaccgugagcacagccaauauugcccucucuugguccagcguugaacaucgcgggaacaagauccuggugaccggccggucugaguccaucaugaaacuggaggaaagaacaggggucagcugggaccuuggcguggaggaugcuucugaaagcaagcuccugaccguguccauuauggaccugagccaaauguacucuccgguuuucgaguaucucuccggagaucgccaggucgaagaguggcccaaagcgacgugcacaggcgacuguccugagcggugcggguguaccagcuccacaugccugcacaaggaauggccccauucuagaaauuggcgcuguaacccuaccuggugcuggggagugggcaccggguguacaugcuguggaguggaugucaaggaccuuuuuacggaccacauguucgugaaauggaagguugaguacaucaaaaccgaagccauugugugcgucgagcugacaagccaggaacggcaguguucccucaucgaggcuggcaccagauuuaaucuggggcccgugacaauuacccugucugagccgcggaacauccaacagaaacuuccucccgaaaucauuacgcuccauccuaagguugaggaaggcuucuuugaucugaugcacgugcagaagguccugagcgccuccacagugugcaagcuccagucuugcacccacggaauccccggcgaccugcaaguuuaucauauugggaaucuucugaaaggagaucgcaucaacggccaccucauucauaagaucgagccucacuucaauaccagcuggauguccugggacgggugugaucuggacuacuacugcaacaugggagauuggcccagcuguacauauaccggcgugacacagcacaaucaugccgcuuuugucaaccugcuuaauaucgaaacggacuacaccaaaacauuccacuuccauucuaagagagugaccgcccacggggauacaccgcagcucgaccugaaagcgcggccuaccuauggcgcuggagagauuacggugcuggucgagguugccgauauggaacuccauaccaagaaaguggagaucuccggccugaaguuugccagccuugcuugcacaggguguuacgccugcagcuccggaauuagcuguaaggugagaauccacgucgacgaacccgaugagcugaccgugcacguuaaaucuuccgaccccgacguggucgcugccagcacaucccucauggcgcgcaagcuggaguucggcaccgauagcacauuuaaagccuucucugcuaugccuaagaccagccugugcuuuuauauuguggaacgggaguacuguaaauccugcucugaagaggacacgcagaaguguguugauacaaaacuugaacaaccgcagagcauccugauugagcauaaggggaccaucaucggaaagcagaacgauaccugcacagccaaggcuuccugcuggcucgagucugugaagucuuucuuuuauggccugaaaaauaugcucggguccgucuucggcaacuuuuucauuggaauccugcuuuuucuggcccccuucgugcuccugguucuguuuuucauguucggcuggaagauucuguuuuguuucaagugcuguagacgcaccagagggcuucucaaauaccggcaccugaaggacgacgaagagacgggauaccgcagaaucauugaacggcucaacaauaaaaagggcaaaaaccgccugcuugauggggagagacuggcggaccggaagaucgccgaacucuuuucuacaaagacccauaucgga

SEQ ID NO: 13817 - RNA, 3495 nt, Artificial Sequence
  derived and/or modified CDS sequence (opt5) from CCHVF(CCHVF Nakiwogo)__KX013484.1__Gn-NSm-Gc
gccgagggcgugagcaacgacugcgucuccagaacccagcugaucaagacagaaguugcugagauucacgaagauucuuacgggggacccggcgagaaaaucacgauuuguaaugggagcaccaucguggaccaacggcucggauccgaacugggcugcuauacaauuaaccgcgugaagaccuacaaacuuugugagaauagcgccacagagaaggggugcgaaaucgauagcgucccugugaaauguaagcagggauucugccugaagguuacccaggagggcagaggccaugugaaacucucccgggggacagaaaucguccuggacgugugugauaccucuugcgagcuuaugauuccgaagggaacgggcgacauccugguugauuguagcgggggacagcaacacuuucuccaggacaaccugauugaucugggcugccccaaugugccucuccuggggaaaauggcgaucuauauuugucgcauguccaaccaucccaagaccacaauggcuuuccuguuuugguucagcuuuggauacgucauuaccugcguggugugcaaaguccuguucuaucuccugaucguuaucggcacacuuggcaagaagcugaaacaguacagagagcucaagccucagaccuguaucgugugcgaaucuauucccgugaaugucaucgacgccgagaugcacgaacugaacuguaauuauaacauuugcccuuacugugccucccggcugacgagcgaugggcucgugcgccauguuacacaaugcccgaaaagaaaggagaaaguggaagagaccgagcuguaccuuaaucuggaacggauccccuggcucguccgcagacugcuucaggugucugaguccacaggaauggcucugaagcggagcuguuggaugaccacccuccugauucugcucguugugucucuguccccuguccagagcgcccccgugggccaggaaaaagcuaucgaggucuaucaagugcgcgaauccuacacaucuaugugccuuuuuguucuggggagcguccucuucgccguguccuggcuggugaagggacuuaucgacggcauugggaacagcuuuuucccuggacugucuguuuguaagacgugcuccaucggcagcauuaauggcuuugagaucgagucucacaaauguuauugcagccucuucugcugucccuacugcagagcguguuccucugauaagauuacccaccggaugcaucugaacaucugcaaacgcagaaagguggggagcaaugucaugcuggccguguguaaacggaugugcuuuaaggcuacaguggaagccuccaacagcgcucuccugaucagaucuauuaucaacuccaccuucguuauuuguguccuuauccuggugauuugcguggucagcacaucugccguggacauggagaaucucccggcgggaaucugggaacgcgaggaagaccugaccaacuucugucaccaggagugccagguuacggagacagaaugucugugcccuuaugaggcccuuauucuccggaagccccuguaccuggauuccaucgcuaaaggcaugaaaagccuccuuaauuccaccaaccuugaaaccucucugagcaucgaggccccuuggggagcuauuaaugugcaauccacauuuaaacccaccgucucugccgccaacaucgcucucagcugguccagcguggagcauagagggaauaagauucugguuucuggccgcuccgaaagcaucaugaaacuggaggaacggacagggauuucuuggucccuuggcguggaggacgcgagcgaaucuaagacgcucaccgucagcgugauggaucugucccagauguauagccccguuuucgaguaccugucuggagacagacagguggaggaauggccuaaggccacaugcaccggcgauuguccggagcgcugcggguguacauccucuaccugccuccacaaagaauggccccacucccggaacuggagauguaauccuacguggugcuggggagucggcaccggguguacaugcuguggacuggacgugcgcgaucuuuuuaccgacuacaugauggugaaguggaaagucgaguauguuaagacagaagcuaucaugugcguggagcugaccucucaggagcggcaauguagccucaucgaagccggcacgagauucaaccuggggcccgugacaauuacccuguccgagccucgcaauguccagcagcggcuucccucugaaaucgugacacuccauccgaaaauugaggaaggcuuuuucgaucugaugcacguucagaaggugcuguuuugcaagcauagccuccaagccaccuccugcacccacggagucccuggcgaccuucagguguaccauguugggaaccuucugaaaggagauaaggugaauggccacucuauccacaaaauugagagccauuucaacacauccuggaugagcugggacgggugugaccucgauuauuuuugcaauaugggagacuggcccucuuguacguacaccggcgucacacagcacaacagagcugccuucgugaacaugcugaauaucgagaccgauuauacaaagaccuuucauuuccacuccaaacggguuacggcgcacggggacacaccucagcuggaucuuaaggcucgccccaccuacggcgccggagaagugaccguccucguggagguggccgaccuggaacugcauacaaagaagaucgaggucagcggccucaaguuugcuucucugaccugcuccggguguuaugccugcagcucuggaauuuccuguaaaguuagaauccacgugaacgagccugaugaauuuacagugcaugucaagagcaaugaccccgaugugguugcugccggcuccagccuuauggcgcggaaaauugagcugggggccgacucuacguucaaggcuuuuagcuccaugccgaaaaacucucucugcuucuacaucguggaaagagauuacuguagcuccugcaccgacgaugacacacaaaagugugucaauaccaagcuggagcacccucagucuauucugaucgaacauaaaggaacaaucauuggcaagcagaacgauaccugccccacgaaaaccagcugcuggcuugaguccgugaagucuuucuucuaugggcugaaaaauaugcucggcggaaucuuuggcaacguuuuccuggggauuuuucucuuccuggcccccuuugcucugcugauccucuucuuuuucuuuggauggcgccugcuguucugucuuaagugcugucggagaacacgcggccugcucaaguacaaacagcugaaggacgaggaagaggccggguauaaaaagauuaucgaaagacucaaugacaaaaagggaaagagccggcuguucgauggcgagcgccuugcggacagaaaaauugccgaacuguuuuccaccaagacacacaucggc

SEQ ID NO: 13818 - RNA, 3495 nt, Artificial Sequence
  derived and/or modified CDS sequence (opt5) from CCHVF(CCHVF Saf)__KX013487.1__Gn-NSm-Gc
agcgaggaacccggcgacgauugcaucuccagaacccagcugcuccggacagagacggccgaaauucacgacgauaacuacgggggaccuggcgacaagaucaccauuuguaaugggucuacaaucguggaucaacgccugggaagcgagcuuggcugcuauaccauuaacagagucaaauccuucaagcugugugaaaauucugcuacagggaaaaccugcgagaucgacagcacaccgguuaagugucggcagggauuuugccucaaaaucacccaggagggccgcggccaugugaagcuguccagagggucugaagugguccuugaugccugugacagcuccugcgaggugaugauucccaagggaacgggcgauauccugguugacuguagcgggggacagcaacacuaccucaaagauaaccugauugaccugggcugcccucauaucccccuccuggggaagauggcgauuuauaucugucggaugucuaaucacccucgcaccacaauggcuuuccuuuucugguuuuccuuuggauacgugauuaccugcaucuucugcaaagcccuguuuuauagccucaucauuaucggcacacugggcaagaaaauuaagcaguacagagaacuuaagccccagaccuguacgaucugcgagacagccccugucaacgcuauugaugccgagaugcaugaccugaauuguucuuauaacaucugcccguacugugcuucccggcucaccagcgacgggcuggcccgccacgugccccagugcccuaaaagaaaggaaaaaguugaggaaacagagcuguaccucaaucuggaacggauccccuggauugugcgcaaacuucugcaagucucugaguccaccggaguggcgcucaagagaagcuccuggcugaucgugcuucugguccuccugaccguuucucugagcccugugcaguccgcccccgugggccacgggaagacaauugagacguaucagacccgggaaggauucacaagcaucugucucuuuaugcugggcucuauucuuuuccuggucuccugccucgugaaagggcugguugauagcgugucugacagcuuuuucccgggacuuuccgucuguaagaccugcucuaucggcagcaucaacggcuuugagauugaaucccauaaguguuacugcagccuguucugcuguccuuauugccgccacuguucugcugauagagagauccaucagcuccaccuguccauuugcaaaaagcggaaaacagggagcaaugugaugcuggccguuuguaagagaaugugcuuccgcgcuaccaucgaagccucucggagagcgcuccugauucgcuccaucauuaacacgacauuugugaucuguauccuuacccugaccauuugcgucgugagcacauccgccgucgagauggagaaucuccccucuggaaccugggaacgggaggaagaccugacaaacuucugucaccaagagugccaggugacggaaaccgagugucugugcccuuacgaggcucuuguucucagaaaaccccuguuuagcgauuccaucgugaagggcaugaagaaucugcucaacucuacaagccuggaaaccucccuuagcauugaggcccccuggggagcuaucaacguccagucuacauucaaaccuaccguguccacggccaauauugcccugagcuggucuuccguugaacaucgcggaaacaagauccucgugaccggccggagcgagucuaucaugaaacuggaggaaagaacaggggucagcugggaccugggcguggaggaugcuuccgaaagcaaacuucucaccgugucuauuauggaccugucccaaauguauagcccgguuuuugaguaccuguccggagaucgccaggucgaagaguggcccaaggcgacaugcaccggcgacuguccugagcggugcggguguacgucuagcacaugccuccacaaggaauggccccauuccagaaauuggcgcuguaacccuaccuggugcuggggagugggcacaggguguaccugcuguggaguggaugucaaggaccuguucaccgaccacauguuugugaaauggaagguugaguauaucaaaacagaagccauugugugcgucgagcuuacgucucaggaacggcaguguagccugaucgaggcuggcaccagauucaaucucgggcccgugacaauuacccuguccgagccgcggaacauccaacagaagcugccucccgaaaucauuacacuucauccuaaaguugaggaaggcuuuuucgaucucaugcacgugcagaagguccugucugccagcaccgugugcaagcugcaguccugcacgcacggaauccccggcgaccuccaaguuuaccauauugggaaucugcuuaaaggagaucgcgugaacggccaccugauccauaagauugagccucacuuuaauacaagcuggaugucuugggacgggugugaucucgacuacuauugcaacaugggagauuggcccuccuguaccuacaccggcgucacacagcacaaucaugccgcuuucgugaaccugcugaauaucgaaaccgacuauaugaaaacauuucacuuccauagcaagagagugacggcccacggggauaccccgcagcuugaccucaaagcgcggccuacauacggcgcuggagagaucaccguccugguugagguggccgauauggaacugcauacaaagaaaguggagauuucuggccucaaguucgucucccuggccugcaccggguguuaugcuugcagcucuggaaucuccuguaaggugcgcauucacguugacgaacccgaugagcuuacggugcacgucaaaagcuccgaccccgacgugguugccgcuagcaccucucugauggccagaaagcucgaguuuggcacagauagcaccuucaaagcguuuuccgccaugccuaagacaucucugugcuucuacaucguggaacgggaguauuguaaaagcugcuccgaagaggacacccagaagugugucgauacaaagcuggaacaaccgcagucuauucuuaucgagcauaaagggaccauuaucggaaagcagaacgacacgugcacagcuaaagccagcugcuggcuggaguccgugaagucuuucuuuuacggccucaaaaauaugcuggggagcguuuuuggcaacuucuuuaucgggauucuccuguuccuugcucccuuugugcugcucguccuguucuuuauguucggcuggaagauccuguucuguuuuaagugcuguagacgcaccagagggcuucugaaauaccggcaccucaaggaugacgaagagaccggauaucgcagaauuaucgaacggcugaacaauaaaaagggcaaaaaccgccuccuggauggggagagacuugccgaccggaagauugcggaacuguucuccacaaagacccauaucgga

SEQ ID NO: 13819 - RNA, 3495 nt, Artificial Sequence
  derived and/or modified CDS sequence (opt5) from CCHVF(CCHVF Ast199)__KX056051.1__Gn-NSm-Gc
agcgaggaacccggcgacgauugcaucuccagaacccagcugcucaagacagagacggccgaaauucacgacgauaacuacgggggaccuggcgacaaaaucaccauuuguaaugggucuacaaucguggaucaacggcugggaagcgagcuuggcugcuauaccauuaaccgcgucaaguccuucaaacugugugaaaauucugcuacagggaagaccugcgagaucgacagcacaccgguuaaauguagacagggauuuugccucaagaucacccaggagggccggggccaugugaagcugucccgcgggucugaagugguccuugaugccugugacagcuccugcgagauuaugauccccaaaggaacgggcgauauucugguggacuguagcgggggacagcaacacuuccucaaggauaaccugaucgaccugggcugcccucauauuccccuccuggggaaaauggcgaucuacauuuguagaaugucuaaucacccucggaccacaauggcuuuucuuuucugguuuuccuucggauauguuauuaccugcaucuuuugcaaggcccuguucuacagccucauuaucauuggcacacugggcaaaaagaucaagcaguaucgcgaacuuaaaccccagaccuguacgauuugcgagacagccccugugaacgcuaucgaugccgagaugcaugaccugaauuguucuuacaacaucugcccguauugugcuuccagacucaccagcgacgggcuggcccggcacgucacacagugccccaagcgcaaagaaaagguggaggaaaccgagcuguaccucaaucuggaaagaaucccuuggaucguucggaaacuucugcaagugucugaguccaccggagucgcgcucaagcgcuguagcuggcugauugugcuucuggugcuccugacagucucccugucucccguucagagcgccccugugggccacgggaaaacgaucgagaccuaccagacaagagaaggauuuaccaacauuugccucuucaugcugggcuccauccuuuuuaucgugagcugucuggucaaggggcucguggauucuguuuccgacagcuucuuucccggacugucugugugcaagacauguagcauuggcuccaucaauggcuucgagauugaaucucauaaaugcuauugcagccuuuucuguugcccguacugucggcacugcuccgcugaucgcgagauccaucagcugcaccucgggauuuguaagaaaagaaagaccggaagcaacgucaugcuggccgugugcaaacggauguguuuuaaggcuacgaucgaagccucuagacgcgcgcugcucauucgguccaucaucaauacaaccuucguuauuugcauccugacccuugccauuuguguggucagcacaucugcuguggagauggagaaccugccugccggcaccugggaaagagaggaagaccucacaaauuuuugccaccaagagugucaggucacggaaaccgagugccugugccccuaugaggcucuggugcuucgcaagccucucuuccuggauuccaucguuaaagggaugaagaaccugcucaacagcacaucccuggaaaccucucuuagcauugaggcccccuggggagccaucaaugugcaguccacauuuaaacccaccgucucuacggcuaacaucgcgcugagcugguccagcguggaacaucggggcaauaagauucucguuaccgggagaucugaguccaucaugaaacuggaggaacgcacaggcgugagcugggaccugggagucgaggaugccucugaauccaaacuucucaccgugagcauuauggaccugucucaaauguacagcccuguguucgaguaucuguccggcgaucggcagguugaagaguggccgaaggcuacauguaccggggacugccccgagagauguggaugcacgagcucuacaugucuccacaaagaauggccucauucccgcaacuggcggugcaaucccaccugguguuggggcgucgggacaggaugcaccuguugcggcguggaugugaaggaccuguuuaccgaccacauguucaucaaauggaaggucgaguacauuaaaacagaagccaucguguguguugagcuuacgagccaggaaagacagugcucccugaucgaggccgggacccgcuuuaaccucggcccugugacaauuacccugucugagccccggaauauccaacagaagcugccgccugaaauuaucacacuucaucccaagauugaggaaggauucuuugaucucaugcacguccagaaagugcugagcgcuuccaccguuugcaagcugcagucuuguacgcacggcaucccuggggaccuccaaaucuaucauauuggaaaccugcuuaaaggcgauagacugaaugggcaccucauccauaagauugagccccacuucaacacaagcuggauguccugggacggaugcgaucuggacuacuacuguaauaugggcgauuggccuucuugcaccuauaccggggugacacagcacaaccaugccgcguuugucaaucugcuuaacaucgaaaccgacuacacaaaaacguuccacuuccauagcaagcgggugaccgcucacggcgauacaccccagcucgaccugaaagcccgcccgaccuauggagccggcgagauuacaguucugguggaggucgcugauauggaacuccauaccaagaagguggagguguccgggcugaaauuugccagccuugcuuguacgggaugcuacgccuguucuuccggcaucagcugcaagguccggauucacguugacgaaccugaugagcugaccgugcacgugaaaucuuccgaccccgacgucguggcggccagcacaucucucauggcuagaaagcuggaguucgggaccgauuccacauuuaaagccuucagcgcuaugcccaagaccucccuguguuuuuauaucguugaaagagaguacugcaagagcuguucugaagacgauacaaagaagugcguggacaccaaacuugagcagccucaaagcauccugauugaacauaagggaacgaucauuggcaaacagaaugauacaugcaccgccaaggcguccuguuggcucgagucugucaagagcuucuuuuaugggcugaaaaacaugcucggcuccguguucggaaacuuuuucguuggcauccugcuuuuucuggccccguucgugcuccugguccuguuuuucauuuucggguggaagauccuguuuugcuucaaauguugccgccggaccagaggacuguuuaaguaccgccaccucaaagacgaugaggaaacaggcuacagaaagaucauugagcggcuuaauucuaagaaagggaagaaccgccuccuggacggagaaagacuugcugaucggaaaaucgccgagcuguucagcaccaagacgcauauuggc

SEQ ID NO: 13820 - RNA, 3495 nt, Artificial Sequence
  derived and/or modified CDS sequence (opt5) from CCHVF(CCHVF Ast149)__KX056054.1__Gn-NSm-Gc
agcgaggaacccggcgacgauugcaucuccagaacccagcugcucaagacagagacggccgaaauucacgacgauaacuacgggggaccuggcgacaaaaucaccauuuguaaugggucuacaaucguggaucaacggcugggaagcgagcuuggcugcuauaccauuaaccgcgucaaguccuucaaacugugugaaaauucugcuacagggaagaccugcgagaucgacagcacaccgguuaaauguagacagggauuuugccucaagaucacccaggagggccggggccaugugaagcugucccgcgggucugaagugguccuugaugccugugacagcuccugcgagauuaugauccccaaaggaacgggcgauauucugguggacuguagcgggggacagcaacacuuccucaaggauaaccugaucgaccugggcugcccucauauuccccuccuggggaaaauggcgaucuacauuuguagaaugucuaaucacccucggaccacaauggcuuuucuuuucugguuuuccuucggauauguuauuaccugcaucuuuugcaaggcccuguucuacagccucauuaucauuggcacacugggcaaaaagaucaagcaguaucgcgaacuuaaaccccagaccuguacgauuugcgagacagccccugugaacgcuaucgaugccgagaugcaugaccugaauuguucuuacaacaucugcccguauugugcuuccagacucaccagcgacgggcuggcccggcacgucacacagugccccaagcgcaaagaaaagguggaggaaaccgagcuguaccucaaucuggaaagaaucccuuggaucguucggaaacuucugcaagugucugaguccaccggagucgcgcucaagcgcagcuccuggcugauugugcuucuggugcuccugacagucucucugagccccguucaguccgccccugugggccacgggaaaacgaucgagaccuaccagacaagagaaggauuuaccaacauuugucucuucaugcugggcagcauccuuuuuaucgugucuugccuggucaaggggcucguggauuccguuagcgacucuuucuuucccggacugagcguguguaagacaugcuccauuggcucuaucaauggcuucgagauugaaagccauaaauguuauugcucccuuuucugcuguccguacugccggcacuguagcgcugaucgcgagauccaucagcugcaccucgggauuugcaagaaaagaaagaccggaucuaacgucaugcuggccguguguaaacggaugugcuuuaaggcuacgaucgaagccuccagacgcgcgcugccuauucggagcaucaucaauacaaccuucguuauuuguauccucacccuggccauuugcguggucucuacauccgcuguggagauggagaaccuucccgccggcaccugggaaagagaggaagaccugacaaauuuuugucaccaagagugccaggucacggaaaccgagugucucugcccuuaugaggcucuggugcugcgcaagccccuuuuccucgauagcaucguuaaagggaugaagaaccugcugaacuccacaucucucgaaaccagccuguccauugaggcccccuggggagccaucaaugugcagucuacauuuaaaccuaccgucagcacggcuaacaucgcgcuuuccuggagcucuguggaacaucggggcaauaagauucugguuaccgggagauccgagagcaucaugaaacucgaggaacgcacaggcgugucuugggaccugggagucgaggaugccuccgaaagcaagcugcuuaccgugucuauuauggaccucagccaaauguacuccccgguguucgaguaucugagcggcgaucggcagguugaagaguggcccaaggcuacaugcaccggggacuguccugagagaugcggauguacgucuuccacaugccugcacaaagaauggccccauagccgcaacuggcgguguaauccuaccuggugcuggggcgucgggacaggauguaccugcuguggcguggaugugaaggaccucuuuaccgaccacauguucaucaaauggaaggucgaguacauuaaaacagaagccaucgugugcguugagcugacgucccaggaaagacaguguucucuuaucgaggccgggacccgcuuuaaccugggccccgugacaauuacccucagcgagccgcggaauauccaacagaagcugccucccgaaauuaucacacugcauccuaagauugaggaaggauucuuugaucuuaugcacguccagaaagugcucuccgcuucuaccguuugcaagcugcagagcugcacgcacggcauccccggggaccugcaaaucuaucauauuggaaaccuccugaaaggcgauagacuuaaugggcaccugauccauaagauugagccucacuucaacacauccuggaugucuugggacggaugugaucucgacuacuacugcaauaugggcgauuggcccagcuguaccuauaccggggugacacagcacaaccaugccgcguuugucaaucugcugaacaucgaaaccgacuacacaaaaacguuccacuuccauuccaagcgggugaccgcucacggcgauacaccgcagcuugaccucaaagcccgcccuaccuauggagccggcgagauuacaguucugguggaggucgcugauauggaacugcauaccaagaagguggaggugagcgggcucaaauuugccucucuggcuugcacgggauguuacgccugcuccagcggcaucucuuguaagguccggauucacguugacgaacccgaugagcuuaccgugcacgugaaauccagcgaccccgacgucguggcggccucuacaucccugauggcuagaaagcucgaguucgggaccgauagcacauuuaaagccuucuccgcuaugccuaagaccagccugugcuuuuauaucguugaaagagaguacuguaagucuugcagcgaagacgauaccaaaaaguguguggacacaaaacuggagcagccgcaauccauccuuauugaacauaagggaacgaucauuggcaaacagaaugauacaugcaccgccaaggcgucuugcuggcuggagagcgucaaguccuucuuuuaugggcucaaaaacaugcugggcucuguguucggaaacuuuuucguuggcauccuccuguuucuugcccccuucgugcugcucgcucuguuuuucauuuucggguggaagauccuguuuuguuucaaaugcugucgccggaccagaggacuuuuuaaguaccgccaccugaaagacgaugaggaaacaggcuacagaaagaucauugagcggcucaauagcaagaaagggaagaaccgccugcucgacggagaaagacuggccgaucggaaaaucgcugagcuuuucuccaccaagacgcauauuggc

SEQ ID NO: 13821 - RNA, 3495 nt, Artificial Sequence
  derived and/or modified CDS sequence (opt5) from CCHVF(CCHVF Ast137)__KX056057.1__Gn-NSm-Gc
agcgaggaacccggcgacgauugcaucuccagaacccagcugcucaagacagagacggccgaaauucacgacgauaacuacgggggaccuggcgacaaaaucaccauuuguaaugggucuacaaucguggaucaacggcugggaagcgagcuuggcugcuauaccauuaaccgcgucaaguccuucaaacugugugaaaauucugcuacagggaagaccugcgagaucgacagcacaccgguuaaauguagacagggauuuugccucaagaucacccaggagggccggggccaugugaagcugucccgcgggucugaagugguccuugaugccugugacagcuccugcgagauuaugauccccaaaggaacgggcgauauucugguggacuguagcgggggacagcaacacuuccucaaggauaaccugaucgaccugggcugcccucauauuccccuccuggggaaaauggcgauccacauuuguagaaugucuaaucauccucggaccacaauggcuuuucuuuucugguuuuccuucggauacguuauuaccugcaucuuuugcaaggcccuguucuauagccucauuaucauuggcacacugggcaaaaagaucaagcaguaccgcgaacuuaaaccccagaccuguacgauuugcgagacagccccugugaacgcuaucgaugccgagaugcacgaccugaauuguucuuauaacaucugcccguacugugcuuccagacucaccagcgacgggcuggcccggcacgucacacagugccccaagcgcaaagaaaagguggaggaaaccgagcuguaucucaaucuggaaagaaucccuuggaucguucggaaacuucugcaagugucugaguccaccggagucgcgcucaagcgcagcuccuggcugauugugcuucuggugcuccugacagucucucugagccccguucaguccgccccugugggccaugggaaaacgaucgagaccuaccagacaagagaaggauuuaccaacauuugucucuucaugcugggcagcauccuuuuuaucgugucuuaccuggucaaggggcucguggauuccguuagcgacucuuucuuucccggacugagcgugugcaagacauguuccauuggcucuaucaauggcuucgagauugaaagccacaaaugcuauuguucccuuuucugcugcccguacugucggcauugcagcgcugaucgcgagauccaccagcugcaccucgggauuuguaagaaaagaaagaccggaucuaacgucaugcuggccgugugcaaacggauguguuuuaaggcuacgaucgaagccuccagacgcgcgcugcucauucggagcaucaucaauacaaccuucguuauuugcauccugacccuugccauuuguguggucucuacauccgcuguggagauggagaaccugccugccggcaccugggaaagagaggaagaccucacaaauuuuugccaucaagagugucaggucacggaaaccgagugccugugucccuaugaggcucuggugcuucgcaagccucucuuccuggauagcaucguuaaagggacaaagaaccugcucaacuccaccucucuggaaacaagccuuuccauugaggcccccuggggagccaucaaugugcagucuaccuuuaaacccacggucagcaccgcuaacaucgcgcuguccuggagcucuguggaacaccggggcaauaagauucucguuacagggagauccgagagcaucaugaaacuggaggaacgcaccggcgugucuugggaccugggagucgaggaugccuccgaaagcaaacuucucacagugucuauuauggaccugagccaaauguacuccccuguguucgaguaucugagcggcgaucggcagguugaagaguggccgaaggcuaccugcacgggggacugccccgagagauguggaugcacaucuuccaccugucuccauaaggaauggccucacagccgcaacuggcggugcaaucccacaugguguuggggcgucgggaccggaugcaccuguugcggcguggaugugaaggaccuguuuacagaccauauguucaucaaauggaaggucgaguacauuaaaacggaagccaucguguguguugagcuuaccucccaggaaagacagugcucucugaucgaggccgggacacgcuuuaaccucggcccugugaccauuacacugagcgagccccggaauauccaacagaagcugccgccugaaauuaucacccuucaccccaagauugaggaaggauucuuugaucucaugcacguccagaaagugcuguccgcuucuacgguuuguaagcugcagagcugcacacauggcaucccuggggaccuccaaaucuaucacauuggaaaccugcuuaaaggcgauagacugaaugggcaucucauccacaagauugagccccacuucaacaccuccuggaugucuugggacggaugcgaucuggacuacuacuguaauaugggcgauuggccuagcugcaccuauacaggggugacccagcauaaccacgccgcguuugucaaucugcuuaacaucgaaacagacuacacgaaaaccuuccauuuccacuccaagcgggugacagcucauggcgauacaccccagcucgaccugaaagcccgcccgaccuauggagccggcgagauuaccguucugguggaggucgcugauauggaacuccacacgaagaagguggaggugagcgggcugaaauuugccucucuugcuuguaccggaugcuacgccuguuccagcggcaucucuugcaagguccggauucacguugacgaaccugaugagcugacagugcaugugaaauccagcgaccccgacgucguggcggccucuaccucccucauggcuagaaagcuggaguucgggacagauagcaccuuuaaagccuucuccgcuaugcccaagacaagccuguguuuuuauaucguugaaagagaguacugcaagucuuguagcgaagacgauaccaaaaagugcguggacacgaaacuugagcagccucaauccauccugauugaacacaagggaacaaucauuggcaaacagaaugauaccuguaccgccaaggcgucuugcuggcucgagagcgucaaguccuucuuuuaugggcugaaaaacaugcucggcucuguguucggaaacuuuuucguuggcauccugcuuuuucuggccccguucgugcuccugguccuguuuuucauuuucggguggaagauccuguuuugcuucaaauguugccgccggacaagaggacuuuuuaaguaccgccaucucaaagacgaugaggaaaccggcuacagaaagaucauugagcggcugaauagcaagaaagggaagaaccgccuccuggacggagaaagacuugcugaucggaaaaucgccgagcuguucuccacgaagacacacauuggc

SEQ ID NO: 13822 - RNA, 3495 nt, Artificial Sequence
  derived and/or modified CDS sequence (opt5) from CCHVF(CCHVF Ast133)__KX056060.1__Gn-NSm-Gc
agcgaggaacccgacgaugacugcaucuccagaacccagcugcucaagacagagacggccgaaauucacgaugacaacuacggcgggccuggagauaaaaucaccauuuguaauggcucuacaaucguggaccaacggcuggggagcgagcuuggaugcuauaccauuaaccgcgucaaguccuucaaacugugugaaaauucugcuacaggcaagaccugcgagaucgauagcacaccgguuaaauguagacagggguuuugccucaagaucacccaggagggacggggccaugugaagcugucccgcggcucugaagugguccuugacgccugugauagcuccugcgagauuaugauccccaaagggacgggagacauucugguggauuguagcggcgggcagcaacacuuccucaaggacaaccugaucgaucugggaugcccucauauuccccuccugggcaaaauggcgaucuacauuuguagaaugucuaaucacccucggaccacaauggcuuuucuuuucugguuuuccuucggguauguuauuaccugcaucuuuugcaaggcccuguucuaccuccugauuaucauuggaacacuuggcaaaaagaucaagcaguaucgcgaacugaaaccccagaccuguacgauuugcgagacagccccugugaacgcuaucgacgccgagaugcaugaccucaauuguagcuacaacaucugcccguauugugcuucuagacugaccuccgauggccuggcccggcacgucacacagugccccaagcgcaaagaaaagguggaggaaaccgagcucuaccugaaucuugaaagaaucccuuggaucguucggaaacugcuccaagugagcgagucuaccggggucgcgcugaagcgcuccagcuggcuuauugugcugcucgugcugcugacagucucccucucucccguucagagcgccccugugggacacggcaaaacgaucgagaccuaccagacaagagaaggguuuaccuccauuugucuguucaugcuuggaagcauccuguuuaucgugucuugccucgucaagggccugguggacuccguuagcgauucuuucuuucccgggcuuagcguguguaagacaugcuccauuggaucuaucaacggcuucgagauugaaagccauaaauguuauugcucccuguucugcuguccguacugccggcacuguagcgcugaccgcgagauccaucagcuccaccugucuauuugcaagaaaagaaagaccggcuccaaugucaugcuggccguguguaaacggaugugcuuuaaggcuacgaucgaagccagcagacgcgcgcuccugauucggucuaucaucaacacaaccuucguuauguguauucuuacccuggccaucugcguggucuccacaagcgcuguggagauggaggaucucccugccgggaccugggaaagagaggaagaccugacaaauuuuugucaccaagagugccaggucacggaaaccgagugucugugccccuaugaggcucuugugcuccgcaagccucuguucuccgauucuauuguuaaaggaaugaagaaccugcucaauagcacaucccuggaaaccucucuuagcaucgaggcccccuggggcgccauuaacgugcaguccacauuuaaacccaccgucagcacggcuaacaucgcgcugucuugguccagcguggaacaucgggggaauaagauccucguuaccggaagaucugaguccauuaugaaacuggaggaacgcacaggcgugagcugggaccugggggucgaggaugccucugaaagcaaacuucucaccguguccaucauggaccugagccaaauguacucuccuguguucgaguaucuguccggcgaucggcagguugaagaguggccgaaggcuacaugcaccggagacugucccgagagaugcggcuguacgagcuccacaugccuccacaaagaauggccucauucucgcaacuggcgguguaaucccaccuggugcuggggagucggaacaggcuguaccugcugugggguggacgugaaggaucuguuuaccgaccacauguucauuaaauggaaggucgaguacaucaaaacagaagccauugugugcguugagcuuacgagccaggaaagacaguguucccugaucgaggccggaacccgcuuuaaccucggcccugugacaaucacccugucugagccccggaauauucaacagaagcugccgccugaaaucauuacacuucaucccaagaucgaggaaggguucuuugaucucaugcacguccagaaagugcugagcgcuuccaccguuugcaagcugcagucuugcacgcacggcauuccuggagaccuccaaaucuaucauaucggcaaccugcuuaaaggggauagagugaauggacaccugauucauaagaucgagccccacuucaacacaagcuggauguccugggacggcugugaucucgacuacuacugcaauaugggggauuggccuagcuguaccuauaccggagucacacagcacaaccaugccgcguuugugaaucugcugaacauugaaaccgacuacacaaaaacguuccacuuccauucuaagcggguuaccgcucacggcgauacaccccagcuugaccucaaagcccgcccgaccuauggggccggcgagaucacagugcuggucgagguggcugauauggaacugcauaccaagaagguggagauuuccggacucaaauuugccagccugacgugcaccggcuguuacgcuuguucuuccgggaucagcugcaagguccggauucacguugacgaaccugacgagcuuacagugcacgugaaaucuuccgaucccgacgucguggccgcgagcaccucccugauggccagaaagcucgaguucggaacagauagcaccuuuaaggcuuucucugccaugcccaagacaagccugugcuuuuauaucguugaaagagaguacuguaaguccugcucugaagacgauaccaaaaaguguguggacacgaaacuggagcagccucaaagcauccuuauugaacauaagggcacaaucauugggaaacagaaugauaccugcaccgcuaaggccuccugcuggcuggagucugucaagagcuucuuuuauggacucaaaaacaugcugggcuccguguucgggagcuuuuucguuggcauccuccuguuucuugcgccguucgugcugcucguccuguuuuucauguucggauggaagauucuguuuuguuucaaaugcugucgccggacaagaggccuuuuuaaguaccgccaccugaaagacgaugaggaaaccggguacagacggaucaucgagcgccucaauucuaagaaggggaaaaacagacugcucgacggcgaacggcuggccgaucgcaagauugcugagcuuuucuccagcaaaacgcauaucggg

SEQ ID NO: 13823 - RNA, 3495 nt, Artificial Sequence
  derived and/or modified CDS sequence (opt5) from CCHVF(CCHVF SK/2015/human)__KX458183.1__Gn-NSm-Gc
agcgaggaauccggcgacgauugcaucucuagaacccggcugcuccgcacagagacggccgaaauucacggggacagcuacggaggccccggggauaagaucaccauuuguaacggauccacaaucguggaccagagacugggcucugagauggggugcuauaccauuaaucgggucaagagcuucaagcugugugaaaacuccgcuacaggaaaaucuugcgagaucgauagcaucccuguucgcuguagacaaggcuacugccugaagauuacccaggagggccgggggcaugugaaacucucccgcggaagcgaagugguccuggacgccugugauucuuccugcgaggugaugaucccgaagggcacaggggacauucuuguugauuguagcggaggccagcagcacuuucugaaggacaaucucaucgaucuggggugccccaacauuccucugcucggaaaaauggcgaucuauauuuguagaaugucuaaucaucccaagaccacgauggcuuuccuguuuugguucuccuuuggcuacgugauuaccugcauccuuugcaaagccaucuucuaucugcucaucauugucggcacacuggggaagcgguuuaaacaauaccgcgaacuuaagccucagaccuguacaaucugcgagaccacgcccgccaacgcuauugacgccgagaugcacgaucugaauuguagcuauacaaucugcccuuacugugcuucuagacucaccuccgacggacuggcccggcaugugacacagugcccgaagcgcaaagaaaagguugaggaaaccgagcuguaccucaaccuggaaagaauccccugggugguccggaaacuucuucaggugagcgaguccaccggcguggcgcucaagcgcucuagcuggcugauuguccuucugguucucuucacagugucccugagcccugugcaaucugcccccaucgggcacggaaaaacgauugagaccuaucaggcuagagaagaguacacaggcaucugucuguuuguccucggguccauucuguucaucgugagcugccuuguuaagggacugguggacggcgucggcaauaucuuuuucccugggcucucuauuuguaaaaccugcagcaucggauccauuaacggcuuugaaaucgagucucacaaguguuauugcagccugcuuugcugucccuacugccggcauuguuccgccgauagagaaauucaccagcugcaucucagcaucugcaagaaacgcaagacagggucuaaugugaugcuggcuguuuguaaacggaugugcuucagagccaccauggagguguccaacaaggcgcugcucauucgcagcaucaucaauacgacauucgucguguguauucugauccuugccgucugcgugguuucuaccuccgcuguggagauggaaagccugccggccggaaccugggagcgggaagaggaccucacaaacuuuugucaccaggaaugccaagucaccgagacagagugucugugcccuuaugaagcucuggugcuuagacgcccccucuuccuggauuccauuguucggggcaugaaaaaucugcucaacucuacgagccuggagaccucccuuucuaucgaagccccuuggggcgccauuaacgugcagagcacauacaagcccaccgucuccacagcuaauaucgcgcugagcuggucuuccguggagcacagagggaacaagauccucgugagcggacgcucugaguccauuaugaaacuggaggaacggaccggcguuagcugggaccugggggucgaagaugccucugagagcaagcugcucacgguguccgugauggaccugagccagauguauucucccgucuuugaauaccuguccggagauagacaaguggaggaguggccuaaagcuaccugcacaggcgacuguccggaacgcugcggguguaccacaucuaccugccuccauaaggaguggccccacucccggaauuggagauguaacccuacguggugcuggggaguuggcacaggguguaccugcuguggccuggaugugaaagaccuuuucacagauuacauguuugucaaguggaagguggaauauaucaaaaccgaggccauuguuugcguggaacugaccucucagggacggcaguguagccucaucgaggccggcacacgcuucaaucugggguccgucacgauuacccugucugagcccagaaacauccagcauaaacuuccucccgaaaucauuacacuccacccgcggaucgaggaaggauuuuucgaccugaugcaugugcaaaaaguucugagcgcuuccaccgugugcaagcuccagucuugcacacacggcgucccuggggaccuucagguguaccacauuggaaaucuucugaaaggcgauaaggugaacgggcaucucauccacaagauugagccccauuuuaauaccagcuggauguccugggacggcugugaucuggacuauuacugcaacaugggagauuggccuagcuguacguauacaggcgucacccagcacaaucacgccucuuucguuaaccugcuuaauaucgaaaccgacuacacaaagaacuuucauuuccacuccaagagagugaccgcgcauggggauacaccccaacucgaccugaaagcucgcccuacguauggagccggcgagaucaccgugcuggucgagguggccgauauggaacuccacacaaagaaaauugagaucagcgggcugaaguuugcuucucuuaccugcacaggauguuacgccugcuccagcggcauuucuuguaaaguucggauccauguggacgaacccgaugagcugaccguccacgugaaguccgacgauccggacguuguggcugccagcuccagccucauggcgagaaagcuggaguucgggacggacucuaccuucaaagccuuuagcgcuaugccuaagacaucccugugcuucuacauugucgaacgcgaguauuguaaaucuugcagcaaggaagauacccagaaaugugugaauacaaaacuugagcagccccaguccauccugauugaacacagaggcaccaucaucggaaagcaaaacaacacaugcauugccaaagcuagcugcuggcucgagagcguuaaguccuuuuucuacggccugaaaaauaugcucucugggaucuuuggaaaccuguuccuuggcauuuuucuguuccucgcccccuuuauccugcugauucuuuucuuuauguucggguggcggauccuguuuuguuucaagugcugucgcagaacccggggacucuucaaauaucgccaucugaaggacgaugaggaaacgggcuacagacggaucauugagcgccucaauaacaagaaaggcaagaauaaacugcuugacggggaaagacuggcggaucggcgcaucgccgagcucuuuagcacaaagacccacauugga

SEQ ID NO: 13824 - RNA, 3495 nt, Artificial Sequence
  derived and/or modified CDS sequence (opt5) from CCHVF(CCHVF YL16070)__KY354081.1__Gn-NSm-Gc
gccgagggcgggagcuccgacugcaucucuagaacccagcuggugaagacagaagucgcugagauucacgaagauagcuacggaggccccggggagaaaaucacgauuuguaacggauccaccaucguugaccagcggcucggcucugaacuggggugcuauacaauuaaucgcgucaagagcuacaaacuuugugagaacuccgccucuggaaagagcugcgagaucgauuccaucccugugaaauguaagcagggcuucugccugaagauuacccaggaaggcagagggcaugugaaacucagccggggaacagagaucgugcuggacguuugugauucuuccugcgaacuuaugauuccgaagggcaccggggacauccugguggauuguagcggaggccagcaacacuuucuccagaauaaccugauugaccuggggugccccaaugucccucuccugggaaaaauggcgaucuaugugugucgcaugucuaaccaucccaagacaaccauggcuuuccuuuucugguucuccuuuggcuacguuauuacgugcaucgugugcagaguccuguucuaucuccugaucgccauuggcaccguggggaaaaagcugaagcaguaccgggagcugaaaccucagacauguaucgugugcgagagcguccccguuaaugccauugaugcugaaaugcacgagcucaacuguucuuauaauaucugcccuuacugugccucccgccugagcaccgacggacugauuagacaugugacacaaugcccgaagcggcgcgaaaaaguggaggaaaccgagcucuuucugaaccuugagagaauccccuggcugguccggaagcuccuucagguguccgaaucuacgggcauggcucuuaaacgcagcuguuggaugaucacacugcucauucugcugcucguuuccaugagcccugugcagucugcccccgucgggaaggagagagcgaucgaaaccuaccaggcccgggaggcuuauacaggaauuugccuguucgugcuuggcuccguucuguuugccgugagcuggcucaccaaagcucugaucgaugggauuggaaauucuuucuuuccuggccuuagcgucuguaagaccugcuccaucggcucuaucaacggguucgaaauugagagccacaaguguuacugcucccuguuuugcugucccuauugccgcgccuguagcucugacaaaaauacacacagaaugcaucucaacgugugcaagaaacggaagaugggauccaaugucaugcuggcgguguguaaaagaaugugcuuccgcgccacgaucgaggcuagcaacaaggcccugcucauucggucuaucauuaacuccaccuucguuaucuguauucugauccuuacaaucugcguggucagcaccuccgcuguggauauggaaaaucugccggccggcauuugggagaaggaagaggaccucacaaacuuuugucaccaagaaugccagguuaccgagacggagugucugugcccuuacgaagccauggugcugagaaaaccccuuuuccucgacucuaucgcuaaggggaugaaaagccugcugaauagcacaucucucgagaccagccuguccauugaagcgccuuggggagccaucaacguccagagcaccuuuaagcccacagugucugcugccaauauugcccuuuccuggagcucuguggagcaucgcggcaacaaaauccugguuuccgggcggagcgagucuaucaugaagcucgaagagagaaccggcgucagcuggaaucugggaguggaagaugcuuccgagagcaagacacugacggugucugucauggaccuuucccaaauguauagccccguguucgaauaccucuccggcgaucgccagguugaggaguggccuaaagcgaccugcacaggggacuguccggaacggugcggauguaccucuagcacaugccugcacaaggaguggccccacuccagaaacuggcgcuguaauccuaccuggugcuggggcguggggacgggauguaccugcuguggccuggaugucaaagacuuuuucacagauuauaugcucgugaaguggaaaguugaauacauuaagaccgaggccaucgugugcgucgaacugacaucucaggagcggcaguguagccuuauugaggcugggaccagauuuaaccugggccccgugacgaucacacucuccgaaccucgcaauguucaacagcggcugcccccggagauugugacccugcauccuaagaucgaagagggauucuuugaccuuaugcacguccagaaaauccucucugccagcacagugugcaagcugcaguccugcacccauggcgugcccggggauuuccaagucuaccacguuggaaaccugcucagaggcgacaaagugaaugggcauagcauucacaagaucgaaccucacuuuaacaccucuuggauguccugggauggaugugaccuggacuauuucugcaauaugggcgauuggcccagcuguacauacacgggggugacccagcauaaccgggccgcuuuuauuaacaugcuuaauaucgagacagacuauaccaaaacauuccacuuccauucuaagcgcgucaccgcccacggcgauacgccucagcuggaccucaaagcuagacccgccuacggagcgggcgaggugacaguucugguggaagucgccgaucuggagcuucacaccaagaagcucgaaguguccgggcugaaaauugcuagccugaccugcucuggauguuaugccugcuccagcggcaucuccuguaagguucggauccaugugaacgagccggacgaguuuacaguccacgugagaagcucugauccugacguuguggcugccgggagcucccucauggcgcgcaaaauugaauuuggagccgauucuaccuuuaaggcuuucagcuccaugcccaaagacucucugugcuuuuacaucgucgagaaggauuauuguagcuccugcacagacgaugacacgcagaagugugugaauaccaaacuugaccauccccaaucuauucugaucgaacacaagggcacaauuaucgggaaacagaacgauaccugcagcacaaagaccuccugcuggcucaaauccuucaagggcuuuuucuacggacugaagaauaugcugucuggcauuuuugggaacguguuccuuggaauccugcucuuucuggccccuuucguccuccugaucuuuuucuucuuuuucggcuggcggcuucuguuuugucucaaaugcuguaagaaaacgaaggggcugcugaaauacaagcaucuuaaggacaaagaggaagcuggauauaagaaaauuaucgagagacugaauggcaagaaaggcaagucccaacucuucgauggggagcgccuggccaacagaaaaauugccgaacucuuuagcaccaagauccacauugga

SEQ ID NO: 13825 - RNA, 3495 nt, Artificial Sequence
  derived and/or modified CDS sequence (opt5) from CCHVF(CCHVF Oman_812956)__KY362518.1__Gn-NSm-Gc
agcgaggaauccggcgaggacugcaucucuagaacccagcugcuccggacagaaacggccgagauucacggggauaacuacggaggccccggggacaagaucaccauuuguaauggaagcacaaucguggaucaacgccugggcuccgaacuugggugcuauaccauuaacagagucaaaucuuucaagcugugugagaauagcgcuacaggaaaauccugcgagaucgacaacaccccuguuaaguguaaacagggcuuuugccucaagaucacacaggaaggccgggggcaugugaagcugucucgcgauagcgaggugguccuugacgccugugauuccagcugcgaaauuaugaucccgaaaggaaccggcgacauucugguggauuguucugggggacagcaacacuuccucaaggacaaucugaucgaucugggcugccccaacauuccucuccuggggaaaauggcgaucuacauuuguagaauguccaaucaucccaagacgaccauggcuuuucuuuucugguuuagcuucggauauguuaucacaugcauccugugcaaagugaucuuuuaccuccugauugucgugggcacccuuggcaagaaguucaaacaguaucgggagcugaagccucagacauguaccauuugcgagacgacacccguuaacgccaucgacgccgaaaugcacgaucucaauuguucuuacaacauuugcccuuauugugcuucccgccugaccagcgacgggcuggccagacaugugaugcagugcccgaaacggaaggagaaaaucgaagagacagaacucuaccugaaucuugagcgcauccccugggucgugagaaagcugcuccaagugucugaguccaccggagucgcucugaaacggagcuccuggcuuauuguucugcucgugcugcugaccgugucucucagcccuguccaguccgcccccaucggccacgggaagacaauugaaacguaccagacccgcgagggauauacaagcaucugucuguuugugcuuggcucuauucuguucaucguuucccaccucaugaaggggcugguggacagcgucggaaacagcuuuuucccuggccuuucuaucugcaaaaccuguuccauuggcucuaucaauggguuugaaauugagagccauaagugcuacuguucccuguucugcugccccuauuguagacacugcagcgcggauaaagaaauccauaagcuccaccugucuauuuguaaaaagcggaaggccggauccaacgugaugcuggcuguuugcaaacgcauguguuucagagccacaauggaggugagcaauaaggcucuccugauccggucugucauuaacaccacguuuguggucugcauccuuauccuggccguguguguuguguccacaagcgcggucgagauggaaucccucccggccggcaccugggagagagaagaggaccugaccaacuucugccaccaggaaugucaagugacagagaccgagugccuguguccuuacgaagcucuuguucuccgcaaaccccuguuuuucgauucuauugccaaggggaugaaaaaucugcucaacagcacaucccuggagacgucucuuagcaucgaagcuccuuggggagccauuaaugugcaguccaccuuuaagcccacagucagcaccgccaacaucgcucugucuugguccagcguggagcaucggggcaauaagauucucgugucugggagauccgagagcaucaugaaacuggaagagagaacaggcaucucuugggaccugggaguugaagaugcgagcgaguccaagcugcucaccgucagcgugauggaccugucucagauguauucccccguguucgaauaccugagcggcgaucggcaagucgaggaguggccuaaagccacgugcaccggggacugcccggaaagauguggaugcacauccucuaccugucuccacaaggaguggccccauagccgcaacuggcggugcaauccuacaugguguuggggcguggggaccggaugcacguguugcggccuggauguuaaagaccuuuuuacagauuauauguucgugaaguggaaggucgaauacauuaaaaccgaggcuaucguguguguugaacugacaucccaggagagacagugcucucucauugaggccgggacccgcuuuaaccugggccccgugaccaucacacugagcgaaccucggaauauucagcaaaaacuucccccggagaucgucacgcuccacccuagaaucgaagagggauucuuugaccugaugcaugugcagaagguucuguccgccucuaccguguguaagcuccagagcugcacacacggcguccccggggaccuucagguguaccacauuggaaaccuucugaaaggcgauaaggugaaugggcaucucauccacaaagucgaaccucauuucaacaccuccuggaugagcugggacggaugcgaucuggacuauuacuguaauaugggcgauuggcccucuugcacauauaccgggguuacgcaacacaaccacgcugccuuugugaaucugcuuaacauugagacagacuacaccaagaacuuccauuuccacuccaagcgcgugaccgcgcauggcgauacaccucagcucgaccugaaagcucggcccaauuauggagccggcgagaucaccguccugguggaaguugccgauauggagcuccacacaaagaaaauugaaaucagcgggcugaaguuugcuucucuuacguguaccggaugcuacgccuguuccagcggcaucucuugcaaagugcgcauucaugucgacgagccggaugagcugacagugcacguuaaguccgaagacccugauaucguggcugccagcuccagccucauggcgcggaagcuggaguucgggaccgacucuacauuuaaagccuucagcgcuaugcccaagaccucccuguguuuuuauauugucgaacgcgaguacugcaaaucuuguagcaaggaagacacgcagaaaugcgugaacgccaaacuugagagaccccaguccauccugauugagcacaagggaaccaucauuggcaagcaaaaugauacauguaccgcuaaggccucuugcuggcucgaaagcguuaaauccuucuuuuacgggcugaagaacaugcucucuggcaucuucggaaauguguuuaucggcauuuuccuguuucuugcgccuuucauccugcucauucuguuuuucauguucggguggcggauccuguuuugcuucaaauguugcagacgcacacggggacuuuuuaaguauagacaucugaaggacgaugaggaaaccggcuaccgcaaaauuaucgagagacucaacaauaagaaagggaagaacaaacugcucgacggagaacggcuggccgaucgcaagaucgcugagcuuuucagcacaaaaacccacauuggc

SEQ ID NO: 13826 - RNA, 3495 nt, Artificial Sequence
  derived and/or modified CDS sequence (opt5) from CCHVF(CCHVF UCCR4405)__KY484029.1__Gn-NSm-Gc
agcgaggaacccggcgacgauugcaucuccagaacccagcugcucaagacagagacggccgaaauucacgacgauaacuacgggggaccuggcgacaaaaucaccauuuguaaugggucuacaaucguggaucaacggcugggaagcgagcuuggcugcuauaccauuaaccgcgucaaguccuucaaacugugugaaaauucugcuacagggaagaccugcgagaucgacagcacaccgguuaaauguagacagggauuuugccucaagaucacccaggagggccggggccaugugaagcugucccgcgggucugaagugguccuugaugccugugacagcuccugcgaggugaugauucccaaaggaacgggcgauauccugguugacuguagcgggggacagcaacacuuccucaaggauaaccugauugaccugggcugcccucauaucccccuccuggggaaaauggcgauuuacaucuguagaaugucuaaucacccucggaccacaauggcuuuucuuuucugguuuuccuucggauaugugauuaccugcaucuuuugcaaggcccuguucuacagccucaucauuaucggcacacugggcaaaaagauuaagcaguaucgcgaacuuaaaccccagaccuguacgaucugcgagacagccccugucaacgcuauugaugccgagaugcaugaccugaaguguucuuacaauaucugcccguauugugcuuccagacucaccagcgacgggcuggcccggcacgugacacagugccccaaacgcaaggaaaaaguugaggaaaccgagcuguaccucaaccuggaaagaaucccuuggauugugcggaaacuucugcaagucucugaguccaccggaguggcgcucaagcgcagcuccuggcugaucgugcuucugguccuccugacaguuucucugagccccgugcaguccgccccugugggccacgggaagacgauugagaccuaccagacaagagaaggauuuaccagcaucugucucuucaugcugggcucuauucuuuuuaucgucuccugccuggugaaggggcucguugauagcgugucugacagcuucuuucccggacuguccgucuguaaaacaugcucuaucggcagcauuaauggcuucgagaucgaaucccauaaguguuauugcagccuuuucugcuguccguacugccggcacuauucugcugaucgcgagauucaucagcugcaccucuccaucuguaaaaagagaaaaaccgggagcaacgugaugcuggccguuugcaagcggauguguuuuaaggcuacgauugaagccucuagacgcgcgcugcucauccgguccauuaucaauacaaccuucgugaucugcauucugauccuugccauuugugucgugagcaccuccgcugucgagauggagaaccugccugccggaacaugggaaagagaggaagaccucaccaauuuuugccaccaagagugucaggugacagaaacggagugccugugucccuacgaggcucugguucuucgcaaaccucucuuccuggauucuaccgugaagggcaugaaaaaccugcucaauagcacaucccuggaaaccucucuuagcaucgaggcccccuggggagccauuaacguccaguccacauuuaagcccaccgugagcacggcuaacaucgcgcugucuugguccagcguugaacaucgggggaauaaaauccucgugaccggcagaucugaguccauuaugaagcuggaggaacgcacaggggucagcugggaccugggcguggaggaugccucugaaagcaaacuucucaccguguccaucauggaccugagccaaauguauucuccuguuuucgaguaccuguccggagaucggcaggucgaagaguggccgaaggcuacaugcaccggcgacugccccgagagaugugggugcacgagcuccacaugucuccacaaggaauggccucauucucgcaacuggcggugcaaucccaccugguguuggggagugggcacagggugcaccuguugcggaguggaugucaaagaccuguuuaccgaccacauguucgugaaguggaaaguugaguauauuaagacagaagccaucgugugugucgagcuuacgagccaggaaagacagugcucccugauugaggccggcacccgcuuuaaccucgggccugugacaaucacccugucugagccccggaauauccaacagaagcugccgccugaaauuaucacacuucaucccaaaauugaggaaggcuucuuugaucucaugcacguucagaaggugcugagcgcuuccaccgucuguaaacugcagucuugcacgcacggaaucccuggcgaccuccaaauuuaccauaucgggaaccugcuuaagggagauagagugaauggccaccugauccauaaaauugagccccacuucaacacaagcuggauguccugggacgggugcgaucucgacuacuauuguaauaugggaaacuggccuagcugcaccuacaccggcguuacacagcacaaucaugccgcguuugugaaccugcugaauaucgaaaccgauuauacaaagacguuccacuuccauucuaaacgggucaccgcucacggggacacaccccagcuugaucucaaggcccgcccgaccuacggcgccggagagauuacagugcugguggaggucgcugacauggaacugcauaccaagaaaguugagaucuccggccucaaguuugccagccugguguguacggggugcuaugcuuguucuuccggaauuagcugcaaagugagaauccacgucgaugaaccugacgagcuuaccgugcacguuaagucuuccgaucccgacguggucgccgcgagcacaucccugauggcccggaaacucgaguucggcaccgacagcauuuuuaaggcuuucucugccaugcccaagacaagccuguguuuuuacaucguggaaagagaguauugcaaauccuguucugaagaugacaccaagaaaugcguugauacaaagcuggagcagccucaaagcauccuuauugaacauaaagggaccaucauuggaaagcagaacgacacguguacagcuaaggccuccugcuggcuggagucugugaaauccuucuuuuacggccucaagaauaugcuggggagcgucuucggcaacuuuuucgugggaauccuccuguuucuugcgccguucguucugcucgugcuguuuuucauguucggcuggaaaauucuguuuugcuucaaguguugccgccggaccagagggcuuuuuaaauaccgccaccugaaggaugacgaggaaaccggauauagacggaucaucgagcgccucaacucuaagaaaggcaagaauagacugcucgauggggaacggcuggccgaccgcaaaauugcugagcuuuucagcacaaagacccauaucgga

SEQ ID NO: 13827 - RNA, 3495 nt, Artificial Sequence
  derived and/or modified CDS sequence (opt5) from CCHVF(CCHVF UCCR4459)__KY484032.1__Gn-NSm-Gc
agcgaggaauccggcgacgauugcaucucuagaacccagcugagccggacagagacggccgaaauucacuccgacaacuacgggggacccggcgauaagaucaccauuuguaaugggucuacaaucguggaccaacgccucggaagcgagcugggcugcuauaccauuaacagagucaaauccuucaaacuuugugaaaauucugcuacagggaaaagcugcgagaucgauuccaccccuaucaagugucggcagggauuuugccugaaaauuacacaggagggccgcggccauguuaagcucagcagagggucugaaguggugcuggacgccugugauuccagcugcgagaucaugauuccgaagggaaccggcgacauccuugucgauuguucugggggacagcaacacuuccugaaagacaaccucauugaucugggcugccccaauaucccucugcucgggaagauggcgauuuacaucugucggauguccaaccaucccaaaacgaccauggcuuuucuguucugguuuagcuucggauaugugaucacaugcauucuuugcaagguuaucuuuuaccugcucauuguggucggcacccugggcaaaaaguucaagcaguaucgcgaacuuaaaccucagacauguaccaucugcgagacgacacccgugaaugccauugacgccgagaugcacgaucugaacuguucuuacaauaucugcccuuauugugcuuccagacucaccagcgacgggcuggcccggcauguuaugcagugcccgaagcgcaaagaaaagguggaggaaacagagcuguaccucaaccuggaaagaauccccugggucgugcggaaacuucugcaaguguccgagucuaccggagucgcucucaagcgcagcuccuggcugguugugcuucuggugcuccugaccgucagccugucuccugugcaguccgcccccauuggccacgggaaaacaguugagacguaccagaccagagaaggauauacaagcaucugucucuuugugcugggcucuauucuuuucaucgucagcugccugaugaaggggcucguggacuccguuggaaauagcuuuuucccuggccugucuauuuguaagaccugcuccaucggcagcaucaacggguuugagauugaaucucacaaauguuacugcucccuuuucugcugucccuauugccggcauuguagcgcggaucgcgagauccacaagcugcaucucucuauuugcaaaaagagaaaaacaggauccaaugugaugcuggccgucuguaagcggaugugcuucagagcuaccguggaagucagcaacaaggcccugcucauccgcaauauuaucaacacgacauuugugguuuguauucugauccuugcugugugcgucguguccaccucugccguugagauggagagccugccggcgggcaccugggaacgggaggaagaccucacaaacuucugucaccaggagugccaagugaccgaaacagagugucugugcccuuacgaggcccugguccuuagaaaaccccucuuuuccgauucuaucgugaaggggaugaaaaaucugcugaacagcacgucccucgaaaccagccugucuauugaggcuccuuggggagccaucaaugugcaguccacauucaagcccaccguuagcgcugccaacauugcccuuucuugguccagcgucgaacaccgcggcaauaaaauccuggugucugggcggagcgaguccauuaugaagcucgaggaaagaacaggcaucagcugggaccugggaguggaggaugcuucugaauccaagcugcuuaccgucagcaucauggaccucucccagauguauucucccguguuugaguaccugagcggcgaucgccaaguugaagaguggccuaaagcgacgugcaccggggacuguccggagcggugcggauguacauccucuaccugccugcauaaggaauggccccacagcagaaacuggcgcuguaauccuacauggugcuggggcguggggaccggauguacgugcuguggccucgaugucaaagaccuguucacagauuauauguuugugaaguggaaaguugaguacauuaagaccgaagccaucgugugcgucgagcuuacaucccaggaacggcaguguucucugauugaggcugggaccagauucaaccucggccccgugaccaucacacugagcgagccucgcaauauucagcaaaagcugcccccggaaaucguuacgcuucauccucggaucgaggaaggauuuuucgaccucaugcacgugaaaaagguccuguccgccagcaccgugugcaaacugcagucuugcacacauggcgugcccggggaccuccaggucuaccacauuggaaaccugcuuaagggcgauaaaguuaaugggcaccugauccauaagauugagccucacuuuaacaccuccuggaugagcugggacggaugugaucucgacuauuacugcaauaugggcgauuggcccucuuguuccuauacaggggugacccagcauaaccacgccgcuuucgugaauaugcugaacaucgaaacggacuacacaaaaauuuuucacuuccauagcaagagagucaccgcccacggcgauaccccucaacuggaccuuaaggcgcggcccacauauggagcuggcgagaucaccgugcucguugagguggccgauauggaacugcauacaaagaagaucgagauuucugggcugaaauucgccucccucacgugcaccggauguuacgcuugcagcuccggcaucagcuguaagguccgcauucacguggacgaaccggaugagcugacaguucaugugaaaucugaggacccugauaucgucgccgcuagcuccucucuuauggccagaaagcuggaauuugggaccgacagcacauucaaggcguuuuccgccaugcccaaaaccucucucugcuucuauauuguggagcgggaauacuguaagagcugcuccaaagaggacacgcagaaguguguuaacaccaaacuggaacagccccagucuauccugauugagcacaagggaacaaucaucggcaagcaaaaugauaccugcacaagcaaagcugggugcuggcuugaguccgucaagagcuuuuucuacggccugaaaaacaugcucucuggaauuuuuggcaauguguucaucgggauuuuucuguuccucgccccuuuuauccugcuuauucuguucuuuauguucggauggagaauccucuucuguuuuaagugcugucgccggaccagaggccuguucaaauaucgccaccugaaggacgaugaagagacaggguacagaaagaucauugaacggcuuaacaauaaaaagggcaaaaacaagcugcucgacggagagcgccuggcugauagaaaaaucgccgaacucuuuuccaccaagacgcauauuggc

SEQ ID NO: 13828 - RNA, 3495 nt, Artificial Sequence
  derived and/or modified CDS sequence (opt5) from CCHVF(CCHVF UCCR4401)__KY484035.1__Gn-NSm-Gc
agcgaggaacccuccgacgauugcaucucuagaacccagcugcuccggacagagacggccgaaauucacggcgacaacuacgggggaccuggcgauaagaucaccauuuguaaugggagcacaaucguggaccaacgccugggauccgagcuuggcugcuauaccauuaacagaguccggucuuucaaacugugugaaaauagcgcuacagggaagaacugcgagaucgauuccguuccggugaaaugucgccagggauacugccucagaaucacccaggagggccggggccaugugaagcugucucgcgggagcgaagucgugcuugacgccugugauacauccugcgagauuaugauccccaaaggaaccggcgacauucugguugauuguagcgggggacagcaacacuuucucaaggacaaucugaucgaucugggcugcccuaagauuccccuccuggggaaaauggcgaucuauauuuguagaaugucuaaccauccuaagacgaccauggcuuuccuguuuugguucuccuuuggauacgugaucacaugcauccuuugcaaagccauuuucuaucuccugaucauugucggcacccuuggcaagcggcugaaacaguaccgcgaacucaagccccagacauguaccaucugcgagacgacaccugugaaugccauugacgcugagaugcacgaucugaacuguagcuauaauaucugcccguacugugccucuagacugaccuccgacgggcucgcucggcauguuauccagugccccaagcgcaaagaaaagguggaggaaacagagcuguaccuuaaccuggaacggauuccuugggucgugagaaaacuccugcaagugagcgagucuaccggagucgcccuuaagcgcuccagcuggcugaucguucuccuggugcuguuuaccgugucccucucucccguccagagcgcgccuauuggccaggggaaaacaaucgaggccuauagagcucgggaaggauacacguccauuugucuguucgugcuuggcagcauccuguuuaucguuucuugccucaugaaggggcugguggacuccgucggaaauagcuucuuucccggccuuucuauuuguaaaaccugcagcaucuccucuauuaacggcuucgagaucgaaagccacaaguguuauugcucccuguuuugcuguccguacugcagacacuguagcacagauaaggagauucauaaacuccaccugucuaucugcaagaaacgcaagaccggguccaaugugaugcuggccguuuguaaacucaugugcuuccgggcuacaauggaagugagcaacagagcccuguucauucgcucuaucaucaauaccacguuuguccuuuguauucugauccucgcggugugcgucguguccacaagcgccguugagauggagaaccugccugcuggaaccugggaacgggaggaagaccugaccaacuucugucaucaggagugccaagugacagaaaccgagugucuuugccccuaugaggcccucguccugagaaagccucuguuucucgauuccacagcuaagggcaugaaaaaucugcuuaacucuacgagccuggaaaccucccucucuauugaggcccccuggggagccaucaaugugcagagcacauacaagcccaccguuuccacagcuaacauugcgcugagcuggucuuccguggaacaccgcgggaauaaaauccuggucagcggccggucugaguccaucaugaaacuugaggaaagaaccgggauuagcugggaccucggcguggaggaugccucugaaagcaagcugcugacgguguccguuauggaccucagccagauguauucuccugucuucgaguaccuguccggagaucgccaaguggaagaguggccgaaggcuaccugcacaggcgacugucccgagcggugcggguguaccagcuccacaugccuucacaaggaauggccucauucuagaaacuggcgcuguaaucccaccuggugcuggggagugggcacgggguguacaugcuguggacuggaugucaaagaccucuuuaccgauuacauguucgugaaguggaaaguugaguauaucaagacagaagccauugugugcgucgagcugaccagccaggaacggcaguguucccugaucgaggccggcaccagauuuaaccuugggccugugacaauuacgcucucugagccccggaauauccagcaaaaacugccgccugaaaucauuacccugcacccccgcaucgaggaaggcuucuuugaccucaugcauguucagaaggugcugagcgcuuccacagucugcaaacuucagucuugcacccacggagugccuggcgaccugcagguuuaccauauugggaaccuccugaagggagauaaggugaauggccaccugauccacaaaauugagccccauuucaacacaagcuggauguccugggacgggugugaucuugacuauuacugcaauaugggagauuggccuagcuguaccuauacgggcgucacacaacacaaccaugccucuuuugugaaucuccugaacaucgaaaccgacuacaccaagaacuuccacuuucacuccaaaagagugacagcgcauggggauacaccccagcuggaccucaaggcucggccgaccuauggcgccggagagaucacgguccugguugagguggccgauauggaacuucacaccaaaaagauugagaucagcggccugaaguucgcuucucucgccugcacaggguguuacgcuugcuccagcggaauuucuuguaaagugagaauccaugucgacgaaccugaugagcugaccgugcacguuaaguccgacgaucccgacguggucgccgcgagcuccagccugauggcccgcaaacuugaguucggcacagacucuaccuuuaaggcuuucagcgccaugcccaaaacgucccugugcuuuuacauuguggaacgggagcauuguaagucuugcagcgaagaggauaccaagaaauguguuaauacaaagcucgaacagccucaguccauccugauugagcacaaagggaccaucaucggaaagcaaaacucuacaugcaccgcuaaagccagcugcuggcucgaguccgugaagucuuucuuuuauggccugaagaauaugcuuagcgggauuuucggcaacgucuuuaugggaaucuuccuguuucucgcgccguucauucugcugauccuguuuuucauguuuggcuggcgcauucuuuucuguuucaaaugcuguagaagaacacgggggcucuuuaaguaccgccaccugaaagacgaugaagagaccggauauagacggaucaucgaaaagcucaauaacaaaaagggcaagaauaaacugcuugacggggagcgccuggccgauagacggauugcugaacucuucuccacgaagacacauaucgga

SEQ ID NO: 13829 - RNA, 3495 nt, Artificial Sequence
  derived and/or modified CDS sequence (opt5) from CCHVF(CCHVF UCCR4448)__KY484042.1__Gn-NSm-Gc
agcgaggaaaccuccgacgauugcaucucuagaacacagcuucuccggacggagaccgccgaaauucacggcgacaacuacgggggacccggcgauaagaucacaauuuguaaugggagcaccaucguggaccagcgccugggauccgagcuuggcugcuauacaauuaacagagucaaaucuuucaagcugugugaaaauagcgcuaccgggaaauccugcgagaucgauucuguuccugugaagugucggcagggauacugccuccgcaucacacaggagggcagaggccaugugaaacugagccggggguccgaagucgugcuugacgccugugauaccagcugcgagauuaugaucccgaagggaacgggcgacauucugguugauuguucugggggacagcaacacuuucucaaggacaaccugaucgaucugggcugccccaaaauuccucuccuggggaagauggcgaucuauauuugucgcauguccaaucaucccaaaaccacaauggcuuuccuguuuugguucagcuuuggauacgugauuaccugcauccugugcaaggccaucuucuaucuccugaucauuaucggcacacuuggcaaaagauuuaagcaguaccgggaacugaagccucagaccuguacgauuugcgagacaacccccgucaacgccaucgacgcugagaugcacgaucucaauuguucuuauaacaucugcccuuacugugccucccgccugacaagcgacgggcuggcuagacaugugacccagugcccgaaacggaaggaaaaaguugaggaaaccgagcucuaccugaaucuugaacgcauucccuggguggucagaaagcugcuccaagugucugaguccacaggaguggcccugaaacggagcuccuggcuuaucguccugcucguucuguucacgauuucucugagcccugugcaguccgcgcccaucagccacggcaagaccauugaggccuaucgcgcuagagaaggguacacaucuaucugucucuuugugcugggauccauccuuuucauugucagcuaucugaugaaaggccucguggacucuguugggaacagcuuuuucccuggacuguccaucugcaagaccuguucuacaagcuccauuaauggcuuugagaucgaaagccacaagugcuacuguucucuuuucugcugccccuauugucggcauugcuccgccgauaaagagauucacaagcugcaucucagcaucuguaaaaagagaaaaaccggcucuaacgugaugcuggcugucugcaagcgcauguguuuccgggccacgauggaaguguccaauagagcgcuguuuauucgcagcaucaucaacacaaccuucguucucugcauucugauccuugccgugugugucguguccaccucugcugucgagauggagaaucugccggccgggacaugggaacgggaggaagaccucaccaacuuuugccaccaggagugucaggugacagaaacggagugccuguguccuuacgaggcucugguucuuagaaagccccucuuccuggauagcauugugaaaggaaugaagaaccugcucaauuccaccucucuggaaacaagccuuuccaucgaggccccuuggggcgccauuaacguccaaagcaccuauaaacccacagugucuaccgcuaauaucgcgcuguccuggagcucuguugaacaccgcgggaacaagauccucguguccggacggagcgagucuauuaugaaacuggaggaaaagacgggcaucagcugggaccugggggucgaggaugccuccgaaagcaaacuucucaccgugucugugauggaccugucccagauguacagccccguuuuugaguaccuguccggcgauagacaggucgaagaguggccuaaggcuacaugcaccggagacugcccggagcgcuguggcugcacaucuagcaccugucuccauaaggaauggccccacucccggaauuggagaugcaacccuacgugguguuggggaguggggacaggcugcaccuguugcgggcuggaugugaaagaccuuuucacagauuauauguuugucaaguggaaaguggaguacauuaagaccgaagccaucguuuguguggagcugaccucucaagaacgccagugcagccucauugaggccggaacacgguucaaucugggccccgucacgaucacccuguccgagccuagaaacauccagcagaaacuucccccggaaauuaucacacuccauccucggauugaggaaggguuuuucgaccugaugcacgugcaaaagguucugucugcuagcaccguguguaagcuccaguccugcacacauggcguccccggagaccuucagguguaucacaucggcaaucuucugaaaggggauaagguuaacggacaccucauucauaaaaucgagccucacuuuaauaccagcuggaugucuugggacggcugcgaucuggacuacuauuguaacaugggggauuggcccuccugcacguacacaggagugacccagcauaaucacgccagcuucgucaaccugcuuaauaucgaaaccgacuauacaaagaacuuucacuuccauucuaaacgcgugaccgcgcacggcgauacaccucaacucgaccugaaggcuagacccacguacggggccggcgagauuaccgugcuggucgagguugccgauauggaacuccauacaaagaaaaucgagauuuccggacugaaguucgcuagccuuaccuguacaggcugcuacgccuguucuuccgggaucagcugcaaagugcggauucacguggacgaaccggaugagcugaccguccaugugaaguccgacgauccugacguuguggcugccagcucuagccucauggcgagaaaacuggaguuuggaacggacuccaccuucaaggccuuuucugcuaugcccaagacaagccuguguuucuauaucgucgaacgcgagcacugcaaauccuguucugaagaggauaccaagaaaugcgugaacacaaaacuugaacagccccagagcauucugaucgagcacaagggcaccaucauugggaagcaaaauuccacauguaccgccaaggcuucuugcuggcucgagagcguuaaauccuuuuucuacggacugaagaacaugcucagcggcaucuuugggaauguguucauuggcaucuuucuguuccuugccccuuuuauucugcucauccuguucuuuauguucggauggaaaauccuguucugcuuuaaguguugccggagaacgcgcggccuuuucaaauauagacaucugaaggacgaugaagagacaggguaccggcgcauuaucgaaagacucaacaauaagaaaggaaagaacaaacugcucgacggcgagauucuggcggaucggcgcaucgccgaacuguuuucuaccaagacccacauuggg

SEQ ID NO: 13830 - RNA, 3495 nt, Artificial Sequence; identical to SEQ ID NO: 13746
  derived and/or modified CDS sequence (opt5) from CCHVF(CCHVF SPU4/81 )__DQ157175.1__Gn-NSm-Gc

SEQ ID NO: 13831 - RNA, 3495 nt, Artificial Sequence; identical to SEQ ID NO: 13767
  derived and/or modified CDS sequence (opt5) from CCHVF(CCHVF Sudan Al-Fulah 9-2008)__HQ378185.1__Gn-NSm-Gc

SEQ ID NO: 13832 - RNA, 3495 nt, Artificial Sequence; identical to SEQ ID NO: 13761
  derived and/or modified CDS sequence (opt5) from CCHVF(CCHVF NIV161064)__KY213713.1__Gn-NSm-Gc

SEQ ID NO: 13833 - RNA, 3495 nt, Artificial Sequence; identical to SEQ ID NO: 13783
  derived and/or modified CDS sequence (opt5) from CCHVF(CCHVF 5180-R-2011)__KR814874.1__Gn-NSm-Gc

SEQ ID NO: 13834 - RNA, 3495 nt, Artificial Sequence; identical to SEQ ID NO: 13791
  derived and/or modified CDS sequence (opt5) from CCHVF(CCHVF 4574-ST-2008)__KR814870.1__Gn-NSm-Gc

SEQ ID NO: 13835 - RNA, 3495 nt, Artificial Sequence; identical to SEQ ID NO: 13743
  derived and/or modified CDS sequence (opt5) from CCHVF(CCHVF 3010)__DQ019222.1__Gn-NSm-Gc

SEQ ID NO: 13836 - RNA, 3495 nt, Artificial Sequence; identical to SEQ ID NO: 13743
  derived and/or modified CDS sequence (opt5) from CCHVF(CCHVF UG3010)__DQ211637.1__Gn-NSm-Gc

SEQ ID NO: 13837 - RNA, 2916 nt, Artificial Sequence
  derived and/or modified CDS sequence (opt5) from CCHFV(10200, Artificial)__U39455.2__Gn-4aa-Gc
agcgaggaacccuccgacgauugcgugucuagaacccagcugcuccggacagagacggccgaaauccacggcgacaacuacgggggaccuggcgauaagauuaccaucuguaaugggagcacaauugucgaccaacgccugggauccgagcuuggcugcuauaccaucaacagaguucggucuuucaaacugugugaaaauagcgcuacagggaagaacugcgagauugauuccgugccggugaaaugucgccagggauacugccucagaaucacccaggagggccggggccaugucaagcugucucgcgggagcgaagugguucuugacgccugugauacauccugcgagaucaugauucccaaaggaaccggcgacauccugguggauuguagcgggggacagcaacacuuucucaaggacaaucugauugaucugggcugcccuaagaucccccuccuggggaaaauggcgauuuauaucuguagaaugucuaaccauccuaagacgaccauggcuuuccucuuuugguucuccuuuggauacgucauuacaugcauccugugcaaagccaucuucuaucuccugauuaucgugggcacccuuggccggcgccugaagcaguacagagaacucaaaccccagacauguaccauuugcgagacgacaccuguuaaugccaucgacgcugagaugcacgaucugaacuguagcuauaauauuugcccguacugugccucucggcugaccuccgacgggcucgcucgccaugugauccagugccccaagagaaaggaaaaagucgaggaaacagagcuguaccuuaaccuggaacggaucccuuggguggugcgcaagcuccugcaagucagcgagucuaccggaguugcccuuaaaagauccagcuggcugauugugcuccuggugcuguuuaccgucucccucucucccgugcagagcgcgccuaucggccggaagccccuguuccuugacuccacagccaaagggaugaagaaucugcucaacagcacgucucuggagaccucccuuagcauugaagcuccguggggagccaucaauguucagucuacauauaaaccuaccgugagcacagcuaacauugcccuguccuggucuagcgucgagcacagaggcaauaagauccucguguccgggcgcagcgaaucuaucaugaagcuggaggaacggaccggaauuuccugggaucugggcguugaggacgcgagcgagucuaaacuccugacgguguccgucauggaucuuagccagauguacucccccguguuugaauaucugucuggcgacagacaagucgaggaauggccuaaggccacauguaccggggauugccccgagcgcuguggaugcaccagcuccacaugucuccacaaagaauggccccauucucggaacuggagaugcaacccuaccuggugcuggggcguggggacaggauguacgugcuguggccuggacguuaaggaucuguucaccgacuacauguuugugaaauggaaggucgaguauaucaagacagaggcuauugugugcguugaacuuaccagccaggagcgccaguguucccucaucgaagccgggacacgguucaaucugggcccggugaccauuacgcugagcgagcccagaaacauccaacagaaacucccucccgagauuaucacccugcacccucgcaucgaagagggauuuuucgaucuuaugcauguccagaaggugcugucugcuuccacagugugcaaacuccagagcuguacccacggcguucccggggaccugcaagucuaccacauuggaaaucugcuuaagggcgauaaagugaacgggcaucucauccacaagauugaaccgcauuucaauacaucuuggauguccugggacggaugcgaccuggauuauuacuguaacaugggcgacuggccuagcugcaccuacacgggggugacacagcacaaucaugccucuuuugucaaccugcucaauaucgagaccgauuauacaaagaacuuccacuuucacagcaaacgggugaccgcccauggcgacacaccccagcuggaucuuaaggcuagaccuacauacggagcgggcgaaauuacgguucugguggaggucgccgacauggagcuccacaccaaaaagaucgaaaucuccgggcugaaauucgcuagccuggccuguacaggaugcuaugccuguucuuccagcauuuccugcaaggugcgcauccauguugaugagcccgacgaacuuaccgugcacgucaagucugaugacccugaugugguugcugccagcuccucucucauggcgcggaaacuggaguuuggcacagacagcaccuucaaggcuuuuuccgccaugcccaaaacgucucugugcuucuacauuguggaaagagagcacuguaagagcugcuccgaggaagauaccaaaaagugugucaauaccaaacucgagcagccgcaaagcauccugauugaacauaaggggaccaucaucggaaagcagaacucuacaugcaccgccaaggcuuccuguuggcuugagagcgugaaguccuuuuucuauggccugaaaaauaugcucucugggauuuuuggcaacguguucaugggaaucuuucuguuccuggccccuuucauucuucucauccuguuuuucauguuuggcuggcggauucuguucugcuuuaaguguugccgcagaacacgggggcuuuucaaauacagacaccugaaggacgacgaagagacgggauaucgccggaucaucgagaaacuuaauaacaaaaagggcaaaaacaagcugcucgauggggaaagacuggcugacggacgcauugccgagcuguuuagcaccaaaacacauaucggc

SEQ ID NO: 13838 - RNA, 2916 nt, Artificial Sequence
  derived and/or modified CDS sequence (opt5) from CCHFV(IbAr10200, Artificial)__AF467768.2__Gn-4aa-Gc
agcgaggaacccuccgacgauugcaucucuagaacccagcugcuccggacagagacggccgaaauucacggcgacaacuacgggggaccuggcgauaagaucaccauuuguaaugggagcacaaucguggaccaacgccugggauccgagcuuggcugcuauaccauuaacagaguccggucuuucaaacugugugaaaauagcgcuacagggaagaacugcgagaucgauuccguuccggugaaaugucgccagggauacugccucagaaucacccaggagggccggggccaugugaagcugucucgcgggagcgaagucgugcuugacgccugugauacauccugcgagauuaugauccccaaaggaaccggcgacauucugguugauuguagcgggggacagcaacacuuucucaaggacaaucugaucgaucugggcugcccuaagauuccccuccuggggaaaauggcgaucuauauuuguagaaugucuaaccauccuaagacgaccauggcuuuccuguuuugguucuccuuuggauacgugaucacaugcauccuuugcaaagccauuuucuaucuccugaucauugucggcacccuuggcaagcggcugaaacaguaccgcgaacucaagccccagacauguaccaucugcgagacgacaccugugaaugccauugacgcugagaugcacgaucugaacuguagcuauaauaucugcccguacugugccucuagacugaccuccgacgggcucgcucggcauguuauccagugccccaagcgcaaagaaaagguggaggaaacagagcuguaccuuaaccuggaacggauuccuugggucgugagaaaacuccugcaagugagcgagucuaccggagucgcccuuaagcgcuccagcuggcugaucguucuccuggugcuguuuaccgugucccucucucccguccagagcgcgccuauuggcagaaaaccccuguuccuugacuccacagccaaggggaugaaaaaucugcucaacagcacgucucuggagaccucccuuagcaucgaagcuccguggggagccauuaaugugcagucuacauauaagccuaccguuagcacagcuaacaucgcccuguccuggucuagcguggagcaccggggcaauaagauccucgucuccgggagaagcgaaucuauuaugaaacuggaggaacgcaccggaaucuccugggaucugggcguggaggacgcgagcgagucuaagcuccugacgguuuccgugauggaucuuagccagauguacucccccgucuuugaauaucugucuggcgaccggcaagugggggaguggccuaaagccacauguaccggagauugccccgaaagauguggcugcaccagcuccacaugucuccacaaggaguggccccauucucgcaacuggcggugcaacccuaccuggugcuggggagucgggacaggcuguacgugcugugggcuggacgugaaagaucuguucaccgacuacauguuuguuaaguggaagguggaauauauuaaaacagaggcuaucgucugcguggagcuuaccagccaggaaagacaguguucccucauugaggccggcacacgcuucaaucugggaccgguuaccaucacgcugagcgaaccccggaacauucaacagaagcucccucccgagaucaucacccugcacccuagaauugaggaaggcuuuuucgaucuuaugcaugugcagaaaguccugucugcuuccacagugugcaagcuccagagcuguacccacggggugcccggagaccugcaaguuuaccacaucggcaaucugcuuaaaggggauaaggucaacggacaucucauucacaagaucgagccgcauuucaauacaucuuggauguccugggacggcugcgaccuggauuauuacuguaacaugggggacuggccuagcugcaccuacacgggcgugacacagcacaaucaugccucuuuugugaaccugcucaauauugaaaccgauuauaccaaaaacuuccacuuucacagcaagcgcgucaccgcccauggagacacaccccagcuggaucuuaaagcucggccuacauacggcgcgggggagaucacggugcugguugaaguggccgacauggagcuccacaccaagaaaaucgagauuuccggacugaaguucgcuagccuggccuguacaggcugcuaugccugcucuagcgggaucagcuguaagguccgcauucauguggaugaacccgacgagcuuaccguucacgugaaauccgaugacccugaugucguggcugccucuagcucccucauggcgagaaagcuggaauuuggaacagacucuaccuucaaggcuuuuagcgccaugcccaaaacgucccugugcuucuacaucguugagcgggaacacuguaaaucuugcagcgaggaggauacaaagaaaugugugaauaccaagcucgaacagccgcaauccauucugaucgagcauaagggcaccaucauugggaaacagaacagcacaugcaccgccaaggcuucuuguuggcuugaauccgucaaauccuuuuucuauggccugaagaauaugcucucuggaaucuuuggcaacguguucauggggauuuuucuguuccuggccccuuucauccuucucauucuguuuuucauguuuggauggagaauccuguucugcuuuaaauguugccggcgcacaagaggccucuucaaguaccggcaccugaaggacgacgaggaaacgggguauagacgcaucauugagaaacuuaauaacaagaaaggaaagaacaaacugcucgauggcgagcggcuggcugacagacgcaucgccgaacuguuuuccaccaagacacauauuggg

SEQ ID NO: 13839 - RNA, 2916 nt, Artificial Sequence
  derived and/or modified CDS sequence (opt5) from CCHFV(Turkey-Kelkit06, Artificial)__GQ337054.1__Gn-4aa-Gc
agcgaggaacccggcgacgauugcaucuccagaacccagcugcuccggacagagacggccgaaauucacgacgauaacuacgggggaccuggcgacaagaucaccauuuguaaugggucuacaaucguggaucaacgccugggaagcgagcuuggcugcuauaccauuaacagagucaaauccuucaagcuguguaaaaauucugcuacagggaagaccugcgaaguugacagcacaccggugaaaugucggcagggauuuugccucaagaucacccaggagggccgcggccaugugaagcuguccagagggucugaggucgugcuugaugccugugacagcuccugcgaaguuaugauccccaaaggaacgggcgauauucugguggacuguagcgggggacagcaacacuuccucaaggauaaccugaucgaccugggcugcccucauauuccccuccuggggcggauggcgaucuacauuugucgcaugucuaaucacccuagaaccacaauggcuuuucuuuucugguuuuccuucggauaugucauuaccugcaucuuuugcaaagcccuguucuacagccucaucaucauuggcacacugggcaagaaaaucaagcaguaucgggagcuuaagccccagaccuguacgauuugcgaaacagccccugugaacgcuaucgaugccgagaugcaugaccugaauuguucuuacaacauuugcccguauugugcuucccgccucaccagcgacgggcuggccagacacguuacacagugccccaaacggaaggagaaaguggaagagaccgaacuguaccucaaucuggagcgcaucccuuggaucgucagaaaacuucugcaagugucugaauccaccggaguggcgcucaaacggagcuccuggcugauuguccuucugguucuccugacagugucucugagccccgugcaguccgccccugucggccgcaagccccucuuucuggauagcaucgugaaagggaugaagaaccuucucaauucuacgucccuggagaccagccugucuauugaggcuccguggggagccaucaacguucagagcacauucaagccuaccguguccacagcuaauauugcccuuucuuggagcuccgucgugcacagaggcaacaaaauccugguuaccgggcggagcgaaucuaucaugaagcucgaggaaagaacgggaguguccugggaccugggcgucgaggaugcgagcgaaucuaaacugcucacaguguccauuauggaccugagccagauguacucccccgucuuugaguaucuuucuggcgaucgccaaguggaggaauggccuaaggccaccuguaccggggacugccccgagcgguguggaugcacaagcuccaccugucugcauaaagaauggucucacagcagaaauuggcgcugcaaccccacauggugcuggggcguugggacgggauguaccugcuguggcguggaugucaaggaccucuucacagaucauauguuugugaaguggaaaguugaguacaucaagaccgaagcuauugugugcgucgcccugacaucccaggagcggcaguguagccugaucgaggcugggaccagauucaaccuuggcccugugacgauuacccucucugaaccgcgcaauauccaacagaaacugcccccugagauuaucacacugcaccccaagaucgaagagggauucuuugaccucaugcacgugcagaaaguucuguccgccagcaccgucugcaaacuucagucuuguacacauggcauuccuggggaucugcaaguguaucacaucggaaaccuccugaagggcgaccgggugaaugggcaucugauucacaaaaucgagucccauuucaacaccagcuggaugucuugggacggaugcgaucuugacuacuauuguaauaugggcgauuggcccagcugcacguacacaggggucacccagcacaaccacgccgcuuuugugaaucuccugaacauugaaacagacuauaccaagaccuuccauuuucacuccaaaagaguuacagcgcauggcgauacgccgcagcuggaccucaaggcccgcccuaccuacggagcuggcgggaucacagugcuggucgagguggccgauauggaacuucacaccaaaaagguugagaucagcggacugaaguucgccucucucgcuuguacaggcugcuacgccugcuccagcgggauuuccuguaaagugcggauccacgucgacgaacccgaugagcugaccgugcauguuaagucuagcgacccugauguggucgcggcuuccacgucucugauggccagaaaacuugaguuuggaacagacagcaccuucaaggccuuuuccgcuaugcccaaaaccucucucugcuucuauauuguggaacgcgaguacuguaagagcugcuccgaagaugacacacagaaauguguggacacccggcuggagcaaccucagagcauccugauugaacacaagggcacaaucaucgggaagcagaaugauacgugcaccgccaaggcuucuuguuggcucgaguccgucaagagcuuuuucuauggccugaaaaacaugcuuggaucuguuuuuggcaaucuguucauugggauccuccuguuccuggcccccuuugugcuucucgugcuguucuuuauguucggauggaagauucuguuuugcuucaaauguugcagacggacacgcggccucuuuaaguacagacaucugaaggacgaugaggaaaccggguaucggagaaucauugagcgccuuaacuccaaaaagggaaagaaucggcugcucgacggcgauagacuggcggaccgcaagaucgccgaacuguucagcacaaaaacccacaucggg

SEQ ID NO: 13840 - RNA, 2919 nt, Artificial Sequence
  derived and/or modified CDS sequence (opt5) from CCHFV(SR3, Artificial)__AJ538199.1__Gn-4aa-Gc
agcgaggaauccggcgacgauugcaucucuagaacccagcugcuccggacagagacggccgaagugcacggggacaacuacggaggccccggggauaagauuaccaucuguaauggaagcacagucguugaccaacgccugggcuccgagcuugggugcuauaccauuaacagagugcggucuuucaaacugugugaaaauagcgcuacaggaaaguccugcgagaucgauucuauuccugugaaauguaagcagggcuacugccucaaaaucacccaggagggccgcgggcaugucaagcugagcagaggauccgaagugguucuugacgugugugauagcucuugcgaggucaugaucccgaagggcacaggggacauucugguggauuguuccggaggccagcaacacuuucucaaagacaaccugguugaucuggggugccccaagaucccucuccugggaaaaauggccauuuauaucugucggaugagcaaucaucccaagaccacgauggcguuccuguuuugguucucuuuuggcuacgugauuaccugcauccuuugcaaagcuauuuucuuucuccugaucaucuucggcacacuugggaagcgcuuuaagcaguauagagaacugaaaccucagaccuguacaauuugcgagaccacgcccgucaacgccaucgacgccgagaugcacgaucucaauuguuccuacaacauuugcccuuauugugcuagccggcugacaucugacggacuggcccgccaugugacccagugcccgagacggaaggaaaaaguggaggaaacagagcucuaccugaaucuugaacgcauccccugggucguuagaaagcugcuccaaguguccgagagcaccggcaccgugcugaaacgguccucuuggcuuauuguccugcucgugcuguucacaguuagccuguccccugugcagagcgcucccaucgggcuccgcagaccucuguuucuugacucuaucgucaagggaaugaaaaaccugcucaauuccacgagccuggagaccucucuuagcauugaagcccccuggggcgcgaucaacgugcaguccacauacaagccgaccguuucuacagccaauauugcucugagcugguccagcguggagcaccgggggaacaagguccucgugucuggaagauccgaaagcaucaugaaacuggaggaacgcaccggcauuucuugggaucugggcgucgaggacgccuccgagagcaagcuccugacgguguccguuauggaucuuucucagauguauagcccuguguucgaauaccuguccggggaccggcaagucgaggaauggcccaaagcuacauguaccggagauugcccugagagauguggcugcaccucuagcacaugucuccacaaggaauggccccauucccgcaauuggcggugcaaccccaccuggugcuggggaguggggacaggcuguacgugcugugggcuggacguuaaagaucuguuuaccgacuauauguucgugaaguggaaggucgaguacaucaaaacagaggccaucgugugcguggaacuuaccagccaggagagacaguguucucucauugaagcgggcacacgcuucaaccugggauccguuaccaucacgcugagcgagccucggaauauucaacagaagcucccgcccgagaucauuacccugcacccuaaaaucgaagagggcuuuuucgaucuuaugcauguccagaaggugcugucugccuccacagugugcaaacuccagagcuguacccacgggguccccggagaccugcaaguguaucacauuggcaaccugcuuaagggggauagaguuaauggacaucucauccacaagaucgaacagcauuuuaacacaucuuggaugagcugggacggcugcgaccuggauuacuauuguaauaugggggacuggccuuccugcaccuacacgggcgugacacagcacaaccaugcuagcuucgucaaucugcucaacauugagaccgauuacacaaaaaccuuucacuuccacucuaagcgcgugaccgcccauggagacacaccccagcuggaucuuaaagcucggccgacguauggcgccggggaaaucaccguucugguggaggucgccgacauggagcuccacacaaagaaaauugaaaucuccggacugaaguuugcuggccugaccuguacagggugcuacgcgugcagcuccggaauuucuuguaaggugagaauccauguugaugagccugacgaacuuaccgugcacgucaaaagcgaugaccccgaugugguggccgcuuccucuagccucauggcccgcaagcuggaguucggcacggacuccacauuuaaagccuucucugcuaugccuaagaccagccugugcuuuuauaucgucgaacgggaguacuguaaauccugcaauaaggaggauacccaaaaauguguuaacacaaagcucgaacagccccagagcauucugaucgagcacaaggggaccauuaucggcaaacagaauaacacaugcacggccaaggcgucuuguuggcuugaauccgugaaaucuuucuuuuauggacugaagaauaugcucggcgggauuuucggaaacguguucaucggcaucuuuaccuuccugacaccuuuuauucugcuuauccucuucuuuauguucggguggcggauucuguuuugcuucaaauguugcagacgcaccagaggacuguuuaaguaccggcaucucaaggacgacgaggaaacaggcuauagaaaaaucauugagcgccugaauaacaagaaagggaagaaccggcuucuggauggcgagagacucgcugaccgcaaaaucgccgaacuguucagcaccaagacgcacaucgga

SEQ ID NO: 13841 - RNA, 2919 nt, Artificial Sequence
  derived and/or modified CDS sequence (opt5) from CCHFV(UCCR4413, Artificial)__KY484038.1__Gn-4aa-Gc
agcgaguccucugccagcggcugcaucuccagaacccagaugauuaagucugaaacagcugagauccacgacgauauuuacgggggacccggcgaaaaacugacgaucuguaacgggaccacaguggucgaccaacggcucggaagcgagcugggcugcuauaccauuaaucgcaucaagacauacaaacuuugugaaaacuccguuaaggagaaaaccugcgagaucgauucugugccugugaaguguagacaggggcugugccucaagauuacacaggaaggacggggccaugucaaacugagccgcggcuccgagaucgugcuugacauuugugauagcucuugcgaacugaugaucccgaaggggaccggagacauucucguugauuguuccggcgggcagcaacacuuccugcaggacaaucugguggaucucggaugccccaacaucccucugcuuggcaaagucgccauuuauaucuguagaaugagcaaucaucccaagacgaccauggcguuucuguucugguuuucuuucggguacgugaucacaugcauucucugcaaaauccuguuuuaucuucugauuaucaccggaacacucggcaagaagcugaaacaguaccgggagcugaagccucagaccuguacgauuugcgaguccacacccguuaacgcuaucgacgccgaaaugcacgaucucaauuguagcuauaacaucugcccuuacugugccucucgccugaccuccgacggccuuauuagacaugugaaucugugcccgaaacggaaggagaaagucgaagagacagaacucuaccugaaccuugagcgcauccccugguucgugagaaagcugcuccaagugagcgaguccaccggggucgcucugaaacggucuagcuggcugcucauucugguuauccuucugaccguguccaugagcccugugcagucugcccccauuaaucgcaagccucucuuucuguccagcaucgucaaggggaaaaagaaccuucuuaauucugcuagccucgaaacaucccugucuaucgaggcccccuggggcgcgauuaacgcccagagcacguucaaaccgaccaucuccacagcuaauauugcccugagcuggucuuccguggaacacagagggaacaagguucucgugagcggacggucugaguccaucaugaaacuggaagaacgcaccggcauuagcuggaaccuuggggucgaggaugcuuccgaaucuagaaugcugacagugagcguuauggaccucucccagauguaucugccuguguuugaguaccugucuggagaccggcaagucgaagaguggcccaaggccaccuguacgggcgauugcccugaaagauguggcugcacaagcuccaccugucuucacaaggaguggccccauagccgcaauuggcggugcaaccccaccuggugcuggggagugggaacaggcuguaccugcugugggcucgacgucaaagaucuguucacagacuauauguuugugaaguggaaaguugaguacaucaagacggaagcgauugugugcgucgagcugaccucucaggaaagacaguguucccucaucgaggccggaacacgcuucaaucugggcccugugaccaucacacuuagcgagccgcggaacauucaacagaaacugcccucugaaaucguuacccuccacccuaagauugaggaaggguuuuucgaucugaugcaugugcagaagguccuguccgcuagcacggugugcaaacuucagucuuguacccacggcguggccggagaccuccaaguuuaucacgucggcaaucugcugaagggggauaaaaucaacggacauagcauucacaagaucgagccccaucucaauacauccuggaugagcugggacggcugcgaucuggacuacuauuguaacaugggggauuggccuucuugcaccuacacaggagugacccagcacaaucaugcugccuucgugaaccuucugaauaucgaaacggacuacacaaaauccuuucacuuccacagcaagagagucaccgcccauggcgacacaccccagcucgaucugaaggcucgcccgauguauggggcgggcgagauuaccgugcugguugagguggccgacauggaacuucacuccaaaaacaucgagauuucuggacucaaguuugcuagccugaccuguuccggcugcuacgccugcucuagcgggaucuccuguaaaguccggauucauguggaugaaccugacgagcuggccguucacgugaagucugaugaccucgaugucguggcugccagcuccagccugauggcgagaaaaaucgaguucggaacagacucuacguuuaaggcuuucuccagcaugcccaaagagucucuuugcuuuuauaucguugagcgcgauuucuguaaguccugcgccgccgaagacacccagaagugugugaaagcuaagcuggagcaaccucagagcauucucaucgaacacaaaggcacaauuaucgggaagcagaaugauaccugcucuacaaaaaccuccuguuggcuggagagcuuuaaguccuucuuuuacggacugaagaacaugcuuagcggcgucuucgggucugccauuaugggcauccuccuguuucuggcucccuucauccuccugauucuuuucuuuuucuuuggauggcggauccuguucugccucagauguugccgccggacgagaggccuguuuaaauauaagcauauuaaagacgaugaagaggccggguacaagaaaaucauugagaagcugaauaacaagaaaggaggcacaagcaagcugcuggacggggaacggcucgcggaccgcaaaaucgccgagcuguucuccaccaaggcucacauugga

SEQ ID NO: 13842 - RNA, 2916 nt, Artificial Sequence
  derived and/or modified CDS sequence (opt5) from CCHFV(66019, Artificial)__AB069669.1__Gn-4aa-Gc
agcgaggaauccggcgacgauugcaucucuagaacccagcugcuccggacagagacggccgaagugcacggggacaacuacggaggccccggggauaagauuaccaucuguaauggaagcacaauugucgaccaacgccugggcuccgagcuugggugcuauaccaucaacagaguuaaaucuuucaagcugugugaaaauagcggaacaggcaaauccugcaagauugauaacaccccugugaaaugucggcagggcuuuugccucaagaucacacaggaggggcgcggacaugugaagcugucuagaggcagcgaggucgugcuugacgcuugugauuccagcugcgaaaucaugauuccgaaagggaccggagacauccugguugauuguucuggcgggcagcaacacuuccucaaggacaaucugguggaucugggaugccccaacauuccucuccugggcaaaauggccaucuacauuugucggauguccaaucaucccaagacgaccauggcguuucuuuucugguuuagcuucggcuaugucaucacaugcauuuucugcaaaaucaucuucuaccugcucauugugguugggacccugggaaagaaguuuaaacaguaucgcgagcuuaagccucagacauguaccaucugcgaaacgacacccaccaacgcuauugacgccgagaugcacgaucugaaauguucuuacaauaucugcccuuauugugccuccagacucacaagcgacggccuggcucggcaugugacccagugcccgaagcgcaaagagaaggucgaagagaccgaacuguaccucaaccuggagcggauucccuggaucgugagaaaacuucugcaagugucugaauccacaggggucgcccucaagcgcagcuccuggcugaucguucuucuggugcuccugacggugucucugagcccuguccaguccgcucccauuggaagaaagccucucuucagcgacucuaucgugaaaggcaugaagaaucugcuuaacuccaccagccuggagacaucucucagcauugaggcccccuggggagcgaucaauguucaguccaccuuuaaaccgacagugucuaccgccaacauugcucugagcugguccagcgucgaacaccgggggaauaagauccuugugucuggccgcuccgagagcaucaugaaacuggaagagagaacgggcauuucuugggaucucgggguugaagacgccuccgagagcaagcugcugacaguguccgucauggaucucucucagauguacagcccuguguucgaguaucuguccggagaccggcaagucgaagaguggcccaaggcuaccuguaccggcaacugcccugauagaugugggugcacaucuagcaccugucuucacaaagaauggccccauucccgcaacuggcggugcaaucccacauggugcuggggagugggcacgggguguaccugcuguggccuggacguuaaggaucucuuuacagacuacauguucgugaaauggaaggucgaguauaucaaaaccgaagccauugugugcguugagcugaacagccaggagagacaguguucucugaucgaagcgggaacacgcuucaaucuuggcccugugaccauuacgcucuccgagccgcggaacauccaacagaagcugcccagcgaaauuaucacccugcacccuagaaucgaggagggguuuuucgaucucaugcauguccagaaggugcugucugccuccacagugugcaaacuucagagcuguacccacggaguucccggcgaccugcaaauuuaccacaucgggaaucuccugaagggagaucgcgucaacggccaucugauucacaaaaucgaaccucauuuuaauacaucuuggaugagcugggacgggugcgaccuugauuauuacuguaacaugggcgacuggcccuccugcaccuauacgggagugacacagcacaaucaugcugccuucgugaaccuccugaauauugagaccgauuacacaaagaacuuucacuuccacagcaaacgggucaccgcucauggcgacaccccgcagcuggaucucaaggccagaccuacauacggggccggagaaaucacggugcugguugagguggcugacauggaacuucacaccaagaaaaucgcgauuucuggccugaaguuugccucccucacauguaccgggugcuaugcuugcagcuccggaaucucuuguaaaguccgcauucauguggaugagcccgacgagcugacaguucacgucaagagcgaagauccugacaucguggccgccuccucuagccugauggcucggaaacuugaguucggcaccgauuccacguuuaaggccuucucugcgaugcccaaaacaagccucugcuuuuacauuguggaaagagaguauugugaauccugcagcaaggaggacacccagaaguguguuaauaccaaacuggagcaaccucagucuauccugaucgaacacaaggggacaauuaucggcaaacagaacgauaccugcacagcuaaggccuccuguuggcucgagagcgugaaaucuuucuuuuacggacugaagaauaugcuuuccggcauuuucgggaacgucuucaucggaauuuuucuguuccucgcccccuuuauccugcugauccuuuucuuuauguucggcuggcgcauucucuuuugcuucaaguguugccggagaacgcgggggcuguuuaaauaucgcuaccugaaggacgacgaagagagcggauauagacggaucauugaaagacucaacaauaaaaagggcaaaaacaagcugcuugauggggagcgccuggcugaccggagaaucgccgagcucuuuucuaccaagacacauauuggc

SEQ ID NO: 13843 - RNA, 2916 nt, Artificial Sequence
  derived and/or modified CDS sequence (opt5) from CCHFV(7001, Artificial)__AB069670.1__Gn-4aa-Gc
gccgagggcgggagcuccgacugcaucucuagaacccagcuggugaagacagaagucgcugagauucacgaagauagcuacggaggccccggggagaaaaucacgauuuguaacggauccaccaucguugaccaacggcucggcucugaacuggggugcuauacaauuaaucgcgugagaagcuacaaacuuugugagaacuccgccucuggaaaaagcugcgagaucgauuccaucccugugaaguguaaacagggcuucugccugaagauuacccaggaaggccgggggcaugucaagcucagccgcggaacagagaucgugcuggacguuugugauucuuccugcgaacuuaugauuccgaaaggcaccggggacauccugguggauuguagcggaggccagcaacacuuucuccagaauaaccugauugaccuggggugccccaaugucccucuccugggaaagauggcgaucuauguguguagaaugucuaaccaucccaaaacaaccauggcuuuccucuuuugguucuccuuuggcuacguuauuacgugcaucgccugccgggugcuguucuaucuccugaucgccauuggcaccgucgggaagaaacuuaagcaguaccgcgagcugaagccucagacauguaucgugugcgagagcgugcccgucaaugcuauugaugccgaaaugcacgagcucaacuguucuuauaauaucugcccuuacugugcuuccagacugagcaccgacggacugauucggcauguuacacaaugcccgaaacgcagagaaaagguggaggaaaccgagcucuuucugaaccuugagcggauccccuggcuggugcgcaaacuccugcaggucuccgaaucuacgggcauggcccuuaagagaagcuguuggaugaucacacugcucauucugcugcucguguccaucagcccuguucagucugcgcccguggggcggaaaccucuguuccuugauaauauugccaagggaaugaaaucccugcucaacagcaccucucuggagacaagccuuuccaucgaagcucccuggggcgccauuaauguccagucuaccuuuaagccgaccgugagcgcugccaacaucgcgcuguccuggagcucuguugagcaccgcgggaauaagauccucguguccggaagaagcgaaucuauuaugaaacuggaggagcggacaggcgucuccuggaaccugggcguggaagacgccagcgaguccaagacgcucaccgucucugugauggaucugagccaaauguacuccccuguuuucgaauaucuuucuggggacagacagguggaggaauggcccaaagcuacaugcaccggagacuguccugagcgcugcggcuguacaagcuccacgugccugcacaaggaguggccccauagccggaacuggagaugcaaucccaccugguguuggggagucgggacaggcugcaccuguugcgggcucgaugugaaagacuuuuucaccgauuacaugcugguuaaguggaagguggaauauaucaaaacagaggccauugucuguguggaacugaccucucaggagcgccaaugcucccuuaucgaggcuggcacacgguuuaaccucggaccugugacgauuacccugagcgaaccgagaaauguucagcagcgccugcccccugagaucgucacacuccaccccaagauugaagagggcuucuucgaccugaugcaugugcagaaaauccuuucugccuccaccguguguaagcugcaaagcugcacacacggggucccuggagauuuucagguguaccacguuggcaaccuccugagaggggacaaagugaauggacauucuauccacaagauugaaccccauuucaacaccagcuggauguccugggauggcugugaccuggauuauuuuugcaauaugggggacuggccgagcuguacguacaccggcgucacacagcacaaccgggccgcuuucaucaauaugcuuaacauugagaccgauuauacaaagaccuuucauuuccacucuaaacgcgugacggcgcacggagacacaccucagcucgaccugaaggcccggcccgcuuacggcgccggggagguuaccgugcuggucgaaguggccgaucucgagcugcauacaaagaaacuugaaguuuccggacugaaaaucgcuagccuuaccugcuccggcugcuacgccuguucuagcgggauuuccugcaaggugagaauccacgucaaugagccugacgaauuuaccgugcaugugcgcucuagcgaucccgacgucguugcggcuggauccucucugauggcccggaagaucgaguucggcgccgauagcacauuuaaggcuuucuccagcaugccuaaggacucucuguguuuuuauauuguggagaaagauuacugcuccagcuguacggacgaugacacccaaaagugcgugaacacaaaacuugaucacccccagucuauccucauugaacacaaggggaccaucauuggcaaacagaaugacacauguuccaccaagacgagcugcuggcuggagucugucaagggauucuuuuauggccugaaaaacaugcucuccgggaucuucggaaauguguuccugggcaucuuucuuuuccuggccccguuuguucuccugauuuucuuuuucuuuuucggguggagacugcucuuuugucuuaagugcugucggcgcacaagaggacugcugaaauacaagcaucucaaagaugaagaggaagcuggcuauaagaagaucauugagcggcugaacgggaaaaagggcaaaagccagcuuuucgacggagagagacuggccgaccgcaagaucgcggaacucuuuuccaccaaaauucacaucggc

SEQ ID NO: 13844 - RNA, 2916 nt, Artificial Sequence
  derived and/or modified CDS sequence (opt5) from CCHFV(75024, Artificial)__AB069671.1__Gn-4aa-Gc
agcgaggaauccggcgacgauugcaucucuagaacccagcugcuccggacagagacggccgaaauucacggggacaacuacggaggccccggggauaagaucaccauuuguaauggaagcacaaucguggaccaacgccugggcuccgagauggggugcuauaccauuaacagagucaaaucuuucaaacuuugugaaaauagcgcuacaggaaaauccugcgagaucgauucuaucccuguuaagugucggcagggcuacugccugaaaauuacccaggagggccgcgggcaugugaagcucagcagaggauccgaagugguccuggacgccugugauagcucuugcgaggugaugaucccgaagggcacaggggacauucuuguugauuguuccggaggccagcaacacuuucugaaagacaaccucaucgaucuggggugccccagcauuccucugcucggaaagauggcgaucuauauuugucggaugucuaaucaucccaaaaccacgauggcuuuccuguuuugguucuccuuuggcuacgugauuaccugcauccuuugcaaggccaucuucuaucugcucaucauugucggcacacuggggaaacgcuuuaagcaguacagagaacuuaagccucagaccuguacaaucugcgagaccacgcccgccaacgcuauugacgccgagaugcacgaucugaauuguagcuauaacaucugcccuuacugugcuucucggcucacauccgacggacuggcccgccaugugacccagugcccgaaaagaaaggaaaaaguugaggaaacagagcuguaccucaaucuggaacggauccccugggugguccgcaaacuucugcaagugagcgaguccaccggcguggcgcucaagagaucuagcuggcugauuguccuucugguucucuucgccaucucccugagcccugugcagucugcucccauugggcggcgcccucuguuucucgacuccaucgugagaggaaugaagaaccagcugaauagcaccucucuugagacaagccuguccauugaagcccccuggggcgcuaucaacguccagucuacguauaaaccgaccgugagcacagccaauaucgcgcucuccuggagcucuguugagcaccgggggaacaagauucugguguccggaagaagcgaaucuaucaugaaacuugaggaacgcaccggcauuuccugggaucugggcgucgaggacgccagcgaguccaagcuccugacagugucuguuauggaucugagccaaauguacuccccuguguucgaauaucucucuggggaccggcaggucgaggaauggcccaaggcuaccuguacgggagauugcccugagagauguggcugcacaaccagcaccugucugcacaaagaauggccccauucccgcaauuggcggugcaaccccacauggugcuggggaguggggaccggcuguacaugcugugggcuugacgucaaggaucuguuuacggacuacaugaucgugaaauggaagguugaguauauuaagaccgaggccaucgugugcgucgaacucacaagccaggagagacaauguucucugauugaagcuggcacccgcuucaaccugggauccgugacaaucacccuuagcgagccucggaauauccagcagaaacucccgcccgagauuaucacgcugcacccuagaauugaagagggcuuuuucgaucugaugcauguucagaaggugcucucugccuccaccgucugcaaacugcaaagcuguacacacggggugcccggagaccuucagguguaccacguuggcaaccugcucaagggggauaaagucaauggacaucugauccacaagauugaaccucaucugaacaccucuuggaugagcugggacggcugcgaccuugauuauuacuguaauaugggggacuggcccuccugcacauacaccggcgugacgcagcacaaccaugccagcuucgugaaucuccugaacaucgagacagauuauaccaagucuuuucacuuccacuccaaacgcgucacagcucauggagacaccccgcagcuggaucucaaggcgcggccuaccuacggcgccggggaaaucacagugcugguugagguggcugacauggaguuuacgcccaaaaagauugaaaucagcggacuuaaauucgccucccugaccuguacaggcugcuaugccugcucuagcgggauuuccuguaaggucagaauccacguggaugagccugacgaacucaccguucaugugaagucugaugaccccgaugucguggcugccagcuccucucugauggcgcgcaaacuggaguuuggaacagacagcaccuucaaggcuuuuuccgccaugccuaaaacgagccuuugcuucuacauuguugaacgggaguauuguaagucuugcuccaaagaggauacacaaaagugugugaauaccaaacucgaacagccccagagcauccugaucgagcacaagggcaccauuaucgggaagcagaacaauacaugcaccgccaaggcuucuuguuggcuggaauccgucaagagcuuuuucuacggccucaaaaacaugcugucuggaauuuuuggcaaucuuuucauggggaucuuucuguuccucgccccguucauucugcugauccucuuuuucauguuuggauggagaauccuuuucugcuuuaaguguugccggcgcacaagaggccuguucaaauaucggcaccugaaggacgacgaggaaacgggguacagacgcauuaucgagcggcucaacaauaagaaaggaaagaacaaacugcuugauggcgagagacuggcugaccgcagaauugccgaacucuuuuccaccaagacacauaucggg

SEQ ID NO: 13845 - RNA, 2916 nt, Artificial Sequence
  derived and/or modified CDS sequence (opt5) from CCHFV(7803, Artificial)__AB069672.1__Gn-4aa-Gc
agcgaggaauccggcgacgauugcaucucuagaacccagcugcuccggacagagacggccgaaauucacggggacaacuacggaggccccggggauaagaucaccauuuguaauggaagcacaaucguggaccaacgccugggcuccgagauggggugcuauaccauuaacagagucaaaucuuucaagcucugugaaaauagcgcuacaggaaaauccugcgagaucgauucuaucccuguuaagugucggcagggcuacugccugaaaauuacccaggagggccgcgggcaugugaagcucagcagaggauccgaagugauccuggacgccugugauagcucuugcgaggucaugauuccgaagggcacaggggacauccuuguggauuguuccggaggccagcaacacuuucugaaagacaaccucauugaucuggggugccccagcaucccucugcucggaaagauggcgauuuauaucugucggaugucuaaucaucccaaaaccacgauggcuuuccuguuuugguucuccuuuggcuacguuauuaccugcauccuuugcaaggccaucuucuaucugcucauuaucgugggcacacuggggaaacgcuuuaagcaguacagagaacuuaagccucagaccuguacaauuugcgagaccacgcccgccaacgcuaucgacgccgagaugcacgaucugaauuguagcuauaacaucugcccuuacugugcuucucggcucacauccgacggacuggcccgccaugucacccagugcccgaaaagaaaggaaaaaguggaggaaacagagcuguaccucaaucuggaacggauucccuggguugugcgcaaacuucugcaagucagcgaguccaccggcguggcgcucaagagaucuagcuggcugaucgugcuucugguccucuucgccauuucccugagcccuguucagucugcucccaucucccggcgcccucuguuucucgacagcauugugagagggaugaagaacccccuuaauucuaccagccuugagacaucccugucuaucgaagccccguggggagcuaucaacgugcagagcacguauaaaccuaccgucuccacagccaauauugcgcucagcuggucuuccguggagcaccggggcaacaagauccugguuagcgggagaucugaauccauuaugaaacuugaggaacgcaccggaaucagcugggaucugggcguggaggacgccuccgagucuaagcuccugacagucagcgugauggaucugucccagauguacucucccguuuucgaauaucucagcggcgaccggcaaguggaggaauggccuaaggcuaccuguacgggggauugccccgagagauguggaugcacaaccuccaccugucugcacaaagaauggccccauagccgcaauuggcggugcaacccuacauggugcuggggcgucgggaccggauguacaugcuguggccuugacgugaaggaucuguuuacggacuacaugauugucaaauggaagguggaguauaucaagaccagagggauuguuugcguggagcucacaucucaggaacgccaguguucccugaucgaggccggcacccgguucaaccugggaagcgucacaaucacccuuucugaaccgagaaauauucaacagaaacuucccccugagaucauuacgcugcacccccgcaucgaggaaggcuuuuucgaucugaugcaugugcagaagguucucuccgcuagcaccgugugcaaacugcagucuuguacacacggggucccuggagaccuucaaguguaccacgugggcaaccugcucaagggggauaaaguuaauggacaucugauucacaagaucgagccccaucugaacaccagcuggauguccugggacggcugcgaccuugauuauuacuguaauaugggggacuggccgagcugcacauacaccggcgucacgcagcacaaccaugccucuuucgugaaucuccugaacaucgaaacagauuauaccaaguccuuucacuuccacagcaaacgggugacagcccauggagacaccccucagcuggaucucaaggcuagacccaccuacggcgcgggggagauuacaguccugguggaaguugccgacauggaguuuacgccuaaaaagaucgagauuuccggacuuaaauucgcuucucugaccuguacaggcugcuaugccugcagcuccgggaucucuuguaaggugcgcauucacgucgaugaacccgacgagcucaccgugcauguuaagagcgaugacccugauguggucgccgcuuccucuagccugauggcccggaaacuggaauuuggaacagacuccaccuucaaggcguuuagcgcuaugcccaaaacgucucuuugcuucuacaucguggagagagaauauuguaaguccugcagcaaagaggauacacagaaguguguuaauaccaaacucgagcaaccgcagucuauccugauugaacacaagggcaccaucauugggaagcagaacaauacaugcaccgccaaagccuccuguuggcuggagagcgugaaguccuuuuucuacggccucaaaaacaugcugucuggaaucuuuggcaauuucuuuauggggauuuuccuuuuccuggcuccuuuuauccuccugauccuguucuuuauguucggauggcggauucuguuuugcuucaaguguugccgcagaacacggggccucuuuaaauauagacaccugaaggacgacgaagagacgggguaccgccggaucauugaaagacugaacaauaagaaaggaaagaacaaacuccuggauggcgagcgccuugccgacagacggaucgcugagcuguucagcaccaagacacauauuggg

SEQ ID NO: 13846 - RNA, 2916 nt, Artificial Sequence
  derived and/or modified CDS sequence (opt5) from CCHFV(79121, Artificial)__AB069673.1__Gn-4aa-Gc
gccgagggcgggagcuccgacugcaucucuagaacccagcuggugaagacagaagucgcugagauucacgaagauagcuacggaggccccggggagaaaaucacgauuuguaacggauccaccaucguugaccaaggccucgggucugaacugggaugcuauacaauuaaucgggugcgcagcuacaaacuuugugagaacuccgccucuggcaagagcugcgagaucgauuccaucccugugaaguguaaacagggcuucugccugaagauuacccaggaagggagaggacaugucaagcucagccggggcacagagaucgugcuggacguuugugauucuuccugcgaacuuaugauuccgaaagggaccggagacauccugguggauuguagcggcgggcagcaacacuuucuccagaauaaccugauugaccugggaugccccaaugucccucuccugggcaagauggcgaucuaugugugucgcaugucuaaccaucccaaaacaaccauggcuuuccucuuuugguucuccuuuggcuacguuauuacgugcaucgccugcagagugcuguucuaucuccugaucgccauugggaccgucggaaagaaacuuaagcaguaccgggagcugaagccucagacauguaucgugugcgagagcgugcccgucaaugcuauugaugccgaaaugcacgagcucaacuguucuuauaauaucugcccuuacugugcuucccgccugagcaccgacggccugauuagacauguuacacaaugcccgaaacggcgcgaaaagguggaggaaaccgagcucuuucugaaccuugagagaauccccuggcuggugcggaaacuccugcaggucuccgaaucuacggggauggcccuuaagcgcagcuguuggaugaucacacugcucauucugcugcucguguccaucagcccuguucagucugcgcccgugggaagaaaaccucuguuccuugauuccaccgccaagggcaugaaaagccugcucaauucuacaagccuggagaccucccuuucuauugaagcucccuggggagccaucaacguccagagcaccuuuaagccgacaguguccgcugccaauauugcgcugagcuggucuuccguugagcaccgggggaacaagauccucgugagcggccgcucugaauccaucaugaaacuggaggagagaacgggcgucagcuggaaucuggggguggaagacgccuccgagucuaagacccucacagucagcgugauggaucugucccaaauguacucuccuguuuucgaauaucuuagcggagacagacagguggaggaauggcccaaagcuaccugcacaggcgacuguccugagcggugcggguguaccuccagcacgugccugcacaaggaguggccccauucucgcaacuggcggugcaaccccacaugguguuggggagucggcaccgggugcaccuguugcggccucgaugugaaagacuuuuucacagauuacaugcugguuaaguggaagguggaauauauuaaaaccgaggccaucgucuguguggaacugacaucccaggagagacaaugcagccuuauugaggcuggaacgcgcuuuaaucucggcccugugaccaucacacugucugaaccgcggaacguucagcagagacugcccccugagauugucacccuccaccccaagaucgaagagggguucuucgaccugaugcaugugcagaaaauucuuuccgccagcacaguguguaagcugcaaucuugcacccacggagucccuggcgauuuucagaucuaccacguggggaaucuccugcgcggagacaaaguuaacggccauagcauccacaagauugaaccccauuucaauacguccuggaugagcugggaugggugugaccuggauuauuuuugcaacaugggcgacuggccgucuuguaccuacacaggagugacccagcacaaucgggccgcuuucaucaacaugcuuaauauugagacagauuauaccaagacguuucauuuccacuccaaaagagucacagcgcacggcgacaccccucagcucgaccugaaggcccgccccgcuuacggggccggagaggugacaguucugguggaagucgccgaucucgagcugcauaccaaaaaccuugaagugagcggccugaagaucgcuucccuuaccugcucugggugcuacgccuguagcuccggaauuucuugcaaaguucggauccacgugaaugagccugacgaauuuacaguccaugugagaagcuccgaucccgacguggucgcggcuggcucuagccugauggcccgcaagaucgaguucggggccgauuccacguuuaaggcuuucagcucuaugccuaaagacucccuguguuuuuauauuguugagaaggauuacugcagcucuuguaccgacgaugacacacaaaaaugcgugaacaccaaacuugaucacccccaguccauccucauugaacacaagggcacaaucauuggaaagcagaaugacaccuguagcacgaaaacaucuugcuggcuggaguccgugaagggcuucuuuuaugggcugaagaacaugcucagcggaaucuucggcaaugucuuccuggggaucuuucuuuuccuggccccguuugugcuccugauuuucuuuuucuuuuucggauggcggcugcucuuuugucuuaaaugcuguagacggacccgcggccugcugaaguacaaacaucucaaggaugaagaggaagcuggguauaaaaagaucauugagagacugaacggcaagaaaggaaagucccagcuuuucgacggcgagcggcuggccgacagaaaaaucgcggaacucuuuagcaccaagauucacaucggg

SEQ ID NO: 13847 - RNA, 2916 nt, Artificial Sequence
  derived and/or modified CDS sequence (opt5) from CCHFV(8402, Artificial)__AB069674.1__Gn-4aa-Gc
agcgaggaauccggcgacgauugcaucucuagaacccagcugcuccggacagagacggccgaaauucacaacgacaauuacgggggacccggcgauaagaucaccauuuguaacgggagcacaguggucgaccaacgccugggauccgagcuuggcugcuauaccaucaauagaguuaaaucuuucaagcugugugaaaacagcgcuacagggaaauccugcgagauugauucuaccccugugaagugucggcagggauuuugccucaaaaucacacaggagggccgcggccaugugaagcugagcagaggguccgaagucgugcuugacgccugugauagcucuugcgagaucaugauuccgaagggaaccggcgacauccugguugauuguuccgggggacagcaacacuuccucaaagacaaucugauugaucugggcugccccaacaucccucuccuggggaagauggcgauuuacaucugucggaugagcaaucaucccaaaacgaccauggcuuuucuuuucugguuuucuuucggauauguggucacaugcauucugugcaaggugaucuuuuaccuccugaucguugugggcacccuuggcaaaaaguucaagcaguaucgcgaacugaaaccucagacauguaccauuugcgagacgacacccgucaacgccaucgacgccgagaugcacgaucucaauuguuccuacaacauuugcccuuauugugcuagcagacugaccucugacgggcuggcccggcaugugaugcagugcccgaagcgcaaagaaaagaucgaggaaacagagcucuaccugaaucuugaacggauucccuggguggucagaaaacugcuccaaguuuccgagagcaccggaguggcucugaagcgcuccucuuggcuugugguccugcucgugcugcugaccguuagccucuccccugugcagagcgcccccaucggcagaaaaccucuguuuucugacuccaucgucaaggggaugaagaaccuucugaauagcacaucucucgagacgagccuguccauugaagcgcccuggggagccaucaacgugcagucuaccuucaaaccgacaguuagcgcugccaauauugcucuuuccuggagcucuguggagcaccggggcaacaagauccuggucuccgggcgcagcgaaucuauuaugaaacucgaggaaagaaccggaaucuccugggaucugggcguggaggacgccagcgaguccaagcugcucacagucucugugauggaucugagccagauguacuccccuguuuuugaauaucuuucuggcgaccggcaaguggaggaauggcccaaagcgaccuguacgggggauugcccugagagauguggaugcacaagcuccaccugucugcacaaggaauggccccauagccgcaacuggcggugcaaucccaccuggugcuggggcgucgggacaggauguaccugcuguggccucgacgugaaggaucuguucacagacuacauguuuaucaaauggaagguugaguauauuaaaacggaggccaucgugugcgucgaacugaccucucaggagagacaguguacacuuauugaagcugggacccgcuucaaccucggcccugugacaaucacccuguccgagccgcggaauauucaacagaagcugcccccugagaucgugacgcuccaccccagaauugaagagggauucuuugaucugaugcauguucagaaaguccuuagcgccucuaccgugugcaagcugcaguccuguacacacggcgugccuggggaccuccaagucuaccacaucggaaaccugcugaagggcgauaaagugaaugggcaucuuauccacaagauugaaccccauuucaacaccagcuggaugucuugggacggaugcgaccucgauuauuacuguaauaugggcgacuggccgagcugcacauauaccgggguuacgcagcacaaccaugcugccuuugugaauaugcugaacaucgagacagauuacaccaaaaauuuccacuuucacuccaagcgcgucacagcccauggcgacaccccucagcuggaucucaaagcucggcccaccuacggagcgggcgaaauuacagugcugguugagguggccgacauggagcuucacacgaagaagaucgaaauuagcgggcugaaauucgcuucucucaccuguacaggaugcuaugccugcuccagcggcaucuccuguaaggucagaauccauguggaugagccugacgaacugaccguucacgugaaaucugaggaucccgacauugucgccgcuagcuccucucugauggcccgcaaacuugaauuugggacagauagcaccuucaaggcguuuuccgcuaugccuaagacgucucucugcuucuacaucguggagcgggaguauuguaaaagcugcuccaaggaagacacacagaagugugugaacaccaaacuggagcaaccccagagcauucugaucgaacacaagggaaccauuaucggcaaacagucuaauacaugcaccgccaaggccuccuguuggcucgagagcgucaaauccuuuuucuacgggcugaagaacaugcuuucuggcaucuuuggaaauguuuucauuggcguguuccuguuuuucgcuccguuuauccuccugauucuguucuuuauguucggguggagaauccucuuuugcuucaaguguugccgccggacaagaggacuuuuuaaauaucggcaucugaaggaugacgaagagacgggcuaccgcaaaauuaucgagagacugaacaacaagaaagggaagaauaagcuccuggacggagaacggcuugccgauagaaaaaucgcugagcuguucagcaccaagacacacauuggc

SEQ ID NO: 13848 - RNA, 2916 nt, Artificial Sequence
  derived and/or modified CDS sequence (opt5) from CCHFV(88166, Artificial)__AB069675.1__Gn-4aa-Gc
agcgaggaauccggcgacgauugcaucucuagaacccagcugcuccggacagagacggccgaaauucacagcgacaacuacgggggacccggcgauaagaucaccauuuguaauggguccacaguggucgaccaacgccugggaucugagcuuggcugcuauaccaucaacagaguuaagagcuucaaacugugugaaaauuccgcuacagggaaaucuugcgagauugauagcaccccugugaagugucggcagggauuuugccucaaaaucacacaggagggccgcggccaugugaagcuguccagagggagcgaagucgugcuugacgccugugauucuuccugcgagaucaugauuccgaagggaaccggcgacauccugguugauuguagcgggggacagcaacacuuccucaaagacaaccugauugaucugggcugccccaauaucccucuccuggggaagauggcgauuuacaucugucggaugucuaaccaucccaaaacgaccaugggauuucuuuucugguuuuccuucggcuauguggucacaugcauucugugcaaggugaucuuuuaccuccugaucguugugggcacccuugggaaaaaguucaagcaguaucgcgaacugaaaccucagacauguaccauuugcgagacgacacccgucaaugcuaucgacgccgagaugcacgaucucaacuguagcuacaauauuugcccuuauugugccucuagacugaccuccgacggacuggcucggcaugugaugcagugcccgaagcgcaaagaaaagaucgaggaaacagagcucuaccugaaccuugaacggauucccuggguggucagaaaacugcuccaaguuagcgaguccaccggcguggcccugaagcgcucuagcuggcuugugguccugcucgugcugcugaccguuucccucagcccugugcagucugcucccaucgggagaaaaccucuguuuuccgacagcaucgucaagggaaugaagaaucuucugaacucuacaagccucgagacgucccugucuauugaagcccccuggggcgcgaucaaugugcagagcaccuucaaaccgacaauguccgccgcuaacauugcccuuagcuggucuuccguugagcaccgggggaauaagauccuggugagcggacgcucugaauccauuaugaaacucgaggaaagaaccggcaucagcuggaaccugggcgucgaggaugcuuccgagucuaagcugcucacagugagcgucauggaccugucccagauguacucuccuguguuugaauaucuuagcggggaucggcaaguugaggaauggcccaaagccaccuguacgggagacugcccugagagauguggcugcacauccagcaccugucugcacaaggaauggccccauucucgcaacuggcggugcaaucccaccuggugcuggggaguggggacaggcuguaccugcugugggcucgaugucaaggaccuguucacagauuacauguuuaucaaauggaagguggaguauauuaaaacggaggcgaucguuugcguggaacugaccucccaggagagacaguguacacuuauugaagccggcacccgcuucaaccucggaccugucacaaucacccugagcgagccgcggaauauucaacagaagcugcccccugagaucgugacgcuccaccccagaauugaagagggcuucuuugaccugaugcaugugcagaaaguucuuucugcuuccaccgucugcaagcugcagagcuguacacacggggugccuggagaucuccaaguguaccacaucggcaaccugcugaagggggacaaagucaauggacaucuuauccacaagauugaaccccauuucaacaccucuuggaugagcugggauggcugcgaccucgacuauuacuguaauaugggggauuggccguccugcacauauaccggcgugacgcagcacaaccaugccgcuuuuguuaauaugcugaacaucgagacagacuacaccaaaaauuuccacuuucacagcaagcgcgugacagcccauggagauaccccucagcuggaccucaaagcccggcccaccuacggcgcuggggaaauuacaguccugguggagguugcggauauggagcuucacacgaagaagaucgaaauuucuggacugaaauucgccucccucaccuguacaggcugcuaugcuugcagcuccgggaucucuuguaaggugagaauccaugucgacgagccugaugaacugaccgugcacguuaaaagcgaggaccccgaucugguggccgccuccucuagccuuauggcucgcaagcucgaauuuggaacagacuccaccuucaaagccuuuucugcgaugccuaagacgagccugugcuucuacauugucgagcgggaguauuguaaauccugcagcaaggaagauacacagaagugugugaacaccaaacuggagcaaccccagucuauccucauugaacacaagggcaccaucauugggaaacagaauaacacaugcaccgcuaaggccuccuguuggcuggagagcgugaaaucuuucuucuacggccuuaagaauaugcuguccggaaucuuuggcaacgucuucaucgggguuuuccucuuuuucgccccguuuauucugcugauccuuuucuuuauguucggauggcgcauucucuuuugcuucaaguguugcagacggacaagaggccuguuuaaauaucggcaucugaaggacgaugaagagacgggguaccgcaaaaucauugagagacucaacaauaagaaaggaaagaacaagcugcuugacggcgaacggcuggcugacagaaaaaucgccgagcucuuuagcaccaagacacacaucggg

SEQ ID NO: 13849 - RNA, 2916 nt, Artificial Sequence
  derived and/or modified CDS sequence (opt5) from CCHFV(BA88166, Artificial)__AF338470.1__Gn-4aa-Gc
agcgaggaauccggcgacgauugcaucucuagaacccagcugcuccggacagagacggccgaaauucacagcgacaacuacgggggacccggcgauaagaucaccauuuguaauggguccacaguggucgaccaacgccugggaucugagcuuggcugcuauaccaucaacagaguuaagagcuucaaacugugugaaaauuccgcuacagggaaaucuugcgagauugauagcaccccugugaagugucggcagggauuuugccucaaaaucacacaggagggccgcggccaugugaagcuguccagagggagcgaagucgugcuugacgccugugauucuuccugcgagaucaugauuccgaagggaaccggcgacauccugguugauuguagcgggggacagcaacacuuccucaaagacaaccugauugaucugggcugccccaauaucccucuccuggggaagauggcgauuuacaucugucggaugucuaaccaucccaaaacgaccaugggauuucuuuucugguuuuccuucggcuauguggucacaugcauucugugcaagggcaucuuuuaccuccugaucgugguugggacccuugggaaaaaguucaagcaguaucgcgaacugaaaccucagacauguaccauuugcgagacgacacccgugaaugcuaucgacgccgagaugcacgaucucaacuguagcuacaauauuugcccuuauugugccucuagacugaccuccgacggccuggcucggcaugucaugcagugcccgaagcgcaaagaaaagaucgaggaaacagagcucuaccugaaccuugaacggauucccuggguggugagaaaacugcuccaagucagcgaguccaccgggguugcccugaagcgcucuagcuggcuuguggugcugcucguccugcugaccgugucccucagcccuguucagucugcucccaucggaagaaaaccucuguaccuugacuccaucgugaagggcaugaagaaucugcucaacagcacaucucuggagacgagccuuuccauugaagcccccuggggagcgaucaauguccagucuaccuuuaaaccgacaaugagcgccgcuaacauugcccuguccuggagcucuguggagcaccggggaaauaagauccucguuuccggccgcagcgaaucuauuaugaaacuggaggaaagaaccggcaucuccuggaaccuggggguggaggaugcuagcgaguccaagcuccugacagucucugugauggaccuuagccagauguauuccccugucuucgaauaccugucuggagaucggcaaguggaggaauggcccaaagccaccuguacgggcgacugcccugagagaugugggugcacaagcuccaccugucuccacaaggaauggccccauagccgcaacuggcggugcaaucccaccuggugcuggggaguuggcacaggguguaccugcuguggccuggaugugaaggaccuguuuacagauuauauguucaucaaauggaaggucgaguacauuaaaacggaggcgaucgugugcguugaacuuaccucucaggagagacaguguacacucauugaagccggaacccgcuuuaaccugggcccugugaucauuacacuguccgagccgcggaauauccaacagaagcucccucccgagauugucacccugcaccccagaaucgaagagggguucuucgaccuuaugcaugugcagaaagugcugagcgcuucuacgguuugcaagcuccaguccuguacccacggagucccuggcgaucugcaaguguaucacaucgggaaccugcuuaagggagacaaagugaauggccaucucauucacaagaucgaaccccauuuuaacacaagcuggaugucuugggaugggugcgaccuggacuacuauuguaauaugggcgauuggccgagcugcaccuacacaggagucacccagcacaaccaugccgcuuucgugaauaugcugaacauugagacggacuacaccaaaaauuuucacuuccacuccaagcgcguuacagcccauggcgauacaccucagcucgaccugaaagcccggcccaccuauggggcuggagaaaucaccgugcuugucgagguggcggauauggagcugcacacaaagaagauugaaaucagcggccucaaauuugccucucugacguguaccgggugcuacgcuugcuccagcggaaucuccuguaagguucgcauucauguggacgagccugaugaacugacaguccacgugaaaucugaggaccccgauaucguugccgccagcuccucucuuauggcuagaaagcucgaguucggcaccgacagcacauuuaaagccuucuccgcgaugccuaagaccucucugugcuuuuauauuguggaacgggaguacuguaaaagcugcuccaaggaagauacgcagaagugugucaacacaaaacuggagcaaccccagagcauccucauugaacacaaggggaccaucaucggcaaacagaauaauaccugcacagcuaaggccucuuguuggcuggaguccgugaaaucuuucuuuuauggacuuaagaacaugcugagcggcauuuucgggaacguguuuaucggagucuuccucuucuuugccccguucauucugcugauccucuuuuucauguuuggcuggcgcauucuuuucugcuuuaaguguugcagacggaccagagggcuguucaaauaccggcaucugaaggacgaugaagagacaggauaucgcaaaaucaucgagagacucaacaauaagaaaggcaagaacaagcugcuugacggggaacggcuggcugacagaaaaauugccgagcucuuuuccacgaagacccacaucggc

SEQ ID NO: 13850 - RNA, 2916 nt, Artificial Sequence
  derived and/or modified CDS sequence (opt5) from CCHFV(BA66019, Artificial)__AF350448.1__Gn-4aa-Gc
agcgaggaauccggcgacgauugcaucucuagaacccagcugcuccggacagagacggccgaagugcacggggacaacuacggaggccccggggauaagauuaccaucuguaauggaagcacaauugucgaccaacgccugggcuccgagcuugggugcuauaccaucaacagaguuaaaucuuucaagcugugugaaaauagcggaacaggcaaauccugcaagauugauaaacauccugugaagugucggcagggcuuuugccucaagaucacccaggaggggcgcggacacgugaaacugucuagaggcagcgaggucgugcuugacgcuugugauuccagcugcgaaaucaugauuccgaaggggacaggagacauccugguugauuguucuggcgggcagcaacauuuccucaaagacaaccugguggaucugggaugccccaauauuccucuccugggcaagauggccaucuacauuugucggauguccaaccaccccaaaaccacgauggcguuucuuuucugguuuagcuucggcuaugucauuaccugcaucuuuugcaagaucaucuucuaccugcucauugugguugggacacugggaaagaaauuuaagcaguaucgcgagcuuaaaccucagaccuguacaaucugcgaaaccacgcccacaaaugcuauugacgccgagaugcaugaucugaaguguucuuacaacaucugcccuuauugugccuccagacucaccagcgacggccuggcucggcacgugacacagugcccgaaacgcaaggagaaagucgaagagaccgaacuguaccucaaucuggagcggauucccuggaucgugagaaagcuccugcaagugucugaauccaccggggucgcccucaagcgcagcuccuggcugaucguucuucuggugcuccugacagugucucugagcccuguccaguccgcucccauuggaagaaaaccucucuucagcgacucuaucgugaagggcaugaaaaaccugcuuaauuccacgagccuggagaccucucucagcauugaggcccccuggggagcgaucaacguucaguccacauuuaagccgaccgugucuacagccaauauugcucugagcugguccagcgucgaacaccgggggaacaaaauccuugugucuggccgcuccgagagcaucaugaagcuggaagagagaaccggcauuucuugggaucucgggguugaagacgccuccgagagcaagcugcugacgguguccgucauggaucucucucagauguacagcccuguguucgaguaucuguccggagaccggcaagucgaagaguggcccaaagcuacauguaccggcgauugcccugacagaugugggugcaccucuagcacaugucuucauaaggaauggccccacucccgcaauuggcggugcaaccccaccuggugcuggggagugggcacaggguguacgugcuguggccuggauguuaaagaccucuuuaccgauuacauguucgugaaguggaaagucgaguauaucaagacagaagccauugugugcguugagcugaacagccaggagagacaguguucucugaucgaagcgggaacccgcuucaaucuuggcccugugacaauuacccucuccgagccgcggaacauccaacagaagcugcccccugaaauuaucacgcugcaucccagaaucgaggagggguuuuucgaccucaugcacguccagaaagugcugagcgccucuaccgugugcaaacuucaguccuguacacacggaguuccuggcgaucugcaaauuuaccauaucgggaaucuccugaagggagaccgcgucaacggccaccugauucauaagaucgaaccccacuuuaauaccagcuggaugucuugggacgggugcgaucuugacuauuacuguaacaugggcgauuggccgagcugcacauauaccggagugacgcagcauaaucacgcugccuucgugaaccuccugaauauugagacagacuacaccaaaaacuuucacuuccauuccaagcgggucacagcucacggcgauaccccucagcuggaccucaaggccagacccaccuacggggccggagaaaucacagugcugguugagguggcugauauggaacuucauacgaaaaagaucgcgauuagcggccugaaauuugccucucucaccuguacagggugcuaugcuugcuccagcggaaucuccuguaagguccgcauucacguggacgagccugaugagcugaccguucacgugaaaucugaagaccccgauaucgucgccgccagcuccucucugauggcucggaaacuugaguucggcacagacagcaccuuuaaggccuucuccgcgaugccuaagacgucucucugcuuuuacauuguggaaagagaguauugugaaagcugcuccaaggaggauacacagaaauguguuaauaccaagcuggagcaaccccagagcauccugaucgaacauaaagggaccauuaucggcaagcagaacgacacaugcaccgcuaaagccucuuguuggcucgaguccgucaagagcuucuuuuacggacugaagaauaugcuuucuggcauuuucgggaacguguucaucggaauuuuucuguuccucgccccguuuauccugcugauccuuuucuuuauguucggcuggcgcauucucuuuugcuucaaauguugccggagaacacgggggcuguuuaaguaucgcuaccugaaagacgaugaagaguccggauauagacggaucauugaaagacucaauaacaagaaaggcaagaacaagcugcuugacggggagcgccuggcugaucggagaaucgccgagcuuuucagcacgaaaacccacauuggc

SEQ ID NO: 13851 - RNA, 2916 nt, Artificial Sequence
  derived and/or modified CDS sequence (opt5) from CCHFV(BA8402, Artificial)__AF350449.1__Gn-4aa-Gc
agcgaggaauccggcgacgauugcaucucuagaacccagcugcuccggacagagacggccgaaauucacaacgacaauuacgggggacccggcgauaagaucaccauuuguaacgggagcacaguggucgaccaacgccugggauccgagcuuggcugcuauaccaucaauagaguuaacucuuucaaucugugugaaaacacagcuaccgggaaaagcugcgagauugauuccacaccugugaagugucggcagggauuuugccucaaaaucacccaggagggccgcggccaugugaagcugucuagagggagcgaagucgugcuugacgccugugaguccagcugcgaaaucaugauuccgaaaggaacgggcgauauccugguugacuguucugggggacagcaacacuuccucaaggauaaucugauugaccugggcugccccaacaucccucuccuggggaagauggcgauuuacaucugucggauguccaaucaucccaaaaccacaauggcuuuucuuuucugguuuagcuucggauauguggugaccugcauucugugcaaggucaucuuuuaccuccugaucguugugggcacacuuggcaaaaaguucaaacaguaucgcgagcugaagccucagaccuguacgauuugcgagacaacccccgucaacgccaucgaugccgaaaugcacgaccucaauuguucuuacaacauuugcccuuauugugcuuccagaccgacaagcgaugggcuggcccggcaugugaugcagugccccaagcgcaaagagaagaucgaagagaccgcucuguaccucaaucuggaacggauuccuuggguggucagaaaacuucugcaaguuucugaguccaccggaguggcccucaagcgcagcuccuggcuggugguccuucuggugcuccugacaguuucucugagccccgugcaguccgcgccuaucggcagaaaaccccucuuuagcgacucuaucgucaaggggaugaaaaaccugcuuaauuccacgagccuggagaccucucucagcauugaagccccguggggagcuaucaacgugcaguccacauucaagccuaccguuucugccgcuaacauugcccugagcugguccagcguggagcaccggggcaauaagauccuugucucugggcgcuccgaaagcauuaugaaacuggaggaaagaacaggaaucucuugggaccucggcguggaggaugcguccgagagcaagcugcugaccgucuccgugauggaccucucucagauguacagccccguuuuugaauaucuguccggcgaucggcaaguggaggaauggccuaaagccacguguacaggggacugccccgagagauguggaugcaccucuagcaccugucuucacaaggaauggccccauucccgcaacuggcggugcaauccuacauggugcuggggcgucgggaccggauguacaugcuguggccuggaugugaaagaccucuucacggauuacauguuuaucaaguggaagguugaguauauuaaaaccgaggcuaucgugugcgucgaacugacaagccaggagagacaguguacccugauugaagccgggacacgcuucaaccuuggcccggugaccaucacgcucucugagccccggaauauucaacagaagcugccucccgagaucgugacccugcacccuagaauugaagagggauucuuugaccucaugcauguucagaaaguccuguccgcuagcacagugugcaaacuucagucuuguacccacggcgugcccggggaucugcaagucuaccacaucggaaaccuccugaaaggcgacaaggugaaugggcaucugauccacaagauugaaccgcauuucaacacauccuggaugagcugggauggaugcgaccuucacuauuacuguaauaugggcgacuggccuucuugcaccuauacggggguuacacagcauaaccacgccgccuuugugaauaugcucaacaucgagaccgauuacaccaaaaauuuccacuuucauagcaagcgcgucaccgcucacggcgacacaccccagcuggaucugaaagcgcggccuacauacggagccggcgaaauuacggugcucguugagguggcugacauggagcugcauaccaagaaaaucgaaauuuccgggcuuaaguucgccagccugacauguaccggaugcuaugccuguucuuccggcaucagcugcaaggucagaauccacguggaugagcccgacgaacucacaguucacgugaaauccgaggauccugacauugucgcugccucuagcucccugauggcgcgcaagcuggaauuugggaccgauucuacguucaaagccuuuagcgcuaugcccaagacaucccuuugcuucuacaucguggagcgggaguauugugaaucuugcagcaaagaggacacccagaagugugugaacaccaaacucgaacaaccgcaguccauucugaucgagcauaagggaacaauuaucggcaagcagagcaauaccugcacagccaaggcuucuuguuggcuggaauccgucaagagcuuuuucuacgggcucaaaaacaugcugucuggcaucuuuggaaacguuuucauuggcguguuccuguuuuucgccccuuuuauccuucucauucuguucuuuauguucggguggagaauccuguuuugcuucaaguguugccgccggacgagaggacuuuuuaaauaucggcaccucaaggaugacgaggagaccggcuaccgcaagauuaucgaaagacugaauaacaaaaaggggaaaaauaagcugcucgauggagagcggcuggcugacagaaaaaucgccgaacuuuucuccacaaagacccauauuggc

SEQ ID NO: 13852 - RNA, 2916 nt, Artificial Sequence
  derived and/or modified CDS sequence (opt5) from CCHFV(Matin, Artificial)__AF467769.2__Gn-4aa-Gc
agcgaggaauccggcgacgauugcaucucuagaacccagcugcuccggacagagacggccgaaauucacagcgacuccuacgggggacccggcgauaagaucaccauuuguaacgggucuacaguggucgaccaacgccugggaagcgagcuuggcugcuauaccaucaauagaguuaaauccuucaagcugugugaaaacucugcuacagggaaaagcugcgagauugauuccaccccugugaagugucggcagggauuuugccucaaaaucacacaggagggccgcggccaugugaagcugagcagagggucugaagucgugcuugacgccugugauuccagcugcgagaucaugauuccgaagggaaccggcgacauccugguugauuguucugggggacagcaacacuuccucaaagacaaucugauugaucugggcugccccaacaucccucuccuggggaagauggcgauuuacaucugucggauguccaaucaucccaaaacgaccaugguguuucuuuucugguuuagcuucggauaugucauuacaugcauccugugcaaggugaucuuuuaccuccugauuguugugggcacccuuggcaaaaaguucaagcaguaucgcgaacugaaaccucagacauguaccaucugcgagacgacacccgucaacgcuauugacgccgagaugcacgaucucaauuguucuuacaacaucugcccuuauugugccuccagacugaccagcgacgggcuggcucggcaugugaugcagugcccgaagcgcaaagaaaagauugaggaaacagagcucuaccugaaucuugaaagaauccccugggugguccggaaacugcuccaaguuuccgagucuaccggaguggcccugaagcgcagcuccuggcuugugguccugcucgugcugcugaccguuagccucucuccugugcaguccgcucccaucggcagaaaaccucuguuucuugacagcauuaucaaggggaugaagaaccugcucaauucuacaagccuggagacgucccuuucuauugaagcccccuggggagcgaucaacguccagagcaccuucaaaccgacaauguccgccgcuaauauugcccugagcuggucuuccguggagcaccggggcaacaagauccucguuagcgggcgcucugaauccaucaugaaacuggaggaaagaaccggaauuagcugggaucugggcguggaggacgcuuccgagucuaagcuccugacagucagcgugauggaucuuucccagauguacucuccugucuuugaauaucugagcggcgaccggcaaguggaggaauggcccaaagccaccuguacgggggauugcccugagagauguggaugcacauccagcaccugucuccacaaggaauggccccauucucgcaauuggcggugcaaccccaccuggugcuggggcguugggacaggauguaccugcuguggccuggacgugaaggaucuguucacagacuacauguuugucaaauggaagguggaguauaucaaaacggagguuauugugugcgucgaacuuaccucccaggagagacaguguagccucaucgaagcggggacacgcuucaaccugggcccugugaccauuacacugucugagccgcggaauauccaacagaagcugcccccugagauugugacccuccaccccagaaucgaagagggauucuuugaucuuaugcauguucagaaaguccuguccgccagcacggugugcaagcuccagucuuguacccacggcgugccuggggaccugcaagucuaccacaucggaaaccugcuuaagggcgauaaagugaaugggcaucucauucacaagaucgaaccccauuucaacacaagcuggauguccugggacggaugcgaccuggauuauuacuguaauaugggcgacuggccgagcugcucuuauaccgggguuacacagcacaaccaugcugccuuugugaauaugcuguccauugagaccgauuacacgaaaaacuuccacuuucacagcaagcgcgucacagcucauggcgacaccccucagcucgaucugaaagcccggcccacauacggagccggcgaaaucaccgugcuuguugagguggcugacauggagcugcacaccaagaagauugaaaucuccgggcucaaauucgcgucucugacauguacgggaugcuaugccugcagcuccggcaucucuuguaagguccgcauucauguggaugagccugacgaacugaccguucacgugaaaagcgaggaucccgacaucgucgcugccuccucuagccuuauggccagaaagcucgaauuugggacagauuccaccuucaaggcuuuuagcgccaugccuaagacaucucugugcuucuacauuguggagcgggaguauuguaaauccugcagcaaggaagacacccagaagugugugaauacgaaacuggagcaaccccagucuauccucauugaacacaagggaacaaucaucggcaaacagaacgauaccugcaccgcgaaggcuuccuguuggcuggagagcgucaaauccuuuuucuacgggcuuaagaauaugcugucuggcauuuuuggaaacguuuucaucggcauuuuccucuuucuggccccguucgcccugcuuauccucuuuuucauguuuggguggcgcauucuguucugcuuuaaguguugcagacggacaagaggacuguucaaauaucggcaucucaaggacgacgaagagaccggcuaccgcaaaaucaucgagagacugaauaacaagaaagggaagaauaaacuucuggauggagaacggcucgcugacagaaaaauugccgagcuguuuagcacaaagacgcacgugggc

SEQ ID NO: 13853 - RNA, 2916 nt, Artificial Sequence
  derived and/or modified CDS sequence (opt5) from CCHFV(Baghdad 12, Artificial)__AJ538197.2__Gn-4aa-Gc
agcgaggaauccggcgacgauugcaucucuagaacccggcugcuccgcacagagacggccgaaauucacggggacagcuacggaggccccggggauaagaucaccauuuguaacggauccacaaucguggaccagagacugggcucugagauggggugcuauaccauuaaucgggucaagagcuucaagcucugugaaaacuccgcuacaggaaaaucuugcaagaucgauagcaucccuguuaaaugucgccaaggcuacugccugaagauuacccaggagggcagagggcaugugaagcucucccggggaagcgaggugguccuggacgccugugauucuuccugcgaagugaugaucccgaaaggcacaggggacauucuuguugauuguagcggaggccagcagcacuuucugaaggacaaucucaucgaucuggggugccccaacauuccucugcucggaaaaauggcgaucuauauuugucgcaugucuaaucaucccaagaccacgauggcuuuccuguuuugguucuccuuuggcuacgugauuaccugcauccuuugcaaagccaucuucuaucugcucaucauugucggcacacuggggaagagauuuaagcaauaccgggagcuuaaaccucagaccuguacaaucugcgaaaccacgcccgugaacgccauugacgcugagaugcacgaucugaauuguagcuauaacaucugcccuuacugugccucucgccucacauccgacggacuggcuagacauguuacccagugcccgaagcggaaagagaagguggaagagacagaacuguaccucaaucuggagcgcauccccugggucgugagaaaacuucuucaggugagcgaauccaccggcgucgcccucaagcggucuagcuggcugauuguucuucuggugcuccuggcgguguccagcucuccuguccaauccgcccccaucgggcgcaaaccucuguuccucgacagcauugugaagggaaccaagaaccugcuuaauucuacaagccuggagacgucccucucuaucgaggcucccuggggcgccauuaacguucagagcaccuauaaaccgacaguguccaccgcuaauaucgcccugagcuggucuuccgucgaacacagagggaacaagauccuugugagcggacggucugaguccauuaugaaacuggaagagagaacaggcaucagcugggaucucggcguugaagacgcguccgagucuaagcugcugaccgugagcgucauggaucucucccagauguacucuccuguguuugaguaucugagcggggaccgccaggucgaagaguggcccaaagccacguguacaggagauugcccugaacgguguggcugcaccaccuccacaugucuucacaaggaguggccccauagcagaaauuggcgcugcaaccccaccuggugcuggggagugggaacaggcuguacgugcugugggcuggacguuaaggaucucuucaccgacuacauguuugugaaauggaaggucgaauauauuaaaacagaugcuaucgugugcguugagcugaccucucaagagcggcaguguucccugauugaagccggcacaagauucaaccuuggaagcgugaccaucacgcucucugagccucgcaauauucagcaaaagcugccgcccgaaaucaucacccugcacccucggauugaggagggcuuuuucgaccucaugcauguccagaaagugcuguccgcuagcacagugugcaagcugcagucuuguacccacgggguucccggagaucugcaggucuaccacaucggcaaccuccugaagggggacaaagugaauggacaucugauucacaagaucgaaccucauuucaacacaagcuggauguccugggacggcugcgaucuugacuauuacuguaauaugggggauuggcccagcugcaccuacacgggcgugacacaacacaaccaugccucuuuugucaaucuccugaacauugagaccgacuauacaaaauccuuccacuuucacagcaagagagugaccgcccauggagauaccccgcagcuggaccucaaaguucgcccuacauacggcgcuggggaaaucacggugcuggucgagguggcggauauggaacuucacaccaagaagaucgagauuuccggacugaaauucgccucucucacauguaccggcugcuaugcuugcagcuccgggaucucuuguaagguucggauucauguggacgagcccgaugaacugacaguccacgugaaaagcgacgauccugacguuguggccgccuccucuagccugauggcuagaaaacuugaguuuggaaccgauuccacguucaaagccuuuagcgcgaugcccaagacaucucucugcuucuacaucgucgaacgcgaguauuguaaauccugcagcaaggaagacacccagaagugugugaauaccaaacuggagcagccucaaucuauucugaucgagcacaagggcacaaucauugggaaacagaacaauaccugcacagcuaagacguccuguuggcucgaaagcgugaaauccuuuuucuacggccugaagaacaugcuuucuggaaucuuuggcaauuucuuuauggggauuuuccuguuccucgcccccuuuauccugcugauucuuuucuuuauguucggauggcggauccucuuuugcuucaaguguugcagacggacccgcggccuguuuaaauauagacaucugaaggacgaugaggaaacaggguaccggagaaucauugagcgccucaacaauaaaaaggggaaaaacaagcugcuugacggcgaacggcuggccgauagacgcaucgcugagcuuuucagcaccaagacacacauuggg

SEQ ID NO: 13854 - RNA, 2916 nt, Artificial Sequence
  derived and/or modified CDS sequence (opt5) from CCHFV(VLG/TI29414, Artificial)__AY179961.1__Gn-4aa-Gc
agcgaggaacccggcgacgauugcaucuccagaacccagcugcuccgggccgagccugcugaaauucacgacgauaacuacgggggaccgggcgacaagaucacaauuuguaaugggucuacgaucguggaucaacgccugggaagcgagcuuggcugcuauaccauuaacagagucaaauccuucaagcugugugaaaauucugccacagggaaaaccugcgagaucgacagcacacccguuaagugucggcagggauuuugccucaaaaucacccaggagggccgcggccaugugaagcuguccagagggucugaagugguccuugaugcgugugacagcuccugcgaggugaugauuccuaagggaacaggcgauauccugguugacuguagcgggggacagcaacacuuccucaaagauaaccugauugaccugggcugcccccauaucccucuccuggggaagauggcuauuuacaucugucggaugucuaaucacccccgcaccacgauggccuuucuuuucugguuuuccuucggauaugugauuaccugcaucuuuugcaaagcccuguucuacagccucaucauuaucggcacacugggcaagaaaauuaagcaguauagagaacuuaagccucagaccuguacaaucugcgagaccgcuccggucaacgccauugaugcugagaugcaugaccugaauuguucuuacaacaucugccccuauugugccucccggcucacgagcgacgggcuggcgcgccacgugccucagugccccaaaagaaaggaaaaaguugaggaaacagagcuguaccucaaucuggaacggaucccuuggaacgugcgcaaacuucugcaagucucugaguccaccggaguggcccucaagagaagcuccuggcugauugugcuucugguccuccugacaguuucucugagccccgugcaguccgcuccggugggccggaagccucucuuucuggauagcaucgucaaagggaugaagaaucuucugaacucuaccaaucucgagaccucccugagcauugaagcccccuggggagcuaucaacgugcagucuacauucaagccuacgguuagcaccgccaauauugcgcuuuccuggucuagcguggagcaccgcggcaacaaaauccuggucacagggagauccgaaagcaucaugaagcucgaggaacggaccggagugucuugggaccugggcguugaggaugccuccgagagcaaacugcucacagugucuauuauggaccugucccagauguacagccccgucuuugaauaucuuuccggcgauagacaaguggaggaauggcccaaggcuaccuguacgggggacugcccugagcgcuguggaugcacaucuagcaccugucugcauaaagaauggccgcacucccggaacuggagaugcaaucccaccuggugcugggaggucggcacaggguguaccugcuguggauggaacgugaaggaucucuucacagaccauauguuuguuaaguggaaaguggaguacaucaagacggaagccauugucugcguggagcugaccucucaggaacgccaguguagccugaucgaggcuggcacacgguucaaucuugggccuguuaccauuacacucuccgagcccagaaacauccaacagaaacugccucccgaaauuaucacccugcacccgaagguggaggaaggcuucuuugaucucaugcacguccagaaagugcugagcgccucuacggugugcaaacuucaguccuguacccauggaaucccuggcgaccugcaaguuuaucacauugggaaucuccugaagggagaucgcgucaacggccaucugauccacaagauugagccccauuucaauacaagcuggaugucuugggacgggugcgaccuugauuacuauuguaacaugggagacuggccuuccugcaccuacacaggcaugacccagcacaaucacgccgcuuuugugaaccuccugaauaucgaaacggauuauacaaagaccuuccauuuucacagcaaacgggugacagcgcauggggacacaccccagcuggaucucaaggccagaccuaccuacggcgcuggagagauuaccguccugguggagguugccgacauggaacuucacacgaaaaagguggagaucucuggccugaaguucgccagccucgcuuguaccgggugcuacgccugcuccagcggaaucucuuguaaaguccgcauucacguggaugaacccgacgagcugacaguucaugugaaguccaacgauccggacgucaucgcggcuagcaccucccugauggcccggaaacuugaauuuggcacagauucuaccuucaaggccuuuagcgcuaugccuaaaacgucccucugcuucuauauugccgagagagaguacuguaagucuugcagcgaagaggacacacagaaauguguggauaccaagcuggaacaaccccaguccauccugauugagcacaaggggaccaucaucggaaaacagaaugacacaugcaccgcuaaggccucuuguuggcucgaaagcguuaaauccuuuuucuauggccugaagaacaugcuugggagcguguuuggcaauuucuucauuggaauccugcucuuucuggcgcccuucguccugcuugugcucuuuuucauguuuggcuggaaaauucuguucugcuuuaaguguugccgccggacaagagggcugcucaaguaccggcugcuuaaagacgaugaggagacgggauaucgcagaaucauugaacggcugaacaacaagaaaggcaagaauagacuccuggacggggagcgccuggccgaucggaaaaucgcugaacuuuucucuaccaagacacauaucgga

SEQ ID NO: 13855 - RNA, 2916 nt, Artificial Sequence
  derived and/or modified CDS sequence (opt5) from CCHFV(TADJ/HU8966, Artificial)__AY179962.1__Gn-4aa-Gc
agcgaggaauccggcgacgauugcaucucuagaacccagcugcuccggacagagacggccgaaauucacggggacgauuacggaggccccggggacaagaucaccauuuguaacggaagcacaaucguggaucaacgccugggcuccgagcuugggugcuauaccauuaauagagucaaaucuuucaagcugugugaaaacagcgcuacaggaaagaauugcgagaucgacuccguuccugugaagugucggcagggcuacugccucaaaaucacccaggagggccgcgggcaugugaagcugucuagaggaagcgaagucgugcuugaugccugugacuccagcugcgagguuaugauuccgaagggcacaggggauaucucuguggacuguuccggaggccagcaacacuuucugaaagauaaccucauugaccuggggugccccaagaucccucugcucggaaaaauggcgauuuauaucugucggaugagcaaucaucccaagaccacgauggcuuuccuguuuugguucucuuuuggcuacgucauuacccgcauccuuugcaaagccaucuucuaucugcucauuaucgugggcacacuggggaagagauuuaagcaguaccgggaacuuaaaccucagaccugcacaauuugugagaccacgcccgccaacgcuaucgaugccgagaugcacgaccugaauugcuccuauaacauuuguccuuacugcgcuagccgccucacaucugacggacuggccagacauguuacccaguguccgaagcggaaagaacgcguggaggaaacagagcuguaccucaaucuggaaagaauccccuggaucguccggaagcugcugcaaguguccgagagcaccggcguggcgcucaaacgcuccucuuggcugauuguccuucugguucucuucaccgugagccuguccccugugcagagcgcccccaucgggagacggccucuguuucucgauucuauugucaagggaaugaaaaacccccuuaauuccacaagccuugagacgucucugagcaucgaagcuccguggggcgccauuaacgugcaguccaccuauaagccuacaguuucuaccgcuaauaucgcccucagcugguccagcaucgagcacagagggaacaauauucuggugucuggacgcuccgaaagcaucaugaaacuugaggaacggacaggcauuucuggcgaccugggggucgaggaugcguccgagagcaaacuccugaccguguccguuauggaccugucucagauguacagccccguguucgaauaucucuccggagauagacaagucgaggaauggccuaaggccacgugcacaggcgacugucccgagcgcugcggguguaccucuagcacaugccugcacaaagaauggccccauucccggaacuggagauguaacccuacauggugcuggggagugggcaccgggugcacauguugcggccuugaugucaaggaccuguuuaucgauuacauguucgugaaauggaagguugacuauauuaagacggaggcuaucgugugugucgagcucaccagccaggaacgccagugcucucugguggaggccggaacacgguuuaaucugggcccgguuaccauuacacuuuccgaacccagaaacauccaacagaaacucccucccgagaucauuacccugcacccucgcaucgaggaaggguucuucgaucugaugcaugugcagaagguccucagcgcuucuacgguguguaaacugcaguccugcacccacggagugcccggcgaccuucaaguuuaccacauugggaaucugcucaagggagacaaagagaacggccaucugauccacaagauugaaccgcauuuuaauacaagcuggaugucuugggaugggugugaccuggauuauuacugcaacaugggcgacuggccuagcuguaccuacacaggagucacccagcacaaucaugccuccuucgugaaccuucucaauaucgagacggauuauacaaagagcuuucacuuccacucuaaacgggugaccgcccauggcgacacaccccagcuggaucugaaggcuagaccuaccuacggggcgggagaaaucaccguccucguggagguugccgacauggagcugcacaccaaaaagauugaaaucacgggccuuaaauuugcuucccugaccugcacaggguguuaugccugcagcuccggaauuucuugcaaggugcgcauccaugucgaugagcccgacgaacucaccgugcacguuaagagcgaugacccugauguggucgccgcuuccucuagccugauggcccggaaacuggaguucggcacagacuccaccuuuaaggcguucucugcuaugcccaaaacgagccuuuguuuuuacauuguggaaagagaguaucggaaguccugcagcaaagaggacacacagaaguguguuaacaccaaacucgaacaaccgcagucuauccugaucgagcacaaggggaccauuaucggcaagcagaauaacacaugcaccgccaaagccuccuguuggcuggaaagcgugaagucuuucuuuuacggacucaaaaauaugcuguccggcauuuucgggaacgucuuugugggaaucuuccuuuuccuggcuccuuuuauucuccugauccuguucuuuauguucggcuggcgcauccuuagcugcuuuaaguguugcagacggacaagagggcuccugaaacaucgccaccugaaggaugacgaggaaacgggauaucggagaauuaucgagcgccucaauaacaagaaaggcaagaacaaacugcuugauggggagagacuggccgaccggcgcauugcugaacucuucucuaccaagacacauaucggc

SEQ ID NO: 13856 - RNA, 2916 nt, Artificial Sequence
  derived and/or modified CDS sequence (opt5) from CCHFV(Hodzha, Artificial)__AY223476.1__Gn-4aa-Gc
agcgaggaauccggcgacgauugcaucucuagaacccagcugcuccggacagagacggccgaaauucacggggacgauuacggaggccccggggacaagaucaccauuuguaacggaagcacaaucguggaucaacgccugggcuccgagcuugggugcuauaccauuaauagagucaaaucuuucaagcuguguaaaaacagcgcuacaggaaaguccugcgaaaucgacucuaccccuguuaaaugucggcagggcuacugccucaagaucacacaggagggccgcgggcaugugaagcugagcagaggauccgaggugguccuugaugccugugacagcucuugcgaagugaugauuccgaaaggcaccggggauauccugguugacuguuccggaggccagcaacacuuucucaaggauaaucugauugaccuggggugcccccggaucccucuccugggaaaaauggcgauuuauaucugucgcaugagcaaccaucccaagacgaccauggcuuuccuguuuugguucucuuuuggcuacgugauuacaugcauccuuugcaaagccaucuucuaucuccugauuaucgucggcacccuugggaagagauuuaagcaguaccgggagcugaaaccucagacauguaccauuugcgaaacgacacccgccaaugcuaucgaugccgagaugcacgaccucaacuguuccuauaauauuugcccuuacugugcuagccgccugaccucugacggacuggccagacaugugacacagugcccgaagcggaaagagaagguugaagagaccgaacucuaccugaaccuugagcgcauccccuggaucgugagaaaacugcuccaagucuccgaaagcaccggcguggcgcugaagcgguccucuuggcuuauugugcugcucguccuguucgccguuagccuguccccugugcagagcgcucccaucgggcgcagaccucucuuucuggauucuauugugaaaggaacaaagaaucuucugaacuccacgagccucgagaccucucugagcaucgaggcccccuggggcgcuauuaauguccaguccacauauaagccgaccgugucuacagccaacaucgcgcuuagcugguccagcguugaacaccgggggaauaaaauccuggugucuggaagauccgagagcauuaugaagcucgaggaacgcaccggcaucucuugggaccugggcgucgaagaugccuccgagagcaaacugcucacgguguccguuauggaccugucucagauguacagcccuguguucgaguaucuuuccggggaucggcaagucgaagaguggcccaaggcuacauguaccggagacugcccugaaagauguggcugcaccucuagcacaugucugcacaaagaguggccccauucccgcaacuggcggugcaaucccaccuggugcuggggagugggaacaggcuguacgugcugugggcucgaugucaaggaccuguuuaccgauuacauguucgugaaguggaaaguugacuauauuaagacagaagccaucgugugcgucgagcugaccagccaggagagacaguguucucuuguggaagcuggcacacgcuuuaaccucggaccuguuaccauuacgcuguccgagccgcggaacauccaacagaaacugcccccugaaauuaucacccuccaccccagaaucgaggagggcuucuucgaucugaugcaugugcagaagguccuuagcgccucuacagugugcaaacugcaguccuguacccacggggugccuggagaccuccaaguuuaccacauuggcaaucugcugaagggggacaaggucaacggacaucuuauccacaaaauugaaccccauuuuaauacaagcuggaugucuugggauggcugcgaccucgauuauuacuguaacaugggggacuggccgagcugcaccuacacgggcgugacacagcacaaucaugccuccuucgugaaccugcugaauaucgagaccgauuauacaaagagcuuucacuuccacucuaaacgcgucaccgcucauggagacaccccucagcucgaucugaaggcgcggcccacauacggcgccggggaaauuacggugcuuguugagguggcugacauggaacugcacaccaaaaagaucgagaucacaggacucaaguuugccucccugaccuguacaggcugcuaugccugcagcuccgggauuucuuguaaagucagaauccauguggaugagccugacgaacugaccguucacgucaagagcgaugaccccgaugugguggcugccuccucuagccuuauggcgcgcaaacucgaguucggaacggacuccacauuuaaggcuuucucugccaugccuaaaaccagccugugcuuuuacauuguugaacgggaguauuguaaguccugcagcaaagaagacacccagaagugugugaacacaaagcuggagcaaccccagucuauccucauugagagaaaaggcaccaucaucgggaagcagaauaacacaugcacggccaaggcuuccuguuggcuggaaagcgucaagucuuucuuuuacggccuuaaaaauaugcuguccggaauuuucggcaacguguuuguggggaucuuccucuuccuggccccguuuauucugcuuauccucuucuuuauguucggauggcggauucuguuuugcuucaaguguugccgcagaacccggggccuguuuaaguauaaacaccucaaggaugacgaggaaacaggguacagacgcaucaucgagcggcugaauaacaaaaaggggaaaaauaaacuucuggauggcgaaagacucgcugaccgcagaauugccgagcuguucagcaccaagacacauaucggg

SEQ ID NO: 13857 - RNA, 2916 nt, Artificial Sequence
  derived and/or modified CDS sequence (opt5) from CCHFV(Kosovo/9553/2001, Artificial)__AY675511.1__Gn-4aa-Gc
agcgaggaacccggcgacgauugcaucuccagaacccagcugcuccggacagagacggccgaaauucacgacgauaacuacgggggaccuggcgacaagaucaccauuuguaaugggucuacaaucguggaucaacgccugggaagcgagcuuggcugcuauaccauuaacagagucaaauccuucaagcugugugaaaauucugcuacagggaaaaccugcgagaucgacagcacaccgguuaagugucggcagggauuuugccucaaaaucacccaggagggccgcggccaugugaagcuguccagagggucugaagugguccuugaugccugugacagcuccugcgaggugaugauucccaagggaacgggcgauauccugguugacuguagcgggggacagcaacacuuccucaaagauaaccugauugaccugggcugcccucauaucccccuccuggggaagauggcgauuuacaucgcucggaugucuaaucacccuaaaaccacaauggccuuucuuuucugguuuucccugggauaugugauuaccuguauccucugcaaggcccuguucuacagccuuaucauuaucggcacacugggcaaaaagauuaagcaguaucgcgaacucaaaccccagaccugcacgaucugugagacagcuccugucaacgccauugaugcugagaugcaugaccugaauugcucuuacaacaucuguccguauugcgccuccagacugaccagcgacgggcucgcgcggcacgugaagcagugucccaaacgcaaggaaaaaguugaggaaacagagcuguaccuuaaucuggaaagaaucccuugggugguccggaagcuccugcaagugucugaguccaccggaguggcccuuaaacgcagcuccuggcugauuguccuccugguucugcucaccgugucucugagccccgugcaguccgcuccugucggcagaaagccccuuuuucuggauagcaucgugaaggggaugaaaaaccuccugaauagcacaucccuugagacgagccugucuauugaagccccguggggagcuaucaacguucagagcaccuucaagccuacaguguccaccgccaauauugcgcucucuuggagcuccgucgagcaccggggcaacaaaauccuggugacagggcgcagcgaaucuaucaugaagcuggaggaaagaaccggaguuuccugggaccucggcguggaggaugccagcgagucuaaacugcuuacggucuccauuauggaccugagccagauguacucccccguguuugaauaucucucuggcgaucggcaagucgaggaauggccuaaggcuacaugcaccggggacugucccgagagaugcggauguaccagcuccacaugccugcauaaggaauggccccacucucgcaauuggcgguguaacccuaccuggugcuggggcguggggacaggaugcacguguugcggcguugaugugaaagaccuguucaccgaucauauguuugucaaguggaaaguggaguacaucaagacagaggccauuguuuguguggaacuuaccagccaggagagacagugcucccucaucgaagcugggacacgcuucaaccugggcccggucaccauuacgcugagcgagccccggaauauccaacagaaacucccucccgagauuaucacccugcacccuaagaucgaagagggauuuuucgaccuuaugcacgugcagaaggugcugucugccuccacaguuuguaaacuccagagcugcacccauggcauucccggggaucugcaagucuaucacaucggaaaccugcuuaagggcgacagagugaaugggcaucucauucacaaaaucgaaccgcauuucaacacaucuuggauguccugggacggaugugaucuggacuacuauugcaauaugggcgauuggccuagcuguaccuacacgggggugacacagcacaaccacgccgcuuuugucaaucugcucaacauugagaccgacuauacaaagaccuuccauuuucacucuaaacgcgugaccgcgcauggcgauacaccccagcuggaccuuaaggcccggccuacguacggagcuggcgaaaucaccguucugguggaggucgccgauauggagcuccacacaaagaaaguggaaaucagcgggcugaaguucgccucccuggcuugcaccggauguuacgccugcagcucuggcauuuccugcaaaguuagaauccacguggacgagcccgaugaacuuacaguccaugugaagucuuccgacccugauguuguggcggcuucuaccagccucauggcccgcaaacuggaguuugggacggacuccacauucaaggccuuuucugcuaugcccaaaaccagccuguguuucuauauugucgaaaaggaguacugcaaguccuguucugaggaugacaccaaaaagugcguggacacaaaacucgaacagccgcaaagcauccugauugagcaccggggaaccaucaucggcaagccuaaugauacaugucccgccaaaacguccugcuggcuugaaagcgugaaguccuuuuucuaugggcugaagaacaugcucggcucugucuuuggaaauuucuuuauuggcauccugcuguuccuugcucccuucuuucucuggaugcugagcuucauguuuggguggaaaauucuguucuguuuuaagugcuguagacgcacccggggacucuucaaauacagacaucugaaggacgaugaggaaacaggcuaucggcgcaucauugagagacuuaacaauaaaaaggggaagaaccggcugcucgacggagagagacuggccgaucgcaaaaucgcggaacuguuuucuaccaagacacacaucggc

SEQ ID NO: 13858 - RNA, 2916 nt, Artificial Sequence
  derived and/or modified CDS sequence (opt5) from CCHFV(SPU41/84, Artificial)__AY900142.1__Gn-4aa-Gc
agcgaggaauccucugacgauugcaucagcagaacccagcugcuccggacagagacggccgaaauucacggcgacaacuacgggggacccggcgauaagaucaccauuuguaauggguccacaguggucgaccaacgccugggaucugagcuuggcugcuauaccaucaacagaguuaaaacauucaagcugugugaaaauagcgcuaccgggaaauccugcgagauugauucugugccugugaagugucggcagggauacugccucaaaaucacacaggagggccgcggccaugucaagcugagcagaggguccgaagugguucuugacgccugugauaccagcugcgaggugaugaucccgaagggaacgggcgacauucuggucgauuguucugggggacagcaacacuuucucaaagacaaccugaucgaucugggcugccccaagauuccucuccuggggaaaauggcgaucuauauuugucggauguccaaucaucccaagaccacaauggcuuuccuguuuugguucagcuuuggauacgugauuaccugcaucaucugcaaaguuaucuucuaucugcucauuaucgugggcacacugggcaagcgcuuuaagcaguacagagaacuuaaaccucagaccuguacgauuugcgagacaacccccgucaacgccaucgacgccgagaugcacgaucugaauuguucuuauaacauuugcccuuacugugcuucccggcucacaagcgacgggcuggcccgccaugugacccagugcccgaagagaaaagaaaagguggaggaaaccgagcuguaccucaaucuggaacggauccccugggucguucgcaaacuucugcaagugucugaguccacaggaguggcucucaagagaagcuccuggcuggucgugcuucugguucuccugacggugucucugagcccuguccaguccgcccccaucagccggcgcccucucuuccuggacucuauugugaaaggcaugaagaaccuucuuaauuccaccagccucgagacaucucugagcaucgaagcgcccuggggagccauuaacguucaguccaccuauaagccgacagugucuaccgcuaauaucgcccuuagcugguccagcgucgagcacagagggaacaaaauucuggugucuggccgguccgaaagcaucaugaagcucgaggaaagaacggggaucucuugggaucugggagucgaggacgcuuccgagagcaaacugcucacaguguccguuauggaucugucucagauguacagcccuguguuugaauaucuuuccggcgaccgccaagucgaggaauggcccaaggccaccuguaccggcgauugcccugagcggugugggugcacaucuagcaccugucugcacaaagaauggccccauuccagaaauuggcgcugcaaccccacauggugcuggggagugggcacgggguguaccugcuguggacucgacguuaaggaucuguucacagacuacauguuugugaaguggaaagucgaguauauuaagaccgaggcgaucgugugcguggaacugacaagccaggagcggcaguguucucuuauugaagccggcaccagauucaaccucgggccuguuacgaucacccuguccgagccgcgcaauauucaacagaaacugcccccugagaucauuacacuccacccccggaucgaagagggcuuuuucgaucugaugcauguccagaaggugcuuagcgcuucuaccgugugcaaacugcaguccuguacacacggagucccuggcgaccuccaaguguaccacaucgggaaccugcugaagggagauaagguuaauggccaucuugugcacaaaauugaaccccauuucaacaccagcuggaugucuugggacgggugcgaccucgauuauuacuguaauaugggagacuggccgagcugcacguacacaggcgucacccagcacaaccaugccuccuuugugaauaugcugaacaucgagacagauuauaccaagaauuuccacuuucacagcaaaagaguuaccgcucauggggacacaccucagcuggaucucaaggcccgccccacguacggcgccggagaaauuaccgugcuggucgagguggcugacauggagcuucacacaaagaagaucgaaauuucuggccugaaguucaccucccucacauguaccgggugcuaugcgugcagcuccggaaucucuuguaaaguucggauccauguggaugagccugacgaacugacgguccacgugaaaagcgaggaucccgacguggucgccgcuuccucuagccugauggccagaaaacuugaauuuggcacagauuccaccuucaaggccuuuucugcuaugccuaaaaccagccucugcuucuacauuguugagcgcgaguauuguaaguccugcagcgaagaggacacacagaaaugugugaacaccaagcuggaacaaccccagucuauccugauugagcggaaggggacaaucauuggaaaacagaauaacacgugcaaggccaaagcgggcuguuggcucgaauccgucaagagcuuuuucuacgggcugaaaaauaugcuuucuggcaucuuuggaaacguguucaucggcauuuuucuguuccucgcuccguucauccugcugauucucuuuuucauguuuggguggagaauccuuuucugcuuuaaguguugccggcgcaccagaggacuguucaaguaucggcaccugaaagaugacgaggagacaggcuacagaaagauuaucgaacgccucaauaacaaaaaggggaaaaacaagcugcuugacggagagcggcuggccgauagacgcaucgccgaacucuuuuccaccaagacacauauuggc

SEQ ID NO: 13859 - RNA, 2916 nt, Artificial Sequence
  derived and/or modified CDS sequence (opt5) from CCHFV(UG3010, Artificial)__AY900143.1__Gn-4aa-Gc
gccgagggcgugagcaacgacugcgucuccagaacccagcugaucaagacagaaguugcugagauucacgaagauucuuacgggggacccggcgagaaaaucacgauuuguaaugggagcaccaucguggaccaacggcucggauccgaacugggcugcuauacaauuaaccgcgugaagaccuacaaacuuugugagaauagcgccacagagaaggggugcgaaaucgauagcgucccugugaaauguaagcagggauucugccugaagguuacccaggagggcagaggccaugugaaacucucccgggggacagaaaucguccuggacgugugugauaccucuugcgagcuuaugauuccgaagggaacgggcgacauccugguugauuguagcgggggacagcaacacuuucuccaggacaaccugauugaucugggcugccccaaugugccucuccuggggaaaauggcgaucuauauuugucgcauguccaaccaucccaagaccacaauggcuuuccuguuuugguucagcuuuggauacgucauuaccugcaucgugugcaaagugcuguucuaucuccugaucgucaucggcacacuuucuaagaagcugaaacaguacagagagcucaagccucagaccuguauuguuugcgaauccacgcccgugaaugccaucgacgccgagaugcacgaacugaacuguaauuauaacauuugcccuuacugugcuagccggcugacaucugauggccucgugcgccaugucaaucaaugcccgaaaagaaaggagaaaguggaagagaccgagcuguaccuuaaccuggaacggauccccuggcucguucgcagacugcuucagguguccgagagcacagggauggcccugaagcggucuuguuggaugaccacccuccugauucugcucgucgugucccugagcccuguucaguccgcucccgugggacgcaaaccucuuuaucuggacucuaucgccaagggcaugaaaagccuccuuaauuccacaaaccuugaaacgagccugucuaucgaggcgcccuggggagccauuaauguccaguccaccuuuaagccgacagugagcgcugccaacaucgcucucucuuggagcuccgucgaacacagagggaacaagauucuggugucuggccggagcgaguccaucaugaaacuggaggaacgcaccgggauuagcuggucucucggaguugaggaugccuccgaaagcaagacacugaccgugucugucauggaccuuucccaaauguacagcccuguguucgaguaucuguccggcgacagacagguugaagaguggcccaaagcgacgugcacaggcgauugucaggagcggugcggguguaccucuucuaccugccuccacaaggaauggccucauuccagaaauuggcgcugcaaccccacaugguguuggggagugggcaccgggugcacauguugcggacuggacguccgggaucuguuuacggacuacaugauggugaaguggaaaguggaguauguuaagaccgaagccaucaugugugucgagcuuacaucucaagagagacagugcagccucaucgaagcuggcacccgcuucaaucuggggcccgugacaauuacccuguccgagccucggaacauccagcagagacucccgagcgaaauugugacgcugcaccccaaaaucgaggaaggcuuuuucgaucuuaugcauguccaaaaggugcugucugccuccaccguuuguaaacuccagagcugcacacacggagugccuggcgaccugcaggucuaccacguggggaaucugcuuaagggagauaagguuaacggccauucuauucacaaaaucgagucccauuuuaauaccagcuggaugucuugggacgggugugaucucgacuauuucugcaacaugggagauuggcccagcuguacauacaccggcgugacgcagcacaaucgcgcugccuucauuaacaugcugaauaucgagacagacuacaccaagacauuucauuuccacuccaaacgggucaccgcccacggggacaccccucaacuggaucucaaggcuagacccacauauggcgcgggagaagugacgguucugguggaggucgccgaccuugaacugcauaccaaaaagaucgaggugagcggccucaaguuugcuucucugacaugcuccgggugcuacgccuguagcuccggaauuucuugcaaagugcgcauccacgucaacgaaccggaugaguucaccguucaugucaagagcuccgacccugaugugguggccgcuggcucuagccugauggcccggaaaauugaguuuggggcggacuccacauucaaggcuuuuucuagcaugcccaaaaauucccuuuguuucuauaucguggaaagagauuacugcagcucuuguaccaacgacgauacgcagaagugcguugacacaaaacucgagcacccucaguccauucugaucgaacacaagggaaccaucauuggcaagcagaaugauaccuguagcacaaaaaccucuugcuggcuggaguccgucaagagcuuuuucuaugggcucaaaaacaugcugggcggaaucuuuggcaacguguuccuugggauuuuucuguuccucgcccccuucgcccugcugaucuuuuucuuuuucuuuggauggcgccuucucuucugucugaagugcugucggagaacacggggccugcucaaauacaagcaacugaaggacgaagaggaggcuggguauaaaaagauuaucgaacgccuuaaugauaaaaagggaaaaucuagacuguuugacggcgagcggcucgccgacagaaagaucgcugaacuguucuccacgaagacccauauuggg

SEQ ID NO: 13860 - RNA, 2916 nt, Artificial Sequence
  derived and/or modified CDS sequence (opt5) from CCHFV(Hy13, Artificial)__AY900145.1__Gn-4aa-Gc
agcgaggaauccggcgacgauugcaucucuagaacccagcugagccggacagagacggccgaaauucacuccgacaacuacgggggacccggcgauaagaucaccauuuguaaugggucuacaaucguggaccaacgccucggaagcgagcugggcugcuauaccauuaacagagucaaauccuucaagcugugugaaaauucugcuacagggaaaagcugcgagaucgauuccaccccuaucaagugucggcagggauuuugccugaaaauuacacaggagggccgcggccauguuaagcucagcagagggucugaaguggugcuggacgccugugauuccagcugcgagaucaugauuccgaagggaaccggcgacauccuugucgauuguucugggggacagcaacacuuccugaaagacaaccucauugaucugggcugccccaauaucccucugcucgggaagauggcgauuuacaucugucggauguccaaccaucccaaaacgaccauggcuuuucuguucugguuuagcuucggauaugugaucacaugcauucuuugcaagguuaucuuuuaccugcucauuguggucggcacccugggcaaaaaguucaagcaguaucgcgaacuuaaaccucagacauguaccaucugcgagacgacacccgugaaugccauugacgccgagaugcacgaucugaacuguucuuacaauaucugcccuuauugugcuuccagacucaccagcgacgggcuggcccggcauguuaugcagugcccgaagcgcaaagaaaagguggaggaaacagagcuguaccucaaccuggaaagaauccccugggucgugcggaaacuucugcaaguguccgagucuaccggagucgcucucaagcgcagcuccuggcugguugugcuucuggugcuccugaccgucagccugucuccugugcaguccgcccccauuggcagaaaaccucucuuuagcgacucuaucguuaaggggaugaagaaucugcuuaacagcacaucccuggagacgucucucagcauugaagcgcccuggggagccaucaaugugcaguccaccuucaaaccgacagucagcgcugccaacauugcucugucuugguccagcguggagcaccggggcaauaagauccuuguuucugggcgcuccgaaagcaucaugaaacuggaggaaagaaccggaauuuccugggaucucggcguggaggacgccucugagagcaagcugcugacagucuccaucauggaucucucucagauguacagcccuguguuugaauaucuguccggcgaccggcaagucgaggaauggcccaaagcgaccuguacgggggauugcccugagagauguggaugcacaagcucuaccugucuucacaaggaauggccccauucccgcaacuggcggugcaaccccaccuggugcuggggcguggggacaggauguaccugcuguggccuggacguuaaggaucucuucacagaccacauguuugugaaauggaaggucgaguacauuaaaacggaggccaucgugugcguugaacugaccagccaggagagacaguguucucugauugaagcugggacacgcuucaaucuuggcccugugaccaucacacucuccgagccgcggaacauucaacagaagcugcccccugagaucgucacccugcaucccagaaucgaagagggauucuuugaucucaugcacgugaaaaaggugcugagcgccucuacgguuugcaaacuucagagcuguacccacggcgucccuggggaccuucagguguaucauauuggaaaucuccugaagggcgauaaggugaacgggcaccugauccauaaaauugaaccccacuucaauacauccuggaugagcugggacggaugcgaccuugauuacuauuguaacaugggcgacuggccgucuugcuccuacaccggggucacacaacauaaucacgcugccuuugugaacaugcucaauaucgagaccgauuauacgaagauuuuccacuuucauagcaaacgcguuacagcccacggcgacaccccucagcuggaucugaaggcucggcccacauacggagcgggcgaaaucaccgugcucgucgagguggccgacauggagcugcauaccaagaaaaucgaaauuuccgggcuuaaguucgcuucucugacauguacgggaugcuacgccugcagcuccggcaucucuuguaaaguucgcauucacguggaugagccugacgaacucaccguccacguuaagagcgaggaucccgacaucguggccgcuuccucuagccugauggccagaaaacuggaauuugggacagauuccaccuucaaggcguuuagcgcuaugccuaaaacaucucuuugcuucuauauuguggagcgggaguacuguaaguccugcagcaaggaagacacccagaaaugugucaacacgaagcucgagcagccccaaucuauccugaucgaacauaaaggaacaauuaucggcaagcagaaugauaccugcaccuccaaagccggguguuggcuggagagcgugaaguccuuuuucuauggccucaagaacaugcugucuggaauuuuuggcaauguguucaucgggauuuuccuuuuucuggccccguucauccuccugauccuguuuuucauguuuggauggcgcauucuuuucugcuuuaaauguugcagacggacaagaggccucuucaaguaccggcaccugaaagacgacgaagagaccggguaucgcaagaucauugagagacugaacaauaaaaagggaaagaacaaacuccuggauggcgaacggcuugcugacagaaagaucgccgagcuguuuagcacaaaaacgcauauuggg

SEQ ID NO: 13861 - RNA, 2916 nt, Artificial Sequence
  derived and/or modified CDS sequence (opt5) from CCHFV(Semunya, Artificial)__DQ094832.1__Gn-4aa-Gc
gccgagggcgugagcaacgacugcgucuccagaacccagcugaucaagacagaaguugcugagauucacgaagauucuuacgggggacccggcgagaaaaucacgauuuguaaugggagcaccaucguggaccaacggcucggauccgaacugggcugcuauacaauuaaccgcgugaagaccuacaaacuuugugaaaauucugccacagagaaggggugcgagaucgauagcgucccugugaaauguaagcagggauucugccugaagguuacccaggagggcagaggccaugugaaacucucccgggggacagaaaucguccuggacgugugugauaccucuugcgagcuuaugauuccgaagggaacgggcgacauccugguugauuguagcgggggacagcaacacuuucuccaggacaaccugauugaucugggcugccccaaugugccucuccuggggaaaauggcgaucuauauuugucgcauguccaaccaucccaagaccacaauggcuuuccuguuuugguucagcuuuggauacgucauuaccugcguggugugcaaaguccuguucuaucuccugaucguuaucggcacacuuggcaagaagcugaaacaguacagagagcucaagccucagaccuguaucgugugcgaaucuauucccgugaaugccaucgacgccgagaugcacgaacugaacuguaauuauaacauuugcccuuacugugcuucccggcugacgagcgaugggcucguccgccaugugacacaaugcccgaaaagaaaggagaaaguugaagagaccgagcuguaccuuaaucuggaacggauccccuggcucgugcgcagacugcuucaggucucugaguccacaggaauggcccugaagcggagcuguuggaugaccacccuccugauucugcucgugguuucucuguccccugugcagagcgcucccgucggccgcaaaccucuuuuucuggacuccaucgccaaggggaagaaaucucuccugaacagcacaaaucuugaaacgucccugagcaucgaggcgcccuggggagccauuaacgugcagucuaccuucaagccgacagucuccgcugccaauaucgcucucagcuggucuagcguggaacacagaggcaacaaaauucugguuuccgggcggucugagagcaucaugaagcuggaggaacgcaccggaauuuccuggagccucggcguggaggaugccucugaauccaaaacacugaccgucagcgugauggaccuuucucaaauguauuccccuguuuuugaguaccugagcggcgacagacagguggaagaguggcccaaggcgacgugcacaggggauuguccugagcggugcggauguaccuccucuaccugccuccacaaggaauggccccauagcagaaacuggcgcugcaaucccacaugguguuggggcgucgggaccggaugcacauguugcggccuggacgugcgggaucuguucacggacuauaugauggugaaauggaagguugaguacgucaaaaccgaagccaucauguguguggagcuuacaucccaggagagacaaugcucucucaucgaagcugggacccgcuuuaaccugggcccugugacaauuacccugagcgagccgcggaauguccagcagagacuccccuccgaaaucgugacgcugcacccuaagauugaggaaggauucuuugaucuuaugcauguucagaaagugcuguucuguaaguauagccuccaagccaccucuugcacacacggcguccccggggaccuucagguguaccacguuggaaaccugcuuaagggcgauaaagugaaugggcauuccauccacaagauugagagccauuucaacaccucuuggauguccugggacggaugugaucucgacuauuuuugcaauaugggcgauuggccuagcuguacauacaccggggucacgcagcacaaccgcgcugccuucgugaauaugcugaacaucgagacagacuacaccaaaacauuucauuuccacucuaagcggguuaccgcccacggcgacacaccccagcuggaucucaaagcuagaccgaccuauggagcgggcgaagugacgguccugguggagguggccgaccuugaacugcauaccaagaagauugaggucagcgggcucaaauuugcuucccugacaugcagcggaugcuacgccuguucuuccggcaucagcugcaagguucgcauccacgugaaugaaccugaugaguucaccgugcaugucaaauccaacgaccccgaugugguugccgcugggucuagccugauggcccggaagauugaguuuggagcggacuccacauucaaggcuuuuucuagcaugccuaaaaauucccuuuguuucuauaucguggaaagagauuacugcucuagcuguaccgacgaugacacgcaaaaaugcgucaacauuaagcucgagcacccccaguccauccugauugaacacaagggcacaaucaucgggaaacagaaugauaccuguccuaccaagacaagcugcuggcuggagucugugaaauccuuuuucuauggccucaagaacaugcugggaggcauuuuugggaacguuuuccuuggaaucuuccuguuucucgcccccuucgcccugcugauucucuuuuucuuuuucggcuggcgccuucuguuuugucugaaaugcugucggagaacccgggggcuccugaaguacaagcagcuuaaagacgaagaggaggcuggauauaagaaaaucauugaacgccugaaugauaagaaaggcaagagcagacucuucgacggggagcggcuggccgacagaaagaucgcuaaacuguuuucuacaaagacgcauaucggc

SEQ ID NO: 13862 - RNA, 2916 nt, Artificial Sequence
  derived and/or modified CDS sequence (opt5) from CCHFV(SPU128/81/7, Artificial)__DQ157174.1__Gn-4aa-Gc
agcgaggaacccuccgacgauugcaucucuagaacccagcugcuccggacagagacggccgaaauucacggcgacaacuacgggggaccuggcgauaagaucaccauuuguaaugggagcacaaucguggaccagcgccugggauccgagcuuggcugcuauaccauuaacagagucaaaucuuucaagcugugugaaaauagcgcuacagggaaauccugcgagaucgagucuguuccggugaagugucggcagggauacugccuccgcaucacccaggaaggcagaggccaugugaaacugagccggggguccgaggucgugcuugaugccugugacacaagcugcgaaauuaugauccccaagggaaccggcgauauucugguugacuguucugggggacagcaacacuuucucaaggauaaccugaucgaccugggcugcccuaaaauuccccuccuggggaagauggcgaucuauauuugucgcauguccaaucauccuaaaacgaccauggcuuuccuguuuugguucagcuuuggauacgugaucacaugcauccugugcaaggccauuuucuaucuccugaucauuaucggcacccuuggcaaaagauuuaagcaguaccgggagcugaagccccagacauguaccauuugcgagacgacaccugucaacgccaucgaugcugaaaugcacgaccucaauuguucuuauaacaucugcccguacugugccucccgccugaccagcgaugggcuggcuagacaugugacacagugccccaaacggaaggagaaaguugaagagaccgaacucuaccugaaucuugagcgcauuccuuggguggucagaaagcugcuccaagugucugaguccaccggaguggcccugaaacggagcuccuggcuuaucguccugcucguucuguucacagugucucugagccccgugcaguccgcgccuauuggccgcaagccccucuuucuggacagcaucgucaaagggaugaagaaccuucuuaauucuacgucccucgaaaccagccugucuauugaggccccguggggagcuaucaacgugcagagcacauauaagccuaccguuuccacagccaauaucgcucuuucuuggagcuccguggaacacagaggcaacaaaauucuggucagcgggcggucugaguccaucaugaagcucgaagagagaaccggaauuagcugggaccugggcguggaggaugccucugaauccaaacugcucacgguuagcgugauggaccugucccagauguacucucccgucuucgaguaucuuagcggcgaucgccaaguggaagaguggccuaaggcgacauguaccggggacugccccgaacgguguggaugcaccuccucuacaugucugcacaaagaguggccccauagcagaaauuggcgcugcaacccuaccuggugcuggggcgucgggacaggauguacgugcuguggccucgaugugaaggaccuguuuaccgauuacauguucguuaaguggaaaguggaguauaucaagacagaagccauugucugcguggagcugaccucccaggaacggcaguguagccuuaucgaggcugggacaagauuuaaccucggcccgguuaccauuacgcugucugagccccgcaauauccaacagaaacugccucccgaaaucauuacccuccacccucggaucgaggaaggauucuucgaccugaugcaugugcagaagguccuuuccgccagcacagugugcaaacugcagucuuguacccacggcgugcccggggaucuccaaguuuaccacauuggaaaccugcugaagggcgacaaggucaaugggcaucuuauccacaaaauugagccgcauuuuaacacauccuggaugagcugggauggaugcgaccucgacuauuacuguaauaugggcgauuggccuucuugcaccuacacgggggugacacagcacaaccaugcuagcuucgugaaucugcugaacaucgaaaccgacuauacaaagaauuuucacuuccacuccaaaagagucaccgcccauggcgauacaccccagcucgaccugaaggcccgcccuaccuacggagcuggcgagaucacggugcuuguugagguggcggauauggaacugcacaccaaaaagauugagaucagcgggcucaaguuugccucucugacauguaccggaugcuaugcuugcuccagcggcauuuccuguaaaguccggauccauguggacgaacccgaugagcugacaguucacgugaagucugacgauccugacgucguggccgccagcuccucucuuauggcuagaaaacucgaguucgggaccgauagcacguuuaaggccuucuccgcgaugcccaaaacaucucugugcuuuuacauuguugaacgcgagcacuguaagagcugcuccgaagaggacaccaaaaagugugugaacaccaagcuggaacagccgcaaagcauccucaucgagcauaaaggaacaauuaucggcaagcaaaauucuaccugcacagcuaaagccuccuguuggcuggaaagcgucaagucuuucuuuuaugggcuuaaaaacaugcuguccggcauuuucggaaauguguuuaucggcauuuuccucuuccuggggccuuuuauccugcuuauccucuucuuuauguucggauggcggauucuguuuugcuucaaguguugcagacggacgcgcggccugcucaaguacagacaccugaaagaggaugaggaaaccggguaucggagaaucauugagcgccuuaacaauaagaaaggaaagaacaaacugcucgacggcgaacggcuggccgacagacgcaucgcugagcuguuuagcacaaagacccauauuggg

SEQ ID NO: 13863 - RNA, 2916 nt, Artificial Sequence
  derived and/or modified CDS sequence (opt5) from CCHFV(ROS/HUVLV-100, Artificial)__DQ206448.1__Gn-4aa-Gc
agcgaggaacccggcgacgauugcaucuccagaacccagcugcuccggacagagacggccgaaauucacgacgauaacuacgggggaccuggcgacaagaucaccauuuguaaugggucuacaaucguggaucaacgccugggaagcgagcuuggcugcuauaccauuaacagagucaaauccuucaagcugugugaaaauucugcuacagggaaaaccugcgagaucgacagcacaccgguuaagugucggcagggauuuugccucaaaaucacccaggagggccgcggccaugugaagcuguccagagggucugaagugguccuugaugccugugacagcuccugcgaggugaugauucccaagggaacgggcgauauccugguugacuguagcgggggacagcaacacuuccucaaagauaaccugauugaccugggcugcccucauaucccccuccuggggaagauggcgauuuacaucugucggaugucuaaucacccucgcaccacaauggcuuuucuuuucugguuuuccuucggauaugugauuaccugcaucuuuugcaaagcccuguucuacagccucaucauuaucggcacacugggcaagaaaauuaagcaguauagagaacuuaagccccagaccuguacgaucugcgagacagccccugucaacgcuauugaugccgagaugcaugaccugaauuguucuuacaacaucugcccguauugugcuucccggcucaccagcgacgggcuggcccgccacgugccccagugcccuaaaagaaaggaaaaaguugaggaaacagagcuguaccucaaucuggaacggauccccuggauugugcgcaagcugcugcaagucucugaguccaccggaguggcgcucaaaagaagcuccuggcugaucgugcuucugguccuccugaccguuucucugagcccugugcaguccgcccccgugggccggaagccgcucuuucuggauagcauugucaaagggaugaagaaccuucuuaauucuacaucccucgagacgagccugucuaucgaagcuccuuggggagccauuaacgugcagagcaccuucaagcccacaguuuccaccgcuaauaucgcccuuucuuggagcuccguggagcaccgcggcaacaaaauccuggucacagggagaagcgaaucuauuaugaagcucgaggaacggaccggaguguccugggaccugggcguugaggaugcgagcgagucuaaacugcucacgguguccaucauggaccugagccagauguacuccccugucuuugaauaucuuucuggcgauagacaaguggaggaauggcccaaggccacauguaccggggacugccccgagcgcuguggaugcaccagcuccacaugucugcauaaagaauggccucacucucggaauuggagaugcaacccgaccuggugcuggggcgucgggacaggauguacgugcuguggcguggauguuaaggaccucuucaccgaucauauguuugugaaguggaaagucgaguacauuaagacagaggcuaucgugugcguugaacugaccagccaggagcgccaguguucccugauugaagccgggacacgguucaaccuuggccccgugaccaucacgcucagcgagccuagaaauauucaacagaaacugcccccugagaucaucacccugcaccccaaggucgaagagggauucuuugaccucaugcacgugcagaaagugcugucugcuuccacaguuugcaaacuucagagcuguacccauggcauuccgggggaucugcaagucuaucacaucggaaaccuccugaagggcgaccgcgugaaugggcaucugauucacaaaaucgaaccucauuucaacacaucuuggauguccugggacggaugcgaucuugacuacuauuguaauaugggcgauuggcccagcugcaccuacacgggggugacacagcacaaccacgccgccuuugucaaucuccugaacauugagaccgacuauacaaagaccuuccauuuucacucuaaacgggugaccgcucauggcgauacaccucagcuggaccucaaggcgagacccacguacggagccggcgaaaucaccguucugguggaggucgcugauauggagcuucacacaaagaagguggaaaucagcgggcugaaguucgccucccucgccuguaccggaugcuacgcuugcagcucuggcauuuccuguaaaguucgcauccacguggacgagccugaugaacugacaguccauguuaagagcuccgaccccgaugugguggccgcgucuaccagccugauggcucggaaacuugaguuugggacggacuccacauucaaggccuuuucugccaugccgaaaaccagccucugcuucuauauugucgaaagagaguacuguaaguccugcucugaggaagauacccagaaauguguggacacaaagcuggagcaaccucagagcauccugauugaacacaagggaaccaucaucggcaaacagaaugacacaugcacggcuaaggccuccuguuggcucgagagcgugaaauccuuuuucuaugggcugaagaacaugcuuggcucugucuuuggaaauuucuucauuggcauccugcucuuucuggcucccuucguucugcuugugcucuuuuucauguuuggguggaaaauucuguucugcuuuaaguguugccgccggaccagaggacugcucaaguaccggcugcuuaaagaugacgaagagacaggcuaucgcagaaucauugagcggcugaacaauaagaaagggaagaacagacuccuggauggagaacgccuggccgaccggaaaaucgcggagcuuuucagcaccaagacacauaucggc

SEQ ID NO: 13864 - RNA, 2916 nt, Artificial Sequence
  derived and/or modified CDS sequence (opt5) from CCHFV(AP92, Artificial)__DQ211625.1__Gn-4aa-Gc
agcgagggcggggacggaggcugcaucuccagaacccagcugauuaagacagaaacggccgaggugcacggggaugacuacggaggccccggggagaaaaucaccauuuguaacggaucuacaaucgucgaucaacggcucggcagcgagcugggcugcuauaccauuaaucgcaucaaguccuucaaacuuugugaaaacucugcucaggggaagaauugcgagaucgacagcgccccuguucaguguagacagggauacugccugaaaauuucccaagagggccgggggcaugugaagcucucucgcggaagcgaaaucgugcuggaugucugugacacauccugcgagauuaugaucccgaagggcaccggggauauucuuguggacuguagcggaggccagcagcacuuucugcagucuaaccucguugaucugggcugccccaauaucccucugcucgggaaaauggcgauuuauaucuguagaauguccaaccaucccaagacaaccauggcuuuccuguuuugguucagcuuuggauacgugaucacgugcauucuuugcaaaacccuguucuauauccucauuaucauuggcacacuggggaagaaacuuaagcaauaccgggaacugaagccucagaccuguacaaucugcgagucuguccccgugaaugccaucgacgccgagaugcacgaucucaacuguuccuauaauauuugcccuuacugugcuagccgccugaccucugaaggacugacgagacauguuaaccagugcccgaaacggaaggagaaaguggaagagacagaacucuaccugaaucuugagcgcauccccuggauugucagaaagcugcuccagguguccgagagcaccggcguggcccugaaacgguccucuuggaugaucguccuucugauucuccugaucguuagcauguccccugugcaaagcgcucccaucucucgcaagccucuguuucucgacuccauugccaaaggggugaagaaccugcuuaauagcacaucucuggaaaccagccucuccaucgaggcgcccuggggagccauuaacgcucagucuaccuauaagccgacagccagcuccgcuaauaucgcccugacguggagcucugucgaacacagaggcaacaaaauucuuguguccggccggagcgagucuaucaugaagcuggaagaacgcaccgggauuuccuggaaccucggaguugaggaugcgagcgaauccagaacacugaccaucucugugauggaccugagccagauguacuccccugucuucgaguaucucucuggcgaccggcaaguggaagaguggcccaaagccacauguaccgggaauugcccugaaagauguggaugcacgagcuccacaugucuguacaaggaguggccccacagccgcaacuggcggugcaaucccaccuggugcuggggcguugggaccggcuguacaugcuguggacuugaugugaaagagcuguuuaccgaccauaugcucgucaaguggaagguggaauauaucaaaacagaggcuauugucugcguggaacugacgucucaggagagacaguguucccugaucgaggccggcacccgcuucagccuugggccuguuacaauuacccucucugaaccgcggaacauccagcaaaagcugcccccugagcugauuacacuccaccccaaaaucgaagauggauacuuugaccugaugcaugugcagaaggucauguccgcuagcaccgugugcaaacuucagucuuguacgcacggcguuccuggggaucugcagaucuaucacgugggaaaucuccugaagggcgacagagucaacgggcaucugauucacaagguggagccccaucuuaauaccagcuggauguccugggauggcugcgaccucgauuacuucuguaacaugggagacuggccgagcugcacauacaccggcgugacacaacacaaucaugccgccuuugcuaaccugcugaauaucgaaaccgauuauacgaaaacauuccacuuccacucuaagcgcguuaccgcgcauggggacacaccucagcucgaccugaaagcccggcccagauacggagcuggcgagauuaccguccuuguggagguggccgauauggaacugcacaccaagaaagucgaggugacagggcucaaguuugccucccugacguguagcggaugcuaugcuugcuccucuggcaucagcuguaagguucgcauucauguggacgaaccugaugagcugaccguccacgugaaauccucugaccccgauaucguugccgcgagcuccucucuuauggcucggaagaucgaauuugggguggacagcacauuuaaagccuucuccagcaugccuaaggauucucucugcuuuuacauugucgagagagacuauuguaacuccugcaaaaaugaggaaacccagcgcugugugaacgccaagcuggagcagccccaaagcauccugauugaacacacaggcaccaucauuggaaaacagaaugauacgugcggcucucggacauccuguuggcucgacagcuucaagucuuucuucuacgggcugaaguccaugcuuagcggaaucuuuggcaacguuuuccuggggaucuuucucuuccuggcuccguuugcccugcuucucuucuucuuuuucuuuggauggcggauucuguucugcuuuaaauguugcagacgcaccagaggccuguucaaguaucggcauaucaaagaugacgaggaagugggguacaagaaaauuaucgagagacucaacaauaagaagggcaaacaccgccugcuugauggagagcggcuggcugacagaaagauugccgaacucuuuuccaccaaaacacauaucggc

SEQ ID NO: 13865 - RNA, 2916 nt, Artificial Sequence
  derived and/or modified CDS sequence (opt5) from CCHFV(ArD8194, Artificial)__DQ211626.1__Gn-4aa-Gc
gccgagggcgggagcaacgacugcguguccagaacccagcuugucaagacagaaguugcugagauccacgaagauucuuacggaggccccggggagaaaauuacgaucuguaauggaagcaccauuguggaccaacggcucggcuccgaacuggggugcuauacaaucaaccgcgugagaaccuacaagcucugugaaaauucugccacagagaaaagcugcgaaauugauuccgucccugugaaguguaaacagggauucugccugaagaucacccaggagggccggggccauguuaagcucucucgcgggacagaaaucgugcuggacgucugugauaccagcugcgagcuuaugauuccgaaaggaacgggcgacauccugguggauuguuccgggggacagcaacacuuucuccaggacaaccugauugaucugggcugccccaauaucccucuccuggggagaaccgcgauuuauguuugucggaugagcaaccaucccaagacaaccauggcuuuccuguuuugguucucuuuuggauacgugaucacaugcgucgugugcaaagugcuguucuaucuccugauugucaucggcacccuuggcaagcgccugaaacaguacagagagcucaagccucagacguguaucguuugcgaauccauucccgugaaugccaucgacgccgagaugcacgaucugaacuguaauuauaacauuugcccuuacugugcuagccggcugacaucugacgggcucgugcgccaugucacccaaugcccgaagagaaaagaaaagguggaggaaacagagcuguaccuuaaucuggagcggauccccuggcucguucgcaaacugcuucagguguccgaaagcaccggagucgcccugaagagaucuuguuggaugauuacccuccugauccugcucacaguguccaugagcccuguucaguccgcucccgugggccggaaaccucuguuucuugaucgcaucgccaaggggaugaaaucucugcucaacagcacgucccuggagaccagccuuucuauugaagcgcccuggggagccaucaauguccaguccacauucaagccgaccgugagcgcugccaacauugcucugucuuggagcuccgucgagcacaagggcaauaaaauccucgugucugggagaagcgaauccauuaugaagcuggaggagcggacaggaaucagcuggugccugggcguugaagacgccucugaguccaaaacccucacggugagcgucauggaccugucucaaauguauuccccuguguuugaauaccuuagcggcgauagacagguugaggaauggcccaaggcgacauguaccggggacugcccugagcgcuguggaugcaccuccucuacaugccugcacaaagaguggccccauagccggaacuggagauguaaccccaccuggugcuggggcguggggacaggauguacgugcuguggccucgaugucaaggaccuguucaccgauuauaugcuggugaaguggaaaguggaauacaucaagacagaggccauuaucugcguugaacuuaccucccaggagcgccaauguucucucauugaggcugggacacgguuuaaucugggcccugucaccaucacgcugagcgaaccgagaaacgugcagcagcgccuucccccugagauuaucacccugcaccccaaaauugaagagggauucuuugaccuuaugcaugugcagaaggucauguccgccagcacagugugcaaacugcaaucuuguacccacggcguuccuggggaucuccagguguaucacgucggaaaucugcugaagggcgacaaggugaacgggcauuccauccacaaaaucgaaagccaucuuaauacaucuuggauguccugggauggaugcgaccucgauuacuucuguaacaugggcgacuggcccagcugcaccuauacggggguuacacagcacaaucaugcugccuucauuaacaugcugaauaucgagaccgacuacacaaagaccuuucacuuccacucuaaacgggugaccgcccauggcgauacaccgcagcuggaccucaaggcuagaccugcguacggagccggcgagauuacgguccugguggaaguugcugaucuugagcugcacaccaaaaagaucgaagugagcgggcucaaguuugccucccugagcugcucuggauguuaugccugcuccagcggcauuuccuguaaaguccgcauccaugugaacgagcccgacgaguucacagugcacgucaagucuaaugauccugacguuguggcugccgggagcucccugauggcgcggaaaaucgagucuggagcugauagcaccuuuaaggccuucuccucuaugcccaaaaacagccuuugcuuuuacauuguggagagagacuauuguuccagcugcacagaugacgauacccaaaagugugucgacaucaaacucgaacacccucagucuauucugaucgagcauaagggcacgauuaucgggaagcagaaugauacaugccccaccaaaaccuccuguuggcuggaaagcaucaagucuuucuuuuacggccucaaaaacaugcuguccggaauuuucggcaauguguuucuugggaugcuucucuuccuggccccguuuauccugcuuauucucuucuucuuuuucggauggcgccugcuguuuugccucaaguguugccggagaacacggaaacugcuuaaguauaagcaucugcgcgacgaggaagagagcggcuacaaaaagaucauugagagacucaacgacaaaaaggggaaaucucggcuguucgauggagaaagacuggcugaccgcaagaucgccgagcuguuuuccaccaagacacacaucggc

SEQ ID NO: 13866 - RNA, 2916 nt, Artificial Sequence
  derived and/or modified CDS sequence (opt5) from CCHFV(ArD15786, Artificial)__DQ211627.1__Gn-4aa-Gc
gccgagggcgggagcaacgacugcguguccagaacccagcuggucaagacagaaguuacggagauccacgaagauucuuacggaggccccggggagaaaauuaccaucuguaauggaagcacaauuguggaccaacggcucggcuccgaacuggggugcuauaccaucaaccgcgugagaacauacaagcucugugagaauagcgcuaccgagaaaagcugcgaaauugauuccgucccugugaaguguaaacagggauucugccugaagaucacacaggagggccggggccauguuaagcucucucgcgggaccgaaaucgugcuggacgucugugauacgagcugcgagcuuaugauuccgaaaggaaccggcgacauccugguggauuguuccgggggacagcaacacuuucuccaggacaaccugauugaucugggcugccccaauaucccucuccuggggcagacagccauuuauguuuguagaaugagcaaccaucccaagaccacaauggcguuccuguuuugguucucuuuuggauacgugauuaccugcgucgugugcaaagugcuuuucuaucuccugauugucaucggcacgcuuggcaagcggcugaaacaguaccgcgagcucaagccucaaacauguaucguuugcgaauccauucccgugaaugcuaucgacgccgagaugcacgaucugaacuguaauuauaacauuugcccuuacugugccagcagacugaccucugacgggcucgugcggcaugucacacagugcccgaagcgcaaagaaaagguggaggaaaccgagcuguaccuuaaucuggagagaauccccuggcucguucggaaacugcuucagguguccgaaagcaccggagucgcucugaagcgcucuuguuggauuaucacacuccugauccugcucacgguguccaugagcccuguucaguccgcccccgugggcagaaaaccucugucucuugauagcauugcuaaggggaugaaaucccugcucaacagcaccucucuggagacaucccuuagcaucgaagcccccuggggagcgauuaauguccaaucuaccuuuaagccgacaaucagcgccgcuaacauugcccuguccuggucuagcguggagcacaagggcaauaaaauccucgucuccgggcggagcgaaucuaucaugaagcuggaggagcgcaccggaauuuccuggugccugggcguggaagacgcuagcgagucuaaaacgcucacaguuuccgugauggaccugagccagauguauuccccugucuucgaauaccuuucuggcgauagacagguggaggaauggcccaaggccaccuguaccggggacugcccugagcgguguggaugcacaagcucuaccugccugcacaaagaguggccccauuccagaaacuggcgcuguaaccccacauggugcuggggcguugggacgggauguaccugcuguggccucgaugugaaggaccuguuuacagauuauaugcuggucaaguggaaaguggaauacaucaagaccgaggcgauuaucugcguggaacuuacaagccaagagcggcaguguucccucauugaggccgggaccagauucaaucugggcccuguuacgaucacccugagcgaaccgcgcaacguccagcagcggcuucccccugagauuaucacacugcaccccaaaaucgaagagggauuuuucgaccuuaugcaugugcaaaaggugaugucugcuuccaccgucugcaaacugcagagcuguacacacggcgugccuggggaucuccagguuuaucacgugggaaaucugcugaagggcgacaaggucaacgggcauucuauucacaaaaucgaaucccaucuuaauaccagcuggaugucuugggauggaugcgaccucgauuacuuuuguaacaugggcgacuggcccagcugcacguauacaggggugacccagcacaauagagccgcuuucauuaacaugcugaauaucgagacagacuacaccaagaccuuccauuuucacuccaaacgcguuacagcccacggcgauacgccgcaacuggaccucaaggcccggccuaccuacggagcuggcgagauuacagugcuggucgaaguggcggaucuugagcugcauaccaaaaagaucgaaguuagcgggcucaaguucgccucucugacaugcuccggauguuaugcuugcagcuccggcaucucuuguaaagugagaauccacgucaacgagcccgacgaauuuaccgugcaugugaagucuaaugauccugacgucguugccgccggguccucucugauggcucgcaaaaucgagagcggagccgauuccacguucaaggcguuuucuagcaugcccaaaaacucccuuugcuucuacauuguggagcgggacuauuguagcucuugcacagaugacgauacccagaaguguguggacaucaaacucgaacacccucaguccauucugaucgagcacaagggcaccaucauugggaagcagaaugauacaugccccaccaaaacaagcuguuggcuggaaucuaucaaguccuuuuucuacggccucaaaaacaugcugagcggaauuuuuggcaauaucuuccuugggaugcugcucuuucuggcuccguucguccugcuuauucucuuuuucuucuuuggauggagacugcuguucugccucaaguguugccgccggacgagaaaacugcuuaaguauaagcaucugcgggacgaggaagagucuggcuacaaaaagaucaucgagcgccucaacgacaaaaaggggaaauccagacuguuugauggagaacggcuggccgacagaaagauugccgagcuuuucagcaccaagacacacgugggc

SEQ ID NO: 13867 - RNA, 2916 nt, Artificial Sequence
  derived and/or modified CDS sequence (opt5) from CCHFV(ArD39554, Artificial)__DQ211628.1__Gn-4aa-Gc
agcgaguccaacaauaacgacugcgugucuagaacccagcugaucaagacagaaaaugccgagauucacggcgaugacuacgggggacccggcgaaaagaucacgauuuguaacgggagcaccaucgucgagcaacggcucggauccgaacugggcugcuauacaauuaaucgcaucaagucuuucaaacuuugugagaacagcgcuuccgggaagggaugcgagaucgauucuaccccuguuaaauguaagcagggcuuuugccugaagauuacacaggaaggcagagggcaugugaaacucagccggggauccgagaucauucuggacgugugugauagcucuugcgaaaugaugaucccgaagggcuccggggacauucuugucgauuguagcggaggccagcaacacuuccugcaggacaaucucguggaucuggggugccccaacguuccucugcucggaaaaauggccaucuacauuugucgcaugucuaaucaucccaagaccacaauggcguuucuguucugguuuuccuucggcuaugugauuaccugcaucuuuugcaaagucaucuucuacgugcuuaucauuaucggcacgcuggggaagagaauuaagcaguaucgggagcucaaaccucagaccuguacaaucugcgaggcuacccccguuaacgccaucgacgccgaaaugcacgaucugaauuguagcuacaacauuugcccuuauugugcuucucgccuuacauccgagggacuggugagacaugucacccaaugcccgaagcggaaagaaaagaucgaggaaacggagcucuaccugaaucuggagcgcauucccugguuugugagaaaacuccuucaggugagcgaauccacaggcgucgcccugaagcggucuagcuggcugguuacccuccuggugcuucugacagugucccucagcccuguccagucugcucccaucgggcgcaaaccucuguuccuggacuccaccgccaagagcaugaagucucuccugaacagcaccucccuugagacaucucugagcauugaagcgcccuggggagccaucaaugugcaguccacguuuaaaccgaccgcuagcacagccaacaucgcucucucuugguccagcguugagcacagaggcaacaagauucuggugaccgggcggucugaauccaucaugaaacuugaggagcgcacaggaauuagcuggaaucugggcgucgaagaugccuccgagucuaagacccucacggugagcguuauggaccugucccaaauguacucuacaguguucgaauaucugagcggcgacagacaggucgaggaauggccuaaagcgaccuguaccggggauugccccgagcgguguggaugcacauccagcaccugucuccacaaggccuggccucauucuagaaacuggcgcugcaaucccacauggugcuggggcguggggacgggauguaccugcuguggccuggacgucaagaaccuuuuuacagauuacaugcugaucaaauggaagguggaguucauuaaaaccgaagcuaucguuugcguggagcucacaucccaggaacggcaauguagccugauugaggccgggaccagauucaaucugggccccgucacgaucacccuuucugagccucgcaacauccagcagaagcucccgcccgaacuggugacacugcacccucggguugaggaaggauuuuucgaccucaugcaugugcagaaaguccuguccgcuagcaccgugugcaaacuucaaucuuguacacacggcgugcccggggaucugcagguuuaucacgucggaaaucuccugaagggcgacaaaauuaacgggaauagcuuucauaagaucgagccuaaccugaauaccuccuggaugagcugggauggaugcgaccuugauuacuauuguaacaugggcgacuggcccucuugcacguacacaggggugacccagcacaaucaugccgccuucgugaaccuccugaauauugaaacagauuauaccaaaaacuuucacuuccauuccaagagagucaccgcucacggcgagacaccgcagcuggaccucaaagcgcgcccuaaguacggagccggcgaggugacgguucugguggaagucgcugacauggagcuucacaccaagaaaaucgaaauuagcgggcugaaguuugccucccucacauguaccggaugcuacgccugcucuagcggcaucuccuguaaagugcggcugcauguugaugagcccgacgaacugacagugcacgucaagucugaugacccugaugugguugcugccagcuccucucuuauggcgagaaaaaucgaguucgggaccgacagcacguuuaaggcuuucuccagcaugcccaaagauaagcucugcuuuuauauuguggagcgcgacuacuguucuuccugcagcaaggaagauacacaaaaaugugucaacgccaagcuggagcagccucagucuauccugauugaacauaaaggaaccaucauuggcaagcagaaugauaccugcacagugaaagccuccuguuggcucgagagcgugaagucuuucuuuuaugggcugaagaacaugcuuggcggaaucuucggcaaugucauccuggggauuaucauguuccucgcucccuuugcccugcugcuucucuucuuucuguucggauggcggauucuguuuugccucagauguugccgccggaccagaggccuguucaaauacaagcacaucaaagacgacgaagaguccggguauaagcggauuaucgagcgccuuaacaauaaaaagggaaagaacaaacuguuugauggcgaaagacucgcugacaagaaaaucgccgagcuguucagcacaaagacgcacauuggg

SEQ ID NO: 13868 - RNA, 2916 nt, Artificial Sequence
  derived and/or modified CDS sequence (opt5) from CCHFV(C-68031, Artificial)__DQ211629.1__Gn-4aa-Gc
agcgaggaauccggcgacgauugcaucucuagaacccagcugagccggacagagacggccgaaauucacuccgacaacuacgggggacccggcgauaagaucaccauuuguaaugggucuacaaucguggaccaacgccucggaagcgagcugggcugcuauaccauuaacagagucaaauccuucaagcugugugaaaauucugcuacagggaaaagcugcgagaucgauuccaccccuaucaagugucggcagggauuuugccugaaaauuacacaggagggccgcggccauguuaagcucagcagagggucugaaguggugcuggacgccugugauuccagcugcgagaucaugauuccgaagggaaccggcgacauccuugucgauuguucugggggacagcaacacuuccugaaagacaaccucauugaucugggcugccccaauaucccucugcucgggaagauggcgauuuacaucugucggauguccaaccaucccaaaacgaccauggcuuuucuguucugguuuagcuucggauaugugaucacaugcauucuuugcaagguuaucuuuuaccugcucauuguggucggcacccugggcaaaaaguucaagcaguaucgcgaacuuaaaccucagacauguaccaucugcgagacgacacccgugaaugccauugacgccgagaugcacgaucugaacuguucuuacaauaucugcccuuauugugcuuccagacucaccagcgacgggcuggcccggcauguuaugcagugcccgaagcgcaaagaaaagguggaggaaacagagcuguaccucaaccuggaaagaauccccugggucgugcggaaacuucugcaaguguccgagucuaccggagucgcucucaagcgcagcuccuggcugguugugcuucuggugcuccugaccgucagccugucuccugugcaguccgcccccauuggcagaaaaccucucuuuagcgacucuaucguuaaggggaugaagaaucugcuuaacagcacaucccuggagacgucucucagcauugaagcgcccuggggagccaucaaugugcaguccaccuucaaaccgacagucagcgcugccaacauugcucugucuugguccagcguggagcaccggggcaauaagauccuuguuucugggcgcuccgaaagcaucaugaaacuggaggaaagaaccggaauuuccugggaucucggcguggaggacgccucugagagcaagcugcugacagucuccaucauggaucucucucagauguacagcccuguguuugaauaucuguccggcgaccggcaagucgaggaauggcccaaagcgaccuguacgggggauugcccugagagauguggaugcacaagcucuaccugucuucacaaggaauggccccauucccgcaacuggcggugcaaccccaccuggugcuggggcguggggacaggauguaccugcuguggccuggacguuaaggaucucuucacagacuacauguuugugaaauggaaggucgaguauauuaaaacggaggccaucgugugcguugaacugaccagccaggagagacaguguucucugauugaagcugggacacgcuucaaucuuggcccugugaccaucacacucuccgagccgcggaacauucaacagaagcugcccccugagaucgucacccugcaccccagaaucgaagagggauucuuugaucucaugcaugugaaaaaggugcugagcgccucuacgguuugcaaacuucagagcuguacccacggcgucccuggggaccuucagguguaccacauuggaaaucuccugaagggcgauaaggugaacgggcaucugauccacaaaauugaaccccauuucaauacauccuggaugagcugggacggaugcgaccuugauuauuacuguaacaugggcgacuggccgucuugcuccuauaccggggucacacaacacaaucaugcugccuuugugaacaugcucaauaucgagaccgauuacacgaagauuuuccacuuucacagcaaacgcguuacagcccauggcgacaccccucagcuggaucugaaggcucggcccacauacggagcgggcgaaaucaccgugcucgucgagguggccgacauggagcugcacaccaagaaaaucgaaauuuccgggcuuaaguucgcuucucugacauguacgggaugcuaugccugcagcuccggcaucucuuguaaaguucgcauucauguggaugagccugacgaacucaccguccacguuaagagcgaggaucccgacaucguggccgcuuccucuagccugauggccagaaaacuggaauuugggacagauuccaccuucaaggcguuuagcgcuaugccuaaaacaucucuuugcuucuacauuguggagcgggaguauuguaaguccugcagcaaggaagacacccagaaaugugucaacacgaagcucgagcagccccaaucuauccugaucgaacacaaaggaacaauuaucggcaagcagaaugauaccugcaccuccaaagccggguguuggcuggagagcgugaaguccuuuuucuacggccucaagaacaugcugucuggaauuuuuggcaauguguucaucgggauuuuccuuuuucuggccccguucauccuccugauccuguuuuucauguuuggauggcgcauucuuuucugcuuuaaauguugcagacggacaagaggccucuucaaguaucggcaucugaaagacgacgaagagaccggguaccgcaagaucauugagagacugaacaauaaaaagggaaagaacaaacuccuggauggcgaacggcuugcugacagaaagaucgccgagcuguuuagcacaaaaacgcacauuggg

SEQ ID NO: 13869 - RNA, 2916 nt, Artificial Sequence
  derived and/or modified CDS sequence (opt5) from CCHFV(Drosdov, Artificial)__DQ211630.1__Gn-4aa-Gc
agcgaggaacccggcgacgauugcaucuccagaacccagcugcucaagacagagacggccgaaauucacgacgauaacuacgggggaccuggcgacaaaaucaccauuuguaaugggucuacaaucguggaucaacggcugggaagcgagcuuggcugcuauaccauuaaccgcgucaaguccuucaaacugugugaaaauucugcuacagggaagaccugcgagaucgacagcacaccgguuaaauguagacagggauuuugccucaagaucacccaggagggccggggccaugugaagcugucccgcgggucugaagugguccuugaugccugugacagcuccugcgaggugaugauucccaaaggaacgggcgauauccugguugacuguagcgggggacagcaacacuuccucaaggauaaccugauugaccugggcugcccucauaucccccuccuggggaaaauggcgauuuacaucuguagaaugucuaaucacccucggaccacaauggcuuuucuuuucugguuuuccuucggauaugugauuaccugcaucuuuugcaaggcccuguucuacagccucaucauuaucggcacacugggcaaaaagauuaagcaguaucgcgaacuuaaaccccagaccuguacgaucugcgagacagccccugucaacgcuauugaugccgagaugcaugaccugaaguguucuuacaauaucugcccguauugugcuuccagacucaccagcgacgggcuggcccggcacgugacacagugccccaaacgcaaggaaaaaguugaggaaaccgagcuguaccucaaccuggaaagaaucccuuggauugugcggaaacuucugcaagucucugaguccaccggaguggcgcucaaacgcagcuccuggcugaucgugcuucugguccuccugacaguuucucugagccccgugcaguccgccccugugggcagaaagccccucuuucuggauagcacggucaaggggaugaaaaaucuucugaacucuaccucccucgagacaagccugucuauugaagcuccguggggagccaucaaugugcagagcaccuucaagccuacaguuuccaccgcuaacauugcccuuucuuggagcuccguggagcaccggggcaauaaaauccuggucacggggcgcagcgaaucuaucaugaagcucgaggaaagaacaggaguguccugggaccugggcguugaggaugcgagcgagucuaaacugcucaccguguccauuauggaccugagccagauguacucccccgucuuugaauaucuuucuggcgaucggcaaguggaggaauggccuaaggccaccuguacaggggacugccccgagagauguggaugcaccagcuccacaugucugcauaaggaauggccccacucucgcaacuggcggugcaauccuacguggugcuggggcgucgggaccggauguacaugcuguggcguggauguuaaagaccucuucaccgaucauauguuugugaaguggaaagucgaguacaugaagacagaggcuaucgugugcguugaacugaccagccaggagagacaguguucccugauugaagccgggacgcgcuucaaccuuggcccggugaccaucacacucagcgagccccggaacauucaacagaaacugccucccgagaucauuacccugcacccuaagaucgaagagggauucuuugaccucaugcacguccagaaggugcugucugcuuccacagugugcaaacuucagagcuguacccauggcauccccggggaucugcaaauuuaucacaucggaaaucuccugaagggcgacagaguuaacgggcaucugauucacaaaaucgaaccgcauuucaauacgucuuggauguccugggacggaugcgaucuugacuacuauuguaacaugggcaauuggccuagcugcacauacaccggggucacacagcacaaccacgccgccuuugugaaucuccugaacauugagaccgauuauaccaagacauuccauuuucacucuaaacgcgugacggcucauggcgacacaccccagcuggaucucaaggcgcggccuaccuacggagccggcgaaaucaccguccugguggagguugcugacauggagcuucacacaaagaaaguggaaaucagcgggcugaaguucgccucccucgucuguaccggaugcuacgccugcagcucuggcauuuccuguaaagugagaauccacguugaugagcccgacgaacugacggugcaugucaagagcuccgauccugacgugguugcugccucuacaagccugauggcgcgcaaacuugaguuugggaccgauuccauuuucaaggcuuuuucugccaugcccaaaaccagccucugcuucuauaucguggaacgggaguacuguaaguccugcucugaggacgauacaaagaaaugugucgacaccaagcuggaacagccgcaaagcauucugaucgagcacaaaggaacaaucauuggcaagcagaaugacacgugcaccgccaaggcuuccuguuggcucgaaagcgugaaguccuuuuucuaugggcugaagaacaugcuuggcucuguguuuggaaauuucuucgucggcauccugcucuuucuggccccuuucguucugcuugugcucuuuuucauguuuggguggaaaauucuguucugcuuuaaguguugcagacgcacacggggacuguucaaauacagacaucucaaggaugacgaggaaaccggcuaucggcgcaucauugagagacugaacagcaaaaaggggaagaaucggcuucuggauggagagagacucgcugaccgcaaaaucgccgaacuguuuucuacaaagacccacaucggc

SEQ ID NO: 13870 - RNA, 2916 nt, Artificial Sequence
  derived and/or modified CDS sequence (opt5) from CCHFV(Kashmanov, Artificial)__DQ211631.1__Gn-4aa-Gc
agcgaggaacccggcgacgauugcaucuccagaacccagcugcuccggacagagacggccgaaauucacgacgauaacuacgggggaccuggcgacaagaucaccauuuguaaugggucuacaaucguggaucaacgccugggaagcgagcuuggcugcuauaccauuaacagagucaaauccuucaagcugugugaaaauucugcuacagggaaaaccugcgagaucgacagcacaccgguuaagugucggcagggauuuugccucaaaaucacccaggagggccgcggccaugugaagcuguccagagggucugaagugguccuugaugccugugacagcuccugcgaggugaugauucccaagggaacgggcgauauccugguugacuguagcgggggacagcaacacuuccucaaagauaaccugauugaccugggcugcccucauaucccccuccuggggaagauggcgauuuacaucugucggaugucuaaucacccucgcaccacaauggcuuuucuuuucugguuuuccuucggauaugugauuaccugcaucuuuugcaaagcccuguucuacagccucaucauuaucggcacacugggcaagaaaauuaagcaguauagagaacuuaagccccagaccuguacgaucugcgagacagccccugucaacgcuauugaugccgagaugcaugaccugaauuguucuuacaacaucugcccguauugugcuucccggcucaccagcgacgggcuggcccgccacgugccccagugcccuaaaagaaaggaaaaaguugaggaaacagagcuguaccucaaucuggaacggauccccuggauugugcgcaaacuucugcaagucucugaguccaccggaguggcgcucaaaagaagcuccuggcugaucgugcuucugguccuccugaccguuucucugagcccugugcaguccgcccccgugggccggaagccgcucuuucuggauagcauugucaaagggaugaagaacucucuuaauuccacaagccuggagacgucucucagcaucgaagcuccuuggggagccauuaacgugcaguccaccuucaagcccacaguuucuaccgcuaauaucgcccugagcugguccagcguggagcaccgcggcaacaaaauccuugucacagggagaucugaauccauuaugaagcuggaggaacggaccggagugagcugggaccucggcguugaggaugcgucugaguccaaacugcugacggugagcaucauggaccucucccagauguacucuccugucuuugaauaucugagcggcgauagacaaguggaggaauggcccaaggccacauguaccggggacugccccgagcgcuguggaugcaccuccucuacaugucuucauaaagaauggccucacagccggaauuggagaugcaacccgaccuggugcuggggcgucgggacaggauguacgugcuguggcguggauguuaaggaccuguucaccgaucauauguuugugaaguggaaagucgaguacauuaagacagaggcuaucgugugcguugaacucaccucccaggagcgccaguguagccugauugaagccgggacacgguucaaccugggccccgugaccaucacgcuuucugagccuagaaauauucaacagaaacuucccccugagaucaucacccugcaccccaaggucgaagagggauucuuugaccugaugcacgugcagaaagugcucuccgcuagcacaguuugcaagcugcagucuuguacccauggcauuccgggggaucuucaagucuaucacaucggaaaccugcucaagggcgaccgcauuaaugggcaucugauccacaaaauugaaccucauuucaacacauccuggaugagcugggacggaugcgaucuggacuacuauuguaauaugggcgauuggcccucuugcaccuacacgggggugacacagcacaaccacgccgccuuugugaaucuucucaacaucgagaccgacuauacaaagaccuuccauuuucacagcaaacgggucaccgcucauggcgauacaccucagcuggaccugaaggcgagacccacguacggagccggcgaaaucaccgugcucguugagguggcugauauggagcugcacacaaagaaggucgaaauuuccgggcuuaaguucgccagccuggccuguaccggaugcuacgcuuguucuuccggcaucagcugcaaagugcgcauucacguugacgagccugaugaacucacagugcaugucaaguccucugaccccgaugugguugccgcgagcaccucccugauggcucggaaacuggaguuugggacggacucuacauucaaggccuuuagcgccaugccgaaaaccucccuuugcuucuauaucguggaaagagaguacuguaagucuugcagcgaggaagauacccagaaaugugucgacacaaagcucgagcaaccucaguccauucugaucgaacacaagggaaccaucauuggcaaacagaaugacacaugcacggcuaaggccagcuguuggcuggagucugugaaauccuuuuucuaugggcucaagaacaugcugggcagcguguuuggaaauuucuucaucggcauucuucuguuucucgcucccuucguccugcugguucucuuuuucauguuuggguggaaaauccucuucugcuuuaaguguugccgccggaccagaggacugcugaaguaccggcaucucaaagaugacgaagagacaggcuaucgcagaauuaucgagcggcugaacaauaagaaagggaagaacagacuucuggauggagaacgccucgccgaccggaaaaucgcggagcuguucucuaccaagacacacauuggc

SEQ ID NO: 13871 - RNA, 2916 nt, Artificial Sequence
  derived and/or modified CDS sequence (opt5) from CCHFV(Oman, Artificial)__DQ211632.1__Gn-4aa-Gc
agcgaggaauccggcgaggacugcaucucuagaacccagcugcuccggacagaaacggccgagauucacggggauaacuacggaggccccggggacaagaucaccauuuguaauggaagcacaaucguggaucaacgccugggcuccgaacuugggugcuauaccauuaacagagucaaaucuuucaagcugugugagaauagcgcuacaggaaaauccugcgagaucgacaacaccccuguuaaguguaaacagggcuuuugccucaagaucacacaggaaggccgggggcaugugaagcugucucgcgauagcgaggugguccuugacgccugugauuccagcugcgaaauuaugaucccgaaaggaaccggcgacauucugguggauuguucugggggacagcaacacuuccucaaggacaaucugaucgaucugggcugccccaacauuccucuccuggggaaaauggcgaucuacauuuguagaauguccaaucaucccaagacgaccauggcuuuucuuuucugguuuagcuucggauauguuaucacaugcauccugugcaaagugaucuuuuaccuccugauugucgugggcacccuuggcaagaaguucaaacaguaucgggagcugaagccucagacauguaccauuugcgagacgacacccguuaacgccaucgacgccgaaaugcacgaucucaauuguucuuacaacauuugcccuuauugugcuucccgccugaccagcgacgggcuggccagacaugugaugcagugcccgaaacggaaggagaaaaucgaagagacagaacucuaccugaaucuugagcgcauccccugggucgugagaaagcugcuccaagugucugaguccaccggagucgcucugaaacggagcuccuggcuuauuguucugcucgugcugcugaccgugucucucagcccuguccaguccgcccccaucggccgcaagccucuguuucuugacagcauugcgaaggggaugaaaaaccugcucaauucuacaucccuggaaacgagccuuucuaucgaggcccccuggggagcuauuaacgugcagagcaccuucaagccgacaguuuccaccgccaauaucgcucugucuuggagcuccguggaacacagaggcaacaaaauccucgucagcgggcggucugaguccauuaugaagcuggaagagagaacaggaaucagcugggaucugggcguggaggacgccucugaauccaaacuccugaccguuagcgugauggaucuuucccagauguacucuccugucuuugaguaucugagcggcgacagacaaguggaagaguggcccaaggcgacguguacaggggauugcccugaacgguguggaugcaccuccucuaccugucuccacaaggaguggccccauagcagaaacuggcgcugcaaucccacauggugcuggggcgucgggaccggauguacaugcuguggccuggacgugaaagaucuguucacggacuacauguuuguuaaguggaaaguggaguauauuaagaccgaagccaucgucugcguggagcuuacaucccaggaacggcaguguagccucauugaggcugggaccagauucaaccugggcccuguuacaaucacccugucugagccgcgcaauauucaacagaaacugcccccugaaaucgugacgcuccacccccggaucgaggaaggauucuuugaucuuaugcauguccagaaggugcuguccgccagcaccgugugcaagcuccagucuuguacacacggcguuccuggggaccugcaagucuaccacauuggaaaccugcuuaaaggcgauaaggugaaugggcaucucauccacaaaguggagccccauuucaacaccuccuggaugagcugggacggaugcgaccuggauuauuacuguaauaugggcgacuggccgucuugcacauauaccggggucacgcagcacaaccaugcugccuuugugaaucugcucaacauugaaacagauuacaccaagaauuuccacuuucacagcaaaagaguuacagcccauggcgacaccccucagcuggaucuuaaggcucgccccaacuacggagcgggcgaggugaccguccugguggagguugccgacauggaacuccacacaaagaaaaucgagauuuccgggcugaaguucgcuagccugacguguaccggaugcuaugccuguucuuccggcaucagcugcaaagugcggauccaugucgaugaaccugacgagcuuacagugcacguuaaguccgaagaucccgacauuguggccgcuucuagcucccucauggccagaaaacuggaguuugggaccgauucuacauucaaggcguuuagcgcuaugccuaaaaccucccugugcuucuacaucgucgagcgcgaauauuguaagucuugcagcaaggaggacacgcagaaaugugugaaugccaagcucgaacggccccaauccauucugaucgagcacaaaggaacaauuaucggcaagcagaacgauaccugcaccgccaaagcuagcuguuggcuugaaucugugaaguccuuuuucuacgggcugaagaauaugcucagcggcaucuuuggaaacgucuucauuggcaucuuccuguuucuggccccguucauucuucucauccuguuuuucauguuuggguggcgcauucuguucugcuuuaaauguugccgccggacaagaggacucuucaaguaucggcaucugaaagacgacgaggagaccggcuaccgcaagaucaucgaaagacuuaacaauaaaaaggggaagaacaaacugcucgauggagagcggcuggcugacagaaagauugccgaacuguuuucuacaaaaacgcacaucggc

SEQ ID NO: 13872 - RNA, 2916 nt, Artificial Sequence
  derived and/or modified CDS sequence (opt5) from CCHFV(SPU97/85, Artificial)__DQ211633.1__Gn-4aa-Gc
agcgaggaauccgacggcgauugcaucucuagaacccagcugcuccggacagagacggccgaaauucacagcgacaacuacgggggacccggcgauaagaucaccauuuguaauggguccacaaucguggaccaacgccugggaucugagcuuggcugcuauaccauuaacagagucaagagcuucaaacugugugaaaauuccgcuacagggaaaucuugcgagaucgauagcaccccuguuaagugucggcagggauuuugccucaaaaucacacaggagggccgcggccaugugaagcuguccagagggagcgaaauugugcuugacgccugugauucuuccugcgagaucaugauuccgaagggaaccggcgacauccuggucgauuguagcgggggacagcaacacuuccucaaagacaaccugauugaucugggcugccccaauaucccucuccuggggcggauggcgauuuacaucugucgcaugucuaaccaucccaagacgaccauggcuuuucuuuucugguuuuccuucggauaugugaucacaugcauucugugcaaaguuaucuuuuaccuccugauuguggccggcaccgucggcaagaaauucaagcaguauagagaacuucggccucagacauguaccaucugcgagacgacacccgugaaugccauugacgcugagaugcacgaucugaacuguagcuacaauaucugcccuuauugugccucucgccucaccuccgacgggcuggcuagacauguuaugcagugcccgaagcggaaagaaaagaucgaggaaacagagcuguaccucaaccuggaacgcauucccuggguggucagaaaacuucugcaagugagcgaguccaccggaguggcccucaagcggucuagcuggcugaccguccuucugguucuccugaucgugucccugagcccugugcagucugcgcccauuggccgcaaaccucucuuucuggacuccaucgucaaggggaaaaagaaucuucugaacagcacaucucucgagacgagccuguccauugaagcccccuggggagcuaucaaugugcagucuaccuucaagccgacaguuagcgccgcuaacaucgcccuuuccuggagcucuguggagcacagaggcaauaaaauucuggucuccgggcggagcgaaucuaucaugaagcucgaggaaagaaccggaauuuccugggaucugggcguggaggacgcgagcgaguccaaacugcucacaguuucugugauggaucugagccagauguacuccccugucuuugaauaucuuucuggcgaccgccaaguggaggaauggcccaaggccaccuguacgggggauugcccugagcgguguggaugcacaagcuccaccugucugcacaaagaauggccccauagcagaaacuggcgcugcaaccccaccuggugcuggggcgucgggacaggauguaccugcuguggccucgacgugaaggaucuguucacagacuacauguuuguuaaguggaaaguggaguauaucaagacggaggcuauugucugcguggaacugaccucucaggagcggcaguguucccuuaucgaagccgggacaagauucaaucucggcccuguuaccauuacacugagcgagccgcgcaacauccaacagaaacugcccccugagaucauuacccuccacccccggaucgaagagggauucuuugaucugaugcaugugcagaagguccuuucugcuuccacggugugcaaacugcagagcuguacccacggcgugccuggggaccuccaaguuuaccacauuggaaaucugcugaagggcgauaaggucaacgggcaucuuauccacaaaauugaaccccauuucaauacaucuuggaugagcugggacggaugcgaccucgauuauuacuguaacaugggcgacuggccguccugcaccuauacaggggugacccagcacaaucaugccgccuuugugaaccugcugaauaucgagacggauuacacaaagaacuuccacuuucacagcaaaagagucaccgcucauggcgacacaccucagcucgaucugaaggcgcgccccaccuacggagccggcgaagugaccguucuuguggaggucgcugacauggagcugcacacgaaaaagaucgaaauuucugggcucaaguucgccucccugagcuguacaggaugcuaugccugcuccucuggcaucagcuguaaagugcggauucauguugaugagccugacgaacugaccgugcacgucaaguccgaggaucccgacaucguggcugccgggucuagccuuauggcgagaaaacucgaauuuggagcugauuccacauucaaggccuuuucugccaugccuaaaaccagccugugcuucuacauuguugagcgcgaguauuguaaguccugcagccgggaagacacacagaaaugugugaauaccaagcuggagagaccccaaucuauccucaucgaacacaagggcacgauuaucgggaaacagaacgauacaugcaccgcuaaggccuccuguuggcuggagagcgucaaauccuuuuucuacggccuuaagucuaugcugagcggaauuuuuggcaauguguucaucgggauuuuccucuuuaucgcuccguucgugcugcugauccucuuuuucauguuuggauggcggauucuuuucugcuuuaaauguugccgcagaacccggggccuguucaaguauagacaucugaaggacgacgaagagacaggguaccgcaaaaucauugagcggcucaacaauaagaaaggaaagaacaaacugcuugauggcgaaagacuggccgaccgcaagaucgcggagcucuuuucuaccaagucccacauuggg

SEQ ID NO: 13873 - RNA, 2916 nt, Artificial Sequence
  derived and/or modified CDS sequence (opt5) from CCHFV(SPU103/87, Artificial)__DQ211634.1__Gn-4aa-Gc
agcgaggaauccucugacgauugcaucagcagaacccagcugcuccggacagagacggccgaaauucacggcgacaacuacgggggacccggcgauaagaucaccauuuguaauggguccacaaucguggaccaacgccugggaucugagcuuggcugcuauaccauuaacagagucaaaacauucaagcugugugaaaauagcgcuaccgggaaauccugcgagaucgauucuguuccugugaagugucggcagggauacugccucaaaaucacacaggagggccgcggccaugugaagcugagcagaggguccgaagucgugcuugacgccugugauaccagcugcgagguuaugauuccgaagggaacgggcgacauccugguggauuguucugggggacagcaacacuuucucaaagacaaccugauugaucugggcugccccaagaucccucuccuggggaaaauggcgauuuauaucugucggauguccaaucaucccaagaccacaauggcuuuccuguuuugguucagcuuuggauacgucauuaccugcgugcuuugcaaagccaucuucuaucuccugaucauuguuggcacacuuggcaagcgccugaagcaguacagagaacucaaaccucagaccuguacgaucugcgagacaacccccgugaacgccauugacgcugagaugcacgaucugaauuguucuuauaacaucugcccuuacugugccucccggcugacaagcgacgggcucgcucgccaugucacccagugcccgaagagaaaagaaaagguggaggaaaccgagcuguaccuuaaucuggaacggauucccugggugguccgcagacuccugcaaguuucugaguccacaggaguggcccuuaaacggagcuccuggcugaucgugcuccugguccuguuuacggugucucucagcccuguucaguccgcgcccaucagccgcagaccucuguuccuugacaacauugugaagggcaugaaaaaucugcucaacucuaccucccuggagacaagccuuucuaucgaagcccccuggggagcuauuaauguccagagcaccuauaagccgacaguguccaccgccaacaucgcucugucuuggagcuccguugagcaccgggggaauaagauucucgugagcggcagaucugaauccaucaugaaacuggaggaacgcacggggaucagcugggaucugggagucgaggacgccucugaguccaagcuccugacagugagcgucauggaucuuucccagauguacucuccuguguuugaauaucugagcggcgaccggcaaguugaggaauggcccaaagcgaccuguaccggcgauugcccugagagaugugggugcacauccucuaccugucuccacaaggaauggccccauagccgcaacuggcggugcaaccccacauggugcuggggagugggcacgggguguaccugcuguggacuggacgucaaagaucuguucacagacuacauguuugugaaguggaagauugaguauaucaaaaccgaggccauuguuugcguggaacuuacaucccaggagagacaguguagccucaucgaagcuggcacccgcuucaaucuggggccugucacgauuacccugucugagccgcggaacauccaacagaagcuccccuccgagauuaucacacugcacccuagaaucgaagagggcuuuuucgaucuuaugcaugugcagaaagugcugagcgccucuaccguuugcaagcuccaguccuguacacacggaguccccggcgaccugcaaguguaccacauugggaaucugcuuaaaggagauaaggugaacggccaucucguccacaagaucgaaccucauuucaauaccagcuggaugucuugggacgggugcgaccuggauuauuacuguaacaugggagacuggcccagcugcacguacacaggcgugacccagcacaaucaugcuuccuuuguuaaccugcucaauauugagacagauuauaccaaaaacuuccacuuucacagcaagcgcgugaccgcccauggggacacaccgcagcuggaucuuaaagcccggccuacguacggcgcuggagaaaucaccguccugguggagguugcggacauggagcuccacacaaagaaaauugaaaucucuggccugaaguucaccucccugacauguaccgggugcuaugccugcagcuccggaaucucuuguaaggugcgcauucaugucgaugagcccgacgaacuuacggugcacguuaaaagcgaugacccugauguggucgcugccuccucuagccucauggccagaaagcuggaguuuggcacagacuccaccuucaaggcuuuuucugccaugcccaaaaccagccugugcuucuacaucguggaacgggaguauuguaaauccugcagcgaggaagauacacagaagugugugaauaccaaacucgagcaaccucagucuauucugaucgaacacaaggggacaauuaucggaaagcagaacaauacgugcaaagcgagagcuggcuguuggcuugaguccgucaagagcuuuuucuacgggcugaaaaacaugcucucuggcaucuuuggaaauguuuucauuggcaucuuucuguuccuggcccccuucauucuucucauccuguuuuucauguuuggguggcggauucuguucugcuuuaaguguugccgcagaacccggggacucuucaaauauagacaucugaaggacgacgaagagacaggcuaccgcaagaucaucgagcggcuuaacaacaaaaaggggaaaaauaagcugcucgauggagaaagacuggccgaccgcagaauugcugagcuguuuuccaccaaaacacacaucggc

SEQ ID NO: 13874 - RNA, 2916 nt, Artificial Sequence
  derived and/or modified CDS sequence (opt5) from CCHFV(SPU415/85, Artificial)__DQ211635.1__Gn-4aa-Gc
agcgaggaauccgacggcgauugcaucucuagaacccagcugcuccggacagagacgaccgaaauucacagcgacaacuacgggggacccggcgauaagaucacaauuuguaauggguccaccaucguggaccaacgccugggaucugagcuuggcugcuauacaauuaacagagucaagagcuucaagcugugugaaaauuccgccaccgggaaaucuugcgagaucgauagcacaccuguuaagugucggcagggauuuugccucaaaaucacccaggagggccgcggccaugugaagcuguccagagggagcgaaauugugcuugacgcuugugauucuaacugcgagaucaugauuccgaagggaacgggcgacauccuggucgauuguuccgggggacagcaacacuuccucaaagacaaucugauugaucugggcugccccaacaucccucuccuggggaagauggccauuuacaucugucggaugagcaaucaucccaaaaccacaauggcguuucuuuucugguuuucuuucggauaugugaucacaugcauucugugcaagguuaucuuuuaccuccugauuguggcuggcacagucggcaaaaaguucaagcaguaucgcgaacuuagaccucagaccuguacgaucugcgagacaauucccgugaacgccaucgacgccgagaugcacgaucugaauuguuccuacaacaucugcccuuauugugcuagccggcucaccucugacgggcuggcccgccauguuaugcagugcccgaaaagaaaggaaaaaguggaggaaacagagcuguaccucaaucuggaacggauucccugggucgugcgcaaacuucugcaaguguccgagagcaccggagucgcucucaaaagauccucuuggcugaccguucuucuggugcuccugaucgugagccuguccccuguccagagcgcccccauuggccggaagccucucuuucuggacucuaucgugaaagggaugaagaaccuucuuaauuccacaagccucgagacgucucugagcauugaagcgcccuggggagccaucaacguucaguccaccuucaagccgacagugucugcugccaauaucgcucuuagcugguccagcgucgagcaccgcggcaacaaaauucuggugucugggagauccgaaagcaucaugaagcucgaggaacggaccggaauuucuugggaucugggcguugaggacgccuccgagagcaaacugcucacaguguccgucauggaucugucucagauguacagcccuguguuugaauaucuuuccggcgacagacaagucgaggaauggcccaaggcgaccuguacgggggauugcccugagcgcuguggaugcacaucuagcaccugucugcacaaagaauggccccauucccggaacuggagaugcaaucccaccuggugcuggggcguggggacaggauguaccugcuguggccucgacguuaaggaucuguucacagacuacauguuugugaaguggaaagucgaguauaucaagacggaggccauugugugcguugaacugaccagccaggagcgccaguguucucuuaucgaagcugggacacgguucaaccucggcccugugaccauuacacuguccgagccgagaaauauccaacagaaacugcccccugagaucauuacccuccacccccgcaucgaagagggauucuuugaucugaugcauguccagcgggugcuuagcgccucuacggugugcaagcugcaguccuguacccacggcguuccuggggaccuccaagucuaccacauuggaaaccugcugaaaggcgauaaggugaaugggcaucuuauccacaagauugaaccccauuucaacacaagcuggaugucuugggacggaugcgaccucgauuauuacuguaauaugggcgacuggccgagcugcaccuauacaggggugacccagcacaaccaugcugccuuugucaaucugcugaacaucgagacggauuacaccaaaaauuuccacuuucacuccaagagagugaccgcccauggcgacacaccucagcucgaucugaaagcucgccccaccuacggagcgggcgaaguuaccgugcuugucgagguggccgacauggagcugcacacaaagaaaaucgaaauuagcgggcucaaguucgcuucucugacguguaccggaugcuaugccugcuccagcggcaucuccuguaagguuaaaauucauguggaugagccugacgaacugacaguccacgugaagucugaggaucccgacaucguugccgcugggagcucccuuauggcccggaaacucgaauuuggagcggauucuaccuucaaggcuuuuagcgccaugccuaaaacaucccugugcuucuacauuguggagagagaguauuguaagucuugcagccgcgaagacacccggaaaugugucaacacgaagcuggauagaccccaguccauccucaucgagcacaagggcacaauuaucgggaaacaaaauaauaccugcaccgccaaggcuagcuguuggcuggaaucugugaaauccuuuuucuacggccuuaagaacaugcugagcggaauuuuuggcaacguguucaucgggauuuuccucuuuaucgccccguucguccugcugauccuguuuuucauguuuggauggcggauucucuucugcuuuaaauguugccgcagaacacggggccuguucaaguauagacaucugaaggacgacgaggaaaccggguaccgcaaaaucauugagcggcucaacaauaagaaaggaaagaacaaacugcuugauggcgagagacuggcugaccgcaagaucgccgaacucuuuucuacaaagucccacauuggg

SEQ ID NO: 13875 - RNA, 2916 nt, Artificial Sequence
  derived and/or modified CDS sequence (opt5) from CCHFV(Turkey200310849, Artificial)__DQ211636.1__Gn-4aa-Gc
agcgaggaacccggcgacgauugcaucuccagaacccagcugcuccggacagagacggccgaaauucacgacgauaacuacgggggaccuggcgacaagaucaccauuuguaaugggucuacaaucguggaucaacgccugggaagcgagcuuggcugcuauaccauuaacagagucaaauccuucaagcugugugaaaauucugcuacagggaaaaccugcgagguugacagcacaccggugaagugucggcagggauuuugccucaaaaucacccaggagggccgcggccaugugaagcuguccagagggucugaagucgugcuugaugccugugacagcuccugcgagguuaugauccccaagggaacgggcgauauucugguggacuguagcgggggacagcaacacuuccucaaagauaaccugaucgaccugggcugcccucauauuccccuccuggggaagauggcgaucuacauuugucggaugucuaaucacccucgcaccacaauggcuuuucuuuucugguuuuccuucggauaugucauuaccugcaucagcugcaaagcccuguuuuacucucucaucaucauuggcacacugggcaagaaaaucaagcaguauagagaacuuaagccccagaccuguacgauuugcgagacagccccugugaacgcuaucgaugccgagaugcaugaccugaauuguuccuacaacauuugcccguauugugcuagccggcucaccucugacgggcuggcccgccacguuacacagugccccaaaagaaaggaaaaaguggaggaaaccgagcuguaccucaaucuggaacggaucccuuggaucguccgcaagcugcugcaaguguccgagagcaccggaguggcgcucaaaagauccucuuggcugauuguccuucugguucuccugacagugagccugucccccgugcagagcgccccugucggccggaagccccucuuccuggauucuaucgugaaagggaugaagaaccuucuuaauuccacgagccucgagaccucucugagcauugaagcuccguggggagccaucaacguucaguccacauuuaagccugcugugucuaccgccaauauugcgcuuagcugguccagcgucgagcaccgcggcaacaaaauccuggugacagggagaucugaauccaucaugaagcucgaggaacggaccggaguuagcugggaccugggcguggaggaugccucugaguccaaacugcucacggucagcauuauggaccugucccagauguacucucccguguucgaauaucuuagcggcgauagacaagucgaggaauggccuaaggcuacauguaccggggacugccccgagcgcuguggaugcaccuccucuacaugucugcauaaagaauggccccacagccggaauuggagaugcaacccuaccuggugcuggggcguggggacaggauguacgugcuguggcguugaugugaaggaccucuuuaccgaucauauguucgucaaguggaaaguggaguacaucaagacagaggccauuguuugcguggaacugaccucccaggagcgccaguguagccugaucgaagcugggacacgguuuaaccuuggcccggucaccauuacgcucucugagcccagaaauauccaacagaaacugccucccgagauuaucacccugcacccuaagaucgaagagggauucuucgaccucaugcacgugcagaaagugcuguccgccagcacaguuugcaaacuucagucuuguacccauggcauucccggggaucugcaagucuaucacaucggaaaccuccugaagggcgaccgcgugaaugggcaucugauucacaaaaucgaaucccauuuuaacacaagcuggaugucuugggacggaugcgaucuugacuacuauuguaauaugggcgauuggccgagcugcaccuacacgggggugacacagcacaaccacgccgcuuucgucaaucuccugaacauugagaccgacuauacaaagaccuuucauuuccacuccaaacgggugaccgcgcauggcgauacaccucagcuggaccucaaggccagacccacguacggagcuggcgaaaucaccguucugguggaggucgccgauauggagcuucacacaaagaagguggaaaucagcgggcugaaguuugccucucucgcuuguaccggaugcuacgccugcuccagcggcauuuccuguaaaguucgcauccacguggacgagccugaugaacugacaguccaugugaagucuagcgaccccgauguuguggcggcuuccaccucucugauggcccggaaacuugaguucgggacggacagcacauuuaaggccuucuccgcuaugccuaaaaccucucucugcuuuuauauugucgaaagagaguacuguaagagcugcuccgaggaugacacccagaaauguguggacacacgccuggaacaaccccagagcauccugauugagcacaagggaaccaucaucggcaagcagaaugauacaugcacggccaaagcuagcuguuggcucgaauccgugaagucuuucuuuuaugggcugaaaaacaugcuuggcucugucuucggaaaucuguuuauuggcauccuccuguuccuggccccguucguucuucucgugcuguuuuucauguuuggguggaagauucuguucugcuuuaaauguugccggagaacccggggacucuucaaguaccgccaucugaaggacgaugaggaaacaggcuauagacggaucauugagagacuuaacuccaaaaaggggaaaaaucgccugcucgacggagaucggcuggcggacagaaagaucgccgagcuguuuagcaccaaaacacacaucggc

SEQ ID NO: 13876 - RNA, 2916 nt, Artificial Sequence
  derived and/or modified CDS sequence (opt5) from CCHFV(Iran-52, Artificial)__DQ446215.1__Gn-4aa-Gc
agcgaggaauccggcgacgauugcaucucuagaacccagcugcuccggacagagacggccgaagugcacggggacaacuacggaggccccggggauaagauuaccaucuguaauggaagcacagucguugaccaacgccugggcuccgagcuugggugcuauaccauuaacagagugcggucuuucaaacugugugaaaauagcgcuacaggaaaguccugcgagaucgauucuauuccugugaaauguaagcagggcuacugccucaaaaucacccaggagggccgcgggcaugucaagcugagcagaggauccgaagugguucuugacgugugugauagcucuugcgaggucaugaucccgaagggcacaggggacauucugguggauuguuccggaggccagcaacacuuucucaaagacaaccugguugaucuggggugccccaagaucccucuccugggaaaaauggccauuuauaucugucggaugagcaaucaucccaagaccacgauggcguuccuguuuugguucucuuuuggcuacgugauuaccugcauccugugcaaagcuauuuucuuucuccugaucaucuucggcacacuugggaagcgcuuuaagcaguauagagaacugaaaccucagaccuguacaauuugcgagaccacgcccgucaacgccaucgacgccgagaugcacgaucucaauuguuccuacaacauuugcccuuauugugcuagccggcugacaucugacggacuggcccgccaugugacccagugcccgagacggaaggaaaaaguggaggaaacagagcucuaccugaaucuugaacgcauccccugggucguuagaaagcugcuccaaguguccgagagcaccggcaccgugcugaaacgguccucuuggcuuauuguccugcucgugcuguucacaguuagccuguccccugugcagagcgcucccaucgggcgcagaccucucuuucuggacucuaucgucaagggaaugaaaaaccuucuuaauuccacgagccucgagaccucucugagcauugaagcccccuggggcgcgaucaacgugcaguccacauacaagccgaccguuucuacagccaauauugcucuuagcugguccagcguggagcaccgggggaacaagguccuggugucuggaagauccgaaagcaucaugaaacucgaggaacgcaccggcauuucuugggaucugggcgucgaggacgccuccgagagcaagcugcucacgguguccguuauggaucugucucagauguauagcccuguguucgaauaccuuuccggggaccggcaagucgaggaauggcccaaagcuacauguaccggagauugcccugagagauguggcugcaccucuagcacaugucugcacaaggaauggccccauucccgcaauuggcggugcaaccccaccuggugcuggggaguggggacaggcuguacgugcugugggcucgacguuaaagaucuguuuaccgacuauauguucgugaaguggaaggucgaguacaucaaaacagaggccaucgugugcguggaacugaccagccaggagagacaguguucucuuauugaagcgggcacacgcuucaaccucggauccguuaccaucacgcugagcgagccucggaauauucaacagaagcugccgcccgagaucauuacccuccacccuaaaaucgaagagggcuuuuucgaucugaugcauguccagaaggugcuuucugccuccacagugugcaaacugcagagcuguacccacgggguccccggagaccuccaaguguaucacauuggcaaccugcugaagggggauagaguuaauggacaucuuauccacaagaucgaacagcauuuuaacacaucuuggaugagcugggacggcugcgaccucgauuacuauuguaauaugggggacuggccuuccugcaccuacacgggcgugacacagcacaaccaugcuagcuucgucaaucugcugaacauugagaccgauuacacaaaaaccuuucacuuccacucuaagcgcgugaccgcccauggagacacaccccagcucgaucugaaagcucggccgacguauggcgccggggaaaucaccguucuuguggaggucgccgacauggagcugcacacaaagaaaauugaaaucuccggacucaaguuugcuggccugaccuguacagggugcuacgcgugcagcuccggaauuucuuguaaggugagaauccauguugaggaaccugaugagcugaccgugcacgucaaaagcgacgaucccgacgugguggccgcuuccucuagccuuauggcccgcaagcucgaguucggcacggauuccacauuuaaagccuucucugcuaugccuaagaccagccugugcuuuuauaucgucgagcgggaguacuguaaauccugcagcaaggaagacacccaaaaauguguuaauacaaagcuggagcagccccagucuauucucaucgaacacaaggggaccauuaucggcaaacagaacaauacaugcacggccaaggcguccuguuggcuggagagcgugaaaucuuucuuuuauggacuuaagaacaugcugggcgggauuuucggaaauguguucaucggcaucuuuaccuuccucacaccuuuuauucugcugauccuuuucuuuauguucggguggcggauucucuuuugcuucaaauguugcagacgcaccagaggacuguuuaaguaccggcaucugaaggaugacgaagagacaggcuauagaaaaaucauugagcgccucaacaauaagaaagggaagaaccggcugcuugacggcgaaagacuggcugaucgcaaaaucgccgaacucuucuccaccaagacgcacaucgga

SEQ ID NO: 13877 - RNA, 2916 nt, Artificial Sequence
  derived and/or modified CDS sequence (opt5) from CCHFV(Iran-53, Artificial)__DQ446216.1__Gn-4aa-Gc
agcgaggaauccggcgacgauugcaucucuagaacccagcugcuccggacagagacggccgaagugcacggggacaacuacggaggccccggggauaagauuaccaucuguaauggaagcacagucguugaccaacgccugggcuccgagcuugggugcuauaccauuaacagagugcggucuuucaaacugugugaaaauagcgcuacaggaaaguccugcgagaucgauucuauuccugugaaauguaagcagggcuacugccucaaaaucacccaggagggccgcgggcaugucaagcugagcagaggauccgaagugguucuugacgugugugauagcucuugcgaggucaugaucccgaagggcacaggggacauucugguggauuguuccggaggccagcaacacuuucucaaagacaaccugguugaucuggggugccccaagaucccucuccugggaaaaauggccauuuauaucugucggaugagcaaucaucccaagaccacgauggcguuccuguuuugguucucuuuuggcuacgugauuaccugcauccugugcaaagcuauuuucuuucuccugaucaucuucggcacacuugggaagcgcuuuaagcaguauagagaacugaaaccucagaccuguacaauuugcgagaccacgcccgucaacgccaucgacgccgagaugcacgaucucaauuguuccuacaacauuugcccuuauugugcuagccggcugacaucugacggacuggcccgccaugugacccagugcccgagacggaaggaaaaaguggaggaaacagagcucuaccugaaucuugaacgcauccccugggucguuagaaagcugcuccaaguguccgagagcaccggcaccgugcugaaacgguccucuuggcuuauuguccugcucgugcuguucacaguuagccuguccccugugcagagcgcucccaucgggcgcagaccucucuuucuggacucuaucgucaagggaaugaaaaaccuucuuaauuccacgagccucgagaccucucugagcauugaagcccccuggggcgcgaucaacgugcaguccacauacaagccgaccguuucuacagccaauauugcucuuagcugguccagcguggagcaccgggggaacaagguccuggugucuggaagauccgaaagcaucaugaaacucgaggaacgcaccggcauuucuugggaucugggcgucgaggacgccuccgagagcaagcugcucacgguguccguuauggaucugucucagauguauagcccuguguucgaauaccuuuccggggaccggcaagucgaggaauggcccaaagcuacauguaccggagauugcccugagagauguggcugcaccucuagcacaugucugcacaaggaauggccccauucccgcaauuggcggugcaaccccaccuggugcuggggaguggggacaggcuguacgugcugugggcucgacguuaaagaucuguuuaccgacuauauguucgugaaguggaaggucgaguacaucaaaacagaggccaucgugugcguggaacugaccagccaggagagacaguguucucuuauugaagcgggcacacgcuucaaccucggauccguuaccaucacgcugagcgagccucggaauauucaacagaagcugccgcccgagaucauuacccuccacccuaaaaucgaagagggcuuuuucgaucugaugcauguccagaaggugcuuucugccuccacagugugcaaacugcagagcuguacccacgggguccccggagaccuccaaguguaucacauuggcaaccugcugaagggggauagaguuaauggacaucuuauccacaagaucgaacagcauuuuaacacaucuuggaugagcugggacggcugcgaccucgauuacuauuguaauaugggggacuggccuuccugcaccuacacgggcgugacacagcacaaccaugcuagcuucgucaaucugcugaacauugagaccgauuacacaaaaaccuuucacuuccacucuaagcgcgugaccgcccauggagacacaccccagcucgaucugaaagcucggccgacguauggcgccggggaaguuaccgugcuugucgagguggccgacauggagcugcacacaaagaaaaucgaaauuuccggacucaaguuugcuggccugaccuguacagggugcuacgcgugcagcuccggaaucucuuguaagguucgcauucauguggaugagccugacgaacugaccguccacgugaaaagcgaugaccccgauguggucgccgcuuccucuagccuuauggccagaaagcucgaguucggcacggacuccacauuuaaagccuucucugcuaugccuaagaccagccugugcuuuuauaucguugaacgggaguacuguaaauccugcagcaaggaggauacccaaaaaugugugaauacaaagcuggaacagccccagucuauccucauugagcacaaggggaccaucauuggcaaacagaacaauacaugcacggccaaggcguccuguuggcuggaaagcgugaaaucuuucuuuuauggacuuaagaacaugcugggcgggaucuucggaaaugucuucauuggcaucuuuaccuuccucacaccuuuuauccugcugauucuuuucuuuauguucggguggagaauccucuuuugcuucaaauguugccggcgcaccagaggacuguuuaaguaccggcaucugaaggacgacgaggaaacaggcuauagaaaaauuaucgagcgccucaacaauaagaaagggaagaaccggcugcuugauggcgagagacuggcugaccgcaaaauugccgaacucuucuccaccaagacgcacaucgga

SEQ ID NO: 13878 - RNA, 2916 nt, Artificial Sequence
  derived and/or modified CDS sequence (opt5) from CCHFV(Kosova Hoti, Artificial)__EU037902.1__Gn-4aa-Gc
agcgaggaacccggcgacgauugcaucuccagaacccagcugcuccggacagagacggccgaaauucacgacgauaacuacgggggaccuggcgacaagaucaccauuuguaaugggucuacaaucguggaucaacgccugggaagcgagcuuggcugcuauaccauuaacagagucaaauccuucaagcugugugaaaauucugcuacagggaaaaccugcgagaucgacagcacaccgguuaagugucggcagggauuuugccucaaaaucacccagaagggccgcggccaugugaagcuguccagagggucugaggugguccuugaugccugugacagcaacugcgaagugaugauucccaaaggaacgggcgauauccugguugacuguuccgggggacagcaacacuuccucaaggauaaucugauugaccugggcugcccucauaucccccuccuggggaaaauggcgauuuacaucugucggaugagcaaccacccuaagaccacaauggcuuuucuuuucugguuuucuuucggauaugugauuaccugcaucuuuugcaaagcccuguucuacucccucaucauuaucggcacacugggcaagaagauuaaacaguaucgcgagcuuaagccccagaccuguacgaucugcgaaacagccccugucaaugcuauugaugccgagaugcaugaccugaacuguagcuacaauaucugcccguauugugcuucuagacucaccuccgacgggcuggcccggcacgugaaacagugccccaagcgcaaagagaagguugaagagacagaacuguaccucaaccuggagagaaucccuugggugguccggaaacuucugcaagugagcgaaucuaccggaguggcgcucaagcgcuccagcuggcugauuguccuucugguucuccugaccgugucccugucucccgugcagagcgccccugucggcagaaagccccucuuucuggauuccaucgugaaagggaugaagaaucuucugaacagcacaucucucgagacgucccugagcauugaggcuccguggggagccaucaauguucagucuaccuucaaaccuacagugagcaccgcuaacauugcccuuuccuggucuagcgucgaacaccggggcaauaagauccuggugacagggcgcuccgagagcaucaugaaacucgaagagagaaccggaauuucuugggaccugggcguugaagaugcguccgagagcaagcugcucacggugucuaucauggaccugucccagauguacagccccgucuuugaguaucuuuccggcgaucggcaaguggaagaguggccuaaggccacauguaccggggacugcccccagagauguggaugcaccucuagcacaugucugcauaaagaauggccccacucccgcaacuggcggugcaacccuaccuggugcuggggcgucgggacaggauguacgugcuguggcguggauguuaaggaccucuucaccgaucauauguuugugaaauggaaggucgaguacauuaaaacagaagcuaucgugugcguugagcugaccucucaggagagacaauguagccugauugaagccgggacacgcuucaaucuuggcccggugaccaucacgcucuccgagccccggaacauucagcagaagcugccucccgaaaucaucacccugcacccuaagauugaggagggauucuuugaccucaugcacguccagaaagugcugagcgcuucuacagugugcaaacuucaauccuguacccauggcauccccggggaucugcagguuuaucacauuggaaaucuccugaaaggcgacagagucaacgggcaucugauccacaagauugaaccgcauuucaauacaagcuggaugucuugggacggaugcgaucuugacuacuauuguaacaugggcgauuggccuuccugcaccuacacgggggugacacagcacaaucacgccgccuuugugaaccuccugaauaucgagaccgacuauacaaaaaccuuccauuuucacagcaagcgcgucaccgcucauggcgauacaccccagcuggaccucaaggcgcggccuacguacggagccggcgaaaucaccgugcugguugagguggcugauauggaacuucacacaaagaaggucgagauuucugggcugaaauucgccagccucgccuguaccggaugcuacgcuugcuccagcggcaucucuuguaaggugcgcauucacguugacgagcccgaugaacugacagugcaugucaaauccagcgacccugaugugguugccgcggggaccucccugauggcuagaaaacuugaguuuggaacggacucuacauucaaagccuuuagcgccaugcccaagaccucccucugcuucuauaucguggaaaaggaguacuguaaaucuugcagcgaagaugacaccaagaaaugugucgacacaaagcuggagcaaccgcaguccauucugaucgagcaccggggcaccaucauugggaaacagaacgauacaugcacggcuaaggccucuuguuggcucgaaagcgugaaguccuuuuucuauggccugaaaaauaugcuuggaagcguguuuggcaacuucuucaucgggauucugcucuuucuggcuccuuucguccugcuuguucucuuuuucauguuuggauggaagauccuguucugcuuuaaauguugcagacgcacccggggccuguucaaguacagacaucucaaagacgaugaggaaacaggguaucggcgcauuaucgagagacugaauaacaagaagggaaagaaucggcuucuggacggcgaaagacucgccgaucgcaagaucgcggagcuguuuucuaccaaaacacacauuggg

SEQ ID NO: 13879 - RNA, 2916 nt, Artificial Sequence
  derived and/or modified CDS sequence (opt5) from CCHFV(YL04057, Artificial)__FJ562094.1__Gn-4aa-Gc
gccgagggcgggagcuccgacugcaucucuagaacccagcuggugaagacagaagucgcugagauucacgaagauagcuacggaggccccggggagaaaaucacgauuuguaacggauccaccaucguugaccaacggcucggccgcgaacuggggugcuauacaauuaauagagugcggucuuacaaacuuugugagaacagcgccuccggaaagucuugcgagaucgauagcaucccugugaaguguaaacagggcuucugccugaagauuacccaggaaggccgcgggcaugucaagcucuccagaggaacagagaucgugcuggacguuugugauagcucuugcgaacuuaugauuccgaaaggcaccggggacauccugguggauuguuccggaggccagcaacacuuucuccagaauaaccugauugaccuggggugccccaaugucccucuccugggaaagauggcgaucuaugugugucggaugagcaaccaucccaaaacaaccauggcuuuccucuuuugguucucuuuuggcuacguuauuacgugcaucgccugccgcgugcuguucuaucuccugaucgccauuggcaccgucgggaagaaacuuaagcaguacagagagcugaagccucagacauguaucgugugcgaguccgugcccgucaaugcuauugaugccgaaaugcacgagcucaacuguagcuauaauaucugcccuuacugugcuucucggcuguccaccgacggacugauucgccauguuacacaaugcccgaaaagacgggaaaagguggaggaaaccgagcucuuucugaaccuugagcgcauccccuggcuggugagaaaacuccugcaggucagcgaauccacgggcauggcccuuaagcggucuuguuggaugaucacacugcucauucugcugcucgugagcaucuccccuguucagagcgcgcccguggggcgcaaaccucuguuccuugauucuauugccaaggggaaaaagucccugcucaauagcaccucucuggagacaagccuuuccaucgaagcucccuggggcgccauuaacguccagucuaccuuuaagccgaccgugagcgcugccaauaucgcgcuguccuggagcucuguugagcacagagggaacaaaauccucguguccggacggagcgaaucuauuaugaagcuggaggagagaacaggcgucuccuggaaucugggcguggaagacgccagcgaguccaaaacgcucaccgucucugugauggaucugagccaaauguacuccccuguuuucgaauaucuuucuggggaccgccagguggaggaauggcccaaggcuacaugcaccggagacuguccugagcggugcggcuguacaagcuccacgugccugcacaaagaguggccccauagcagaaacuggcgcugcucucccaccugguguuggggagucggaacaggcugcaccuguugcgggcucgaugugaaggacuuuuucaccgauuacaugcugguuaaguggaaaguggaauauaucaagacagaggccauugucuguguggaacugaccucccaggagcggcaaugcagccuuaucgaggcuggcacaagauuuaaccucggaccugugacgauuacccugucugaaccgcgcaauguucagcagcggcugcccccugagaucgucacacuccaccccaaaauugaagagggcuucuucgaccugaugcaugugcagaagauccuuuccgccagcaccguguguaaacugcaaucuugcacacacggggucccuggagauuuucagguguaccacguuggcaaccuccugagaggggacaaggugaauggacauagcauccacaagauugaaccccauuucaacaccuccuggaugagcugggauggcugugaccuggauuauuuuugcaauaugggggacuggccgucuuguacguacaccggcgucacacagcacaaccgcgccgcuuucaucaauaugcuuaacauugagaccgauuauacaaaaaccuuucauuuccacuccaagcgggugacggcgcacggagacacaccucagcucgaccugaaagccagacccgcuuacggcgccggggagguuaccgugcuggucgaaguggccgaucucgagcugcauacaaagaaacuugaaguuagcggacugaagaucgcuucccuuaccugcucuggcugcuacgccuguagcuccgggauuucuugcaaggugcgcauccacgucaaugagccugacgaauuuaccgugcaugugcggagcuccgaucccgacgucguugcggcuggaucuagccugauggccagaaaaaucgaguucggcgccgauuccacauuuaaggcuuucagcucuaugccuaaagacucccuguguuuuuauauuguggagaaggauuacugcagcucuuguacggacgaugacacccaaaaaugcgugaacacaaaacuugaucacccccaguccauccucauugaacacaaggggaccaucauuggcaagcagaaugacacauguagcaccaagacgucuugcuggcuggaguccgucaaaggauucuuuuauggccugaagaacaugcucagcgggaucuucggaaauguguuccugggcauccuucuguuucucgccccguucguucugcugaucuuuuucuuuuucuuuggguggcggcuucucuucugucugaaaugcugucgcagaacacggggacugcucaaguacaaacaucugaaggaugaagaggaagcuggcuauaagaaaauuauugagagacuuaacgggaagaaaggcaagucccagcuguuugacggagagcgccucgccgaccggaaaaucgcggaacuguucagcaccaagauucacaucggc

SEQ ID NO: 13880 - RNA, 2916 nt, Artificial Sequence
  derived and/or modified CDS sequence (opt5) from CCHFV(V42/81, Artificial)__GU477490.1__Gn-4aa-Gc
agcaaggagcccggcgacgauugcaucuccagaacccagcugaugcggacagaaacggccgagauucacgacgauaacuacgggggaccuggcgacaaaaucaccauuuguaaugggucuacaaucguggaucaacgccucggaagcgaacugggcugcuauaccauuaacagagucaaguccuucaaacuuugugagaauagcgcuacagggaaggccugcgaaguugacagcaccccggugaaaugucggcagggauuuugccugaagaucacacaggagggccgcggccaugugaagcucuccagagggucugaggucgugcuggaugcgugugacagcuccugcgaaguuaugauccccaaaggaaccggcgauauucuuguggacuguagcgggggacagcaacacuuccugaaggauaaccucaucgaccuggagugcccucauauuccccugcucggcaaacuggcuaucuacauuugucggaugucuaaucacccucgcacgaccauggccuuucuuuucugguuuggguucggauaugucaucacaugcauucugugcaaggcccucuuuuacucccugaucaucauuggcacccuuggcaaaaagaucaagcaguauagagaacugaaaccccagacauguaccauuugcgagacggcuccugugaacgccaucgaugcugagaugcaugaccucaauuguagcuacaacauuugcccguauugugccucucggcugacauccgacgggcuggcgcgccacguuacccagugccccaagagaaaagaaaagguggaggaaacagagcucuaccugaaucuugaacggaucccuuggaucguccgcaaacugcuccaagugagcgagucuaccggagugguccugaagagauccagcuggcuuauuguucugcucgugcugcugaccgugucccucucucccguccagagcgccccugugggccggaaaccccuguuccuugauuccaucguuaaggggaagaaaaaccugcucaauagcacaucucuggagacgucccuuagcauugaagcuccguggggagccaucaacauucagucuaccuuuaagccuacagugagcgcugccaauaucgcgcuguccuggucuagcgucgagcaccgcggcaacaaaauccucguguccgggagaagcgaaucuauuaugaagcuggaggaacggaccggaguuuccuggaaucugggcguggaggacgccagcgagucuaaacuccugacagucuccaucauggaucuuagccagauguacucccccguguucgaauaucugucuggcgacagacaagucgaggaauggccuaaggcuaccuguacgggggauugccccgagcgcuguggaugcacaagcuccaccugucuccauaaggaauggccccacucucggaacuggagaugcaacccuaccuggugcuggggcguggggacaggauguaccugcuguggcguugacgugaaagaucuguuuauugaccauauguucgucaaguggaaaguggaguacaucaagacagaggccauuguuugcguggaacugacgagccaggagcgccaguguucccuuaucgaagcugggacccgguuuaaucucggcccggucacaauuacccugagcgagcccagaaacauccaacagaaacugccucccgagaucauuacacuccacccuaagaucgaagagggauucuucgaucugaugcacgugcagaaggugcuuucugccuccaccguuugcaaacugcagagcuguacgcauggcauucccggggaccuccaagucuaucacaucggaaaucugcugaagggcgaucgcgugaacgggcaucuuauucacaaaaucgaaccgcauuuuaauaccucuuggauguccugggacggaugcgaccucgauuacuauuguaacaugggcgacuggccuagcugcacauacaccggggugacacagcacaaucacgccgcuuucgucaaccugcugaauaucgagaccgauuauacgaagacauuucauuuccacucuaaacgggugaccgcgcauggcgaaacaccccagcucgaccugaaggccagaccugcuuacggagccggcgagauuaccguucuuguggaggucgccgauauggaacugcacaccaagaaaguggagaucagcgggcucaaguuugcuucccuggccuguacaggaugcuacgcgugcagcucuggcauuuccuguaaaguucgcauccacguggacgaacccgaugagcugacgguccaugugaagucuaacgacccugauguuguggcugccuccaccucucuuauggcccggaaacucgaaagcgggacagacuccaccuucaaggcuuuuucugccaugcccaaaacaagccugugcuucuauauugucgagagagaguacuguaaguccugcucugaagaugacacccagaaguguguggagacgaaacuggaacaaccgcagagcauccucaucgagcacaagggaacaauuaucggcaaacagaaugauaccugcaccgcuaaggccuccuguuggcuggaaagcgugaaauccuuuuucuaugggcuuaagaacaugcugggcucugucuuuggaaauuucuuuauuggcauccuccuguuccuggcgccuuucguucuucucgugcuguuuuucauguuuggguggaagauucuguucugcuuuaaauguugccgccggacaagaggacucuucaaguaccggcaucugaaagaggacgaggaaaccggcuaucgcagaaucaucgagcggcuuaacagcaagaaagggaagaauagacugcucgacggagaacgccuggccgaucggaagauugcugagcuguuuucuacaaaaacgcacaucggc

SEQ ID NO: 13881 - RNA, 2916 nt, Artificial Sequence
  derived and/or modified CDS sequence (opt5) from CCHFV(79121M18, Artificial)__GU477493.1__Gn-4aa-Gc
gccgagggcgggagcuccgacugcaucucuagaacccagcuggugaagacagaagucgcugagauucacgaagauagcuacggaggccccggggagaaaaucacgauuuguaacggauccaccaucguugaccaaggccucgggucugaacugggaugcuauacaauuaaucgggugcgcagcuacaaacuuugugagaacuccgccucuggcaaaagcugcgagaucgauuccaucccugugaaguguaaacagggcuucugccugaagauuacccaggaagggagaggacaugucaagcucagccggggcacagagaucgugcuggacguuugugauucuuccugcgaacuuaugauuccgaaagggaccggagacauccugguggauuguagcggcgggcagcaacacuuucuccagaauaaccugauugaccugggaugccccaaugucccucuccugggcaagauggcgaucuaugugugucgcaugucuaaccaucccaaaacaaccauggcuuuccucuuuugguucuccuuuggcuacguuauuacgugcaucgccugcagagugcuguucuaucuccugaucgccauugggaccgucggaaagaaacuuaagcaguaccgggagcugaagccucagacauguaucgugugcgagagcgugcccgucaaugcuauugaugccgaaaugcacgagcucaacuguucuuauaauaucugcccuuacugugcuucccgccugagcaccgacggccugauuagacauguuacacaaugcccgaaacggcgcgaaaagguggaggaaaccgagcucuuucugaaccuugagagaauccccuggcuggugcggaaacuccugcaggucuccgaaucuacggggauggcccuuaagcgcagcuguuggaugaucacacugcucauucugcugcucguguccaucagcccuguucagucugcgcccgugggaagaaaaccucuguuccuugauuccaccgccaagggcaugaaaagccugcucaauucuacaagccuggagaccucccuuucuauugaagcucccuggggagccaucaacguccagagcaccuuuaagccgacaguguccgcugccaauauugcgcugagcuggucuuccguugagcaccgggggaacaagauccucgugagcggccgcucugaauccaucaugaaacuggaggagagaacgggcgucagcuggaaucuggggguggaagacgccuccgagucuaagacccucacagucagcgugauggaucugucccaaauguacucuccuguuuucgaauaucuuagcggagacagacagguggaggaauggcccaaagcuaccugcacaggcgacuguccugagcggugcggguguaccuccagcacgugccugcacaaggaguggccccauucucgcaacuggcggugcaaccccacaugguguuggggagucggcaccgggugcaccuguugcggccucgaugugaaagacuuuuucacagauuacaugcugguuaaguggaagguggaauauauuaaaaccgaggccaucgucuguguggaacugacaucccaggagagacaaugcagccuuauugaggcuggaacgcgcuuuaaucucggcccugugaccaucacacugucugaaccgcggaacguucagcagagacugcccccugagauugucacccuccaccccaagaucgaagagggguucuucgaccugaugcaugugcagaaaauucuuuccgccagcacaguguguaagcugcaaucuugcacccacggagucccuggcgauuuucagaucuaccacguggggaaucuccugcgcggagacaaaguuaacggccauagcauccacaagauugaaccccauuucaauacguccuggaugagcugggaugggugugaccuggauuauuuuugcaacaugggcgacuggccgucuuguaccuacacaggagugacccagcacaaucgggccgcuuucaucaacaugcuuaauauugagacagauuauaccaagacguuucauuuccacuccaaaagagucacagcgcacggcgacaccccucagcucgaccugaaggcccgccccgcuuacggggccggagaggugacaguucugguggaagucgccgaucucgagcugcauaccaaaaagcuggaagugagcggccuuaaaaucgcuucccuuaccugcucugggugcuacgccuguagcuccggaauuucuugcaagguucggauccacgugaacgagccugacgaauuuacaguccaugugagaagcuccgaucccgacguggucgcggcuggcucuagccugauggcccgcaagaucgaguucggggccgauuccacguuuaaggcuuucagcucuaugccuaaggacucccuguguuuuuauauuguugagaaagauuacugcagcucuuguaccgacgaugacacacaaaagugcgugaauaccaaacuugaucacccccaguccauccucauugaacacaagggcacaaucauuggaaaacagaacgacaccuguagcacgaagacaucuugcuggcuggaguccgugaagggcuucuuuuaugggcugaaaaauaugcucagcggaaucuucggcaacgucuuccuggggaucuuucuuuuccuggccccguuugugcuccugauuuucuuuuucuuuuucggauggcggcugcucuuuugucuuaagugcuguagacggacccgcggccugcugaaauacaagcaucucaaagaugaagaggaagcuggguauaagaagaucauugagagacugaauggcaaaaagggaaaaucccagcuuuucgacggcgagcggcuggccgacagaaagaucgcggaacucuuuagcaccaaaauucacaucggg

SEQ ID NO: 13882 - RNA, 2916 nt, Artificial Sequence
  derived and/or modified CDS sequence (opt5) from CCHFV(Afg09-2990, Artificial)__HM452306.1__Gn-4aa-Gc
agcgaggaauccggcgacgauugcaucucuagaacccagcugcuccggacagagacggccgaagugcacggggacaacuacggaggccccggggauaagauuaccaucuguaauggaagcacagucguugaccaacgccugggcuccgagcuugggugcuauaccauuaacagagugcggucuuucaaacugugugaaaauagcgcuacaggaaaguccugcgagaucgauucuauuccugugaaauguaagcagggcuacugccucaaaaucacccaggagggccgcgggcaugucaagcugagcagaggauccgaagugguucuugacgugugugauagcucuugcgaggucaugaucccgaagggcacaggggacauucugguggauuguuccggaggccagcaacacuaucucaaagacaaccugguugaucuggggugccccaagaucccucuccugggaaaaauggccauuuacaucugucggaugagcaaucaucccaagaccacgauggcguuucuuuucugguuuucuuucggcuaugugauuaccugcauccugugcaaagcuaucuuuuuccuccugauuaucuuuggcacacuugggaagcgcuucaagcaguacagagaacugaaaccucagaccuguacaauuugcgagaccacgcccgucaacgccaucgacgccgagaugcacgaucucaauuguuccuauaacauuugcccuuacugugcuagccggcugacaucugacggacuggcccgccaugugacccagugcccgagacggaaggaaaaaguggaggaaacagagcucuaccugaaucuugaacgcauccccugggucguuagaaagcugcuccaaguguccgagagcaccggcaccgugcugaaacgguccucuuggcuuauuguccugcucgugcuguuuacaguuagccuguccccugugcagagcgcucccaucgggcgcagaccucucuuccuggacucuaucgucaagggaaugaaaaaccuucuuaauuccacgagccucgagaccucucugagcauugaagcccccuggggcgcgaucaacgugcaguccacauauaagccgaccguuucuacagccaauauugcucuuagcugguccagcguggagcaccgggggaacaagguccuggugucuggaagauccgaaagcaucaugaaacucgaggaacgcaccggcauuucuugggaucugggcgucgaggacgccuccgagagcaagcugcucacgguguccguuauggaucugucucagauguacagcccuguguuugaauaucuuuccggggaccggcaagucgaggaauggcccaaagcuacauguaccggagauugcccugagagauguggcugcaccucuagcacaugucugcacaaggaauggccccauucccgcaauuggcggugcaaccccaccuggugcuggggaguggggacaggcuguacgugcugugggcucgacguuaaagaucuguucaccgacuacauguuugugaaguggaaggucgaguauaucaaaacagaggccaucgugugcguggaacugaccagccaggagagacaguguucucuuauugaagcgggcacacgcuucaaccucggauccguuaccaucacgcugagcgagccucggaauauucaacagaagcugccgcccgagaucauuacccuccacccuaaaaucgaagagggcuucuuugaucugaugcauguccagaaggugcuuucugccuccacagugugcaaacugcagagcuguacccacgggguccccggagaccuccaaguguaccacauuggcaaccugcugaagggggauagaguuaauggacaucuuauccacaagaucgaacagcauuucaacacaucuuggaugagcugggacggcugcgaccucgauuauuacuguaauaugggggacuggccuuccugcaccuacacgggcgugacacagcacaaccaugcuagcuuugucaaucugcugaacauugagaccgauuauacaaaaaccuuccacuuucacucuaagcgcgugaccgcccauggagacacaccccagcucgaucugaaagcucggccgacguacggcgccggggaaaucaccguucuuguggaggucgccgacauggagcugcacacaaagaaaauugaaaucuccggacucaaguucgcuggccugaccuguacagggugcuaugcgugcagcuccggaauuucuuguaaggugagaauccauguugaugagccugacgaacugaccgugcacgucaaaagcgaugaccccgaugugguggccgcuuccucuagccuuauggcccgcaagcucgaguuuggcacggacuccacauucaaagccuuuucugcuaugccuaagaccagccugugcuucuacaucgucgaacgggaguauuguaaauccugcagcaaggaggauacccaaaaauguguuaauacaaagcuggaacagccccagucuauucucaucgagcacaaggggaccauuaucggcaaacagaacaauacaugcacggccaaggcguccuguuggcuggaaagcgugaaauccuuuuucuacggacuuaagaacaugcugggcgggauuuuuggaaauguguucaucggcaucuucaccuuucucacaccuuucauucugcugauccuguuuuucauguuuggguggcggauucucuucugcuuuaaauguugcagacgcaccagaggacuguucaaguaucggcaucugaaggacgacgaggaaacaggcuacagaaaaaucauugagcgccucaacaauaagaaagggaagaaccggcugcuugauggcgagagacuggcugaccgcaaaaucgccgaacucuuuucuaccaagacgcacaucgga

SEQ ID NO: 13883 - RNA, 2916 nt, Artificial Sequence
  derived and/or modified CDS sequence (opt5) from CCHFV(Sudan Al-Fulah 3-2008, Artificial)__HQ378184.1__Gn-4aa-Gc
agcgaggaacccuccgacgauugcaucucuagaacccagcugcuccggacagagacggccgaaauucacggcgacaacuacgggggaccuggcgauaagaucaccauuuguaaugggagcacaaucguggaccagcgccugggauccgagcuuggcugcuauaccauuaacagagucaaaucuuucaagcugugugaaaauagcgcuacagggaaauccugcguuaucgauucugugccggugaagugucggcagggauacugccuccgcaucacccaggagggcagaggccaugucaaacugagccggggguccgaggugguucuugacgccugugauacaagcugcgaaauuaugauccccaagggaaccggcgacauucugguggauuguucugggggacagcaacacuuucucaaggacaaccuggucgaucugggcugcccuaaaaucccccuccuggggaagauggcgauuuauaucugucgcauguccaaucauccuaaaacgaccauggcuuuccuuuucugguucagcuuuggauacgugauuacaugcauccugugcaaggccaucuucuaucuccugauuaucauuggcacccuuggcaaaagauuucggcaguaccgcgagcugaagccccagacauguaccaucugcgaaacgacaccuguuaacgccauugacgcugagaugcacgaucucaauuguucuuauaacaucugcccguacugugccuccagacugaccagcgacgggcuggcucggcaugugacacagugccccaagcgcaaagagaaggucgaagagaccgaacucuaccugaaucuugagagaaucccuuggguggugcggaaacugcuccaagucucugaauccaccggaguugcccugaagcgcagcuccuggcuuauugugcugcucgugcuguucacagucucucugagccccgugcaguccgcgccuaucggcagacggccccucuuucuggacagcauuguuaaagggaugaagaaccuucucaauucuacgucccucgagaccagccugucuaucgaggccccguggggagcuauuaacgugcagagcacauauaaaccuaccgucuccacagccaauaucgcucuuucuuggagcuccguggaacacagaggcaacaagauccugguuagcgggcgcucugaguccauuaugaagcucgaggaacggaccggaaucagcugggaucugggcguggaagacgccucugaguccaaacugcucacggucagcgugauggaucugucccagauguacucucccgucuucgaguaucuuagcggcgacagacaaguggaagaguggccuaaggcgacauguaccggggauugccccgaacgcuguggaugcaccuccucuacaugucugcacaaagaguggccccauagccggaauuggagaugcaacccuaccuggugcuggggcguugggacaggauguacgugcuguggccucgacgugaaggaucuguuuaccgacuacauguucgucaaauggaagguggaauauauuaagacagaggccaucguuugcguggagcugaccucccaggaacgccaguguagccuuauugaggcugggacacgguuuaaccucggcccggucaccaucacgcugucugaacccagaaauauucaacagaaacugccucccgagaucaucacccuccacccucgcauugaggaaggauucuucgaucugaugcaugugcagaaggugcuuuccgccagcacaguuugcaaacugcagucuuguacccacggcguccccggggaccuccaaguguaccacaucggaaaccugcugaagggcgauaaagugaaugggcaucuuauucacaagaucgagccgcauuuuaacacauccuggaugagcugggacggaugcgaccucgauuauuacuguaauaugggcgacuggccuucuugcaccuacacgggggucacacagcacaaccaugcuagcuucgugaaucugcugaacauugaaaccgauuauacaaagaauuuucacuuccacuccaaacggguuaccgcccauggcgacacaccccagcucgaucugaaggccagaccuaccuacggagcuggcgagaucacggugcuugucgaaguggcggacauggagcugcacaccaaaaagaucgagauuagcgggcucaaauuugccucucugacauguaccggaugcuaugcuugcuccagcggcaucuccuguaagguucgcauucauguggaugaacccgacgagcugacaguccacgugaagucugaugacccugauguuguggccgccagcuccucucuuauggcucggaaacucgaauuugggaccgacagcacguuuaaggccuucuccgcgaugcccaaaacaucucugugcuuuuacaucgucgagaaggaauauuguaaaagcugcuccgaggaggauaccaagaaaugugugaacaccaagcuggaacagccgcaaagcauucucaucgagcacaagggaacaaucauuggcaaacaaaauucuaccugcacagcuaagguguccuguuggcuggaaagcgccaaaucuuucuuuuacgggcuuaaggacaugcuguccggcaucuucggaaacgucuuuauuggcaucuuccucuuccuggccccuuuuguucugcuugugcuguucuuuauguucggguggcggauucugcugugcuuuagauguugccgcagaacgcggggacucuucaaauauagacaucugaaggacgaugaggaaaccggcuaccgccggaucaucgagagacuuaauaacaagaaagggaagaauaaacugcucgacggagagcgccuggcugauagaaagauugccgaacuguuuagcacaaaaacccacaucggc

SEQ ID NO: 13884 - RNA, 2916 nt, Artificial Sequence
  derived and/or modified CDS sequence (opt5) from CCHFV(Sudan AB1-2009, Artificial)__HQ378187.1__Gn-4aa-Gc
agcgaggaacccuccgacgauugcaucucuagaacccagcuucuccggacagagacggccgaaauucacggcgacaacuacgggggaccuggcgauaagaucaccauuuguaaugggagcacaaucguggaccagcgccugggauccgagcuuggcugcuauaccauuaacagagucaaaucuuucaagcugugugaaaauagcgcuacagggaaaaacugcgagaucgauuccguuccggugaagugucggcagggauacugccuccgcaucacccaggagggcagaggccaugugaaacugucucgggggagcgaagucgugcuugacgccugugauacauccugcgagauuaugauccccaagggaaccggcgacauucugguugauuguagcgggggacagcaacacuuucucaaggacaaucugaucgaucugggcugcccuaaaauuccccuccuggggaagauggcgaucuauauuugucgcaugucuaaccauccuaaaacgaccauggcuuuccuguuuugguucuccuuuggauaccuuaucacaugcauccucugcaaggccauuuucuaucugcuuaucauuaucggcacccugggcaaaagacucaagcaguaccgggaacugaagccccagacauguaccauuugcgagacgacaccugugaaugccaucgacgcugagaugcacgaucugaacuguagcuauaauaucugcccguacugugccucucgccucaccuccgacgggcuggcuagacaugucauucagugccccaaacggaaggaaaaaguggaggaaacagagcuuuaccugaaccucgaacgcaucccuuggguugugagaaagcugcuucaagucagcgagucuaccggaguggcccugaaacgguccagcuggcucauugugcugcugguccucuuuaccguuucccugucucccgugcagagcgcgccuaucggccgcaagccccuuuuccuggacuccauugccaaagggaugaagaaucuccugaacagcacaucucuugagacgucccugagcaucgaagcuccguggggagccaucaaugugcagucuaccuauaagccuacagucagcaccgcuaacauugcccucuccuggucuagcguggagcacagaggcaauaaaauccugguuuccgggcggagcgaaucuauuaugaagcuggaggaaagaacaggaaucuccugggaucucggcguggaggacgcgagcgagucuaaacugcuuaccgucuccgugauggaucugagccagauguacucccccguuuuugaauaucucucuggcgaccgccaaguggaggaauggccuaaggccacguguacaggggauugccccgagcgguguggaugcaccagcuccaccugucugcacaaagaauggccccauucuagaaacuggcgcugcaacccuacauggugcuggggcgucgggaccggauguacaugcuguggccuggacgugaaggaucuuuucacggacuacauguuugucaaguggaaaguggaguauauuaagaccgaggcuaucguuugcguggaacucacaagccaggagcggcaguguucccugauugaagccgggaccagauucaaucugggcccggucacaaucacccucagcgagccccgcaacauccaacagaaacugccucccgagauuaucacgcuucacccucggauugaagagggauuuuucgaucugaugcaugugcagaagguucucucugcuuccaccgugugcaaacugcagagcuguacacacggcguccccggggaccugcaaguguaccacaucggaaaucuucucaagggcgauaaggugaacgggcaucugauucacaaaaucgaaccgcauuucaauaccucuuggauguccugggacggaugcgaccuggauuauuacuguaacaugggcgacuggccuagcugcacauacaccgggguuacgcagcacaaucaugccucuuuugucaaccuccugaauaucgagacagauuauaccaagaacuuccacuuucacagcaaaagagugacagcccauggcgacacaccccagcuugaucugaaggcucgcccuaccuacggagcgggcgaaauuacagugcucgucgagguggccgacauggagcugcacacgaaaaagaucgaaauuuccgggcugaaguucgcuagccuuaccuguacaggaugcuaugccuguucuuccggcaucagcugcaaaguucggauucauguggaugagcccgacgaacucaccguccacgugaaguccgaugacccugauguuguggccgcuucuagcucccugauggccagaaaacuggaguuugggacagacucuaccuucaaggcguuuagcgcuaugcccaaaacgucccucugcuucuacaucgucgaacgcgagcacuguaagucuugcaaugaggaagauaccaaaaagugugugaacaccaagcuggagcagccgcaaagcauccuuauugaacauaaaggaaccaucauuggcaagcaaaauuccacaugcaccgcccgggccagcuguuggcuggagucuguuaaauccuuuuucuaugggcucaagaacaugcugagcggcaucuuuggaaauguguucaugggcauuuuucuguuccuugcuccuuucauccuccugauccuguuuuucauguuuggguggcggauucucuucugcuuuaaauguugcagacgcacaagaggacuguucaaguaccggcaccuuaaggacgacgaagagacgggcuauagacgcaucauugagcggcugaacaacaaaaaggggaaaaauaagcuccuggauggagaaagacuggccgaccgcagaaucgcugagcuguuuucuaccaaaacacauauuggc

SEQ ID NO: 13885 - RNA, 2916 nt, Artificial Sequence
  derived and/or modified CDS sequence (opt5) from CCHFV(NIVA 118595, Artificial)__JN572083.1__Gn-4aa-Gc
agcgaggaauccggcgacgauugcaucucuagaacccagcugcuccggacagagacggccgaagugcacggggacaacuacggaggccccggggauaagauuaccaucuguaauggaagcacagucguugaccaacgccugggcuccgagcuugggugcuauaccauuaacagagugaaaucuuucaagcugugugaaaauagcgcuacaggaaaauccugcgagaucgauucuauuccugugaagugucggcagggcuacugccucaaaaucacccaggagggccgcgggcaugucaagcugagcagaggauccgaagugguucuugacgccugugauagcucuugcgaggugaugaucccgaagggcacaggggacauucuggucgauuguuccggaggccagcaacacuuucucaaagacaaccugaucgaucuggggugccccaagauuccucuccugggaaaaauggcgaucuauauuugucggaugagcaaucaucccaagaccacgauggcuuuccuguuuugguucucuuuuggcuacgugauuaccugcauucuuugcaaaguuaucuucuaucuccugaucauuuuuggcacacuugggaagcgcuucaagcaguacagagaacugaaaccucagaccuguacaaucugcgagaccacgcccgugaacgccauugacgccgagaugcacgaucucaauuguuccuauaacaucugcccuuacugugcuagccggcugacaucugacggacuggcccgccaugucacccagugcccgaagagaaaagaaaagguggaggaaacagagcucuaccugaaucuugaacggauucccugggugguccgcaaacugcuccaaguuuccgagagcaccggcaucgcucugaagagauccucuuggcuuaucgugcugcucgugcuguuuaccgucagcauuacaccugugcaguccgcccccaucgggcggcgcccucuguuccucgacagcauuguuaaaggaaugaagaaccugcuuaauucuacgucccuggagaccagccucucuaucgaagcgcccuggggcgccauuaacgugcagagcacauauaagccgaccgucuccgcugccaauaucgcucugucuuggagcuccguggagcacagagggaacaaaauccuuguuagcggacggucugaauccauuaugaagcuggaggaaagaacaggcaucagcugggaucucggcguggaggacgccucugaguccaaacugcugaccgucagcgugauggaucucucccagauguacucuccugucuuugaauaucugagcggggaccgccaaguggaggaauggcccaaggcgacguguacaggagauugcccugagcgguguggcugcaccuccucuaccugucuucacaaagaauggccccauagcagaaauuggcgcugcaaccccacauggugcuggggaguugggaccggcuguacaugcugugggcuggacgugaaggaucucuucacggacuacauguuugucaaguggaaaguggaguauauuaagaccgaggccaucguuugcguggaacugacaucccaggagcggcaguguagccugauugaagcuggcaccagauucaaccuuggaucugucacaaucacccucuccgagccucgcaauauucaacagaaacugccgcccgagaucaucacgcugcacccucggauugaagagggcuucuuugaucucaugcaugugcagaaggugcugagcgccucuaccguuugcaaacuucaguccuguacacacgggguccccggagaccugcaaguguaccacaucggcaaccuccugaagggggauagagugaauggacaucugauucacaagaucgaacagcaucuuaacaccagcuggaugucuugggacggcugcgaccucgauuauuacuguaauaugggggacuggccuagcugcacauacaccggcgucacgcagcacaaccaugcuuccuucgugaaucugcugaacauugagacagauuauaccaaaacauuucacuuccacagcaagcgcguuaccgcccauggagacacaccccagcucgaucugaaagcccggccgaccuacggcgcuggggaaaucacggugcuugucgagguggcggacauggagcugcacaccaagaaaaucgaaauuucuggacucaaguuugccucccugagcuguacaggcugcuaugcuugcuccucugggaucagcuguaagguucgcauucauguggaugagccugacgaacugaccguccacgugaaauccgaugaccccgauguuguggccgccucuagcucccuuauggcuagaaagcucgagucuggaacagacagcaccuucaaagccuuuuccgcgaugccuaagacgagccugugcuucuacaucgucgaacgggaguauuguaaaggcugcucuaaggaggauacacaaaaaugugugaauaccaagcuggaacagccccaguccauucucaucgagcacaaggggaccaucauuggcaaacagaacaauacaugcaccgcuaaggccagcuguuggcuggaaucugugaaauccuuuuucuacggacuuaagaacaugcugagcggcaucuuugggaaugucuuccucggaaucuuuucuuuccuggccccuuucguucugcuuauccucuuuuucauguuuggcuggcggauucuguucugcuuuaaauguugcagacgcacaagagggcuguucaaguaucggcaucucaaggacgacgaggaaacgggauacagaaaaaucaucgagcgccugaacaauaagaaaggcaagaacaaacuucuggauggggagcggcucgcugacagaaagauugccgaacuguuuuccaccaagacacacaucggc

SEQ ID NO: 13886 - RNA, 2916 nt, Artificial Sequence
  derived and/or modified CDS sequence (opt5) from CCHFV(NIV 112143, Artificial)__JN572085.1__Gn-4aa-Gc
agcgaggaauccggcgacgauugcaucucuagaacccagcugcuccggacagagacggccgaagugcacggggacaacuacggaggccccggggauaagauuaccaucuguaauggaagcacagucguugaccaacgccugggcuccgagcuugggugcuauaccauuaacagagugaaaucuuucaagcugugugaaaauagcgcuacaggaaaauccugcgagaucgauucuauuccugugaagugucggcagggcuacugccucaaaaucacccaggagggccgcgggcaugucaagcugagcagaggauccgaagugguucuugacgccugugauagcucuugcgaggugaugaucccgaagggcacaggggacauucuggucgauuguuccggaggccagcaacacuuucucaaagacaaccugaucgaucuggggugccccaagauuccucuccugggaaaaauggcgaucuauauuugucggaugagcaaucaucccaagaccacgauggcuuuccuguuuugguucucuuuuggcuacgugauuaccugcauucuuugcaaaguuaucuucuaucuccugaucauuuuuggcacacuugggaagcgcuucaagcaguacagagaacugaaaccucagaccuguacaaucugcgagaccacgcccgugaacgccauugacgccgagaugcacgaucucaauuguuccuauaacaucugcccuuacugugcuagccggcugacaucugacggacuggcccgccaugucacccagugcccgaagagaaaagaaaagguggaggaaacagagcucuaccugaaucuugaacggauucccugggugguccgcaaacugcuccaaguuuccgagagcaccggcaucgcucugaagagauccucuuggcuuaucgugcugcucgugcuguuuaccgucagcauuacaccugugcaguccgcccccaucgggcggcgcccucuguuccucgacagcauuguuaaaggaaugaagaaccugcuuaauucuacgucccuggagaccagccucucuaucgaagcgcccuggggcgccauuaacgugcagagcacauauaagccgaccgucuccgcugccaauaucgcucugucuuggagcuccguggagcacagagggaacaaaauccuuguuagcggacggucugaauccauuaugaagcuggaggaaagaacaggcaucagcugggaucucggcguggaggacgccucugaguccaaacugcugaccgucagcgugauggaucucucccagauguacucuccugucuuugaauaucugagcggggaccgccaaguggaggaauggcccaaggcgacguguacaggagauugcccugagcgguguggcugcaccuccucuaccugucuucacaaagaauggccccauagcagaaauuggcgcugcaaccccacauggugcuggggaguugggaccggcuguacaugcugugggcuggacgugaaggaucucuucacggacuacauguuugucaaguggaaaguggaguauauuaagaccgaggccaucguuugcguggaacugacaucccaggagcggcaguguagccugauugaagcuggcaccagauucaaccuuggaucugucacaaucacccucuccgagccucgcaauauucaacagaaacugccgcccgagaucaucacgcugcacccucggauugaagagggcuucuuugaucucaugcaugugcagaaggugcugagcgccucuaccguuugcaaacuucaguccuguacacacgggguccccggagaccugcaaguguaccacaucggcaaccuccugaagggggauagagugaauggacaucugauucacaagaucgaacagcaucuuaacaccagcuggaugucuugggacggcugcgaccucgauuauuacuguaauaugggggacuggccuagcugcacauacaccggcgucacgcagcacaaccaugcuuccuucgugaaucugcugaacauugagacagauuauaccaaaacauuucacuuccacagcaagcgcguuaccgcccauggagacacaccccagcucgaucugaaagcccggccgaccuacggcgcuggggaaaucacggugcuugucgagguggcggacauggagcugcacaccaagaaaaucgaaauuucuggacucaaguuugccucccugagcuguacaggcugcuaugcuugcuccucugggaucagcuguaagguuagaauccauguggaugagccugacgaacugaccguccacgugaaauccgaugaccccgauguuguggccgccucuagcucccuuauggcucgcaagcucgaguucggaacagacucuaccuuuaaagccuucagcgcgaugccuaagacgucccugugcuuuuacaucgucgaacgggaguauuguaaaggcugcagcaaggaggauacacaaaaaugugugaauaccaagcuggaacagccccagucuauucucaucgagcacaaggggaccaucauuggcaaacagaacaauacaugcaccgcuaaggccuccuguuggcuggaaagcgugaaaucuuucuuuuacggacuuaagaacaugcuguccggcaucuucgggaaugucuuucucggaauuuucagcuuccuggccccuuuuguucugcuuauccucuucuuuauguucggcuggcggauucuguuuugcuucaaauguugcagacgcacaagagggcuguuuaaguaucggcaucucaaggacgacgaggaaacgggauacagaaaaaucaucgagcgccugaacaauaagaaaggcaagaacaaacuucuggauggggagcggcucgcugacagaaagauugccgaacuguucucuaccaagacacacaucggc

SEQ ID NO: 13887 - RNA, 2916 nt, Artificial Sequence
  derived and/or modified CDS sequence (opt5) from CCHFV(SCT ex Afghanistan, Artificial)__KC344856.1__Gn-4aa-Gc
agcgaggaauccggcgacgauugcaucucuagaacccagcugcuccggacagagacggccgaagugcacaacgacaauuacgggggacccggcgauaagauuaccaucuguaacgggagcacaauugucgaccaacgccugggauccgagcuuggcugcuauaccaucaauagaguuaaaucuuucaagcugugugaaaacagcgcuacagggaaauccugcaagauugauucuaccccugugaaaugucggcagggauuuugccucaagaucacacaggagggccgcggccaugugaagcugagcagaggguccgaggucgugcuugacgccugugauagcucuugcgaaaucaugauuccgaaaggaaccggcgacauccugguugauuguuccgggggacagcaacacuuccucaaggacaaucugauugaucugggcugccccaacaucccucuccuggggaaaauggcgauuuacaucugucggaugagcaaucaucccaagacgaccauggcuuuucuuuucugguuuucuuucggauaugugauuacaugcaucuuuugcaaagucaucuucuaccugcucauugugguuggcacccugggcaagaaguuuaaacaguaucgcgagcuuaagccucagacauguaccaucugcgaaacgacacccaccaacgccauugacgccgagaugcacgaucugaauuguuccuacaacaucugcccuuauugugcuagcagacucacaucugacgggcuggcccggcaugugacccagugcccgaaacgcaaggagaaagucgaagagaccgaacuguaccucaaucuggagcggauucccuggaucgugagaaagcuccugcaaguguccgaaagcacaggagucgcucucaaacgcuccucuuggcugaucguucuucuggugcuccugacggugagccuguccccuguccagagcgcccccauuggcagaaagccucucuuccugaacucuaucgugaaggggaugaaaaaucuucugaacuccaccaaucucgagacaagccugucuauugaggcgcccuggggagccaucaacguucagagcaccuuuaagccgacaguguccaccgcuaacauugcccuuucuuggagcuccgucgaacaccggggcaauaaaauccuggugagcgggcgcucugaguccaucaugaagcucgaagagagaacgggaauuagcugggaccugggcguugaagaugcuucugaguccaaaagccugacaguguccgucauggaccucucucagauguacagcccuguguucgaguaucuguccggcgaucggcaagucgaagaguggcccaaggccaccuguaccggggacugcccugaaagauguggaugcacaucuagcaccugucuucacaaggaguggccccauucccgcaacuggcggugcaaucccacauggugcuggggcguggggacgggauguaccugcuguggccuggauguuaaagaccucuuuacagauuacauguucgugaaguggaaagucgaauauaucaagaccgaggcgauugugugcguugagcugacaagccaggaaagacaguguucucugaucgaggccgggacccgcuucaaccuuggcccugugacgauuacccucuccgaaccgcggaauauccaacagaaacugcccccugagauuaucacacugcaccccagaaucgaggaaggauuuuucgaccucaugcauguccagaaggugcugagcgcuucuaccgugugcaaacuucaguccuguacacacggcguuccuggggaucugcaagucuaccacauuggaaaccuccugaagggcgacaagcugaaugggcauaugauccacaaaauugagccccauuuuaacaccagcuggaugucuugggauggaugcgaccuugacuauuacuguaauaugggcgauuggccgagcugcacguauacaggggugacccagcacaaccaugccgcuuucgugaaucuccugaacaucgaaacagacuacaccaagaauuuucacuuccacuccaaacgcgucaccgcccauggcgauacaccucagcuggaccucaaggcccggcccacguacggagcuggcgagauuaccgugcugguugaaguggcggauauggagcuucacacaaagaaaaucgacaucagcgggcugaaguuugccucucucaccugugcuggaugcuaugccugcuccagcggcauuuccuguaaagucagaauccauguggaugagccugacgaacugacaguucacgugaagucugaggaucccgacauugucgccgcuagcaccucccugaucgcccgcaaacuugaacucgggacggauucuacauucaaggcguuuagcgcuaugccuaaaaccucccugugcuucuacauuguggagcgggaauauuguaagucuugcagcaaggaggacacccagaaauguguuaacacaaagcuggagcacccccaaggaauccucaucgaacauaaaggcaccauuaucgggaagcagaaugauacaugcacggccaaagccggcuguuggcuggaguccgucaagagcuuuuucuacggacuuaagaacaugcugucuggcauuuuugggaacguguucaucggaauuuuccucuuucuggcuccguucgugcugcuuauccucuuuuucauguuuggcuggagacugcuguucugcuuuaaauguugccgccggaccagagggcuuuucaaguaucggcaccugaaagaagacgaggaauccggauaccgcagaaucauugagcggcuuaauaacaagaaaggcaagaauaagcugcucgacggggagagacuggccgaucgccggaucgcugaacuguuuagcacaaaaacccauauuggc

SEQ ID NO: 13888 - RNA, 2916 nt, Artificial Sequence
  derived and/or modified CDS sequence (opt5) from CCHFV(Zahedan 2007, Artificial)__KC867273.1__Gn-4aa-Gc
agcgaggaauccggcgacgauugcaucucuagaacccagcugcuccggacagagacggccgaagugcacggggacaacuacggaggccccggggauaagauuaccaucuguaauggaagcacagucguugaccaacgccugggcuccgagcuugggugcuauaccauuaacagagugcggucuuucaaacugugugaaaauagcgcuacaggaaaguccugcgagaucgauucuauuccugugaaauguaagcagggcuuuugccucaaaaucacccaggagggccgcgggcaugucaagcugagcagaggauccgaagugguucuugacgugugugauagcucuugcgaggucaugaucccgaagggcacaggggacauucugguggauuguuccggaggccagcaacacuuccucaaagacaaccugguugaucuggggugccccaagaucccucuccugggaaaaauggccauuuacaucugucggaugagcaaucaucccaagaccacgauggcguuucuuuucugguuuucuuucggcuaugugauuaccugcauccugugcaaagcuaucuuuuuccuccugauuaucuuuggcacacuugggaagcgcuucaagcaguacagagaacugaaaccucagaccuguacaauuugcgagaccacgcccgucaacgccaucgacgccgagaugcacgaucucaauuguuccuauaacauuugcccuuacugugcuagccggcugacaucugacggacuggcccgccaugugacccagugcccgagacggaaggaaaaaguggaggaaacagagcucuaucugaaucuugaacgcauccccugggucguuagaaagcugcuccaaguguccgagagcaccggcaccgugcugaaacgguccucuuggcuuauuguccugcucgugcuguuuacaguuagccuguccccugugcagagcgcucccaucgggcgcagaccucucuuccuggacucuaucgucaaggauaugaaaaaccuucuuaauuccacgagccucgagaccucucugagcauugaagcccccuggggagcgaucaacgugcaguccacauacaagccgaccguuucuacagccaauauugcucuuagcugguccagcguggagcaccggggcaacaagguccuggugucugggagauccgaaagcaucaugaaacucgaggaacgcaccggaauuucuugggaccugggcgucgaggaugccuccgagagcaagcugcucacgguguccguuauggaccugucucagauguacagcccuguguuugaauaucuuuccggcgaucggcaagucgaggaauggcccaaagcuacauguaccggggacugcccugagagauguggaugcaccucuagcacaugucugcacaaggaauggccccauucccgcaauuggcggugcaaccccaccuggugcuggggcguggggacaggauguacgugcuguggccucgauguuaaagaccuguucaccgauuacauguucgugaaguggaaggucgaguauaucaaaacagaggccaucgugugcguggaacugaccagccaggagagacaguguucucuuauugaagcggggacacgcuuuaaccucggcuccguuaccaucacgcugagcgagccucggaauauucaacagaagcugccgcccgagaucauuacccuccacccuaaaaucgaagagggauucuuugaccugaugcauguccagaaggugcuuucugccuccacagugugcaaacugcagagcuguacccacggcguccccggggaucuccaaguguaccacauuggaaaccugcugaagggcgacagaguuaaugggcaucuuauccacaagaucgaacagcauuucaacacaucuuggaugagcugggacggaugcgaucucgacuauuacuguaauaugggcgauuggccuuccugcaccuauacgggggugacacagcacaaccaugcuagcuuugucaaucugcugaacauugagaccgacuacacaaaaaccuuccacuuucacucuaagcgcgugaccgcccauggcgauacaccccagcucgaccugaaagcucggccgacguacggagccggcgaaaucaccguucuuguggaggucgccgauauggagcugcacacaaagaaaauugaaaucuccgggcucaaguucgcuggacugaccuguacaggcugcuaugcgugcagcuccgggauuucuuguaaggugagaauccauguugacgagccugaugaacugaccgugcacgucaaaagcgacgaucccgacgugguggccgcuuccucuagccuuauggcccgcaagcucgaguuuggaacggauuccacauucaaagccuuuucugcuaugccuaagaccagccugugcuucuacaucgucgaacgggaguauuguaaauccugcagcaaggaggacacccaaaaauguguuaauacaaagcuggaacagccccagucuauucucaucgagcacaagggcaccauuaucgggaaacagaacaauacaugcacggccaaggcguccuguuggcuggaaagcgugaaauccuuuuucuacggccuuaagaacaugcugggaggcauuuucgggaauguguuuaucggaaucuucaccuuucucacaccuuucauucugcugaucuuuuucuuuauguucggcuggcggauucuguuuugcuucaaauguugcagacgcaccagagggcucuuuaaguaucggcaucugaaggacgaugaggaaacaggauacagaaaaaucauugagcgccugaacaauaagaaaggcaagaaccggcuccuggacggggagagacuugcugaucgcaaaaucgccgaacuguucucuaccaagacgcacaucggc

SEQ ID NO: 13889 - RNA, 2916 nt, Artificial Sequence
  derived and/or modified CDS sequence (opt5) from CCHFV(SPU 44/08, Artificial)__KJ682805.1__Gn-4aa-Gc
agcgaggaauccaacgacgauugccugucuagaacccagcuccugcggacagagaaugccgaaauccacagcgacaacuacggcgggcccggagauaagauuacgaucuguaauggcuccaccauuguggaccaacgccuugggucugagcugggaugcuauacaaucaacagagucaaaucuuucaagcucugugaaaauuccgcuaccggcaaaucuugcgagauugauagcacaccuguucggugucgccagggguuuugccugaagaucacccaggagggaagaggccaugugaaacuuucccggggcagcgaagugguccuggacgccugugauucuuccugcgagaucaugauuccgaaggggacaggagacauccucguggauuguagcggcgggcagcaacacuuccugaaggacaaccugguugaucucggaugccccaauauuccucugcuuggcaaaauggcgaucuacauuugucgcaugucuaaccaucccaagaccacgauggcuuuucuguucugguuuuccuucggguaugugaucacaugcauucucugcaaagccaucuuuuaccugcuuaucgucgugggaacacugggcaagaaauucaagcaguauagagaacucaagccucagaccuguacaauuugcgagaccaaucccguuaacgccaucgacgcugagaugcacgaucugaauuguagcuacaacauuugcccuuauugugccucucggcugacguccgacggccucgcucgccaugugaugcagugcccgaaaagaaaggaaaagaucgaggaaacagagcuguaccuuaaucuggaacggauucccugggucgugcgcaagcuccugcaagugagcgaguccaccggggucgcccuuaaaagaucuagcuggcugguuauccuccuggugcugcucacagugucccugagcccuguccagucugcgcccaucucccggaagccucuuuuucuggacagcauugugaaaggaaugaagaaccuccuuaauucuaccagccuggagaccucccugucuaucgaagcccccuggggcgcuauuaacguucagagcacauucaagccgacgguguccgccgcuaacaucgcccucagcuggucuuccgucgagcaccgcgggaauaaaauucuggugagcggaagaucugaauccaucaugaagcuggaggaacggaccggcaucagcugggaucucgggguugaggacgcguccgagucuaaacugcuuacagugagcgucauggaucugucccagauguacucuccuguguuugaauaucucagcggagacagacaagucgaggaauggcccaaggccaccuguacaggcgauugcccugagcgcuguggcugcaccuccagcacgugucugcacaaagaauggccccauucucggaacuggagaugcaaucccacauggugcuggggagugggaaccggcuguaccugcugugggcuggacguuaaggaucuuuucacagacuacauguuugugaaguggaaagucgauuauauuaagaccgaggcuaucgugugcguugagcucacaucccaggaacgccaguguagccugauugaggccggaacgcgguucaaccugggcccugugaccaucacacucucugaaccgagaaauauucaacagaaacugcccccugagaucgucacccuucacccccgcauugaggaaggguucuuugaccugaugcauauccagaaggugcucuccgcuagcacagugugcaaacugcagucuuguacccacggcguuccuggagaucugcaaaucuaccacauuggcaaccuucucaagggggacaaggucaauggacaucugauccacaaaauugagccccauuucaacacgagcuggauguccugggacggcugcgaucuggacuauuacuguaauaugggggauuggccgagcugcucuuauaccggagugacacagcacaaccaugccgccuuugugaauaugcucaacaucgaaaccgacuacacaaagaauuuccacuuucacuccaaacgggucaccgcucauggcgauacgccucagcuggaccuuaaggcgagacccacauacggggccggcgagauuaccgugcugguugaaguggcugauauggagcuccacaccaaaaagaucgagaucagcggacugaaguucgccucccugaccuguaccggcugcuaugccugcucuagcgggauuuccuguaaaguccgcauccauguggacgaaccugaugagcuuacaguucacgugaagucugaagaccccgauauugucgcugccagcuccucucucauggcgcggaaacuggaguuuggaacggacagcaccuucaaggcuuuuuccgccaugccuaaaacaagccugugcuucuacaucguggaaagagaguauuguaagucuugcuccaaagaggauacccagaaguguguuaacacaaagcucgaacaaccccagagcauucugaucgagcacaaaggcaccaucauugggaagcagaaugacacgugcacagccaaagcuagcuguuggcuugaauccaucaagagcuuuuucuacggacugaaaaacaugcucucuggcauuuuugggaacguguucaucggcauuuuccuguuucuggccccguucaucaugcuuauccucuuuuucauguuuggauggcgcauucuguucugcuuuaaguguugccggagaacccggggccuguucaaguaucgccaucucaaagacgaugaggaaaucggguacagaaagauuaucgagcggcugaauaacaaaaaggggaaaaauaaacuucuggacggcgagagacucgcugaucgcaagauugccgaacuguuuuccaccaaaacacacaucggg

SEQ ID NO: 13890 - RNA, 2916 nt, Artificial Sequence
  derived and/or modified CDS sequence (opt5) from CCHFV(SPU 383/87, Artificial)__KJ682806.1__Gn-4aa-Gc
agcgaggaauccaacgacgauugccugucuagaacccagcuccugcggacagagaaugccgaaauccacagcgacaacuacggcgggcccggagauaagauuacgaucuguaauggcuccaccauuguggaccaacgccuugggucugagcugggaugcuauacaaucaacagagucaaaucuuucaagcucugugaaaauuccgcuaccggcaaaucuugcgagauugauagcacaccuguucggugucgccagggguuuugccugaagaucacccaggagggaagaggccaugugaaacuuucccggggcagcgaagugguccuggacgccugugauucuuccugcgagaucaugauuccgaaggggacaggagacauccucguggauuguagcggcgggcagcaacacuuccugaaggacaaccugguugaucucggaugccccaauauuccucugcuuggcaaaauggcgaucuacauuugucgcaugucuaaccaucccaagaccacgauggcuuuucuguucugguuuuccuucggguaugugauuaccugcauccucugcaaagucaucuuuuaccugcuugugguugugggaacacugggcaagaaauucaagcaguauagagaacucaagccucagaccuguacaaucugcgagaccaaucccgucaacgccauugacgccgagaugcacgaucugaauuguagcuacaacaucugcccuuauugugcuucucggcugacguccgacggccucgcccgccaugugauucagugcccgaaaagaaaggaaaagaucgaggaaacagagcuguaccuuaaucuggaacggauucccugggugguccgcaagcuccugcaaguuagcgaguccaccgggguggcucuuaaaagaucuagcuggcuggugauccuccugguccugcucacagugucccugagcccuguucagucugcccccaucucccggaagccucuuuuucuggacagcauugugaaaggaaugaagaaccuccugaauagcaccagccuugagaccucccugucuaucgaagcgcccuggggcgccauuaacguccagagcacauucaagccgacgguguccgcugccaacaucgcucucagcuggucuuccguugagcaccgcgggaauaaaauucuggugagcggaagaucugaauccaucaugaagcuggaggaacggaccggcaucagcugggaucucggggucgaggacgccuccgagucuaaacugcuuacagugagcgucauggaucugucccagauguacucuccuguguuugaauaucucagcggagacagacaaguugaggaauggcccaaggcgaccuguacaggcgauugcccugagcgcuguggcugcaccuccagcacgugucugcacaaagaauggccccauucucggaacuggagaugcaaucccacauggugcuggggagugggaaccggcuguaccugcugugggcuggacgucaaggaucuuuucacagacuacauguuugugaaguggaaaguugauuauauuaagaccgaggccaucgugugcgucgagcucacaucccaggaacgccaguguagccugauugaggcuggaacgcgguucaaccugggcccugugaccaucacacucucugaaccgagaaauauucaacagaaacugcccccugagaucgugacccuucacccccgcauugaggaaggguucuuugaccugaugcauauccagaagguucucuccgccagcacagucugcaaacugcagucuuguacccacggcgugccuggagaucugcaaaucuaccacauuggcaaccuucucaagggggacaaggugaauggacaucugauccacaaaauugagccccauuucaacacgagcuggauguccugggacggcugcgaucuggacuauuacuguaauaugggggauuggccgagcugcucuuauaccggagucacacagcacaaccaugcugccuuugugaauaugcucaacaucgaaaccgacuacacaaagaauuuccacuuucacuccaaacggguuaccgcccauggcgauacgccucagcuggaccuuaaggcuagacccacauacggggcgggcgagauuaccgugcuggucgaaguggccgauauggagcuccacaccaaaaagaucgagaucagcggacugaaguucgcuucccugacauguaccggcugcuaugccugcucuagcgggauuuccuguaaaguucgcauccauguggacgaaccugaugagcuuacaguccacgugaagucugaagaccccgauauuguugccgcuagcuccucucucauggcccggaaacuggaguuuggaacggacagcaccuucaaggcguuuuccgcuaugccuaaaacaagccugugcuucuacaucguggaaagagaguauuguaagucuugcuccaaagaggauacccagaagugugucaacacaaagcucgaacaaccccagagcauucugaucgagcacaaaggcaccaucuuugggaagcagaaugacacgugcacagccaaagccucuuguuggcuugaauccgucaagagcuucuuuuacggacugaaaaacaugcucucuggcauuuucgggaacguguucaucggcguguuucuguuccuggcuccguuuauuaugcuuauccucuucuuuauguucggauggcgcauucuguuuugcuucaaguguugccggagaacccggggccuguuuaaguaucgccaucucaaagacgaugaggaaaucggguacagaaagaucauugagcggcugaauaacaaaaaggggaaaaauaaacuucuggacggcgagagacucgccgaucgcaagaucgcugaacuguucuccaccaaaacacacauuggg

SEQ ID NO: 13891 - RNA, 2916 nt, Artificial Sequence
  derived and/or modified CDS sequence (opt5) from CCHFV(SPU 130/89, Artificial)__KJ682807.1__Gn-4aa-Gc
agcgaggaacccaacuacgacugccuguccagaacccagcuccugcggacagagaaugccgaaauccacucugauaacuauggcgggccuggagacaagauuacgaucuguaauggcagcaccauuguggaucaacgccuuggguccgagcugggaugcuacacaaucaacagagucaaaucuuucaagcucugugaaaauagcgcuaccggcaaauccugcgagauugacucuacaccgguucggugucgccagggguuuugccugaagaucacccaggagggaagaggccaugugaaacuuagccggggcuccgaagugguccuggaugccugugacagcucuugcgagaucaugauucccaaggggacaggagauauccucguggacuguuccggcgggcagcaacacuuccugaaggauaaccugguugaccucggaugcccuaauauuccccugcuuggcaaaauggcgaucuauauuugucgcaugagcaaccauccuaagaccacgauggcuuuucuguucugguuuucuuucggguacgugaucacaugcauucucugcaaagucaucuuuuaucugcuuaucgugguuggaacacugggcaagaaauucaagcaguacagagaacucaagccccagaccuguacaauuugcgagaccaauccugugaacgccaucgaugccgagaugcacgaccugaauuguuccuauaacauuugcccguacugugcuagccggcugacgucugauggccucgcccgccaugucaugcagugccccaaaagaaaggagaaaaucgaagaaacagagcuguaccuuaaucuggaacggauuccuuggguggugcgcaagcuccugcaagucuccgagagcaccgggguugcucuuaaaagauccucuuggcugguggugcuccugguccugcucacagugagccugucccccguucagagcgccccuaucucucggaagccccuuucccuggacagcaucgugaaaggaaugaagaaccuccugaauagcaccagccuugagaccucccugucuauugaagcgccguggggcgccaucaacguccagagcacauuuaagccuacgguguccgcugccaacauugcucucagcuggucuuccguugagcaccgcgggaauaaaauccuggugagcggaagaucugaauccauuaugaagcuggaggaacggaccggcaucagcugggaccucggggucgaggaugccuccgagucuaaacugcuuacagugagcgucauggaccugucccagauguauucucccguguucgaauaccucagcggagauagacaaguugaggaauggccuaaggcgaccuguacaggcgacugccccgagcgcuguggcugcaccuccagcacgugucugcacaaagaauggccccauucucggaacuggagaugcaauccuacauggugcuggggaguggggaccggcuguaccugcugugggcuggaugucaaggaccuuuuuacagauuauauguucgugaaguggaaaguugacuacaucaagaccgaggccauugugugcgucgagcucacaucccaggaacgccaguguagccugaucgaggcuggaacgcgguuuaaccugggcccggugaccauuacacucucugaacccagaaauauccaacagaaacugccucccgagauugugacccuucacccucgcaucgaggaaggguucuucgaucugaugcauauucagaagguucucuccgccagcacagucugcaaacugcagucuuguacccacggcgugcccggagaccugcaaaucuaucacaucggcaaccuucucaagggggauaaggugaauggacaucugauucacaaaaucgagccgcauuuuaacacgagcuggauguccugggacggcugcgaccuggauuacuauuguaauaugggggacuggccuagcugcucuuacaccggagucacacagcacaaccaugcugccuucgugaauaugcucaacauugaaaccgauuacacaaagaauuuucacuuccacuccaaacggguuaccgcccauggcgacacgccccagcuggaucuuaaggcuagaccuacauauggggcgggcgagaucaccgugcuggucgaaguggccgacauggagcuccacaccaaaaagguugagauuagcggacugaaguuugcuucccugaccuguaccggcugcuacgccugcucuagcgggaucuccuguaaagugcgcauccaugucgaugaacccgacgagcuuacagugcacguuaagucugaagauccugacauuguggccgcuagcuccucucucauggcccggaaacuggaguucggaacggauagcaccuuuaaggcguucuccgcuaugcccaaaacaagccugugcuuuuauaucgucgaaagagagcacuguaagucuugcuccaaagaggacacccagcgcugugugaacacaaagcucgaacaaccgcagagcauucugaucgagcauaagggcaccauuaucgggaaacagaaugauacgugcacagccaaggccucuuguuggcuugaauccaucaaaucuuucuuuuacggacugaagaacaugcucucuggcauuuucgggaacguguuuaucggcgucuuccuguuccuggcuccuuuuauuauccuuauucucuucuuuauguucggauggcggauccuguuuugcuucaaauguugcagacggacccgcggccugcucaaguauagacaccugaaggacgacgaggaaaucggguaccggaaaauuaucgagagacuuaauaacaagaaaggaaagaauaaacugcucgauggcgagcgccuggccgaccggaagauugcugaacuguuuuccaccaagacacauaucggg

SEQ ID NO: 13892 - RNA, 2916 nt, Artificial Sequence
  derived and/or modified CDS sequence (opt5) from CCHFV(SPU 497/88, Artificial)__KJ682808.1__Gn-4aa-Gc
agcgaggaauccaacgacgauugccugucuagaacccagcuccugcggacagagaaugccgaaauccacagcgacaacuacggcgggcccggagauaagauuacgaucuguaauggcuccaccauuguggaccaacgccuugggucugagcugggaugcuauacaaucaacagagucaaaucuuucaagcucugugaaaauuccgcuaccggcaaaucuugcgagauugauagcacaccuguucggugucgccagggguuuugccugaagaucacccaggagggaaaaggccaugugaaacuuuccagaggcagcgaagugguccuggacgccugugauucuuccugcgagaucaugauuccgaaggggacaggagacauccucguggauuguagcggcgggcagcaacacuuccugaaagacaaccugguugaucucggaugccccaauauuccucugcuuggcaagauggcgaucuacauuugucggaugucuaaccaucccaaaaccacgaugguguuucuguucugguuuuccuucggguaugucauuaccugcauucucugcaaggugaucuuuuaccugcuuaucguugugggaacacugggcaaaaaguucaagcaguaucgcgaacucaaaccucagaccuguacaauuugcgagaccaaucccgucaacgcuaucgacgccgagaugcacgaucugaauuguagcuacaacauuugcccuuauugugccucuagacugacguccgacggccucgcucggcaugugaugcagugcccgaagcgcaaagaaaagaucgaggaaacagagcuguaccuuaaucuggaaagaauccccugggugguccggaaacuccugcaaguuagcgaguccaccgggguggcccuuaagcgcucuagcuggcuggugauccuccugguccugcucacagugucccugagcccuguucagucugcucccaucuccagaaaaccucuuuuucuggacagcauugugaagggaaugcggaaccuccugaauagcaccagccuugagaccucccugucuaucgaagcccccuggggcgcgauuaacguccagagcacauucaagccgacgguguccgccgcuaacaucgcccucagcuggucuuccguugagcaccgcgggaauaaaauucuggugagcggaagaucugaauccaucaugaagcuggaggaacggaccggcaucagcugggaucucggggucgaggacgcuuccgagucuaaacugcuuacagugagcgucauggaucugucccagauguacucuccuguguuugaauaucucagcggagacagacaaguugaggaauggcccaaggccaccuguacaggcgauugcccugagcgcuguggcugcaccuccagcacgugucugcacaaagaauggccccauucucggaacuggagaugcaaucccacauggugcuggggaguggggaccggcuguaccugcugugggcuggacgucaaggaucuuuucacagacuacauguuugugaaguggaaaguugauuauauuaagaccgaggcgaucgugugcgucgagcucacaucccaggaacgccaguguagccugauugaggccggaacgcgguucaaccugggcccugugaccaucacacucucugaaccgagaaauauucaacagaaacugcccccugagaucgugacccuucacccccgcauugaggaaggguucuuugaccugaugcauauccagaagguucucuccgcuagcacagucugcaaacugcagucuuguacccacggcgugccuggagaucugcaaaucuaccacauuggcaaccuucucaagggggacaaggugaauggacaucugauccacaaaauugagccccauuucaacacgagcuggauguccugggacggcugcgaucuggacuauuacuguaauaugggggauuggccgagcugcucuuauaccggagucacacagcacaaccaugccgcuuuugugaauaugcucaacaucgaaaccgacuacacaaagaauuuccacuuucacuccaaacggguuaccgcccauggcgauacgccucagcuggaccuuaaggccagacccacauacggggcuggcgagauuaccgugcuggucgaaguggcggauauggagcuccacaccaaaaagaucgagaucagcggacugaaguucgccucccugacauguaccggcugcuaugcuugcucuagcgggauuuccuguaaaguucgcauccauguggacgaaccugaugagcuuacaguccacgugaagucugaagaccccgauauuguugccgccagcuccucucucauggcucggaaacuggaguuuggaacggacagcaccuucaaggccuuuuccgcgaugccuaaaacaagccugugcuucuacaucguggaaagagaguauuguaagucuugcuccaaagaggauacccagaagugugucaacacaaagcucgaacaaccccagagcauucugaucgagcacaaaggcaccaucauugggaagcagaaugacacgugcacagcucgcgccucuuguuggcuugaauccaucaagagcuuuuucuacggacugaagaacaugcucucuggcauuuuugggaacguguucaucggcauuuuccuguuuuucgccccguuuaucaugcugauccuuuucuuuauguucggauggcggauucucuuuugcuucaaauguugcagacggacccgcggccuguuuaaguauagacaucugaaggacgaugaggaagugggguaccggaaaaucauugagagacucaauaacaagaaaggaaagaauaaacugcuugacggcgagcgccuggcugaucggaagaucgccgaacucuucuccaccaagacacacauuggg

SEQ ID NO: 13893 - RNA, 2916 nt, Artificial Sequence
  derived and/or modified CDS sequence (opt5) from CCHFV(SPU 18/88, Artificial)__KJ682810.1__Gn-4aa-Gc
agcgaggaauccaacgacgauugccugucuagaacccagcuccugcggacagagaaugccgaaauccacagcgacaacuacggcgggcccggagauaagauuacgaucuguaauggcuccaccauuguggaccaacgccuugggucugagcugggaugcuauacaaucaacagagucaaaucuuucaagcucugugaaaauuccgcuaccggcaaaucuugcgagauugauagcacaccuguucggugucgccagggguuuugccugaagaucacccaggagggaagaggccaugugaaacuuucccggggcagcgaagugguccuggacgccugugauucuuccugcgagaucaugauuccgaaggggacaggagacauccucguggauuguagcggcgggcagcaacacuuccugaaggacaaccugguugaucucggaugccccaauauuccucugcuuggcaaaauggcgaucuacauuugucgcaugucuaaccaucccaagaccacgaugggguuucuguucugguuuuccuucggauaugugaucacaugcauucucugcaaagucaucuuuuaccugcuuaucgugguuggcacacugggcaagaaauucaagcaguauagagaacucaagccucagaccuguacaauuugcgagaccaaucccgugaacgcuaucgacgccgagaugcacgaucugaauuguagcuacaacauuugcccuuauugugccucucggcugacguccgacgggcucgcucgccaugucaugcagugcccgaaaagaaaggagaaaaucgaagaaacagagcuguaccuuaaucuggaacggauucccuggguggugcgcaagcuccugcaagucagcgaguccaccggaguugcccuuaaaagaucuagcuggcuggugauccuccuggugcugcucacagucucccugagcccugugcagucugcucccaucucccggaagccucuuuuucuggacagcauuguuaaaggcaagaagaaccuccugaauagcaccagccuugagaccucccugucuaucgaagcccccuggggagcgauuaacgugcagagcacauucaaaccgacggucuccgccgcuaacaucgcccucagcuggucuuccguggagcaccgcgggaauaagauucugguuagcggcagaucugaauccaucaugaaacuggaggaacggaccgggaucagcugggaucucggaguggaggacgcuuccgagucuaagcugcuuacagucagcgugauggaucugucccagauguacucuccugucuuugaauaucucagcggcgacagacaaguggaggaauggcccaaagccaccuguacaggcgauugcccugagcgcugugggugcaccuccagcacgugucugcacaaggaauggccccauucucggaacuggagaugcaaucccacauggugcuggggaguuggcaccggguguaccugcuguggacuggacgugaaggaucuuuucacagacuacauguuugucaaauggaagguggauuauauuaaaaccgaggcgaucguuugcguggagcucacaucccaggaacgccaguguagccugauugaggccggcacgcgguucaaccuggggccugucaccaucacacucucugaaccgagaaauauucaacagaagcugcccccugagaucgugacccuucacccccgcauugaggaaggcuucuuugaccugaugcauauccagaaagugcucuccgcuagcacaguuugcaagcugcagucuuguacccacggagucccuggcgaucugcaaaucuaccacauugggaaccuucucaagggagacaaagugaauggccaucugauccacaagauugagccccauuucaacacgagcuggauguccugggacgggugcgaucuggacuauuacuguaauaugggagauuggccgagcugcucuuauaccggcgugacacagcacaaccaugccgcuuuugucaauaugcucaacaucgaaaccgacuacaccaaaaauuuccacuuucacuccaagcgggugaccgcccauggggauacgccucagcuggaccuuaaagccagacccacauacggcgcuggagagauuaccguucugguggaagucgcggauauggagcuccacacaaagaagaucgagaucagcggccugaaauucgccucccugaccuguaccgggugcuaugcuugcucuagcggaauuuccuguaaggugcgcauccauguugacgaaccugaugagcuuacagugcacgucaaaucugaagaccccgauauuguggccgccagcuccucucucauggcucggaagcuggaguuuggcacggacagcaccuucaaagccuuuuccgcgaugccuaagacaagccugugcuucuacaucguugaaagagaguauuguaaaucuugcuccaaggaggauacccagaagugugugaacacaaaacucgaacaaccccagagcauucugaucgagcacaaggggaccaucauuggaaaacagaaugacacgugcacaggcaaggcuggguguuggcuugaaucuaucaaauccuuuuucuacggccugaagaacaugcucagcggaauuuuuggcaacgucuucaucgggauuuuccuguuucuggccccguucaucaugcuuauccucuuuuucauguuuggauggcgcauucuguucugcuuuaaguguugccggagaacccggggccuguucaaauaucgccaucucaaggacgaugaggaaaucggguacagaaaaauuaucgagcggcugaagaauaaaaagggaaagaacaaacuucuggacggcgagagacucgccgaucgcaagauugcugaacuguuuucuaccaaaacacacaucggg

SEQ ID NO: 13894 - RNA, 2916 nt, Artificial Sequence
  derived and/or modified CDS sequence (opt5) from CCHFV(SPU 431/85, Artificial)__KJ682812.1__Gn-4aa-Gc
agcgaggaauccgacggcgauugcaucucuagaacccagcugcuccggacagagacgaccgaaauucacagcgacaacuacgggggacccggcgauaagaucacaauuuguaauggguccaccaucguggaccaacgccugggaucugagcuuggcugcuauacaauuaacagagucaagagcuucaagcugugugaaaauuccgccaccgggaaaucuugcgagaucgauagcacaccuguuaagugucggcagggauuuugccucaaaaucacccaggagggccgcggccaugugaagcuguccagagggagcgaaauugugcuugacgcuugugauucuaacugcgagaucaugauuccgaagggaacgggcgacauccuggucgauuguuccgggggacagcaacacuuccucaaagacaaucugauugaucugggcugccccaacaucccucuccuggggaagauggccauuuacaucugucggaugagcaaucaucccaaaaccacaauggcguuucuuuucugguuuucuuucggauaugugaucacaugcauucugugcaagguuaucuuuuaccuccugauuguggcuggcacagucggcaaaaaguucaagcaguaucgcgaacuuagaccucagaccuguacgaucugcgagacaauucccgugaacgccaucgacgccgagaugcacgaucugaauuguuccuacaacaucugcccuuauugugcuagccggcucaccucugacgggcuggcccgccauguuaugcagugcccgaaaagaaaggaaaaaguggaggaaacagagcuguaccucaaucuggaacggauucccugggucgugcgcaaacuucugcaaguguccgagagcaccggagucgcucucaaaagauccucuuggcugaccguucuucuggugcuccugaucgugagccuguccccuguccagagcgcccccauuggccggaagccucucuuucuggacucuaucgugaaagggcgcaagaaccuucuuaauuccacaagccucgagacgucucugagcauugaagcgcccuggggagccaucaacguucaguccaccuucaagccgacagugucugcugccaauaucgcucuuagcugguccagcgucgagcacagaggcaacaaaauucuggugucugggcgguccgaaagcaucaugaagcucgaggaaagaaccggaauuucuugggaucugggcguugaggacgccuccgagagcaaacugcucacaguguccgucauggaucugucucagauguacagcccuguguuugaauaucuuuccggcgaccgccaagucgaggaauggcccaaggcgaccuguacgggggauugcccugagcgguguggaugcacaucuagcaccugucugcacaaagaauggccccauuccagaaacuggcgcugcaaucccaccuggugcuggggcguggggacaggauguaccugcuguggccucgacguuaaggaucuguucacagacuacauguuugugaaguggaaagucgaguauaucaagacggaggccauugugugcguugaacugaccagccaggagcggcaguguucucuuaucgaagcugggacaagauucaaccucggcccugugaccauuacacuguccgagccgcgcaauauccaacagaaacugcccccugagaucauuacccuccacccccggaucgaagagggauucuuugaucugaugcauguccagagagugcuuagcgccucuacggugugcaagcugcaguccuguacccacggcguuccuggggaccuccaagucuaccacauuggaaaccugcugaaaggcgauaaggugaaugggcaucuuauccacaagauugaaccccauuucaacacaagcuggaugucuugggacggaugcgaccucgauuauuacuguaauaugggcgacuggccgagcugcaccuauacaggggugacccagcacaaccaugcugccuuugucaaucugcugaacaucgagacggauuacaccaaaaauuuccacuuucacuccaagcgcgugaccgcccauggcgacacaccucagcucgaucugaaagcucggcccaccuacggagcgggcgaaguuaccgugcuugucgagguggccgacauggagcugcacacaaagaaaaucgaaauuagcgggcucaaguucgcuucucugacguguaccggaugcuaugccugcuccagcggcaucuccuguaagguuaaaauucauguggaugagccugacgaacugacaguccacgugaagucugaggaucccgacaucguugccgcugggagcucccuuauggccagaaaacucgaauuuggagcggauucuaccuucaaggcuuuuagcgccaugccuaaaacaucccugugcuucuacauuguggagcgcgaguauuguaagucuugcagccgggaagacaccagaaaaugugucaacacgaagcuggaucggccccaguccauccucaucgagcacaagggcacaauuaucgggaaacaaaauaauaccugcaccgccaaggcuagcuguuggcuggaaucugugaaauccuuuuucuacggccuuaagaacaugcugagcggaauuuuuggcaacguguucaucgggauuuuccucuuuaucgccccguucguccugcugauccuguuuuucauguuuggauggcgcauucucuucugcuuuaaauguugcagacggacaagaggccuguucaaguaucgccaucugaaggacgacgaggaaaccggguaccggaaaaucauugagagacucaacaauaagaaaggaaagaacaaacugcuugauggcgagcgccuggcugacagaaagaucgccgaacucuuuucuacaaagucccacauuggg

SEQ ID NO: 13895 - RNA, 2916 nt, Artificial Sequence
  derived and/or modified CDS sequence (opt5) from CCHFV(SPU 48/90, Artificial)__KJ682813.1__Gn-4aa-Gc
agcgaggaacccuccgacgauugcaucucuagaacccagcugcuccggacagagacggccgaaauucacggcgacaacuacgggggaccuggcgauaagaucaccauuuguaaugggagcacaaucguggaccagcgccugggauccgagcuuggcugcuauaccauuaacagagucaaaucuuucaagcugugugaaaauagcgcuacagggaaauccugcguuaucgauucugugccggugaagugucggcagggauacugccuccgcaucacccaggagggcagaggccaugucaaacugagccggggguccgaggugguucuugacgccugugauacaagcugcgaaauuaugauccccaagggaaccggcgacauucugguggauuguucugggggacagcaacacuuucucaaggacaaccugaucgaucugggcugcccuaaaauuccccuccuggggaagauggcgaucuauauuugucgcauguccaaucauccuacgaccacaauggcuuuccuuuucugguucagcuuuggauacgucauuaccugcauccugugcaaagccauuuucuaucuccugaucauuaucggcacacuuggcaagagauuucggcaguaccgcgagcugaaaccccagaccuguacgauuugcgaaacaaccccugugaacgccaucgacgcugagaugcacgaucucaauuguucuuauaacaucugcccguacugugccuccagacugacaagcgacgggcuggcucggcauguuacccagugccccaagcgcaaggagaaaguggaagagaccgaacucuaccugaaucuugagagaaucccuugggucgugcggaagcugcuccaagugucugaauccacaggagucgcccugaaacgcagcuccuggcuuaucguucugcucgugcuguucacggugucucugagccccguccaguccgcgccuauuggcagaaagccccucuuucgggacagcaucgugaaagggaugaagaaccugcuuaauucuaccucccuggagacaagccucucuauugaggccccguggggagcuaucaacguucagagcaccuauaaaccuacaguguccaccgccaauaucgcucugucuuggagcuccgucgaacacagaggcaacaagauucuugugagcgggcgcucugaguccaucaugaagcuggaggaacggacgggaauuagcugggaucucggcguugaagacgccucugaguccaaacugcugacagugagcgucauggaucucucccagauguacucucccguguucgaguaucugagcggcgacagacaagucgaagaguggccuaaggcgaccuguaccggggauugccccgaacgcuguggaugcacauccucuaccugucuucacaaagaguggccccauagccggaauuggagaugcaacccuacauggugcuggggcguggggacgggauguaccugcuguggccuggacguuaaggaucucuuuacagacuacauguucgugaaauggaaggucgaauauaucaagaccgaggccauugugugcguugagcugacaucccaggaacgccaguguagccugaucgaggcugggacccgguuuaaccuuggcccggugacgauuacccucucugaacccagaaauauccaacagaaacugccucccgagaucauuacacugcacccucgcaucgaggaaggauucuucgaucucaugcauguccagaaggugcuguccgccagcaccgugugcaaacuucagucuuguacacacggcguucccggggaccugcaagucuaccacauuggaaaccuccugaagggcgauaaagugaaugggcaucugauccacaagauugagccgcauuuuaacaccuccuggaugagcugggacggaugcgaccuugauuauuacuguaauaugggcgacuggccuucuugcacguacacaggggugacccagcacaaccgggcuagcuucgucaaucuccugaacaucgaaacagauuauaccaagaauuuucauuuccacuccaaaagagugaccgcccacggcgacacaccccagcuggaucucaaggcccgcccuacguacggagcuggcgagaucaccguucugguggaagucgcggacauggagcuucauacaaagaagauugagaucagcgggcugaaauuugccucucucaccuguacaggaugcuaugcuugcuccagcggcauuuccuguaaggugcggauccacguugaugaacccgacgagcugaccgugcaugucaagucugaugacccugaugugguugccgccagcuccucucugauggcuagaaaacuugaauuugggacggacagcacauuuaaggccuucuccgcgaugcccaaaaccucucucugcuuuuacauuguggagaaggaauauuguaaaagcugcuccgaggaggauaccaagaaaugugucaacacaaagcuggaacagccgcaaagcauccugaucgagcacaagggaaccauuaucggcaaacaaaauucuacaugcacggcuaagguguccuguuggcucgaaagcgccaaaucuuucuuuuacgggcugaaggacaugcuuuccggcauuuucggaaacguguuuaucggcauuuuccuguuccucgccccuuuuauccugcugauccuuuucuuuauguucggguggcggauucuccugugcuuuaaauguugccgcagaacccggggacuguucaaguauagacaccucaaggacgaugaggaaacaggcuaccgccggaucauugagagacugaauaacaaaaaggggaaaaauaaacuucuggacggagagcgccucgcugauagacggaucgccgaacuguuuagcaccaaaacacauauuggc

SEQ ID NO: 13896 - RNA, 2916 nt, Artificial Sequence
  derived and/or modified CDS sequence (opt5) from CCHFV(SPU 187/90, Artificial)__KJ682814.1__Gn-4aa-Gc
agcgaggaacccuccgacgauugcaucucuagaacccagcugcuccggacagagacggccgaaauucacggcgacaacuacgggggaccuggcgauaagaucaccauuuguaaugggagcacaaucguggaccagcgccugggauccgagcuuggcugcuauaccauuaacagagucaaaucuuucaagcugugugaaaauagcgcuacagggaaauccugcgagaucgauucuguuccggugaagugucggcagggauacugccuccgcaucacccaggagggcagaggccaugugaaacugagccggggguccgaagucgugcuugacgccugugauacaagcugcgagauuaugauccccaagggaaccggcgacauucugguugauuguucugggggacagcaacacuuucucaaggacaaccugaucgaucugggcugcccuaaaauuccccuccuggggaagauggcgaucuauauuugucgcauguccaaucauccuaaaacgaccauggcuuuccuguuuugguucagcuuuggauacgugaucacaugcauccugugcaaggccauuuucuaucuccugaucauuaucggcacccuuggcaaaagauuuaagcaguaccgggaacugaagccccagacauguaccauuugcgagacgacaccugucaacgccaucgacgcugagaugcacgaucucaauuguucuuauaacaucugcccguacugugccucccgccugaccagcgacgggcuggcuagacaugugacacagugccccaaacggaaggaaaaaguugaggaaaccgagcucuaccugaaucuugaacgcauuccuuggguggucagaaagcugcuccaagugucugaguccaccggaguggcccugaaacggagcuccuggcuuaucguccugcucguucuguucacagugucucugagccccgugcaguccgcgccuauuggccgcagaccccucuuucuggacagcaucgucaaggggaugaaaaaccuucuuaauucuacgucccucgagaccagccugucuauugaagccccguggggagcuaucaacgugcagagcacauauaagccuaccguuuccacagccaauaucgcucuuucuuggagcuccguggagcaccggggcaacaagauucuggucagcgggagaucugaauccaucaugaaacucgaggaacgcaccggaauuagcugggaucugggcguggaggacgccucugaguccaagcugcucacgguuagcgugauggaucugucccagauguacucucccgucuucgaauaucuuagcggcgaccggcaaguggaggaauggccuaaagcgacauguaccggggauugccccgagagauguggaugcaccuccucuacaugucugcacaaggaauggccccauagccgcaauuggcggugcaacccuaccuggugcuggggcgucgggacaggauguacgugcuguggccucgacgugaaagaucuguuuaccgacuacauguucguuaaguggaagguggaguauaucaaaacagaggccauugucugcguggaacugaccucccaggagagacaguguagccuuaucgaagcugggacacgcuuuaaccucggcccgguuaccauuacgcugucugagccccggaauauccaacagaagcugccucccgagaucauuacccuccacccuagaaucgaagagggauucuucgaucugaugcaugugcagaaaguccuuuccgccagcacagugugcaagcugcagucuuguacccacggcgugcccggggaccuccaaguuuaccacauuggaaaccugcugaaaggcgauaaggucaaugggcaucuuauccacaagauugaaccgcauuuuaacacauccuggaugagcugggacggaugcgaccucgauuauuacuguaauaugggcgacuggccuucuugcaccuacacgggggugacacagcacaaccaugcuagcuucgugaaucugcugaacaucgagaccgauuauaccaaaaauuuucacuuccacuccaagcgcgucaccgcccauggcgacacaccccagcucgaucugaaagcccggccuacauacggagcuggcgaaaucacggugcuuguugagguggcggacauggagcugcacaccaagaaaauugaaaucagcgggcucaaguuugccucucugacauguaccggaugcuaugcuugcuccagcggcauuuccuguaaggucagaauccauguggaugagcccgacgaacugacaguucacgugaaaucugaugacccugaugucguggccgccagcuccucucuuauggcucgcaagcucgaguucgggaccgacagcauuuuuaaagccuucuccgcgaugcccaagacgucucugugcuuuuacaucguugaacgggagcacuguaaaagcugcuccgaggaagauacaaagaaaugugugaacaccaagcuggagcagccgcaaagcauccucauugaacauaagggaaccaucauuggcaaacaaaauucuacaugcaccgcuaagacauccuguuggcuggagagcgucaaaucuuucuuuuaugggcuuaagaacaugcuguccggcaucuucggaaauguguuuauuggcaucuuccucuuccuggccccuuuuauccugcuuauucucuucuuuauguucggguggagaauccuguuuugcuucaaauguugccggcgcacgagaggacuguuuaaguaccggcaccucaaggacgacgaagagaccggcuauagacgcauuaucgagcggcugaacaauaaaaaggggaaaaacaaacuucuggauggagaaagacucgccgaccgcagaauugcugagcuguucagcacaaagacccauaucggc

SEQ ID NO: 13897 - RNA, 2916 nt, Artificial Sequence
  derived and/or modified CDS sequence (opt5) from CCHFV(Haskovo-V46/13, Artificial)__KR092379.1__Gn-4aa-Gc
agcgaggaacugggcgacgauugcaucuccagaacccagcuccugcggacagagacggccgaaauucacgacgauaacuacgggggacccggcgacaagaucaccauuuguaaugggucuacaaucguggaucaacgccuuggaagcgagcugggcugcuauaccauuaacagagggaaauccuucaagcucugugaaaauucugcuacaggaaaaaccugcgagaucgacagcacaccugucaagugucggcagggcuuuugccugaaaaucacccaggagggccgcgggcauguuaaacuuuccagaggaucugaaguggugcuggaugccugugacagcuccugcgaggucaugauuccgaagggcacgggggauauccucguggacuguagcggaggccagcaacacuuccugaaggauaaccugauugaccucgggugcccccauaucccucugcuuggaaagauggcgauuuacaucugucggaugucuaaucacccccgcaccacaauggcuuuucuguucugguuuuccuucggcuauguuauuaccugcaucuuuugcaaagcccucuucuacagccugaucauuaucggcacacuugggaagaaaauuaagcaguauagagaacugaagccucagaccuguacgaucugcgagacaacccccgugaacgccauugaugcugagaugcaugaccucaauuguucuuacaacaucugcccuuauugugccucccggcugacaagcgacggacuggcucgccacgucacccagugcccgaaaagaaaggaaaaaguggaggaaaccgagcucuaccugaaucuugaacggauccccuggauuguucgcaagcugcuccaagugucugaguccacaggcgucgcccugaaaagaagcuccuggcuuaucgugcugcucgugcugcugccugucucucucagccccguucaguccgcgccuguggggcggaagccccuguuucuugauagcauugugaaaggaaugaagaaccugcucaauucuacgucccuggagaccagccuuucuaucgaagccccguggggcgcuauuaacguccagagcacauucaagccuaccguguccacagccaauaucgcucugucuuggagcuccguugagcaccgcgggaacaaaauccucgugaccggaagaagcgaaucuauuaugaagcuggaggaacggacgggcgucuccugggaccugggcguggaggaugccagcgagucuaaacuccugacaguuuccaucauggaccuuagccagauguacucccccguguuugaauaucugucuggggauagacaagucgaggaauggccuaaggcgaccuguaccggagacugccccgagcgcuguggcugcacaagcuccaccugucuccauaaagaauggccccacucucggaauuggagaugcaacccuacauggugcuggggagugggaacgggcuguaccugcuguggggucgaugugaaggaccuguucacagaucauauguuuguuaaguggaaaguggaguacauuaagaccgaggccaucgucugcguggaacugacaagccaggagcgccaguguucccuuauugaagcuggcacccgguucaaccucggaccgguuacgaucacccugagcgagcccagaaauauucaacagaaacugccucccgagaucaucacacuccacccuaagauugaagagggcuucuuugaccugaugcacgugcagaaaguccuuucugccuccaccgugugcaagcugcagagcuguacacaugggauccccggagaucuccaaguguaucacauuggcaaccugcugaagggggaccgcguuaauggacaucuuauccacaaaauugaaccgcauuucaacaccucuuggauguccugggacggcugcgaucucgacuacuauuguaauaugggggauuggccuagcugcacguacacaggcgucacccagcacaaccacgcugccuuugugaaucugcugaacaucgagacagacuauaccaagaccuuccauuuucacucuaaacgggugacagcccauggagauacgccccagcucgaccugaaggcuagaccuaccuacggcgcgggggaaaucacaguccuuguggagguugccgauauggagcugcacaccaaaaagguggaaauuagcggacucaaguucgcuucccugacauguaccggcugcuacgccugcagcucugggaucuccuguaaaguccgcauucacguggacgagcccgaugaacugacgguucaugucaagagcuccgacccugaugugguggccgcuggaacaucucuuauggcccggaaacucgaguuuggcaccgacagcaccuucaaggcguuuuccgcuaugcccaaaacaucucugugcuucuauaucguugaaagagaguacuguaagagcugcuccgaggaugacacccagaaauguguggacacaaagcuggaacaaccgcagucuauucucaucgagcacaaggggacgaucauuggcaaacagaaugauaccugcacagcccgcgccagcuguuggcuggaauccgucaagagcuuuuucuauggacuuaaaaacaugcugggcucuguguuugggaauuuccucaucgggauucugcuguuccuugcuccuuuugugcuccugguccuguucuuuauguucggcuggaagauccucuuuugcuucaaauguugccggagaacccgggggcuguuuaaguaccgccaucuuaaggacgaugaggaaacaggauauagacggauuaucgagagacugaacuccaaaaagggcaaaaaucgccuccuggacggggagcggcuggccgauagaaagaucgcugaacuuuucagcaccaaaacgcacauuggc

SEQ ID NO: 13898 - RNA, 2916 nt, Artificial Sequence
  derived and/or modified CDS sequence (opt5) from CCHFV(24-R-2012, Artificial)__KR814856.1__Gn-4aa-Gc
agcgaggaacccggcgacgauugcaucuccagaacccagcugcuccggacagagacggccgaaauucacgacgauaacuacgggggaccuggcgacaagaucaccauuuguaaugggucuacaaucguggaucaacgccugggaagcgagcuuggcugcuauaccauuaacagagucaaauccuucaagcugugugaaaauucugcuacagggaaaaccugcgagaucgacagcacaccgguuaagugucggcagggauuuugccucaaaaucacccaggagggccgcggccaugugaagcuguccagagggucugaagugguccuugaugccugugacacgagcugcgaggugaugauucccaagggaaccggcgauauccugguugacuguuccgggggacagcaacacuuccucaaagauaaccugauugaccugggcugcccucauaucccccuccuggggaagauggcgauuuacaucugucggaugagcaaucacccucgcacaaccauggcuuuucuuuucugguuuucuuucggauaugugauuacaugcaucuuuugcaaagcccuguucuacucccucaucauuaucggcacccugggcaagaaaauuaagcaguauagagaacuuaagccccagacguguacaaucugcgagaccgccccugucaacgcuauugaugccgagaugcaugaccugaauuguagcuacaacaucugcccguauugugcuucucggcucacauccgacgggcuggcccgccacgugccccagugcccuaaaagaaaggaaaaaguugaggaaaccgagcuguaccucaaucuggaacggauccccuggauugugcgcaaacuucugcaagucagcgagucuaccggaguggcgcucaagagauccagcuggcugaucgugcuucugguccuccugacaguuucccugucuccugugcagagcgcccccgugggccggaagccgcucuuucuggauuccauugucaaagggaugaagaaccuucugaauagcacgucucucgagaccucccugagcaucgaagcuccuuggggagccauuaacgugcagucuacauucaagcccaccguuagcacagcuaauaucgcccuuuccuggucuagcguggagcaccgcggcaacaaaauccuggucaccgggagauccgaaagcauuaugaagcucgaggaacggacgggagugucuugggaccugggcguugaggaugcguccgagagcaaacugcucacagugucuaucauggaccugucccagauguacagcccugucuuugaauaucuuuccggcgauagacaaguggaggaauggcccaaggccaccuguaccggggacugccccgagcgcuguggaugcacaucuagcaccugucugcauaaagaauggccucacucccggaauuggagaugcaacccgacauggugcuggggcgucgggacgggauguaccugcuguggcguggauguuaaggaccucuucacagaucauauguuugugaaguggaaagucgaguacauuaagaccgaggcuaucgugugcguugaacugacaucucaggagcgccaguguagccugauugaagccgggacccgguucaaccuuggccccgugacgaucacccucuccgagccuagaaauauucaacagaaacugcccccugagaucaucacacugcaccccaaggucgaagagggauucuuugaccucaugcacgugcagaaagugcugagcgcuucuaccguuugcaaacuucaguccuguacacauggcauuccgggggaucugcaagucuaucacaucggaaaccuccugaagggcgaccgcgugaaugggcaucugauucacaagaucgaaccucauuucaacaccagcuggaugucuugggacggaugcgaucuugacuacuauuguaauaugggcgauuggcccuccugcacguacacaggggugacccagcacaaccacgccgccuuugucaaucuccugaacauugagacagacuauaccaagaccuuccauuuucacagcaaacgggugacagcucauggcgauacgccucagcuggaccucaaggcgagacccaccuacggagccggcgaaaucacaguucugguggaggucgcugauauggagcuucacaccaaaaagguggaaaucucugggcugaaguucgccagccucgccuguacaggaugcuacgcuugcuccagcggcauuucuuguaaaguucgcauccacguggacgagccugaugaacugaccguccaugugaaguccaaugaccccgauguuguggccgcgagcacgucccugauggcucggaaacuugaguuugggacagacucuaccuucaaggccuuuagcgccaugccgaaaaccucccucugcuucuauauugucgaaagagaguacuguaagucuugcagcgaggaagauacacagaaauguguggacaccaagcuggagcaaccucaguccauccugauugaacacaagggaacaaucaucggcaaacagaacgacacgugcaccgcuaaggccucuuguuggcucgagagcgugaaauccuuuuucuaugggcugaagaauaugcuuggcagcgucuuuggaaacuucuucauuggcauccugcucuuucuggcucccuucguucugcuugugcucuuuuucauguuuggguggaaaauucuguucugcuuuaaguguugccgccggacaagaggacugcucaaguaccggcugcuuaaagaugacgaagagaccggcuaucgcagaaucauugagcggcugaauaacaagaaagggaagaauagacuccuggauggagaacgccuggccgaccggaaaaucgcggagcuuuucucuacaaagacccauaucggc

SEQ ID NO: 13899 - RNA, 2916 nt, Artificial Sequence
  derived and/or modified CDS sequence (opt5) from CCHFV(36-ST-2014, Artificial)__KR814857.1__Gn-4aa-Gc
agcgaggaacccggcgacgauugcaucuccagaacccagcugcucaagacagagacggccgaaauucacgacgauaacuacgggggaccuggcgacaaaaucaccauuuguaaugggucuacaaucguggaucaacggcugggaagcgagcuuggcugcuauaccauuaaccgcgucaaguccuucaaacugugugaaaauucugcuacagggaagaccugcgagaucgacagcacaccgguuaaauguagacagggauuuugccucaagaucacccaggagggccggggccaugugaagcugucccgcgggucugaagugguccuugaugccugugacagcuccugcgagauuaugauccccaaaggaacgggcgauauucugguggacuguagcgggggacagcaacacuuccucaaggauaaccugaucgaccugggcugcccucauauuccccuccuggggaaaauggcgaucuacauuuguagaaugucuaaucacccucggaccacaauggcuuuucuuuucugguuuuccuucggauauguuauuaccugcaucuuuugcaaggcccuguucuacagccucauuaucauuggcacacugggcaaaaagaucaagcaguaucgcgaacuuaaaccccagaccuguacgauuugcgagacagccccugugaacgcuaucgaugccgagaugcaugaccugaauuguucuuacaacaucugcccguauugugcuuccagacucaccagcgacgggcuggcccggcacgucacacagugccccaagcgcaaagaaaagguggaggaaaccgagcuguaccucaaucuggaaagaaucccuuggaucguucggaaacuucugcaagugucugaguccaccggagucgcgcucaagcgcagcuccuggcugauugugcuucuggugcuccugacagucucucugagccccguucaguccgccccugugggcagaaaaccccucuuucuggauagcaucgugaaggggaugaagaaccuucuuaauucuacgucccucgagaccagccugucuauugaagcuccguggggagccaucaacguccagagcacauucaaaccuaccguguccacagcuaauaucgcccuuucuuggagcuccguugagcaccggggcaacaagauucuggugaccgggcgcagcgaaucuaucaugaaacucgaggaaagaacgggagucuccugggaccugggcguggaggaugcgagcgagucuaagcugcucacaguuuccauuauggaccugagccagauguacucccccguguuugaauaucuuucuggcgaucggcaagucgaggaauggccuaaagccaccuguaccggggacugccccgagagauguggaugcacaagcuccaccugucugcauaaggaauggccccacucucgcaauuggcggugcaacccuacauggugcuggggcguggggacgggauguaccugcuguggcgucgaugugaaggaccucuucacagaucauauguuuaucaaauggaagguugaguacauuaaaaccgaggcuaucgugugcgucgaacugacaagccaggagagacaguguucccugauugaagccgggacccgcuucaaccuuggcccggugacgaucacccucagcgagccccggaauauccaacagaagcugccucccgagauuaucacacugcacccuaaaauugaagagggauucuuugaccucaugcacguucagaaggugcugucugcuuccaccgucugcaagcugcagagcuguacacauggcauccccggggaucugcaaauuuaucacaucggaaaccuccugaaaggcgacagacugaaugggcaucuuauccacaagauugaaccgcauuucaacaccucuuggauguccugggacggaugcgaucucgacuacuauuguaauaugggcgauuggccuagcugcacguacacaggggugacccagcacaaccacgccgccuuugugaaucugcugaacaucgagacagacuauaccaaaaccuuccauuuucacucuaagcgcguuacagcucauggcgauacgccccagcucgaccugaaagcgcggccuaccuacggagccggcgaaauuacaguccuuguggagguggcugauauggagcugcacaccaagaaggucgaaaucagcgggcucaaauucgccucccuggccuguacaggaugcuacgcuugcagcucuggcauuuccuguaaggugagaauccacguugacgagcccgaugaacugaccgugcaugucaaaagcuccgacccugaugugguugccgcgucuacgagccuuauggcucgcaagcucgaguuugggacagacuccaccuucaaagccuuuucugccaugcccaagaccagccugugcuucuauaucguggaacgggaguacuguaaauccugcucugaggaugacacaaagaagugugucgacaccaaacuggaucagccgcaaagcauucucaucgaacacaagggaacaauuaucggcaaacagaaugacacgugcaccgcuaaggccuccuguuggcuggagagcgugaaauccuuuuucuaugggcuuaagaacaugcugggcucuguuuuuggaaauuucuucgugggcauucuccuguuucuggcuccuuucguccuucucgugcuguuuuucaugugcggguggaaguuucuguucuguuuuaaaugcuguagacgcacacggggacucuucaaguacagacaucugaaagaugacgaagagaccggcuaucggcgcaucaucgaaagacuuaacagcaagaaagggaagaaucggcugcucgauggagagagacuggccgaccgcaagauugcggagcuguuuucuacaaaaucccacaucggc

SEQ ID NO: 13900 - RNA, 2916 nt, Artificial Sequence
  derived and/or modified CDS sequence (opt5) from CCHFV(37-R-2013, Artificial)__KR814858.1__Gn-4aa-Gc
agcgaggaacccggcgacgauugcaucuccagaacccagcugcuccggacagagacggccgaaauucacgacgauaacuacgggggaccuggcgacaagaucaccauuuguaaugggucuacaaucguggaucaacgccugggaagcgagcuuggcugcuauaccauuaacagagucaaauccuucaagcugugugaaaauucugcuacagggaaaaccugcgagaucgacagcacaccgguuaagugucggcagggauuuugccucaaaaucacccaggagggccgcggccaugugaagcuguccagagggucugaagugguccuugaugccugugacacgagcugcgaggugaugauucccaagggaaccggcgauauccugguugacuguuccgggggacagcaacacuuccucaaagauaaccugauugaccugggcugcccucauaucccccuccuggggaagauggcgauuuacaucugucggaugagcaaucacccucgcacaaccauggcuuuucuuuucugguuuucuuucggauaugugauuacaugcaucuuuugcaaagcccuguucuacucccucaucauuaucggcacccugggcaagaaaauuaagcaguauagagaacuuaagccccagacguguacaaucugcgagaccgccccugucaacgcuauugaugccgagaugcaugaccugaauuguagcuacaacaucugcccguauugugcuucucggcucacauccgacgggcuggcccgccacgugccccagugcccuaaaagaaaggaaaaaguugaggaaaccgagcuguaccucaaucuggaacggauccccuggauugugcgcaaacuucugcaagucagcgagucuaccggaguggcgcucaagagauccagcuggcugaucgugcuucugguccuccugacaguuucccugucuccugugcagagcgcccccgugggccggaagccgcucuuucuggauuccauugucaaagggaugaagaaccuucugaauagcacgucucucgagaccucccugagcaucgaagcuccuuggggagccauuaacgugcagucuacauucaagcccaccguuagcacagcuaauaucgcccuuuccuggucuagcguggagcaccgcggcaacaaaauccuggucaccgggagauccgaaagcauuaugaagcucgaggaacggacgggagugucuugggaccugggcguugaugacgcguccgagagcaaacugcucacagugucuaucauggaucugucccagauguacagcccugucuuugaguaucuuuccggcgacagacaaguggaagaguggcccaaggccaccuguaccggggauugccccgaacgcuguggaugcacaucuagcaccugucugcauaaagaguggccucacucccggaauuggagaugcaacccgacauggugcuggggcgucgggacgggauguaccugcuguggcguggacguuaaggaucucuucacagaccauauguuugugaaguggaaagucgaauacauuaagaccgaggcuaucgugugcguugagcugacaucucaggaacgccaguguagccugauugaggccgggacccgguucaaccuuggccccgugacgaucacccucuccgaaccuagaaauauucaacagaaacugcccccugagaucaucacacugcaccccaaggucgaggaaggauucuuugaucucaugcacgugcagaaagugcugagcgcuucuaccguuugcaaacuucaguccuguacacauggcauuccgggggaccugcaagucuaucacaucggaaaccuccugaagggcgaccgcgugaaugggcaucugauucacaagaucgagccucauuucaacaccagcuggaugucuugggauggaugcgaccuugauuacuauuguaauaugggcgacuggcccuccugcacguacacaggggugacccagcacaaccacgccgccuuugucaaucuccugaacauugaaacagauuauaccaagaccuuccauuuucacagcaaacgggugacagcucauggcgacacgccucagcuggaucucaaggcgagacccaccuacggagccggcgagaucacaguucugguggaagucgcugacauggagcuucacaccaaaaagguggagaucucugggcugaaguucgccagccucgccuguacaggaugcuacgcuugcuccagcggcauuucuuguaaaguucgcauccacguggaugaaccugacgagcugaccguccaugugaaguccaaugaucccgacguuguggccgcgagcacgucccugauggcucggaaacuugaauuugggacagauucuaccuucaaggccuuuagcgccaugccgaaaaccucccucugcuucuauauugucgagagagaauacuguaagucuugcagcgaggaggacacacagaaauguguggacaccaagcuggaacaaccucaguccauccugauugagcacaagggaacaaucaucggcaaacagaacgugacgugcaccgcuaaggccucuuguuggcucgaaagcgucaaauccuuuuucuaugggcugaagaauaugcuuggcagcguuuuuggaaacuucuucauuggcauccugcucuuucuggcucccuucgugcugcuugugcucuuuuucauguuuggguggaaaauucuguucugcuuuaaguguugccgccggacaagaggacugcucaaguaccggcugcuuaaagaugacgaggaaaccggcuaucgcagaaucauugagcggcugaauaacaagaaagggaagaauagacuccuggauggagagcgccuggccgaccggaaaaucgcggaacuuuucucuacaaagacccauaucggc

SEQ ID NO: 13901 - RNA, 2916 nt, Artificial Sequence
  derived and/or modified CDS sequence (opt5) from CCHFV(44-ST-2010, Artificial)__KR814859.1__Gn-4aa-Gc
agcgaggaacccggcgacgauugcaucuccagaacccagcuucucaagacagagacggccgaaauucacgacgauaacuacgggggaccuggcgacaaaaucaccauuuguaaugggucuacaaucguggaucaacggcugggaagcgagcuuggcugcuauaccauuaaccgcgucaaguccuucaaacugugugaaaauucugcuacagggaagaccugcgagaucgacagcacaccgguuaaauguagacagggauuuugccucaagaucacccaggagggccggggccaugugaagcugucccgcgggucugaagugguccuugaugccugugacagcuccugcgagauuaugauccccaaaggaacgggcgauauucugguggacuguagcgggggacagcaacacuuccucaaggauaaccugaucgaccugggcugcccucauauuccccuccuggggaaaauggcgaucuacauuuguagaaugucuaaucacccucggaccacaauggcuuuucuucugugguucuccuuuggauauguuauuaccugcaucuucugcaaggcccucuuuuacagccugauuaucauuggcacacuuggcaaaaagaucaagcaguaucgcgaacugaaaccccagaccuguacgauuugcgagacagccccugugaacgcuaucgaugccgagaugcaugaccucaauuguucuuacaacaucugcccguauugugcuuccagacugaccagcgacgggcuggcccggcacgucacacagugccccaagcgcaaagaaaagguggaggaaaccgagcucuaccugaaucuugaaagaaucccuuggaucguucggaaacugcuccaagugucugaguccaccggagucgcgcugaagcgcagcuccuggcuuauugugcugcucgugcugcugacagucucucucagccccguucaguccgccccugugggcagaaaaccccuguuccuugauagcaucgugaaggggaugaagaaccugcucaauucuacgucccuggagaccagccuuucuauugaagcuccguggggagccaucaacguccagagcacauuuaaaccuaccguguccacagcuaauaucgcccugucuuggagcuccguugagcaccggggcaacaagauucucgugaccgggcgcagcgaaucuaucaugaaacuggaggaaagaacgggagucuccugggaccugggcguggaggaugcgagcgagucuaagcuccugacaguuuccauuauggaccuuagccagauguacucccccguguucgaauaucugucuggcgaucggcaagucgaggaauggccuaaagccaccuguaccggggacugccccgagagauguggaugcacaagcuccaccugucuccauaaggaauggccccacucucgcaauuggcggugcaacccuacauggugcuggggcguggggacgggauguaccugcuguggcgucgaugugaaggaccuguuuacagaucauauguucaucaaauggaagguugaguacauuaaaaccgaggcuaucgugugcgucgaacugacaagccaggagagacaguguucccuuauugaagccgggacccgcuuuaaccucggcccggugacgaucacccugagcgagccccggaauauccaacagaagcugccucccgagauuaucacacuccacccuaaaauugaagagggauucuucgaccugaugcacguucagaaggugcuuucugcuuccaccgucugcaagcugcagagcuguacacauggcauccccggggaucuccaaauuuaucacaucggaaaccugcugaaaggcgacagacuuaaugggcaucucauccacaagauugaaccgcauuuuaacaccucuuggauguccugggacggaugcgaucuggacuacuauuguaauaugggcgauuggccuagcugcacguacacaggggugacccagcacaaccacgccgccuucgugaaucugcucaacaucgagacagacuauaccaaaaccuuucauuuccacucuaagcgcguuacagcucauggcgauacgccccagcuggaccuuaaagcgcggccuaccuacggagccggcgaaauuacaguccugguggagguggcugauauggagcuccacaccaagaaggucgaaaucagcgggcugaaauuugccucccuggccuguacaggaugcuacgcuugcagcucuggcauuuccuguaaggugagaauccacguugacgagcccgaugaacuuaccgugcaugucaaaagcuccgacccugaugugguugccgcgucuacgagccucauggcucgcaagcuggaguucgggacagacuccaccuuuaaagccuucucugccaugcccaagaccagccugugcuuuuauaucguggaacgggaguacuguaaauccugcucugaggaugacacaaagaagugugucgacaccaaacucgaucagccgcaaagcauucugaucgaacacaagggaacaauuaucggcaaacagaaugacacgugcaccgcuaaggccuccuguuggcuugagagcgugaaaucuuucuuuuaugggcugaagaacaugcucggcuccguuuucggaaacuuuuucgugggcauucugcuguuccuugcuccuuuuguccuccuggugcuguucuuuaugugcggguggaagauccucuucuguuuuaaaugcuguagacgcacacggggacuguucaaguacagacaucuuaaagaugacgaagagaccggcuaucggcgcaucauugaaagacugaauagcaagaaagggaagaaucggcuccuggauggagagagacuggccgaccgcaagaucgcggagcuguuuucuacaaaaucccacauuggc

SEQ ID NO: 13902 - RNA, 2916 nt, Artificial Sequence
  derived and/or modified CDS sequence (opt5) from CCHFV(46-ST-2012, Artificial)__KR814860.1__Gn-4aa-Gc
agcgaggaacccggcgacgauugcaucuccagaacccagcugcuccggacagagacggccgaaauucacgacgauaacuacgggggaccuggcgacaagaucaccauuuguaaugggucuacaaucguggaucaacgccugggaagcgagcuuggcugcuauaccauuaacagagucaaauccuucaagcugugugaaaauucugcuacagggaaaaccugcgagaucgacagcacaccgguuaagugucggcagggauuuugccucaaaaucacccaggagggccgcggccaugugaagcuguccagagggucugaagugguccuugaugccugugacagcuccugcgaggugaugauucccaagggaacgggcgauauccugguugacuguagcgggggacagcaacacuuccucaaagauaaccugauugaccugggcugcccucauaucccccuccuggggaagauggcgauuuacaucugucggaugucuaaucacccucgcaccacaauggcuuuucuuuucugguuuuccuucggauaugugauuaccugcaucuuuugcaaagcccuguucuacagccucaucauuaucggcacacugggcaagaaaauuaagcaguauagagaacuuaagccccagaccuguacgaucugcgagacagccccugucaacgcuauugaugccgagaugcaugaccugaauuguucuuacaacaucugcccguauugugcuucccggcucaccagcgacgggcuggcccgccacgugccccagugcccuaaaagaaaggaaaaaguugaggaaacagagcuguaccucaaucuggaacggauccccuggauugugcgcaagcugcugcaagucucugaguccaccggaguggcgcucaaaagaagcuccuggcugaucgugcuucugguccuccugaccguuucucugagcccugugcaguccgcccccgugggccggaagccgcucuuucuggauagcauugucaaagggaugaagaaccuucuuaauucuacaucccucgagacgagccugucuaucgaagcuccuuggggagccauuaacgugcagagcaccuucaagcccacaguuuccaccgcuaauaucgcccuuucuuggagcuccguggagcaccgcggcaacaaaauccuggucacagggagaagcgaaucuauuaugaagcucgaggaacggaccggaguguccugggaccugggcguugaggaugcgagcgagucuaaacugcucacgguguccaucauggaccugagccagauguacuccccugucuuugaauaucuuucuggcgauagacaaguggaggaauggcccaaggccacauguaccggggacugccccgagcgcuguggaugcaccagcuccacaugucugcauaaagaauggccucacucucggaauuggagaugcaacccgaccuggugcuggggcgucgggacaggauguacgugcuguggcguggauguuaaggaccucuucaccgaucauauguuugugaaguggaaagucgaguacauuaagacagaggcuaucgugugcguugaacugaccagccaggagcgccaguguucccugauugaagccgggacacgguucaaccuuggccccgugaccaucacgcucagcgagccuagaaauauucaacagaaacugcccccugagaucaucacccugcaccccaaggucgaagagggauucuuugaccucaugcacgugcagaaagugcugucugcuuccacaguuugcaaacuucagagcuguacccauggcauuccgggggaucugcaagucuaucacaucggaaaccuccugaagggcgaccgcauuaaugggcaucugauccacaaaauugaaccucauuucaacacaucuuggauguccugggacggaugcgaucuugacuacuauuguaauaugggcgauuggcccagcugcaccuacacgggggugacacagcacaaccacgccgccuuugugaaucuccugaacaucgagaccgacuauacaaagaccuuccauuuucacucuaaacgggucaccgcucauggcgauacaccucagcuggaccucaaggcgagacccacguacggagccggcgaaaucaccgugcugguugagguggcugauauggagcuucacacaaagaaggucgaaauuagcgggcugaaguucgccucccucgccuguaccggaugcuacgcuugcagcucuggcaucuccuguaaagugcgcauucacguugacgagccugaugaacugacagugcaugucaagagcuccgaccccgaugugguugccgcgucuaccagccugauggcucggaaacuugaguuugggacggacuccacauucaaggccuuuucugccaugccgaaaaccagccucugcuucuauaucguggaaagagaguacuguaaguccugcucugaggaagauacccagaaaugugucgacacacgccuggagcaaccucagagcauucugaucgaacacaagggaaccaucauuggcaagcagaaugacacaugcacggcuaaagccuccuguuggcucgagagcgugaaguccuuuuucuaugggcugaaaaacaugcuuggcucuguguuuggaaauuucuucaucggcauucugcucuuucuggcucccuucguccugcuuguucucuuuuucauguuuggguggaagauccuguucugcuuuaaauguugccggagaacccggggacugcucaaguaccgccaucugaaggaugacgaagagacaggcuauagacggauuaucgagagacuuaacaauaaaaaggggaaaaaccgccugcucgauggagaacggcuggccgacagaaagaucgcggagcuguucagcaccaaaacacacauuggc

SEQ ID NO: 13903 - RNA, 2916 nt, Artificial Sequence
  derived and/or modified CDS sequence (opt5) from CCHFV(47-ST-2013, Artificial)__KR814861.1__Gn-4aa-Gc
agcgaggaacccggcgacgauugcaucuccagaacccagcugcucaagacagagacggccgaaauucacgacgauaacuacgggggaccuggcgacaaaaucaccauuuguaaugggucuacaaucguggaucaacggcugggaagcgagcuuggcugcuauaccauuaaccgcgucaaguccuucaaacuguguaaaaauucugcuacagggaagaccugcgaaaucgacagcacaccgguuaaguguagacagggauuuugccucaagaucacccaggagggccggggccaugugaaacugucccgcgggucugaggugguccuugaugccugugacagcuccugcgaaauuaugauccccaagggaacgggcgauauucugguggacuguagcgggggacagcaacacuuccucaaagauaaccugaucgaccugggcugcccucauauuccccuccuggggaagauggcgaucuacauuuguagaaugucuaaucacccucggaccacaauggcuuuucuuuucugguuuuccuucggauauguuauuaccugcaucuuuugcaaagcccuguucuacagccucauuaucauuggcacacugggcaagaagaucaaacaguaucgcgagcuuaagccccagaccuguacgauuugcgaaacagccccugugaacgcuaucgaugccgagaugcaugaccugaauuguucuuacaacaucugcccguauugugcuuccagacucaccagcgacgggcuggcccggcacgucacacagugccccaaacgcaaggagaaaguggaagagaccgaacuguaccucaaucuggagagaaucccuuggaucguucggaagcugcugcaagugucugaauccaccggagucgcgcucaaacgcagcuccuggcugauugugcuucuggugcuccugacagucucucugagccccguucaguccgccccugugggcagaaagccccucuuucuggauagcaucgugaaggggaugaaaaaccuucuuaauucuacgucccucgagaccagccugucuauugaggcuccguggggagccaucaacguccagagcacauucaagccuaccguguccacagcuaauaucgcccuuucuuggagcuccguugaacaccggggcaacaaaauucuggugaccgggcgcagcgagucuaucaugaagcucgaagagagaacgggagucuccugggaccugggcguggaagaugcgagcgagucuaaacugcucacaguuuccauuauggaccugagccagauguacucccccguguuugaguaucuuucuggcgaucggcaagucgaagaguggccuaaggccaccuguaccggggaaugccccgagagauguggaugcacaagcuccaccugucugcauaaggaauggccccacucucgcaauuggcggugcaacccuacauggugcuggggcguggggacgggauguaccugcuguggcgucgacgugaaagaucucuucacagaccauauguuuaucaaguggaaaguugaguacauuaagaccgaggcuaucgugugcgucgaacugacaagccaggagagacaguguucccugauugaagccgggacccgcuucaaccuuggcccggugacgaucacccucagcgagccccggaauauccaacagaaacugccucccgagauuaucacacugcacccuaagauugaagagggauucuuugaucucaugcacguucagaaggugcugucugcuuccaccgucugcaaacuucagagcuguacacauggcauccccggggaccugcaaauuuaucacaucggaaaccuccugaagggcgauagagugaaugggcaucugauccacaaaauugaaccgcauuucaacaccucuuggauguccugggacggaugcgaccuugauuacuauuguaauaugggcgacuggccuagcugcacguacacaggggugacccagcacaaccacgccgccuuuguuaaucuccugaacaucgagacagauuauaccaagaccuuccauuuucacucuaaacgcgucacagcucauggcgacacgccccagcuggaucucaaggcgcggccuaccuacggagccggcgaaauuacagugcugguggaggucgcugacauggagcuucacaccaagaaaguggaaguuagcgggcugaaguucgccucccucgccuguacaggaugcuacgcuugcagcucuggcaucuccuguaaagugcgcauucacgucgaugagcccgacgaacugaccgugcauguuaagagcuccgauccugacguggucgccgcgucuacgagccugauggcuagaaaacuugaguuugggacagauuccaccuucaaggccuuuucugccaugcccaaaaccagccucugcuucuauaucguggaacgggaguacuguaaguccugcucugaggacgauacaaagaaauguguugacaccaagcuggaacagccgcaaagcauccugauugagcacaaaggaacaaucauuggcaagcagaaugacacgugcaccgcuaaagccuccuguuggcucgaaagcgugaaguccuuuuucuaugggcugaagaacaugcuuggcucugucuuuggaaauuucuucgugggcauccugcucuuucuggcuccuuucgugcugcuuguccucuuuuucauguuuggguggaaaauucuguucugcuuuaaguguugcagacgcacacggggacuguucaaauacagacaucucaaggaugacgaggaaaccggcuaucggcgcaucaucgagagacugaacagcaaaaaggggaagaaucggcuucuggauggagagagacucgccgaccgcaaaauugcggaacuguuuucuacaaagacccacaucggc

SEQ ID NO: 13904 - RNA, 2916 nt, Artificial Sequence
  derived and/or modified CDS sequence (opt5) from CCHFV(52-R-2014, Artificial)__KR814862.1__Gn-4aa-Gc
agcgaggaacccggcgacgauugcaucuccagaacccagcugcuccggacagagacggccgaaauucacgacgauaacuacgggggaccuggcgacaagaucaccauuuguaaugggucuacaaucguggaucaacgccugggaagcgagcuuggcugcuauaccauuaacagagucaaauccuucaagcugugugaaaauucugcuacagggaaaaccugcgagaucgacagcacaccgguuaagugucggcagggauuuugccucaaaaucacccaggagggccgcggccaugugaagcuguccagagggucugaagugguccuugaugccugugacacgagcugcgaggugaugauucccaagggaaccggcgauauccugguugacuguuccgggggacagcaacacuuccucaaagauaaccugauugaccugggcugcccucaugugccccuccuggggaagauggcgaucuacauuugucggaugagcaaucacccucgcacaaccauggcuuuucuuuucugguuuucuuucggauaugucaucacaugcaucuuuugcaaagcccuguucuacucccucauuaucauuggcacccugggcaagaaaaucaagcaguauagagaacuuaagccccagacguguacaauuugcgagaccgccccugugaacgcuaucgaugccgagaugcaugaccugaauuguagcuacaacauuugcccguauugugcuucucggcucacauccgacgggcuggcccgccacguuccccagugcccuaaaagaaaggaaaaaguggaggaaaccgagcuguaccucaaucuggaacggauccccuggaucguccgcaaacuucugcaagugagcgagucuaccggaguggcgcucaaaagauccagcuggcugauuguccuucugguucuccugacagugucccugucuccugugcagagcgcccccgucggccggaagccgcucuuucuggauuccaucgugaaagggaugaagaaccuucugaauagcacgucucucgagaccucccugagcauugaagcuccuuggggagccaucaacguucagucuacauucaagcccaccgugagcacagcuaauauugcccuuuccuggucuagcgucgagcaccgcggcaacaaaauccuggugaccgggagauccgaaagcaucaugaagcucgaggaacggacgggaguuucuugggaccugggcguggaugacgcguccgagagcaaacugcucacagucucuauuauggaucugucccagauguacagcccuguguuugaguaucuuuccggcgacagacaagucgaagaguggcccaaggccaccuguaccggggauugccccgaacgcuguggaugcacaucuagcaccugucugcauaaagaguggccucacucccggaauuggagaugcaacccgacauggugcuggggcguggggacgggauguaccugcuguggcguugacgugaaggaucucuucacagaccauauguuugucaaguggaaaguggaauacaucaagaccgaggcuauuguuugcguggagcugacaucucaggaacgccaguguagccugaucgaggccgggacccgguucaaccuuggccccgucacgauuacccucuccgaaccuagaaauauccaacagaaacugcccccugagauuaucacacugcaccccaagguggaggaaggauucuuugaucucaugcacgugcagaaaguucugagcgcuucuaccgucugcaaacuucaguccuguacacauggcaucccgggggaccugcaaguguaucacauuggaaaccuccugaagggcgaccgcgugaaugggcaucugauccacaagauugagccucauuucaacaccagcuggaugucuugggauggaugcgaccuugauuacuauuguaauaugggcgacuggcccuccugcacguacacaggggucacccagcacaaccacgccgccuuugugaaucuccugaacaucgaaacagauuauaccaagaccuuccauuuucacagcaaacggguuacagcucauggcgacacgccucagcuggaucucaaggcgagacccaccuacggagccggcgagauuacagugcuggucgaaguggcugacauggagcuucacaccaaaaagguugagaucucugggcugaaguucgccagccucgccuguacaggaugcuacgcuugcuccagcggcaucucuuguaaagugcgcauucacgucgaugaaccugacgagcugaccgugcauguuaaguccaaugaucccgacguggucgccgcgagcacgucccugauggcucggaaacuugaauuugggacagauucuaccuucaaggccuuuagcgccaugccgaaaaccucccucugcuucuauaucguggagagagaauacuguaagucuugcagcgaggaggacacacagaaauguguggacaccaagcuggaacaaccucaguccauucugaucgagcacaagggaacaauuaucggcaaacagaacgauacgugcaccgcuaaggccggguguuggcucgaaucugucaagagcuuuuucuauggccugaagaauaugcuuggauccguuuuuggcaacuucuucaucgggauucugcucuuucuggcucccuucgugcugcuugugcucuuuuucauguuuggauggaaaauccuguucugcuuuaaguguugccgccggacaagaggccugcucaaguaccggcugcuuaaagacgaugaggaaaccggguaucgcagaauuaucgagcggcugaauaacaagaaaggaaagaauagacuccuggacggcgagcgccuggccgaucggaaaauugcggaacuuuucagcacaaagacccauaucggg

SEQ ID NO: 13905 - RNA, 2916 nt, Artificial Sequence
  derived and/or modified CDS sequence (opt5) from CCHFV(75-R-2012, Artificial)__KR814863.1__Gn-4aa-Gc
agcgaggaacccggcgacgauugcaucuccagaacccagcugcuccggacagagacggccgaaauucacgacgauaacuacgggggaccuggcgacaagaucaccauuuguaaugggucuacaaucguggaucaacgccugggaagcgagcuuggcugcuauaccauuaacagagucaaauccuucaagcugugugaaaauucugcuacagggaaaaccugcgagaucgacagcgccccgguuaagugucggcagggauuuugccucaaaaucacacaggagggccgcggccaugugaagcuguccagagggucugaagugguccuugaugcgugugacagcuccugcgaggugaugauucccaagggaaccggcgauauccugguugacuguagcgggggacagcaacacuuccucaaagauaaccugauugaccugggcugcccucauaucccccuccuggggaagauggcuauuuacaucugucggaugucuaaucacccucgcacgaccauggccuuucuuuucugguuuuccuucggauaugugauuacaugcaucuuuugcaaagcccuguucuacagccucaucauuaucggcacccugggcaagaaaauuaagcaguauagagaacuuaagccccagacauguaccaucugcgagacggcuccugucaacgccauugaugcugagaugcaugaccugaauuguucuuacaacaucugcccguauugugccucccggcucacaagcgacgggcuggcgcgccacgugccccagugcccuaaaagaaaggaaaaaguugaggaaaccgagcuguaccucaaucuggaacggauccccuggauugugcgcaagcugcugcaagucucugaguccacaggaguggcccucaaaagaagcuccuggcugaucgugcuucugguccuccugaccguuucucugagcccugugcaguccgcucccgugggccggaagccgcucuuucuggauagcauugucaaagggaugaagaaccuucuuaauucuaccucccucgagacaagccugucuaucgaagccccuuggggagcuauuaacgugcagagcacguucaagcccaccguuuccacagccaauaucgcgcuuucuuggagcuccguggagcaccgcggcaacaaaauccuggucaccgggagaagcgaaucuauuaugaagcucgaggaacggacaggaguguccugggaccugggcguugaggaugccagcgagucuaaacugcucaccguguccaucauggaccugagccagauguacuccccugucuuugaauaucuuucuggcgauagacaaguggaggaauggcccaaggcuacguguacaggggacugccccgagcgcuguggaugcaccagcuccaccugucugcauaaagaauggccucacucucggaauuggagaugcaacccgacauggugcuggggcgucgggaccggauguacaugcuguggcguggauguuaaggaccucuucacggaucauauguuugugaaguggaaagucgaguacauuaagaccgaggccaucgugugcguugaacugacaagccaggagcgccaguguucccugauugaagcugggacccgguucaaccuuggccccgugacaaucacccucagcgagccuagaaauauucaacagaaacugcccccugagaucaucacgcugcaccccaaggucgaagagggauucuuugaccucaugcacgugcagaaagugcugucugccuccaccguuugcaaacuucagagcuguacacauggcauuccgggggaucugcaagucuaucacaucggaaaccuccugaagggcgaccgcgugaaugggcaucugauucacaagaucgaaccucauuucaacaccucuuggauguccugggacggaugcgaucuugacuacuauuguaauaugggcgauuggcccagcugcacauacaccggggugacgcagcacaaccacgccgcuuuugucaaucuccugaacauugagacagacuauaccaagacauuccauuuucacucuaaacgggugaccgcgcauggcgauaccccucagcuggaccucaaggccagacccacauacggagcuggcgaaaucacgguucugguggaggucgccgauauggagcuucacaccaaaaagguggaaaucagcgggcugaaguucgccucccucgcuuguacaggaugcuacgccugcagcucuggcauuuccuguaaaguucgcauccacguggacgagccugaugaacugaccguccauguuaagagcuccgaccccgaugugguggcggcuucuacaagccugauggcccggaaacuugaguuugggaccgacuccacguucaaggccuuuucugcuaugccgaaaacaagccucugcuucuauauugucgaaagagaguacuguaaguccugcucugaggaagauacccagaaauguguggacaccaagcuggagcaaccucagagcauccugauugaacacaagggaacaaucaucggcaaacagaaugauaccugcacagccaaggcuuccuguuggcucgagagcgugaaaucuuuucuguaugggcuuaagaacaugcugggcuccgucuucggaaacuuuuucauuggcauccuccuguuccuggcccccuuuguucuucucgugcuguucuuuauguucggguggaaaauucuguuuugcuucaaguguugccgccggacgagaggacuccugaaguaccggcuucugaaagacgacgaagagaccggcuaucgcagaaucauugagcggcucaauaauaagaaagggaagaacagacugcuggauggagaacgccuugcggaccggaaaaucgccgagcuguuuagcacaaagacccauaucggc

SEQ ID NO: 13906 - RNA, 2916 nt, Artificial Sequence
  derived and/or modified CDS sequence (opt5) from CCHFV(75-ST-2010, Artificial)__KR814864.1__Gn-4aa-Gc
agcgaggaauccggcgacgauugcaucucuagaacccagcugcuccggacagagacggccgaaauucacgacgauaacuacgggggacccggcgacaagaucaccauuuguaaugggagcacaaucguggaucaacgccugggauccgagcuuggcugcuauaccauuaacagagucaaaucuuucaagcugugugaaaauagcgcuacagggaaaaccugcgagaucgacuccacaccuguuaagugucggcagggauuuugccucaaaaucacccaggagggccgcggccaugugaagcugucuagagggagcgaagugguccuugaugccugugacuccagcugcgaggugaugauuccgaagggaacgggcgauauccugguugacuguucugggggacagcaacacuuccucaaagauaaccugauugaccugggcugcccccauaucccucuccuggggaagauggcgauuuacaucugucggauguccaaucacccccgcaccacaauggcuuuucuuuucugguuuagcuucggauaugugauuaccugccuguuuugcaaagcccucuucuacucucugaucaucauuggcacacuuggcaagaaaaucaagcaguauagagaacugcggccucagaccuguacgauuugcgagacagcccccgucaacgcuaucgaugccgagaugcaugaccucaauuguuccuacaacauuugcccuuauugugcuagccgccugaccucugacgggcuggccagacacgugccgcagugccccaagcggaaagaaaagguugaggaaacagagcucuaccugaaucuugaacgcaucccuuggaucgugagaaaacugcuccaagucuccgagagcaccggaguggcgcugaagcgguccucuuggcuuauugugcugcucguccugcugaccguuagccucucccccgugcagagcgccccugugggccgcaaaccccuguuucuugauucuaucgucaaggggaugaaaaaccugcucaauuccacaagccuggagacgucucuuagcauugaagcuccguggggagccaucaacgugcaguccaccuucaagccuacaguuucuaccgcuaauauugcccugagcugguccagcguggagcacagaggcaacaagauccucgucacagggcggucugaauccaucaugaaacuggaggaaagaaccggagugagcugggaccugggcguugaggaugcgucugaguccaagcuccugacggugagcauuauggaccuuucccagauguacucucccgucuuugaauaucugagcggcgaucgccaaguggaggaauggccuaaagccacauguaccggggacugccccgagcgguguggaugcaccuccucuacaugucuccauaaggaauggccccacagcagaaauuggcgcugcaacccuaccuggugcuggggcgucgggacaggauguacgugcuguggcguggauguuaaagaccuguucaccgaucauauguuugugaaguggaaggucgaguacaucaaaacagaggcuauugugugcguugaacugaccucccaggagcggcaguguagccuuaucgaagccgggacaagauucaaccucggcccggugaccauuacgcugucugagccccgcaauauccaacagaagcugccucccgagauuaucacccuccacccuaaagucgaagagggauucuuugaccugaugcacgugcagaaggugcuuuccgcuagcacaguuugcaaacugcagucuuguacccauggcauccccggggaucuccaagucuaucacauuggaaaccugcugaagggcgaccgggugaaugggcaucuuauccacaagauugaaccgcauuucaacacauccuggaugagcugggacggaugcgaucucgacuacuauuguaauaugggcgauuggccuucuugcaccuacacgggggugacacagcacaaccacgccgccuuugucaaucugcugaacaucgagaccgacuauacaaaaaccuuccauuuucacagcaagagagugaccgcucauggcgauacaccccagcucgaccugaaagcgcgcccuacguacggagccggcgaaauuaccguucuuguggaggucgcugauauggagcugcacacaaagaaaguggaaaucuccgggcucaaguucgccagccuggccuguaccggaugcuacgcuuguucuuccggcaucagcugcaagguucggauucacguggacgagcccgaugaacugacaguccaugugaaauccucugacccugauguuguggccgcgagcaccucccuuauggcuagaaagcucgaguuugggacggacucuacauucaaagccuuuagcgccaugcccaagaccucccugugcuucuauaucgucgaacgcgaguacuguaaaucuugcagcgaggaagauacccagaaguguguggacacaaaacuggagcaaccgcaguccauucucaucgaacacaagggaaccauuaucggcaagcagaaugacacaugcacggcuaaagccagcuguuggcuggagucugugaaguccuuuuucuaugggcuuaaaaacaugcugggcagcgucuuuggaaauuucuucaucggcauucuccuguuucuggcuccuuucguucuucucgugcuguuuuucauguuuggguggaagauccuguucugcuuuaaauguugccggagagcccggggacuccugaaguaccgccaucuuaaggaugacgaagagaccggcuauagaaaaauuaucgagcggcugaacaauaagaaagggaagaacagacuccuggauggagaacgccuggcggaccggaaaauugccgagcuuuucucuacaaagacccacaucggc

SEQ ID NO: 13907 - RNA, 2916 nt, Artificial Sequence
  derived and/or modified CDS sequence (opt5) from CCHFV(3756-ST-2007, Artificial)__KR814866.1__Gn-4aa-Gc
agcgaggaacccggcgacgauugcaucuccagaacccagcugcucaagacagagacggccgaaauucacgacgauaacuacgggggaccuggcgacaaaaucaccauuuguaaugggucuacaaucguggaucaacggcugggaagcgagcuuggcugcuauaccauuaaccgcgucaaguccuucaaacugugugaaaauucugcuacagggaagaccugcgagaucgacagcacaccgguuaaauguagacagggauuuugccucaagaucacccaggagggccggggccaugugaagcugucccgcgggucugaagugguccuugaugccugugacagcuccugcgagauuaugauccccaaaggaacgggcgauauucugguggacuguagcgggggacagcaacacuuccucaaggauaaccugaucgaccugggcugcccucauauuccccuccuggggaaaauggcgaucuacauuuguagaaugucuaaucacccucggaccacaauggcuuuucuuuucugguuuuccuucggauauguuauuaccugcaucuuuugcaaggcccuguucuacagccucauuaucauuggcacacugggcaaaaagaucaagcaguaucgcgaacuuaaaccccagaccuguacgauuugcgagacagccccugugaacgcuaucgaugccgagaugcaugaccugaauuguucuuacaacaucugcccguauugugcuuccagacucaccagcgacgggcuggcccggcacgucacacagugccccaagcgcaaagaaaagguggaggaaaccgagcuguaccucaaucuggaaagaaucccuuggaucguucggaaacuucugcaagugucugaguccaccggagucgcgcucaagcgcagcuccuggcugauugugcuucuggugcuccugacagucucucugagccccguucaguccgccccugugggcagaaaaccccucuuucuggauagcaucgugaaggggaugaagaaccuucugaauagcacgucccucgagaccagccugucuauugaagcuccguggggagccaucaacguccagagcacauucaaaccuaccguguccacagcuaauaucgcccuuucuuggagcuccguugagcaccggggcaacaagauucuggugaccgggcgcagcgaaucuaucaugaaacucgaggaaagaacgggagucuccugggaccugggcguggaggaugcgagcgagucuaagcugcucacaguuuccauuauggaccugagccagauguacucccccguguuugaauaucuuucuggcgaucggcaagucgaggaauggccuaaagccaccuguaccggggacugccccgagagauguggaugcacaagcuccaccugucugcauaaggaauggccccacucucgcaauuggcggugcaacccuacauggugcuggggcguggggacgggauguaccugcuguggcgucgaugugaaggaccucuucacagaucauauguuuaucaaauggaagguugaguacauuaaaaccgaggcuaucgugugcgucgaacugacaagccaggagagacaguguucccugauugaagccgggacccgcuucaaccuuggcccggugacgaucacccucagcgagccccggaauauccaacagaagcugccucccgagauuaucacacugcacccuaaaauugaagagggauucuuugaccucaugcacguucagaaggugcugucugcuuccaccgucugcaagcugcagagcuguacacauggcauccccggggaucugcaaauuuaucacaucggaaaccuccugaaaggcgacagagugaaugggcaucugauccacaagauugaaccgcauuucaacaccucuuggauguccugggacggaugcgaucuugacuacuauuguaauaugggcgauuggccuagcugcacguacacaggggugacccagcacaaccacgccgccuuuguuaaucuccugaacaucgagacagacuauaccaaaaccuuccauuuucacucuaagcgcgucacagcucauggcgauacgccccagcuggaccucaaagcgcggccuaccuacggagccggcgaaauuacagugcugguggaggucgcugauauggagcuucacaccaagaagguggaaaucagcgggcugaaauucgccucccucacauguaccggaugcuacgccugcagcucuggcauuuccuguaagguuagaauccacguggacgagcccgaugaacugacgguccaugugaaaagcuccgacccugauguuguggcugccucuacaagccugauggcgcgcaaacuugaguuugggaccgacuccaccuucaaggcuuuuucugccaugcccaagacaagccucugcuucuauaucgucgaacgggaguacuguaaauccugcucugaggaugacaccaagaaguguguggacacaaaacuggaacagccgcaaagcauucugaucgagcacaagggaacgauuaucggcaaacagaaugauaccugcacagccaaggcuuccuguuggcucgaaagcguuaaauccuuuuucuaugggcugaagaacaugcuuggcucuguguuuggaucuuucuucgucggcauucugcucuuucugaccccuuucgugcugcuugugcucuuuuucauguuuggguggaagauccuguucugcuuuaaauguugcagacgcacacggggacuguucaaguacagacaucucaaagacgaugaggaaaccggcuaucggcgcaucauugagagacuuaauucuaagaaagggaagaaccggcuucuggacggagagagacucgccgaucgcaagaucgcugaacuguuuuccacgaaaacccacauuggc

SEQ ID NO: 13908 - RNA, 2916 nt, Artificial Sequence
  derived and/or modified CDS sequence (opt5) from CCHFV(3809-ST-2007, Artificial)__KR814867.1__Gn-4aa-Gc
agcgaggaacccggcgacgauugcaucuccagaacccagcugcuccggacagagacggccgaaauucacgacgauaacuacgggggaccuggcgacaagaucaccauuuguaaugggucuacaaucguggaucaacgccugggaagcgagcuuggcugcuauaccauuaacagagucaaauccuucaagcugugugaaaauucugcuacagggaaaaccugcgagaucgacagcacaccgguuaagugucggcagggauuuugccucaaaaucacccaggagggccgcggccaugugaagcuguccagagggucugaagugguccuugaugccugugacagcuccugcgaggugaugauucccaagggaacgggcgauauccugguugacuguagcgggggacagcaacacuuccucaaagauaaccugauugaccugggcugcccucauaucccccuccuggggaagauggcgauuuacaucugucggaugucuaaucacccucgcaccacaauggcuuuucuuuucugguuuuccuucggauaugugauuaccugcaucuuuugcaaagcccuguucuacagccucaucauuaucggcacacugggcaagaaaauuaagcaguauagagaacuuaagccccagaccuguacgaucugcgagacagccccugucaacgcuauugaugccgagaugcaugaccugaauuguucuuacaacaucugcccguauugugcuucccggcucaccagcgacgggcuggcccgccacgugccccagugcccuaaaagaaaggaaaaaguugaggaaacagagcuguaccucaaucuggaacggauccccuggauugugcgcaagcugcugcaagucucugaguccaccggaguggcgcucaaaagaagcuccuggcugaucgugcuucugguccuccugaccguuucucugagcccugugcaguccgcccccgugggccggaagccgcucuuucuggauagcauugucaaagggaugaagaaccuucuuaauucuacaucccucgagacgagccugucuaucgaagcuccuuggggagccauuaacgugcagagcaccuucaagcccacaguuuccaccgcuaauaucgcccuuucuuggagcuccguggagcaccgcggcaacaaaauccuggucacagggagaagcgaaucuauuaugaagcucgaggaacggaccggaguguccugggaccugggcguugaggaugcgagcgagucuaaacugcucacgguguccaucauggaccugagccagauguacuccccugucuuugaauaucuuucuggcgauagacaaguggaggaauggcccaaggccacauguaccggggacugccccgagcgcuguggaugcaccagcuccacaugucugcauaaagaauggccucacucucggaauuggagaugcaacccgaccuggugcuggggcgucgggacaggauguacgugcuguggcguggauguuaaggaccucuucaccgaucauauguuugugaaguggaaagucgaguacauuaagacagaggcuaucgugugcguugaacugaccagccaggagcgccaguguucccugauugaagccgggacacgguucaaccuuggccccgugaccaucacgcucagcgagccuagaaauauucaacagaaacugcccccugagaucaucacccugcaccccaaggucgaagagggauucuuugaccucaugcacgugcagaaagugcugucugcuuccacaguuugcaaacuucagagcuguacccauggcauuccgggggaucugcaagucuaucacaucggaaaccuccugaagggcgaccgcgugaaugggcaucugauucacaaaaucgaaccucauuucaacacaucuuggauguccugggacggaugcgaucuugacuacuauuguaauaugggcgauuggcccagcugcaccuacacgggggugacacagcacaaccacgccgccuuugucaaucuccugaacauugagaccgacuauacaaagaccuuccauuuucacucuaaacgggugaccgcucauggcgauacaccucagcuggaccucaaggcgagacccacguacggagccggcgaaaucaccguucugguggaggucgcugauauggagcuucacacaaagaagguggaaaucagcgggcugaaguucgccucccucgccuguaccggaugcuacgcuugcagcucuggcauuuccuguaaaguucgcauccacguggacgagccugaugaacugacaguccauguuaagagcuccgaccccgaugugguggccgcgucuaccagccugauggcucggaaacuugaguuugggacggacuccacauucaaggccuuuucugccaugccgaaaaccagccucugcuucuauauugucgaaaaggaguacuguagauccugcucugaggaagauacccagaaauguguggacacaaagcuggagcaaccucagagcauccugauugaacacaagggaaccaucaucggcaaacagaaugacacaugcacggcuaaggccuccuguuggcucgagagcgugaaauccuuuuucuaugggcugaagaacaugcuuggcucugucuuuggaaauuucuucauuggcauccugcucuuucugacccccuucguucugcuugugcucuuuuucauguuuggguggaaaauucuguucugcuuuaaguguugccgccggacaagaggacugcucaaguaccggcaucugaaagaugacgaagagaccggcuaucgcagaaucauugagcggcuuaacaauaagaaagggaagaacagacugcucgauggagaacgccuggcugaccggaaaaucgccgagcuguucagcacaaagacccacaucggc

SEQ ID NO: 13909 - RNA, 2916 nt, Artificial Sequence
  derived and/or modified CDS sequence (opt5) from CCHFV(3820-ST-2007, Artificial)__KR814868.1__Gn-4aa-Gc
agcgaggaacccggcgacgauugcaucuccagaacccagcugcucaagacagagacggccgaaauucacgacgauaacuacgggucuccuggagacaaaaucaccauuuguaauggcagcacaaucguggaucaacggcugggguccgagcuuggaugcuauaccauuaaccgcgucaagucuuucaaacugugugaaaauagcgcuacaggcaagaccugcgagaucgacuccacaccgguuaaauguagacagggguuuugccucaagaucacccaggagggacggggccaugugaagcugucucgcggcagcgaagugguccuugaugccugugacuccagcugcgagauuaugauccccaaagggacgggagauauucugguggacuguucuggcgggcagcaacacuuccucaaggauaaccugaucgaccugggaugcccucauauuccccuccugggcaaaauggcgaucuacauuuguagaauguccaaucacccucggaccacaauggcuuuucuuuucugguuuagcuucggguauguuauuaccugcaucuuuugcaaggcccuguucuacucucucauuaucauuggaacacugggcaaaaagaucaagcaguaucgcgaacuuaaaccccagaccuguacgauuugcgagacagccccugugaacgcuaucgaugccgagaugcaugaccugaauuguuccuacaacaucugcccguauugugcuagcagacucaccucugacggccuggcccggcacgucacacagugccccaagcgcaaagaaaagguggaggaaaccgagcuguaccucaaucuggaaagaaucccuuggaucguucggaaacuucugcaaguguccgagagcaccggggucgcgcucaagcgcuccucuuggcugauugugcuucuggugcuccuggccgucagccugucccccguucagagcgcuccugugggaagaaaaccccucuuucuggauucuaucgugaagggcaugaagaaccuucuuaauuccacaagccucgagacgucucugagcauugaagccccguggggagcuaucaacguccaguccaccuucaaaccuacagugucuaccgccaauaucgcgcuuagcugguccagcguugagcaccggggaaacaagauucuggugacaggccgcucugaauccaucaugaaacucgaggaaagaaccggggucagcugggaccugggaguggaggaugccucugaguccaagcugcucacgguuagcauuauggaccugucccagauguacucucccguguuugaauaucuuagcggcgaucggcaagucgaggaauggccuaaagcuacauguaccggcgacugccccgagagaugugggugcaccuccucuacaugucugcauaaggaauggccccacagccgcaauuggcggugcaacccuaccuggugcuggggagugggcacaggguguacgugcuguggagucgaugugaaggaccucuucaccgaucauauguuuaucaaauggaagguugaguacauuaaaacagaggccaucgugugcgucgaacugaccucccaggagagacaguguagccugauugaagcuggcacacgcuucaaccuugggccggugaccaucacgcucucugagccccggaauauccaacagaagcugccucccgagauuaucacccugcacccuaaaauugaagagggcuucuuugaccucaugcacguucagaaggugcuguccgccagcacagucugcaagcugcagucuuguacccauggaauccccggcgaucugcaaauuuaucacaucgggaaccuccugaaaggagacagagugaauggccaucugauccacaagauugaaccgcauuucaacacauccuggaugagcugggacgggugcgaucuugacuacuauuguaauaugggagauuggccuucuugcaccuacacgggcgugacacagcacaaccacgccgcuuuuguuaaucuccugaacaucgagaccgacuauacaaaaaccuuccauuuucacagcaagcgcgucaccgcgcauggggauacaccccagcuggaccucaaagcccggccuacguacggcgcuggagaaauuaccgugcugguggaggucgccgauauggagcuucacacaaagaagguggaaaucuccggccugaaauucgccagccucaccuguacagggugcuacgcuuguucuuccggaauuagcugcaagguuagaauccacguggacgagcccgaugaacugaccguccaugugaaauccucugacccugauguuguggccgcgagcacgucccugauggcucgcaagcuggaguuuggcacagacucuaccuucaaagccuuuagcgccaugcccaagaccucccucugcuucuauaucgucgaacgggaguacuguaaaucuugcagcgaggaugacacaaagaaguguguggacaccaaacuggaacagccgcaauccauucugaucgagcacaaggggacaauuaucggaaaacagaaugauacgugcaccgcuaaggccagcuguuggcucgaaucuguuaaauccuuuuucuauggccugaagaacaugcuugggagcguguuuggcucuuucuucgucgggauucugcucuuucuggcuccuuucgugcugcuugugcucuuuuucauguuuggcuggaagauccuguucugcuuuaaauguugcagacgcacacgggggcuguucaaguacagacaucucaaagacgaugaggaaaccggauaucggcgcaucauugagagacuuaauuccaagaaaggcaagaaccggcuucuggacggggagagacucgccgaucgcaagaucgcggaacuguuuagcacaaaaacccacauugga

SEQ ID NO: 13910 - RNA, 2916 nt, Artificial Sequence
  derived and/or modified CDS sequence (opt5) from CCHFV(4495-ST-2008, Artificial)__KR814869.1__Gn-4aa-Gc
agcgaggaauccggcgacgauugcaucucuagaacccagcugcuccggacagagacggccgaaauucacgacgauaacuacgggggacccggcgacaagaucaccauuuguaaugggagcacaaucguggaucaacgccugggauccgagcuuggcugcuauaccauuaacagagucaaaucuuucaagcugugugaaaauagcgcuacagggaaaaccugcgagaucgacuccacaccuguuaagugucggcagggauuuugccucaaaaucacccaggagggccgcggccaugugaagcugucuagagggagcgaagugguccuugaugccugugacuccagcugcgaggugaugauuccgaagggaacgggcgauauccugguugacuguucugggggacagcaacacuuccucaaagauaaccugauugaccugggcugcccccauaucccucuccuggggaagauggcgauuuacaucugucggauguccaaucacccccgcaccacaauggcuuuucuuuucugguuuagcuucggauaugugauuaccugccuguuuugcaaagcccucuucuacucucugaucaucauuggcacacuuggcaagaaaaucaagcaguauagagaacugcggccucagaccuguacgauuugcgagacagcccccgucaacgcuaucgaugccgagaugcaugaccucaauuguuccuacaacauuugcccuuauugugcuagccgccugaccucugacgggcuggccagacacgugccgcagugccccaagcggaaagaaaagguugaggaaacagagcucuaccugaaucuugaacgcaucccuuggaucgugagaaaacugcuccaagucuccgagagcaccggaguggcgcugaagcgguccucuuggcuuauugugcugcucguccugcugaccguuagccucucccccgugcagagcgccccugugggccgcaaaccccuguuucuugauucuaucgucaaggggaugaaaaaccugcucaauuccacaagccuggagacgucucuuagcauugaagcuccguggggagccaucaacgugcaguccaccuucaagccuacaguuucuaccgcuaauauugcccugagcugguccagcguggagcacagaggcaacaagauccucgucacagggcggucugaauccaucaugaaacuggaggaaagaaccggaauuagcugggaccugggcguggaggaugcgucugaguccaagcuccugacgguuagcaucauggaccuuucccagauguacucucccguguuugaauaucugagcggcgaucgccaagucgaggaauggccuaaagccacauguaccggggacugccccgagcgguguggaugcaccuccucuacaugucuccauaaggaauggccccacagcagaaauuggcgcugcaacccuaccuggugcuggggcguggggacaggauguacgugcuguggcgucgaugugaaagaccuguucaccgaucauauguuuguuaaguggaagguggaguacauuaaaacagaggcuaucgucugcguggaacugaccucccaggagcggcaguguagccuuauugaagccgggacaagauucaaccucggcccgguuaccaucacgcugucugagccccgcaauauucaacagaagcugccucccgagaucaucacccuccacccuaaaguggaagagggauucuuugaccugaugcacguccagaaggugcuuuccgcuagcacagugugcaaacugcagucuuguacccauggcauucccggggaucuccaaguuuaucacaucggaaaccugcugaagggcgaccgggucaaugggcaucuuauucacaagaucgaaccgcauuucaacacauccuggaugagcugggacggaugcgaucucgacuacuauuguaauaugggcgauuggccuucuugcaccuacacgggggugacacagcacaaccacgccgccuuugugaaucugcugaacauugagaccgacuauacaaaaaccuuccauuuucacagcaagagagucaccgcucauggcgauacaccccagcucgaccugaaagcgcgcccuacguacggagccggcgaaaucaccgugcuuguugagguggcugauauggagcugcacacaaagaaagucgaaaucuccgggcucaaguucgccagccuggccuguaccggaugcuacgcuuguucuuccggcauuagcugcaaggugcggauccacguugacgagcccgaugaacugacagugcaugucaaauccucugacccugaugugguugccgcgagcaccucccuuauggcuagaaagcucgaguuugggacggacucuacauucaaagccuuuagcgccaugcccaagaccucccugugcuucuauauuguggaacgcgaguacuguaaaucuugcagcgaggaagauacccagcggugugucgacacaaagcuggagcaaccgcaguccauccucauugaacacaaaggaaccaucaucggcaagcagaaugacacaugcacggcuaaggccagcuguuggcuggagucugugaaauccuuuuucuaugggcuuaagaacaugcugggcagcguguuuggaaauuucuucauuggcauccuccuguuucuggcuccuuucguccuucucguucuguuuuucauguuuggguggaaaauucuguucugcuuuaaguguugcagacgggcccgcggacuccugaaauacagacaucuuaaggaugacgaagagaccggcuaucggaagaucauugagagacugaacaauaaaaaggggaaaaaccgccuccuggauggagaacggcuggcggacagaaagaucgccgagcuuuucucuacaaaaacccacaucggc

SEQ ID NO: 13911 - RNA, 2916 nt, Artificial Sequence
  derived and/or modified CDS sequence (opt5) from CCHFV(4691-ST-2009, Artificial)__KR814871.1__Gn-4aa-Gc
agcgaggaacccggcgacgauugcaucuccagaacccagcugcucaagacagagacggccgaaauucacgacgauaacuacgggggaccuggcgacaaaaucaccauuuguaaugggucuacaaucguggaucaacggcugggaagcgagcuuggcugcuauaccauuaaccgcgucaaguccuucaaacugugugaaaauucugcuacagggaagaccugcgagaucgacagcacaccgguuaaauguagacagggauuuugccucaagaucacccaggagggccggggccaugugaagcugucccgcgggucugaagugguccuugaugccugugacagcuccugcgagauuaugauccccaaaggaacgggcgauauucugguggacuguagcgggggacagcaacacuuccucaaggauaaccugaucgaccugggcugcccucauauuccccuccuggggaaaauggcgaucuacauuuguagaaugucuaaucacccucggaccacaauggcuuuucuuuucugguuuuccuucggauauguuauuaccugcaucuuuugcaaggcccuguucuacagccucauuaucauuggcacacugggcaaaaagaucaagcaguaucgcgaacuuaaaccccagaccuguacgauuugcgagacagccccugugaacgcuaucgaugccgagaugcaugaccugaauuguucuuacaacaucugcccguauugugcuuccagacucaccagcgacgggcuggcccggcacgucacacagugccccaagcgcaaagaaaagguggaggaaaccgagcuguaccucaaucuggaaagaaucccuuggaucguucggaaacuucugcaagugucugaguccaccggagucgcgcucaagcgcagcuccuggcugauugugcuucuggugcuccugacagucucucugagccccguucaguccgccccugugggcagaaaaccccucuuucuggauagcaucgugaaggggaugaagaaccuucuuaauucuacgucccucgagaccagccugucuauugaagcuccguggggagccaucaacguccagagcacauucaaaccugcuguguccaccgccaauaucgcgcuuucuuggagcuccguugagcaccggggcaacaagauucuggugacagggcgcagcgaaucuaucaugaaacucgaggaaagaaccggagucuccugggaccugggcguggaggaugccagcgagucuaagcugcucacgguuuccauuauggaccugagccagauguacucccccguguuugaauaucuuucuggcgaucggcaagucgaggaauggccuaaagcuacauguaccggggacugccccgagagauguggaugcaccagcuccacaugucugcauaaggaauggccccacucucgcaauuggcggugcaacccuaccuggugcuggggcguggggacaggauguacgugcuguggcgucgaugugaaggaccucuucaccgaucauauguuuaucaaauggaagguugaguacauuaaaacagaggccaucgugugcgucgaacugaccagccaggagagacaguguucccugauugaagcugggacacgcuucaaccuuggcccggugaccaucacgcucagcgagccccggaauauccaacagaagcugccucccgagauuaucacccugcacccuaaaauugaagagggauucuuugaccucaugcacguucagaaggugcugucugccuccacagucugcaagcugcagagcuguacccauggcauccccggggaucugcaaauuuaucacaucggaaaccuccugaaaggcgacagagugaaugggcaucugauccacaagauugaaccgcauuucaacacaucuuggauguccugggacggaugcgaucuugacuacuauuguaauaugggcgauuggccuagcugcaccuacacgggggugacacagcacaaccacgccgcuuuuguuaaucuccugaacaucgagaccgacuauacaaaaaccuuccauuuucacucuaagcgcgucaccgcgcauggcgauacaccccagcuggaccucaaagcccggccuacguacggagcuggcgaaauuaccgugcugguggaggucgccgauauggagcuucacacaaagaagguggaaaucagcgggcugaaauucgccucccucgcuuguaccggaugcuacgccugcagcucuggcauuuccuguaagguuagaauccacguggacgagcccgaugaacugacaguccaugugaaaagcuccgacccugauguuguggcggcuucuaccagccugauggcccgcaaacuugaguuugggacggacuccacauucaaggccuuuucugcuaugcccaagaccagccucugcuucuauaucgucgaacgggaguacuguaaauccugcucugaggaugacaccaagaaguguguggacacaaaacuggaacagccgcaaagcauucugaucgagcacaagggaaccauuaucggcaaacagaaugauacaugcacggccaaggcuuccuguuggcucgaaagcguuaaauccuuuuucuaugggcugaagaacaugcuuggcucuguguuuggaaauuucuucgucggcauucugcucuuucuggccccuuucgugcugcuugugcucuuuuucauguuuggguggaagauccuguucugcuuuaaauguugcagacgcacccggggacuguucaaguacagacaucucaaagacgaugaggaaacaggcuaucggcgcaucauugagagacugaacagcaagaaagggaagaaucggcuucuggacggagagagacucgcggaucgcaagaucgccgaacuguuuucuaccaaaacacacauuggc

SEQ ID NO: 13912 - RNA, 2916 nt, Artificial Sequence
  derived and/or modified CDS sequence (opt5) from CCHFV(4701-ST-2009, Artificial)__KR814872.1__Gn-4aa-Gc
agcgaggaacccggcgacgauugcaucuccagaacccagcugcucaagacagagacggccgaaauucacgacgauaacuacgggggaccuggcgacaaaaucaccauuuguaaugggucuacaguggucgaucaacggcugggaagcgagcuuggcugcuauaccaucaaccgcguuaaguccuucaaacugugugaaaauucugcuacagggaagaccugcgagauugacagcacaccggugaaauguagacagggauuuugccucaagaucacccaggagggccggggccaugugaagcugucccgcgggucugaagucgugcuugaugccugugacagcuccugcgagaucaugauucccaaaggaacgggcgauauccugguugacuguagcgggggacagcaacacuuccucaaggauaaccugauugaccugggcugcccucauaucccccuccuggggaaaauggcgauuuacaucuguagaaugucuaaucacccucggaccacaauggcuuuucuuuucugguuuuccuucggauaugugauuaccugcaucuuuugcaaggcccuguucuacagccucaucauuaucggcacacugggcaaaaagauuaagcaguaucgcgaacuuaaaccccagaccuguacgaucugcgagacagccccugucaacgcuauugaugccgagaugcaugaccugaauuguucuuacaacaucugcccguauugugcuuccagacucaccagcgacgggcuggcccggcacgugacacagugccccaagcgcaaagaaaagguugaggaaaccgagcuguaccucaaucuggaaagaaucccuuggauugugcggaaacuucugcaagucucugaguccaccggaguggcgcucaagcgcagcuccuggcugaucgugcuucugguccuccugacaguuucucugagccccgugcaguccgccccugugggcagaaaaccccucuuucuggauagcauugucaaggggaugaagaaccuucuuaauucuacgucccucgagaccagccugucuaucgaagcuccguggggagccauuaacgugcagagcacauucaaaccuaccguuuccacagcuaauaucgcccuuucuuggagcuccguggagcaccggggcaacaagauccuggucaccgggcgcagcgaaucuauuaugaaacucgaggaaagaacgggaguguccugggaccugggcguugaggaugcgagcgagucuaagcugcucacaguguccaucauggaccugagccagauguacucccccgucuuugaauaucuuucuggcgaucggcaaguggaggaauggccuaaagccaccuguaccggggacugccccgagagauguggaugcacaagcuccaccugucugcauaaggaauggccccacucucgcaauuggcggugcaacccuacauggugcuggggcgucgggacgggauguaccugcuguggcguggauguuaaggaccucuucacagaucauauguuuauuaaauggaagguggaguacaucaaaaccgaggcuauugucugcguggaacugacaagccaggagagacaguguucccugaucgaagccgggacccgcuucaaccuuggcccgguuacgauuacccucagcgagccccggaauauccaacagaagcugccucccgagaucauuacacugcacccuaaaaucgaagagggauucuuugaccucaugcacgugcagaagguccugucugcuuccaccgugugcaagcugcagagcuguacacauggcauucccggggaucugcaaaucuaucacauuggaaaccuccugaaaggcgacagagugaaugggcaucugauccacaagaucgaaccgcauuucaacaccucuuggauguccugggacggaugcgaucuugacuacuauuguaauaugggcgauuggccuagcugcacguacacagggguuacccagcacaaccacgccgccuuugucaaucuccugaacauugagacagacuauaccaaaaccuuccauuuucacucuaagcgcgugacagcucauggcgauacgccccagcuggaccucaaagcgcggccuaccuacggagccggcgaaaucacagugcuggucgagguggcugauauggagcuucacaccaagaagguugaaauuagcgggcugaaauucgccucccucacauguaccggaugcuacgccugcagcucuggcaucuccuguaaggugcgcauucacgucgacgagcccgaugaacugacggugcauguuaaaagcuccgacccugauguggucgcugccucuacaagccugauggcgagaaaacuugaguuugggaccgacuccaccuucaaggcuuuuucugccaugcccaagacaagccucugcuucuauaucguggaacgggaguacuguaaauccugcucugaggaugacaccaagaaguguguugacacaaaacuggaacagccgcaaagcauccugauugagcacaagggaacgaucauuggcaaacagaaugauaccugcacagccaaggcuuccuguuggcucgaaagcgugaaauccuuuuucuaugggcugaagaacaugcuuggcucugucuuuggaggcuucuucguggggauccugcucuuucuggccccuuucgugcugcuuguccucuuuuucauguuuggauggaagauucuguucugcuuuaaauguugcagacgcacccggggccuguucaaguacagacaucucaaagacgaugaggaaacaggguaucggcgcaucaucgagagacugaauagcaagaaaggaaagaaccggcuucuggacggcgagagacucgcugaucgcaagauugccgaacuguuuucuaccaaaacgcacaucggg

SEQ ID NO: 13913 - RNA, 2916 nt, Artificial Sequence
  derived and/or modified CDS sequence (opt5) from CCHFV(5170-R-2011, Artificial)__KR814873.1__Gn-4aa-Gc
agcgaggaacccggcgacgauugcaucuccagaacccagcugcucaagacagagacggccgaaauucacgacgauaacuacgggggaccuggcgacaaaaucaccauuuguaaugggucuacaaucguggaucaacggcugggaagcgagcuuggcugcuauaccauuaaccgcgucaaguccuucaaacugugugaaaauucugcuacagggaagaccugcgagaucgacagcacaccgguuaaauguagacagggauuuugccucaagaucacccaggagggccggggccaugugaagcugucccgcgggucugaagugguccuugaugugugugacagcuccugcgagauuaugauccccaaaggaacgggcgauauucugguugacuguagcgggggacagcaacacuuccucaaggauaaccugaucgaccugggcugcccucauauuccccuccuggggaaaauggccaucuacauuuguagaaugucuaaucacccucggaccacaauggcguuucuuuucugguuuuccuucggauaugugauuaccugcaucuuuugcaaggcucuguucuacagccucauuaucauuggcacacugggcaaaaagaucaagcaguaucgcgaacuuaaaccccagaccuguacgauuugcgagacagccccugucaacgccaucgaugcugagaugcaugaccugaauuguucuuacaacaucugcccguauugugccuccagacucaccagcgaagggcuggcucggcacgugacacagugccccaagcgcaaagagaagguugaagagaccgaacuguaccucaaucuggagagaaucccuuggaucgugcggaaacuucugcaagucucugaguccaccggaguggcccucaagcgcagcuccuggcugauugugcuucugguccuccugacaguuucucugagccccgugcaguccgcgccugugggcagaaaaccccucuuucuggacagcaucgucaaggggaugaagaaccuucuuaauucuacgucccucgaaaccagccugucuauugaggccccguggggagcuaucaacgugcagagcacauucaaaccuaccguuuccacagccaauaucgcucuuucuuggagcuccguggaacaccggggcaacaagauucuggucaccgggcgcagcgagucuaucaugaaacucgaagagagaacgggaguguccugggaucugggcguugaggacgccagcgaaucuaagcugcucacaguguccauuauggaucugagccagauguacucccccgucuuugaguaucuuucuggcgaccggcaaguggaagaguggccuaaagcgaccuguaccggggauugccccgaaagauguggaugcacaagcuccaccugucugcauaaggaguggccccacucucgcaauuggcggugcaacccuacauggugcuggggcgucgggacgggauguaccugcuguggcguggacguuaaggaucucuucacagaccauauguuuaucaaauggaagguggaguacauuaaaaccgaagccaucgucugcguggagcugacaagccaggaaagacaguguucccugauugaggcugggacccgcuucaaccuuggcccgguuacgaucacccucagcgagccccggaauauccaacagaagcugccucccgaaauuaucacacugcacccuaaaauugaggaaggauucuuugaucucaugcacgugcagaagguccugucugccuccaccgugugcaagcugcagagcuguacacauggcauccccggggaccugcaaauuuaucacaucggaaaccuccugaaaggcgauagagugaaugggcaucugauccacaagauugagccgcauuucaacaccucuuggauguccugggacggaugcgaccuugauuacuauuguaauaugggcgacuggccuagcugcacguacacagggguuacccagcacaaccacgcugccuuugucaaucuccugaacaucgaaacagauuauaccaaaaccuuccauuuucacucuaagcgcgugacagcccauggcgacacgccccagcuggaucucaaagcucggccuaccuacggagcgggcgagauuacagugcuggucgagguggccgacauggaacuucacaccaagaagguugagaucagcgggcugaaauucgcuucccucacauguaccggaugcuacgccugcagcucuggcauuuccuguaaggugagaauccacgucgaugaacccgacgagcugacggugcauguuaaaagcuccgauccugacguggucgccgcuucuacaagccugauggcccgcaagcuggaauuugggaccgauuccaccuucaaagcguuuucugcuaugcccaagacaagccucugcuucuauaucguggagcgggaguacuguaaauccugcucugaagacgauaccaagaaguguguugacacaaaacuggagcagccgcaaagcauucugaucgaacacaagggaacgauuaucggcaaacagaaugauaccugcacagccaaggccuccuguuggcucgagagcgugaaaucuuucuuuuaugggcugaagaacaugcuuggcuccgucuuuggaucuuucuucgugggcauucugcucuuucuggcuccuuucgugcugcuuguccucuuuuucauguuuggguggaagauccuguucugcuuuaaauguugcagacgcacccggggacuguucaaguacagacaucucaaagacgacgaagagacaggcuaucggcgcaucauugagagacuuaauagcaagaaagggaagaaccggcuucuggauggagaaagacucgccgaccgcaagaucgcugagcuguuuuccaccaaaacgcacauuggc

SEQ ID NO: 13914 - RNA, 2916 nt, Artificial Sequence
  derived and/or modified CDS sequence (opt5) from CCHFV(Oman-199809166, Artificial)__KR864901.1__Gn-4aa-Gc
agcgaggaauccggcgaggacugcaucucuagaacccagcugcuccggacagaaacggccgagauucacggggauaacuacggaggccccggggacaagaucaccauuuguaauggaagcacaaucguggaucaacgccugggcuccgaacuugggugcuauaccauuaacagagucaaaucuuucaagcugugugagaauagcgcuacaggaaaauccugcgagaucgacaacaccccuguuaaguguaaacagggcuuuugccucaagaucacacaggaaggccgggggcaugugaagcugucucgcgauagcgaggugguccuugacgccugugauuccagcugcgaaauuaugaucccgaaaggaaccggcgacauucugguggauuguucugggggacagcaacacuuccucaaggacaaucugaucgaucugggcugccccaacauuccucuccuggggaaaauggcgaucuacauuuguagaauguccaaucaucccaagacgaccauggcuuuucuuuucugguuuagcuucggauauguuaucacaugcauccugugcaaagugaucuuuuaccuccugauugucgugggcacccuuggcaagaaguucaaacaguaucgggagcugaagccucagacauguaccauuugcgagacgacacccguuaacgccaucgacgccgaaaugcacgaucucaauuguucuuacaacauuugcccuuauugugcuucccgccugaccagcgacgggcuggccagacaugugaugcagugcccgaaacggaaggagaaaaucgaagagacagaacucuaccugaaucuugagcgcauccccugggucgugagaaagcugcuccaagugucugaguccaccggagucgcucugaaacggagcuccuggcuuauuguucugcucgugcugcugaccgugucucucagcccuguccaguccgcccccaucggccgcaagccucuguuucuugacagcauugcgaaggggaugaaaaaccugcucaauucuacaucccuggaaacgagccuuucuaucgaggcccccuggggagcuauuaacgugcagagcaccuucaagccgacaguuuccaccgccaauaucgcucugucuuggagcuccguggaacacagaggcaacaaaauccucgucagcgggcggucugaguccauuaugaagcuggaggaacgcacaggaaucagcugggaucugggcguggaggacgccucugaauccaaacuccugaccguuagcgugauggaucuuucccagauguacucuccugucuuugaguaucugagcggcgacagacaaguggaagaguggcccaaggcgacguguacaggggauugcccugaacgguguggaugcaccuccucuaccugucuccacaaggaguggccccauagcagaaacuggcgcugcaaucccacauggugcuggggcgucgggaccggauguacaugcuguggccuggacgugaaagaucuguucacggacuacauguuuguuaaguggaaaguggaguauauuaagaccgaagccaucgucugcguggagcuuacaucccaggaacggcaguguagccucauugaggcugggaccagauucaaccugggcccuguuacaaucacccugucugagccgcgcaauauucaacagaaacugcccccugaaaucgugacgcuccacccccggaucgaggaaggauucuuugaucuuaugcauguccagaaggugcuguccgccagcaccgugugcaagcuccagucuuguacacacggcguuccuggggaccugcaagucuaccacauuggaaaccugcuuaaaggcgauaaggugaaugggcaucucauccacaaaguggagccccauuucaacaccuccuggaugagcugggacggaugcgaccuggauuauuacuguaauaugggcgacuggccgucuugcacauauaccggggucacgcagcacaaccaugcugccuuugugaaucugcucaacauugaaacagauuacaccaagaauuuccacuuucacagcaaaagaguuacagcccauggcgacaccccucagcuggaucuuaaggcucgccccaacuacggagcgggcgagaucaccgugcuggucgagguggccgacauggaacuccacacaaagaaaauugagaucuccgggcugaaguucgcuagccugacguguaccggaugcuaugccuguucuuccggcaucagcugcaaaguucggauucauguggaugaaccugacgagcuuacaguccacgugaaguccgaagaucccgacaucguugccgcuucuagcucccucauggccagaaaacuggaguuugggaccgauucuacauucaaggcguuuagcgcuaugccuaaaaccucccugugcuucuacauuguggagcgcgaauauuguaagucuugcagcaaggaggacacgcagaaaugugucaaugccaagcucgaacggccccaauccauccugauugagcacaaaggaacaaucaucggcaagcagaacgauaccugcaccgccaaagcuagcuguuggcuugaaucugugaaguccuuuuucuacgggcugaagaauaugcucagcggcauuuuuggaaacguguucaucggcauuuuccuguuucuggccccguucauccuucucauucuguuuuucauguuuggguggagaauccuguucugcuuuaaauguugccgccggacaagaggacucuucaaguaucggcaucugaaagacgacgaggagaccggcuaccgcaagaucauugaaagacuuaacaauaaaaaggggaagaacaaacugcucgauggagagcggcuggcugacagaaagaucgccgaacuguuuucuacaaaaacgcacauuggc

SEQ ID NO: 13915 - RNA, 2916 nt, Artificial Sequence
  derived and/or modified CDS sequence (opt5) from CCHFV(200406546-Turkey, Artificial)__KR864902.1__Gn-4aa-Gc
agcgaggaacccggcgacgauugcaucuccagaacccagcugcuccggacagagacggccgaaauucacgacgauaacuacgggggaccuggcgacaagaucaccauuuguaaugggucuacaaucguggaucaacgccugggaagcgagcuuggcugcuauaccauuaacagagugaaauccuucaagcugugugaaaauucugcuacagggaaaaccugcgagaucgacagcacaccgguuaagugucggcagggauuuugccucaaaaucacccaggagggccgcggccaugugaagcuguccagagggucugaagugguccuugaugugugugacagcuccugcgagguuaugauucccaagggaacgggcgauauccugguggacuguagcgggggacagcaacacuuccucaaagauaaccugauugaccugggcugcccucaugucccccuccuggggcggauggccaucuacauuugucgcaugucuaaucacccuagaaccacaauggcguuucuuuucugguuuuccuucggauaugugauuaccugcaucuuuugcaaggcucuguucuacagccucaucaucauuggcacacugggcaaaaaguuuaaacaguaucgggaacuuaagccccagaccuguacgaucugcgagacagccccuguuaacgccauugaugcugagaugcaugaccugaauuguucuuacaacaucugcccguauugugccucccgccucaccagcgacgggcuggcuagacacgugccccagugcccuaagcggaaagaaaaggucgaggaaacagagcuguaccucaaucuggaacgcauucccuggaucgugagaaaacuucugcaagugucugaguccaccggagucgcccucaagcggagcuccuggcugaucguucuucuggugcuccugaccgugucucugagcccuguccaguccgcgcccgugggccgcaaaccgcuguuccuggauagcauuguuaaggggaugaaaaaccuucugaauagcacaucccucgagacgagccugucuaucgaagccccuuggggagcuauuaacgugcagagcaccuuuaagcccacagucuccaccgccaauaucgcucuuucuuggagcuccauugagcacagaggcaacaagauccuggugacagggcggagcgaaucuaucaugaaacucgaggaaagaaccggaguuuccugggaccugggcguggaggaugccagcgagucuaagcugcucacggucuccauuauggaccugagccagauguacuccccuguguucgaauaucuuucuggcgaucgccaagucgaggaauggcccaaagcgacauguaccggggacugccccgagcgguguggaugcaccagcuccacaugucugcauaaggaauggccucacucuagaaauuggcgcugcaacccgaccuggugcuggggcguggggacaggauguacgugcuguggcguugaugugaaagaccucuuuaccgaucauauguucgucaaguggaagguggaguacaucaaaacagaggccauuguuugcguggaacugaccagccaggagcggcaguguucccugaucgaagcugggacaagauucaaccuuggccccgucaccauuacgcucagcgagccucgcaauauccaacagaagcugcccccugagauuaucacccugcaccccaaaguggaagagggauuuuucgaccucaugcacgugcagaagguucugucugccuccacagucugcaaacuucagagcuguacccauggcaucccgggggaucugcaaguguaucacauuggaaaccuccugaagggcgaccgggugaaugggcaucugauccacaagauugaaccucauuuuaacacaucuuggauguccugggacggaugcgaucuugacuacuauuguaauaugggcgauuggcccagcugcaccuacacgggggucacacagcacaaccacgcugccuucgugaaucuccugaacaucgagaccgacuauacaaaaaccuuucauuuccacucuaagagaguuaccgcccauggcgauacaccucagcuggaccucaaagcucgccccacguacggagcgggcgaaauuaccgugcuggucgagguggccgauauggagcuucacacaaagaaaguugaaaucagcgggcugaaguuugcuucccucgccuguaccggaugcuacgccugcagcucuggcaucuccuguaaggugcggauucacgucgacgagccugaugaacugacagugcauguuaaaagcuccgaccccgauguggucgcugccucuaccagccugacggcgagaaaacuugaguucgggacagacuccaccuuuaaggcuuucucugccaugccgaagaccagccucugcuuuuauaucguggaaaaagaguacuguaaguccugcaaugaggaugacacacagaaauguguggacaccaagcuggaacaaccucagucuauucugaucgagcacaagggaacaauuaucggcaaacagaacgauacgugcaccgccaaggcuagcuguuggcucgaauccgucaaaucuuucuuuuaugggcugaagaauaugcuuggcucuguuuucggaaacuucuuuaucggcauucuccucuuccuggcccccuuugugcugcuuguccucuucuuuauguucggguggaaaauccuguuuugcuucaaguguugccgccggacaagaggacuguuuaaguaccggcaucucaaagacgaugaggaaaccggcuauaagcgcauuaucgagagacugaauaacaaaaaggggaaaaaucggcuucuggacggagagagacucgcugaucgcaagauugccgaacuguucuccacaaagacccacaucggc

SEQ ID NO: 13916 - RNA, 2916 nt, Artificial Sequence
  derived and/or modified CDS sequence (opt5) from CCHFV(1-CR/HU-2015, Artificial)__KU161584.1__Gn-4aa-Gc
agcgaggaacccggcgacgauugcaucuccagaacccagcugcuccggacagagacggccgaaauucacgacgauaacuacgggggaccuggcgacaagaucaccauuuguaaugggucuacaaucguggaucaacgccugggaagcgagcuuggcugcuauaccauuaacagagucaaauccuucaagcugugugaaaauucugcuacagggaaaaccugcgagaucgacagcacaccgguuaagugucggcagggauuuugccucaaaaucacccaggagggccgcggccaugugaagcuguccagagggucugaagugguccuugaugccugugacagcuccugcgaggugaugauucccaagggaacgggcgauauccugguugacuguagcgggggacagcaacacuuccucaaagauaaccugauugaccugggcugcccucauaucccccuccuggggaagauggcgauuuacaucugucggaugucuaaucacccucgcaccacaauggcuuuucuuuucugguuuuccuucggauaugugauuaccugcaucuuuugcaaagcccuguucuacagccucaucauuaucggcacacugggcaagaaaauuaagcaguauagagaacuuaagccccagaccuguacgaucugcgagacagccccugucaacgcuauugaugccgagaugcaugaccugaauuguucuuacaacaucugcccguauugugcuucccggcucaccagcgacgggcuggcccgccacgugacacagugccccaaaagaaaggaaaaaguugaggaaaccgagcuguaccucaaucuggaacggaucccuuggauugugcgcaagcugcugcaagucucugaguccaccggaguggcgcucaaaagaagcuccuggcugaucgugcuucugguccuccugacaguuucucugagccccgugcaguccgccccugugggccggaagccccucuuucuggauagcauugucaaagggaugaagaaccuucuuaauucuacgucccucgagaccagccugucuaucgaagcuccguggggagccauuaacgugcagagcacauucaagccuaccguuuccacagcuaauaucgcccuuucuuggagcuccguggagcaccgcggcaacaaaauccuggucaccgggagaagcgaaucuauuaugaagcucgaggaacggacgggaguguccugggaccugggcguugaggaugcgagcgagucuaaacugcucacaguguccaucauggaccugagccagauguacucccccgucuuugaauaucuuucuggcgauagacaaguggaggaauggccuaaggccaccuguaccggggacugccccgagcgcuguggaugcacaagcuccaccugucugcauaaagaauggccccacucucggaauuggagaugcaacccuacauggugcuggggcgucgggacgggauguaccugcuguggcguggauguuaaggaccucuucacagaucauauguuugugaaguggaaagucgaguacauuaagaccgaggcuaucgugugcguugaacugacaagccaggagcgccaguguucccugauugaagccgggacccgguucaaccuuggcccggugacgaucacccucagcgagcccagaaauauucaacagaaacugccucccgagaucaucacacugcacccuaagauugaagagggauucuuugaccucaugcacguccagaaagugcugucugcuuccaccgugugcaaacuucagagcuguacacauggcauccccggggaucugcaaguuuaucacauuggaaaccuccugaagggcgaccgcgucaaugggcaucugauccacaaaauugaaccgcauuucaacaccucuuggauguccugggacggaugcgaucuugacuacuauuguaauaugggcgauuggccuagcugcacguacacaggggugacccagcacaaccacgccgccuuugugaaucuccugaacaucgagacagacuauaccaagaccuuccauuuucacucuaaacgggucacagcucauggcgauacgccccagcuggaccucaaggcgagaccuaccuacggagccggcgaaaucacagugcugguugagguggcugauauggagcuucacaccaaaaaggucgaaauuagcgggcugaaguucgccucccucgccuguacaggaugcuacgcuugcagcucuggcaucuccuguaaagugcgcauucacguugacgagcccgaugaacugaccgugcaugucaagagcuccgacccugaugugguugccgcgucuacgagccugauggcucggaaacuugaguuugggacagacuccaccuucaaggccuuuucugccaugcccaaaaccagccucugcuucuauaucguggaaagagaguacuguaaguccugcucugaggaugacacaaagaagugugucgacaccaagcuggaacagccgcaaagcauucugaucgagcacaaaggaacaaucauuggcaagcagaaugauacgugcaccgcuaaagccuccuguuggcucgaaagcgugaaguccuuuuucuaugggcugaaaaacaugcuuggcucuguguuuggaaauuucuucaucggcauucugcucuuucuggcuccuuucguccugcuuguucucuuuuucauguuuggguggaagauccuguucugcuuuaaguguugccgccggacaagaggacuguucaaauaccggcaucucaaggacgaugaggaaaccggcuaucgcagaauuaucgagcggcugaacaauaaaaaggggaaaaacagacuucuggacggagagcgccucgccgaucggaagaucgcggaacuguuuagcacaaagacccacauuggc

SEQ ID NO: 13917 - RNA, 2916 nt, Artificial Sequence
  derived and/or modified CDS sequence (opt5) from CCHFV(Gaib, Artificial)__KX013445.1__Gn-4aa-Gc
agcgaggaauccucugacgauugcaucagcagaacccagcugcuccggacagagacggccgaaauucacaacgacaauuacggcgggcccggagauaagaucaccauuuguaacggcuccacaaucguggaccaacgccuggggucugagcuuggaugcuauaccauuaauagagucaagagcuucaaacugugugaaaacuccgcuacaggcaaaucuugcgagaucgauagcaucccuguuaagugucggcagggguuuugccucaaaauuacccaggagggacgcggccaugugaagcuguccagaggcagcgaagugguccuugacgccugugauucuuccugcgagaucaugauuccgaaggggacaggagacauccugguggauuguagcggcgggcagcaacacuuccucaaagacaaucugauugaucugggaugccccaacaucccucuccugggcaagauggcgauuuacaucugucggaugucuaaucaucccaaaaccacgauggcuuuucuuuucugguuuuccuucggguauguuaucacaugcauuuucugcaaggccaucuucuaccugcucauuaucgugggaacacugggcaaaaaguuuaagcaguaucgcgaacuuaaaccucagaccuguacaauuugcgagaccacgcccgucaacgccaucgacgcugagaugcacgaucugaauuguagcuacaacaucugcccuuauugugccucuagacucacauccgacggccuggcucggcaugugguucacugcccgaagcgcaaagaaaagauugaggaaaccgagcuguaccucaaucuggaaagagugcccugggucgugcggaaacuucuucaggugagcgaguccacaggggucgcccucaagcgcucuagcuggcugaucguucuucuggugcuccugaccgugucccugagcccuguccaaucugcgcccauuggaagaaaaccucucuucuccgacagcaucgugaagggcaugaagaaccugcuuaauucuaccagccuggagacaucccucucuauugaagcccccuggggagcuaucaacguucagagcacguuuaaaccgaccguguccacagccaauaucgcucugagcuggucuuccauugagcaccgggggaacaagauccuugucagcggccgcucugaauccauuaugaaacuggaggaaagaaccgggaucagcugggaucucggaguggaggacgccuccgagucucggcugcugacaguuagcgugauggaucucucccagauguacucuccugucuucgaauaucugagcggcgacagacagguggaggaauggcccaaggcgaccuguacgggcgauugcccugagcgcugugggugcacauccagcaccugucuucauaaagaauggccccacucucggaacuggagaugcaaucccaccuggugcuggggagucggcacaggguguaccugcuguggacuggacgugaaggaucucuuuacagacuacauguucguuaaguggaaaguggaguauauuaagacggaggccaucgucugcguggaacugaccucccaagagcgccaguguagccugauugaagcuggcacacgguucaaccuugggccuguuaccaucacacucucugagccgagaaauauccagcaaaaacugcccccugagauuaucacccugcauccccgcauugaagagggcuuuuucgaucucaugcacgugcagaagguccuguccgccagcacggugugcaaacuucagucuuguacccacggagugccuggcgaccugcagguuuaccauaucgggaaccuccugaagggagauaaggucaauggccaccugauucauaaaaucgaaccccacuuuaacacaagcuggauguccugggacgggugcgaccuugauuauuacuguaauaugggagacuggccgagcugcaccuauacaggcgugacccaacauaaccacgcugccuucgugaaucuccugaacaucgagacggauuacacaaagaauuuucacuuccauucuaaacgggucaccgcccacggggacacaccucagcuggaucucaaggcuagacccaccuacggcgcgggagaaauuaccgugcugguugagguggccgacauggagcuucauaccaaaaagaucgaaauuuccggccugaaguuugcuagccucacguguaccgggugcuaugccugcuccucuggaaucagcuguaaaguccgcauucacguggaugagccugacgaacugacaguucacgugaaguccgaggaucccgacaucgucgccgcuucuagcucccugauggcccggaaacuugaauuuggcaccgauucuacauuuaaggcguucagcgcuaugccuaaaaccucccucugcuuuuacaucguggagagagaguauuguaagagcugcucucgcgaagacacgcagaaauguguuuccacaaagcuggagcagccccaaagcauucugaucgaacauaaggggaccauuaucggaaaacagaacaauaccugcacaaccaagacaacguguuggcucgagucugugaaauccuucuuuuacggccugaagaacaugcuuagcucuauuuucgggaaugucuucgugggcaucuuuuccuuccuggccccguuuauccuccugauucuguucuuuauguucggauggcggauccuguuuugcuucaaauguugcagacggacccgcggccucuuuaaguauagacaccugaaggaugacgaagagacaggguaccggagaauuaucgagcgccugaacaacaaaaagggaaaaagcaagcuccuggacggcgaacggcuugccgauagaaaaauugcugagcuguucuccaccaagacacauaucggg

SEQ ID NO: 13918 - RNA, 2916 nt, Artificial Sequence
  derived and/or modified CDS sequence (opt5) from CCHFV(Hodzha, Artificial)__KX013448.1__Gn-4aa-Gc
agcgaggaauccggcgacgauugcaucucuagaacccagcugcuccggacagagacggccgaaauucacggggacgauuacggaggccccggggacaagaucaccauuuguaacggaagcacaaucguggaucaacgccugggcuccgagcuugggugcuauaccauuaauagagucaaaucuuucaagcugugugaaaacagcgcuacaggaaaauccugcgagaucgacucuaccccuguuaagugucggcagggcuacugccucaaaaucacacaggagggccgcgggcaugugaagcugagcagaggauccgaagugguccuugaugccugugacagcucuugcgaggugaugauuccgaagggcaccggggauauccugguugacuguuccggaggccagcaacacuuucucaaagauaaucugauugaccuggggugcccccggaucccucuccugggaaagauggcgauuuauaucugucgcaugagcaaccaucccgaaacgaccauggcuuuccuguuuugguucucuuuuggcuacgugauuacaugcauccuuugcaaagccaucuucuaucuccugauuaucgucggcacccuugggaagagauuuaaacaguaccgggagcugaagccucagacauguaccauuugcgagacgacacccgccaaugcuaucgaugccgaaaugcacgaccucaacuguuccuauaauauuugcccuuacugugcuagccgccugaccucugacggacuggccagacaugugacacagugcccgaagcggaaagagaagguugaagagaccgaacucuaccugaaccuugagcgcauccccuggaucgugagaaaacugcuccaagucuccgagagcaccggcguggcgcugaagcgguccucuuggcuuauugugcugcucguccuguucgccguuagccuguccccugugcagagcgcucccaucgggcgcagaccucucuuucuggauucuauugugaaaggaaagaaaaaucuucugaacuccacaagccucgaaacgucucugagcaucgaggcccccuggggcgcuauuaauguccaguccaccuauaagccgacagugucuaccgccaacaucgcgcuuagcugguccagcguugaacaccgggggaauaagauccuggugucuggaagauccgagagcauuaugaaacucgaagagagaacaggcaucucuugggaccugggcgucgaggaugccuccgaaagcaagcugcucaccguguccguuauggaccugucucagauguacagcccuguguucgaguaucuuuccggggaucggcaagucgaagaguggcccaaagcuacguguacaggagacugcucugaaagauguggcugcaccagcuccaccugucugcacaaggaguggccucauagccgcaacuggcggugcaaucccacauggugcuggggaguggggaccggcuguacaugcugugggcucgaugucaaagaccuguuuacggauuacauguucgugaaguggaagguugacuauauuaaaaccgaggccaucgugugcgucgaacugacaucucaggagagacaguguucccuuguggaagcuggcacccgcuuuaaccucggacccguuacaauuacccugagcgagccucggaacauccaacagaagcugccgcccgagauuaucacgcuccacccuagaaucgaagagggcuucuucgaucugaugcaugugcagaaaguccuuucugccuccaccgugugcaagcugcagagcuguacacacggggugcccggagaccuccaaguuuaccacauuggcaaucugcugaaaggggacaaggucaacggacaucuuauccacaagauugaaccucauuuuaauaccucuuggaugagcugggauggcugcgaccucgauuauuacuguaacaugggggacuggcccuccugcacauacaccggcgugacgcagcacaaucaugccagcuucgugaaccugcugaauaucgagacagauuauaccaaaucuuuucacuuccacuccaagcgcgucacagcucauggagacaccccgcagcucgaucugaaagcgcggccuaccuacggcgccggggaaauuacagugcuuguugagguggcugacauggagcugcacacgaagaaaaucgaaaucaccggacucaaguuugccagccugacauguaccggcugcuaugccugcuccucugggauuagcuguaaggucagaauccauguggaugagcccgacgaacugacaguucacgugaaauccgaugacccugaugucguggcugccucuagcucccuuauggcgcgcaagcucgaguucggaaccgacucuacguuuaaggcuuucagcgccaugcccaaaacaucccugugcuuuuacauuguugaacgggaguauuguaaaagcugcucuaaggaggacacccagaaaugugugaacaccaagcuggaacaaccucaguccauccucauugagcagaagggcacaaucaucgggaaacagaauaauaccugcacagccaaggcuagcuguuggcuggaaucugucaaauccuucuuuuacggccuuaagaacaugcugagcggaauuuucggcaacguguuuguggggaucuuccucuuccuggcccccuuuauucugcuuauccucuucuuuauguucggauggcgcauucuguuuugcuucaaauguugccggcgcacgagaggccuguuuaaguauaagcaccucaaagaugacgaggaaaccggguaccggagaaucaucgagcgccugaauaacaagaaaggaaagaauaaacuucuggauggcgagcggcucgcugacagacgcauugccgaacuguucucuacaaagacccauaucggg

SEQ ID NO: 13919 - RNA, 2916 nt, Artificial Sequence
  derived and/or modified CDS sequence (opt5) from CCHFV(IbAn7620, Artificial)__KX013451.1__Gn-4aa-Gc
agcgaggaacccuccgacgauugcaucucuagaacccagcugcuccggacagagacggccgaaauucacggcgacaacuacgggggaccuggcgauaagaucaccauuuguaaugggagcacaaucguggaccaacgccugggauccgagcuuggcugcuauaccauuaacagagucaaaucuuucaagcugugugaaaauagcgcuacagggaaaaacugcgagaucgauuccguuccggugaagugucggcagggauacugccuccgcaucacccaggagggcagaggccaugugaaacugucucgggggagcgaaauuguccuugacgccugugauacauccugcgagaucaugauucccaagggaaccggcgacauccugguggauuguagcgggggacagcaacacuuucucaaggacaaucugauugaucugggcugcccuaaaaucccccuccuggggaagauggcgauuuauaucugucgcaugucuaaccauccuaaaacgaccauggcuuuccuguuuugguucuccuuuggauacguuaucacaugcauucuuugcaaggccaucuucuaucuccugauuaucauuggcacccuuggcaaaagacugaagcaguaccgggaacucaagccccagacauguaccaucugcgagacgacaccugugaaugccaucgacgcugagaugcacgaucugaacuguagcuauaauauuugcccguacugugccucucgccugaccuccgacgggcucgcuagacaugucauccagugccccaaacggaaggaaaaaguggaggaaacagagcuguaccuuaaccuggaacgcauuccuuggguugugagaaagcuccugcaagucagcgagucuaccggaguggcccuuaaacgguccagcuggcugaucgugcuccugguccuguuuaccguuucccucucucccgugcagagcgcgccuauuggccgcaagccccuguuccuugacuccaucgccaaagggaugaagaauccgcugaacagcacaucucucgagacgucccugagcaucgaagcuccuuggggagccauugaugugcagucuaccuauaagcccacagucagcaccgcuaauaucgcccuuuccuggucuagcguggagcacagaggcaacaaaauucugguuuccgggcggagcgaaucuaucaugaagcucgaggaaagaacaggaauuuccugggaccugggcguggaggaugcgagcgagucuaaacugcucaccgucuccgugauggaccugagccagauguacuccccuguuuuugaauaucuuucuggcgaucgccaaguggaggaauggcccaaggccacguguacaggggacugccccgagcgguguggaugcaccagcuccaccugucugcacaaagaauggccucauucuagaaauuggcgcugcaacccgacauggugcuggggcgucgggaccggauguacaugcuguggccucgaugugaaggaccuguucacggauuacauguuugucaaguggaaaguggaguauaucaagaccgaggcuauuguuugcguggaacugacaagccaggagcggcaguguucccuuaucgaagccgggaccagauucaaccucggccccgucacaaucacccugagcgagccucgcaauauucaacagaaacugcccccugagaucauuacgcuccacccccggaucgaagagggauuuuucgaccugaugcaugugcagaagguucuuucugcuuccaccgugugcaaacugcagagcuguacacacggcgucccgggggaucuccaaguguaccacauuggaaaccugcugaagggcgacaaggugaaugggcaucuuauccacaaaaucgaaccucauuucaacaccucuuggauguccugggacggaugcgaucucgacuauuacuguaauaugggcgauuggcccagcugcacauacaccgggguuacgcagcacaaccaugccucuuuugucaaucugcugaacauugagacagacuauaccaagaauuuccacuuucacagcaaaagagugacagcccauggcgauaccccucagcucgaccugaaggcucgccccaccuacggagcgggcgaaaucacagugcuugucgagguggccaacauggagcugcacacgaaaaagauugaaaucuccgggcucaaguucgcuagccugaccuguacaggaugcuaugccuguucuuccggcauuagcugcaaaguucggauccauguggaugagccugacgaacugaccguccacgugaaguccgaugaccccgauguuguggccgcuucuagcucccuuauggccagaaaacucgaguuugggacagacucuaccuucaaggcguuuagcgcuaugccgaaaacgucccugugcuucuacaucgucgaacgcgagcacuguaagucuugcagcgaggaagauaccaaaaagugugugaauacaaagcuggagcagccucaauccauucucaucgaacauaaaggaaccauuaucggcaagcagaacagcacaugcaccgccaaagccucuuguuggcuggaguccguuaagagcuuuuucuaugggcuuaaaaauaugcugucuggcauuuuuggaaacguguucaugggcaucuuucucuuccuggcucccuucauccugcuuauucucuuuuucauguuuggguggcggauccuguucugcuuuaaguguugcagacggacacgcggacuguucaaguacagacaccucaaagacgacgaagagacgggcuaucggagaauuaucgagcgccugaauaacaagaaagggaagaacaaacuucuggauggagaacggcucgccgacagacgcauugcugagcuguuuuccaccaagacacauaucggc

SEQ ID NO: 13920 - RNA, 2916 nt, Artificial Sequence
  derived and/or modified CDS sequence (opt5) from CCHFV(K128_76, Artificial)__KX013454.1__Gn-4aa-Gc
agcgacgaguccggcgaugacugcaucucuagaacccagcugcuccggacagaaacggccgagauucacggggauaacuacggaggccccggggacaagaucaccauuuguaauggaagcacaaucguggaucaacgccugggcuccgaacuugggugcuauaccauuaacagagucaaaucuuucaagcugugugagaauagcgcuacaggaaaauccugcgaaaucgacucuaucccuguuaagugucggcagggcuacugccucaaaauuacccaggagggccgcgggcaugugaagcugagcagaggauccgaggugguccuugaugccugugacagcucuugcgaagugaugaucccgaagggcacaggggauauucugguugacuguuccggaggccagcaacacuuucucaaagauaaccugaucgaccuggggugccccaagauuccucuccugggaaaaauggcgaucuauauuugucggaugagcaaucaucccaagaccacgauggcuuuccucuuuugguucucuuuuggcuacgugauuaccugcaucgucugcaaagccauuuucuaucugcucaucauugugggcacacuggggaagcgcuuuaagcaguacagagagcuuaaaccucagaccuguacaaucugcgaaaccacgcccacaaacgccauugaugcugagaugcacgaccugaauuguuccuauaacaucugcccuuacugugccagccggcucaccucugacggacuggcucgccauguuacacacugcccgaagagaaaagagaagguggaagagaccgaacuguaccucaaucuggagcggauccccugggucgugcgcaaacuucuucagguguccgaaagcaccggcgucgcccucaagagauccucuuggcugauuguucuucugguccucuucgcggugagccuguccccugugcaaagcgcccccaucucucggcgcccucuguuucaggauuccauugugaaagggaugaagaaccuccugaauagcacaucucuugagacgagccuguccaucgaggcucccuggggagccauuaacguucagucuaccuauaagccggcugugagcgccgcgaauaucgcccucuccuggagcucugucgaacacagaggcuccaaaauccuggugagcgggcggucugaguccauuaugaagcuggaagagagaacaggaaucagcugggaccugggcguugaagaugcuuccgagucuaaacuccugaccgugagcgucauggaccugucccagauguacucuccuguguucgaguaucucagcggcgaucgccaagucgaagaguggcccaaggccacauguaccggggacugcccugaacgguguggaugcacguccagcacaugucugcauaaagaguggccccacucuagaaacuggcgcugcaaucccaccuggugcuggggcguggggaccggauguacaugcuguggccuugauguuaaggaccuguuuaccgauuacauguucgugaaguggaaagucgaauauauuaagacagaggcuaucgugugcguugagcucacgucccaggaacggcaguguagccugauugaggccgggaccagauuuaaccugggcccugugacaaucacccuuucugaaccgcgcaacauucaacagaaacuucccccugagaucaucacacugcauccccggauugaggaaggauucuucgaccugaugcacguccagaaggugcucuccgccagcaccgugugcaaacugcagucuuguacgcacggcguuccuggggaucuucaagucuaccauaucggaaaucugcucaagggcgacagagugaacgggcaccugauucauaagaucgagccccacuuuaauaccagcuggauguccugggacggaugcgaucuggacuauuacuguaacaugggcgauuggccgagcugcacauacaccggggugacacagcauaaucacgcuucuuucgucaaccuucucaauauugaaaccgacuauacgaaauccuuucacuuccauagcaagcgcgugacagcgcacggcgauaccccucagcuggaccugaaagcccggcccaacuacggagcuggcgagaucacaguucucguggaagucgccgauauggagcugcauaccaagaaaaucgagauuuccgggcuuaaguuugccucucugaccuguacaggaugcuaugcuugcagcuccggcaucucuuguaaggugagaauccacguugacgaaccugaugagcucacggugcacgucaaaagcgacgaucccgacgugguugccgcguccucuagccugauggcucgcaagcuggaauuugggaccgauuccacauuuaaagccuucagcgccaugccuaagaccucucuuugcuuuuacaucguggagcgggaauauuguaaauccugcagcaaggaggacacacagaaaugugucaauaccaagcucgagcaaccccagucuauucugaucgaacauaagggaacgaucauuggcaaacagaacaauacaugcaccgcuaagaccuccuguuggcuggagagcgugaaaucuuucuuuuacgggcucaagaacaugcuguccggcaucuucggaaauguguuugucggcauuuuccuuuuccuggccccguuuauccuccugauucuguucuuuauguucggguggagaauccuuuucugcuucaaauguugccggcgcacaagaggacucuuucgguauaagcaccuggaaaacgacgaggaaaccggcuacagacgcaucauugagcggcugaauaacaagaaagggaagaacaaacuccuggauggagagagacuugcugaccgcagaaucgccgaacuguucagcacaaagacgcauauuggc

SEQ ID NO: 13921 - RNA, 2916 nt, Artificial Sequence
  derived and/or modified CDS sequence (opt5) from CCHFV(K168_40, Artificial)__KX013457.1__Gn-4aa-Gc
agcgacgaguccggcgaugacugcaucucuagaacccagcugcuccggacagaaacggccgagauucacggggauaacuacggaggccccggggacaagaucaccauuuguaauggaagcacaaucguggaucaacgccugggcuccgaacuugggugcuauaccauuaacagagucaaaucuuucaagcugugugagaauagcgcuacaggaaaauccugcgaaguugacucuaucccugugaagugucggcagggcuacugccucaaaaucacccaggagggccgcgggcaugugaagcugagcagaggauccgaggucgugcuugaugccugugacagcucuugcgaaguuaugauuccgaagggcacaggggauauccugguggacuguuccggaggccagcaacacuuucucaaagauaaccugauugaccuggggugccccaagaucccucuccugggaaaaauggcgauuuauaucugucggaugagcaaucaucccaagaccacgauggcuuuccuuuucugguucucuuuuggcuacgucauuaccugcaucgugugcaaagccaucuucuaucugcucauuaucguuggcacacuggggaagcgcuuuaagcaguacagagagcuuaaaccucagaccuguacaauuugcgaaaccacgcccacaaacgccaucgaugcugagaugcacgaccugaauuguuccuauaacauuugcccuuacugugccagccggcucaccucugacggacuggcucgccaugugacacacugcccgaagagaaaagagaaggucgaagagaccgaacuguaccucaaucuggagcggauccccuggguggugcgcaaacuucugcaggucuccgaaagcaccggcguugcccucaagagauccucuuggcugaucgugcuucuggugcuguucgcggucagccuguccccugugcaaagcgcccccauugggcggcgcccucuguuucucgauggaaucguuaaaggcaugaagaaccugcuuaauucuacaucccuggagacgagccucucuauugaggcucccuggggagccaucaacgugcagagcaccuauaagccgacagucuccgcugccaauauugcgcugucuuggagcuccguggaacacagagggaacaaaauccuuguuagcggccggucugaguccaucaugaagcuggaagagagaaccggcauuagcugggaccucgggguggaagaugccucugaguccaaacugcugacagucagcgugauggaccucucccagauguacucuccugucuucgaguaucugagcggagaucgccagguggaagaguggcccaaggcuaccuguacgggcgacugcccugaacggugugggugcacauccucuaccugucuucauaaagaguggccccacagcagaaauuggcgcugcaaccccaccuggugcuggggaguuggcacaggguguaccugcuguggccuggaugugaaggaccucuuuacagauuacauguucgucaaguggaaaguggaauauaucaagacggaggccauuguuugcguggagcugaccucccaagaacggcaguguagccugaucgaggcuggaacaagauuuaaccuuggcccugucaccauuacacucucugaaccgcgcaauauccagcaaaaacugcccccugagauuaucacccugcauccccggaucgaggaaggguucuucgaccucaugcacgugcagaaggugcuguccgccagcacgguuugcaaacuucagucuuguacccacggagucccuggcgaucuccagguguaccauauugggaaccuccugaagggagacaaggugaauggccaccugauccauaaaauugagccccacuuuaacacauccuggaugagcugggacgggugcgaucuugacuauuacuguaauaugggcgauuggccgucuugcaccuacacaggagucacccaacauaaccacgccagcuucaucaaucuccugaacauugaaacggacuauacaaaguccuuucacuuccauagcaaaagagugaccgcucacggcgauacaccucagcuggaccucaaggcgcgccccaauuacggggccggagagaucaccguucugguggaagucgcugauauggagcuucauaccaaaaagaucgagauuucuggccugaaguuugccucccucacauguacggggugcuaugccugcagcuccggaaucucuuguaaagugcggauucacguugacgaaccugaugagcugaccgugcacgucaagagcgacgaucccgacgugguugcugccuccucuagccugauggcgagaaaacuugaauuuggcacagauuccaccuuuaaggcuuucucugccaugccuaaaacaagccucugcuuuuacaucguggagcgcgaauauuguaaguccugcagcaaagaggacacccagaagugugucaacacgaagcuggagcauccccagucuauucugaucgaacacaaagggacaaucauuggcaagcaaaauaauaccugcaccgccaaaacauccuguuggcucgagagcgugaagucuuucuuuuacggacugaaaaacaugcuuuccggcaucuucgggaacguguuugucggaauuuuccuguuccucgcuccguuuauccugcugauucuuuucuuuauguucggcuggcggauccucuuuugcuucaaguguugcagacggacccgcgggcuguuuagauauaagcaucuggaagacgaugaggaaacaggauaccggagaaucauugagcgccucaauaacaaaaagggcaaaaacaagcugcuugacggggagcggcuggccgauagacgcaucgcugaacucuucagcacgaaaacccacauuggc

SEQ ID NO: 13922 - RNA, 2916 nt, Artificial Sequence
  derived and/or modified CDS sequence (opt5) from CCHFV(K168_125, Artificial)__KX013460.1__Gn-4aa-Gc
agcgacgaguccggcgaugacugcaucucuagaacccagcugcuccggacagaaacggccgagauucacggggauaacuacggaggccccggggacaagaucaccauuuguaauggaagcacaaucguggaucaacgccugggcuccgaacuugggugcuauaccauuaacagagucaaaucuuucaagcugugugagaauagcgcuacaggaaaauccugcgaaguugacucuaucccugugaagugucggcagggcuacugccucaaaaucacccaggagggccgcgggcaugugaagcugagcagaggauccgaggucgugcuugaugccugugacagcucuugcgaaguuaugauuccgaagggcacaggggauauccugguggacuguuccggaggccagcaacacuuucucaaagauaaccugauugaccuggggugccccaaggucccucuccugggaaaaauggcgaucuauauuugucggaugagcaaucaucccaagaccacgauggcuuuccuguuuugguucucuuuuggcuacgugauuaccugcaucguuugcaaagccaucuucuaucugcucaucauugugggcacacuggggaagcgcuuuaagcaguacagagagcuuaaaccucagaccuguacaaucugcgaaaccacgcccacaaacgccauugaugcugagaugcacgaccugaauuguuccuauaacaucugcccuuacugugccagccggcucaccucugacggacuggcucgccaugucacacacugcccgaagagaaaagagaagguggaagagaccgaacuguaccucaaucuggagcggauucccugggugguccgcaaacuucugcagguuuccgaaagcaccggcguggcccucaagagauccucuuggcugaucgugcuucugguccucuucgcggugagccuguccccuguucaaagcgcccccaucgggcggcgcccucuguuucucgauucuauugugaaaggaaagaagaaccugcuuaauuccacaagccuggagacgucucucagcaucgaggcucccuggggcgccauuaacguccaguccaccuauaaaccgacagugucugcugccaauaucgcgcugagcugguccagcguugaacacagagggaacaagauucuugugucuggacgguccgagagcaucaugaaacuggaagagagaaccggcaucucuugggaccucggcgucgaagaugccuccgagagcaagcugcugacaguguccgucauggaccucucucagauguacagcccuguguucgaguaucuguccggggaucgccagguugaagaguggcccaaagcuaccuguacgggagacugcccugaacgguguggcugcacaucuagcaccugucuucauaaggaguggccccacuccagaaauuggcgcugcaaccccaccuggugcuggggaguggggacaggcuguaccugcugugggcuggaugucaaggaccucuuuacagauuacauguucgugaaauggaagguugaauauauuaaaacggaggccaucgugugcgucgagcugaccagccaagaacggcaguguucucugauugaggcuggcacaagauuuaaccuuggaccugugaccaucacacucuccgaaccgcgcaauauucagcaaaagcugcccccugagaucauuacccugcauccccggaucgaggaaggcuucuucgaccucaugcacgugcagaaaguucugagcgccucuacggucugcaaacuucaguccuguacccacggggugccuggagaucuucagguguaccauaucggcaaccuccugaagggggacaaagucaauggacaccugauucauaagaucgagccccacuuuaacacaagcuggaugucuugggacggcugcgaucuugacuauuacuguaauaugggggauuggccgagcugcaccuacacaggcgugacccaacauaaccacgccuccuucauuaaucuccugaacaucgaaacggacuauacaaagagcuuucacuuccauucuaagagaguuaccgcucacggagauacaccucagcuggaccucaaagcgcgccccaauuacggcgccggggagauuaccgugcuggucgaaguggcugauauggagcuucauaccaagaagaucgagaucuccggacugaaauuugccagccucacauguacgggcugcuaugccugcuccucugggauuagcuguaagguucggauccacguggacgaaccugaugagcugaccguccacgugaaauccgacgaucccgacguuguggcugccucuagcucccugauggcgagaaaacuugaguucggaacagauucuaccuuuaaggcuuucagcgccaugccuaagacaucccucugcuuuuacauugucgaacgcgaauauuguaaaagcugcucuaaggaggacacccagaagugugugaacacgaaacuggagcauccccaguccauccugauugaacacaagggcacaaucaucgggaaacaaaauaauaccugcaccgccaagacaagcuguuggcucgagucugugaaauccuucuuuuacggccugaagaacaugcuuagcggaauuuucggcaacgucuuuguugggaucuuccuguuccucgcuccguuuauucugcugauccuuuucuuuauguucggauggcggauucucuuuugcuucaaguguugcagacggacccgcggccuguuuagauauaaacaucuggaagacgaugaggaaacaggguaccggagaaucaucgagcgccucaauaacaagaaaggaaagaacaaacugcuugacggcgagcggcuggccgauagacgcauugcugaacucuucucuacgaagacccacaucggg

SEQ ID NO: 13923 - RNA, 2916 nt, Artificial Sequence
  derived and/or modified CDS sequence (opt5) from CCHFV(K229_194, Artificial)__KX013463.1__Gn-4aa-Gc
agcgaggaacccggcgacgauugcaucuccagaacccagcugcucaagacagagacggccgaaauucacgacgauaacuacgggggaccuggcgacaaaaucaccauuuguaaugggucuacaaucguggaucaacggcugggaagcgagcuuggcugcuauaccauuaaccgcgucaaguccuucaaacugugugaaaauucugcuacagggaagaccugcgagaucgacagcacaccgguuaaauguagacagggauuuugccucaagaucacccaggagggccggggccaugugaagcugucccgcgggucugaagugguccuugaugccugugacagcuccugcgagauuaugauccccaaaggaacgggcgauauucugguggacuguagcgggggacagcaacacuuccucaagggcaaccugaucgaucuggggugcccucauauuccccuccugggaaaaauggcgaucuacauuuguagaaugucuaaucacccucggaccacaauggcuuuucuuuucugguuuuccuucggcuauguuauuaccugcaucuuuugcaaggcccuguucuacagccucauuaucauuggcacacuggggaaaaagaucaagcaguaucgcgaacuuaaaccccagaccuguacgauuugcgagacagccccugugaacgcuaucgacgccgagaugcaugaucugaauuguucuuacaacaucugcccguauugugcuuccagacucaccagcgacggacuggcccggcacgucacacagugccccaagcgcaaagaaaagguggaggaaaccgagcuguaccucaaucuggaaagaaucccuuggaucguucggaaacuucugcaagugucugaguccaccggcgucgcgcucaagcgcagcuccuggcugauugugcuucuggugcuccugacagucucucugagccccguucaguccgccccuguggggagaaaaccccucuuucuggacagcaucgugaagggaaagaaaaaccuucucaauucuacgucccuggagaccagccugucuauugaagcuccguggggcgccaucaacguccagagcacauucaagccuaccguguccacagcuaauaucgcccuuucuuggagcuccguugagcaccgggggaacaaaauucuggugaccggacgcagcgaaucuaucaugaagcucgaggaaagaacgggcgucuccugggaucugggcguggaggacgcgagcgagucuaaacugcucacaguuuccauuauggaucugagccagauguacucccccguguuugaauaucuuucuggggaccggcaagucgaggaauggccuaaggccaccuguaccggagauugccccgagagauguggcugcacaagcuccaccugucugcauaaggaauggccccacucucgcaauuggcggugcaacccuacauggugcuggggagugggaacgggcuguaccugcuguggggucgacgugaaagaucucuucacagaccauauguuuaucaaguggaaaguugaguacauuaagaccgaggcuaucgugugcgucgaacugacaagccaggagagacaguguucccugauugaagccggcacccgcuucaaccuuggaccggugacgaucacccucagcgagccccggaauauccaacagaaacugccucccgagauuaucacacugcacccuaagauugaagagggcuucuuugaucucaugcacguucagaaggugcugucugcuuccaccgucugcaaacuucagagcuguacacaugggauccccggagaccugcaaauuuaucacaucggcaaccuccugaagggggauagacugaauggacaucuuauccacaaaauugaaccgcauuucaacaccucuuggauguccugggacggcugcgaccucgauuacuauuguaauaugggggacuggccuagcugcacguacacaggcgugacccagcacaaccacgccgccuuugugaaucugcugaacaucgagacagauuauaccaagaccuuccauuuucacucuaaacgcguuacagcucauggagacacgccccagcucgaucugaaggcgcggccuaccuacggcgccggggaaauuacaguccuuguggagguggcugacauggagcugcacaccaagaaagucgaaaucagcggacucaaguucgccucccuggccuguacaggcugcuacagcuguucuuccgggauuagcugcaaagugagaauccacguugaugagcccgacgaacugaccgugcaugucaaguccucugauccugacgugguugcugccagcacgucccuuauggcgcgcaaacucgaguuuggaacagauucuaccuucaaggcuuuuagcgccaugcccaaaaccucccugugcuucuauaucguggaacgggaguacuguaagucuugcagcgaggacgauacaaagaaaugugucgacaccaagcuggaacagccgcaauccauucucaucgagcacaaaggcacaauuaucgggaagcagaaugacacgugcaccgccaaagcuagcuguuggcuggaaucugugaaguccuuuuucuauggccuuaagaacaugcugggaagcguuuuuggcaauuucuucguggggauucuccuguuucuggccccuuucguccuucucgugcuguuuuucauguuuggauggaaaauccuguucugcuuuaaguguugcagacgcacacggggccucuucaaauacagacaucugaaggaugacgaggaaaccggguaucggaaaaucauugagcgccuuaacucuaagaaggggaaaaauagacugcucgauggcgagcggcuggcugacagaaagaucgccgaacuguuuuccacaaaaacccacauuggg

SEQ ID NO: 13924 - RNA, 2916 nt, Artificial Sequence
  derived and/or modified CDS sequence (opt5) from CCHFV(K229_243, Artificial)__KX013466.1__Gn-4aa-Gc
agcgaggaacccggcgacgauugcaucuccagaacccagcugcuccggacagagacggccgaaauucacgacgauaacuacgggggaccuggcgacaagaucaccauuuguaaugggucuacaaucguggaucaacgccugggaagcgagcuuggcugcuauaccauuaacagagucaaauccuucaagcugugugaaaauucugcuacagggaaaaccugcgagaucgacagcacaccgguuaagugucggcagggauuuugccucaaaaucacccaggagggccgcggccaugugaagcuguccagagggucugaagugguccuugaugccugugacagcuccugcgaggugaugauucccaagggaacgggcgauauccugguugacuguagcgggggacagcaacacuuccucaaagauaaccugauugaccugggcugcccucauaucccccuccuggggaagauggcgauuuacaucugucggaugucuaaucacccucgcaccacaauggcuuuucuuuucugguuuuccuucggauaugugauuaccugcaucuuuugcaaagcccuguucuacagccucaucauuaucggcacacugggcaagaaaauuaagcaguauagagaacuuaagccccagaccuguacgaucugcgagacagccccugucaacgcuauugaugccgagaugcaugaccugaauuguucuuacaacaucugcccguauugugcuucccggcucaccagcgacgggcuggcccgccacgugccccagugcccuaaaagaaaggaaaaaguugaggaaacagagcuguaccucaaucuggaacggauccccuggauugugcgcaagcugcugcaagucucugaguccaccggaguggcgcucaaaagaagcuccuggcugaucgugcuucugguccuccugaccguuucucugagcccugugcaguccgcccccgugggccggaagccgcucuuucuggauagcauugucaaagggaugaagaaccuucuuaauucuacaucccucgagacgagccugucuaucgaagcuccuuggggagccauuaacgugcagagcaccuucaagcccacaguuuccaccgcuaauaucgcccuuucuuggagcuccguggagcaccgcggcaacaaaauccuggucacagggagaagcgaaucuauuaugaagcucgaggaacggaccggaguguccugggaccugggcguugaggaugcgagcgagucuaaacugcucacgguguccaucauggaccugagccagauguacuccccugucuuugaauaucuuucuggcgauagacaaguggaggaauggcccaaggccacauguaccggggacugccccgagcgcuguggaugcaccagcuccacaugucugcauaaagaauggccucacucucggaauuggagaugcaacccgaccuggugcuggggcgucgggacaggauguacgugcuguggcguggauguuaaggaccucuucaccgaucauauguuugugaaguggaaagucgaguacauuaagacagaggcuaucgugugcguugaacugaccagccaggagcgccaguguucccugauugaagccgggacacgguucaaccuuggccccgugaccaucacgcucagcgagccuagaaauauucaacagaaacugcccccugagaucaucacccugcaccccaaggucgaagagggauucuuugaccucaugcacgugcagaaagugcugucugcuuccacaguuugcaaacuucagagcuguacccauggcauuccgggggaucugcaagucuaucacaucggaaaccuccugaagggcgaccgcgugaaugggcaucugauucacaaaaucgaaccucauuucaacacaucuuggauguccugggacggaugcgaucuugacuacuauuguaauaugggcgauuggcccagcugcaccuacacgggggugacacagcacaaccacgccgccuuugucaaucuccugaacauugagaccgacuauacaaagaccuuccauuuucacucuaaacgggugaccgcucauggcgauacaccucagcuggaccucaaggcgagacccacguacggagccggcgaaaucaccguucugguggaggucgcugauauggagcuucacacaaagaagguggaaaucagcgggcugaaguucgccucccucgccuguaccggaugcuacgcuugcagcucuggcauuuccuguaaaguucgcauccacguggacgagccugaugaacugacaguccauguuaagagcuccgaccccgaugugguggccgcgucuaccagccugauggcucggaaacuugaguuugggacggacuccacauucaaggccuuuucugccaugccgaaaaccagccucugcuucuauauugucgaaaaggaguacuguaaauccugcucugaggaagauacccagaaguguguggacacaaagcuggagcaaccucagagcauccugauugaacacaaaggaaccaucaucggcaagcagaaugacacaugcacggcuaaagccuccuguuggcucgagagcgugaaguccuuuuucuaugggcugaaaaacaugcuuggcucugucuuuggaaauuucuucauuggcauccugcucuuucugacccccuucguucugcuugugcucuuuuucauguuuggguggaagauucuguucugcuuuaaguguugcagacgcacacggggacugcucaaauacagacaucugaaggaugacgaagagaccggcuaucggcgcaucauugagagacuuaacaauaaaaaggggaaaaaccggcugcucgauggagaaagacuggcugaccgcaagaucgccgagcuguucagcacaaagacccacaucggc

SEQ ID NO: 13925 - RNA, 2916 nt, Artificial Sequence
  derived and/or modified CDS sequence (opt5) from CCHFV(K315_14, Artificial)__KX013469.1__Gn-4aa-Gc
agcgaggaacccggcgacgauugcaucuccagaacccagcugcucaagacagagacggccgaaauucacgacgauaacuacgggggaccuggcgacaaaaucaccauuuguaaugggucuacaguggucgaucaacggcugggaagcgagcuuggcugcuauaccaucaaccgcguuaaguccuucaaacuguguaaaaauucugcuacagggaagaccugcgaaauugacagcacaccggugaaguguagacagggauuuugccucaagaucacccaggagggccggggccaugugaaacugucccgcgggucugaggucgugcuugauguuugugacagcuccugcgaaaucaugauucccaagggaacgggcgauauccugguggacuguagcgggggacagcaacacuuccucaaagauaaccugauugaccugggcugcccucauaucccccuccuggggaagauggccauuuacaucuguagaaugucuaaucacccucggaccacaauggcguuucuuuucugguuuuccuucggauaugucauuaccugcaucuuuugcaaagcucuguucuacagccucaucauuaucggcacacugggcaagaagauuaaacaguaucgcgagcuuaagccccagaccuguacgaucugcgaaacagccccugugaacgccauugaugcugagaugcaugaccugaauuguucuuacaacaucugcccguauugugccuccagacucaccagcgaggggcuggcucggcacguuacacagugccccaaacgcaaggaaaaaguggaggaaaccgagcuguaccucaaucuggaaagaaucccuuggauuguccggaaacuucugcaagugucugaguccaccggaguggcccucaagcgcagcuccuggcugaucguccuucugguucuccugacagugucucugagccccgugcaguccgcgccugucggcagaaagccccucuuucuggacagcauugugaaggggaugaaaaagcugcuuaacucuacgucccucgagaccagccugucuaucgaagccccguggggagcuauuaauguucagagcacauucaaaccuaccguguccacagccaacaucgcucuuucuuggagcuccgucgagcaccggggcaauaagauccuggugaccgggcgcagcgaaucuauuaugaaacucgaggaaagaacgggaguuuccugggaucugggcguggaggacgccagcgagucuaagcugcucacagucuccaucauggaucugagccagauguacucccccguguuugaauaucuuucuggcgaccggcaagucgaggaauggccuaaggcgaccuguaccggggauugccccgagagauguggaugcacaagcuccaccugucugcauaaagaauggccccacucucgcaacuggcggugcaauccuacauggugcuggggcguggggacgggauguaccugcuguggcguugacgugaaggaucucuucacagaccauauguuuauuaaauggaaggucgaguacaucaaaaccgaggccauugugugcguugaacugacaagccaggagagacaguguucccugaucgaagcugggacccgcuucaaccuuggcccggugacgauuacccucagcgagccccggaacauccaacagaagcugccucccgagaucauuacacugcacccuaagaucgaagagggauucuuugaucucaugcacguccagaaagugcugucugccuccaccgugugcaaacuucagagcuguacacauggcauucccggggaccugcaaaucuaucacauuggaaaucuccugaagggcgauagaguuaacgggcaucugauccacaagaucgaaccgcauuucaauaccucuuggauguccugggacggaugcgaccuugauuacuauuguaacaugggcgacuggccuagcugcacguacacaggggucacccagcacaaucacgcugccuuugugaaccuccugaauauugagacagauuauaccaaaaccuuccauuuucacucuaagcgcgugacagcccauggcgacacgccccagcuggaucucaaggcucggccuaccuacggagcgggcgaaaucacaguccugguggagguugccgacauggagcuucacaccaaaaagguggaaauuagcgggcugaaauucgcuucccucacauguaccggaugcuacgccugcagcucuggcaucuccuguaagguccgcauucacguggaugagcccgacgaacugacgguucaugugaaaagcuccgauccugacgucguggccgcuucuacaagccugauggccagaaaacuugaguuugggaccgauuccaccuucaaggcguuuucugcuaugcccaagacaagccucugcuucuauaucguugaacgggaguacuguaaguccugcucugaggacgauaccaaaaaguguguggacacaaaacuggaacagccgcaaagcauccugauugagcacaagggaacgaucauuggcaaacagaacgauaccugcacagccaaggccuccuguuggcucgaaagcgucaagagcuuuuucuaugggcugaaaaauaugcuuggcuccguguuuggaucuuucuucgugggcauccugcucuuucuggcuccuuucguccugcuuguucucuuuuucauguuuggguggaagauucuguucugcuuuaaauguugcagacgcacccggggacuguucaaguacagacaucucaaagacgacgaggaaacaggcuaucggcgcaucaucgagagacugaacucuaagaaggggaaaaaucggcuucuggauggagagagacucgccgaccgcaagauugcugaacuguuuuccaccaaaacgcacaucggc

SEQ ID NO: 13926 - RNA, 2916 nt, Artificial Sequence
  derived and/or modified CDS sequence (opt5) from CCHFV(K323_27, Artificial)__KX013472.1__Gn-4aa-Gc
agcgaggaacccggcgacgauugcaucuccagaacccagcugcucaagacagagacggccgaaauucacgacgauaacuacgggggaccuggcgacaaaaucaccauuuguaaugggucuacaaucguggaucaacggcugggaagcgagcuuggcugcuauaccauuaaccgcgucaaguccuucaaacugugugaaaauucugcuacagggaagaccugcgagaucgacagcacaccgguuaaauguagacagggauuuugccucaagaucacccaggagggccggggccaugugaagcugucccgcgggucugaagugguccuugaugccugugacagcuccugcgagauuaugauccccaaaggaacgggcgauauucugguggacuguagcgggggacagcaacacuuccucaaggauaaccugaucgaccugggcugcccucauauuccccuccuggggaaaauggcgaucuacauuuguagaaugucuaaucacccucggaccacaauggcuuuucuuuucugguuuuccuucggauauguuauuaccugcaucuuuugcaaggcccuguucuaccuccugauuaucauuggcacacuuggcaaaaagaucaagcaguaucgcgaacugaaaccccagaccuguacgauuugcgagacagccccugugaacgcuaucgaugccgagaugcaugaccucaauuguagcuacaacaucugcccguauugugcuucuagacugaccuccgacgggcuggcccggcacgucacacagugccccaagcgcaaagaaaagguggaggaaaccgagcucuaccugaaucuugaaagaaucccuuggaucguucggaaacugcuccaagugagcgagucuaccggagucgcgcugaagcgcuccagcuggcuuacagugcugcucgugcugcugacggucucccucucucccguucagagcgccccugugggcagaaaaccccuguuucuugauuccauugcuaaggggaugaagaaccugcucaauagcaccucucuggagacaucccuuagcaucgaagccccguggggagcuauuaacgugcagucuaccuucaaaccuacagucagcaccgccaauaucgcgcuguccuggucuagcguggagcaccggggcaacaagauccucguuacggggcgcuccgaaagcauuaugaaacuggaggaaagaacaggagugucuugggaccugggcgucgaggaugccuccgagagcaagcuccugaccgugucuaucauggaccuuucccagauguacagccccguuuuugaauaucuguccggcgaucggcaaguggaggaauggccuaaagcuaccuguacaggggacugccccgagagauguggaugcaccucuagcacaugucuccauaaggaauggccccacucccgcaauuggcggugcaacccuacguggugcuggggcgucgggaccggauguacaugcuguggcguggaugucaaggaccuguucaccgaucauauguuuauuaaauggaagguggaguacaucaaaacagaggccauuguuugcguggaacugaccgggcaggagagacaguguucucuuaucgaagcuggcacgcgcuucaaccucggaccggucaccauuacacugagcgagccccggaauauccaacagaagcugccucccgagaucauuacccuccacccuaaaaucgaagagggcuucuuugaccugaugcacgugcagaagguucuuuccgccagcacagugugcaagcugcagucuuguacccaugggauucccggagaucuccaaaucuaucacauuggcaaccugcugaaaggggacagagucaauggacaucuuauccacaagaucgaaccgcauuucaacacguccuggaugagcugggacggcugcgaucucgacuacuauuguaauaugggggauuggccuucuugcacauacaccggcgugacacagcacaaccacgccgcuuuugugaaucugcugaacauugagaccgacuauaccaaaacauuccauuuucacuccaagcgcguuacggcgcauggagauacaccccagcucgaccugaaagcccggccuaccuacggcgcuggggaaaucaccguccuuguggagguggccgauauggagcugcacacaaagaaggucgaaauuagcggacucaaauucgccucucugaccuguacgggcugcuacgcuugcagcuccgggaucagcuguaaggugcgcauucacguugacgagcccgaugaacugacagugcaugucaaaucuuccgacccugaugugguugccgcgagcaccucccuuauggcuagaaagcucgaguuuggaaccgacucuacauucaaagccuuuagcgccaugcccaagaccucccugugcuucuauaucguggaacgggaguacuguaaaucuugcagcgaggaugacacaaagaagugugucgacacgaaacuggaacagccgcaauccauccucauugagcacaagggcaccaucauugggaaacagaaugauacaugcaccgcuaaggccucuuguuggcuggaaagcgugaaauccuuuuucuauggccuuaagaacaugcugggaagcguuuuuggcucuuucuucguggggauccuccuguuucuggcuccuuucguccuucucgugcuguuuuucauguuuggauggaagauucuguucugcuuuaaauguugcagacgcacacggggccucuucaaguacagacaucugaaugacgaugaggaaaccggguaucggcgcaucaucgagagacuuaacuccaaaaagggcaaaaaucggcugcucgacggagagagacuggccgaucgcaagauugcggaacuguuuagcacgaagacccacaucggg

SEQ ID NO: 13927 - RNA, 2916 nt, Artificial Sequence
  derived and/or modified CDS sequence (opt5) from CCHFV(K340_6, Artificial)__KX013475.1__Gn-4aa-Gc
agcgaggaacccggcgacgauugcaucuccagaacccagcugcucaagacagagacggccgaaauucacgacgauaacuacgggggaccuggcgacaaaaucaccauuuguaaugggucuacaaucguggaucaacggcugggaagcgagcuuggcugcuauaccauuaaccgcgucaaguccuucaaacugugugaaaauucuacaaccgggaagacaugcgagaucgacagcaccccgguuaaauguagacagggauuuugccucaagaucacgcaggagggccggggccaugugaagcugucccgcgggucugaagugguccuugaugcuugugacagcuccugcgagauuaugauccccaaaggaaccggcgauauucugguggacuguagcgggggacagcaacacuuccucaaggauaaccugaucgaccugggcugcccucauauucccccucucgggaaaauggccaucuacauuuguagaaugucuaaucacccccggacaaccauggcguuucuguucugguuuuccuucggauauguuaucacaugcaucuuuugcaaggcucuuuucuacagccugauuaucauuggcacccucggcaaaaagaucaagcaguaucgcgaacugaaaccucagacguguacaauuugcgagaccgccccggugaacgccaucgaugcugagaugcaugaccuuaauuguucuuacaacaucugccccuauugugccuccagacugacaagcgacgggcucgcucggcacgucacccagugcccuaagcgcaaagaaaagguggaggaaaccgagcuguaccugaaucucgaacggauucccuggaucguuagaaaacugcuucaagugucugaguccacaggagucgcccugaagcgcagcuccuggcucauugugcugcuugugcugcucacggucucucugagcccuguucaguccgcgcccgugggcagaaaaccgcugagccucgauucuaucgugaaggggaugaagaaccugcuuaauuccaccagccuggagacaucucucagcauugaagccccuuggggagcuaucaacguccaguccaccuuuaaacccacagugucuaccgccaauaucgcucugagcugguccagcguugagcaccggggcaacaagauucuugugacggggcgcucugaauccaucaugaaacuggaggaaagaacaggagucagcugggaccucggcguggaggaugccucugaguccaagcugcugaccguuagcauuauggaccucucccagauguacucuccuguguucgaauaucugagcggcgaucggcaagucgaggaauggcccaaagcgaccuguacaggggacugccccgagagauguggaugcaccuccucuacaugucuucauaaggaauggccucacagccgcaauuggcggugcaacccgacguggugcuggggcguggggaccggauguacaugcuguggcgucgaugugaaggaccuguuuaccgaucauauguucaucaaauggaagguugaguacauuaaaacagaggccaucgugugcgucgaacucaccucccaggagagacaguguagccugauugaagcugggacgcgcuuuaaccugggccccgugaccaucacacuuucugagccucggaauauccaacagaagcugcccccugagauuaucacccugcaccccaaaauugaagagggauucuucgaccugaugcacguucagaaggugcucuccgccagcacagucugcaagcugcagucuuguacccauggcaucccgggggaucuucaaauuuaucacaucggaaaccugcucaaaggcgacagagugaaugggcaucugauccacaagauugaaccucauuuuaacacguccuggaugagcugggacggaugcgaucuggacuacuauuguaauaugggcgauuggcccucuugcacauacaccggggugacacagcacaaccacgcugccuucguuaaucuucucaacaucgagaccgacuauaccaaaacauuucauuuccacagcaagcgcgucacggcccauggcgauaccccucagcuggaccugaaagcucggcccacauacggagcgggcgaaauuaccgugcucguggaggucacagauauggagcugcacaccaagaagguggaaaucuccgggcuuaaauuugccagccugacguguacaggaugcuacgcuuguucuuccggcauuagcugcaagguuagaauccacguggacgagccugaugaacucaccguccaugugaaauccucugaccccgauguuguggccgccagcaccucccugauggcucgcaagcuggaguucgggacagacucuaccuuuaaagccuucagcgcgaugccgaagacaucccuuugcuuuuauaucgucgaacgggaguacuguaaaucuugcagcgaggaugacacgaagaaguguguggacaccaaacucgaacagccucaauccauucugaucgagcacaagggaacaauuaucggcaaacagaaugauaccugcacagcuaaggccagcuguuggcuggaaucuguuaaauccuucuuuuaugggcucaagaacaugcugggcagcguguucggauccuuuuucgucggcauucuucuguuccucgcccccuuugugcugcuggugcuuuucuuuauguucggguggaagauccucuuuugcuucaaauguugcagacgcacccggggacuguuuaaguacagacauuucaaagacgaugaggaaacgggcuaucggcgcaucauugagagacucaauucuaagaaagggaagaaccggcuccuggacggagagagacuugcugaucgcaagaucgccgaacuguuuagcaccaaaacacacauuggc

SEQ ID NO: 13928 - RNA, 2916 nt, Artificial Sequence
  derived and/or modified CDS sequence (opt5) from CCHFV(Mamon, Artificial)__KX013478.1__Gn-4aa-Gc
agcgaggaacccggcgacgauugcaucuccagaacccagcugcuccggacagagacggccgaaauucacgacgauaacuacgggggaccuggcgacaagaucaccauuuguaaugggucuacaaucguggaucaacgccugggaagcgagcuuggcugcuauaccauuaacagagucaaauccuucaagcugugugaaaauucugcuacagggaaaaccugcgagaucgacagcacaccgguuaagugucggcagggauuuugccucaaaaucacccaggagggccgcggccaugugaagcuguccagagggucugaaguggucagcgaugccugugacuccagcugcgaggugaugauucccaagggaacgggcgauauccuuguugacuguucugggggacagcaacacuuccugaaagauaaccucauugaccugggcugcccucauaucccccugcucgggaagauggcgauuuacaucugucggauguccaaucacccucgcaccacaguggcuuuucuguucugguuuagcuucggauaugucauuaccugcaucuuuugcaaagcccuuuucuacucucugaucauuaucggcacacucggcaagaaaauuaagcaguauagagaacugaagccccagaccuguacgaucugcgagacagccccugugaacgcuauugaugccgagaugcaugaccuuaauuguuccuacaacaucugcccguauugugcuagccggcugaccucugacgggcucgcccgccacguuccccagugcccuaaaagaaaggaaaaaguggaggaaacagagcuguaccugaaucucgaacggauccccuggauuguccgcaagcugcuucaaguguccgagagcaccggaguggcgcugaaaagauccucuuggcucaucguccugcuuguucugcucaccgugagccuguccccugugcagagcgcccccgucggccggaagccgcuguuucucgauucuauugugaaagggaugaagaaccugcuuaauuccacaagccuggagacgucucucagcaucgaagcuccuuggggagccauuaacguucaguccaccuucaagcccacagugucuaccgcuaauaucgcccugagcugguccagcgucgagcaccgcggcaacaaaauccuugugacagggagaucugaauccauuaugaagcuggaggaacggaccggaguuagcugggaccucggcguggaggaugcgucugaguccaaacugcugacggucagcaucauggaccucucccagauguacucuccuguguuugaauaucugagcggcgauagacaagucgaggaauggcccaaggccacauguaccggggacugccccgagcgcuguggaugcaccuccucuacaugucuucauaaagaauggccucacagccggaauuggagaugcaacccgaccuggugcuggggcguggggacaggauguacgugcuguggcguugaugugaaggaccuguucaccgaucauauguuugucaaguggaaaguggaguacauuaagacagaggcuaucguuugcguggaacucaccucccaggagcgccaguguagccugauugaagccgggacacgguucaaccugggccccgucaccaucacgcuuucugagccuagaaauauucaacagaaacuucccccugagaucaucacccugcaccccaagguggaagagggauucuuugaccugaugcacgugcagaaaguucucuccgcuagcacagucugcaagcugcagucuuguacccauggcauuccgggggaucuucaaguguaucacaucggaaaccugcucaagggcgaccgcgugaaugggcaucugauucacaaaaucgaaccucauuucaacacauccuggaugagcugggacggaugcgaucuggacuacuauuguaauaugggcgauuggcccucuugcaccuacacgggggucacacagcacaaccacgccgccuuugugaaucuucucaacauugagaccgacuauacaaagaccuuccauuuucacagcaaacggguuaccgcucauggcgauacaccucagcuggaccugaaggcgagacccacguacggagccggcgaaaucaccgugcucgucgagguggcugauauggagcugcacaccaaaaagguugaaaucuccgggcuuaaguucgccagccuggccuguacaggaugcuacgcuuguucuuccggcauuagcugcaaagugcgcauccacgucgacgagccugaugaacucacagugcauguuaaguccucugaccccgauguggucgccgcgagcaccucccugauggcucggaaacuggaguuugggacggacucuacauucaaggccuuuagcgccaugccgaaaaccucccuuugcuucuauauuguggaaagagaguacuguaagucuugcagcgaggaagauacccagaaauguguggacacaaagcucgagcaaccucaguccauccugauugaacacaagggaaccaucaucggcaaacagaaugacacaugcacggcuaagaccagcuguuggcuggagucugucaaauccuuuuucuaugggcucaagaacaugcugggcagcguuuuuggaaauuucuucauuggcauccuucuguuucucgcccccuucgugcugcuggugcucuuuuucauguuuggguggaaaauucucuucugcuuuaaguguugccgccggacaagaggacugcugaaguaccggcaucucaaagaugacgaagagaccggcuaucgcagaaucauugagcggcugaacaauaagaaagggaagaacagacuucuggauggagaacgccucgcugaccggaaaaucgccgagcuguucucuacaaagacccacaucggc

SEQ ID NO: 13929 - RNA, 2916 nt, Artificial Sequence
  derived and/or modified CDS sequence (opt5) from CCHFV(Min, Artificial)__KX013481.1__Gn-4aa-Gc
agcgaggaacccggcgacgauugcaucuccagaacccagcugcuccggacagagacggccgaaauucacgacgauaacuacgggggaccuggcgacaagaucaccauuuguaaugggucuacaaucguggaucaacgccugggaagcgagcuuggcugcuauaccauuaacagagucaaauccuucaagcugugugaaaauucugcuacagggaaaaccugcgagaucgacagcacaccgguuaagugucggcagggauuuugccucaaaaucacccaggagggccgcggccaugugaagcuguccagagggucugaagugguccuugaugccugugacagcuccugcgaggugaugauucccaagggaacgggcgauauccugguugacuguagcgggggacagcaacacuuccucaaagauaaccugauugaccugggcugcccucauaucccccuccuggggaagauggcgauuuacaucugucggaugucuaaucacccucgcaccacaauggcuuuucuuuucugguuuuccuucggauaugugauuaccugcaucuuuugcaaagcccuguucuacagccucaucauuaucggcacacugggcaagaaaauuaagcaguauagagaacuuaagccccagaccuguacgaucugcgagacagccccugucaacgcuauugaugccgagaugcaugaccugaauuguucuuacaacaucugcccguauugugcuucccggcucaccagcgacgggcuggcccgccacgugccccagugcccuaaaagaaaggaaaaaguugaggaaacagagcuguaccucaaucuggaacggauccccuggauugugcgcaagcugcugcaagucucugaguccaccggaguggcgcucaaaagaagcuccuggcugaucgugcuucugguccuccugaccguuucucugagcccugugcaguccgcccccgugggccggaagccgcucuuucuggauagcauugucaaagggacaaagaaccuucuuaauucuacgucccucgagaccagccugucuaucgaagcuccuuggggagccauuaacgugcagagcacauucaagcccaccguuuccacagcuaauaucgcccuuucuuggagcuccguggagcaccgcggcaacaaaauccuggucaccgggagaagcgaaucuauuaugaagcucgaggaacggacgggaguguccugggaccugggcguugaggaugcgagcgagucuaaacugcucacaguguccaucauggaccugagccagauguacuccccugucuuugaauaucuuucuggcgauagacaaguggaggaauggcccaaggccaccuguaccggggacugccccgagcgcuguggaugcacaagcuccaccugucugcauaaagaauggccucacucucggaauuggagaugcaacccgacauggugcuggggcgucgggacgggauguaccugcuguggcguggauguuaaggaccucuucacagaucauauguuugugaaguggaaagucgaguacauuaagaccgaggcuaucgugugcguugaacugacaagccaggagcgccaguguucccugauugaagccgggacccgguucaaccuuggccccgugacgaucacccucagcgagccuagaaauauucaacagaaacugcccccugagaucaucacacugcaccccaaggucgaagagggauucuuugaccucaugcacgugcagaaagugcugucugcuuccaccguuugcaaacuucagagcuguacacauggcauuccgggggaucugcaagucuaucacaucggaaaccuccugaagggcgaccgcauuaaugggcaucugauccacaagauugaaccucauuucaacaccucuuggauguccugggacggaugcgaucuugacuacuauuguaauaugggcgauuggcccagcugcacguacacaggggugacccagcacaaccacgccgccuuugugaaucuccugaacaucgagacagacuauaccaagaccuuccauuuucacucuaaacgggucacagcucauggcgauacgccucagcuggaccucaaggcgagacccaccuacggagccggcgaaaucacagugcugguugagguggcugauauggagcuucacaccaaaaaggucgaaauuagcgggcugaaguucgccucccucgccuguacaggaugcuacgcuugcagcucuggcaucuccuguaaagugcgcauucacguugacgagccugaugaacugaccgugcaugucaagagcuccgaccccgaugugguugccgcgucuacgagccugauggcucggaaacuugaguuugggacagacuccaccuucaaggccuuuucugccaugccgaaaaccagccucugcuucuauaucguggaaagagaguacuguaaguccugcucugaggaagauacacagaaaugugucgacaccaagcuggagcaaccucagagcauucugaucgaacacaagggaacaaucauuggcaaacagaaugacacgugcaccgcuaaggccuccuguuggcucgagagcgugaaauccuuuuucuaugggcugaagaacaugcuuggcucuguguuuggaaauuucuucaucggcauucugcucuuucuggcucccuucguccugcuuguucucuuuuucauguuuggguggaaaauccuguucugcuuuaaguguugccgccggacaagaggacugcucaaguaccggcaucugaaagaugacgaagagaccggcuaucgcagaauuaucgagcggcuuaacaauaagaaagggaagaacagacugcucgauggagaacgccuggccgaccggaaaaucgcggagcuguucagcacaaagacccacauuggc

SEQ ID NO: 13930 - RNA, 2916 nt, Artificial Sequence
  derived and/or modified CDS sequence (opt5) from CCHFV(Nakiwogo, Artificial)__KX013484.1__Gn-4aa-Gc
gccgagggcgugagcaacgacugcgucuccagaacccagcuuaucaagacagaaguugcugagauucacgaagauucuuacgggggacccggcgagaaaaucacgauuuguaaugggagcaccaucguggaccaacggcucggauccgaacugggcugcuauacaauuaaccgcgugaagaccuacaaacuuugugaaaauucugccacagagaaggggugcgagaucgauagcgucccugugaaauguaagcagggauucugccugaagguuacccaggagggcagaggccaugugaaacucucccgggggacagaaaucguccuggacgugugugauaccucuugcgagcuuaugauuccgaagggaacgggcgacauccugguugauuguagcgggggacagcaacacuuucuccaggacaaccugauugaucugggcugccccaaugugccucuccuggggaaaauggcgaucuauauuugucgcauguccaaccaucccaagaccacaauggcuuuccuguuuugguucagcuuuggauacgucauuaccugcguggugugcaaaguccuuuucuaucuccugaucguuaucggcacacuuggcaagaagcugaaacaguacagagagcucaagccucagaccuguaucgugugcgaaucuauucccgugaaugucaucgacgccgagaugcacgaacugaacuguaauuauaacauuugcccuuacugugccucccggcugacgagcgaugggcucgugcgccauguuacacaaugcccgaaaagaaaggagaaaguggaagagaccgagcuguaccuuaaucuggaacggauccccuggcucguccgcagacugcuucaggugucugaguccacaggaauggcucugaagcggagcuguuggaugaccacccuccugauucugcucguugugucucuguccccuguccagagcgcccccgugggccgcaaaccucuuuaucuggacuccaucgcuaaggggaugaagucucuccugaacagcacaaaucuugaaacgucccugagcaucgaggcccccuggggagcgauuaacguccagucuaccuuuaaaccgacaguguccgccgcuaauaucgcccucagcuggucuagcguugaacacagaggcaacaagauucugguguccgggcggucugagagcaucaugaaacuggaggaacgcaccggaauuuccuggagccucggcgucgaggaugcuucugaauccaagacacugaccgugagcguuauggaccuuucucaaauguacuccccuguguucgaguaucugagcggcgacagacaggucgaagaguggcccaaagccacgugcacaggggauuguccugagcggugcggauguaccuccucuaccugccuccacaaggaauggccccauagcagaaacuggcgcugcaaucccacaugguguuggggcguggggaccggaugcacauguugcggccuggacgugcgggaucuguuuacggacuacaugaugguuaaguggaaagucgaguaugugaagaccgaagcgaucauguguguggagcuuacaucccaggagagacaaugcucucucaucgaagccgggacccgcuucaaccugggcccugucacaauuacccugagcgagccgcggaaugugcagcagagacuccccuccgaaaucguuacgcugcacccuaaaauugaggaaggauuuuucgaucuuaugcaugugcagaagguccuguuuuguaaacacagccuccaagcuaccucuugcacacacggcgugcccggggaccugcagguuuaccaugugggaaaccugcuuaagggcgauaaggucaaugggcacuccauccauaaaauugagagccacuucaacaccucuuggauguccugggacggaugugaucucgacuauuucugcaauaugggcgauuggccuagcuguacauacaccggggugacgcagcauaaccgcgccgcuuuuguuaauaugcugaacaucgagacagacuacaccaagacauuccacuuucacucuaaacgggugaccgcccauggcgacacaccccagcuggaucucaaggccagaccgaccuauggagcuggcgaagucacggugcugguggaggucgcggaccuugaacugcacaccaaaaagauugagguuagcgggcucaaguucgccucccugacaugcagcggaugcuacgcuuguucuuccggcaucagcugcaaagugcgcauccaugugaaugaaccugaugaguuuaccguccacgugaaguccaacgaccccgauguuguggccgccgggucuagccugauggcucggaaaauugagcuuggagccgacuccacauucaaggcguuuucuagcaugccuaaaaauucccucuguuucuauaucgucgaaagagauuacugcucuagcuguaccgacgaugacacgcaaaagugcgugaacacaaaacuggagcacccccaguccauucugaucgaacauaagggcaccauuaucgggaagcagaaugauaccuguccuacaaaaaccagcugcuggcucgagucuguuaaguccuuuuucuauggccugaaaaacaugcuuggaggcaucuuugggaacguguuccugggaauuuuucucuuccuggcucccuucgcccugcuuauccucuuuuucuuuuucggcuggcgccugcuguuuugucucaagugcugucggagaacacgggggcugcuuaaauacaagcagcugaaggacgaagaggaggccggauauaaaaagauuaucgaacgccucaaugauaaaaagggcaaaagcagacuguucgacggggagcggcuggcugacagaaagauugccgaacuguuuucuacgaagacccacaucggc

SEQ ID NO: 13931 - RNA, 2916 nt, Artificial Sequence
  derived and/or modified CDS sequence (opt5) from CCHFV(Saf, Artificial)__KX013487.1__Gn-4aa-Gc
agcgaggaacccggcgacgauugcaucuccagaacccagcugcuccggacagagacggccgaaauucacgacgauaacuacgggggaccuggcgacaagaucaccauuuguaaugggucuacaaucguggaucaacgccugggaagcgagcuuggcugcuauaccauuaacagagucaaauccuucaagcugugugaaaauucugcuacagggaaaaccugcgagaucgacagcacaccgguuaagugucggcagggauuuugccucaaaaucacccaggagggccgcggccaugugaagcuguccagagggucugaagugguccuugaugccugugacagcuccugcgaggugaugauucccaagggaacgggcgauauccugguugacuguagcgggggacagcaacacuaccucaaagauaaccugauugaccugggcugcccucauaucccccuccuggggaagauggcgauuuauaucugucggaugucuaaucacccucgcaccacaauggcuuuccucuuuugguucuccuuuggauacgugauuaccugcaucuucugcaaagcccuguuuuauagccucaucauuaucggcacacugggcaagaaaauuaagcaguacagagaacuuaagccccagaccuguacgaucugcgagacagccccugucaacgcuauugaugccgagaugcaugaccugaauuguucuuauaacaucugcccguacugugcuucccggcucaccagcgacgggcuggcccgccacgugccccagugcccuaaaagaaaggaaaaaguugaggaaacagagcuguaccucaaucuggaacggauccccuggauugugcgcaagcuccugcaagucucugaguccaccggaguggcgcucaaaagaagcuccuggcugaucgugcuucugguccuccugaccguuucucugagcccugugcaguccgcccccgugggccggaagccgcuuuucagcgauucuauugucaaagggaugaagaaccugcuuaauuccacaagccuggagacgucucucagcaucgaagcuccuuggggagccauuaacgugcaguccaccuuuaagcccacaguuucuaccgcuaauaucgcccugagcugguccagcguggagcaccgcggcaacaaaauccuugucacagggagaucugaauccauuaugaagcuggaggaacggaccggagugagcugggaccucggcguugaggaugcgucugaguccaaacugcugacggugagcaucauggaccucucccagauguauucuccugucuucgaauaccugagcggcgauagacaaguggaggaauggcccaaggccacauguaccggggacugccccgagcgcuguggaugcaccuccucuacaugucuucauaaagaauggccucacagccggaauuggagaugcaacccgaccuggugcuggggcgucgggacaggauguacgugcuguggcguggauguuaaggaccuguuuaccgaucauauguucgugaaguggaaagucgaguauauuaagacagaggcuaucgugugcguugaacucaccucccaggagcgccaguguagccugauugaagccgggacacgguuuaaccugggccccgugaccaucacgcuuucugagccuagaaauauucaacagaaacuucccccugagaucaucacccugcaccccaaggucgaagagggauucuucgaccugaugcacgugcagaaagugcucuccgcuagcacaguuugcaagcugcagucuuguacccauggcauuccgggggaucuucaagucuaccacaucggaaaccugcucaagggcgaccgcgugaaugggcaucugauucacaaaaucgaaccucauuuuaacacauccuggaugagcugggacggaugcgaucuggacuauuacuguaauaugggcgauuggcccucuugcaccuauacgggggugacacagcacaaccacgccgccuucgucaaucuucucaacauugagaccgacuacaugaagacauuucauuuccacagcaaacgggugaccgcucauggcgauaccccucagcuggaccugaaggcgagacccacauacggagccggcgaaaucacgguucucguggaggucgcugauauggagcugcacaccaaaaagguggaaaucuccgggcuuaaguuuguuagccuggccuguacaggaugcuaugccuguucuuccggcauuagcugcaaagugcgcauccacgucgacgagccugaugaacucaccgugcauguuaaguccucugaccccgauguggucgcugccagcacaucccugauggcgcggaaacuggaguucgggaccgacucuacguuuaaggcuuucagcgccaugccgaaaacaucccuuugcuuuuacauuguggaaagagaguauuguaagucuugcagcgaggaagauacccagaaauguguggacaccaagcucgagcaaccucaguccauccugauugaacacaagggaacaaucaucggcaaacagaaugauaccugcacagccaaggcuagcuguuggcuggagucugucaaauccuucuuuuacgggcucaagaacaugcugggcagcguuuucggaaacuuuuucauuggcauccuucuguuccucgcccccuuugugcugcuggugcuuuucuuuauguucggguggaaaauucucuuuugcuucaaguguugccgccggacgagaggacugcugaaguaucggcaucucaaagacgacgaagagaccggcuaccgcagaaucauugagcggcugaauaauaagaaagggaagaacagacuucuggauggagaacgccucgcugaccggaaaaucgccgagcuguuuucuacaaagacccacaucggc

SEQ ID NO: 13932 - RNA, 2916 nt, Artificial Sequence
  derived and/or modified CDS sequence (opt5) from CCHFV(Ast199, Artificial)__KX056051.1__Gn-4aa-Gc
agcgaggaacccggcgacgauugcaucuccagaacccagcugcucaagacagagacggccgaaauucacgacgauaacuacgggggaccuggcgacaaaaucaccauuuguaaugggucuacaaucguggaucaacggcugggaagcgagcuuggcugcuauaccauuaaccgcgucaaguccuucaaacugugugaaaauucugcuacagggaagaccugcgagaucgacagcacaccgguuaaauguagacagggauuuugccucaagaucacccaggagggccggggccaugugaagcugucccgcgggucugaagugguccuugaugccugugacagcuccugcgagauuaugauccccaaaggaacgggcgauauucugguggacuguagcgggggacagcaacacuuccucaaggauaaccugaucgaccugggcugcccucauauuccccuccuggggaaaauggcgaucuacauuuguagaaugucuaaucacccucggaccacaauggcuuuucuuuucugguuuuccuucggauauguuauuaccugcaucuuuugcaaggcccuguucuacagccucauuaucauuggcacacugggcaaaaagaucaagcaguaucgcgaacuuaaaccccagaccuguacgauuugcgagacagccccugugaacgcuaucgaugccgagaugcaugaccugaauuguucuuacaacaucugcccguauugugcuuccagacucaccagcgacgggcuggcccggcacgucacacagugccccaagcgcaaagaaaagguggaggaaaccgagcuguaccucaaucuggaaagaaucccuuggaucguucggaaacuucugcaagugucugaguccaccggagucgcgcucaagcgcuguagcuggcugauugugcuucuggugcuccugacagucucccugucucccguucagagcgccccugugggcagaaaaccccucuuucuggauuccaucgugaaggggaugaagaaccuucugaauagcacgucucucgagaccucccugagcauugaagcuccguggggagccaucaacguccagucuacauucaaaccuaccgugagcacagcuaauaucgcccuuuccuggucuagcguugagcaccggggcaacaagauucuggugaccgggcgcuccgaaagcaucaugaaacucgaggaaagaacgggagucucuugggaccugggcguggaggaugcguccgagagcaagcugcucacaguuucuauuauggaccugucccagauguacagccccguguuugaauaucuuuccggcgaucggcaagucgaggaauggccuaaagcuaccugcaccggggacugucccgagagaugcggauguacaucuagcacaugccugcauaaggaauggccccacucccgcaauuggcggugcaacccuaccugguguuggggcguggggacgggaugcaccuguugcggcgucgaugugaaggaccucuucacagaucauauguuuaucaaauggaagguugaguacauuaaaaccgaggccaucgugugugucgaacugacaucucaggagagacagugcagccugauugaagccgggacccgcuucaaccuuggcccggugacgaucacccucuccgagccccggaauauccaacagaagcugccucccgagauuaucacacugcacccuaaaauugaagagggauucuuugaccucaugcacguucagaaggugcugagcgcuucuaccgucuguaaacuucaguccugcacacauggcauccccggggaucugcaaauuuaucacaucggaaaccuccugaaaggcgacagacugaaugggcaucuuauccacaagauugaaccgcauuucaacaccagcuggaugucuugggacggaugugaucucgacuacuauugcaauaugggcgauuggccuuccuguacguacacaggggugacccagcacaaccacgccgccuuugugaaucugcugaacaucgagacagacuauaccaaaaccuuccauuuucacagcaagcgcguuacagcucauggcgauacgccccagcucgaccugaaagcgcggccuaccuacggagccggcgaaauuacaguccuuguggagguggcugauauggagcugcacaccaagaaggucgaagugucugggcucaaauucgccagccuggccugcacaggaugcuacgcuuguuccagcggcaucucuugcaagguucgcauucacguggacgagcccgaugaacugaccguccaugugaaauccagcgacccugauguuguggccgcguccacgucucuuauggcuagaaagcucgaguuugggacagacagcaccuucaaagccuuuuccgccaugcccaagaccucucuguguuucuauaucgucgaacgggaguacugcaaaagcuguuccgaggaugacacaaagaagugcguggacaccaaacuggaacagccgcaaucuauccucauugagcacaagggaacaaucauuggcaaacagaaugauacguguaccgcuaaggccagcugcuggcuggaauccguuaagagcuuuuucuaugggcuuaagaacaugcugggcucuguguuuggaaauuucuucgucggcauccuccuguuucuggcuccuuucgugcuucucgugcuguuuuucauuuuuggguggaagauccuguucuguuuuaaaugcuguagacgcacacggggacucuucaaguacagacaucugaaagacgaugaggaaaccggcuaucggaagaucauugagcgccuuaacuccaaaaaggggaagaauagacugcucgacggagagcggcuggccgauagaaaaaucgcggaacuguuuagcacaaagacccacauuggc

SEQ ID NO: 13933 - RNA, 2916 nt, Artificial Sequence
  derived and/or modified CDS sequence (opt5) from CCHFV(Ast149, Artificial)__KX056054.1__Gn-4aa-Gc
agcgaggaacccggcgacgauugcaucuccagaacccagcugcucaagacagagacggccgaaauucacgacgauaacuacgggggaccuggcgacaaaaucaccauuuguaaugggucuacaaucguggaucaacggcugggaagcgagcuuggcugcuauaccauuaaccgcgucaaguccuucaaacugugugaaaauucugcuacagggaagaccugcgagaucgacagcacaccgguuaaauguagacagggauuuugccucaagaucacccaggagggccggggccaugugaagcugucccgcgggucugaagugguccuugaugccugugacagcuccugcgagauuaugauccccaaaggaacgggcgauauucugguggacuguagcgggggacagcaacacuuccucaaggauaaccugaucgaccugggcugcccucauauuccccuccuggggaaaauggcgaucuacauuuguagaaugucuaaucacccucggaccacaauggcuuuucuuuucugguuuuccuucggauauguuauuaccugcaucuuuugcaaggcccuguucuacagccucauuaucauuggcacacugggcaaaaagaucaagcaguaucgcgaacuuaaaccccagaccuguacgauuugcgagacagccccugugaacgcuaucgaugccgagaugcaugaccugaauuguucuuacaacaucugcccguauugugcuuccagacucaccagcgacgggcuggcccggcacgucacacagugccccaagcgcaaagaaaagguggaggaaaccgagcuguaccucaaucuggaaagaaucccuuggaucguucggaaacuucugcaagugucugaguccaccggagucgcgcucaagcgcagcuccuggcugauugugcuucuggugcuccugacagucucucugagccccguucaguccgccccugugggcagaaaaccccucuuucuggauagcaucgugaaggggaugaagaaccuucuuaauucuacgucccucgagaccagccugucuauugaagcuccguggggagccaucaacguccagagcacauucaaaccuaccguguccacagcuaauaucgcccuuucuuggagcuccguugagcaccggggcaacaagauucuggugaccgggcgcagcgaaucuaucaugaaacucgaggaaagaacgggagucuccugggaccugggcguggaggaugcgagcgagucuaagcugcucacaguuuccauuauggaccugagccagauguacucccccguguuugaauaucuuucuggcgaucggcaagucgaggaauggccuaaagccaccuguaccggggacugccccgagagauguggaugcacaagcuccaccugucugcauaaggaauggccccacucucgcaauuggcggugcaacccuacauggugcuggggcguggggacgggauguaccugcuguggcgucgaugugaaggaccucuucacagaucauauguuuaucaaauggaagguugaguacauuaaaaccgaggcuaucgugugcgucgaacugacaagccaggagagacaguguucccugauugaagccgggacccgcuucaaccuuggcccggugacgaucacccucagcgagccccggaauauccaacagaagcugccucccgagauuaucacacugcacccuaaaauugaagagggauucuuugaccucaugcacguucagaaggugcugucugcuuccaccgucugcaagcugcagagcuguacacauggcauccccggggaucugcaaauuuaucacaucggaaaccuccugaaaggcgacagacugaaugggcaucuuauccacaagauugaaccgcauuucaacaccucuuggauguccugggacggaugcgaucucgacuacuauuguaauaugggcgauuggccuagcugcacguacacaggggugacccagcacaaccacgccgccuuugugaaucugcugaacaucgagacagacuauaccaaaaccuuccauuuucacucuaagcgcguuacagcucauggcgauacgccccagcucgaccugaaagcgcggccuaccuacggagccggcgaaauuacaguccuuguggagguggcugauauggagcugcacaccaagaaggucgaagugagcgggcucaaauucgccucccuggccuguacaggaugcuacgcuugcagcucuggcaucuccuguaagguucgcauucacguggacgagcccgaugaacugaccguccaugugaaaagcuccgacccugauguuguggccgcgucuacgagccuuauggcuagaaagcucgaguuugggacagacuccaccuucaaagccuuuucugccaugcccaagaccagccugugcuucuauaucgucgaacgggaguacuguaaauccugcucugaggaugacacaaagaaguguguggacaccaaacuggaacagccgcaaagcauccucauugagcacaagggaacaaucauuggcaaacagaaugauacgugcaccgcuaaggccuccuguuggcuggaaagcguuaaauccuuuuucuaugggcuuaagaacaugcugggcucuguguuuggaaauuucuucgucggcauccuccuguuucuggcuccuuucgugcuucucgcccuguuuuucauuuuuggguggaagauccuguucugcuuuaaauguugcagacgcacacggggacucuucaaguacagacaucugaaagacgaugaggaaaccggcuaucggaagaucauugagcgccuuaacagcaaaaaggggaagaauagacugcucgacggagagcggcuggcggauagaaaaaucgccgaacuguuuucuacaaagacccacauuggc

SEQ ID NO: 13934 - RNA, 2916 nt, Artificial Sequence
  derived and/or modified CDS sequence (opt5) from CCHFV(Ast137, Artificial)__KX056057.1__Gn-4aa-Gc
agcgaggaacccggcgacgauugcaucuccagaacccagcugcucaagacagagacggccgaaauucacgacgauaacuacgggggaccuggcgacaaaaucaccauuuguaaugggucuacaaucguggaucaacggcugggaagcgagcuuggcugcuauaccauuaaccgcgucaaguccuucaaacugugugaaaauucugcuacagggaagaccugcgagaucgacagcacaccgguuaaauguagacagggauuuugccucaagaucacccaggagggccggggccaugugaagcugucccgcgggucugaagugguccuugaugccugugacagcuccugcgagauuaugauccccaaaggaacgggcgauauucugguggacuguagcgggggacagcaacacuuccucaaggauaaccugaucgaccugggcugcccucauauuccccuccuggggaaaauggcgauccacauuuguagaaugucuaaucauccucggaccacaauggcuuuucuuuucugguuuuccuucggauacguuauuaccugcaucuuuugcaaggcccuguucuauagccucauuaucauuggcacacugggcaaaaagaucaagcaguaccgcgaacuuaaaccccagaccuguacgauuugcgagacagccccugugaacgcuaucgaugccgagaugcacgaccugaauuguucuuauaacaucugcccguacugugcuuccagacucaccagcgacgggcuggcccggcacgucacacagugccccaagcgcaaagaaaagguggaggaaaccgagcuguaucucaaucuggaaagaaucccuuggaucguucggaaacuucugcaagugucugaguccaccggagucgcgcucaagcgcagcuccuggcugauugugcuucuggugcuccugacagucucucugagccccguucaguccgccccugugggcagaaaaccccucuuucuggauagcaucgugaaggggacgaagaaccuucuuaauucuaccucccucgagacaagccugucuauugaagcuccguggggagccaucaacguccagagcaccuucaaaccuacaguguccaccgcuaauaucgcccuuucuuggagcuccguugagcaucggggcaacaagauucuggugacggggcgcagcgaaucuaucaugaaacucgaggaaagaacaggagucuccugggaccugggcguggaggaugcgagcgagucuaagcugcucaccguuuccauuauggaccugagccagauguacucccccguguuugaauaccuuucuggcgaucggcaagucgaggaauggccuaaagccaccuguacaggggacugccccgagagauguggaugcaccagcuccacaugucugcacaaggaauggccccauucucgcaauuggcggugcaacccuacguggugcuggggcguggggaccggauguacaugcuguggcgucgaugugaaggaccucuucaccgaucacauguuuaucaaauggaagguugaguauauuaaaacagaggcuaucgugugcgucgaacugaccagccaggagagacaguguucccugauugaagccgggacgcgcuucaaccuuggcccggugaccaucacacucagcgagccccggaauauccaacagaagcugccucccgagauuaucacccugcacccuaaaauugaagagggauucuuugaccucaugcauguucagaaggugcugucugcuuccacagucugcaagcugcagagcuguacccacggcauccccggggaucugcaaauuuaccauaucggaaaccuccugaaaggcgacagacugaaugggcaccuuauccauaagauugaaccgcacuucaacacgucuuggauguccugggacggaugcgaucucgacuauuacuguaauaugggcgauuggccuagcugcacauauaccggggugacacagcacaaccaugccgccuuugugaaucugcugaacaucgagaccgacuacaccaaaacauuccacuuucauucuaagcgcguuacggcucacggcgauacaccccagcucgaccugaaagcgcggccuaccuauggagccggcgaaauuaccguccuuguggagguggcugauauggagcugcacacaaagaaggucgaagugagcgggcucaaauucgccucccuggccuguaccggaugcuacgcuugcagcucuggcaucuccuguaagguucgcauucauguggacgagcccgaugaacugacgguccacgugaaaagcuccgacccugauguuguggccgcgucuacaagccuuauggcuagaaagcucgaguuugggaccgacuccaccuucaaagccuuuucugccaugcccaagacaagccugugcuucuacaucgucgaacgggaguauuguaaauccugcucugaggaugacaccaagaaguguguggacacaaaacuggaacagccgcaaagcauccucauugagcauaagggaacgaucauuggcaaacagaaugauaccugcacagcuaaggccuccuguuggcuggaaagcguuaaauccuuuuucuacgggcuuaagaacaugcugggcucuguguuuggaaauuucuucgucggcauccuccuguuucuggcuccuuucgugcuucucgugcuguuuuucauuuuuggguggaagauccuguucugcuuuaaauguugcagacgcacccggggacucuucaaguauagacaccugaaagacgaugaggaaacaggcuaccggaagaucauugagcgccuuaacagcaaaaaggggaagaauagacugcucgacggagagcggcuggccgauagaaaaaucgcggaacuguuuucuaccaagacgcauauuggc

SEQ ID NO: 13935 - RNA, 2916 nt, Artificial Sequence
  derived and/or modified CDS sequence (opt5) from CCHFV(Ast133, Artificial)__KX056060.1__Gn-4aa-Gc
agcgaggaacccgacgaugacugcaucuccagaacccagcugcucaagacagagacggccgaaauucacgaugacaacuacggcgggccuggagauaaaaucaccauuuguaauggcucuacaaucguggaccaacggcuggggagcgagcuuggaugcuauaccauuaaccgcgucaaguccuucaaacugugugaaaauucugcuacaggcaagaccugcgagaucgauagcacaccgguuaaauguagacagggguuuugccucaagaucacccaggagggacggggccaugugaagcugucccgcggcucugaagugguccuugacgccugugauagcuccugcgagauuaugauccccaaagggacgggagacauucugguggauuguagcggcgggcagcaacacuuccucaaggacaaccugaucgaucugggaugcccucauauuccccuccugggcaaaauggcgaucuacauuuguagaaugucuaaucacccucggaccacaauggcuuuucuuuucugguuuuccuucggguauguuauuaccugcaucuuuugcaaggcccuguucuaccuccugauuaucauuggaacacuuggcaaaaagaucaagcaguaucgcgaacugaaaccccagaccuguacgauuugcgagacagccccugugaacgcuaucgacgccgagaugcaugaccucaauuguagcuacaacaucugcccguauugugcuucuagacugaccuccgauggccuggcccggcacgucacacagugccccaagcgcaaagaaaagguggaggaaaccgagcucuaccugaaucuugaaagaaucccuuggaucguucggaaacugcuccaagugagcgagucuaccggggucgcgcugaagcgcuccagcuggcuuauugugcugcucgugcugcugacagucucccucucucccguucagagcgccccugugggaagaaaaccccuguuuuccgacagcaucgugaagggcaugaagaaccuucuuaauucuacgucccucgagaccagccugucuauugaagcuccguggggagccaucaacguccagagcacauucaaaccuaccguguccacagcuaauaucgcccuuucuuggagcuccguugagcaccggggaaacaagauucuggugaccggccgcagcgaaucuaucaugaaacucgaggaaagaacgggggucuccugggaucugggaguggaggacgcgagcgagucuaagcugcucacaguuuccauuauggaucugagccagauguacucccccguguuugaauaucuuucuggcgaccggcaagucgaggaauggccuaaagccaccuguaccggcgauugccccgagagaugugggugcacaagcuccaccugucugcauaaggaauggccccacucucgcaauuggcggugcaacccuacauggugcuggggagugggcacgggguguaccugcuguggagucgacgugaaggaucucuucacagaccauauguuuaucaaauggaagguugaguacauuaaaaccgaggcuaucgugugcgucgaacugacaagccaggagagacaguguucccugauugaagccggcacccgcuucaaccuugggccggugacgaucacccucagcgagccccggaauauccaacagaagcugccucccgagauuaucacacugcacccuaaaauugaagagggcuucuuugaucucaugcacguucagaaggugcugucugcuuccaccgucugcaagcugcagagcuguacacauggaauccccggcgaccugcaaauuuaucacaucgggaaccuccugaaaggagacagagugaauggccaucugauccacaagauugaaccgcauuucaacaccucuuggauguccugggaugggugcgaccuugauuacuauuguaauaugggagacuggccuagcugcacguacacaggcgugacccagcacaaccacgccgccuuuguuaaucuccugaacaucgagacagauuauaccaaaaccuuccauuuucacucuaagcgcgucacagcucauggggacacgccccagcuggaucucaaagcgcggccuaccuacggcgccggagaaauuacagugcugguggaggucgcugacauggagcuucacaccaagaagguggaaaucagcggccugaaauucgccucccucacauguaccgggugcuacgccugcagcucuggaauuuccuguaagguuagaauccacguggaugagcccgacgaacugacgguccaugugaaaagcuccgauccugacguuguggcugccucuacaagccugauggcgcgcaaacuugaguuuggcaccgauuccaccuucaaggcuuuuucugccaugcccaagacaagccucugcuucuauaucgucgaacgggaguacuguaaauccugcucugaggacgacaccaagaaguguguggauacaaaacuggaacagccgcaaagcauucugaucgagcacaaggggacgauuaucggaaaacagaaugauaccugcacagccaaggcuuccuguuggcucgaaagcguuaaauccuuuuucuauggccugaagaacaugcuugggucuguguuuggcagcuucuucgucgggauucugcucuuucuggccccuuucgugcugcuugugcucuuuuucauguuuggcuggaagauccuguucugcuuuaaauguugcagacgcacccgggggcuguucaaguacagacaucucaaagacgacgaggaaacaggauaucggcgcaucauugagagacuuaauucuaagaaaggcaagaaccggcugcuggauggggagagacucgcugaccgcaagaucgccgaacuguuuuccagcaaaacccacauugga

SEQ ID NO: 13936 - RNA, 2916 nt, Artificial Sequence
  derived and/or modified CDS sequence (opt5) from CCHFV(SK/2015/human, Artificial)__KX458183.1__Gn-4aa-Gc
agcgaggaauccggcgacgauugcaucucuagaacccggcugcuccgcacagagacggccgaaauucacggggacagcuacggaggccccggggauaagaucaccauuuguaacggauccacaaucguggaccagagacugggcucugagauggggugcuauaccauuaaucgggucaagagcuucaagcugugugaaaacuccgcuacaggaaaaucuugcgagaucgauagcaucccuguucgcuguagacaaggcuacugccugaagauuacccaggagggccgggggcaugugaaacucucccgcggaagcgaagugguccuggacgccugugauucuuccugcgaggugaugaucccgaagggcacaggggacauucuuguugauuguagcggaggccagcagcacuuucugaaggacaaucucaucgaucuggggugccccaacauuccucugcucggaaaaauggcgaucuauauuuguagaaugucuaaucaucccaagaccacgauggcuuuccuguuuugguucuccuuuggcuacgugauuaccugcauccuuugcaaagccaucuucuaucugcucaucauugucggcacacuggggaagcgguuuaaacaauaccgcgaacuuaagccucagaccuguacaaucugcgagaccacgcccgccaacgcuauugacgccgagaugcacgaucugaauuguagcuauacaaucugcccuuacugugcuucuagacucaccuccgacggacuggcccggcaugugacacagugcccgaagcgcaaagaaaagguugaggaaaccgagcuguaccucaaccuggaaagaauccccugggugguccggaaacuucuucaggugagcgaguccaccggcguggcgcucaagcgcucuagcuggcugauuguccuucugguucucuucacagugucccugagcccugugcaaucugcccccaucgggagacggccucuguuucucgacuccauugucagaggaaugaaaaaucugcuuaacagcacgucucuggagaccagccucuccaucgaagcucccuggggcgccauuaaugugcagucuacauauaagccgaccguuagcacagcuaacaucgcccuguccuggagcucuguggagcaccgcgggaauaaaauccuugucuccggacggagcgaaucuauuaugaagcuggaggaaagaaccggcguguccugggaucucggcguugaggacgcgagcgaguccaagcugcugacggugucugucauggaucucagccagauguacuccccuguguucgaauaucugucuggggaccgccaggucgaggaauggcccaaagccacauguaccggagauugcccugagcgguguggcugcaccacaagcaccugucuucacaaggaauggccccauuccagaaacuggcgcugcaaucccacauggugcuggggaguggggacgggcuguaccugcugugggcuggacguuaaagaucucuuuacagacuacauguucgugaaguggaaagucgaguauaucaagaccgaggcuauugugugcguugaacugacaagccaaggccggcaguguucucugaucgaggccggaaccagauuuaaccuuggcuccgugacgauuacccucagcgaaccucgcaacauccagcacaagcugccgcccgagauuaucacacugcauccucggaucgaggaaggguucuucgaucucaugcacguccaaaaagugcugucugcuuccaccgugugcaaacuucagagcuguacacacggaguucccggcgaccugcaggucuaccauauugggaaucuccugaaaggagauaaggugaacggccaccugauccauaaaauugagccucacuuuaauaccucuuggaugagcugggacgggugcgaccuugauuauuacuguaacaugggcgacuggcccuccugcacguacacaggagugacccagcauaaucacgccagcuucgucaaccuccugaauaucgaaacagauuauaccaagaacuuucacuuccauucuaagagagugaccgcccacggcgacacaccgcaacuggaucucaaagcucgcccuacguacggggcgggagagauuaccguucugguggaagucgccgacauggagcuucauacaaagaaaaucgagaucuccggccugaaguuugcuagccucaccuguacagggugcuaugccugcuccucuggaauuagcuguaaagugcggauccacguugaugaacccgacgagcugaccgugcacgucaaguccgaugacccugaugugguugccgcuucuagcucccugauggccagaaaacuugaguucggcacggacucuacauuuaaggcguucagcgcuaugcccaagaccucccucugcuuuuacauuguggaacgggaauauuguaaaagcugcucuaaggaggauacccagaaaugugucaauacaaagcuggagcagccucaguccauccugauugaacaucgcgggaccaucaucggcaaacaaaacaauacaugcauugccaaggccagcuguuggcucgagucugugaaguccuucuuuuacggacugaaaaacaugcuuagcggcaucuucgggaaucuguuucucggaauuuuccuguuccuggcucccuuuauccuucucauucuguucuuuauguucggcuggagaauccuguuuugcuucaaguguugccggagaacgcgcgggcucuuuaaauaucggcaccugaaggacgacgaagagaccggauacagacgcaucauugaaagacuuaacaauaaaaagggcaagaacaaacugcucgauggggagcggcuggccgaccgcagaaucgcugagcuguucucuacaaagacccauauuggc

SEQ ID NO: 13937 - RNA, 2916 nt, Artificial Sequence
  derived and/or modified CDS sequence (opt5) from CCHFV(YL16070, Artificial)__KY354081.1__Gn-4aa-Gc
gccgagggcgggagcuccgacugcaucucuagaacccagcuggugaagacagaagucgcugagauucacgaagauagcuacggaggccccggggagaaaaucacgauuuguaacggauccaccaucguugaccaacggcucggcucugaacuggggugcuauacaauuaaucgcgucaagagcuacaaacuuugugagaacuccgccucuggaaagagcugcgagaucgauuccaucccugugaaauguaagcagggcuucugccugaagauuacccaggaaggcagagggcaugugaaacucagccggggaacagagaucgugcuggacguuugugauucuuccugcgaacuuaugauuccgaagggcaccggggacauccugguggauuguagcggaggccagcaacacuuucuccagaauaaccugauugaccuggggugccccaaugucccucuccugggaaaaauggcgaucuaugugugucgcaugucuaaccaucccaagacaaccauggcuuuccucuuuugguucuccuuuggcuacguuauuacgugcaucgugugcagaguccuguucuaucuccugaucgccauuggcaccguggggaaaaagcugaagcaguaccgggagcugaaaccucagacauguaucgugugcgagagcguccccguuaaugccauugaugcugaaaugcacgagcucaacuguucuuauaauaucugcccuuacugugccucccgccugagcaccgacggacugauuagacaugugacacaaugcccgaagcggcgcgaaaaaguggaggaaaccgagcucuuucugaaccuugagagaauccccuggcugguccggaagcuccuucagguguccgaaucuacgggcauggcucuuaaacgcagcuguuggaugaucacacugcucauucugcugcucguuuccaugagcccugugcagucugcccccgucgggagaaagccucuguuccuugauuccaucgcgaaaggaaugaaaagccugcucaauucuaccagccuggagacaucccuuucuauugaagcccccuggggcgcuaucaacgugcagagcaccuuuaagccgaccguuuccgccgcuaauauugcccugagcuggucuuccguggagcaccgggggaacaagauccucgucagcggacgcucugaauccaucaugaagcuggaggagagaacaggcgugagcuggaaucugggcgucgaagacgcguccgagucuaaaacgcucaccgugagcguuauggaucugucccaaauguacucuccuguguucgaauaucuuagcggggaccggcaggucgaggaauggcccaaggccacaugcaccggagacuguccugagagaugcggcuguacauccucuaccugccugcacaaagaguggccccauagccgcaacuggcggugcaaccccacgugguguuggggaguggggacaggcugcaccuguugcgggcucgauguuaaggacuuuuucaccgauuacaugcuggugaaguggaaagucgaauauauuaagacagaggcuaucguguguguggaacugaccucccaggagagacaaugcagccuuauugaggccggcacacgcuuuaaucucggaccuguuacgaucacccugucugaaccgcggaacguccagcagagacugcccccugagauugugacacuccaccccaaaaucgaagagggcuucuucgaccugaugcaugugcagaagauucuuuccgcuagcaccgucuguaaacugcaaucuugcacacacggggugccuggagauuuucagguuuaccacgugggcaaucuccugcgcggggacaaggucaacggacauagcauccacaagaucgaaccccauuucaauaccuccuggaugagcugggauggcugugaccuggauuauuuuugcaacaugggggacuggccgucuuguacguacaccggcgugacacagcacaaucgggccgccuucauuaacaugcuuaauaucgagaccgauuauacaaaaaccuuucauuuccacuccaagagaguuacggcucacggagacacaccucagcucgaccugaaagcgcgccccgccuacggcgcuggggaggugaccguccugguggaaguugccgaucucgagcugcauacaaagaaacuugaagugagcggacugaagauugccucccuuaccugcucuggcugcuacgcuuguagcuccgggaucucuugcaagguccggauucacgugaacgagccugacgaauuuaccgugcaugucagaagcuccgaucccgacguuguggccgcgggaucuagccugauggcucgcaaaaucgaguucggcgccgauuccacauuuaaggccuucagcucuaugccuaaagacucccuguguuuuuauaucguggagaaggauuacugcagcucuuguacggacgaugacacccaaaaaugcgucaauacaaaacuugaucacccccaguccauucucaucgaacacaaggggaccauuaucggcaagcagaacgacacauguagcaccaagacgucuugcuggcugaaauccuucaagggauuuuucuauggccugaaaaauaugcucagcgggauuuucggaaacguguuucugggcauccuucuguuccucgcuccguuuguucugcugaucuucuuuuucuuuuucggguggcggcuucucuuuugucugaagugcuguaaaaagacaaagggacugcucaaauacaagcaucugaaagauaaggaggaagccggcuauaaaaagauuaucgagagacuuaaugggaagaaaggcaagucccagcuguucgacggagaacggcucgcuaaccgcaaaauugccgagcuguuuagcaccaagauccacauuggc

SEQ ID NO: 13938 - RNA, 2916 nt, Artificial Sequence
  derived and/or modified CDS sequence (opt5) from CCHFV(Oman_812956, Artificial)__KY362518.1__Gn-4aa-Gc
agcgaggaauccggcgaggacugcaucucuagaacccagcugcuccggacagaaacggccgagauucacggggauaacuacggaggccccggggacaagaucaccauuuguaauggaagcacaaucguggaucaacgccugggcuccgaacuugggugcuauaccauuaacagagucaaaucuuucaagcugugugagaauagcgcuacaggaaaauccugcgagaucgacaacaccccuguuaaguguaaacagggcuuuugccucaagaucacacaggaaggccgggggcaugugaagcugucucgcgauagcgaggugguccuugacgccugugauuccagcugcgaaauuaugaucccgaaaggaaccggcgacauucugguggauuguucugggggacagcaacacuuccucaaggacaaucugaucgaucugggcugccccaacauuccucuccuggggaaaauggcgaucuacauuuguagaauguccaaucaucccaagacgaccauggcuuuucuuuucugguuuagcuucggauauguuaucacaugcauccugugcaaagugaucuuuuaccuccugauugucgugggcacccuuggcaagaaguucaaacaguaucgggagcugaagccucagacauguaccauuugcgagacgacacccguuaacgccaucgacgccgaaaugcacgaucucaauuguucuuacaacauuugcccuuauugugcuucccgccugaccagcgacgggcuggccagacaugugaugcagugcccgaaacggaaggagaaaaucgaagagacagaacucuaccugaaucuugagcgcauccccugggucgugagaaagcugcuccaagugucugaguccaccggagucgcucugaaacggagcuccuggcuuauuguucugcucgugcugcugaccgugucucucagcccuguccaguccgcccccaucggccgcaagccucuguuuuucgacagcauugcgaaggggaugaaaaaccuucucaauucuacaucccuggaaacgagccugucuaucgaggcccccuggggagcuauuaacgugcagagcaccuuuaagccgacaguuuccaccgccaauaucgcucuuucuuggagcuccguggaacacagaggcaacaaaauccuggucagcgggcggucugaguccauuaugaagcucgaggaacgcacaggaaucagcugggaucugggcguggaggacgccucugaauccaaacugcucaccguuagcgugauggaucugucccagauguacucuccugucuucgaguaucuuagcggcgacagacaaguggaagaguggcccaaggcgacguguacaggggauugcccugaacgguguggaugcaccuccucuaccugucugcacaaggaguggccccauagcagaaacuggcgcugcaaucccacauggugcuggggcgucgggaccggauguacaugcuguggccucgacgugaaagaucuguuuacggacuacauguucguuaaguggaaaguggaguauauuaagaccgaagccaucgucugcguggagcugacaucccaggaacggcaguguagccuuauugaggcugggaccagauucaaccucggcccuguuacaaucacccugucugagccgcgcaauauucaacagaaacugcccccugaaaucgugacgcuccacccccggaucgaggaaggauuuuucgaucugaugcauguccagaaggugcuuuccgccagcaccgugugcaagcugcagucuuguacacacggcguuccuggggaccuccaagucuaccacauuggaaaccugcugaaaggcgauaaggugaaugggcaucuuauccacaaaguggagccccauuuuaacaccuccuggaugagcugggacggaugcgaccucgauuauuacuguaauaugggcgacuggccgucuugcacauauaccggggucacgcagcacaaccaugcugccuucgugaaucugcugaacauugaaacagauuacaccaagaauuuucacuuccacagcaaaagaguuacagcccauggcgacaccccucagcucgaucugaaggcucgccccaacuacggagcgggcgagaucaccgugcuugucgagguggccgacauggaacugcacacaaagaaaauugagaucuccgggcucaaguuugcuagccugacguguaccggaugcuaugccuguucuuccggcaucagcugcaaaguucggauucauguggaugaaccugacgagcugacaguccacgugaaguccgaagaucccgacaucguugccgcuucuagcucccuuauggccagaaaacucgaguucgggaccgauucuacauuuaaggcguucagcgcuaugccuaaaaccucccugugcuuuuacauuguggagcgcgaauauuguaagucuugcagcaaggaggacacgcagaaaugugucaaugccaagcuggaacggccccaauccauccucauugagcacaaaggaacaaucaucggcaagcagaacgauaccugcaccgccaaagcuagcuguuggcuggaaucugugaaguccuucuuuuacgggcuuaagaauaugcugagcggcauuuucggaaacguguucaucggcauuuuucucuuccuggccccguuuauccugcuuauucucuucuuuauguucggguggagaauccuguuuugcuucaaauguugccgccggacaagaggacuguuuaaguaucggcaucucaaagacgacgaggagaccggcuaccgcaagaucauugaaagacugaacaauaaaaaggggaagaacaaacuucuggauggagagcggcucgcugacagaaagaucgccgaacuguucucuacaaaaacgcacauuggc

SEQ ID NO: 13939 - RNA, 2916 nt, Artificial Sequence
  derived and/or modified CDS sequence (opt5) from CCHFV(UCCR4405, Artificial)__KY484029.1__Gn-4aa-Gc
agcgaggaacccggcgacgauugcaucuccagaacccagcugcucaagacagagacggccgaaauucacgacgauaacuacgggggaccuggcgacaaaaucaccauuuguaaugggucuacaaucguggaucaacggcugggaagcgagcuuggcugcuauaccauuaaccgcgucaaguccuucaaacugugugaaaauucugcuacagggaagaccugcgagaucgacagcacaccgguuaaauguagacagggauuuugccucaagaucacccaggagggccggggccaugugaagcugucccgcgggucugaagugguccuugaugccugugacagcuccugcgaggugaugauucccaaaggaacgggcgauauccugguugacuguagcgggggacagcaacacuuccucaaggauaaccugauugaccugggcugcccucauaucccccuccuggggaaaauggcgauuuacaucuguagaaugucuaaucacccucggaccacaauggcuuuucuuuucugguuuuccuucggauaugugauuaccugcaucuuuugcaaggcccuguucuacagccucaucauuaucggcacacugggcaaaaagauuaagcaguaucgcgaacuuaaaccccagaccuguacgaucugcgagacagccccugucaacgcuauugaugccgagaugcaugaccugaaguguucuuacaauaucugcccguauugugcuuccagacucaccagcgacgggcuggcccggcacgugacacagugccccaaacgcaaggaaaaaguugaggaaaccgagcuguaccucaaccuggaaagaaucccuuggauugugcggaaacuucugcaagucucugaguccaccggaguggcgcucaaacgcagcuccuggcugaucgugcuucugguccuccugacaguuucucugagccccgugcaguccgccccugugggcagaaagccccucuuucuggauagcacggucaaggggaugaaaaaucuucugaacucuaccucccucgagacaagccugucuauugaagcuccguggggagccaucaaugugcagagcaccuucaagccuacaguuuccaccgcuaacauugcccuuucuuggagcuccguggagcaccggggcaauaaaauccuggucacggggcgcagcgaaucuaucaugaagcucgaggaaagaacaggaguguccugggaccugggcguugaggaugcgagcgagucuaaacugcucaccguguccauuauggaccugagccagauguacucccccgucuuugaauaucuuucuggcgaucggcaaguggaggaauggccuaaggccaccuguacaggggacugccccgagagauguggaugcaccagcuccacaugucugcauaaggaauggccccacucucgcaacuggcggugcaauccuacguggugcuggggcgucgggaccggauguacaugcuguggcguggauguuaaagaccucuucaccgaucauauguuugugaaguggaaagucgaguacaucaagacagaggcuauugugugcguugaacugaccagccaggagagacaguguucccugaucgaagccgggacgcgcuucaaccuuggcccggugaccauuacacucagcgagccccggaacauccaacagaaacugccucccgagauuaucacccugcacccuaagaucgaagagggauucuuugaccucaugcacguccagaaggugcugucugcuuccacagugugcaaacuucagagcuguacccauggcauucccggggaucugcaaaucuaucacauuggaaaucuccugaagggcgacagaguuaacgggcaucugauccacaaaauugaaccgcauuucaauacgucuuggauguccugggacggaugcgaucuugacuacuauuguaacaugggcaauuggccuagcugcacauacaccggggucacacagcacaaccacgccgccuuugugaaucuccugaacaucgagaccgauuauaccaagacauuccauuuucacucuaaacgcgugacggcucauggcgacacaccccagcuggaucucaaggcgcggccuaccuacggagccggcgaaaucaccguccugguggagguugcugacauggagcuucacacaaagaaaguggaaauuagcgggcugaaguucgccucccucgucuguaccggaugcuacgccugcagcucuggcaucuccuguaaagugcgcauucacguugaugagcccgacgaacugacggugcaugucaagagcuccgauccugacgugguugcugccucuacaagccugauggcgagaaaacuugaguuugggaccgauuccaucuucaaggcuuuuucugccaugcccaaaaccagccucugcuucuauauuguggaacgggaguacuguaaguccugcucugaggacgauacaaagaaaugugucgacaccaagcuggaacagccgcaaagcauccugaucgagcacaaaggaacaauuaucggcaagcagaaugacacgugcaccgccaaggcuuccuguuggcucgaaagcgugaaguccuuuuucuaugggcugaagaacaugcuuggcucuguguuuggaaauuucuucgucggcauucugcucuuucuggccccuuucguucugcuugugcucuuuuucauguuuggguggaaaauccuguucugcuuuaaguguugcagacgcacacggggacuguucaaauacagacaucucaaggaugacgaggaaaccggcuaucggcgcauuaucgagagacugaacagcaaaaaggggaagaaucggcuucuggauggagagagacucgcugaccgcaaaaucgccgaacuguuuucuacaaagacccacauuggc

SEQ ID NO: 13940 - RNA, 2916 nt, Artificial Sequence
  derived and/or modified CDS sequence (opt5) from CCHFV(UCCR4401, Artificial)__KY484035.1__Gn-4aa-Gc
agcgaggaacccuccgacgauugcaucucuagaacccagcugcuccggacagagacggccgaaauucacggcgacaacuacgggggaccuggcgauaagaucaccauuuguaaugggagcacaaucguggaccaacgccugggauccgagcuuggcugcuauaccauuaacagaguccggucuuucaaacugugugaaaauagcgcuacagggaagaacugcgagaucgauuccguuccggugaaaugucgccagggauacugccucagaaucacccaggagggccggggccaugugaagcugucucgcgggagcgaagucgugcuugacgccugugauacauccugcgagauuaugauccccaaaggaaccggcgacauucugguugauuguagcgggggacagcaacacuuucucaaggacaaucugaucgaucugggcugcccuaagauuccccuccuggggaaaauggcgaucuauauuuguagaaugucuaaccauccuaagacgaccauggcuuuccuguuuugguucuccuuuggauacgugaucacaugcauccuuugcaaagccauuuucuaucuccugaucauugucggcacccuuggcaagcggcugaaacaguaccgcgaacucaagccccagacauguaccaucugcgagacgacaccugugaaugccauugacgcugagaugcacgaucugaacuguagcuauaauaucugcccguacugugccucuagacugaccuccgacgggcucgcucggcauguuauccagugccccaagcgcaaagaaaagguggaggaaacagagcuguaccuuaaccuggaacggauuccuugggucgugagaaaacuccugcaagugagcgagucuaccggagucgcccuuaagcgcuccagcuggcugaucguucuccuggugcuguuuaccgugucccucucucccguccagagcgcgccuauuggcagaaaaccccuguuccuugacuccacagccaaggggaugaaaaaucugcucaacagcacgucucuggagaccucccuuagcaucgaagcuccguggggagccauuaaugugcagucuacauauaagccuaccguuagcacagcuaacaucgcccuguccuggucuagcguggagcaccggggcaauaagauccucgucuccgggagaagcgaaucuauuaugaaacuggaggaacgcaccggaaucuccugggaucugggcguggaggacgcgagcgagucuaagcuccugacgguuuccgugauggaucuuagccagauguacucccccgucuuugaauaucugucuggcgaccggcaaguggaggaauggccuaaagccacauguaccggggauugccccgagagauguggaugcaccagcuccacaugucuccacaaggaauggccccauucucgcaacuggcggugcaacccuaccuggugcuggggcgucgggacaggauguacgugcuguggccuggacgugaaagaucuguucaccgacuacauguuuguuaaguggaagguggaguauauuaaaacagaggcuaucgucugcguggaacuuaccagccaggagagacaguguucccucauugaagccgggacacgcuucaaucugggcccgguuaccaucacgcugagcgagccccggaacauucaacagaagcucccucccgagaucaucacccugcacccuagaauugaagagggauuuuucgaucuuaugcaugugcagaaaguccugucugcuuccacagugugcaagcuccagagcuguacccacggcgugcccggggaccugcaaguuuaccacaucggaaaucugcuuaaaggcgauaaggucaacgggcaucucauucacaagaucgaaccgcauuucaauacaucuuggauguccugggacggaugcgaccuggauuauuacuguaacaugggcgacuggccuagcugcaccuacacgggggugacacagcacaaucaugccucuuuugugaaccugcucaauauugagaccgauuauaccaaaaacuuccacuuucacagcaagcgcgucaccgcccauggcgacacaccccagcuggaucuuaaagcucggccuacauacggagcgggcgaaaucacggugcugguugagguggccgacauggagcuccacaccaagaaaaucgaaauuuccgggcugaaguucgcuagccuggccuguacaggaugcuaugccugcucuagcggcaucagcuguaagguccgcauucauguggaugagcccgacgaacuuaccguucacgugaaauccgaugacccugaugucguggcugccucuagcucccucauggcgagaaagcuggaguuugggacagacucuaccuucaaggcuuuuagcgccaugcccaaaacgucccugugcuucuacaucguugaacgggagcacuguaaaucuugcagcgaggaagauacaaagaaaugugugaauaccaagcucgagcagccgcaauccauucugaucgaacauaagggaaccaucauuggcaaacagaacagcacaugcaccgccaaggcuucuuguuggcuugaguccgucaaauccuuuuucuaugggcugaagaauaugcucucuggcaucuuuggaaacguguucaugggcauuuuucuguuccuggccccuuucauccuucucauucuguuuuucauguuuggguggagaauccuguucugcuuuaaauguugccggcgcacaagaggacucuucaaguaccggcaccugaaggacgacgaagagacgggcuauagacgcaucauugagaaacuuaauaacaagaaagggaagaacaaacugcucgauggagaacggcuggcugacagacgcaucgccgagcuguuuuccaccaagacacauauuggc

SEQ ID NO: 13941 - RNA, 2916 nt, Artificial Sequence
  derived and/or modified CDS sequence (opt5) from CCHFV(UCCR4448, Artificial)__KY484042.1__Gn-4aa-Gc
agcgaggaaaccuccgacgauugcaucucuagaacacagcugcuccggacggagaccgccgaaauucacggcgacaacuacgggggacccggcgauaagaucacaauuuguaaugggagcaccaucguggaccagcgccugggauccgagcuuggcugcuauacaauuaacagagucaaaucuuucaagcugugugaaaauagcgcuaccgggaaauccugcgagaucgauucuguuccugugaagugucggcagggauacugccuccgcaucacacaggagggcagaggccaugugaaacugagccggggguccgaagucgugcuugacgccugugauaccagcugcgagauuaugaucccgaagggaacgggcgacauucugguugauuguucugggggacagcaacacuuucucaaggacaaccugaucgaucugggcugccccaaaauuccucuccuggggaagauggcgaucuauauuugucgcauguccaaucaucccaaaaccacaauggcuuuccuguuuugguucagcuuuggauacgugauuaccugcauccugugcaaggccaucuucuaucuccugaucauuaucggcacacuuggcaaaagauuuaagcaguaccgggaacugaagccucagaccuguacgauuugcgagacaacccccgucaacgccaucgacgcugagaugcacgaucucaauuguucuuauaacaucugcccuuacugugccucccgccugacaagcgacgggcuggcuagacaugugacccagugcccgaaacggaaggaaaaaguugaggaaaccgagcucuaccugaaucuugaacgcauucccuggguggucagaaagcugcuccaagugucugaguccacaggaguggcccugaaacggagcuccuggcuuaucguccugcucguucuguucacgauuucucugagcccugugcaguccgcgcccaucagccgcaagccucucuuucuggacucuauugugaaaggcaugaagaaccuucuuaauuccaccagccucgagacaucucugagcaucgaagcccccuggggagcuaucaacguccaguccaccuauaagccgacagugucuaccgccaauauugcucuuagcugguccagcguugagcacagagggaacaaaauccuggugucuggccgguccgaaagcauuaugaagcucgaggaaaagacggggaucucuugggaucugggagucgaggacgccuccgagagcaagcugcucacaguguccguuauggaucugucucagauguacagcccuguguucgaauaucuuuccggcgacagacaagucgaggaauggcccaaagcgaccuguaccggcgauugcccugagcgcugugggugcacaucuagcaccugucugcacaaggaauggccccauucccggaauuggagaugcaaccccacauggugcuggggagugggcacgggguguaccugcuguggacucgacgucaaggaucuguuuacagacuacauguucgugaaauggaagguugaguauauuaaaaccgaggccaucgugugcgucgaacugacaagccaggagcgccaguguucucuuauugaagcuggcacccgguuuaaccucgggccugugacgaucacccuguccgagccgagaaauauccaacagaagcugcccccugagauuaucacacuccacccccgcauugaagagggcuucuucgaucugaugcauguucagaaagugcuuagcgccucuaccgucugcaagcugcaguccuguacacacggagugccuggcgaccuccaaguguaccacaucgggaaccugcugaagggagauaaaguuaauggccaucuuauucacaagaucgaaccccauuuuaacaccagcuggaugucuugggacgggugcgaccucgauuauuacuguaauaugggagacuggccgagcugcacguacacaggcgucacccagcacaaccaugcuuccuucgugaaucugcugaacaucgagacagauuauaccaaaaauuuucacuuccacagcaagcgggugaccgcccauggggacacaccucagcucgaucugaaagccagacccacguacggcgcuggagaaauuaccguccuuguggagguugcggacauggagcugcacacaaagaagaucgaaauuucuggccucaaauuugccucccugaccuguacagggugcuaugcuugcagcuccggaaucucuuguaaggugcgcauucaugucgaugagccugacgaacugaccgugcacguuaaaagcgaugaccccgauguggucgccgccuccucuagccuuauggcucggaagcucgaguucggcacggacuccacauuuaaagccuucucugcgaugccuaagaccagccugugcuuuuacaucguggaaagagagcacuguaaauccugcagcgaggaagauaccaagaaguguguuaacacaaaacuggagcagccccaaucuauccucauugaacauaaggggaccaucauuggaaaacaaaauuccacaugcacggcuaaggccagcuguuggcuggagucugugaaauccuucuuuuauggccuuaagaacaugcugagcgggaucuucggcaaugucuuuauuggaaucuuccucuuccuggccccguuuauccugcuuauucucuucuuuauguucggcuggaagauccuguuuugcuucaaauguugccgccggaccagagggcuguuuaaguaccggcaccucaaagacgacgaagagacaggauaucgcagaauuaucgagcggcugaacaauaagaaaggcaagaacaaacuucuggauggggaaauucucgcugacagacgcaucgccgagcuguucucuaccaaaacacauauugga

SEQ ID NO: 13942 - RNA, 2916 nt, Artificial Sequence
  derived and/or modified CDS sequence (opt5) from CCHFV(SPU 45/88, Artificial)__KJ682809.1__Gn-4aa-Gc
agcgaggaauccucugacgauugccugagcagaacccagcuccugcggacagagaacacggaaauccacuccgacaauuacggcgggcccggagauaagauuaccaucuguaacggcucuacaauuguggaccaacgccuugggagcgagcugggaugcuauaccaucaauagagugaaauccuucaagcucugugaaaacucugccacaggcaaaagcugcgagauugauuccaccccuguucggugucgccagggguuuugccugaagaucacacaggagggaagaggccaugugaaacuuagccggggcucugaagugguccuggacgcuugugauuccagcugcgagaucaugauuccgaaggggaccggagacauccucguggauuguucuggcgggcagcaacacuuccugaaggacaaucugguugaucucggaugccccaacauuccucugcuuggcaaaauggccaucuacauuugucgcauguccaaucaucccaagacgaccaugggguuucuguucugguuuagcuucggauaugugaucacaugcauucucugcaaagucaucuuuuaccugcuuaucgugguuggcacccugggcaagaaauucaagcaguauagagaacucaagccucagacauguaccauuugcgagacgacacccgugaacgcgaucgacgcugagaugcacgaucugaauuguucuuacaacauuugcccuuauugugccucccggcugaccagcgacgggcucgcccgccaugucaugcagugcccgaaaagaaaggagaaaaucgaagaaacagagcuguaccuuaaucuggaacggauucccuggaucgugcgcaagcuccugcaaguguccgagucuaccggagucgcucuuaaaagaagcuccuggcugguugugcuccuggugcugcucaccgucagccugucuccugugcaguccgcccccaucggccggaagccucuuuuucuggacagcauuguuaaagggaagaagaaccuccuuaauucuacaagccuggagacgucccugucuaucgaagcucccuggggagccauuaacgugcagagcaccuucaaaccgacagucuccgcggccaauaucgcucucagcuggucuuccguggagcaccgcggcaacaagauucugguuagcgggagaucugaauccaucaugaaacuggaggaacggaccggaaucagcugggaucucggcguggaggacgccuccgagucuaagcugcuuacagucagcgugauggaucugucccagauguacucuccugucuuugaauaucucagcggcgacagacaaguggaggaauggcccaaagcuaccuguacgggggauugcccugagcgcuguggaugcacauccagcaccugucugcacaaggaauggccccauucucggaacuggagaugcaaucccaccuggugcuggggcguugggacaggauguaccugcuguggccuggacgugaaggaucuuuucacagacuacauguuugucaaauggaagguggauuauauuaaaacggaggccaucguuugcguggagcucaccucccaggaacgccaguguagccugauugaggcggggacacgguucaaccugggcccugucaccaucacacucucugaaccgagaaauauucaacagaagcugcccccugagaucgugacccuucacccccgcauugaggaaggauucuuugaccugaugcaugugcagaacguucucuccgccagcacggucugcaaacugcagucuuguacccacggcgugccuggggaucugcaaaucuaccacaucggaaaucuucucaagggcgacaaggugaacgggcaucugauucacaaaaucgagccccauuucaauacaagcuggauguccugggacggaugcgaucuggacuauuacuguaacaugggcgauuggccgagcugcucuuauaccggggucacacagcacaaucaugcugccuuugugaacaugcucaauauugaaaccgacuacacgaagaacuuccacuuucacuccaaacggguuacagcucauggcgauaccccucagcuggaccuuaaggccagacccacauacggagccggcgagaucaccgugcuggucgaaguggcugauauggagcuccacaccaaaaagauugagaucagcgggcugaaguucgcgucccugacauguacgggaugcuaugccugcucuagcggcaucuccuguaaaguucgcauucauguggacgaaccugaugagcuuaccguccacgugaagucugaagaccccgauaucguugcugccagcuccucucucauggcccggaaacuggaguuugggacagacagcaccuucaaggcuuuuuccgccaugccuaaaacaagccugugcuucuacauuguggaaagagaguauuguaagucuugcuccaaagaggauacccagaagugugucaauacgaagcucgaacaaccccagagcauccugauugagcacaaaggaacaaucaucggcaagcagaacgauaccugcaccgcgaaagccucuuguuggcuugaauccgucaagagcuuuuucuacgggcugaaaaauaugcucucuggcauuuuuggaaacguguucaucggcauucugcuguuccuugcuccguuuaucaugcucauucuguucuuuauguucggguggcgcauccuguuuugcuucaaguguugccggagaacacggggacucuuuaaguaucgccaucugaaagacgacgaggaaaucggcuacagaaagauuaucgagcggcuuaacaauaaaaaggggaaaaacaagcugcucgacggagagagacuggccgaucgcaagauugcugaacuguucuccaccaaaacacacaucggc

SEQ ID NO: 13943 - RNA, 2916 nt, Artificial Sequence
  derived and/or modified CDS sequence (opt5) from CCHFV(3010, Artificial)__DQ019222.1__Gn-4aa-Gc
gccgagggcgugagcaacgacugcgucuccagaacccagcugaucaagacagaaguugcugagauucacgaagauucuuacgggggacccggcgagaaaaucacgauuuguaaugggagcaccaucguggaccaacggcucggauccgaacugggcugcuauacaauuaaccgcgugaagaccuacaaacuuugugagaauagcgccacagagaaggggugcgaaaucgauagcgucccugugaaauguaagcagggauucugccugaagguuacccaggagggcagaggccaugugaaacucucccgggggacagaaaucguccuggacgugugugauaccucuugcgagcuuaugauuccgaagggaacgggcgacauccugguugauuguagcgggggacagcaacacuuucuccaggacaaccugauugaucugggcugccccaaugugccucuccuggggaaaauggcgaucuauauuugucgcauguccaaccaucccaagaccacaauggcuuuccuguuuugguucagcuuuggauacgucauuaccugcauugugugcaaagugcuguucuaucuccugaucgucaucggcacacuuucuaagaagcugaaacaguacagagagcucaagccucagaccuguauuguuugcgaauccacgcccgugaaugccaucgacgccgagaugcacgaacugaacuguaauuauaacauuugcccuuacugugcuagccggcugacaucugauggccucgugcgccaugucaaucaaugcccgaaaagaaaggagaaaguggaagagaccgagcuguaccuuaaccuggaacggauccccuggcucguucgcagacugcuucagguguccgagagcacagggauggcccugaagcggucuuguuggaugaccacccuccugauucugcucgucgugucccugagcccuguucaguccgcucccgugggacgcagaccucuuuuucuggacucuaucgucaaaggcaugaagaaucuccugaacagcacaucccuugaaacgagccugucuaucgaggcccccuggggagcgauuaaugugcaguccaccuauaagccgacagucagcaccgccaacaucgcucucucuuggagcuccguggaacaccggggaaacaaaguucuggugucuggccgcagcgaguccauuaugaagcuggaggaaagaacagggaucagcugggaucucggagucgaggacgccucugaauccaaacugcuuaccgugagcguuauggaccugucucaaauguacuccccuguguucgaguaucucagcggcgaucggcaggucgaagaguggcccaaggcuacgugcacaggcgacuguccugagagaugcggguguaccuccucuaccugccugcacaaagaauggccccauagccgcaauuggcggugcaaccccacaugguguuggggagugggcaccgggugcacauguugcggacuggaugugaaggaccuuuuuacggauuacauguucguuaaguggaaagucgaguauauuaagaccgaagccaucguguguguggagcucacaucccaggagagacaaugcucucugaucgaagcgggcacccgcuuuaaucuggggagcgucacaauuacccucuccgagccucggaacauccagcagaaacugccgcccgaaauuaucacgcuucacccuaagauugaggaaggcuucuuugaccugaugcaugugcagaaaguucucagcgccucuaccguguguaagcugcaauccugcacacacggaguccccggcgaucuucagguguaccacaucgggaaucuucucaagggagacagaguuaacggccaucugauucacaaaaucgagcagcauuucaauaccagcuggaugucuugggaugggugugaccuggauuauuacugcaacaugggagacuggccuuccuguacauacaccggcgugacgcagcacaaucaugcuagcuucgucaaccuccugaauaucgagacagacuauaccaagacauuucacuuccacucuaaacgcgugaccgcccauggggauacaccccaacuugaccugaaggcucggccgaccuacggcgccggagaaguuacggugcucgucgagguggccgauauggaacugcacaccaaaaagauugagaucagcggccugaaguuugcugggcuuacaugcaccggaugcuaugcguguuccagcggcauuucuugcaaagugagaauccaugucgacgaaccugaugagcucacaguucacgugaaguccgacgaucccgacguggucgccgcuagcuccucucugauggcccgcaaacuggaguucgggaccgauagcacguuuaaggccuucuccgcuaugccuaaaacaucucucuguuuuuacauuguggaacgggaguauugcaagagcuguuccaaagaagacacccagaagugcguuaacaccaagcuggagcagccccagucuauccuuaucgaacacaaaggaacaauuaucggcaagcaaaauaacaccuguacagccaaagcgagcugcuggcuggaguccgugaagucuuucuuuuacgggcucaaaaauaugcugggcggaauuuucggcaacgucuuuaucgggauuuucacguuucugaccccuuucauccuucucauccuguucuuuauguucggauggagaauccuguuuuguuucaagugcugucgccggacaagaggccucuuuaaguaucggcaucugaaagaugacgaggaaaccggguaccgcaagaucauugagagacuuaacaauaaaaaggggaaaaaccggcugcucgauggcgaaagacuggcugaccgcaagaucgccgagcuguucucuacaaagacccacauuggg

SEQ ID NO: 13944 - RNA, 972 nt, Artificial Sequence
  derived and/or modified CDS sequence (opt5) from CCHFV(10200)__U39455.2__Gn
agcgaggaacccuccgacgauugcgugucuagaacccagcugcuccggacagagacggccgaaauccacggcgacaacuacgggggaccuggcgauaagauuaccaucuguaaugggagcacaauugucgaccaacgccugggauccgagcuuggcugcuauaccaucaacagaguucggucuuucaaacugugugaaaauagcgcuacagggaagaacugcgagauugauuccgugccggugaaaugucgccagggauacugccucagaaucacccaggagggccggggccaugucaagcugucucgcgggagcgaagugguucuugacgccugugauacauccugcgagaucaugauucccaaaggaaccggcgacauccugguggauuguagcgggggacagcaacacuuucucaaggacaaucugauugaucugggcugcccuaagaucccccuccuggggaaaauggcgauuuauaucuguagaaugucuaaccauccuaagacgaccauggcuuuccuguuuugguucuccuuuggauacgucauuacaugcauccuuugcaaagccaucuucuaucuccugauuaucgugggcacccuuggccggcgccugaagcaguacagagaacucaaaccccagacauguaccauuugcgagacgacaccuguuaaugccaucgacgcugagaugcacgaucugaacuguagcuauaauauuugcccguacugugccucucggcugaccuccgacgggcucgcucgccaugugauccagugccccaagagaaaggaaaaagucgaggaaacagagcuguaccuuaaccuggaacggaucccuuggguggugcgcaagcuccugcaagucagcgagucuaccggaguugcccuuaaaagauccagcuggcugauugugcuccuggugcuguuuaccgucucccucucucccgugcagagcgcgccuaucggc

SEQ ID NO: 13945 - RNA, 972 nt, Artificial Sequence
  derived and/or modified CDS sequence (opt5) from CCHFV(IbAr10200)__AF467768.2__Gn
agcgaggaacccuccgacgauugcaucucuagaacccagcugcuccggacagagacggccgaaauucacggcgacaacuacgggggaccuggcgauaagaucaccauuuguaaugggagcacaaucguggaccaacgccugggauccgagcuuggcugcuauaccauuaacagaguccggucuuucaaacugugugaaaauagcgcuacagggaagaacugcgagaucgauuccguuccggugaaaugucgccagggauacugccucagaaucacccaggagggccggggccaugugaagcugucucgcgggagcgaagucgugcuugacgccugugauacauccugcgagauuaugauccccaaaggaaccggcgacauucugguugauuguagcgggggacagcaacacuuucucaaggacaaucugaucgaucugggcugcccuaagauuccccuccuggggaaaauggcgaucuauauuuguagaaugucuaaccauccuaagacgaccauggcuuuccuguuuugguucuccuuuggauacgugaucacaugcauccuuugcaaagccauuuucuaucuccugaucauugucggcacccuuggcaagcggcugaaacaguaccgcgaacucaagccccagacauguaccaucugcgagacgacaccugugaaugccauugacgcugagaugcacgaucugaacuguagcuauaauaucugcccguacugugccucuagacugaccuccgacgggcucgcucggcauguuauccagugccccaagcgcaaagaaaagguggaggaaacagagcuguaccuuaaccuggaacggauuccuugggucgugagaaaacuccugcaagugagcgagucuaccggagucgcccuuaagcgcuccagcuggcugaucguucuccuggugcuguuuaccgugucccucucucccguccagagcgcgccuauuggc

SEQ ID NO: 13946 - RNA, 972 nt, Artificial Sequence
  derived and/or modified CDS sequence (opt5) from CCHFV(Turkey-Kelkit06)__GQ337054.1__Gn
agcgaggaacccggcgacgauugcaucuccagaacccagcugcuccggacagagacggccgaaauucacgacgauaacuacgggggaccuggcgacaagaucaccauuuguaaugggucuacaaucguggaucaacgccugggaagcgagcuuggcugcuauaccauuaacagagucaaauccuucaagcuguguaaaaauucugcuacagggaagaccugcgaaguugacagcacaccggugaaaugucggcagggauuuugccucaagaucacccaggagggccgcggccaugugaagcuguccagagggucugaggucgugcuugaugccugugacagcuccugcgaaguuaugauccccaaaggaacgggcgauauucugguggacuguagcgggggacagcaacacuuccucaaggauaaccugaucgaccugggcugcccucauauuccccuccuggggcggauggcgaucuacauuugucgcaugucuaaucacccuagaaccacaauggcuuuucuuuucugguuuuccuucggauaugucauuaccugcaucuuuugcaaagcccuguucuacagccucaucaucauuggcacacugggcaagaaaaucaagcaguaucgggagcuuaagccccagaccuguacgauuugcgaaacagccccugugaacgcuaucgaugccgagaugcaugaccugaauuguucuuacaacauuugcccguauugugcuucccgccucaccagcgacgggcuggccagacacguuacacagugccccaaacggaaggagaaaguggaagagaccgaacuguaccucaaucuggagcgcaucccuuggaucgucagaaaacuucugcaagugucugaauccaccggaguggcgcucaagcggagcuccuggcugauuguccuucugguucuccugacagugucucugagccccgugcaguccgccccugucggc

SEQ ID NO: 13947 - RNA, 972 nt, Artificial Sequence
  derived and/or modified CDS sequence (opt5) from CCHFV(SR3)__AJ538199.1__Gn
agcgaggaauccggcgacgauugcaucucuagaacccagcugcuccggacagagacggccgaagugcacggggacaacuacggaggccccggggauaagauuaccaucuguaauggaagcacagucguugaccaacgccugggcuccgagcuugggugcuauaccauuaacagagugcggucuuucaaacugugugaaaauagcgcuacaggaaaguccugcgagaucgauucuauuccugugaaauguaagcagggcuacugccucaaaaucacccaggagggccgcgggcaugucaagcugagcagaggauccgaagugguucuugacgugugugauagcucuugcgaggucaugaucccgaagggcacaggggacauucugguggauuguuccggaggccagcaacacuuucucaaagacaaccugguugaucuggggugccccaagaucccucuccugggaaaaauggccauuuauaucugucggaugagcaaucaucccaagaccacgauggcguuccuguuuugguucucuuuuggcuacgugauuaccugcauccuuugcaaagcuauuuucuuucuccugaucaucuucggcacacuugggaagcgcuuuaagcaguauagagaacugaaaccucagaccuguacaauuugcgagaccacgcccgucaacgccaucgacgccgagaugcacgaucucaauuguuccuacaacauuugcccuuauugugcuagccggcugacaucugacggacuggcccgccaugugacccagugcccgagacggaaggaaaaaguggaggaaacagagcucuaccugaaucuugaacgcauccccugggucguuagaaagcugcuccaaguguccgagagcaccggcaccgugcugaaacgguccucuuggcuuauuguccugcucgugcuguucacaguuagccuguccccugugcagagcgcucccaucggg

SEQ ID NO: 13948 - RNA, 972 nt, Artificial Sequence
  derived and/or modified CDS sequence (opt5) from CCHFV(UCCR4413)__KY484038.1__Gn
agcgaguccucugccagcggcugcaucuccagaacccagaugauuaagucugaaacagcugagauccacgacgauauuuacgggggacccggcgaaaaacugacgaucuguaacgggaccacaguggucgaccaacggcucggaagcgagcugggcugcuauaccauuaaucgcaucaagacauacaaacuuugugaaaacuccguuaaggagaaaaccugcgagaucgauucugugccugugaaguguagacaggggcugugccucaagauuacacaggaaggacggggccaugucaaacugagccgcggcuccgagaucgugcuugacauuugugauagcucuugcgaacugaugaucccgaaggggaccggagacauucucguugauuguuccggcgggcagcaacacuuccugcaggacaaucugguggaucucggaugccccaacaucccucugcuuggcaaagucgccauuuauaucuguagaaugagcaaucaucccaagacgaccauggcguuucuguucugguuuucuuucggguacgugaucacaugcauucucugcaaaauccuguuuuaucuucugauuaucaccggaacacucggcaagaagcugaaacaguaccgggagcugaagccucagaccuguacgauuugcgaguccacacccguuaacgcuaucgacgccgaaaugcacgaucucaauuguagcuauaacaucugcccuuacugugccucucgccugaccuccgacggccuuauuagacaugugaaucugugcccgaaacggaaggagaaagucgaagagacagaacucuaccugaaccuugagcgcauccccugguucgugagaaagcugcuccaagugagcgaguccaccggggucgcucugaaacggucuagcuggcugcucauucugguuauccuucugaccguguccaugagcccugugcagucugcccccauuaau

SEQ ID NO: 13949 - RNA, 972 nt, Artificial Sequence
  derived and/or modified CDS sequence (opt5) from CCHFV(66019)__AB069669.1__Gn
agcgaggaauccggcgacgauugcaucucuagaacccagcugcuccggacagagacggccgaagugcacggggacaacuacggaggccccggggauaagauuaccaucuguaauggaagcacaauugucgaccaacgccugggcuccgagcuugggugcuauaccaucaacagaguuaaaucuuucaagcugugugaaaauagcggaacaggcaaauccugcaagauugauaacaccccugugaaaugucggcagggcuuuugccucaagaucacacaggaggggcgcggacaugugaagcugucuagaggcagcgaggucgugcuugacgcuugugauuccagcugcgaaaucaugauuccgaaagggaccggagacauccugguugauuguucuggcgggcagcaacacuuccucaaggacaaucugguggaucugggaugccccaacauuccucuccugggcaaaauggccaucuacauuugucggauguccaaucaucccaagacgaccauggcguuucuuuucugguuuagcuucggcuaugucaucacaugcaucuuuugcaaaauuaucuucuaccugcucauugugguugggacccugggaaagaaguuuaaacaguaucgcgagcuuaagccucagacauguaccaucugcgaaacgacacccaccaacgcuauugacgccgagaugcacgaucugaaauguucuuacaauaucugcccuuauugugccuccagacucacaagcgacggccuggcucggcaugugacccagugcccgaagcgcaaagagaaggucgaagagaccgaacuguaccucaaccuggagcggauucccuggaucgugagaaaacuucugcaagugucugaauccacaggggucgcccucaagcgcagcuccuggcugaucguucuucuggugcuccugacggugucucugagcccuguccaguccgcucccauugga

SEQ ID NO: 13950 - RNA, 972 nt, Artificial Sequence
  derived and/or modified CDS sequence (opt5) from CCHFV(7001)__AB069670.1__Gn
gccgagggcgggagcuccgacugcaucucuagaacccagcuggugaagacagaagucgcugagauucacgaagauagcuacggaggccccggggagaaaaucacgauuuguaacggauccaccaucguugaccaacggcucggcucugaacuggggugcuauacaauuaaucgcgugagaagcuacaaacuuugugagaacuccgccucuggaaagagcugcgagaucgauuccaucccugugaaguguaaacagggcuucugccugaagauuacccaggaaggccgggggcaugucaagcucagccgcggaacagagaucgugcuggacguuugugauucuuccugcgaacuuaugauuccgaaaggcaccggggacauccugguggauuguagcggaggccagcaacacuuucuccagaauaaccugauugaccuggggugccccaaugucccucuccugggaaagauggcgaucuauguguguagaaugucuaaccaucccaaaacaaccauggcuuuccuguuuugguucuccuuuggcuacguuauuacgugcaucgccugccgggugcuuuucuaucuccugaucgccauuggcaccgucgggaagaaacuuaagcaguaccgcgagcugaagccucagacauguaucgugugcgagagcgugcccgucaaugcuauugaugccgaaaugcacgagcucaacuguucuuauaauaucugcccuuacugugcuuccagacugagcaccgacggacugauucggcauguuacacaaugcccgaaacgcagagaaaagguggaggaaaccgagcucuuucugaaccuugagcggauccccuggcuggugcgcaaacuccugcaggucuccgaaucuacgggcauggcccuuaagagaagcuguuggaugaucacacugcucauucugcugcucguguccaucagcccuguucagucugcgcccgugggg

SEQ ID NO: 13951 - RNA, 972 nt, Artificial Sequence
  derived and/or modified CDS sequence (opt5) from CCHFV(75024)__AB069671.1__Gn
agcgaggaauccggcgacgauugcaucucuagaacccagcugcuccggacagagacggccgaaauucacggggacaacuacggaggccccggggauaagaucaccauuuguaauggaagcacaaucguggaccaacgccugggcuccgagauggggugcuauaccauuaacagagucaaaucuuucaaacuuugugaaaauagcgcuacaggaaaguccugcgagaucgauucuaucccuguuaagugucggcagggcuacugccugaaaauuacccaggagggccgcgggcaugugaagcucagcagaggauccgaagugguccuggacgccugugauagcucuugcgaggugaugaucccgaagggcacaggggacauucuuguugauuguuccggaggccagcaacacuuucugaaagacaaccucaucgaucuggggugccccagcauuccucugcucggaaagauggcgaucuauauuugucggaugucuaaucaucccaaaaccacgauggcuuuccuguuuugguucuccuuuggcuacgugauuaccugcauccuuugcaaggccaucuucuaucugcucaucauugucggcacacuggggaaacgcuuuaagcaguacagagaacuuaagccucagaccuguacaaucugcgagaccacgcccgccaacgcuauugacgccgagaugcacgaucugaauuguagcuauaacaucugcccuuacugugcuucucggcucacauccgacggacuggcccgccaugugacccagugcccgaaaagaaaggaaaaaguugaggaaacagagcuguaccucaaucuggaacggauccccugggugguccgcaaacuucugcaagugagcgaguccaccggcguggcgcucaagagaucuagcuggcugauuguccuucugguucucuucgccaucucccugagcccugugcagucugcucccauuggg

SEQ ID NO: 13952 - RNA, 972 nt, Artificial Sequence
  derived and/or modified CDS sequence (opt5) from CCHFV(7803)__AB069672.1__Gn
agcgaggaauccggcgacgauugcaucucuagaacccagcugcuccggacagagacggccgaaauucacggggacaacuacggaggccccggggauaagaucaccauuuguaauggaagcacaaucguggaccaacgccugggcuccgagauggggugcuauaccauuaacagagucaaaucuuucaaacuuugugaaaauagcgcuacaggaaaguccugcgagaucgauucuaucccuguuaagugucggcagggcuacugccugaaaauuacccaggagggccgcgggcaugugaagcucagcagaggauccgaagugauccuggacgccugugauagcucuugcgaggucaugauuccgaagggcacaggggacauccuuguggauuguuccggaggccagcaacacuuucugaaagacaaccucauugaucuggggugccccagcaucccucugcucggaaagauggcgauuuauaucugucggaugucuaaucaucccaaaaccacgauggcuuuccuguuuugguucuccuuuggcuacguuauuaccugcauccuuugcaaggccaucuucuaucugcucauuaucgugggcacacuggggaaacgcuuuaagcaguacagagaacuuaagccucagaccuguacaauuugcgagaccacgcccgccaacgcuaucgacgccgagaugcacgaucugaauuguagcuauaacaucugcccuuacugugcuucucggcucacauccgacggacuggcccgccaugucacccagugcccgaaaagaaaggaaaaaguggaggaaacagagcuguaccucaaucuggaacggauucccuggguugugcgcaaacuucugcaagucagcgaguccaccggcguggcgcucaagagaucuagcuggcugaucgugcuucugguccucuucgccauuucccugagcccuguucagucugcucccaucucc

SEQ ID NO: 13953 - RNA, 972 nt, Artificial Sequence
  derived and/or modified CDS sequence (opt5) from CCHFV(79121)__AB069673.1__Gn
gccgagggcgggagcuccgacugcaucucuagaacccagcuggugaagacagaagucgcugagauucacgaagauagcuacggaggccccggggagaaaaucacgauuuguaacggauccaccaucguugaccaaggccucgggucugaacugggaugcuauacaauuaaucgggugcgcagcuacaaacuuugugagaacuccgccucuggcaagagcugcgagaucgauuccaucccugugaaguguaaacagggcuucugccugaagauuacccaggaagggagaggacaugucaagcucagccggggcacagagaucgugcuggacguuugugauucuuccugcgaacuuaugauuccgaaagggaccggagacauccugguggauuguagcggcgggcagcaacacuuucuccagaauaaccugauugaccugggaugccccaaugucccucuccugggcaagauggcgaucuaugugugucgcaugucuaaccaucccaaaacaaccauggcuuuccuguuuugguucuccuuuggcuacguuauuacgugcaucgccugcagagugcuuuucuaucuccugaucgccauugggaccgucggaaagaaacuuaagcaguaccgggagcugaagccucagacauguaucgugugcgagagcgugcccgucaaugcuauugaugccgaaaugcacgagcucaacuguucuuauaauaucugcccuuacugugcuucccgccugagcaccgacggccugauuagacauguuacacaaugcccgaaacggcgcgaaaagguggaggaaaccgagcucuuucugaaccuugagagaauccccuggcuggugcggaaacuccugcaggucuccgaaucuacggggauggcccuuaagcgcagcuguuggaugaucacacugcucauucugcugcucguguccaucagcccuguucagucugcgcccguggga

SEQ ID NO: 13954 - RNA, 972 nt, Artificial Sequence
  derived and/or modified CDS sequence (opt5) from CCHFV(8402)__AB069674.1__Gn
agcgaggaauccggcgacgauugcaucucuagaacccagcugcuccggacagagacggccgaaauucacaacgacaauuacgggggacccggcgauaagaucaccauuuguaacgggagcacaguggucgaccaacgccugggauccgagcuuggcugcuauaccaucaauagaguuaaaucuuucaagcugugugaaaacagcgcuacagggaaauccugcgagauugauucuaccccugugaagugucggcagggauuuugccucaaaaucacacaggagggccgcggccaugugaagcugagcagaggguccgaagucgugcuugacgccugugauagcucuugcgagaucaugauuccgaagggaaccggcgacauccugguugauuguuccgggggacagcaacacuuccucaaagacaaucugauugaucugggcugccccaacaucccucuccuggggaagauggcgauuuacaucugucggaugagcaaucaucccaaaacgaccauggcuuuucuuuucugguuuucuuucggauauguggucacaugcauucugugcaaggugaucuuuuaccuccugaucguugugggcacccuuggcaaaaaguucaagcaguaucgcgaacugaaaccucagacauguaccauuugcgagacgacacccgucaacgccaucgacgccgagaugcacgaucucaauuguuccuacaacauuugcccuuauugugcuagcagacugaccucugacgggcuggcccggcaugugaugcagugcccgaagcgcaaagaaaagaucgaggaaacagagcucuaccugaaucuugaacggauucccuggguggucagaaaacugcuccaaguuuccgagagcaccggaguggcucugaagcgcuccucuuggcuugugguccugcucgugcugcugaccguuagccucuccccugugcagagcgcccccaucggc

SEQ ID NO: 13955 - RNA, 972 nt, Artificial Sequence
  derived and/or modified CDS sequence (opt5) from CCHFV(88166)__AB069675.1__Gn
agcgaggaauccggcgacgauugcaucucuagaacccagcugcuccggacagagacggccgaaauucacagcgacaacuacgggggacccggcgauaagaucaccauuuguaauggguccacaguggucgaccaacgccugggaucugagcuuggcugcuauaccaucaacagaguuaagagcuucaaacugugugaaaauuccgcuacagggaaaucuugcgagauugauagcaccccugugaagugucggcagggauuuugccucaaaaucacacaggagggccgcggccaugugaagcuguccagagggagcgaagucgugcuugacgccugugauucuuccugcgagaucaugauuccgaagggaaccggcgacauccugguugauuguagcgggggacagcaacacuuccucaaagacaaccugauugaucugggcugccccaauaucccucuccuggggaagauggcgauuuacaucugucggaugucuaaccaucccaaaacgaccaugggauuucuuuucugguuuuccuucggcuauguggucacaugcauucugugcaaggugaucuuuuaccuccugaucguugugggcacccuugggaaaaaguucaagcaguaucgcgaacugaaaccucagacauguaccauuugcgagacgacacccgucaaugcuaucgacgccgagaugcacgaucucaacuguagcuacaauauuugcccuuauugugccucuagacugaccuccgacggacuggcucggcaugugaugcagugcccgaagcgcaaagaaaagaucgaggaaacagagcucuaccugaaccuugaacggauucccuggguggucagaaaacugcuccaaguuagcgaguccaccggcguggcccugaagcgcucuagcuggcuugugguccugcucgugcugcugaccguuucccucagcccugugcagucugcucccaucggg

SEQ ID NO: 13956 - RNA, 972 nt, Artificial Sequence
  derived and/or modified CDS sequence (opt5) from CCHFV(BA88166)__AF338470.1__Gn
agcgaggaauccggcgacgauugcaucucuagaacccagcugcuccggacagagacggccgaaauucacagcgacaacuacgggggacccggcgauaagaucaccauuuguaauggguccacaguggucgaccaacgccugggaucugagcuuggcugcuauaccaucaacagaguuaagagcuucaaacugugugaaaauuccgcuacagggaaaucuugcgagauugauagcaccccugugaagugucggcagggauuuugccucaaaaucacacaggagggccgcggccaugugaagcuguccagagggagcgaagucgugcuugacgccugugauucuuccugcgagaucaugauuccgaagggaaccggcgacauccugguugauuguagcgggggacagcaacacuuccucaaagacaaccugauugaucugggcugccccaauaucccucuccuggggaagauggcgauuuacaucugucggaugucuaaccaucccaaaacgaccaugggauuucuuuucugguuuuccuucggcuauguggucacaugcauucugugcaagggcaucuuuuaccuccugaucgugguugggacccuuggcaaaaaguucaagcaguaucgcgaacugaaaccucagacauguaccauuugcgagacgacacccgugaaugcuaucgacgccgagaugcacgaucucaacuguagcuacaauauuugcccuuauugugccucuagacugaccuccgacggacuggcucggcaugucaugcagugcccgaagcgcaaagaaaagaucgaggaaacagagcucuaccugaaccuugaacggauucccuggguggugagaaaacugcuccaagucagcgaguccaccgggguugcccugaagcgcucuagcuggcuuguggugcugcucguccugcugaccgugucccucagcccuguucagucugcucccaucgga

SEQ ID NO: 13957 - RNA, 972 nt, Artificial Sequence
  derived and/or modified CDS sequence (opt5) from CCHFV(BA66019)__AF350448.1__Gn
agcgaggaauccggcgacgauugcaucucuagaacccagcugcuccggacagagacggccgaagugcacggggacaacuacggaggccccggggauaagauuaccaucuguaauggaagcacaauugucgaccaacgccugggcuccgagcuugggugcuauaccaucaacagaguuaagucuuucaagcugugugaaaauagcggaacaggcaaauccugcaagauugauaaacauccugugaagugucggcagggcuuuugccucaagaucacccaggaggggcgcggacacgugaaacugucuagaggcagcgaggucgugcuugacgcuugugauuccagcugcgaaaucaugauuccgaaggggacaggagacauccugguugauuguucuggcgggcagcaacauuuccucaaagacaaccugguggaucugggaugccccaauauuccucuccugggcaagauggccaucuacauuugucggauguccaaccaccccaaaaccacgauggcguuucuuuucugguuuagcuucggcuaugucauuaccugcaucuuuugcaagaucaucuucuaccugcucauugugguugggacacugggaaagaaauuuaagcaguaucgcgagcuuaaaccucagaccuguacaaucugcgaaaccacgcccacaaaugcuauugacgccgagaugcaugaucugaaguguucuuacaacaucugcccuuauugugccuccagacucaccagcgacggccuggcucggcacgugacacagugcccgaaacgcaaggagaaagucgaagagaccgaacuguaccucaaucuggagcggauucccuggaucgugagaaaacuucugcaagugucugaauccaccggggucgcccucaagcgcagcuccuggcugaucguucuucuggugcuccugacagugucucugagcccuguccaguccgcucccauugga

SEQ ID NO: 13958 - RNA, 972 nt, Artificial Sequence
  derived and/or modified CDS sequence (opt5) from CCHFV(BA8402)__AF350449.1__Gn
agcgaggaauccggcgacgauugcaucucuagaacccagcugcuccggacagagacggccgaaauucacaacgacaauuacgggggacccggcgauaagaucaccauuuguaacgggagcacaguggucgaccaacgccugggauccgagcuuggcugcuauaccaucaauagaguuaacucuuucaaucugugugaaaacacagcuaccgggaaaagcugcgagauugauuccacaccugugaagugucggcagggauuuugccucaaaaucacccaggagggccgcggccaugugaagcugucuagagggagcgaagucgugcuugacgccugugaguccagcugcgaaaucaugauuccgaaaggaacgggcgauauccugguugacuguucugggggacagcaacacuuccucaaggauaaucugauugaccugggcugccccaacaucccucuccuggggaagauggcgauuuacaucugucggauguccaaucaucccaaaaccacaauggcuuuucuuuucugguuuagcuucggauauguggugaccugcauucugugcaaggucaucuuuuaccuccugaucguugugggcacacuuggcaaaaaguucaaacaguaucgcgagcugaagccucagaccuguacgauuugcgagacaacccccgucaacgccaucgaugccgaaaugcacgaccucaauuguucuuacaacauuugcccuuauugugcuuccagaccgacaagcgaugggcuggcccggcaugugaugcagugccccaagcgcaaagagaagaucgaagagaccgcucuguaccucaaucuggaacggauuccuuggguggucagaaaacuucugcaaguuucugaguccaccggaguggcccucaagcgcagcuccuggcuggugguccuucuggugcuccugacaguuucucugagccccgugcaguccgcgccuaucggc

SEQ ID NO: 13959 - RNA, 972 nt, Artificial Sequence
  derived and/or modified CDS sequence (opt5) from CCHFV(Matin)__AF467769.2__Gn
agcgaggaauccggcgacgauugcaucucuagaacccagcugcuccggacagagacggccgaaauucacagcgacuccuacgggggacccggcgauaagaucaccauuuguaacgggucuacaguggucgaccaacgccugggaagcgagcuuggcugcuauaccaucaauagaguuaaauccuucaagcugugugaaaacucugcuacagggaaaagcugcgagauugauuccaccccugugaagugucggcagggauuuugccucaaaaucacacaggagggccgcggccaugugaagcugagcagagggucugaagucgugcuugacgccugugauuccagcugcgagaucaugauuccgaagggaaccggcgacauccugguugauuguucugggggacagcaacacuuccucaaagacaaucugauugaucugggcugccccaacaucccucuccuggggaagauggcgauuuacaucugucggauguccaaucaucccaaaacgaccaugguguuucuuuucugguuuagcuucggauaugucauuacaugcauccugugcaaggugaucuuuuaccuccugauuguugugggcacccuuggcaaaaaguucaagcaguaucgcgaacugaaaccucagacauguaccaucugcgagacgacacccgucaacgcuauugacgccgagaugcacgaucucaauuguucuuacaacaucugcccuuauugugccuccagacugaccagcgacgggcuggcucggcaugugaugcagugcccgaagcgcaaagaaaagauugaggaaacagagcucuaccugaaucuugaaagaauccccugggugguccggaaacugcuccaaguuuccgagucuaccggaguggcccugaagcgcagcuccuggcuugugguccugcucgugcugcugaccguuagccucucuccugugcaguccgcucccaucggc

SEQ ID NO: 13960 - RNA, 972 nt, Artificial Sequence
  derived and/or modified CDS sequence (opt5) from CCHFV(Baghdad 12)__AJ538197.2__Gn
agcgaggaauccggcgacgauugcaucucuagaacccggcugcuccgcacagagacggccgaaauucacggggacagcuacggaggccccggggauaagaucaccauuuguaacggauccacaaucguggaccagagacugggcucugagauggggugcuauaccauuaaucgggucaagagcuucaaacuuugugaaaacuccgcuacaggaaaaucuugcaagaucgauagcaucccuguuaaaugucgccaaggcuacugccugaagauuacccaggagggcagagggcaugugaagcucucccggggaagcgaggugguccuggacgccugugauucuuccugcgaagugaugaucccgaaaggcacaggggacauucuuguugauuguagcggaggccagcagcacuuucugaaggacaaucucaucgaucuggggugccccaacauuccucugcucggaaaaauggcgaucuauauuugucgcaugucuaaucaucccaagaccacgauggcuuuccuguuuugguucuccuuuggcuacgugauuaccugcauccuuugcaaagccaucuucuaucugcucaucauugucggcacacuggggaagagauuuaagcaauaccgggagcuuaaaccucagaccuguacaaucugcgaaaccacgcccgugaacgccauugacgcugagaugcacgaucugaauuguagcuauaacaucugcccuuacugugccucucgccucacauccgacggacuggcuagacauguuacccagugcccgaagcggaaagagaagguggaagagacagaacuguaccucaaucuggagcgcauccccugggucgugagaaaacuucuccaggugagcgaauccaccggcgucgcccugaagcggucuagcuggcugauuguucuucuggugcuccuggcgguguccagcucuccuguccaauccgcccccaucggg

SEQ ID NO: 13961 - RNA, 972 nt, Artificial Sequence
  derived and/or modified CDS sequence (opt5) from CCHFV(VLG/TI29414)__AY179961.1__Gn
agcgaggaacccggcgacgauugcaucuccagaacccagcugcuccgggccgagccugcugaaauucacgacgauaacuacgggggaccgggcgacaagaucacaauuuguaaugggucuacgaucguggaucaacgccugggaagcgagcuuggcugcuauaccauuaacagagucaaauccuucaagcugugugaaaauucugccacagggaaaaccugcgagaucgacagcacacccguuaagugucggcagggauuuugccucaaaaucacccaggagggccgcggccaugugaagcuguccagagggucugaagugguccuugaugcgugugacagcuccugcgaggugaugauuccuaagggaacaggcgauauccugguugacuguagcgggggacagcaacacuuccucaaagauaaccugauugaccugggcugcccccauaucccucuccuggggaagauggcuauuuacaucugucggaugucuaaucacccccgcaccacgauggccuuucuuuucugguuuuccuucggauaugugauuaccugcaucuuuugcaaagcccuguucuacagccucaucauuaucggcacacugggcaagaaaauuaagcaguauagagaacuuaagccucagaccuguacaaucugcgagaccgcuccggucaacgccauugaugcugagaugcaugaccugaauuguucuuacaacaucugccccuauugugccucccggcucacgagcgacgggcuggcgcgccacgugccucagugccccaaaagaaaggaaaaaguugaggaaacagagcuguaccucaaucuggaacggaucccuuggaacgugcgcaaacuucugcaagucucugaguccaccggaguggcccucaagagaagcuccuggcugauugugcuucugguccuccugacaguuucucugagccccgugcaguccgcuccggugggc

SEQ ID NO: 13962 - RNA, 972 nt, Artificial Sequence
  derived and/or modified CDS sequence (opt5) from CCHFV(TADJ/HU8966)__AY179962.1__Gn
agcgaggaauccggcgacgauugcaucucuagaacccagcugcuccggacagagacggccgaaauucacggggacgauuacggaggccccggggacaagaucaccauuuguaacggaagcacaaucguggaucaacgccugggcuccgagcuugggugcuauaccauuaauagagucaaaucuuucaagcugugugaaaacagcgcuacaggaaagaauugcgagaucgacuccguuccugugaagugucggcagggcuacugccucaaaaucacccaggagggccgcgggcaugugaagcugucuagaggaagcgaagucgugcuugaugccugugacuccagcugcgagguuaugauuccgaagggcacaggggauaucucuguggacuguuccggaggccagcaacacuuucugaaagauaaccucauugaccuggggugccccaagaucccucugcucggaaaaauggcgauuuauaucugucggaugagcaaucaucccaagaccacgauggcuuuccuguuuugguucucuuuuggcuacgucauuacccgcauccuuugcaaagccaucuucuaucugcucauuaucgugggcacacuggggaagagauuuaagcaguaccgggaacuuaaaccucagaccugcacaauuugugagaccacgcccgccaacgcuaucgaugccgagaugcacgaccugaauugcuccuauaacauuuguccuuacugcgcuagccgccucacaucugacggacuggccagacauguuacccaguguccgaagcggaaagaacgcguggaggaaacagagcuguaccucaaucuggaaagaauccccuggaucguccggaaacuucugcaaguguccgagagcaccggcguggcgcucaaacgcuccucuuggcugauuguccuucugguucucuucaccgugagccuguccccugugcagagcgcccccaucggg

SEQ ID NO: 13963 - RNA, 972 nt, Artificial Sequence
  derived and/or modified CDS sequence (opt5) from CCHFV(Hodzha)__AY223476.1__Gn
agcgaggaauccggcgacgauugcaucucuagaacccagcugcuccggacagagacggccgaaauucacggggacgauuacggaggccccggggacaagaucaccauuuguaacggaagcacaaucguggaucaacgccugggcuccgagcuugggugcuauaccauuaauagagucaaaucuuucaagcuguguaaaaacagcgcuacaggaaaguccugcgaaaucgacucuaccccuguuaaaugucggcagggcuacugccucaagaucacacaggagggccgcgggcaugugaagcugagcagaggauccgaggugguccuugaugccugugacagcucuugcgaagugaugauuccgaaaggcaccggggauauccugguugacuguuccggaggccagcaacacuuucucaaggauaaucugauugaccuggggugcccccggaucccucuccugggaaaaauggcgauuuauaucugucgcaugagcaaccaucccaagacgaccauggcuuuccuguuuugguucucuuuuggcuacgugauuacaugcauccuuugcaaagccaucuucuaucuccugauuaucgucggcacccuugggaagagauuuaagcaguaccgggagcugaaaccucagacauguaccauuugcgaaacgacacccgccaaugcuaucgaugccgagaugcacgaccucaacuguuccuauaauauuugcccuuacugugcuagccgccugaccucugacggacuggccagacaugugacacagugcccgaagcggaaagagaagguugaagagaccgaacucuaccugaaccuugagcgcauccccuggaucgugagaaaacugcuccaagucuccgaaagcaccggcguggcgcugaagcgguccucuuggcuuauugugcugcucguccuguucgccguuagccuguccccugugcagagcgcucccaucggg

SEQ ID NO: 13964 - RNA, 972 nt, Artificial Sequence
  derived and/or modified CDS sequence (opt5) from CCHFV(Kosovo/9553/2001)__AY675511.1__Gn
agcgaggaacccggcgacgauugcaucuccagaacccagcugcuccggacagagacggccgaaauucacgacgauaacuacgggggaccuggcgacaagaucaccauuuguaaugggucuacaaucguggaucaacgccugggaagcgagcuuggcugcuauaccauuaacagagucaaauccuucaagcugugugaaaauucugcuacagggaaaaccugcgagaucgacagcacaccgguuaagugucggcagggauuuugccucaaaaucacccaggagggccgcggccaugugaagcuguccagagggucugaagugguccuugaugccugugacagcuccugcgaggugaugauucccaagggaacgggcgauauccugguugacuguagcgggggacagcaacacuuccucaaagauaaccugauugaccugggcugcccucauaucccccuccuggggaagauggcgauuuacaucgcucggaugucuaaucacccuaaaaccacaauggccuuucuuuucugguuuucccugggauaugugauuaccuguauccucugcaaggcccuguucuacagccuuaucauuaucggcacacugggcaaaaagauuaagcaguaucgcgaacucaaaccccagaccugcacgaucugugagacagcuccugucaacgccauugaugcugagaugcaugaccugaauugcucuuacaacaucuguccguauugcgccuccagacugaccagcgacgggcucgcgcggcacgugaagcagugucccaaacgcaaggaaaaaguugaggaaacagagcuguaccuuaaucuggaaagaaucccuugggugguccggaagcuccugcaagugucugaguccaccggaguggcccuuaaacgcagcuccuggcugauuguccuccugguucugcucaccgugucucugagccccgugcaguccgcuccugucggc

SEQ ID NO: 13965 - RNA, 972 nt, Artificial Sequence
  derived and/or modified CDS sequence (opt5) from CCHFV(SPU41/84)__AY900142.1__Gn
agcgaggaauccucugacgauugcaucagcagaacccagcugcuccggacagagacggccgaaauucacggcgacaacuacgggggacccggcgauaagaucaccauuuguaauggguccacaguggucgaccaacgccugggaucugagcuuggcugcuauaccaucaacagaguuaaaacauucaagcugugugaaaauagcgcuaccgggaaauccugcgagauugauucugugccugugaagugucggcagggauacugccucaaaaucacacaggagggccgcggccaugucaagcugagcagaggguccgaagugguucuugacgccugugauaccagcugcgaggugaugaucccgaagggaacgggcgacauucuggucgauuguucugggggacagcaacacuuucucaaagacaaccugaucgaucugggcugccccaagauuccucuccuggggaaaauggcgaucuauauuugucggauguccaaucaucccaagaccacaauggcuuuccuguuuugguucagcuuuggauacgugauuaccugcaucaucugcaaaguuaucuucuaucuucucauuaucgugggcacacugggcaagcgcuuuaagcaguacagagaacuuaaaccucagaccuguacgauuugcgagacaacccccgucaacgccaucgacgccgagaugcacgaucugaauuguucuuauaacauuugcccuuacugugcuucccggcucacaagcgacgggcuggcccgccaugugacccagugcccgaagagaaaagaaaagguggaggaaaccgagcuguaccucaaucuggaacggauccccugggucguucgcaaacuucugcaagugucugaguccacaggaguggcucucaagagaagcuccuggcuggucgugcuucugguucuccugacggugucucugagcccuguccaguccgcccccaucagc

SEQ ID NO: 13966 - RNA, 972 nt, Artificial Sequence
  derived and/or modified CDS sequence (opt5) from CCHFV(UG3010)__AY900143.1__Gn
gccgagggcgugagcaacgacugcgucuccagaacccagcugaucaagacagaaguugcugagauucacgaagauucuuacgggggacccggcgagaaaaucacgauuuguaaugggagcaccaucguggaccaacggcucggauccgaacugggcugcuauacaauuaaccgcgugaagaccuacaaacuuugugaaaauucugccacagagaaggggugcgagaucgauagcgucccugugaaauguaagcagggauucugccugaagguuacccaggagggcagaggccaugugaaacucucccgggggacagaaaucguccuggacgugugugauaccucuugcgagcuuaugauuccgaagggaacgggcgacauccugguugauuguagcgggggacagcaacacuuucuccaggacaaccugauugaucugggcugccccaaugugccucuccuggggaaaauggcgaucuauauuugucgcauguccaaccaucccaagaccacaauggcuuuccuguuuugguucagcuuuggauacgucauuaccugcaucgugugcaaagugcuuuucuaucuccugaucgucaucggcacacuuucuaagaagcugaaacaguacagagagcucaagccucagaccuguauuguuugcgaauccacgcccgugaaugccaucgacgccgagaugcacgaacugaacuguaauuauaacauuugcccuuacugugcuagccggcugacaucugauggccucgugcgccaugucaaucaaugcccgaaaagaaaggagaaaguggaagagaccgagcuguaccuuaaccuggaacggauccccuggcucguucgcagacugcuucagguguccgagagcacagggauggcccugaagcggucuuguuggaugaccacccuccugauucugcucgucgugucccugagcccuguucaguccgcucccguggga

SEQ ID NO: 13967 - RNA, 972 nt, Artificial Sequence
  derived and/or modified CDS sequence (opt5) from CCHFV(Hy13)__AY900145.1__Gn
agcgaggaauccggcgacgauugcaucucuagaacccagcugagccggacagagacggccgaaauucacuccgacaacuacgggggacccggcgauaagaucaccauuuguaaugggucuacaaucguggaccaacgccucggaagcgagcugggcugcuauaccauuaacagagucaaauccuucaagcugugugaaaauucugcuacagggaaaagcugcgagaucgauuccaccccuaucaagugucggcagggauuuugccuuaaaauuacacaggagggccgcggccauguuaagcucagcagagggucugaaguggugcuggacgccugugauuccagcugcgagaucaugauuccgaagggaaccggcgacauccuugucgauuguucugggggacagcaacacuuccugaaagacaaccucauugaucugggcugccccaauaucccucugcucgggaagauggcgauuuacaucugucggauguccaaccaucccaaaacgaccauggcuuuucuguucugguuuagcuucggauaugugaucacaugcauucuuugcaagguuaucuuuuaccugcucauuguggucggcacccugggcaaaaaguucaagcaguaucgcgaacuuaaaccucagacauguaccaucugcgagacgacacccgugaaugccauugacgccgagaugcacgaucugaacuguucuuacaauaucugcccuuauugugcuuccagacucaccagcgacgggcuggcccggcauguuaugcagugcccgaagcgcaaagaaaagguggaggaaacagagcuguaccucaaccuggaaagaauccccugggucgugcggaaacuucugcaaguguccgagucuaccggagucgcucucaagcgcagcuccuggcugguugugcuucuggugcuccugaccgucagccugucuccugugcaguccgcccccauuggc

SEQ ID NO: 13968 - RNA, 972 nt, Artificial Sequence
  derived and/or modified CDS sequence (opt5) from CCHFV(Semunya)__DQ094832.1__Gn
gccgagggcgugagcaacgacugcgucuccagaacccagcugaucaagacagaaguugcugagauucacgaagauucuuacgggggacccggcgagaaaaucacgauuuguaaugggagcaccaucguggaccaacggcucggauccgaacugggcugcuauacaauuaaccgcgugaagaccuacaaacuuugugaaaauucugccacagagaaggggugcgagaucgauagcgucccugugaaauguaagcagggauucugccugaagguuacccaggagggcagaggccaugugaaacucucccgggggacagaaaucguccuggacgugugugauaccucuugcgagcuuaugauuccgaagggaacgggcgacauccugguugauuguagcgggggacagcaacacuuucuccaggacaaccugauugaucugggcugccccaaugugccucuccuggggaaaauggcgaucuauauuugucgcauguccaaccaucccaagaccacaauggcuuuccuguuuugguucagcuuuggauacgucauuaccugcguggugugcaaaguccuuuucuaucuccugaucguuaucggcacacuuggcaagaagcugaaacaguacagagagcucaagccucagaccuguaucgugugcgaaucuauucccgugaaugccaucgacgccgagaugcacgaacugaacuguaauuauaacauuugcccuuacugugcuucccggcugacgagcgaugggcucguccgccaugugacacaaugcccgaaaagaaaggagaaaguugaagagaccgagcuguaccuuaaucuggaacggauccccuggcucgugcgcagacugcuucaggucucugaguccacaggaauggcccugaagcggagcuguuggaugaccacccuccugauucugcucgugguuucucuguccccugugcagagcgcucccgucggc

SEQ ID NO: 13969 - RNA, 972 nt, Artificial Sequence
  derived and/or modified CDS sequence (opt5) from CCHFV(SPU128/81/7)__DQ157174.1__Gn
agcgaggaacccuccgacgauugcaucucuagaacccagcugcuccggacagagacggccgaaauucacggcgacaacuacgggggaccuggcgauaagaucaccauuuguaaugggagcacaaucguggaccaacgccugggauccgagcuuggcugcuauaccauuaacagagucaaaucuuucaagcugugugaaaauagcgcuacagggaaauccugcgagaucgagucuguuccggugaagugucggcagggauacugccuccgcaucacccaggaaggcagaggccaugugaaacugagccggggguccgaggucgugcuugaugccugugacacaagcugcgaaauuaugauccccaagggaaccggcgauauucugguugacuguucugggggacagcaacacuuucucaaggauaaccugaucgaccugggcugcccuaaaauuccccuccuggggaagauggcgaucuauauuugucgcauguccaaucauccuaaaacgaccauggcuuuccuguuuugguucagcuuuggauacgugaucacaugcauccuuugcaaggccauuuucuaucuccugaucauuaucggcacccuuggcaaaagauuuaagcaguaccgggagcugaagccccagacauguaccauuugcgagacgacaccugucaacgccaucgaugcugaaaugcacgaccucaauuguucuuauaacaucugcccguacugugccucccgccugaccagcgaugggcuggcuagacaugugacacagugccccaaacggaaggagaaaguugaagagaccgaacucuaccugaaucuugagcgcauuccuuggguggucagaaagcugcuccaagugucugaguccaccggaguggcccugaaacggagcuccuggcuuaucguccugcucguucuguucacagugucucugagccccgugcaguccgcgccuauuggc

SEQ ID NO: 13970 - RNA, 972 nt, Artificial Sequence
  derived and/or modified CDS sequence (opt5) from CCHFV(ROS/HUVLV-100)__DQ206448.1__Gn
agcgaggaacccggcgacgauugcaucuccagaacccagcugcuccggacagagacggccgaaauucacgacgauaacuacgggggaccuggcgacaagaucaccauuuguaaugggucuacaaucguggaucaacgccugggaagcgagcuuggcugcuauaccauuaacagagucaaauccuucaagcugugugaaaauucugcuacagggaaaaccugcgagaucgacagcacaccgguuaagugucggcagggauuuugccucaaaaucacccaggagggccgcggccaugugaagcuguccagagggucugaagugguccuugaugccugugacagcuccugcgaggugaugauucccaagggaacgggcgauauccugguugacuguagcgggggacagcaacacuuccucaaagauaaccugauugaccugggcugcccucauaucccccuccuggggaagauggcgauuuacaucugucggaugucuaaucacccucgcaccacaauggcuuuucuuuucugguuuuccuucggauaugugauuaccugcaucuuuugcaaagcccuguucuacagccucaucauuaucggcacacugggcaagaaaauuaagcaguauagagaacuuaagccccagaccuguacgaucugcgagacagccccugucaacgcuauugaugccgagaugcaugaccugaauuguucuuacaacaucugcccguauugugcuucccggcucaccagcgacgggcuggcccgccacgugccccagugcccuaaaagaaaggaaaaaguugaggaaacagagcuguaccucaaucuggaacggauccccuggauugugcgcaaacuucugcaagucucugaguccaccggaguggcgcucaagagaagcuccuggcugaucgugcuucugguccuccugaccguuucucugagcccugugcaguccgcccccgugggc

SEQ ID NO: 13971 - RNA, 972 nt, Artificial Sequence
  derived and/or modified CDS sequence (opt5) from CCHFV(AP92)__DQ211625.1__Gn
agcgagggcggggacggaggcugcaucuccagaacccagcugauuaagacagaaacggccgaggugcacggggaugacuacggaggccccggggagaaaaucaccauuuguaacggaucuacaaucgucgaucaacggcucggcagcgaacugggcugcuauaccauuaaucgcaucaaguccuucaaacuuugugaaaacucugcucaggggaagaauugcgagaucgacagcgccccuguucaguguagacagggauacugccugaaaauuucccaagagggccgggggcaugugaagcucucucgcggaagcgaaaucgugcuggaugucugugacacauccugcgagauuaugaucccgaagggcaccggggauauucuuguggacuguagcggaggccagcagcacuuucugcagucuaaccucguugaucugggcugccccaauaucccucugcucgggaaaauggcgauuuauaucuguagaauguccaaccaucccaagacaaccauggcuuuccuguuuugguucagcuuuggauacgugaucacgugcauucuuugcaaaacccuguucuauauccucauuaucauuggcacacuggggaagaaacuuaagcaauaccgggaacugaagccucagaccuguacaaucugcgagucuguccccgugaaugccaucgacgccgagaugcacgaucucaacuguuccuauaauauuugcccuuacugugcuagccgccugaccucugaaggacugacgagacauguuaaccagugcccgaaacggaaggagaaaguggaagagacagaacucuaccugaaucuugagcgcauccccuggauugucagaaagcugcuccagguguccgagagcaccggcguggcccugaaacgguccucuuggaugaucguccuucugauucuccugaucguuagcauguccccugugcaaagcgcucccaucucu

SEQ ID NO: 13972 - RNA, 972 nt, Artificial Sequence
  derived and/or modified CDS sequence (opt5) from CCHFV(ArD8194)__DQ211626.1__Gn
gccgagggcgggagcaacgacugcguguccagaacccagcuggucaagacagaaguugcugagauccacgaagauucuuacggaggccccggggagaaaauuacgaucuguaauggaagcaccauuguggaccaacggcucggcuccgaacuggggugcuauacaaucaaccgcgugagaaccuacaagcugugugaaaauucugccacagagaaaagcugcgagauugauuccgucccugugaaguguaaacagggauucugccuuaagaucacccaggagggccggggccauguuaagcucucucgcgggacagaaaucgugcuggacgucugugauaccagcugcgagcuuaugauuccgaaaggaacgggcgacauccugguggauuguuccgggggacagcaacacuuucuccaggacaaccugauugaucugggcugccccaauaucccucuccuggggagaaccgcgauuuauguuugucggaugagcaaccaucccaagacaaccauggcuuuccuguuuugguucucuuuuggauacgugaucacaugcgucgugugcaaagugcuuuucuaucuccugauugucaucggcacccuuggcaagcgccugaaacaguacagagagcucaagccucagacguguaucguuugcgaauccauucccgugaaugccaucgacgccgagaugcacgaucugaacuguaauuauaacauuugcccuuacugugcuagccggcugacaucugacgggcucgugcgccaugucacccaaugcccgaagagaaaagaaaagguggaggaaacagagcuguaccuuaaucuggagcggauccccuggcucguucgcaaacugcuucagguguccgaaagcaccggagucgcccugaagagaucuuguuggaugauuacccuccugauccugcucacaguguccaugagcccuguucaguccgcucccgugggc

SEQ ID NO: 13973 - RNA, 972 nt, Artificial Sequence
  derived and/or modified CDS sequence (opt5) from CCHFV(ArD15786)__DQ211627.1__Gn
gccgagggcgggagcaacgacugcguguccagaacccagcuggucaagacagaaguuacggagauccacgaagauucuuacggaggccccggggagaaaauuaccaucuguaauggaagcacaauuguggaccaacggcucggcuccgaacuggggugcuauaccaucaaccgcgugagaacauacaagcugugugaaaauucugcuaccgagaaaagcugcgagauugauuccgucccugugaaguguaaacagggauucugccuuaagaucacacaggagggccggggccauguuaagcucucucgcgggaccgaaaucgugcuggacgucugugauacgagcugcgagcuuaugauuccgaaaggaaccggcgacauccugguggauuguuccgggggacagcaacacuuucuccaggacaaccugauugaucugggcugccccaauaucccucuccuggggcagacagccauuuauguuuguagaaugagcaaccaucccaagaccacaauggcguuccuguuuugguucucuuuuggauacgugauuaccugcgucgugugcaaagugcuuuucuaucuccugaucgucaucggcacgcuuggcaagcggcugaaacaguaccgcgagcucaagccucaaacauguaucguuugcgaauccauucccgugaaugcuaucgacgccgagaugcacgaucugaacuguaauuauaacauuugcccuuacugugccagcagacugaccucugacgggcucgugcggcaugucacacagugcccgaagcgcaaagaaaagguggaggaaaccgagcuguaccuuaaucuggagagaauccccuggcucguucggaaacugcuucagguguccgaaagcaccggagucgcucugaagcgcucuuguuggauuaucacacuccugauccugcucacgguguccaugagcccuguucaguccgcccccgugggc

SEQ ID NO: 13974 - RNA, 972 nt, Artificial Sequence
  derived and/or modified CDS sequence (opt5) from CCHFV(ArD39554)__DQ211628.1__Gn
agcgaguccaacaauaacgacugcgugucuagaacccagcugaucaagacagaaaaugccgagauucacggcgaugacuacgggggacccggcgagaaaaucacgauuuguaacgggagcaccaucgucgaacaacggcucggauccgaacugggcugcuauacaauuaaucgcaucaagucuuucaaacuuugugagaacagcgcuuccgggaagggaugcgagaucgauucuaccccuguuaaauguaagcagggcuuuugccugaagauuacacaggaaggcagagggcaugugaaacucagccggggauccgagaucauucuggacgugugugauagcucuugcgaaaugaugaucccgaagggcuccggggacauucuugucgauuguagcggaggccagcaacacuuccugcaggacaaucucguggaucuggggugccccaacguuccucugcucggaaaaauggccaucuacauuugucgcaugucuaaucaucccaagaccacaauggcguuucuguucugguuuuccuucggcuaugugauuaccugcaucuuuugcaaagucaucuucuacgugcuuaucauuaucggcacgcuggggaagagaauuaagcaguaucgggagcucaaaccucagaccuguacaaucugcgaggcuacccccguuaacgccaucgacgccgaaaugcacgaucugaauuguagcuacaacauuugcccuuauugugcuucucgccuuacauccgagggacuggugagacaugucacccaaugcccgaagcggaaagaaaagaucgaggaaacggagcucuaccugaaucuggagcgcauucccugguuugugagaaaacuccuucaggugagcgaauccacaggcgucgcccugaagcggucuagcuggcugguuacccuccuggugcuucugacagugucccucagcccuguccagucugcucccaucggg

SEQ ID NO: 13975 - RNA, 972 nt, Artificial Sequence
  derived and/or modified CDS sequence (opt5) from CCHFV(Drosdov)__DQ211630.1__Gn
agcgaggaacccggcgacgauugcaucuccagaacccagcugcucaagacagagacggccgaaauucacgacgauaacuacgggggaccuggcgacaaaaucaccauuuguaaugggucuacaaucguggaucaacggcugggaagcgagcuuggcugcuauaccauuaaccgcgucaaguccuucaaacugugugaaaauucugcuacagggaagaccugcgagaucgacagcacaccgguuaaauguagacagggauuuugccucaagaucacccaggagggccggggccaugugaagcugucccgcgggucugaagugguccuugaugccugugacagcuccugcgaggugaugauucccaaaggaacgggcgauauccugguugacuguagcgggggacagcaacacuuccucaaggauaaccugauugaccugggcugcccucauaucccccuccuggggaaaauggcgauuuacaucuguagaaugucuaaucacccucggaccacaauggcuuuucuuuucugguuuuccuucggauaugugauuaccugcaucuuuugcaaggcccuguucuacagccucaucauuaucggcacacugggcaaaaagauuaagcaguaucgcgaacuuaaaccccagaccuguacgaucugcgagacagccccugucaacgcuauugaugccgagaugcaugaccugaaguguucuuacaauaucugcccguauugugcuuccagacucaccagcgacgggcuggcccggcacgugacacagugccccaaacgcaaggaaaaaguugaggaaaccgagcuguaccucaaccuggaaagaaucccuuggauugugcggaaacuucugcaagucucugaguccaccggaguggcgcucaagcgcagcuccuggcugaucgugcuucugguccuccugacaguuucucugagccccgugcaguccgccccugugggc

SEQ ID NO: 13976 - RNA, 972 nt, Artificial Sequence
  derived and/or modified CDS sequence (opt5) from CCHFV(Oman)__DQ211632.1__Gn
agcgaggaauccggcgaggacugcaucucuagaacccagcugcuccggacagaaacggccgagauucacggggauaacuacggaggccccggggacaagaucaccauuuguaauggaagcacaaucguggaucaacgccugggcuccgaacuugggugcuauaccauuaacagagucaaaucuuucaagcugugugagaauagcgcuacaggaaaauccugcgagaucgacaacaccccuguuaaguguaaacagggcuuuugccucaagaucacacaggaaggccgggggcaugugaagcugucucgcgauagcgaggugguccuugacgccugugauuccagcugcgaaauuaugaucccgaaaggaaccggcgacauucugguggauuguucugggggacagcaacacuuccucaaggacaaucugaucgaucugggcugccccaacauuccucuccuggggaaaauggcgaucuacauuuguagaauguccaaucaucccaagacgaccauggcuuuucuuuucugguuuagcuucggauauguuaucacaugcauccugugcaaagugaucuuuuaccuccugauugucgugggcacccuuggcaagaaguucaaacaguaucgggagcugaagccucagacauguaccauuugcgagacgacacccguuaacgccaucgacgccgaaaugcacgaucucaauuguucuuacaacauuugcccuuauugugcuucccgccugaccagcgacgggcuggccagacaugugaugcagugcccgaaacggaaggagaaaaucgaagagacagaacucuaccugaaucuugagcgcauccccugggucgugagaaagcugcuccaagugucugaguccaccggagucgcucugaaacggagcuccuggcuuauuguucugcucgugcugcugaccgugucucucagcccuguccaguccgcccccaucggc

SEQ ID NO: 13977 - RNA, 972 nt, Artificial Sequence
  derived and/or modified CDS sequence (opt5) from CCHFV(SPU97/85)__DQ211633.1__Gn
agcgaggaauccgacggcgauugcaucucuagaacccagcugcuccggacagagacggccgaaauucacagcgacaacuacgggggacccggcgauaagaucaccauuuguaauggguccacaaucguggaccaacgccugggaucugagcuuggcugcuauaccauuaacagagucaagagcuucaaacugugugaaaauuccgcuacagggaaaucuugcgagaucgauagcaccccuguuaagugucggcagggauuuugccucaaaaucacacaggagggccgcggccaugugaagcuguccagagggagcgaaauugugcuugacgccugugauucuuccugcgagaucaugauuccgaagggaaccggcgacauccuggucgauuguagcgggggacagcaacacuuccucaaagacaaccugauugaucugggcugccccaauaucccucuccuggggcggauggcgauuuacaucugucgcaugucuaaccaucccaagacgaccauggcuuuucuuuucugguuuuccuucggauaugugaucacaugcauucugugcaaaguuaucuuuuaccuccugauuguggccggcaccgucggcaagaaauucaagcaguauagagaacuucggccucagacauguaccaucugcgagacgacacccgugaaugccauugacgcugagaugcacgaucugaacuguagcuacaauaucugcccuuauugugccucucgccucaccuccgacgggcuggcuagacauguuaugcagugcccgaagcggaaagaaaagaucgaggaaacagagcuguaccucaaccuggaacgcauucccuggguggucagaaaacuucugcaagugagcgaguccaccggaguggcccucaagcggucuagcuggcugaccguccuucugguucuccugaucgugucccugagcccugugcagucugcgcccauuggc

SEQ ID NO: 13978 - RNA, 972 nt, Artificial Sequence
  derived and/or modified CDS sequence (opt5) from CCHFV(SPU103/87)__DQ211634.1__Gn
agcgaggaauccucugacgauugcaucagcagaacccagcugcuccggacagagacggccgaaauucacggcgacaacuacgggggacccggcgauaagaucaccauuuguaauggguccacaaucguggaccaacgccugggaucugagcuuggcugcuauaccauuaacagagucaaaacauucaagcugugugaaaauagcgcuaccgggaaauccugcgagaucgauucuguuccugugaagugucggcagggauacugccucaaaaucacacaggagggccgcggccaugugaagcugagcagaggguccgaagucgugcuugacgccugugauaccagcugcgagguuaugauuccgaagggaacgggcgacauccugguggauuguucugggggacagcaacacuuucucaaagacaaccugauugaucugggcugccccaagaucccucuccuggggaaaauggcgauuuauaucugucggauguccaaucaucccaagaccacaauggcuuuccuguuuugguucagcuuuggauacgucauuaccugcgugcuuugcaaagccaucuucuaucuccugaucauuguuggcacacuuggcaagcgccugaagcaguacagagaacucaaaccucagaccuguacgaucugcgagacaacccccgugaacgccauugacgcugagaugcacgaucugaauuguucuuauaacaucugcccuuacugugccucccggcugacaagcgacgggcucgcucgccaugucacccagugcccgaagagaaaagaaaagguggaggaaaccgagcuguaccuuaaucuggaacggauucccugggugguccgcagacuccugcaaguuucugaguccacaggaguggcccuuaaacggagcuccuggcugaucgugcuccugguccuguuuacggugucucucagcccuguucaguccgcgcccaucagc

SEQ ID NO: 13979 - RNA, 972 nt, Artificial Sequence
  derived and/or modified CDS sequence (opt5) from CCHFV(SPU415/85)__DQ211635.1__Gn
agcgaggaauccgacggcgauugcaucucuagaacccagcugcuccggacagagacgaccgaaauucacagcgacaacuacgggggacccggcgauaagaucacaauuuguaauggguccaccaucguggaccaacgccugggaucugagcuuggcugcuauacaauuaacagagucaagagcuucaagcugugugaaaauuccgccaccgggaaaucuugcgagaucgauagcacaccuguuaagugucggcagggauuuugccucaaaaucacccaggagggccgcggccaugugaagcuguccagagggagcgaaauugugcuugacgcuugugauucuaacugcgagaucaugauuccgaagggaacgggcgacauccuggucgauuguuccgggggacagcaacacuuccucaaagacaaucugauugaucugggcugccccaacaucccucuccuggggaagauggccauuuacaucugucggaugagcaaucaucccaaaaccacaauggcguuucuuuucugguuuucuuucggauaugugauuaccugcauccugugcaagguuaucuuuuaccuccugauuguggcuggcacagucggcaaaaaguucaagcaguaucgcgaacuuagaccucagaccuguacgaucugcgagacaauucccgugaacgccaucgacgccgagaugcacgaucugaauuguuccuacaacaucugcccuuauugugcuagccggcucaccucugacgggcuggcccgccauguuaugcagugcccgaaaagaaaggaaaaaguggaggaaacagagcuguaccucaaucuggaacggauucccugggucgugcgcaaacuucugcaaguguccgagagcaccggagucgcucucaaaagauccucuuggcugaccguucuucuggugcuccugaucgugagccuguccccuguccagagcgcccccauuggc

SEQ ID NO: 13980 - RNA, 972 nt, Artificial Sequence
  derived and/or modified CDS sequence (opt5) from CCHFV(Turkey200310849)__DQ211636.1__Gn
agcgaggaacccggcgacgauugcaucuccagaacccagcugcuccggacagagacggccgaaauucacgacgauaacuacgggggaccuggcgacaagaucaccauuuguaaugggucuacaaucguggaucaacgccugggaagcgagcuuggcugcuauaccauuaacagagucaaauccuucaagcugugugaaaauucugcuacagggaaaaccugcgagguugacagcacaccggugaagugucggcagggauuuugccucaaaaucacccaggagggccgcggccaugugaagcuguccagagggucugaagucgugcuugaugccugugacagcuccugcgagguuaugauccccaagggaacgggcgauauucugguggacuguagcgggggacagcaacacuuccucaaagauaaccugaucgaccugggcugcccucauauuccccuccuggggaagauggcgaucuacauuugucggaugucuaaucacccucgcaccacaauggcuuuucuuuucugguuuuccuucggauaugucauuaccugcaucagcugcaaagcccuguuuuacucucucaucaucauuggcacacugggcaagaaaaucaagcaguauagagaacuuaagccccagaccuguacgauuugcgagacagccccugugaacgcuaucgaugccgagaugcaugaccugaauuguuccuacaacauuugcccguauugugcuagccggcucaccucugacgggcuggcccgccacguuacacagugccccaaaagaaaggaaaaaguggaggaaaccgagcuguaccucaaucuggaacggaucccuuggaucguccgcaaacuucugcaaguguccgagagcaccggaguggcgcucaagagauccucuuggcugauuguccuucugguucuccugacagugagccugucccccgugcagagcgccccugucggc

SEQ ID NO: 13981 - RNA, 972 nt, Artificial Sequence
  derived and/or modified CDS sequence (opt5) from CCHFV(Kosova Hoti)__EU037902.1__Gn
agcgaggaacccggcgacgauugcaucuccagaacccagcugcuccggacagagacggccgaaauucacgacgauaacuacgggggaccuggcgacaagaucaccauuuguaaugggucuacaaucguggaucaacgccugggaagcgagcuuggcugcuauaccauuaacagagucaaauccuucaagcugugugaaaauucugcuacagggaaaaccugcgagaucgacagcacaccgguuaagugucggcagggauuuugccucaaaaucacccagaagggccgcggccaugugaagcuguccagagggucugaggugguccuugaugccugugacagcaacugcgaagugaugauucccaaaggaacgggcgauauccugguugacuguuccgggggacagcaacacuuccucaaggauaaucugauugaccugggcugcccucauaucccccuccuggggaaaauggcgauuuacaucugucggaugagcaaccacccuaagaccacaauggcuuuucuuuucugguuuucuuucggauaugugauuaccugcaucuuuugcaaagcccuguucuacucccucaucauuaucggcacacugggcaagaagauuaaacaguaucgcgagcuuaagccccagaccuguacgaucugcgaaacagccccugucaaugcuauugaugccgagaugcaugaccugaacuguagcuacaauaucugcccguauugugcuucuagacucaccuccgacgggcuggcccggcacgugaaacagugccccaagcgcaaagagaagguugaagagacagaacuguaccucaaccuggagagaaucccuugggugguccggaaacuucugcaagugagcgaaucuaccggaguggcgcucaagcgcuccagcuggcugauuguccuucugguucuccugaccgugucccugucucccgugcagagcgccccugucggc

SEQ ID NO: 13982 - RNA, 972 nt, Artificial Sequence
  derived and/or modified CDS sequence (opt5) from CCHFV(YL04057)__FJ562094.1__Gn
gccgagggcgggagcuccgacugcaucucuagaacccagcuggugaagacagaagucgcugagauucacgaagauagcuacggaggccccggggagaaaaucacgauuuguaacggauccaccaucguugaccaacggcucggccgcgaacuggggugcuauacaauuaauagagugcggucuuacaaacuuugugagaacagcgccuccggaaagucuugcgagaucgauagcaucccugugaaguguaaacagggcuucugccugaagauuacccaggaaggccgcgggcaugucaagcucuccagaggaacagagaucgugcuggacguuugugauagcucuugcgaacuuaugauuccgaaaggcaccggggacauccugguggauuguuccggaggccagcaacacuuucuccagaauaaccugauugaccuggggugccccaaugucccucuccugggaaagauggcgaucuaugugugucggaugagcaaccaucccaaaacaaccauggcuuuccuguuuugguucucuuuuggcuacguuauuacgugcaucgccugccgcgugcuuuucuaucuccugaucgccauuggcaccgucgggaagaaacuuaagcaguacagagagcugaagccucagacauguaucgugugcgaguccgugcccgucaaugcuauugaugccgaaaugcacgagcucaacuguagcuauaauaucugcccuuacugugcuucucggcuguccaccgacggacugauucgccauguuacacaaugcccgaaaagacgggaaaagguggaggaaaccgagcucuuucugaaccuugagcgcauccccuggcuggugagaaaacuccugcaggucagcgaauccacgggcauggcccuuaagcggucuuguuggaugaucacacugcucauucugcugcucgugagcaucuccccuguucagagcgcgcccgugggg

SEQ ID NO: 13983 - RNA, 972 nt, Artificial Sequence
  derived and/or modified CDS sequence (opt5) from CCHFV(V42/81)__GU477490.1__Gn
agcaaggagcccggcgacgauugcaucuccagaacccagcugaugcggacagaaacggccgagauucacgacgauaacuacgggggaccuggcgacaaaaucaccauuuguaaugggucuacaaucguggaucaacgccucggaagcgaacugggcugcuauaccauuaacagagucaaguccuucaaacuuugugaaaauucugcuacagggaaggccugcgagguugacagcaccccggugaaaugucggcagggauuuugccugaagaucacacaggagggccgcggccaugugaagcucuccagagggucugaggucgugcuggaugcgugugacagcuccugcgaaguuaugauccccaaaggaaccggcgauauucuuguggacuguagcgggggacagcaacacuuccugaaggauaaccucaucgaccuggagugcccucauauuccccugcucggcaaacuggcuaucuacauuugucggaugucuaaucacccucgcacgaccauggccuuucuuuucugguuuggguucggauaugucaucacaugcauucugugcaaggcccucuuuuacucccugaucaucauuggcacccuuggcaaaaagaucaagcaguauagagaacugaaaccccagacauguaccauuugcgagacggcuccugugaacgccaucgaugcugagaugcaugaccucaauuguagcuacaacauuugcccguauugugccucucggcugacauccgacgggcuggcgcgccacguuacccagugccccaagagaaaagaaaagguggaggaaacagagcucuaccugaaucuugaacggaucccuuggaucguccgcaaacugcuccaagugagcgagucuaccggagugguccugaagagauccagcuggcuuauuguucugcucgugcugcugaccgugucccucucucccguccagagcgccccugugggc

SEQ ID NO: 13984 - RNA, 972 nt, Artificial Sequence
  derived and/or modified CDS sequence (opt5) from CCHFV(Afg09-2990)__HM452306.1__Gn
agcgaggaauccggcgacgauugcaucucuagaacccagcugcuccggacagagacggccgaagugcacggggacaacuacggaggccccggggauaagauuaccaucuguaauggaagcacagucguugaccaacgccugggcuccgagcuugggugcuauaccauuaacagagugcggucuuucaaacugugugaaaauagcgcuacaggaaaguccugcgagaucgauucuauuccugugaaauguaagcagggcuacugccucaaaaucacccaggagggccgcgggcaugucaagcugagcagaggauccgaagugguucuugacgugugugauagcucuugcgaggucaugaucccgaagggcacaggggacauucugguggauuguuccggaggccagcaacacuaucucaaagacaaccugguugaucuggggugccccaagaucccucuccugggaaaaauggccauuuacaucugucggaugagcaaucaucccaagaccacgauggcguuucuuuucugguuuucuuucggcuaugugauuaccugcauccugugcaaagcuaucuuuuuccuccugauuaucuuuggcacacuugggaagcgcuucaagcaguacagagaacugaaaccucagaccuguacaauuugcgagaccacgcccgucaacgccaucgacgccgagaugcacgaucucaauuguuccuauaacauuugcccuuacugugcuagccggcugacaucugacggacuggcccgccaugugacccagugcccgagacggaaggaaaaaguggaggaaacagagcucuaccugaaucuugaacgcauccccugggucguuagaaagcugcuccaaguguccgagagcaccggcaccgugcugaaacgguccucuuggcuuauuguccugcucgugcuguuuacaguuagccuguccccugugcagagcgcucccaucggg

SEQ ID NO: 13985 - RNA, 972 nt, Artificial Sequence
  derived and/or modified CDS sequence (opt5) from CCHFV(Sudan Al-Fulah 3-2008)__HQ378184.1__Gn
agcgaggaacccuccgacgauugcaucucuagaacccagcugcuccggacagagacggccgaaauucacggcgacaacuacgggggaccuggcgauaagaucaccauuuguaaugggagcacaaucguggaccaacgccugggauccgagcuuggcugcuauaccauuaacagagucaaaucuuucaagcugugugaaaauagcgcuacagggaaauccugcguuaucgauucugugccggugaagugucggcagggauacugccuccgcaucacccaggagggcagaggccaugucaaacugagccggggguccgaggugguucuugacgccugugauacaagcugcgaaauuaugauccccaagggaaccggcgacauucugguggauuguucugggggacagcaacacuuucucaaggacaaccuggucgaucugggcugcccuaaaaucccccuccuggggaagauggcgauuuauaucugucgcauguccaaucauccuaaaacgaccauggcuuuccuguuuugguucagcuuuggauacgugauuacaugcauccuuugcaaggccaucuucuaucuccugauuaucauuggcacccuuggcaaaagauuucggcaguaccgcgagcugaagccccagacauguaccaucugcgaaacgacaccuguuaacgccauugacgcugagaugcacgaucucaauuguucuuauaacaucugcccguacugugccuccagacugaccagcgacgggcuggcucggcaugugacacagugccccaagcgcaaagagaaggucgaagagaccgaacucuaccugaaucuugagagaaucccuuggguggugcggaaacugcuccaagucucugaauccaccggaguugcccugaagcgcagcuccuggcuuauugugcugcucgugcuguucacagucucucugagccccgugcaguccgcgccuaucggc

SEQ ID NO: 13986 - RNA, 972 nt, Artificial Sequence
  derived and/or modified CDS sequence (opt5) from CCHFV(Sudan AB1-2009)__HQ378187.1__Gn
agcgaggaacccuccgacgauugcaucucuagaacccagcugcuccggacagagacggccgaaauucacggcgacaacuacgggggaccuggcgauaagaucaccauuuguaaugggagcacaaucguggaccaacgccugggauccgagcuuggcugcuauaccauuaacagagucaaaucuuucaagcugugugaaaauagcgcuacagggaaaaacugcgagaucgauuccguuccggugaagugucggcagggauacugccuccgcaucacccaggagggcagaggccaugugaaacugucucgggggagcgaagucgugcuugacgccugugauacauccugcgagauuaugauccccaagggaaccggcgacauucugguugauuguagcgggggacagcaacacuuucucaaggacaaucugaucgaucugggcugcccuaaaauuccccuccuggggaagauggcgaucuauauuugucgcaugucuaaccauccuaaaacgaccauggcuuuccuguuuugguucuccuuuggauaccuuaucacaugcauccucugcaaggccauuuucuaucugcuuaucauuaucggcacccugggcaaaagacucaagcaguaccgggaacugaagccccagacauguaccauuugcgagacgacaccugugaaugccaucgacgcugagaugcacgaucugaacuguagcuauaauaucugcccguacugugccucucgccucaccuccgacgggcuggcuagacaugucauucagugccccaaacggaaggaaaaaguggaggaaacagagcuuuaccugaaccucgaacgcaucccuuggguugugagaaagcugcuucaagucagcgagucuaccggaguggcccugaaacgguccagcuggcucauugugcugcugguccucuuuaccguuucccugucucccgugcagagcgcgccuaucggc

SEQ ID NO: 13987 - RNA, 972 nt, Artificial Sequence
  derived and/or modified CDS sequence (opt5) from CCHFV(NIVA 118595)__JN572083.1__Gn
agcgaggaauccggcgacgauugcaucucuagaacccagcugcuccggacagagacggccgaagugcacggggacaacuacggaggccccggggauaagauuaccaucuguaauggaagcacagucguugaccaacgccugggcuccgagcuugggugcuauaccauuaacagagugaaaucuuucaagcugugugaaaauagcgcuacaggaaaauccugcgagaucgauucuauuccugugaagugucggcagggcuacugccucaaaaucacccaggagggccgcgggcaugucaagcugagcagaggauccgaagugguucuugacgccugugauagcucuugcgaggugaugaucccgaagggcacaggggacauucuggucgauuguuccggaggccagcaacacuuucucaaagacaaccugaucgaucuggggugccccaagauuccucuccugggaaaaauggcgaucuauauuugucggaugagcaaucaucccaagaccacgauggcuuuccuguuuugguucucuuuuggcuacgugauuaccugcauccuuugcaaaguuaucuucuaucuccugaucauuuuuggcacacuugggaagcgcuucaagcaguacagagaacugaaaccucagaccuguacaaucugcgagaccacgcccgugaacgccauugacgccgagaugcacgaucucaauuguuccuauaacaucugcccuuacugugcuagccggcugacaucugacggacuggcccgccaugucacccagugcccgaagagaaaagaaaagguggaggaaacagagcucuaccugaaucuugaacggauucccugggugguccgcaaacugcuccaaguuuccgagagcaccggcaucgcucugaagagauccucuuggcuuaucgugcugcucgugcuguuuaccgucagcauuacaccugugcaguccgcccccaucggg

SEQ ID NO: 13988 - RNA, 972 nt, Artificial Sequence
  derived and/or modified CDS sequence (opt5) from CCHFV(SCT ex Afghanistan)__KC344856.1__Gn
agcgaggaauccggcgacgauugcaucucuagaacccagcugcuccggacagagacggccgaagugcacaacgacaauuacgggggacccggcgauaagauuaccaucuguaacgggagcacaauugucgaccaacgccugggauccgagcuuggcugcuauaccaucaauagaguuaaaucuuucaagcugugugaaaacagcgcuacagggaaauccugcaagauugauucuaccccugugaaaugucggcagggauuuugccucaagaucacacaggagggccgcggccaugugaagcugagcagaggguccgaggucgugcuugacgccugugauagcucuugcgaaaucaugauuccgaaaggaaccggcgacauccugguugauuguuccgggggacagcaacacuuccucaaggacaaucugauugaucugggcugccccaacaucccucuccuggggaaaauggcgauuuacaucugucggaugagcaaucaucccaagacgaccauggcuuuucuuuucugguuuucuuucggauaugugauuacaugcaucuuuugcaaagucaucuucuaccugcucauugugguuggcacccugggcaagaaguuuaaacaguaucgcgagcuuaagccucagacauguaccaucugcgaaacgacacccaccaacgccauugacgccgagaugcacgaucugaauuguuccuacaacaucugcccuuauugugcuagcagacucacaucugacgggcuggcccggcaugugacccagugcccgaaacgcaaggagaaagucgaagagaccgaacuguaccucaaucuggagcggauucccuggaucgugagaaaacuucugcaaguguccgaaagcacaggagucgcucucaagcgcuccucuuggcugaucguucuucuggugcuccugacggugagccuguccccuguccagagcgcccccauuggc

SEQ ID NO: 13989 - RNA, 972 nt, Artificial Sequence
  derived and/or modified CDS sequence (opt5) from CCHFV(Zahedan 2007)__KC867273.1__Gn
agcgaggaauccggcgacgauugcaucucuagaacccagcugcuccggacagagacggccgaagugcacggggacaacuacggaggccccggggauaagauuaccaucuguaauggaagcacagucguugaccaacgccugggcuccgagcuugggugcuauaccauuaacagagugcggucuuucaaacugugugaaaauagcgcuacaggaaaguccugcgagaucgauucuauuccugugaaauguaagcagggcuuuugccucaaaaucacccaggagggccgcgggcaugucaagcugagcagaggauccgaagugguucuugacgugugugauagcucuugcgaggucaugaucccgaagggcacaggggacauucugguggauuguuccggaggccagcaacacuuccucaaagacaaccugguugaucuggggugccccaagaucccucuccugggaaaaauggccauuuacaucugucggaugagcaaucaucccaagaccacgauggcguuucuuuucugguuuucuuucggcuaugugauuaccugcauccugugcaaagcuaucuuuuuccuccugauuaucuuuggcacacuugggaagcgcuucaagcaguacagagaacugaaaccucagaccuguacaauuugcgagaccacgcccgucaacgccaucgacgccgagaugcacgaucucaauuguuccuauaacauuugcccuuacugugcuagccggcugacaucugacggacuggcccgccaugugacccagugcccgagacggaaggaaaaaguggaggaaacagagcucuaucugaaucuugaacgcauccccugggucguuagaaagcugcuccaaguguccgagagcaccggcaccgugcugaaacgguccucuuggcuuauuguccugcucgugcuguuuacaguuagccuguccccugugcagagcgcucccaucggg

SEQ ID NO: 13990 - RNA, 972 nt, Artificial Sequence
  derived and/or modified CDS sequence (opt5) from CCHFV(SPU 44/08)__KJ682805.1__Gn
agcgaggaauccaacgacgauugccugucuagaacccagcuccugcggacagagaaugccgaaauccacagcgacaacuacggcgggcccggagauaagauuacgaucuguaauggcuccaccauuguggaccaacgccuugggucugagcugggaugcuauacaaucaacagagucaagagcuucaaacucugugaaaauuccgcuaccggcaaaucuugcgagauugauagcacaccuguucggugucgccagggguuuugccugaagaucacccaggagggaagaggccaugugaaacuuucccggggcagcgaagugguccuggacgccugugauucuuccugcgagaucaugauuccgaaggggacaggagacauccucguggauuguagcggcgggcagcaacacuuccugaaggacaaccugguugaucucggaugccccaauauuccucugcuuggcaaaauggcgaucuacauuugucgcaugucuaaccaucccaagaccacgauggcuuuucuguucugguuuuccuucggguaugugauuaccugcauccucugcaaagccaucuuuuaccugcuuaucgucgugggaacacugggcaagaaauucaagcaguauagagaacucaagccucagaccuguacaauuugcgagaccaaucccguuaacgccaucgacgcugagaugcacgaucugaauuguagcuacaacauuugcccuuauugugccucucggcugacguccgacggccucgcucgccaugugaugcagugcccgaaaagaaaggagaaaaucgaagaaacagagcuguaccuuaaucuggaacggauucccugggucgugcgcaagcuccugcaagugagcgaguccaccggggucgcccuuaaaagaucuagcuggcugguuauccuccuggugcugcucacagugucccugagcccuguccagucugcgcccaucucc

SEQ ID NO: 13991 - RNA, 972 nt, Artificial Sequence
  derived and/or modified CDS sequence (opt5) from CCHFV(SPU 383/87)__KJ682806.1__Gn
agcgaggaauccaacgacgauugccugucuagaacccagcuccugcggacagagaaugccgaaauccacagcgacaacuacggcgggcccggagauaagauuacgaucuguaauggcuccaccauuguggaccaacgccuugggucugagcugggaugcuauacaaucaacagagucaagagcuucaaacucugugaaaauuccgcuaccggcaaaucuugcgagauugauagcacaccuguucggugucgccagggguuuugccugaagaucacccaggagggaagaggccaugugaaacuuucccggggcagcgaagugguccuggacgccugugauucuuccugcgagaucaugauuccgaaggggacaggagacauccucguggauuguagcggcgggcagcaacacuuccugaaggacaaccugguugaucucggaugccccaauauuccucugcuuggcaaaauggcgaucuacauuugucgcaugucuaaccaucccaagaccacgauggcuuuucuguucugguuuuccuucggguaugugauuaccugcauccucugcaaagucaucuuuuaccugcuugugguugugggaacacugggcaagaaauucaagcaguauagagaacucaagccucagaccuguacaaucugcgagaccaaucccgucaacgccauugacgccgagaugcacgaucugaauuguagcuacaacaucugcccuuauugugcuucucggcugacguccgacggccucgcccgccaugugauucagugcccgaaaagaaaggagaaaaucgaagaaacagagcuguaccuuaaucuggaacggauucccugggugguccgcaagcuccugcaaguuagcgaguccaccgggguggcucuuaaaagaucuagcuggcuggugauccuccugguccugcucacagugucccugagcccuguucagucugcccccaucucc

SEQ ID NO: 13992 - RNA, 972 nt, Artificial Sequence
  derived and/or modified CDS sequence (opt5) from CCHFV(SPU 130/89)__KJ682807.1__Gn
agcgaggaacccaacuacgacugccuguccagaacccagcuccugcggacagagaaugccgaaauccacucugauaacuauggcgggccuggagacaagauuacgaucuguaauggcagcaccauuguggaucaacgccuuggguccgagcugggaugcuacacaaucaacagagucaaaucuuucaagcucugugaaaauagcgcuaccggcaaauccugcgagauugacucuacaccgguucggugucgccagggguuuugccugaagaucacccaggagggaagaggccaugugaaacuuagccggggcuccgaagugguccuggaugccugugacagcucuugcgagaucaugauucccaaggggacaggagauauccucguggacuguuccggcgggcagcaacacuuccugaaggauaaccugguugaccucggaugcccuaauauuccccugcuuggcaaaauggcgaucuauauuugucgcaugagcaaccauccuaagaccacgauggcuuuucuguucugguuuucuuucggguacgugauuaccugcauccucugcaaagucaucuuuuaucugcuuaucgugguuggaacacugggcaagaaauucaagcaguacagagaacucaagccccagaccuguacaauuugcgagaccaauccugugaacgccaucgaugccgagaugcacgaccugaauuguuccuauaacauuugcccguacugugcuagccggcugacgucugauggccucgcccgccaugucaugcagugccccaaaagaaaggagaaaaucgaagaaacagagcuguaccuuaaucuggaacggauuccuuggguggugcgcaagcuccugcaagucuccgagagcaccgggguugcucuuaaaagauccucuuggcugguggugcuccugguccugcucacagugagccugucccccguucagagcgccccuaucucu

SEQ ID NO: 13993 - RNA, 972 nt, Artificial Sequence
  derived and/or modified CDS sequence (opt5) from CCHFV(SPU 497/88)__KJ682808.1__Gn
agcgaggaauccaacgacgauugccugucuagaacccagcuccugcggacagagaaugccgaaauccacagcgacaacuacggcgggcccggagauaagauuacgaucuguaauggcuccaccauuguggaccaacgccuugggucugagcugggaugcuauacaaucaacagagucaagagcuucaagcucugugaaaauuccgcuaccggcaaaucuugcgagauugauagcacaccuguucggugucgccagggguuuugccugaagaucacccaggagggaaaaggccaugugaaacuuuccagaggcagcgaagugguccuggacgccugugauucuuccugcgagaucaugauuccgaaggggacaggagacauccucguggauuguagcggcgggcagcaacacuuccugaaagacaaccugguugaucucggaugccccaauauuccucugcuuggcaagauggcgaucuacauuugucggaugucuaaccaucccaaaaccacgaugguguuucuguucugguuuuccuucggguaugucauuaccugcauucucugcaaggugaucuuuuaccugcuuaucguugugggaacacugggcaaaaaguucaagcaguaucgcgaacucaaaccucagaccuguacaauuugcgagaccaaucccgucaacgcuaucgacgccgagaugcacgaucugaauuguagcuacaacauuugcccuuauugugccucuagacugacguccgacggccucgcucggcaugugaugcagugcccgaagcgcaaagaaaagaucgaggaaacagagcuguaccuuaaucuggaaagaauccccugggugguccggaaacuccugcaaguuagcgaguccaccgggguggcccuuaagcgcucuagcuggcuggugauccuccugguccugcucacagugucccugagcccuguucagucugcucccaucucc

SEQ ID NO: 13994 - RNA, 972 nt, Artificial Sequence
  derived and/or modified CDS sequence (opt5) from CCHFV(SPU 18/88)__KJ682810.1__Gn
agcgaggaauccaacgacgauugccugucuagaacccagcuccugcggacagagaaugccgaaauccacagcgacaacuacggcgggcccggagauaagauuacgaucuguaauggcuccaccauuguggaccaacgccuugggucugagcugggaugcuauacaaucaacagagucaagagcuucaaacucugugaaaauuccgcuaccggcaaaucuugcgagauugauagcacaccuguucggugucgccagggguuuugccugaagaucacccaggagggaagaggccaugugaaacuuucccggggcagcgaagugguccuggacgccugugauucuuccugcgagaucaugauuccgaaggggacaggagacauccucguggauuguagcggcgggcagcaacacuuccugaaggacaaccugguugaucucggaugccccaauauuccucugcuuggcaaaauggcgaucuacauuugucgcaugucuaaccaucccaagaccacgaugggguuucuguucugguuuuccuucggauaugugauuaccugcauccucugcaaagucaucuuuuaccugcuuaucgugguuggcacacugggcaagaaauucaagcaguauagagaacucaagccucagaccuguacaauuugcgagaccaaucccgugaacgcuaucgacgccgagaugcacgaucugaauuguagcuacaacauuugcccuuauugugccucucggcugacguccgacgggcucgcucgccaugucaugcagugcccgaaaagaaaggagaaaaucgaagaaacagagcuguaccuuaaucuggaacggauucccuggguggugcgcaagcuccugcaagucagcgaguccaccggaguugcccuuaaaagaucuagcuggcuggugauccuccuggugcugcucacagucucccugagcccugugcagucugcucccaucucc

SEQ ID NO: 13995 - RNA, 972 nt, Artificial Sequence
  derived and/or modified CDS sequence (opt5) from CCHFV(SPU 48/90)__KJ682813.1__Gn
agcgaggaacccuccgacgauugcaucucuagaacccagcugcuccggacagagacggccgaaauucacggcgacaacuacgggggaccuggcgauaagaucaccauuuguaaugggagcacaaucguggaccaacgccugggauccgagcuuggcugcuauaccauuaacagagucaaaucuuucaagcugugugaaaauagcgcuacagggaaauccugcguuaucgauucugugccggugaagugucggcagggauacugccuccgcaucacccaggagggcagaggccaugucaaacugagccggggguccgaggugguucuugacgccugugauacaagcugcgaaauuaugauccccaagggaaccggcgacauucugguggauuguucugggggacagcaacacuuucucaaggacaaccugaucgaucugggcugcccuaaaauuccccuccuggggaagauggcgaucuauauuugucgcauguccaaucauccuacgaccacaauggcuuuccuguuuugguucagcuuuggauacgucauuaccugcauccuuugcaaagccauuuucuaucuccugaucauuaucggcacacuuggcaagagauuucggcaguaccgcgagcugaaaccccagaccuguacgauuugcgaaacaaccccugugaacgccaucgacgcugagaugcacgaucucaauuguucuuauaacaucugcccguacugugccuccagacugacaagcgacgggcuggcucggcauguuacccagugccccaagcgcaaggagaaaguggaagagaccgaacucuaccugaaucuugagagaaucccuugggucgugcggaagcugcuccaagugucugaauccacaggagucgcccugaaacgcagcuccuggcuuaucguucugcucgugcuguucacggugucucugagccccguccaguccgcgccuauuggc

SEQ ID NO: 13996 - RNA, 972 nt, Artificial Sequence
  derived and/or modified CDS sequence (opt5) from CCHFV(SPU 187/90)__KJ682814.1__Gn
agcgaggaacccuccgacgauugcaucucuagaacccagcugcuccggacagagacggccgaaauucacggcgacaacuacgggggaccuggcgauaagaucaccauuuguaaugggagcacaaucguggaccaacgccugggauccgagcuuggcugcuauaccauuaacagagucaaaucuuucaagcugugugaaaauagcgcuacagggaaauccugcgagaucgauucuguuccggugaagugucggcagggauacugccuccgcaucacccaggagggcagaggccaugugaaacugagccggggguccgaagucgugcuugacgccugugauacaagcugcgagauuaugauccccaagggaaccggcgacauucugguugauuguucugggggacagcaacacuuucucaaggacaaccugaucgaucugggcugcccuaaaauuccccuccuggggaagauggcgaucuauauuugucgcauguccaaucauccuaaaacgaccauggcuuuccuguuuugguucagcuuuggauacgugaucacaugcauccuuugcaaggccauuuucuaucuccugaucauuaucggcacccuuggcaaaagauuuaagcaguaccgggaacugaagccccagacauguaccauuugcgagacgacaccugucaacgccaucgacgcugagaugcacgaucucaauuguucuuauaacaucugcccguacugugccucccgccugaccagcgacgggcuggcuagacaugugacacagugccccaaacggaaggaaaaaguugaggaaaccgagcucuaccugaaucuugaacgcauuccuuggguggucagaaagcugcuccaagugucugaguccaccggaguggcccugaaacggagcuccuggcuuaucguccugcucguucuguucacagugucucugagccccgugcaguccgcgccuauuggc

SEQ ID NO: 13997 - RNA, 972 nt, Artificial Sequence
  derived and/or modified CDS sequence (opt5) from CCHFV(Haskovo-V46/13)__KR092379.1__Gn
agcgaggaacugggcgacgauugcaucuccagaacccagcuccugcggacagagacggccgaaauucacgacgauaacuacgggggacccggcgacaagaucaccauuuguaaugggucuacaaucguggaucaacgccuuggaagcgagcugggcugcuauaccauuaacagagggaaauccuucaagcucugugaaaauucugcuacaggaaaaaccugcgagaucgacagcacaccugucaagugucggcagggcuuuugccugaaaaucacccaggagggccgcgggcauguuaaacuuuccagaggaucugaaguggugcuggaugccugugacagcuccugcgaggucaugauuccgaagggcacgggggauauccucguggacuguagcggaggccagcaacacuuccugaaggauaaccugauugaccucgggugcccccauaucccucugcuuggaaagauggcgauuuacaucugucggaugucuaaucacccccgcaccacaauggcuuuucuguucugguuuuccuucggcuauguuauuaccugcaucuuuugcaaagcccucuucuacagccugaucauuaucggcacacuugggaagaaaauuaagcaguauagagaacugaagccucagaccuguacgaucugcgagacaacccccgugaacgccauugaugcugagaugcaugaccucaauuguucuuacaacaucugcccuuauugugccucccggcugacaagcgacggacuggcucgccacgucacccagugcccgaaaagaaaggaaaaaguggaggaaaccgagcucuaccugaaucuugaacggauccccuggauuguucgcaagcugcuccaagugucugaguccacaggcgucgcccugaaaagaagcuccuggcuuaucgugcugcucgugcugcugccugucucucucagccccguucaguccgcgccugugggg

SEQ ID NO: 13998 - RNA, 972 nt, Artificial Sequence
  derived and/or modified CDS sequence (opt5) from CCHFV(24-R-2012)__KR814856.1__Gn
agcgaggaacccggcgacgauugcaucuccagaacccagcugcuccggacagagacggccgaaauucacgacgauaacuacgggggaccuggcgacaagaucaccauuuguaaugggucuacaaucguggaucaacgccugggaagcgagcuuggcugcuauaccauuaacagagucaaauccuucaagcugugugaaaauucugcuacagggaaaaccugcgagaucgacagcacaccgguuaagugucggcagggauuuugccucaaaaucacccaggagggccgcggccaugugaagcuguccagagggucugaagugguccuugaugccugugacacgagcugcgaggugaugauucccaagggaaccggcgauauccugguugacuguuccgggggacagcaacacuuccucaaagauaaccugauugaccugggcugcccucauaucccccuccuggggaagauggcgauuuacaucugucggaugagcaaucacccucgcacaaccauggcuuuucuuuucugguuuucuuucggauaugugauuacaugcaucuuuugcaaagcccuguucuacucccucaucauuaucggcacccugggcaagaaaauuaagcaguauagagaacuuaagccccagacguguacaaucugcgagaccgccccugucaacgcuauugaugccgagaugcaugaccugaauuguagcuacaacaucugcccguauugugcuucucggcucacauccgacgggcuggcccgccacgugccccagugcccuaaaagaaaggaaaaaguugaggaaaccgagcuguaccucaaucuggaacggauccccuggauugugcgcaaacuucugcaagucagcgagucuaccggaguggcgcucaagagauccagcuggcugaucgugcuucugguccuccugacaguuucccugucuccugugcagagcgcccccgugggc

SEQ ID NO: 13999 - RNA, 972 nt, Artificial Sequence
  derived and/or modified CDS sequence (opt5) from CCHFV(36-ST-2014)__KR814857.1__Gn
agcgaggaacccggcgacgauugcaucuccagaacccagcugcucaagacagagacggccgaaauucacgacgauaacuacgggggaccuggcgacaaaaucaccauuuguaaugggucuacaaucguggaucaacggcugggaagcgagcuuggcugcuauaccauuaaccgcgucaaguccuucaaacugugugaaaauucugcuacagggaagaccugcgagaucgacagcacaccgguuaaauguagacagggauuuugccucaagaucacccaggagggccggggccaugugaagcugucccgcgggucugaagugguccuugaugccugugacagcuccugcgagauuaugauccccaaaggaacgggcgauauucugguggacuguagcgggggacagcaacacuuccucaaggauaaccugaucgaccugggcugcccucauauuccccuccuggggaaaauggcgaucuacauuuguagaaugucuaaucacccucggaccacaauggcuuuucuuuucugguuuuccuucggauauguuauuaccugcaucuuuugcaaggcccuguucuacagccucauuaucauuggcacacugggcaaaaagaucaagcaguaucgcgaacuuaaaccccagaccuguacgauuugcgagacagccccugugaacgcuaucgaugccgagaugcaugaccugaauuguucuuacaacaucugcccguauugugcuuccagacucaccagcgacgggcuggcccggcacgucacacagugccccaagcgcaaagaaaagguggaggaaaccgagcuguaccucaaucuggaaagaaucccuuggaucguucggaaacuucugcaagugucugaguccaccggagucgcgcucaagcgcagcuccuggcugauugugcuucuggugcuccugacagucucucugagccccguucaguccgccccugugggc

SEQ ID NO: 14000 - RNA, 972 nt, Artificial Sequence
  derived and/or modified CDS sequence (opt5) from CCHFV(44-ST-2010)__KR814859.1__Gn
agcgaggaacccggcgacgauugcaucuccagaacccagcugcucaagacagagacggccgaaauucacgacgauaacuacgggggaccuggcgacaaaaucaccauuuguaaugggucuacaaucguggaucaacggcugggaagcgagcuuggcugcuauaccauuaaccgcgucaaguccuucaaacugugugaaaauucugcuacagggaagaccugcgagaucgacagcacaccgguuaaauguagacagggauuuugccucaagaucacccaggagggccggggccaugugaagcugucccgcgggucugaagugguccuugaugccugugacagcuccugcgagauuaugauccccaaaggaacgggcgauauucugguggacuguagcgggggacagcaacacuuccucaaggauaaccugaucgaccugggcugcccucauauuccccuccuggggaaaauggcgaucuacauuuguagaaugucuaaucacccucggaccacaauggcuuuucuucugugguucuccuuuggauauguuauuaccugcaucuucugcaaggcccucuuuuacagccugauuaucauuggcacacuuggcaaaaagaucaagcaguaucgcgaacugaaaccccagaccuguacgauuugcgagacagccccugugaacgcuaucgaugccgagaugcaugaccucaauuguucuuacaacaucugcccguauugugcuuccagacugaccagcgacgggcuggcccggcacgucacacagugccccaagcgcaaagaaaagguggaggaaaccgagcucuaccugaaucuugaaagaaucccuuggaucguucggaaacugcuccaagugucugaguccaccggagucgcgcugaagcgcagcuccuggcuuauugugcugcucgugcugcugacagucucucucagccccguucaguccgccccugugggc

SEQ ID NO: 14001 - RNA, 972 nt, Artificial Sequence
  derived and/or modified CDS sequence (opt5) from CCHFV(47-ST-2013)__KR814861.1__Gn
agcgaggaacccggcgacgauugcaucuccagaacccagcugcucaagacagagacggccgaaauucacgacgauaacuacgggggaccuggcgacaaaaucaccauuuguaaugggucuacaaucguggaucaacggcugggaagcgagcuuggcugcuauaccauuaaccgcgucaaguccuucaaacuguguaaaaauucugcuacagggaagaccugcgaaaucgacagcacaccgguuaaguguagacagggauuuugccucaagaucacccaggagggccggggccaugugaaacugucccgcgggucugaggugguccuugaugccugugacagcuccugcgaaauuaugauccccaagggaacgggcgauauucugguggacuguagcgggggacagcaacacuuccucaaagauaaccugaucgaccugggcugcccucauauuccccuccuggggaagauggcgaucuacauuuguagaaugucuaaucacccucggaccacaauggcuuuucuuuucugguuuuccuucggauauguuauuaccugcaucuuuugcaaagcccuguucuacagccucauuaucauuggcacacugggcaagaagaucaaacaguaucgcgagcuuaagccccagaccuguacgauuugcgaaacagccccugugaacgcuaucgaugccgagaugcaugaccugaauuguucuuacaacaucugcccguauugugcuuccagacucaccagcgacgggcuggcccggcacgucacacagugccccaaacgcaaggagaaaguggaagagaccgaacuguaccucaaucuggagagaaucccuuggaucguucggaaacuucugcaagugucugaauccaccggagucgcgcucaagcgcagcuccuggcugauugugcuucuggugcuccugacagucucucugagccccguucaguccgccccugugggc

SEQ ID NO: 14002 - RNA, 972 nt, Artificial Sequence
  derived and/or modified CDS sequence (opt5) from CCHFV(52-R-2014)__KR814862.1__Gn
agcgaggaacccggcgacgauugcaucuccagaacccagcugcuccggacagagacggccgaaauucacgacgauaacuacgggggaccuggcgacaagaucaccauuuguaaugggucuacaaucguggaucaacgccugggaagcgagcuuggcugcuauaccauuaacagagucaaauccuucaagcugugugaaaauucugcuacagggaaaaccugcgagaucgacagcacaccgguuaagugucggcagggauuuugccucaaaaucacccaggagggccgcggccaugugaagcuguccagagggucugaagugguccuugaugccugugacacgagcugcgaggugaugauucccaagggaaccggcgauauccugguugacuguuccgggggacagcaacacuuccucaaagauaaccugauugaccugggcugcccucaugugccccuccuggggaagauggcgaucuacauuugucggaugagcaaucacccucgcacaaccauggcuuuucuuuucugguuuucuuucggauaugucaucacaugcaucuuuugcaaagcccuguucuacucccucauuaucauuggcacccugggcaagaaaaucaagcaguauagagaacuuaagccccagacguguacaauuugcgagaccgccccugugaacgcuaucgaugccgagaugcaugaccugaauuguagcuacaacauuugcccguauugugcuucucggcucacauccgacgggcuggcccgccacguuccccagugcccuaaaagaaaggaaaaaguggaggaaaccgagcuguaccucaaucuggaacggauccccuggaucguccgcaaacuucugcaagugagcgagucuaccggaguggcgcucaagagauccagcuggcugauuguccuucugguucuccugacagugucccugucuccugugcagagcgcccccgucggc

SEQ ID NO: 14003 - RNA, 972 nt, Artificial Sequence
  derived and/or modified CDS sequence (opt5) from CCHFV(75-R-2012)__KR814863.1__Gn
agcgaggaacccggcgacgauugcaucuccagaacccagcugcuccggacagagacggccgaaauucacgacgauaacuacgggggaccuggcgacaagaucaccauuuguaaugggucuacaaucguggaucaacgccugggaagcgagcuuggcugcuauaccauuaacagagucaaauccuucaagcugugugaaaauucugcuacagggaaaaccugcgagaucgacagcgccccgguuaagugucggcagggauuuugccucaaaaucacacaggagggccgcggccaugugaagcuguccagagggucugaagugguccuugaugcgugugacagcuccugcgaggugaugauucccaagggaaccggcgauauccugguugacuguagcgggggacagcaacacuuccucaaagauaaccugauugaccugggcugcccucauaucccccuccuggggaagauggcuauuuacaucugucggaugucuaaucacccucgcacgaccauggccuuucuuuucugguuuuccuucggauaugugauuacaugcaucuuuugcaaagcccuguucuacagccucaucauuaucggcacccugggcaagaaaauuaagcaguauagagaacuuaagccccagacauguaccaucugcgagacggcuccugucaacgccauugaugcugagaugcaugaccugaauuguucuuacaacaucugcccguauugugccucccggcucacaagcgacgggcuggcgcgccacgugccccagugcccuaaaagaaaggaaaaaguugaggaaaccgagcuguaccucaaucuggaacggauccccuggauugugcgcaaacuucugcaagucucugaguccacaggaguggcccucaagagaagcuccuggcugaucgugcuucugguccuccugaccguuucucugagcccugugcaguccgcucccgugggc

SEQ ID NO: 14004 - RNA, 972 nt, Artificial Sequence
  derived and/or modified CDS sequence (opt5) from CCHFV(75-ST-2010)__KR814864.1__Gn
agcgaggaauccggcgacgauugcaucucuagaacccagcugcuccggacagagacggccgaaauucacgacgauaacuacgggggacccggcgacaagaucaccauuuguaaugggagcacaaucguggaucaacgccugggauccgagcuuggcugcuauaccauuaacagagucaaaucuuucaagcugugugaaaauagcgcuacagggaaaaccugcgagaucgacuccacaccuguuaagugucggcagggauuuugccucaaaaucacccaggagggccgcggccaugugaagcugucuagagggagcgaagugguccuugaugccugugacuccagcugcgaggugaugauuccgaagggaacgggcgauauccugguugacuguucugggggacagcaacacuuccucaaagauaaccugauugaccugggcugcccccauaucccucuccuggggaagauggcgauuuacaucugucggauguccaaucacccccgcaccacaauggcuuuucuuuucugguuuagcuucggauaugugauuaccugccuguuuugcaaagcccucuucuacucucugaucaucauuggcacacuuggcaagaaaaucaagcaguauagagaacugcggccucagaccuguacgauuugcgagacagcccccgucaacgcuaucgaugccgagaugcaugaccucaauuguuccuacaacauuugcccuuauugugcuagccgccugaccucugacgggcuggccagacacgugccgcagugccccaagcggaaagaaaagguugaggaaacagagcucuaccugaaucuugaacgcaucccuuggaucgugagaaaacugcuccaagucuccgagagcaccggaguggcgcugaagcgguccucuuggcuuauugugcugcucguccugcugaccguuagccucucccccgugcagagcgccccugugggc

SEQ ID NO: 14005 - RNA, 972 nt, Artificial Sequence
  derived and/or modified CDS sequence (opt5) from CCHFV(3820-ST-2007)__KR814868.1__Gn
agcgaggaacccggcgacgauugcaucuccagaacccagcugcucaagacagagacggccgaaauucacgacgauaacuacgggucuccuggagacaaaaucaccauuuguaauggcagcacaaucguggaucaacggcugggguccgagcuuggaugcuauaccauuaaccgcgucaagucuuucaaacugugugaaaauagcgcuacaggcaagaccugcgagaucgacuccacaccgguuaaauguagacagggguuuugccucaagaucacccaggagggacggggccaugugaagcugucucgcggcagcgaagugguccuugaugccugugacuccagcugcgagauuaugauccccaaagggacgggagauauucugguggacuguucuggcgggcagcaacacuuccucaaggauaaccugaucgaccugggaugcccucauauuccccuccugggcaaaauggcgaucuacauuuguagaauguccaaucacccucggaccacaauggcuuuucuuuucugguuuagcuucggguauguuauuaccugcaucuuuugcaaggcccuguucuacucucucauuaucauuggaacacugggcaaaaagaucaagcaguaucgcgaacuuaaaccccagaccuguacgauuugcgagacagccccugugaacgcuaucgaugccgagaugcaugaccugaauuguuccuacaacaucugcccguauugugcuagcagacucaccucugacggccuggcccggcacgucacacagugccccaagcgcaaagaaaagguggaggaaaccgagcuguaccucaaucuggaaagaaucccuuggaucguucggaaacuucugcaaguguccgagagcaccggggucgcgcucaagcgcuccucuuggcugauugugcuucuggugcuccuggccgucagccugucccccguucagagcgcuccuguggga

SEQ ID NO: 14006 - RNA, 972 nt, Artificial Sequence
  derived and/or modified CDS sequence (opt5) from CCHFV(4701-ST-2009)__KR814872.1__Gn
agcgaggaacccggcgacgauugcaucuccagaacccagcugcucaagacagagacggccgaaauucacgacgauaacuacgggggaccuggcgacaaaaucaccauuuguaaugggucuacaguggucgaucaacggcugggaagcgagcuuggcugcuauaccaucaaccgcguuaaguccuucaaacugugugaaaauucugcuacagggaagaccugcgagauugacagcacaccggugaaauguagacagggauuuugccucaagaucacccaggagggccggggccaugugaagcugucccgcgggucugaagucgugcuugaugccugugacagcuccugcgagaucaugauucccaaaggaacgggcgauauccugguugacuguagcgggggacagcaacacuuccucaaggauaaccugauugaccugggcugcccucauaucccccuccuggggaaaauggcgauuuacaucuguagaaugucuaaucacccucggaccacaauggcuuuucuuuucugguuuuccuucggauaugugauuaccugcaucuuuugcaaggcccuguucuacagccucaucauuaucggcacacugggcaaaaagauuaagcaguaucgcgaacuuaaaccccagaccuguacgaucugcgagacagccccugucaacgcuauugaugccgagaugcaugaccugaauuguucuuacaacaucugcccguauugugcuuccagacucaccagcgacgggcuggcccggcacgugacacagugccccaagcgcaaagaaaagguugaggaaaccgagcuguaccucaaucuggaaagaaucccuuggauugugcggaaacuucugcaagucucugaguccaccggaguggcgcucaagcgcagcuccuggcugaucgugcuucugguccuccugacaguuucucugagccccgugcaguccgccccugugggc

SEQ ID NO: 14007 - RNA, 972 nt, Artificial Sequence
  derived and/or modified CDS sequence (opt5) from CCHFV(5170-R-2011)__KR814873.1__Gn
agcgaggaacccggcgacgauugcaucuccagaacccagcugcucaagacagagacggccgaaauucacgacgauaacuacgggggaccuggcgacaaaaucaccauuuguaaugggucuacaaucguggaucaacggcugggaagcgagcuuggcugcuauaccauuaaccgcgucaaguccuucaaacugugugaaaauucugcuacagggaagaccugcgagaucgacagcacaccgguuaaauguagacagggauuuugccucaagaucacccaggagggccggggccaugugaagcugucccgcgggucugaagugguccuugaugugugugacagcuccugcgagauuaugauccccaaaggaacgggcgauauucugguugacuguagcgggggacagcaacacuuccucaaggauaaccugaucgaccugggcugcccucauauuccccuccuggggaaaauggccaucuacauuuguagaaugucuaaucacccucggaccacaauggcguuucuuuucugguuuuccuucggauaugugauuaccugcaucuuuugcaaggcucuguucuacagccucauuaucauuggcacacugggcaaaaagaucaagcaguaucgcgaacuuaaaccccagaccuguacgauuugcgagacagccccugucaacgccaucgaugcugagaugcaugaccugaauuguucuuacaacaucugcccguauugugccuccagacucaccagcgaagggcuggcucggcacgugacacagugccccaagcgcaaagagaagguugaagagaccgaacuguaccucaaucuggagagaaucccuuggaucgugcggaaacuucugcaagucucugaguccaccggaguggcccucaagcgcagcuccuggcugauugugcuucugguccuccugacaguuucucugagccccgugcaguccgcgccugugggc

SEQ ID NO: 14008 - RNA, 972 nt, Artificial Sequence
  derived and/or modified CDS sequence (opt5) from CCHFV(200406546-Turkey)__KR864902.1__Gn
agcgaggaacccggcgacgauugcaucuccagaacccagcugcuccggacagagacggccgaaauucacgacgauaacuacgggggaccuggcgacaagaucaccauuuguaaugggucuacaaucguggaucaacgccugggaagcgagcuuggcugcuauaccauuaacagagucaaauccuucaagcugugugaaaauucugcuacagggaaaaccugcgagaucgacagcacaccgguuaagugucggcagggauuuugccucaaaaucacccaggagggccgcggccaugugaagcuguccagagggucugaagugguccuugaugugugugacagcuccugcgagguuaugauucccaagggaacgggcgauauccugguggacuguagcgggggacagcaacacuuccucaaagauaaccugauugaccugggcugcccucaugucccccuccuggggcggauggccaucuacauuugucgcaugucuaaucacccuagaaccacaauggcguuucuuuucugguuuuccuucggauaugugauuaccugcaucuuuugcaaggcucuguucuacagccucaucaucauuggcacacugggcaaaaaguuuaaacaguaucgggaacuuaagccccagaccuguacgaucugcgagacagccccuguuaacgccauugaugcugagaugcaugaccugaauuguucuuacaacaucugcccguauugugccucccgccucaccagcgacgggcuggcuagacacgugccccagugcccuaagcggaaagaaaaggucgaggaaacagagcuguaccucaaucuggaacgcauucccuggaucgugagaaaacuucugcaagugucugaguccaccggagucgcccucaagcggagcuccuggcugaucguucuucuggugcuccugaccgugucucugagcccuguccaguccgcgcccgugggc

SEQ ID NO: 14009 - RNA, 972 nt, Artificial Sequence
  derived and/or modified CDS sequence (opt5) from CCHFV(1-CR/HU-2015)__KU161584.1__Gn
agcgaggaacccggcgacgauugcaucuccagaacccagcugcuccggacagagacggccgaaauucacgacgauaacuacgggggaccuggcgacaagaucaccauuuguaaugggucuacaaucguggaucaacgccugggaagcgagcuuggcugcuauaccauuaacagagucaaauccuucaagcugugugaaaauucugcuacagggaaaaccugcgagaucgacagcacaccgguuaagugucggcagggauuuugccucaaaaucacccaggagggccgcggccaugugaagcuguccagagggucugaagugguccuugaugccugugacagcuccugcgaggugaugauucccaagggaacgggcgauauccugguugacuguagcgggggacagcaacacuuccucaaagauaaccugauugaccugggcugcccucauaucccccuccuggggaagauggcgauuuacaucugucggaugucuaaucacccucgcaccacaauggcuuuucuuuucugguuuuccuucggauaugugauuaccugcaucuuuugcaaagcccuguucuacagccucaucauuaucggcacacugggcaagaaaauuaagcaguauagagaacuuaagccccagaccuguacgaucugcgagacagccccugucaacgcuauugaugccgagaugcaugaccugaauuguucuuacaacaucugcccguauugugcuucccggcucaccagcgacgggcuggcccgccacgugacacagugccccaaaagaaaggaaaaaguugaggaaaccgagcuguaccucaaucuggaacggaucccuuggauugugcgcaaacuucugcaagucucugaguccaccggaguggcgcucaagagaagcuccuggcugaucgugcuucugguccuccugacaguuucucugagccccgugcaguccgccccugugggc

SEQ ID NO: 14010 - RNA, 972 nt, Artificial Sequence
  derived and/or modified CDS sequence (opt5) from CCHFV(Gaib)__KX013445.1__Gn
agcgaggaauccucugacgauugcaucagcagaacccagcugcuccggacagagacggccgaaauucacaacgacaauuacggcgggcccggagauaagaucaccauuuguaacggcuccacaaucguggaccaacgccuggggucugagcuuggaugcuauaccauuaauagagucaagagcuucaaacugugugaaaacuccgcuacaggcaaaucuugcgagaucgauagcaucccuguuaagugucggcagggguuuugccucaaaauuacccaggagggacgcggccaugugaagcuguccagaggcagcgaagugguccuugacgccugugauucuuccugcgagaucaugauuccgaaggggacaggagacauccugguggauuguagcggcgggcagcaacacuuccucaaagacaaucugauugaucugggaugccccaacaucccucuccugggcaagauggcgauuuacaucugucggaugucuaaucaucccaaaaccacgauggcuuuucuuuucugguuuuccuucggguauguuauuaccugcaucuuuugcaaggccaucuucuaccugcucauuaucgugggaacacugggcaaaaaguuuaagcaguaucgcgaacuuaaaccucagaccuguacaauuugcgagaccacgcccgucaacgccaucgacgcugagaugcacgaucugaauuguagcuacaacaucugcccuuauugugccucuagacucacauccgacggccuggcucggcaugugguucacugcccgaagcgcaaagaaaagauugaggaaaccgagcuguaccucaaucuggaaagagugcccugggucgugcggaaacuucuccaggugagcgaguccacaggggucgcccugaagcgcucuagcuggcugaucguucuucuggugcuccugaccgugucccugagcccuguccaaucugcgcccauugga

SEQ ID NO: 14011 - RNA, 972 nt, Artificial Sequence
  derived and/or modified CDS sequence (opt5) from CCHFV(Hodzha)__KX013448.1__Gn
agcgaggaauccggcgacgauugcaucucuagaacccagcugcuccggacagagacggccgaaauucacggggacgauuacggaggccccggggacaagaucaccauuuguaacggaagcacaaucguggaucaacgccugggcuccgagcuugggugcuauaccauuaauagagucaaaucuuucaagcugugugaaaacagcgcuacaggaaaauccugcgagaucgacucuaccccuguuaagugucggcagggcuacugccucaaaaucacacaggagggccgcgggcaugugaagcugagcagaggauccgaagugguccuugaugccugugacagcucuugcgaggugaugauuccgaagggcaccggggauauccugguugacuguuccggaggccagcaacacuuucucaaagauaaucugauugaccuggggugcccccggaucccucuccugggaaagauggcgauuuauaucugucgcaugagcaaccaucccgaaacgaccauggcuuuccuguuuugguucucuuuuggcuacgugauuacaugcauccuuugcaaagccaucuucuaucuccugauuaucgucggcacccuugggaagagauuuaaacaguaccgggagcugaagccucagacauguaccauuugcgagacgacacccgccaaugcuaucgaugccgaaaugcacgaccucaacuguuccuauaauauuugcccuuacugugcuagccgccugaccucugacggacuggccagacaugugacacagugcccgaagcggaaagagaagguugaagagaccgaacucuaccugaaccuugagcgcauccccuggaucgugagaaaacugcuccaagucuccgagagcaccggcguggcgcugaagcgguccucuuggcuuauugugcugcucguccuguucgccguuagccuguccccugugcagagcgcucccaucggg

SEQ ID NO: 14012 - RNA, 972 nt, Artificial Sequence
  derived and/or modified CDS sequence (opt5) from CCHFV(IbAn7620)__KX013451.1__Gn
agcgaggaacccuccgacgauugcaucucuagaacccagcugcuccggacagagacggccgaaauucacggcgacaacuacgggggaccuggcgauaagaucaccauuuguaaugggagcacaaucguggaccaacgccugggauccgagcuuggcugcuauaccauuaacagagucaaaucuuucaagcugugugaaaauagcgcuacagggaaaaacugcgagaucgauuccguuccggugaagugucggcagggauacugccuccgcaucacccaggagggcagaggccaugugaaacugucucgggggagcgaaauuguccuugacgccugugauacauccugcgagaucaugauucccaagggaaccggcgacauccugguggauuguagcgggggacagcaacacuuucucaaggacaaucugauugaucugggcugcccuaaaaucccccuccuggggaagauggcgauuuauaucugucgcaugucuaaccauccuaaaacgaccauggcuuuccuguuuugguucuccuuuggauacguuaucacaugcauucuuugcaaggccaucuucuaucuccugauuaucauuggcacccuuggcaaaagacugaagcaguaccgggaacucaagccccagacauguaccaucugcgagacgacaccugugaaugccaucgacgcugagaugcacgaucugaacuguagcuauaauauuugcccguacugugccucucgccugaccuccgacgggcucgcuagacaugucauccagugccccaaacggaaggaaaaaguggaggaaacagagcuguaccuuaaccuggaacgcauuccuuggguugugagaaagcuccugcaagucagcgagucuaccggaguggcccuuaaacgguccagcuggcugaucgugcuccugguccuguuuaccguuucccucucucccgugcagagcgcgccuauuggc

SEQ ID NO: 14013 - RNA, 972 nt, Artificial Sequence
  derived and/or modified CDS sequence (opt5) from CCHFV(K128_76)__KX013454.1__Gn
agcgacgaguccggcgaugacugcaucucuagaacccagcugcuccggacagaaacggccgagauucacggggauaacuacggaggccccggggacaagaucaccauuuguaauggaagcacaaucguggaucaacgccugggcuccgaacuugggugcuauaccauuaacagagucaaaucuuucaagcugugugagaauagcgcuacaggaaaauccugcgaaaucgacucuaucccuguuaagugucggcagggcuacugccucaaaauuacccaggagggccgcgggcaugugaagcugagcagaggauccgaggugguccuugaugccugugacagcucuugcgaagugaugaucccgaagggcacaggggauauucugguugacuguuccggaggccagcaacacuuucucaaagauaaccugaucgaccuggggugccccaagauuccucuccugggaaaaauggcgaucuauauuugucggaugagcaaucaucccaagaccacgauggcuuuccuguuuugguucucuuuuggcuacgugauuaccugcaucgucugcaaagccaucuucuaucugcucaucauugugggcacacuggggaagcgcuuuaagcaguacagagagcuuaaaccucagaccuguacaaucugcgaaaccacgcccacaaacgccauugaugcugagaugcacgaccugaauuguuccuauaacaucugcccuuacugugccagccggcucaccucugacggacuggcucgccauguuacacacugcccgaagagaaaagagaagguggaagagaccgaacuguaccucaaucuggagcggauccccugggucgugcgcaaacuucuucagguguccgaaagcaccggcgucgcccucaagagauccucuuggcugauuguucuucugguccucuucgcggugagccuguccccugugcaaagcgcccccaucucu

SEQ ID NO: 14014 - RNA, 972 nt, Artificial Sequence
  derived and/or modified CDS sequence (opt5) from CCHFV(K168_40)__KX013457.1__Gn
agcgacgaguccggcgaugacugcaucucuagaacccagcugcuccggacagaaacggccgagauucacggggauaacuacggaggccccggggacaagaucaccauuuguaauggaagcacaaucguggaucaacgccugggcuccgaacuugggugcuauaccauuaacagagucaaaucuuucaagcugugugagaauagcgcuacaggaaaauccugcgaaguugacucuaucccugugaagugucggcagggcuacugccucaaaaucacccaggagggccgcgggcaugugaagcugagcagaggauccgaggucgugcuugaugccugugacagcucuugcgaaguuaugauuccgaagggcacaggggauauccugguggacuguuccggaggccagcaacacuuucucaaagauaaccugauugaccuggggugccccaagaucccucuccugggaaaaauggcgauuuauaucugucggaugagcaaucaucccaagaccacgauggcuuuccucuuuugguucucuuuuggcuacgucauuaccugcaucgugugcaaagccaucuucuaucugcucauuaucguuggcacacuggggaagcgcuuuaagcaguacagagagcuuaaaccucagaccuguacaauuugcgaaaccacgcccacaaacgccaucgaugcugagaugcacgaccugaauuguuccuauaacauuugcccuuacugugccagccggcucaccucugacggacuggcucgccaugugacacacugcccgaagagaaaagagaaggucgaagagaccgaacuguaccucaaucuggagcggauccccuggguggugcgcaaacuucugcaggucuccgaaagcaccggcguugcccucaagagauccucuuggcugaucgugcuucuggugcuuuucgcggucagccuguccccugugcaaagcgcccccauuggg

SEQ ID NO: 14015 - RNA, 972 nt, Artificial Sequence
  derived and/or modified CDS sequence (opt5) from CCHFV(K168_125)__KX013460.1__Gn
agcgacgaguccggcgaugacugcaucucuagaacccagcugcuccggacagaaacggccgagauucacggggauaacuacggaggccccggggacaagaucaccauuuguaauggaagcacaaucguggaucaacgccugggcuccgaacuugggugcuauaccauuaacagagucaaaucuuucaagcugugugagaauagcgcuacaggaaaauccugcgaaguugacucuaucccugugaagugucggcagggcuacugccucaaaaucacccaggagggccgcgggcaugugaagcugagcagaggauccgaggucgugcuugaugccugugacagcucuugcgaaguuaugauuccgaagggcacaggggauauccugguggacuguuccggaggccagcaacacuuucucaaagauaaccugauugaccuggggugccccaaggucccucuccugggaaaaauggcgaucuauauuugucggaugagcaaucaucccaagaccacgauggcuuuccuguuuugguucucuuuuggcuacgugauuaccugcaucguuugcaaagccaucuucuaucuucucaucauugugggcacacuggggaagcgcuuuaagcaguacagagagcuuaaaccucagaccuguacaaucugcgaaaccacgcccacaaacgccauugaugcugagaugcacgaccugaauuguuccuauaacaucugcccuuacugugccagccggcucaccucugacggacuggcucgccaugucacacacugcccgaagagaaaagagaagguggaagagaccgaacuguaccucaaucuggagcggauucccugggugguccgcaaacuucugcagguuuccgaaagcaccggcguggcccucaagagauccucuuggcugaucgugcuucugguccucuucgcggugagccuguccccuguucaaagcgcccccaucggg

SEQ ID NO: 14016 - RNA, 972 nt, Artificial Sequence
  derived and/or modified CDS sequence (opt5) from CCHFV(K229_194)__KX013463.1__Gn
agcgaggaacccggcgacgauugcaucuccagaacccagcugcucaagacagagacggccgaaauucacgacgauaacuacgggggaccuggcgacaaaaucaccauuuguaaugggucuacaaucguggaucaacggcugggaagcgagcuuggcugcuauaccauuaaccgcgucaaguccuucaaacugugugaaaauucugcuacagggaagaccugcgagaucgacagcacaccgguuaaauguagacagggauuuugccucaagaucacccaggagggccggggccaugugaagcugucccgcgggucugaagugguccuugaugccugugacagcuccugcgagauuaugauccccaaaggaacgggcgauauucugguggacuguagcgggggacagcaacacuuccucaagggcaaccugaucgaucuggggugcccucauauuccccuccugggaaaaauggcgaucuacauuuguagaaugucuaaucacccucggaccacaauggcuuuucuuuucugguuuuccuucggcuauguuauuaccugcaucuuuugcaaggcccuguucuacagccucauuaucauuggcacacuggggaaaaagaucaagcaguaucgcgaacuuaaaccccagaccuguacgauuugcgagacagccccugugaacgcuaucgacgccgagaugcaugaucugaauuguucuuacaacaucugcccguauugugcuuccagacucaccagcgacggacuggcccggcacgucacacagugccccaagcgcaaagaaaagguggaggaaaccgagcuguaccucaaucuggaaagaaucccuuggaucguucggaaacuucugcaagugucugaguccaccggcgucgcgcucaagcgcagcuccuggcugauugugcuucuggugcuccugacagucucucugagccccguucaguccgccccugugggg

SEQ ID NO: 14017 - RNA, 972 nt, Artificial Sequence
  derived and/or modified CDS sequence (opt5) from CCHFV(K315_14)__KX013469.1__Gn
agcgaggaacccggcgacgauugcaucuccagaacccagcugcucaagacagagacggccgaaauucacgacgauaacuacgggggaccuggcgacaaaaucaccauuuguaaugggucuacaguggucgaucaacggcugggaagcgagcuuggcugcuauaccaucaaccgcguuaaguccuucaaacuguguaaaaauucugcuacagggaagaccugcgaaauugacagcacaccggugaaguguagacagggauuuugccucaagaucacccaggagggccggggccaugugaaacugucccgcgggucugaggucgugcuugauguuugugacagcuccugcgaaaucaugauucccaagggaacgggcgauauccugguggacuguagcgggggacagcaacacuuccucaaagauaaccugauugaccugggcugcccucauaucccccuccuggggaagauggccauuuacaucuguagaaugucuaaucacccucggaccacaauggcguuucuuuucugguuuuccuucggauaugucauuaccugcaucuuuugcaaagcucuguucuacagccucaucauuaucggcacacugggcaagaagauuaaacaguaucgcgagcuuaagccccagaccuguacgaucugcgaaacagccccugugaacgccauugaugcugagaugcaugaccugaauuguucuuacaacaucugcccguauugugccuccagacucaccagcgaggggcuggcucggcacguuacacagugccccaaacgcaaggaaaaaguggaggaaaccgagcuguaccucaaucuggaaagaaucccuuggauuguccggaaacuucugcaagugucugaguccaccggaguggcccucaagcgcagcuccuggcugaucguccuucugguucuccugacagugucucugagccccgugcaguccgcgccugucggc

SEQ ID NO: 14018 - RNA, 972 nt, Artificial Sequence
  derived and/or modified CDS sequence (opt5) from CCHFV(K323_27)__KX013472.1__Gn
agcgaggaacccggcgacgauugcaucuccagaacccagcugcucaagacagagacggccgaaauucacgacgauaacuacgggggaccuggcgacaaaaucaccauuuguaaugggucuacaaucguggaucaacggcugggaagcgagcuuggcugcuauaccauuaaccgcgucaaguccuucaaacugugugaaaauucugcuacagggaagaccugcgagaucgacagcacaccgguuaaauguagacagggauuuugccucaagaucacccaggagggccggggccaugugaagcugucccgcgggucugaagugguccuugaugccugugacagcuccugcgagauuaugauccccaaaggaacgggcgauauucugguggacuguagcgggggacagcaacacuuccucaaggauaaccugaucgaccugggcugcccucauauuccccuccuggggaaaauggcgaucuacauuuguagaaugucuaaucacccucggaccacaauggcuuuucuuuucugguuuuccuucggauauguuauuaccugcaucuuuugcaaggcccuguucuaccuccugauuaucauuggcacacuuggcaaaaagaucaagcaguaucgcgaacugaaaccccagaccuguacgauuugcgagacagccccugugaacgcuaucgaugccgagaugcaugaccucaauuguagcuacaacaucugcccguauugugcuucuagacugaccuccgacgggcuggcccggcacgucacacagugccccaagcgcaaagaaaagguggaggaaaccgagcucuaccugaaucuugaaagaaucccuuggaucguucggaaacugcuccaagugagcgagucuaccggagucgcgcugaagcgcuccagcuggcuuacagugcugcucgugcugcugacggucucccucucucccguucagagcgccccugugggc

SEQ ID NO: 14019 - RNA, 972 nt, Artificial Sequence
  derived and/or modified CDS sequence (opt5) from CCHFV(K340_6)__KX013475.1__Gn
agcgaggaacccggcgacgauugcaucuccagaacccagcugcucaagacagagacggccgaaauucacgacgauaacuacgggggaccuggcgacaaaaucaccauuuguaaugggucuacaaucguggaucaacggcugggaagcgagcuuggcugcuauaccauuaaccgcgucaaguccuucaaacugugugaaaauucuacaaccgggaagacaugcgagaucgacagcaccccgguuaaauguagacagggauuuugccucaagaucacgcaggagggccggggccaugugaagcugucccgcgggucugaagugguccuugaugcuugugacagcuccugcgagauuaugauccccaaaggaaccggcgauauucugguggacuguagcgggggacagcaacacuuccucaaggauaaccugaucgaccugggcugcccucauauucccccucucgggaaaauggccaucuacauuuguagaaugucuaaucacccccggacaaccauggcguuucuguucugguuuuccuucggauauguuaucacaugcaucuuuugcaaggcucuuuucuacagccugauuaucauuggcacccucggcaaaaagaucaagcaguaucgcgaacugaaaccucagacguguacaauuugcgagaccgccccggugaacgccaucgaugcugagaugcaugaccuuaauuguucuuacaacaucugccccuauugugccuccagacugacaagcgacgggcucgcucggcacgucacccagugcccuaagcgcaaagaaaagguggaggaaaccgagcuguaccugaaucucgaacggauucccuggaucguuagaaaacugcuucaagugucugaguccacaggagucgcccugaagcgcagcuccuggcucauugugcugcuugugcugcucacggucucucugagcccuguucaguccgcgcccgugggc

SEQ ID NO: 14020 - RNA, 972 nt, Artificial Sequence
  derived and/or modified CDS sequence (opt5) from CCHFV(Mamon)__KX013478.1__Gn
agcgaggaacccggcgacgauugcaucuccagaacccagcugcuccggacagagacggccgaaauucacgacgauaacuacgggggaccuggcgacaagaucaccauuuguaaugggucuacaaucguggaucaacgccugggaagcgagcuuggcugcuauaccauuaacagagucaaauccuucaagcugugugaaaauucugcuacagggaaaaccugcgagaucgacagcacaccgguuaagugucggcagggauuuugccucaaaaucacccaggagggccgcggccaugugaagcuguccagagggucugaaguggucagcgaugccugugacuccagcugcgaggugaugauucccaagggaacgggcgauauccuuguugacuguucugggggacagcaacacuuccugaaagauaaccucauugaccugggcugcccucauaucccccugcucgggaagauggcgauuuacaucugucggauguccaaucacccucgcaccacaguggcuuuucuguucugguuuagcuucggauaugucauuaccugcaucuuuugcaaagcccuuuucuacucucugaucauuaucggcacacucggcaagaaaauuaagcaguauagagaacugaagccccagaccuguacgaucugcgagacagccccugugaacgcuauugaugccgagaugcaugaccuuaauuguuccuacaacaucugcccguauugugcuagccggcugaccucugacgggcucgcccgccacguuccccagugcccuaaaagaaaggaaaaaguggaggaaacagagcuguaccugaaucucgaacggauccccuggauuguccgcaagcugcuucaaguguccgagagcaccggaguggcgcugaaaagauccucuuggcucaucguccugcuuguucugcucaccgugagccuguccccugugcagagcgcccccgucggc

SEQ ID NO: 14021 - RNA, 972 nt, Artificial Sequence
  derived and/or modified CDS sequence (opt5) from CCHFV(Nakiwogo)__KX013484.1__Gn
gccgagggcgugagcaacgacugcgucuccagaacccagcugaucaagacagaaguugcugagauucacgaagauucuuacgggggacccggcgagaaaaucacgauuuguaaugggagcaccaucguggaccaacggcucggauccgaacugggcugcuauacaauuaaccgcgugaagaccuacaaacuuugugaaaauucugccacagagaaggggugcgagaucgauagcgucccugugaaauguaagcagggauucugccugaagguuacccaggagggcagaggccaugugaaacucucccgggggacagaaaucguccuggacgugugugauaccucuugcgagcuuaugauuccgaagggaacgggcgacauccugguugauuguagcgggggacagcaacacuuucuccaggacaaccugauugaucugggcugccccaaugugccucuccuggggaaaauggcgaucuauauuugucgcauguccaaccaucccaagaccacaauggcuuuccuguuuugguucagcuuuggauacgucauuaccugcguggugugcaaaguccuuuucuaucuccugaucguuaucggcacacuuggcaagaagcugaaacaguacagagagcucaagccucagaccuguaucgugugcgaaucuauucccgugaaugucaucgacgccgagaugcacgaacugaacuguaauuauaacauuugcccuuacugugccucccggcugacgagcgaugggcucgugcgccauguuacacaaugcccgaaaagaaaggagaaaguggaagagaccgagcuguaccuuaaucuggaacggauccccuggcucguccgcagacugcuucaggugucugaguccacaggaauggcucugaagcggagcuguuggaugaccacccuccugauucugcucguugugucucuguccccuguccagagcgcccccgugggc

SEQ ID NO: 14022 - RNA, 972 nt, Artificial Sequence
  derived and/or modified CDS sequence (opt5) from CCHFV(Saf)__KX013487.1__Gn
agcgaggaacccggcgacgauugcaucuccagaacccagcugcuccggacagagacggccgaaauucacgacgauaacuacgggggaccuggcgacaagaucaccauuuguaaugggucuacaaucguggaucaacgccugggaagcgagcuuggcugcuauaccauuaacagagucaaauccuucaagcugugugaaaauucugcuacagggaaaaccugcgagaucgacagcacaccgguuaagugucggcagggauuuugccucaaaaucacccaggagggccgcggccaugugaagcuguccagagggucugaagugguccuugaugccugugacagcuccugcgaggugaugauucccaagggaacgggcgauauccugguugacuguagcgggggacagcaacacuaccucaaagauaaccugauugaccugggcugcccucauaucccccuccuggggaagauggcgauuuauaucugucggaugucuaaucacccucgcaccacaauggcuuuccuuuucugguuuuccuuuggauacgugauuaccugcaucuucugcaaagcccuguuuuauagccucaucauuaucggcacacugggcaagaaaauuaagcaguacagagaacuuaagccccagaccuguacgaucugcgagacagccccugucaacgcuauugaugccgagaugcaugaccugaauuguucuuauaacaucugcccguacugugcuucccggcucaccagcgacgggcuggcccgccacgugccccagugcccuaaaagaaaggaaaaaguugaggaaacagagcuguaccucaaucuggaacggauccccuggauugugcgcaaacuucugcaagucucugaguccaccggaguggcgcucaagagaagcuccuggcugaucgugcuucugguccuccugaccguuucucugagcccugugcaguccgcccccgugggc

SEQ ID NO: 14023 - RNA, 972 nt, Artificial Sequence
  derived and/or modified CDS sequence (opt5) from CCHFV(Ast199)__KX056051.1__Gn
agcgaggaacccggcgacgauugcaucuccagaacccagcugcucaagacagagacggccgaaauucacgacgauaacuacgggggaccuggcgacaaaaucaccauuuguaaugggucuacaaucguggaucaacggcugggaagcgagcuuggcugcuauaccauuaaccgcgucaaguccuucaaacugugugaaaauucugcuacagggaagaccugcgagaucgacagcacaccgguuaaauguagacagggauuuugccucaagaucacccaggagggccggggccaugugaagcugucccgcgggucugaagugguccuugaugccugugacagcuccugcgagauuaugauccccaaaggaacgggcgauauucugguggacuguagcgggggacagcaacacuuccucaaggauaaccugaucgaccugggcugcccucauauuccccuccuggggaaaauggcgaucuacauuuguagaaugucuaaucacccucggaccacaauggcuuuucuuuucugguuuuccuucggauauguuauuaccugcaucuuuugcaaggcccuguucuacagccucauuaucauuggcacacugggcaaaaagaucaagcaguaucgcgaacuuaaaccccagaccuguacgauuugcgagacagccccugugaacgcuaucgaugccgagaugcaugaccugaauuguucuuacaacaucugcccguauugugcuuccagacucaccagcgacgggcuggcccggcacgucacacagugccccaagcgcaaagaaaagguggaggaaaccgagcuguaccucaaucuggaaagaaucccuuggaucguucggaaacuucugcaagugucugaguccaccggagucgcgcucaagcgcuguagcuggcugauugugcuucuggugcuccugacagucucccugucucccguucagagcgccccugugggc

SEQ ID NO: 14024 - RNA, 972 nt, Artificial Sequence
  derived and/or modified CDS sequence (opt5) from CCHFV(Ast137)__KX056057.1__Gn
agcgaggaacccggcgacgauugcaucuccagaacccagcugcucaagacagagacggccgaaauucacgacgauaacuacgggggaccuggcgacaaaaucaccauuuguaaugggucuacaaucguggaucaacggcugggaagcgagcuuggcugcuauaccauuaaccgcgucaaguccuucaaacugugugaaaauucugcuacagggaagaccugcgagaucgacagcacaccgguuaaauguagacagggauuuugccucaagaucacccaggagggccggggccaugugaagcugucccgcgggucugaagugguccuugaugccugugacagcuccugcgagauuaugauccccaaaggaacgggcgauauucugguggacuguagcgggggacagcaacacuuccucaaggauaaccugaucgaccugggcugcccucauauuccccuccuggggaaaauggcgauccacauuuguagaaugucuaaucauccucggaccacaauggcuuuucuuuucugguuuuccuucggauacguuauuaccugcaucuuuugcaaggcccuguucuauagccucauuaucauuggcacacugggcaaaaagaucaagcaguaccgcgaacuuaaaccccagaccuguacgauuugcgagacagccccugugaacgcuaucgaugccgagaugcacgaccugaauuguucuuauaacaucugcccguacugugcuuccagacucaccagcgacgggcuggcccggcacgucacacagugccccaagcgcaaagaaaagguggaggaaaccgagcuguaucucaaucuggaaagaaucccuuggaucguucggaaacuucugcaagugucugaguccaccggagucgcgcucaagcgcagcuccuggcugauugugcuucuggugcuccugacagucucucugagccccguucaguccgccccugugggc

SEQ ID NO: 14025 - RNA, 972 nt, Artificial Sequence
  derived and/or modified CDS sequence (opt5) from CCHFV(Ast133)__KX056060.1__Gn
agcgaggaacccgacgaugacugcaucuccagaacccagcugcucaagacagagacggccgaaauucacgaugacaacuacggcgggccuggagauaaaaucaccauuuguaauggcucuacaaucguggaccaacggcuggggagcgagcuuggaugcuauaccauuaaccgcgucaaguccuucaaacugugugaaaauucugcuacaggcaagaccugcgagaucgauagcacaccgguuaaauguagacagggguuuugccucaagaucacccaggagggacggggccaugugaagcugucccgcggcucugaagugguccuugacgccugugauagcuccugcgagauuaugauccccaaagggacgggagacauucugguggauuguagcggcgggcagcaacacuuccucaaggacaaccugaucgaucugggaugcccucauauuccccuccugggcaaaauggcgaucuacauuuguagaaugucuaaucacccucggaccacaauggcuuuucuuuucugguuuuccuucggguauguuauuaccugcaucuuuugcaaggcccuguucuaccuccugauuaucauuggaacacuuggcaaaaagaucaagcaguaucgcgaacugaaaccccagaccuguacgauuugcgagacagccccugugaacgcuaucgacgccgagaugcaugaccucaauuguagcuacaacaucugcccguauugugcuucuagacugaccuccgauggccuggcccggcacgucacacagugccccaagcgcaaagaaaagguggaggaaaccgagcucuaccugaaucuugaaagaaucccuuggaucguucggaaacugcuccaagugagcgagucuaccggggucgcgcugaagcgcuccagcuggcuuauugugcugcucgugcugcugacagucucccucucucccguucagagcgccccuguggga

SEQ ID NO: 14026 - RNA, 972 nt, Artificial Sequence
  derived and/or modified CDS sequence (opt5) from CCHFV(SK/2015/human)__KX458183.1__Gn
agcgaggaauccggcgacgauugcaucucuagaacccggcugcuccgcacagagacggccgaaauucacggggacagcuacggaggccccggggauaagaucaccauuuguaacggauccacaaucguggaccagagacugggcucugagauggggugcuauaccauuaaucgggucaagagcuucaaacuuugugaaaacuccgcuacaggaaaaucuugcgagaucgauagcaucccuguucgcuguagacaaggcuacugccugaagauuacccaggagggccgggggcaugugaaacucucccgcggaagcgaagugguccuggacgccugugauucuuccugcgaggugaugaucccgaagggcacaggggacauucuuguugauuguagcggaggccagcagcacuuucugaaggacaaucucaucgaucuggggugccccaacauuccucugcucggaaaaauggcgaucuauauuuguagaaugucuaaucaucccaagaccacgauggcuuuccuguuuugguucuccuuuggcuacgugauuaccugcauccuuugcaaagccaucuucuaucugcucaucauugucggcacacuggggaagcgguuuaaacaauaccgcgaacuuaagccucagaccuguacaaucugcgagaccacgcccgccaacgcuauugacgccgagaugcacgaucugaauuguagcuauacaaucugcccuuacugugcuucuagacucaccuccgacggacuggcccggcaugugacacagugcccgaagcgcaaagaaaagguugaggaaaccgagcuguaccucaaccuggaaagaauccccugggugguccggaaacuucuccaggugagcgaguccaccggcguggcgcugaagcgcucuagcuggcugauuguccuucugguucucuucacagugucccugagcccugugcaaucugcccccaucggg

SEQ ID NO: 14027 - RNA, 972 nt, Artificial Sequence
  derived and/or modified CDS sequence (opt5) from CCHFV(YL16070)__KY354081.1__Gn
gccgagggcgggagcuccgacugcaucucuagaacccagcuggugaagacagaagucgcugagauucacgaagauagcuacggaggccccggggagaaaaucacgauuuguaacggauccaccaucguugaccaacggcucggcucugaacuggggugcuauacaauuaaucgcgucaagagcuacaaacuuugugagaacuccgccucuggaaagagcugcgagaucgauuccaucccugugaaauguaagcagggcuucugccugaagauuacccaggaaggcagagggcaugugaaacucagccggggaacagagaucgugcuggacguuugugauucuuccugcgaacuuaugauuccgaagggcaccggggacauccugguggauuguagcggaggccagcaacacuuucuccagaauaaccugauugaccuggggugccccaaugucccucuccugggaaaaauggcgaucuaugugugucgcaugucuaaccaucccaagacaaccauggcuuuccuguuuugguucuccuuuggcuacguuauuacgugcaucgugugcagaguccuguucuaucuccugaucgccauuggcaccguggggaaaaagcugaagcaguaccgggagcuuaaaccucagacauguaucgugugcgagagcguccccguuaaugccauugaugcugaaaugcacgagcucaacuguucuuauaauaucugcccuuacugugccucccgccugagcaccgacggacugauuagacaugugacacaaugcccgaagcggcgcgaaaaaguggaggaaaccgagcucuuucugaaccuugagagaauccccuggcugguccggaagcuccuucagguguccgaaucuacgggcauggcucuuaaacgcagcuguuggaugaucacacugcucauucugcugcucguuuccaugagcccugugcagucugcccccgucggg

SEQ ID NO: 14028 - RNA, 972 nt, Artificial Sequence
  derived and/or modified CDS sequence (opt5) from CCHFV(UCCR4448)__KY484042.1__Gn
agcgaggaaaccuccgacgauugcaucucuagaacacagcugcuccggacggagaccgccgaaauucacggcgacaacuacgggggacccggcgauaagaucacaauuuguaaugggagcaccaucguggaccaacgccugggauccgagcuuggcugcuauacaauuaacagagucaaaucuuucaagcugugugaaaauagcgcuaccgggaaauccugcgagaucgauucuguuccugugaagugucggcagggauacugccuccgcaucacacaggagggcagaggccaugugaaacugagccggggguccgaagucgugcuugacgccugugauaccagcugcgagauuaugaucccgaagggaacgggcgacauucugguugauuguucugggggacagcaacacuuucucaaggacaaccugaucgaucugggcugccccaaaauuccucuccuggggaagauggcgaucuauauuugucgcauguccaaucaucccaaaaccacaauggcuuuccuguuuugguucagcuuuggauacgugauuaccugcauccuuugcaaggccaucuucuaucuccugaucauuaucggcacacuuggcaaaagauuuaagcaguaccgggaacugaagccucagaccuguacgauuugcgagacaacccccgucaacgccaucgacgcugagaugcacgaucucaauuguucuuauaacaucugcccuuacugugccucccgccugacaagcgacgggcuggcuagacaugugacccagugcccgaaacggaaggaaaaaguugaggaaaccgagcucuaccugaaucuugaacgcauucccuggguggucagaaagcugcuccaagugucugaguccacaggaguggcccugaaacggagcuccuggcuuaucguccugcucguucuguucacgauuucucugagcccugugcaguccgcgcccaucagc

SEQ ID NO: 14029 - RNA, 972 nt, Artificial Sequence
  derived and/or modified CDS sequence (opt5) from CCHFV(SPU 45/88)__KJ682809.1__Gn
agcgaggaauccucugacgauugccugagcagaacccagcuccugcggacagagaacacggaaauccacuccgacaauuacggcgggcccggagauaagauuaccaucuguaacggcucuacaauuguggaccaacgccuugggagcgagcugggaugcuauaccaucaauagagucaaauccuucaagcucugugaaaacucugccacaggcaaaagcugcgagauugauuccaccccuguucggugucgccagggguuuugccugaagaucacacaggagggaagaggccaugugaaacuuagccggggcucugaagugguccuggacgcuugugauuccagcugcgagaucaugauuccgaaggggaccggagacauccucguggauuguucuggcgggcagcaacacuuccugaaggacaaucugguugaucucggaugccccaacauuccucugcuuggcaaaauggccaucuacauuugucgcauguccaaucaucccaagacgaccaugggguuucuguucugguuuagcuucggauaugugaucacaugcauucucugcaaagucaucuuuuaccugcuuaucgugguuggcacccugggcaagaaauucaagcaguauagagaacucaagccucagacauguaccauuugcgagacgacacccgugaacgcgaucgacgcugagaugcacgaucugaauuguucuuacaacauuugcccuuauugugccucccggcugaccagcgacgggcucgcccgccaugucaugcagugcccgaaaagaaaggagaaaaucgaagaaacagagcuguaccuuaaucuggaacggauucccuggaucgugcgcaagcuccugcaaguguccgagucuaccggagucgcucuuaaaagaagcuccuggcugguugugcuccuggugcugcucaccgucagccugucuccugugcaguccgcccccaucggc

SEQ ID NO: 14030 - RNA, 1932 nt, Artificial Sequence
  derived and/or modified CDS sequence (opt5) from CCHFV(10200)__U39455.2__Gc
uuccuggacagcaccgccaagggcaugaaaaaccuccuuaauuccacaucucuugagacgagccuguccaucgaagcucccuggggagccauuaacgugcagucuaccuacaagccuacagucagcaccgcgaauaucgcucucuccuggucuagcguugagcacagagggaacaaaauucugguguccggccggagcgaaucuaucaugaaacuugaggaacgcacagggauuuccugggaucugggaguggaggacgccagcgagucuaaacuccugaccgucuccgugauggaucugagccagauguauucuccgguuuuugaauaccucuccggcgacagacagguggaggaauggcccaaggccacaugcaccggggauuguccugagcggugcggauguacgagcucuaccugccugcauaaggaguggccccacucucgcaauuggagauguaacccuacauggugcuggggcgucggcaccggguguacaugcuguggacuugacgugaaagaucuguucaccgacuauauguuuguuaaguggaaaguggaauacaucaagacggaggcuaucgucugcguggaacucacaagccaggagcggcaguguucccugauugaagccggcacccgcuucaaucuugggcccgugacaaucacccugagcgagccuagaaacauucaacagaaacucccgcccgagaucauuacccugcauccucggaucgaagagggauuuuucgaucugaugcacguccagaagguucucucugcuuccacagugugcaagcugcagagcugcacgcauggcgugcccggggaccuucaagucuaucacauuggaaaucugcucaaaggcgauaaggugaacggccaccugauccauaaaaucgaaccucacuuuaauaccucuuggaugagcugggacgggugugaucuugacuacuauugcaacaugggagacuggcccuccuguacauacaccggcguuacacagcauaaucacgccucuuucgugaaccugcucaauauugagaccgauuacacgaagaacuuucacuuccauagcaaacgcgucacagcgcacggggacaccccgcagcuggaucugaaggccagaccuaccuauggagcuggcgaaaucacagugcucguugagguggccgacauggagcugcauaccaaaaagauugaaaucuccgggcuuaaguuugcuagccuggccugcacaggauguuacgcguguucuuccagcauuucuugcaaaguccggauccacguggaugagcccgacgaacucacgguccaugugaaguccgaugacccugauguuguggccgcuagcuccucucugauggcccgcaaacuugaguucggcaccgacagcacauuuaaggcuuucuccgccaugcccaaaaccucucugugcuucuauaucgucgaaagagagcacuguaagagcugcuccgaggaagauacaaagaaaugugugaacaccaagcucgagcagccccaaagcauucugaucgaacacaaaggcacgauuaucgggaagcaaaauucuaccugcacagccaaggcuuccugcuggcuggagagcguuaaguccuuuuucuacggacucaagaacaugcuguccggcauuuuugggaauguguucaugggaaucuuucuuuuccuggcgccuuuuauccuccugauucuguucuuuauguucggcuggcggauccuguuuuguuucaaaugcugucgcagaacccgggggcucuuuaaguauagacaucugaaagacgacgaggaaacaggcuaccgccggauuaucgagaagcugaacaauaaaaagggaaagaacaaacuccuggauggcgaaagacuugccgacgggcgcauugcugagcuguucagcaccaagacgcacaucgga

SEQ ID NO: 14031 - RNA, 1932 nt, Artificial Sequence
  derived and/or modified CDS sequence (opt5) from CCHFV(IbAr10200)__AF467768.2__Gc
uuccuggacagcaccgccaagggcaugaaaaaccuccuuaauuccacaucucuugagacgagccuguccaucgaagcucccuggggagccauuaacgugcagucuaccuacaagccuacagucagcaccgcgaauaucgcucucuccuggucuagcguugagcacagagggaacaaaauucugguguccggccggagcgaaucuaucaugaaacuugaggaacgcacagggauuuccugggaucugggaguggaggacgccagcgagucuaaacuccugaccgucuccgugauggaucugagccaaauguauucuccgguuuuugaauaccucuccggcgacagacaggugggggaguggcccaaggccacaugcaccggagauuguccugaacggugcggcuguacgagcucuaccugccugcauaaggaguggccccacucucgcaauuggagauguaacccuacauggugcuggggcgucgggaccggauguacaugcuguggccuugacgugaaagaucuguucaccgacuauauguuuguuaaguggaaaguggaguacaucaagacggaagcuaucgucugcguggagcucacaagccaggaacggcaguguucccugauugaggccgggacccgcuucaaucuuggacccgugacaaucacccugagcgaaccuagaaacauucaacagaaacucccgcccgagaucauuacccugcauccucggaucgaggaaggcuuuuucgaucugaugcacguccagaagguucucucugcuuccacagugugcaagcugcagagcugcacgcauggggugcccggagaccuucaagucuaucacauuggcaaucugcucaaaggcgauaaggugaacgggcaccugauccauaaaaucgagccucacuuuaauaccucuuggaugagcugggacggaugugaucuugacuacuauugcaacaugggcgacuggcccuccuguacauacaccgggguuacacagcauaaucacgccucuuucgugaaccugcucaauauugaaaccgauuacacgaagaacuuucacuuccauagcaaacgcgucacagcgcacggagacaccccgcagcuggaucugaaggccagaccuaccuauggcgcuggggagaucacagugcucguugaaguggccgacauggagcugcauaccaaaaagauugagaucuccggacuuaaguuugcuagccuggccugcacaggcuguuacgcgugcuccuccggcauuagcuguaaaguccggauccacguggaugaacccgacgagcucacgguccaugugaagucugaugacccugauguuguggccgcuuccagcucccugauggcccgcaaacuugaguucgggaccgacucuacauuuaaggcuuucagcgccaugcccaaaaccucccugugcuucuauaucgucgaaagagaacacuguaagucuugcagcgaggaggauacaaagaaaugugugaacaccaagcucgaacagccccaauccauucugaucgagcacaaaggaacgauuaucggcaagcagaauagcacaugcaccgccaaggcuucuugcuggcuggaauccguuaagagcuuuuucuacgggcucaagaacaugcugucuggaauuuuuggcaauguguucauggggaucuuucuuuuccuggcgccuuuuauccuccugauucuguucuuuauguucggcuggcggauccuguuuuguuucaaaugcugucgcagaacccggggacucuuuaaguauagacaucugaaagacgacgaggagacaggcuaccgccggauuaucgaaaagcugaacaauaaaaaggggaagaacaaacuccuggauggagagagacuugccgaccgccggauugcugaacuguucuccaccaagacgcacaucggc

SEQ ID NO: 14032 - RNA, 1932 nt, Artificial Sequence
  derived and/or modified CDS sequence (opt5) from CCHFV(Turkey-Kelkit06)__GQ337054.1__Gc
uuccuggacagcaucgugaagggcaugaaaaaccuccuuaauuccaccucucuggagacaagccuguccauugaagcccccuggggagcuaucaacguccagucuacguuuaagccuaccguuagcacagccaauauugcgcucuccuggucuagcguggugcacagagggaacaaaauccuggucaccggccgguccgagagcauuaugaaacuugaggagcgcacaggggugucuugggaucugggaguugaagacgcuuccgagagcaaacuccugaccgugucuaucauggaucugucccaaauguacagcccggucuucgaguaucucucuggcgacagacagguggaagaguggcccaaggccacaugcaccggggauuguccugaacggugcggauguacguccucuaccugccugcauaaggaguggucccacucucgcaauuggagauguaaccccacauggugcuggggcguuggcaccggguguacaugcuguggaguggacgucaaagaucuuuuuaccgaccauauguucgugaaguggaaaguggaguacaucaagacggaagccauugucugcguugcucugacaagccaggagcggcaguguucccucaucgaagccggcacccgcuuuaaucuggggccugugacaauuacccuuagcgagcccagaaacauccaacagaaacugccuccggaaauuaucacccuccaccccaagauugaggagggauucuuugaucugaugcaugugcagaagguccugucugcuuccacagugugcaaacuccagagcugcacgcacggcaucccuggggaccugcaaguuuaucacaucggaaaucuucugaagggcgaucgggugaacggccaucucauucacaaaaucgaaucucauuucaauaccagcuggauguccugggacgggugugaucuggacuacuauugcaacaugggagacuggcccucuuguacauacaccggcgucacacagcacaaucacgccgcguuugugaaccuucugaauauugagaccgauuauacgaagacauuccauuuucacagcaaacgcguuaccgcccauggggacaccccucagcucgaucugaaggcuagacccacauacggagccggcgggaucaccgugcuggucgaaguggcugacauggagcuccacacaaagaaggucgaaauuuccggacugaaguucgccagccuugcgugcacgggcuguuacgccugcagcuccggcaucagcuguaaagugcggauccauguugaugagccggacgagcugaccgugcacgucaagucuuccgauccugacgugguugcugccagcacaucccucauggcucgcaaacuggaauuugggaccgauucuacauucaaggccuucagcgccaugcccaaaaccucccuuugcuuuuauauuguggagagagaauacuguaagucuugcagcgaggacgauacgcagaagugugucgacacccggcuggaacaaccucaguccauccucauugagcacaaaggaacaaucauuggcaagcagaacgauaccugcacagcuaaagcgagcugcuggcuggagucugugaaguccuucuuuuaugggcugaaaaacaugcucggaagcguguucggcaaucuguuuaucgggauccuucuguuccucgcccccuuuguucugcugguccuuuucuuuauguucggcuggaagauucucuuuuguuucaagugcugucgcagaacccggggacuguuuaaauacagacaucugaaggacgacgaagagacgggcuaucgccggaucauugaaagacucaacucuaaaaaggggaaaaaucgccugcuugauggagaccggcuggcugauagaaagaucgccgaacucuucuccacaaagacccacauuggc

SEQ ID NO: 14033 - RNA, 1935 nt, Artificial Sequence
  derived and/or modified CDS sequence (opt5) from CCHFV(SR3)__AJ538199.1__Gc
cuguuccucgacagcaucgugaagggcaugaaaaaccugcuuaauuccaccucucuggagacaagccucuccauugaagcccccuggggagcuaucaacguccagucuacguacaagccuaccguuagcacagccaauauugcgcuguccuggucuagcguggagcacagagggaacaaagugcuugucuccggccggagcgaaucuaucaugaagcuggaggaacgcaccgggauuuccugggaucucggaguggaggacgcuagcgagucuaaacugcugacaguuuccgugauggaucucagccaaauguauucuccggucuuugaauaccuguccggcgacagacagguggaggaauggcccaaggcuaccugcacaggggauuguccugagcggugcggauguaccagcuccacgugccuucauaaggaguggccccacucucgcaauuggagauguaacccuaccuggugcuggggcguuggcacaggguguaccugcuguggacuggacgugaaagaucucuucacagacuauauguuugucaaguggaaaguggaauacaucaagaccgaggccaucgugugcgucgaacugacgagccaggagcggcaguguucccuuauugaagccggcacacgcuucaaucuggggagcguuaccaucacacucucugagcccagaaacauucaacagaaacugccuccggagaucauuacccugcaucccaagaucgaagagggauuuuucgaucucaugcacgugcagaaggugcuguccgccagcaccgucugcaaacuucagucuugcacacauggcgugccuggggaccugcaaguuuaucacauuggaaaucuccugaagggcgaucgggugaacggccaccuuauccauaaaaucgaacagcacuuuaauacgagcuggauguccugggacgggugugaucuggacuacuauugcaacaugggagacuggcccucuuguaccuacacaggcgucacccagcauaaucacgcuagcuucgugaaccuccugaauauugagacagauuacaccaagacguuucacuuccauuccaaacgcguuacagcccacggggacaccccucagcuggaucucaaggcgagacccaccuauggagccggcgaaaucacagugcuggucgagguggcugacauggagcuucauaccaaaaagauugaaaucagcgggcugaaguuugccggacucacaugcacgggcuguuacgcuuguucuuccggcauuagcugcaaaguccggauccacguggaugagccggacgaacugaccguucaugugaagucugaugacccugaugucguggccgcguccagcucccuuauggcccgcaaacuggaguucgggacagacucuaccuuuaaggcuuucagcgccaugcccaaaacaucccucugcuucuauaucguugaaagagaguacuguaagucuugcaacaaggaggauacccaaaaaugugugaacacgaagcuggaacagccucagagcauucugaucgagcacaaaggaaccauuaucggcaagcaaaauaacacaugcaccgcuaaagccuccugcuggcucgaaagcgucaaguccuuuuucuaugggcugaagaauaugcuuggaggcauuuuugggaacguguucaucggcaucuuuacauuccugacccccuuuauucuccugauccuguucuuuauguucggauggcggauucucuuuuguuucaaaugcugucgcagaacgcggggccuuuuuaaguacagacaccugaaagacgacgaggagacaggguaucgcaagaucauugaacggcugaauaacaaaaagggaaagaauagacuccuggauggcgagcgccuugccgaccggaaaaucgcugaacuguucucuaccaagacacauauuggg

SEQ ID NO: 14034 - RNA, 1935 nt, Artificial Sequence
  derived and/or modified CDS sequence (opt5) from CCHFV(UCCR4413)__KY484038.1__Gc
uuccugagcuccaucgugaagggcaaaaagaaccuccugaauagcgccagccuugagaccucccugucuauugaagcucccuggggagccaucaacgcgcagagcacauuuaaaccuacgauuuccaccgcuaauaucgcccucucuuggagcuccgucgagcacagagggaacaagguucuggugagcggccggucugaauccauuaugaaacuugaggaacgcacagggaucagcuggaaucugggaguggaggacgccucugaguccagaaugcucaccgucagcgugauggaucugucucaaauguaccugccgguuuucgaauaucucuccggcgaccgccagguggaggaauggcccaaggcuacaugcaccggggauuguccugagcggugcggauguacaagcucuaccugccugcauaaggaguggccccacucuagaaacuggcgguguaauccuacguggugcuggggcgucggcaccggguguacaugcuguggacuugacgugaaagaucuguuuaccgacuacauguucguuaaguggaaaguggaauauaucaagacagaggccauugucugcguggaacucaccagccaggagcgccaguguucccugaucgaagcuggcacgagauuuaaccuugggcccgugacaauuacccugagcgagccucggaauauccaacagaaacucccgucugagauugucacacugcaucccaagaucgaagagggauucuuugaucugaugcacguucagaaggugcucuccgccagcaccgugugcaaacugcagucuugcacccauggcgucgcgggggaccuucaaguguaccacguuggaaaccugcucaagggcgauaaaauuaauggccacagcauccauaagaucgaaccucaccugaacacauccuggaugucuugggacgggugugaucuugacuauuacugcaauaugggagauuggcccagcuguacguauaccggcgugacacagcauaaccacgccgcuuucgucaaucugcucaacauugagaccgacuacacaaaauccuuucacuuccauagcaagcgcgugaccgcccacggggacacgccucagcuggaucugaaagcuagacccauguacggagccggcgaaaucacaguucucguggaggucgcggacauggagcugcauucuaagaacauugaaaucuccgggcuuaaguuugccagccugaccugcucuggauguuaugcuugcuccagcggcauuuccuguaaagugcggauccacgucgaugagccggacgaacucgccgugcauguuaagucugaugaccuggauguggucgcugccagcuccucucuuauggcccgcaaaaucgaguucggcaccgacagcacauuuaaggcuuucuccagcaugccuaaagaaucucugugcuucuacauuguggagagagauuuuuguaaguccugcgcggccgaggacacccagaaguguguuaaagcuaagcucgaacaaccccagagcauccugauugagcacaaagggacaaucauuggaaagcagaaugauacgugcucuaccaaaacauccugcuggcuggaaucuuucaaguccuuuuucuauggccucaagaacaugcugagcgggguguuuggauccgccaucaugggcauccuucuguuccucgccccuuuuauucugcugauccuuuucuuuuucuuuggguggcggauucucuucugucugcgcugcuguagacggaccagaggccuguuuaaauacaagcacaucaaagacgacgaggaggcuggauauaagaaaauuaucgaaaagcucaauaacaagaaaggcgggacaagcaagcugcuugauggagagcgccuggccgaccggaaaauugcggaacucuucucuaccaaggcucauaucggc

SEQ ID NO: 14035 - RNA, 1932 nt, Artificial Sequence
  derived and/or modified CDS sequence (opt5) from CCHFV(66019)__AB069669.1__Gc
uucagcgacuccaucgugaagggcaugaaaaaccugcucaauucuaccagccuggagacaucccuuucuauugaagcccccuggggagcuaucaacguccagagcacguuuaagccuaccguuuccacagccaauauugcgcugucuuggagcuccguggagcacagagggaacaaaauccucgugagcggccggucugaauccauuaugaagcuggaggaacgcaccgggaucagcugggaucuuggagucgaggacgcuucugaguccaaacugcucacagugagcguuauggaucugucucaaauguacuccccgguguucgaauaucugagcggcgacagacaggucgaggaauggcccaaggcuaccugcacagggaauuguccugaucggugcggauguaccuccucuacgugccuccauaaggaguggccccacagccgcaacuggagauguaauccuaccuggugcuggggcgugggcacaggguguaccugcuguggacuggacguuaaagaucuuuuuacagacuacauguucgugaaguggaaagucgaguauaucaagaccgaagccauugugugcguggagcugaacucccaggaacggcaguguagccucaucgaggcuggcacgcgcuuuaaucuggggcccgucacaauuacccuuucugaaccuagaaacauccaacagaaacugccguccgagauuaucacacuccauccccggauugaggaaggauucuuugaucugaugcacguucagaaggugcugagcgccucuaccgugugcaagcuccagagcugcacccauggcgucccuggggaccugcaaaucuaccacaucggaaaucuucugaaaggcgaucgcgugaacggccaccucauucauaagaucgagccccacuucaauacauccuggaugucuugggacgggugugaucuggacuauuacugcaacaugggagacuggccuagcuguacguauaccggcguuacacagcauaaucacgcugccuuugugaaccuucugaacauugaaaccgauuacaccaaaaauuuccacuuucauuccaagagagucacagcgcacggggacacgccccagcucgaucugaaagcccggccgacauacggagcuggcgagaucaccgugcugguugaaguggccgacauggagcuccauaccaagaaaauugcuaucagcgggcugaaguucgccucucuuacaugcaccggauguuaugcgugcuccagcggcaucucuuguaagguccgcauucacguggaugagccugacgaacugacaguccaugugaaauccgaggaucccgacaucguugccgcuagcuccucucucauggccagaaagcuggaauuuggcacggauagcaccuucaaagccuucuccgccaugccuaagacaucucuuugcuuuuacauuguggagcgggaauauugugagagcugcuccaaagaggacacccagaagugugucaacacaaagcuggaacaaccccagagcauccucauugagcacaaagggaccaucaucggaaagcagaaugauacgugcaccgccaaagcuagcugcuggcuggaauccgugaagucuuucuuuuacggccugaaaaacaugcucucugggauuuucggaaauguuuuuaucggcauuuuccuguuucuugcgcccuucauccugcucauucuguuuuucauguuuggguggcgcauccuguucuguuuuaagugcuguagacggacaagaggccuuuucaaguaucgcuaccucaaagacgacgaggaguccggauaucggagaauuaucgaacgccugaacaauaagaaaggcaagaacaaacugcucgauggggagcggcuggccgacagacgcaucgcugaacuuuucagcaccaagacacacauugga

SEQ ID NO: 14036 - RNA, 1932 nt, Artificial Sequence
  derived and/or modified CDS sequence (opt5) from CCHFV(7001)__AB069670.1__Gc
uuccuggacaacaucgccaagggcaugaaaagccuccuuaauuccaccucucuugagacaagccuguccauugaagcucccuggggagccaucaacgugcagucuacguuuaagccuaccgucagcgcggcuaauauugcccucuccuggucuagcguugagcacagagggaacaaaauccugguguccggccggagcgaaucuauuaugaagcuggaggaacgcacagggguguccuggaaucugggagucgaggaugccagcgagucuaaaacccucacaguguccguuauggaccugagccaaauguacucuccgguguucgaauaucuguccggcgauagacaggucgaggaauggcccaaggcuaccugcacaggggacuguccugagcggugcggauguaccagcuccacgugccuccauaaggaguggccccacucucgcaacuggagauguaauccuaccuggugcuggggcgugggcacaggguguaccugcuguggacuggauguuaaagacuuuuucacagauuacaugcuugugaaguggaaagucgaauauaucaagaccgaggccaucgugugcguggaacugacgagccaggagcggcaguguucccucauugaagcuggcacacgcuuuaaccuggggcccgucaccaucacacuuagcgagccuagaaauguucaacagcggcugccgcccgagauugugacccuccauccuaaaaucgaagagggauucuuugaccugaugcacgugcagaagauucugucugccuccaccgucugcaagcuccagagcugcacacauggcgugcccggggauuuccaaguuuaccacgugggaaaccugcuucgcggcgacaaagucaauggccacucuauccauaagauugaaccucacuuuaacacgagcuggauguccugggaugggugugaccuggauuauuucugcaauaugggagacuggcccucuuguaccuacacaggcgugacccagcauaacagagcggccuuuaucaauaugcucaacaucgagacagacuauaccaaaacguuccacuuucacagcaagcggguuacagcucauggggauaccccgcagcuggaccuuaaagcccgcccugcuuacggagccggcgaagugaccguccugguggaggucgcggaucucgagcugcacacaaagaaacuggaaguguccgggcucaagauugccagccugaccugcucuggauguuacgcuugcuccagcggcaucucuuguaagguucggauucaugugaacgagcccgacgaauuuacaguccacgugagauccagcgauccugacguuguggccgcuggcuccucucuuauggcccgcaaaaucgaguucggggccgauagcacguuuaaggcuuucuccucuaugcccaaagacagccugugcuuuuauauugucgaaaaggauuacuguuccagcugcaccgacgaugacacacagaaaugugugaauaccaagcucgaccauccccaaucuauccugaucgagcacaagggaacaauuaucggcaaacagaacgauaccugcuccacgaagaccagcugcuggcuugagucugugaaaggguucuuuuauggacugaagaauaugcucuccggcauuuucgggaacguuuuucugggcaucuuccuguuucucgcgccuuucguccugcuuauuuucuucuuuuucuucggauggagacugcucuuuugucugaaaugcugucggagaacacgcggccugcuuaaguacaagcaccucaaagacgaagaggaagccggguauaagaaaaucaucgagcggcugaauggaaagaaaggcaagagccagcuguucgauggggagagacucgcugaccgcaagauugccgaacuguuuucuaccaaaauccauauugga

SEQ ID NO: 14037 - RNA, 1932 nt, Artificial Sequence
  derived and/or modified CDS sequence (opt5) from CCHFV(75024)__AB069671.1__Gc
uuccuggacagcaucgugagaggcaugaagaaccagcucaauuccaccucucuggagacaagccuuuccauugaagcccccuggggagcuaucaacguccaaucuacguacaaaccuaccguuagcacagccaauauugcgcuguccuggucuagcguggagcaccgggggaacaagauccucguguccggccgcagcgaaucuauuaugaaacuggaggaaagaaccgggaucuccugggaucuuggagucgaggacgcuagcgagucuaagcugcucacaguguccguuauggaucugagccagauguauucuccgguguuugaauaccuguccggcgaccggcaggucgaggaauggcccaaagcuaccugcacaggggauuguccugagcgcugcggauguaccacgagcacaugccuccauaaggaguggccccacuccagaaauuggcgguguaacccuaccuggugcuggggcgugggcaccggguguacaugcuguggacuggacguuaaggaucuuuucaccgacuauaugaucgugaaauggaaggucgaauacauuaaaacggaggccaucgugugcguggaacugacaucucaggagcgccaauguagccucauugaagcuggcaccagauuuaaucugggguccgucacaaucacccuuagcgagccccggaacauucagcagaagcugccuccggagaucauuacccuccauccccgcaucgaagagggauucuuugaucugaugcacguucagaaagugcugucugccuccacagugugcaagcuccaaagcugcacgcauggcgucccuggggaccuucagguguaucacguuggaaaucugcugaagggcgauaaagugaacggccaccucauccauaagauugaaccccaccugaauaccucuuggaugagcugggacgggugugaucuugacuacuauugcaacaugggagacuggccuuccuguacauacaccggcgucacacagcauaaucacgcuucuuucgugaaccugcucaauaucgagaccgauuacacgaaauccuuucacuuccauagcaagagaguuacagcccacggggacacaccccagcuggaucugaaagcgcggccgaccuauggagccggcgaaauuaccgugcucgucgagguggcugacauggaguuuaccccuaagaaaaucgaaauuagcgggcugaaguucgccucucuuacaugcacgggauguuacgcuugcuccagcggcaucucuuguaagguccgcauccauguggaugagcccgacgaacugaccguucacgugaaauccgaugacccugaugucguggccgcgagcuccucucucauggccagaaagcuggaguuuggcacagacagcaccuucaaagccuuuuccgccaugcccaagacaucucuuugcuucuauauuguugaacgggaguacuguaaaagcugcuccaaggaggauacccaaaagugugugaacacgaaacuggaacagccccagagcauccucauugagcauaaggggaccaucauuggaaaacaaaacaauacaugcaccgcuaaggccucuugcuggcuggaauccgucaagagcuucuuuuauggccugaaaaacaugcucucugggaucuucggaaaucuguuuaugggcaucuuccuuuuucuggccccuuucauucuccugauccuguuuuucauguuuggguggcgcauucuuuucuguuuuaagugcuguagacggacaagaggccucuucaaauaccgccaccugaaggacgacgaggagaccggauaucggagaaucauugaacgccugaacaauaaaaagggcaaaaacaagcuccuggauggggagcggcuugcugacagacgcaucgcggaacuguuuuccacgaagacacacauugga

SEQ ID NO: 14038 - RNA, 1932 nt, Artificial Sequence
  derived and/or modified CDS sequence (opt5) from CCHFV(7803)__AB069672.1__Gc
uuccuggacagcaucgugagaggcaugaagaacccccucaauuccaccucucuggagacaagccuuuccauugaagccccuuggggagcuaucaacguccagucuacguacaaaccgaccguuagcacagccaauauugcgcuguccuggucuagcguggagcaccgggggaacaagauccucguguccggccgcagcgaaucuauuaugaaacuggaggaaagaaccgggaucuccugggaucuuggagucgaggacgcuagcgagucuaagcugcucacaguguccguuauggaucugagccaaauguauucucccguguuugaauaccuguccggcgaccggcaggucgaggaauggccuaaagcuaccugcacaggggauugucccgagcgcugcggauguaccacgagcacaugccuccauaaggaguggccucacuccagaaauuggcgguguaaccccaccuggugcuggggcgugggcaccggguguacaugcuguggacuggacguuaaggaucuuuucaccgacuauaugaucgugaaauggaaggucgaauacauuaaaacgcgcggcaucgugugcguggagcugacaucucaggaaagacaguguagccucauugaggccgggacccgguuuaaucugggauccgucacaaucacccuuagcgaaccucgcaacauucaacagaagcugccgcccgagaucauuacccuccauccuagaaucgaggaaggcuucuuugaucugaugcacguucagaaagugcugucugccuccacagugugcaagcuccagagcugcacgcaugggguccccggagaccugcaaguguaucacguuggcaaucuucugaagggcgauaaagugaacgggcaccucauccauaagauugagccucaccugaauaccucuuggaugagcugggacggaugugaucuugacuacuauugcaacaugggcgacuggcccuccuguacauacaccggggucacacagcauaaucacgccucuuucgugaaccugcucaauaucgaaaccgauuacacgaaauccuuucacuuccauagcaagcggguuacagcucacggagacaccccgcagcuggaucugaaagcccgcccuaccuauggcgcgggggagauuacagugcucgucgaaguggccgacauggaguuuacccccaagaaaaucgagauuagcggacugaaguucgcuucucuuacaugcacgggcuguuacgccugcuccagcggcaucucuuguaaggucagaauccauguggaugaaccugacgagcugaccguucacgugaaauccgaugaccccgaugucguggcugccagcuccucucucauggcgcggaagcuggaauuugggacagacagcaccuucaaagccuuuuccgcuaugcccaagacaucucuuugcuucuauauuguugagcgcgaauacuguaaaagcugcuccaaggaggauacccagaagugugugaacacgaaacuggagcaaccucagagcauccucauugaacauaagggaaccaucauuggcaaacagaacaauacaugcaccgccaaggcuucuugcuggcuggaguccgucaagagcuucuuuuaugggcugaaaaacaugcucucuggaaucuucggcaacuuuuucauggggaucuuucuguuccuugccccguuuauucugcucauccuguucuuuauguucggcuggcggauucuguuuuguuucaagugcuguagaagaacacgcggacuuuuuaaauaccggcaccucaaggacgacgaagagaccggcuauagacgcaucauugagcggcugaauaauaaaaaggggaaaaacaagcugcucgauggagaaagacuggccgaccgccggaucgcugagcuuuucuccacgaagacacacauuggc

SEQ ID NO: 14039 - RNA, 1932 nt, Artificial Sequence
  derived and/or modified CDS sequence (opt5) from CCHFV(79121)__AB069673.1__Gc
uuccuggacagcaccgccaagggcaugaaaucccuccugaacucuacaagccuugagacgucccugucuaucgaagcucccuggggagccauuaaugugcagagcaccuuuaagccuacagucuccgcggcuaacaucgcccucucuuggagcuccguugagcacagaggaaauaaaauucuggugagcggccggucugaauccaucaugaaacuugaggaacgcaccggggugagcuggaaccugggagucgaggaugccucugaguccaaaacacucaccgugagcguuauggaccugucucaaauguacuccccgguguucgaauaucugagcggcgauagacaggucgaggaauggcccaaggcuacaugcaccggggacuguccugagcggugcggauguacguccucuaccugccuccauaaggaguggccccacagccgcaauuggagauguaacccuacauggugcuggggcgugggcaccggguguacaugcuguggacuggauguuaaagacuuuuucaccgauuacaugcuugugaaguggaaagucgaauauauuaagacggaggccaucgugugcguggaacugacaucccaggagcggcaguguagccucaucgaagcuggcacccgcuuuaaucuggggcccgucacaauuacccuuucugagccuagaaacguucaacagcggcugccgcccgagaucgugacccuccauccuaaaauugaagagggauucuuugaccugaugcacgugcagaagauccuguccgccagcacagucugcaagcuccagucuugcacgcauggcgugcccggggauuuccaaauuuaccacguuggaaaucugcuucgcggcgacaaagugaacggccacagcauccauaagauugaaccucacuuuaauaccuccuggaugucuugggaugggugugaccuggauuauuucugcaacaugggagacuggcccagcuguacauacaccggcgucacacagcauaauagagcggccuuuaucaacaugcucaauaucgagaccgacuauacgaaaacauuccacuuucacuccaagcgggugaccgcucauggggauaccccgcagcuggaccuuaaagcccgcccugcuuacggagccggcgaaguuacagugcuggucgagguggcggaucucgagcugcacaccaagaaccuggaagucagcgggcucaaaauugccucucugacaugcuccggauguuacgcuugcagcucuggcaucuccuguaaggugcggauucauguuaacgagcccgacgaauuuacggugcacgucagaagcuccgauccugacgugguugccgcuggcucuagccuuauggcccgcaagaucgaguucggggccgauuccaccuuuaaggcuuucucuagcaugcccaaggacucccugugcuuuuauauuguggaaaaagauuacuguagcucuugcacagacgaugacacccagaagugugucaauacaaaacucgaccauccccaauccauccugaucgagcacaagggaaccauuaucggcaagcagaacgauacgugcagcaccaaaacaucuugcuggcuugaguccgugaagggguucuuuuauggacugaaaaauaugcucagcggcauuuucgggaacguguuucugggcaucuuccuguuucucgcgccuuucguucugcuuauuuucuucuuuuucuucggauggagacugcucuuuugucugaagugcugucggagaacccgcggccugcuuaaauacaagcaccucaaggacgaagaggaagccggguauaaaaagaucaucgagcggcugaaugggaaaaagggcaaaucucagcuguucgauggggagagacucgcugaccgcaagauugccgaacuguuuagcacaaagauccauauugga

SEQ ID NO: 14040 - RNA, 1932 nt, Artificial Sequence
  derived and/or modified CDS sequence (opt5) from CCHFV(8402)__AB069674.1__Gc
uucagcgacuccaucgugaagggcaugaaaaaccugcucaauucuaccagccuggagacaucccuuucuauugaagcccccuggggagcuaucaacguccagagcacguuuaagccuaccguuuccgccgcgaauauugcucugucuuggagcuccguggagcacagagggaacaaaauccucgugagcggccggucugaauccauuaugaagcuggaggaacgcacagggaucagcugggaucuuggagucgaggacgccucugaguccaaacugcucaccgugagcguuauggaucugucucaaauguacuccccgguguucgaauaucugagcggcgacagacaggucgaggaauggcccaaggccacaugcaccggggauuguccugagcggugcggauguacauccucuaccugccuccauaaggaguggccccacagccgcaauuggagauguaacccuacguggugcuggggcgugggcaccggguguacaugcuguggacuggacguuaaagaucuuuuuaccgacuacauguucaucaaguggaaaguggaauauauuaagacagaggcuaucgucugcguggaacugaccucccaggagcggcaguguacgcucauugaagccggcacacgcuuuaaucuggggcccgugaccaucacacuuagcgagccuagaaacauucaacagaaacugccgcccgagaucgucacccuccauccucggauugaagagggauucuuugaucugaugcacguucagaaggugcugucugcuuccaccgugugcaagcuccagagcugcacacauggcguccccggggaccugcaaguguaccacaucggaaaucuucugaaaggcgauaagguuaacggccaccucauccauaaaauugaaccucacuucaauacgucuuggaugagcugggacgggugugaucuggacuauuacugcaacaugggagacuggcccuccuguaccuauacaggcgugacccagcauaaucacgccgcguuugucaacaugcuuaauaucgagacagauuacaccaagaacuuccacuuucauucuaaacgcgugacggcccacggggacacaccgcagcuggaucucaaggcuagaccuaccuacggagccggcgaaauuaccguucugguggaggucgcugacauggagcugcauacaaagaagaucgaaauuagcgggcucaaguucgccucccugaccugcacaggauguuaugcgugcagcucuggcaucuccuguaaagugcggauccacgucgaugagcccgacgaacuuacggugcauguuaagagcgaggauccugacauuguggccgcuucuuccagccugauggcccgcaaacucgaauuuggcaccgauuccacauucaaggcuuucucugccaugcccaaaaccagccugugcuuuuacaucgucgagagagaguauuguaaguccugcucuaaggaagacacacagaaaugugugaacaccaaacuugagcaaccccagagcauucugaucgaacacaaagggacgauuaucggaaagcaguccaauaccugcacagccaaagcuagcugcuggcucgagucuguuaaguccuucuuuuacggccugaagaacaugcugagcgggaucuucggaaauguguuuauuggcgucuuccucuuuuucgcgccuuuuauccugcuuauucuguucuuuauguucggguggcggauccucuuuuguuucaaaugcugucgcagaacccggggccuguucaaguauagacaccugaaagaugacgaggaaacaggauaccgcaagauuaucgagcggcuuaacaauaaaaagggcaagaacaaacuccuggacggggaaagacuggccgaucgcaagauugcugagcucuuuucuaccaaaacgcauaucgga

SEQ ID NO: 14041 - RNA, 1932 nt, Artificial Sequence
  derived and/or modified CDS sequence (opt5) from CCHFV(88166)__AB069675.1__Gc
uucagcgacuccaucgugaagggcaugaaaaaccugcucaauucuaccagccuggagacaucccuuucuauugaagcccccuggggagcuaucaacguccagagcacguuuaagccuaccauguccgccgcgaauauugcucugucuuggagcuccguugagcacagagggaacaaaauccucgugagcggccggucugaauccauuaugaagcuggaggaacgcacagggaucagcuggaaucuuggaguggaggaugccucugaguccaaacugcucaccgucagcgugauggaccugucucaaauguacuccccgguuuucgaauaucugagcggcgauagacagguggaggaauggcccaaggccacaugcaccggggacuguccugagcggugcggauguacauccucuaccugccuccauaaggaguggccccacagccgcaacuggagauguaauccuacguggugcuggggcgucggcaccggguguacaugcuguggacuggaugugaaagaccuuuuuaccgauuacauguucaucaaguggaaaguugaauauauuaagacagaggcuaucgugugcgucgaacugaccucccaggagcggcaguguacgcucauugaagccggcacacgcuuuaaccuggggcccgugaccaucacacuuagcgagccuagaaauauucaacagaaacugccgcccgagaucgugacccuccauccucggauugaagagggauucuuugaccugaugcacguccagaagguucugucugcuuccaccgugugcaagcuccagagcugcacacauggcgugcccggggaucugcaagucuaccacaucggaaaccuucugaaaggcgacaaggugaauggccaccucauccauaaaauugaaccucacuucaacacgucuuggaugagcugggaugggugugaccuggauuauuacugcaauaugggagacuggcccuccuguaccuauacaggcguuacccagcauaaccacgccgcguuugugaauaugcuuaacaucgagacagacuacaccaagaacuuccacuuucauucuaaacgcgucacggcccacggggauacaccgcagcuggaccucaaggcuagaccuaccuacggagccggcgaaauuaccgugcugguugagguggcugauauggagcugcauaccaaaaagaucgaaauuagcgggcucaaguucgccucccugacaugcacaggauguuaugcgugcagcucuggcaucuccuguaaaguccggauccacguggacgagcccgaugaacuuacgguccaugugaaaagcgaggacccugaucugguugccgcuucuuccagccucauggcccgcaaacuggaauuuggcaccgacuccacauucaaggcuuucucugccaugcccaaaaccagccuuugcuuuuacauuguggagagagaguauuguaaguccugcucuaaggaagauacacagaaaugugucaauaccaagcuggagcaaccccagagcauccucauugaacacaaagggacgaucauuggaaagcagaacaauaccugcacagccaaggcuuccugcuggcuggagagcgugaagucuuucuuuuacggccugaagaacaugcucuccgggaucuucggaaauguuuuuaucggcguguuccuguuuuucgcgccuuuuauucuucugauccucuucuuuauguucggguggcggauucuguuuuguuucaaaugcugucgcagaacccggggccuguucaaguauagacaccuuaaagacgaugaggaaacaggauaccgcaagaucauugagcggcucaacaauaaaaagggcaagaacaaacugcuggacggggaaagacucgccgaccgcaagaucgcugagcuguuuagcaccaaaacgcauauugga

SEQ ID NO: 14042 - RNA, 1932 nt, Artificial Sequence
  derived and/or modified CDS sequence (opt5) from CCHFV(BA88166)__AF338470.1__Gc
uaccuggacagcaucgugaagggcaugaaaaaccuccuuaauuccaccucucuugagacaagccuguccauugaagcccccuggggagcuaucaacguccagucuacguucaagccuaccaugagcgccgcgaauauugcucucuccuggucuagcguugagcacagagggaacaaaauccugguguccggccggagcgaaucuauuaugaagcuggaggaacgcacagggaucuccuggaaucugggaguggaggaugccagcgagucuaaacuccugaccgucuccgugauggaccugagccaaauguauucuccgguuuuugaauaccucuccggcgauagacagguggaggaauggcccaaggccacaugcaccggggacuguccugagcggugcggauguacaagcucuaccugccugcauaaggaguggccccacucucgcaacuggagauguaauccuacguggugcuggggcgucggcaccggguguacaugcuguggacuugaugugaaagaccuguucaccgauuauauguuuaucaaguggaaaguugaauacauuaagacagaggcuaucgugugcgucgaacucaccagccaggagcggcaguguacgcugauugaagccggcacacgcuucaaccuugggcccgugaucauuacccuguccgagccuagaaauauccaacagaaacucccgcccgagauugugacacugcauccucggaucgaagagggauuuuucgaccugaugcacguccagaagguucucagcgcuucuaccgugugcaagcugcaguccugcacccauggcgugcccggggaucuucaagucuaucacaucggaaaccugcucaaaggcgacaaggugaauggccaccugauucauaaaaucgaaccucacuuuaacacaagcuggaugucuugggaugggugugaccuugauuacuauugcaauaugggagacuggcccagcuguacguacaccggcguuacacagcauaaccacgccgcguucgugaauaugcugaacauugagaccgacuacacaaagaacuuucacuuccauuccaaacgcgucaccgcccacggggauacgccgcagcucgaccugaaggcuagaccuacauauggagccggcgaaaucaccgugcugguugagguggcugauauggagcuccauaccaaaaagauugaaaucucugggcugaaguuugccagccuuacaugcaccggauguuacgcgugcuccagcggcaucucuuguaaaguccggauucacguggacgagcccgaugaacugacaguccaugugaaguccgaggacccugauaucguugccgcuagcuccucccucauggcccgcaaacuggaguucggcacggacagcaccuuuaaggcuuucuccgccaugcccaaaacaucucuuugcuucuauauuguggaaagagaguacuguaagagcugcuccaaggaagauacccagaaaugugucaauacaaagcuggagcaaccccagucuauccucauugaacacaaagggaccaucaucggaaagcagaacaauacgugcaccgccaaagcuagcugcuggcuggaguccguuaagagcuuuuucuauggccugaagaacaugcucucugggauuuuuggaaauguguucaucggcguguuucuguucuuugcgccuuucauucuucugauccucuuuuucauguuuggguggcggauucuguucuguuuuaaaugcugucgcagaacacggggccuguucaaguacagacaccuuaaagacgaugaggaaaccggauaucgcaagaucauugagcggcucaacaauaaaaagggcaagaacaaacugcuggacggggaaagacucgccgaccgcaagaucgcugagcuguucuccacaaaaacccauaucgga

SEQ ID NO: 14043 - RNA, 1932 nt, Artificial Sequence
  derived and/or modified CDS sequence (opt5) from CCHFV(BA66019)__AF350448.1__Gc
uucagcgacuccaucgugaagggcaugaaaaaccugcucaauucuaccagccuggagacaucccuuucuauugaagcccccuggggagcuaucaacguccagagcacguuuaagccuaccguuuccacagccaauauugcgcugucuuggagcuccguggagcacagagggaacaaaauccucgugagcggccggucugaauccauuaugaagcuggaggaacgcaccgggaucagcugggaucuuggagucgaggacgcuucugaguccaaacugcucacagugagcguuauggaucugucucaaauguacuccccgguguucgaauaucugagcggcgacagacaggucgaggaauggcccaaggcuaccugcacaggggauuguccugaccggugcggauguaccuccucuacgugccuccauaaggaguggccccacagccgcaauuggagauguaacccuaccuggugcuggggcgugggcacaggguguaccugcuguggacuggauguuaaagaccuuuuuacagauuacauguucgugaaguggaaagucgaguauaucaagaccgaagccauugugugcguggagcucaauucccaggaacggcaguguagccugaucgaggcuggcacgcgcuuuaaccuggggcccgucacaauuacccuuucugaaccuagaaauauccaacagaaacugccgcccgagauuaucacacuccauccucggauugaggaaggauucuuugaccugaugcacguucagaaggugcuguccgccagcaccgugugcaagcuccagucuugcacccauggcguccccggggaucugcaaaucuaccacaucggaaaccuucugaaaggcgaccgcgugaauggccaccucauucauaagaucgagccucacuucaacacaagcuggauguccugggaugggugugaccuggacuauuacugcaauaugggagauuggcccucuuguacguauaccggcguuacacagcauaaccacgcugccuuugugaaucuucugaacauugaaaccgacuacaccaaaaacuuccacuuucauagcaagagagucacagcgcacggggauacgccgcagcucgaccugaaagcccggccuacauacggagcuggcgagaucaccgugcugguugaaguggccgauauggagcuccauaccaagaaaauugcuaucuccgggcugaaguucgccagccuuacaugcaccggauguuaugcguguucuuccggcaucagcugcaagguccgcauucacguggacgagcccgaugaacugacaguccaugugaaaucugaggacccugauaucguugccgcuuccagcucccucauggccagaaagcuggaauuuggcacggacucuaccuucaaagccuucagcgccaugcccaagacaucccuuugcuuuuacauuguggagcgggaauauugugagucuugcagcaaagaggauacccagaagugugucaauacaaagcuggaacaaccccaguccauccucauugagcacaaagggaccaucaucggaaagcagaacgacacgugcaccgccaaagcuagcugcuggcuggaaucugugaaguccuucuuuuacggccugaaaaauaugcucagcgggauuuucggaaacguuuuuaucggcauuuuccuguuucuugcgccuuucauccugcucauucuguuuuucauguuuggguggcgcauccuguucuguuuuaagugcuguagacggacaagaggccuuuucaaguaucgcuaccucaaagacgaugaggagucuggauaucggagaauuaucgaacgccugaauaacaagaaaggcaagaauaaacugcucgacggggagcggcuggccgauagacgcaucgcugaacuuuucuccaccaagacacacauugga

SEQ ID NO: 14044 - RNA, 1932 nt, Artificial Sequence
  derived and/or modified CDS sequence (opt5) from CCHFV(BA8402)__AF350449.1__Gc
uucagcgacuccaucgugaagggcaugaaaaaccugcucaauucuaccagccuggagacaucccuuucuauugaagcccccuggggagcuaucaacguccagagcacguuuaagccuaccguuuccgccgcgaauauugcucugucuuggagcuccguggagcacagagggaacaaaauccucgugagcggccggucugaauccauuaugaagcuggaggaacgcacagggaucagcugggaucuuggagucgaggacgccucugaguccaaacugcucaccgugagcguuauggaucugucucaaauguacuccccgguguucgaauaucugagcggcgacagacaggucgaggaauggcccaaggccacaugcaccggggauuguccugagcggugcggauguacauccucuaccugccuccauaaggaguggccccacagccgcaauuggagauguaacccuacguggugcuggggcgugggcaccggguguacaugcuguggacuggacguuaaagaucuuuuuaccgacuacauguucaucaaguggaaaguggaauauauuaagacagaggcuaucgucugcguggaacugaccucccaggagcggcaguguacgcucauugaagccggcacacgcuuuaaucuggggcccgugaccaucacacuuagcgagccuagaaacauucaacagaaacugccgcccgagaucgucacccuccauccucggauugaagagggauucuuugaucugaugcacguucagaaggugcugucugcuuccaccgugugcaagcuccagagcugcacacauggcguccccggggaccugcaaguguaccacaucggaaaucuucugaaaggcgauaagguuaacggccaccucauccauaaaauugaaccucacuucaauacgucuuggaugagcugggacgggugugaucugcauuauuacugcaacaugggagacuggcccuccuguaccuauacaggcgugacccagcacaaucacgccgcguuugucaacaugcuuaauaucgagacagacuacaccaagaacuuccauuuucacucuaaacgcgugacggcccauggggauacaccgcagcuggaccucaaggcuagaccuaccuacggagccggcgaaauuaccguucugguggaggucgcugauauggagcugcacaccaaaaagaucgaaauuagcgggcucaaguucgccucccugacaugcacaggauguuaugcgugcagcucuggcaucuccuguaaagugcggauccaugucgacgagcccgaugaacuuacggugcacguuaagagcgaggacccugauauuguggccgcuucuuccagccugauggcccgcaaacucgaauuuggcaccgacuccacauucaaggcuuucucugccaugcccaaaaccagccugugcuuuuacaucgucgagagagaguauugugaauccugcucuaaggaggauacacagaagugugugaacaccaaacuugaacaaccccagagcauucugaucgagcacaaggggacgauuaucggaaaacaguccaauaccugcacagccaaggcuagcugcuggcucgagucuguuaaauccuucuuuuacggccugaagaacaugcugagcgggaucuucggaaauguguuuauuggcgucuuccucuuuuucgcgccuuuuauccugcuuauucuguucuuuauguucggguggcggauccucuuuuguuucaagugcugucgcagaacccggggccuguucaaauauagacaucugaaggacgaugaagagacaggauaccgcaaaauuaucgaacggcuuaacaauaagaaaggcaagaacaagcuccuggacggggagagacuggccgaccgcaaaauugcugaacucuuuucuaccaagacgcacaucgga

SEQ ID NO: 14045 - RNA, 1932 nt, Artificial Sequence
  derived and/or modified CDS sequence (opt5) from CCHFV(Matin)__AF467769.2__Gc
uuccuggacagcaucauuaagggcaugaaaaaccuccuuaauuccaccucucuugagacaagccuguccaucgaagcccccuggggagcuauuaacgugcagucuacguuuaagccuaccaugagcgccgcgaauaucgcucucuccuggucuagcgucgagcacagagggaacaaaauucugguuuccggccggagcgaaucuaucaugaagcuggaggaacgcacagggaucuccugggaucugggaguggaggacgccagcgagucuaaacuccugaccguguccgucauggaucugagccaaauguacucuccgguguucgaauaucucuccggcgacagacagguugaggaauggcccaaggccacaugcaccggggauuguccugagcggugcggauguacaagcucuaccugccugcauaaggaguggccccacucccgcaauuggagauguaacccuacguggugcuggggcgugggcaccggguguacaugcuguggacuugacgucaaagaucuguuuaccgacuacauguucgugaaguggaaaguugaauauauuaagacagaggugaucgucugcguggaacucaccagccaggagcggcaguguucccugauugaagcuggcacgcgcuuuaaucuugggcccgugacaaucacccugagcgagccuagaaacauucaacagaaacucccgcccgagaucgucacacugcauccucggauugaagagggauucuuugaucugaugcacguucagaaggugcucucugccuccaccgugugcaagcugcagagcugcacccauggcguccccggggaccuucaaguguaccacaucggaaaucugcucaaaggcgauaagguuaacggccaccugauccauaaaauugaaccucacuucaauacaucuuggaugagcugggacgggugugaucuugacuauuacugcaacaugggagacuggcccuccuguucuuauacgggcgugacccagcauaaucacgcugccuuugucaacaugcugagcaucgagacagauuacaccaagaauuuccacuuucauuccaaacgcgugacagcgcacggggacaccccgcagcucgaucugaaggccagaccuacguacggagcuggcgaaauuacaguucugguggaggucgccgacauggagcuccauaccaaaaagaucgaaauuagcgggcugaaguucgcuucucuuaccugcacaggauguuaugccugcuccagcggcaucucuuguaaagugcggauccacgucgaugagcccgacgaacugaccgugcauguuaaguccgaggauccugacauuguggcggccagcuccucucucauggcucgcaaacuggaauuuggcacagauagcacguucaaggccuucuccgcuaugcccaaaaccucucuuugcuuuuacaucgucgagagagaguauuguaagagcugcuccaaggaagacacacagaaaugugugaacaccaagcuggagcaaccccagagcauucucaucgaacacaaagggacaauuaucggaaagcagaacgauaccugcacggccaaagccucuugcuggcuggaguccguuaagagcuucuuuuacggccugaagaauaugcucucugggaucuucggaaacguguuuauuggcaucuuccuguuucuugcuccuuucgcgcugcucauucuguuuuucauguuuggguggcggauccuguucuguuuuaaaugcugucgcagaacccggggccuuuucaaguauagacaccucaaagacgacgaggaaacaggauaccgcaagauuaucgagcggcugaauaacaaaaagggcaagaauaaacugcucgauggggaaagacuggccgaccgcaagauugcugagcuuuucuccaccaaaacacaugucgga

SEQ ID NO: 14046 - RNA, 1932 nt, Artificial Sequence
  derived and/or modified CDS sequence (opt5) from CCHFV(Baghdad 12)__AJ538197.2__Gc
uuccuggacagcaucgugaagggcaccaaaaaccuccuuaauuccacaucucuugagacgagccuguccauugaagcccccuggggagcuaucaacguccagucuaccuacaagccuacaguuagcaccgccaauauugcgcucuccuggucuagcguggagcacagagggaacaaaauccugguguccggccggagcgaaucuauuaugaagcuggaggaacgcacagggaucuccugggaucugggagucgaggacgcuagcgagucuaaacuccugaccguguccguuauggaucugagccaaauguauucuccgguguuugaauaccucuccggcgacagacaggucgaggaauggcccaaggccacaugcaccggggauuguccugagcggugcggauguacgaccagcacaugccugcauaaggaguggccccacucccgcaauuggagauguaacccuaccuggugcuggggcgugggcacaggguguaccugcuguggacuugacguuaaagaucuguucacggacuauauguuugugaaguggaaagucgaauacaucaagacagaugccauugugugcguggagcucaccucucaggaacggcaguguagccugaucgaggcuggcacacgcuucaaucuuggguccgucaccauuacccugagcgaacccagaaacauccaacagaaacucccuccggagauuaucacacugcauccccggauugaggaaggauuuuucgaccugaugcacguucagaaggugcucucugccuccacggugugcaagcugcagagcugcacccauggcgucccuggggaucuucaaguguaucacaucggaaaucugcucaaaggcgacaagguuaacggccaccugauccauaaaauugagccccacuuuaauacaucuuggaugagcugggaugggugugaccuugacuacuauugcaacaugggagauuggccuuccuguaccuacacaggcgugacccagcauaaucacgcuucuuucgucaaccugcucaauaucgaaacggacuacacaaagagcuuucacuuccauuccaaacgcgugaccgcccacggggauacaccccagcuggaccugaagguuagaccgacauauggagcgggcgagauuaccgugcucgucgaaguggccgauauggagcugcauaccaaaaagaucgagauuagcgggcuuaaguuugcuucucugacgugcaccggauguuacgccugcuccagcggcaucucuuguaaaguccggauccacguggacgaaccugaugagcucacaguucaugugaaguccgacgaucccgacgucguggcugccagcuccucucugauggcgcgcaaacuugaguucggcaccgauagcacauuuaaggccuucuccgcuaugccuaaaaccucucugugcuucuauauuguugaaagagaauacuguaagagcugcuccaaggaggacacgcagaaaugugugaacaccaagcucgagcaaccccagagcauccugauugaacacaaagggacaaucauuggaaagcagaacaauaccugcacagccaaaaccucuugcuggcuggaguccgucaagagcuuuuucuauggccucaagaacaugcugucugggaucuuuggaaauuucuuuaugggcaucuuccuuuuucuggcucccuucauucuccugauccuguuuuucauguuuggguggcggauucuuuucuguuuuaaaugcugucgcagaacgcggggccucuucaaguacagacaccugaaagacgaugaagagacaggauaucgccggaucauugagagacugaacaauaagaaaggcaagaacaagcuccuggacggggaacgccuugccgaucggagaaucgccgagcuguucuccaccaaaacacauauugga

SEQ ID NO: 14047 - RNA, 1932 nt, Artificial Sequence
  derived and/or modified CDS sequence (opt5) from CCHFV(VLG/TI29414)__AY179961.1__Gc
uuccuggacagcaucgugaagggcaugaaaaaccuccuuaauuccaccaaccuugagacaucucugagcauugaagcccccuggggagcuaucaauguccaguccacguuuaagccuaccguuucuacagccaacauugcgcucagcugguccucuguggagcacagaggaaauaaaauccuggugaccggccggagcgaauccauuaugaagcuggaggaacgcacaggggucagcugggaucugggaguggaggacgcuucugaguccaaacuccugaccguuagcaucauggaucugucucaaauguacuccccgguguucgaauaucucagcggcgacagacaggucgaggaauggcccaaggccacaugcaccggggauuguccugagcggugcggauguacgucuuccacaugccugcauaaggaguggccccacagccgcaacuggagauguaauccuacauggugcugggaagugggcaccggcuguacaugcuguggguggaacguuaaagaccuuuuuaccgaucauauguucgugaaguggaaagucgaguacaucaagacggaagccauugugugcguggagcugacaucccaggaacggcaguguucucucaucgaggcuggaacccgcuuuaaucugggccccgucacaauuacccuuagcgagccuagaaacauccaacagaaacugccgcccgaaauuaucacccuccacccuaagguugaggaaggguucuuugaccugaugcaugugcagaaggugcuguccgccagcacagucugcaaacuccagucuugcacgcacgggauucccggcgaucugcaaguguaucacaucgggaaucuucugaagggagaccggguuaacggccaucucauccacaaaauugagccucauuucaauaccuccuggaugagcugggauggcugugaccuggauuacuauugcaacaugggggacuggcccucuuguacauacaccggaaugacacagcacaaucacgcugccuuugugaaccuucugaacaucgaaaccgacuauacgaagacauuccauuuucacagcaaacgcgucaccgcgcauggcgauaccccgcagcucgaccugaaggccagaccuacauacggggcuggagagauuaccgugcugguugagguggccgauauggaacuccacaccaaaaaggucgagaucuccggccugaaguucgcuucucuugccugcacgggguguuacgcgugcagcuccggaauuagcuguaaagugcggauccaugucgacgaacccgaugagcugaccgugcacguuaagucuaaugacccugaugugaucgccgcuuccacaagccucauggcccgcaaacuggaauuuggcaccgacucuacauucaaggcuuucuccgccaugcccaaaaccagccuuugcuuuuauauugccgagagagaguacuguaaguccugcucugaagaggauacgcagaagugugucgacaccaaacuggaacaaccccagagcauccucauugagcacaagggcacaaucauugggaaacagaacgauaccugcacagcuaaggcguccugcuggcuggagucugugaaauccuucuuuuauggacugaagaauaugcucggcagcguuuucgggaacuuuuucaucggaauccugcuuuuucuggccccuuucgugcuccugguccuguuuuucauguuuggcuggaagauucuuuucuguuuuaaaugcugucggcgcaccagagggcuccugaaguaccggcugcucaaagacgacgaagagacgggcuauagacgcaucauugaacggcugaauaacaagaaaggaaagaauagacuucuggauggcgagcgccucgcugaccggaagaucgccgaacuguucagcacaaaaacccauauuggg

SEQ ID NO: 14048 - RNA, 1932 nt, Artificial Sequence
  derived and/or modified CDS sequence (opt5) from CCHFV(TADJ/HU8966)__AY179962.1__Gc
uuccuggacagcaucgugaagggcaugaaaaacccccucaauuccaccucucuggagacaagccuuuccauugaagccccuuggggagcuaucaacguccagucuacguacaagccgaccguuagcacagccaauauugcgcuguccuggucuagcaucgagcacagagggaacaauauucucguguccggccggagcgaaucuaucaugaaacuggaggaacgcaccgggaucuccggagaucuuggcguggaggacgcuagcgagucuaagcugcucacagucuccgugauggaucugagccaaauguauucucccguuuuugaauaccuguccggggacagacagguggaggaauggccuaaagcuaccugcacaggagauugucccgagcggugcggcuguaccagcuccacgugccuccauaaggaguggccucacucucgcaacuggagauguaaucccaccuggugcuggggcgucgggacaggauguaccugcuguggccuggacgugaaggaucuuuucauugacuauauguuuguuaaauggaagguggauuacaucaaaacagaagccauugucugcguggagcugaccagccaggaacggcaguguucccucguggaggcugggacgcgcuucaaccugggaccugucacaaucacccuuagcgaaccgagaaauauucaacagaagcugcccccugagaucauuacacuccauccccggaucgaggaaggcuuuuucgaccugaugcacguucagaaagugcugucugccuccaccgugugcaagcuccagagcugcacccauggggucccuggagaucugcaaguguaucacaucggcaaccuucugaagggcgacaaagagaaugggcaccucauucauaagaucgaaccccacuuuaacacaucuuggaugagcugggauggaugugaccuggacuacuauugcaauaugggcgauuggccguccuguacguacaccgggguuacacagcauaaccacgcuucuuucgugaaucuucugaacauugagaccgacuacacaaaaucuuuucacuuccauuccaagcgcgucaccgcccacggagauacgccucagcucgaccugaaagcgagacccacauauggcgccggggaaaucaccgugcugguugagguggcugauauggagcuccauaccaagaaaauugaaaucacaggacugaaguuugccagccuuaccugcacaggcuguuacgcuugcagcuccggcaucagcuguaagguccggauucacguggacgagccugaugaacugacgguccaugugaaaucugacgaucccgacguuguggccgcguccagcucccucauggcccgcaagcuggaguucgggaccgauucuacauuuaaagccuucagcgccaugcccaagaccucccuuugcuucuauaucgucgaaagagaguaccggaaaucuuguagcaaggaggacacacagaagugcgugaacaccaaacuggaacaaccucaguccauucucaucgagcacaagggaacgauuaucggcaaacagaauaacaccuguacagcuaaggccagcugcuggcuggaaucuguuaaauccuuuuucuaugggcugaagaauaugcucagcggaaucuuuggcaacguguucgucgggauuuuucuguuccuugccccguuuauccugcucauucuguucuuuauguucggcuggcgcauccugucuugcuuuaaguguugcagacggaccagaggacuucucaaacaccgccaucugaaggacgaugaggagacaggcuaccggagaauuaucgaacgccugaauaacaaaaaggggaaaaauaagcuccuggacggagagcggcuugcugauagacgcauugcggaacuguucuccaccaagacgcacaucggc

SEQ ID NO: 14049 - RNA, 1932 nt, Artificial Sequence
  derived and/or modified CDS sequence (opt5) from CCHFV(Hodzha)__AY223476.1__Gc
uuccuggacagcaucgugaagggcaccaaaaaccuccuuaauuccacaucucuugagacgagccuguccauugaagcccccuggggagcuaucaacguccagucuaccuacaagccuacaguuagcaccgccaauauugcgcucuccuggucuagcguggagcacagagggaacaaaauccugguguccggccggagcgaaucuauuaugaagcuggaggaacgcacagggaucuccugggaucugggagucgaggacgcuagcgagucuaaacuccugaccguguccguuauggaucugagccaaauguauucuccgguguuugaauaccucuccggcgacagacaggucgaggaauggcccaaggccacaugcaccggggauuguccugagcggugcggauguacgagcucuaccugccugcauaaggaguggccccacucucgcaauuggagauguaacccuacauggugcuggggcgugggcaccggguguacaugcuguggacuugacguuaaagaucuguucaccgacuauauguuugugaaguggaaagucgauuacaucaagacggaagccauugugugcguggagcucacaagccaggaacggcaguguucccuggucgaggcuggcacccgcuucaaucuugggcccguuacaaucacccugagcgaaccuagaaacauucaacagaaacucccgcccgagaucauuacccugcauccucggaucgaggaaggauuuuucgaccugaugcacgugcagaaggugcucucugccuccacagucugcaagcugcagagcugcacgcauggcgugcccggggaucuucaaguuuaucacauuggaaaucugcucaaaggcgacaaggugaacggccaccugauccauaaaaucgagccucacuuuaauaccucuuggaugagcugggaugggugugaccuugacuacuauugcaacaugggagauuggcccuccuguacauacaccggcgucacacagcauaaucacgcuucuuucgugaaccugcucaauauugaaaccgacuacacaaagagcuuucacuuccauuccaaacgcguuacggcccacggggauaccccgcagcuggaccugaaggcgagaccuaccuauggagccggcgagaucacagugcucgucgaaguggcugauauggagcugcauaccaaaaagauugagaucacagggcuuaaguuugccagccugacgugcaccggauguuacgcuugcuccuccggcauuagcuguaaaguccggauccacguggacgaacccgaugagcucacaguucaugugaagucugacgauccugacgucguggccgcguccagcucccugauggcccgcaaacuugaauuuggcaccgauucuacauuuaaggcuuucagcgccaugcccaaaaccucccugugcuucuauaucguugagagagaauacuguaagucuugcagcaaggaggacacgcagaaaugugugaacaccaagcucgagcaaccccaguccauucugaucgaacggaaagggacaauuaucggaaagcagaacaauaccugcacagcuaaagccagcugcuggcuggagucugucaaguccuuuuucuauggccucaagaacaugcugagcgggauuuuuggaaauguguucgugggcaucuuucuuuuccuggccccuuuuauccuccugauucuguucuuuauguucggguggcgcauccuuuucuguuucaaaugcuguagacggaccagaggccucuuuaaguacaaacaccugaaggacgaugaagagacgggauaucgccggauuaucgagagacugaacaauaaaaagggcaagaacaaacuccuggacggggaacgccuugcugaucggagaauugcggagcuguucucuacaaagacccacaucgga

SEQ ID NO: 14050 - RNA, 1932 nt, Artificial Sequence
  derived and/or modified CDS sequence (opt5) from CCHFV(Kosovo/9553/2001)__AY675511.1__Gc
uuccuggacagcaucgugaagggcaugaaaaaccuccuuaauuccaccucucuugagacaagccuguccauugaagcccccuggggagcuaucaacguccagucuacguuuaagccuaccguuagcacagccaauauugcgcucuccuggucuagcguggagcacagagggaacaaaauccuggugaccggccgguccgaaagcauuaugaagcuggaggaacgcacaggggucucuugggaucugggaguggaggacgcuuccgagagcaaacuccugaccguuucuaucauggaucugucccaaauguacagcccgguguucgaauaucucucuggcgacagacaggucgaggaauggcccaaggccacaugcaccggggauuguccugagcggugcggauguacguccagcacaugccugcauaaggaguggccccacucccgcaauuggagauguaacccuacauggugcuggggcgugggcaccggguguacaugcuguggaguugacgugaaagaucuuuuuaccgaccauauguucgucaaguggaaaguggaauacaucaagacggaggccauugugugcgucgaacugacaucucaggagcggcaguguagccucaucgaagcuggcacccgcuuuaaucuggggcccguuacaauuacccuuuccgagccuagaaacauccaacagaaacugccgcccgagauuaucacccuccacccuaagauugaagagggauucuuugaucugaugcaugugcagaaggugcugagcgccucuacagucugcaaacuccaguccugcacgcacggcauccccggggaccugcaaguguaucacaucggaaaucuucugaagggcgaucggguuaacggccaucucauucacaaaaucgaaccucauuucaauaccagcuggaugucuugggacgggugugaucuggacuacuauugcaacaugggagacuggcccagcuguacauacaccggcgugacacagcacaaucacgcugccuuugucaaccuucugaauauugagaccgauuauacgaagacauuccauuuucacuccaaacgcgugaccgcgcauggggacaccccgcagcucgaucugaaggccagaccuacauacggagcuggcgaaaucaccguucugguggaggucgccgacauggagcuccacaccaaaaagguggaaauuucugggcugaaguucgcuagccuugccugcacgggauguuacgcgugcuccagcggcaucucuuguaaaguccggauccauguggaugagcccgacgaacugaccguucacgugaaguccagcgauccugacgucguggccgcuucuacaucccucauggcccgcaaacuggaguuuggcaccgauagcacauucaaggcuuucuccgccaugcccaaaaccucucuuugcuuuuauauuguugaaaaggaguacuguaagagcugcuccgaggacgauacgaaaaaguguguggacaccaaacuggaacagccccaaucuauccucauugagcacagagggacaaucauuggaaagccuaacgauaccugcccggccaaaacaagcugcuggcuggaauccgucaagagcuucuuuuauggccugaagaacaugcucgggucuguguucggaaacuuuuucaucggcauccugcuuuuucuggcucccuucuuucucuggaugcuguccuucauguuuggguggaaaauucuguucuguuuuaagugcugucggcgcaccagaggccuuuucaaauaccggcaucucaaggacgacgaggagacgggauauagacgcaucauugaacggcugaauaauaaaaagggcaagaacagacugcucgauggggagcgccuggcggaccggaaaaucgccgaacuuuucagcacaaagacccacauugga

SEQ ID NO: 14051 - RNA, 1932 nt, Artificial Sequence
  derived and/or modified CDS sequence (opt5) from CCHFV(SPU41/84)__AY900142.1__Gc
uuccuggacagcaucgugaagggcaugaaaaaccuccuuaauuccaccucucuugagacaagccuguccauugaagcccccuggggagcuaucaacguccagucuacguacaagccuaccguuagcacagccaauauugcgcucuccuggucuagcguggagcacagagggaacaaaauccugguguccggccggagcgaaucuauuaugaagcuggaggaacgcaccgggaucuccugggaucugggagucgaggacgcuagcgagucuaaacuccugacaguguccguuauggaucugagccaaauguauucuccgguguuugaauaccucuccggcgacagacaggucgaggaauggcccaaggccacaugcacaggggauuguccugagcggugcggauguaccagcuccacgugccugcauaaggaguggccccacucucgcaauuggagauguaacccuaccuggugcuggggcgugggcacaggguguaccugcuguggacuugacguuaaagaucuguucacagacuauauguuugugaaguggaaagucgaauacaucaagaccgaggccauugugugcguggaacucacgagccaggagcggcaguguucccugaucgaagcuggcacacgcuucaaucuugggcccgucaccauuacacugagcgagccuagaaacauccaacagaaacucccgcccgagauuaucacccugcauccucggauugaagagggauuuuucgaucugaugcacguucagaaggugcucucugccuccaccgugugcaagcugcagagcugcacacauggcguccccggggaccuucaaguguaucacaucggaaaucugcucaaaggcgauaagguuaacggccaccuggugcauaaaaucgaaccucacuuuaauacgucuuggaugagcugggacgggugugaucuugacuacuauugcaacaugggagacuggcccuccuguaccuacacaggcgucacccagcauaaucacgcuucuuucgugaacaugcugaauauugagacagauuacaccaagaacuuucacuuccauagcaaacgcguuacggcccacggggacacaccgcagcucgaucugaaggcgagaccuaccuauggagccggcgaaaucaccgugcuggucgagguggcugacauggagcuccauaccaaaaagauugaaaucuccgggcugaaguuuaccagccuuacaugcacgggauguuacgccuguucuuccggcauuagcugcaaaguccggauccacguggaugagcccgacgaacugaccguucaugugaagucugaggauccugacgucguggcugccuccagcucccucauggcgcgcaaacuggaauuuggcacagauucuaccuuuaaggccuucagcgcuaugcccaaaacaucccuuugcuucuauaucguugagagagaguacuguaagucuugcagcgaagaggacacccagaagugugugaacacgaaacuggaacaaccccaguccauucucaucgagcggaaggggaccauuaucggaaaacagaauaacacaugcaaggccaaagcuggcugcuggcuggagagcgucaagucuuucuucuaugggcugaagaauaugcucuccggaauuuuuggcaacguguucaucgggaucuuucuguuccuugccccuuuuauucugcucauccuguucuuuauguucggcuggcgcauucuguuuuguuucaaaugcuguagacggaccagaggacuuuuuaaguaccgccaccucaaagaugacgaagagacaggcuaucggaagaucauugaaagacugaauaacaaaaaggggaagaauaaacugcucgacggagagcgccuggccgaucggagaaucgcugaacuuuucagcaccaagacgcacauuggc

SEQ ID NO: 14052 - RNA, 1932 nt, Artificial Sequence
  derived and/or modified CDS sequence (opt5) from CCHFV(UG3010)__AY900143.1__Gc
uaccuggacagcaucgccaagggcaugaaaucccuccugaacucuaccaaucuugagacaagccuguccauugaagcucccuggggagccaucaacgugcagucuacguucaagccuaccgucagcgcggcuaauauugcccucuccuggucuagcguugagcacagagggaacaaaauccugguguccggccggagcgaaucuauuaugaagcuggaggaacgcacagggaucuccuggagccugggaguggaggaugccucugaguccaaaacccucacagucagcgugauggaccugucucaaauguauuccccgguuuuugaauaccugagcggcgauagacagguggaggaauggcccaaggcuaccugcacaggggacugucaggagcggugcggauguaccuccucuacgugccuccauaaggaguggccucacagccgcaauuggagauguaaccccaccuggugcuggggcgucggcacaggguguaccugcuguggacuggaugugcgggaccuuuucacagauuauaugaugguuaaauggaagguggaauacgucaaaaccgaggccaucaugugcguggaacugacgucccaggagcgccaauguagccucauugaagcuggcacaagauuuaaucuggggccugugaccaucacacuuucugagccccggaacauucagcagcgccugccuuccgagaucgucacccuccauccgaagauugaagagggauucuuugaccugaugcacguucagaaagugcugagcgccucuaccgugugcaagcuccaaagcugcacacauggcguccccggggaucuucagguguaucacguuggaaaucuucugaagggcgacaaagugaacggccacuccauccauaagauugaaucucacuucaauacgagcuggauguccugggaugggugugaccucgauuacuuuugcaacaugggagacuggccuagcuguaccuauacaggcgucacccagcauaauagagcggccuucaucaacaugcugaauaucgagacagacuacaccaaaacguuucacuuccacucuaagcgggugacagcucauggggauacaccccagcuugaccugaaagcccgcccuaccuacggagcuggcgaaguuaccgugcucgucgagguggccgaucuggagcugcacaccaagaaaauugaagucuccgggcucaaguuugcgagccugacaugcucuggauguuaugccugcuccagcggcaucuccuguaaggugcggauucauguuaacgagcccgacgaauuuacggugcacgucaaaucuagcgauccggacgugguugcugccggcuccucucuuauggcuagaaagaucgaguuuggggccgauagcaccuucaaagccuucuccagcaugccuaagaacucucugugcuuuuacauuguggaacgcgacuauuguuccagcugcacaaaugaugacacccaaaaaugugucgauacaaagcucgagcauccccagucuauccugaucgagcacaagggaaccauuaucggcaaacagaacgacacgugcuccaccaagacaagcugcuggcuugaaucugugaaauccuucuuuuacgggcugaagaauaugcucggaggcauuuucgggaacguguuucugggcaucuuccuguuucucgcuccuuucgcgcugcuuauuuucuucuuuuucuuuggauggagacuccuguucugucugaaaugcugucggagaacccgcggccugcuuaaguauaagcaacucaaagacgaggaagaggccggguacaagaaaaucaucgagcggcugaaugauaagaaaggaaagagcagacuguucgacggcgaacgccucgcugaucggaagauugccgagcuguuuagcacaaaaacccacaucggg

SEQ ID NO: 14053 - RNA, 1932 nt, Artificial Sequence
  derived and/or modified CDS sequence (opt5) from CCHFV(Hy13)__AY900145.1__Gc
uucagcgacuccaucgugaagggcaugaaaaaccugcucaauucuaccagccuggagacaucccuuucuauugaagcccccuggggagcuaucaacguccagagcacguuuaagccuaccguuuccgccgcgaauauugcucugucuuggagcuccguggagcacagagggaacaaaauccucgugagcggccggucugaauccauuaugaagcuggaggaacgcacagggaucagcugggaucuuggagucgaggacgccucugaguccaaacugcucaccgugagcaucauggaucugucucaaauguacuccccgguuuucgaauaucugagcggcgacagacagguggaggaauggcccaaggccacaugcaccggggauuguccugagcggugcggauguacauccucuaccugccuccauaaggaguggccccacagccgcaauuggagauguaacccuacguggugcuggggcgucggcaccggguguacaugcuguggacuggacgugaaagaucuuuuuaccgaccauauguucguuaaguggaaaguggaauacauuaagacagaggcuaucgucugcguggaacugaccucccaggagcggcaguguagccucauugaagccggcacgcgcuuuaaucuggggcccgugacaaucacccuuucugagccuagaaacauucaacagaaacugccgcccgagaucgucacacuccacccucggauugaagagggauucuuugaucugaugcauguuaagaaggugcuguccgcuagcaccgugugcaaacuccagucuugcacccacggcguccccggggaccuucagguguaucacaucggaaaucugcugaagggcgauaaaguuaacggccaucucauccacaagauugaaccucauuucaauacaagcuggauguccugggacgggugugaucuggacuacuauugcaacaugggagacuggcccucuuguagcuacacgggcgugacccaacacaaucacgccgcguuugucaacaugcuuaauaucgagacagauuauaccaaaauuuuccauuuucacuccaagcgcgugacagcccauggggacaccccgcagcuggaucucaaagcuagaccuacguacggagccggcgaaaucacaguucugguggaggucgcugacauggagcugcacaccaagaagauugaaaucagcgggcucaaauucgccucucugaccugcacaggauguuacgcgugcuccagcggcaucucuuguaaggugcggauucaugucgaugagcccgacgaacuuaccgugcacguuaaauccgaggauccugacaucguggccgcuagcuccucucugauggcccgcaagcucgaauuuggcacagauagcacguucaaggcuuucuccgccaugcccaaaaccucucugugcuuuuauauugucgagagagaguacuguaagagcugcuccaaagaagacacacagaagugugugaacaccaaacuugagcagccccaaagcauccugauugaacacaaggggacaaucaucggaaaacagaacgauaccugcacgucuaaggccggcugcuggcucgaguccguuaagagcuucuuuuaugggcugaaaaauaugcugucuggaauuuucggcaacguguuuaucgggauuuuccucuuucuggcuccuuucauccuucugauucucuuuuucauguuuggcuggcggauccuguucuguuuuaagugcugucgcagaacccggggacuguucaaauacagacaucuuaaggacgacgaggaaacaggcuaucgcaaaauuaucgagcggcucaauaacaagaaggggaaaaauaagcugcuggauggagaaagacucgcggaccgcaaaaucgccgagcuguucuccaccaagacacacauuggc

SEQ ID NO: 14054 - RNA, 1932 nt, Artificial Sequence
  derived and/or modified CDS sequence (opt5) from CCHFV(Semunya)__DQ094832.1__Gc
uuccuggacagcaucgccaagggcaaaaagucccuccugaacucuaccaaucuugagacaagccuguccauugaagcucccuggggagccaucaacgugcagucuacguuuaaaccuaccgucagcgcggcuaauauugcccucuccuggucuagcguugagcacagagggaacaagauccugguguccggccggagcgaaucuauuaugaaacuugaggaacgcacagggaucuccuggagccugggaguggaggaugccucugaguccaagacccucacagucagcgugauggaccugucucaaauguacuccccgguuuucgaauaucugagcggcgauagacagguggaggaauggcccaaggcuaccugcacaggggacuguccugagcggugcggauguaccuccucuacgugccuccauaaagaguggccccacagccgcaauuggagauguaacccuaccuggugcuggggcgucggcacaggguguaccugcuguggacuggaugugcgggaccuuuuuacagauuacaugaugguuaaguggaaaguggaauaugucaagaccgaggccaucaugugcguggaacugacgucccaggagcgccaguguagccucauugaagcuggcacaagauucaaucuggggcccgugaccaucacacuuucugagccucggaacguccaacagcgccugccguccgagauuguuacccuccaucccaaaaucgaagagggauuuuucgaccugaugcacgugcagaaggugcuguuuugcaaguacagccuccaggccaccucuugcacacauggcgucccuggggaucugcaaguguaucacguuggaaaucuucugaaaggcgacaaggugaacggccacagcauucauaaaaucgaaucccacuucaauacgucuuggaugagcugggaugggugugaccucgauuacuuuugcaacaugggagacuggcccuccuguaccuauacaggcgucacccagcauaauagagcggccuucgugaacaugcugaauauugagacagacuacaccaagacguuucacuuccacagcaaacggguuacagcucauggggauaccccucagcuugaccugaaggcccgccccaccuacggagcuggcgaagugacaguccucguggaggucgccgaucuggagcugcacaccaaaaagaucgaagugucugggcucaaguuugcgucccugacaugcagcggauguuaugccuguucuuccggcaucagcugcaaaguucggauucaugugaacgagccggacgaauuuacgguccacgugaaguccaacgauccugacguuguggcugccggcucuagccuuauggcuagaaaaaucgaguucggggccgauuccaccuucaaggccuucucuagcaugcccaaaaauucccugugcuuuuacauugucgaacgcgacuauuguagcucuugcacagaugacgauacccagaagugugugaacaucaagcucgagcauccucaauccauucugaucgagcacaaaggaacaaucauuggcaagcagaaugauaccugccccacgaaaaccagcugcuggcuugaaucugugaaguccuucuuuuacgggcugaaaaacaugcucggaggcaucuucgggaauguuuuucugggcauuuuccuguuucucgcucccuucgcgcugcuuauccuguuuuucuuuuucggauggagacuccuguucugucugaagugcugucggagaacacgcggccuucucaaguauaaacagcugaaggacgaggaagaggccggguacaaaaagauuaucgagcggcugaacgacaaaaagggaaagagcagacucuuugacggcgaacgccuggcugaucggaaaaucgccaaacuuuucucuaccaagacacacauuggg

SEQ ID NO: 14055 - RNA, 1932 nt, Artificial Sequence
  derived and/or modified CDS sequence (opt5) from CCHFV(SPU128/81/7)__DQ157174.1__Gc
uuccuggacagcaucgugaagggcaugaaaaaccuccuuaauuccaccucucuugagacaagccuguccauugaagcccccuggggagcuaucaacguccagucuacguacaagccuaccguuagcacagccaauauugcgcucuccuggucuagcguggagcacagagggaacaaaauccugguguccggccggagcgaaucuauuaugaaacuugaggaacgcaccgggaucuccugggaucugggagucgaggacgcuagcgagucuaagcuccugacaguguccguuauggaucugagccaaauguauucuccgguguuugaauaccucuccggcgacagacaggucgaggaauggcccaaggcuaccugcacaggggauuguccugagcggugcggauguaccagcuccacgugccugcauaaggaguggccccacucucgcaauuggagauguaacccuaccuggugcuggggcgugggcacaggguguaccugcuguggacuugacguuaaagaucuguucacagacuauauguuugugaaguggaaagucgaauacaucaagaccgaggccauugugugcguggaacucacgagccaggagcggcaguguucccugaucgaagccggcacacgcuucaaucuugggcccgucaccauuacacugagcgagccuagaaacauccaacagaaacucccgcccgagauuaucacccugcauccucggauugaagagggauuuuucgaucugaugcacguucagaaggugcucucugccuccaccgugugcaagcugcagagcugcacacauggcguccccggggaccuucaaguguaucacaucggaaaucugcucaaaggcgauaagguuaacggccaccugauccauaaaauugaaccucacuuuaauacgucuuggaugagcugggacgggugugaucuugacuacuauugcaacaugggagacuggcccuccuguaccuacacaggcgugacccagcauaaucacgcuucuuucgucaaccugcucaauaucgagacagauuacaccaagaacuuucacuuccauagcaaacgcgugacggcccacggggacacaccgcagcuggaucugaaggcgagaccuaccuauggagccggcgaaauuaccguucucguggaggucgcugacauggagcugcauaccaaaaagaucgaaauuuccgggcuuaaguuugccagccugaccugcacaggauguuacgcuugcucuagcggcaucagcuguaaagugcggauccacgucgaugagcccgacgaacucacggugcauguuaagucugaugacccugauguggucgccgcguccagcucccugauggcccgcaaacuugaguucggcaccgacucuacauuuaaggcuuucagcgccaugcccaaaaccucccugugcuucuauauuguggaaagagagcacuguaagucuugcagcgaggaagauacaaagaaauguguuaacaccaagcucgagcagccccaauccauccugauugaacacaaagggacgaucauuggaaagcagaauagcacaugcacagcuaaagccucuugcuggcuggaguccgugaaguccuuuuucuacggccucaagaacaugcugucugggaucuuuggaaaugucuucaucggcauuuuucuuuuccuggggccuuuuauccuccugauucuguucuuuauguucggcuggcggauccuguuuuguuucaaaugcugucgcagaacccggggacuccugaaguauagacaucugaaagaggacgaagagacaggcuaccgccggauuaucgaaagacucaacaauaagaaagggaagaacaagcugcuugacggagagcgccuggccgaucggagaauugcugaacucuuuuccaccaaaacgcacaucggc

SEQ ID NO: 14056 - RNA, 1932 nt, Artificial Sequence
  derived and/or modified CDS sequence (opt5) from CCHFV(ROS/HUVLV-100)__DQ206448.1__Gc
uuccuggacagcaucgugaagggcaugaaaaaccuccuuaauuccaccucucuugagacaagccuguccauugaagcccccuggggagcuaucaacguccagucuacguuuaagccuaccguuagcacagccaauauugcgcucuccuggucuagcguggagcacagagggaacaaaauccuggugaccggccgguccgaaagcauuaugaagcuggaggaacgcacaggggucucuugggaucugggaguggaggacgcuuccgagagcaaacuccugaccguuucuaucauggaucugucccaaauguacagcccgguguucgaauaucucucuggcgacagacaggucgaggaauggcccaaggccacaugcaccggggauuguccugagcggugcggauguacguccagcacaugccugcauaaggaguggccccacucccgcaauuggagauguaacccuacauggugcuggggcgugggcaccggguguacaugcuguggaguugacgugaaagaucuuuuuaccgaccauauguucgucaaguggaaaguggaauacaucaagacggaggccauugugugcgucgaacugacaucucaggagcggcaguguagccucaucgaagcuggcacccgcuuuaaucuggggcccguuacaauuacccuuuccgagccuagaaacauccaacagaaacugccgcccgagauuaucacccuccacccuaagguggaagagggauucuuugaucugaugcaugugcagaagguccugagcgccucuacagugugcaaacuccaguccugcacgcacggcauucccggggaccugcaaguuuaucacaucggaaaucuucugaagggcgaucgggugaacggccaucucauccacaaaauugaaccucauuucaauaccagcuggaugucuugggacgggugugaucuggacuacuauugcaacaugggagacuggcccagcuguacauacaccggcgucacacagcacaaucacgcugccuuugugaaccuucugaauaucgagaccgauuauacgaagacauuccauuuucacuccaaacgcguuaccgcgcauggggacaccccgcagcucgaucugaaggccagaccuacauacggagcuggcgaaauuaccgugcuggucgagguggccgacauggagcuccacaccaaaaaggucgaaaucucugggcugaaguucgcuagccuugccugcacgggauguuacgcgugcuccagcggcauuucuuguaaagugcggauccauguugaugagcccgacgaacugaccgugcacgucaaguccagcgauccugacgugguugccgcuucuacaucccucauggcccgcaaacuggaguuuggcaccgauagcacauucaaggcuuucuccgccaugcccaaaaccucucuuugcuuuuauaucguggaaagagaguacuguaagagcugcuccgaggaagacacgcagaagugugucgauaccaaacuggagcaaccccagucuauucucaucgaacacaaggggacaauuaucggaaaacagaacgauaccugcacagccaaggcuagcugcuggcuggaguccgugaaaucuuucuuuuauggccugaagaacaugcucgggagcguguucggaaacuuuuucauuggcauccugcuuuuucuggcgccuuucguucuccugguccuguuuuucauguuuggguggaagauccuuuucuguuuuaaaugcugucggcgcaccagaggccuccugaaguaccggcugcucaaagacgacgaggaaacgggauauagacgcauuaucgagcggcugaauaauaagaaaggcaagaacagacuucuggacggggaacgccucgccgaucggaagauugcugagcuguucuccacaaaaacccauaucgga

SEQ ID NO: 14057 - RNA, 1932 nt, Artificial Sequence
  derived and/or modified CDS sequence (opt5) from CCHFV(AP92)__DQ211625.1__Gc
uuccuggacagcaucgccaagggcgugaaaaaccuccuuaauuccaccucucuugagacaagccuguccauugaagcucccuggggagccaucaacgcgcagucuacguacaagccuaccgcuagcuccgccaauauugcccucacauggucuagcgucgagcacagagggaacaaaauccugguuuccggccggagcgaaucuauuaugaaacuugaggaacgcaccgggaucuccuggaaucugggaguggaggaugcuagcgagucuagaacacucaccaucuccgugauggaccugagccaaauguauucuccggucuuugaauaccuguccggcgaucgccagguggaggaauggcccaaagccacaugcaccgggaacuguccugagcggugcggauguacgagcucuaccugccucuauaaggaguggccccauucuagaaauuggcgguguaacccuacauggugcuggggcguuggcaccggguguacaugcuguggacuggacgugaaggaacuuuucaccgaucacaugcuggucaaauggaagguggaguacauuaaaacggaagcuaucguuugcguggagcucacaagccaggaacgccaguguucccugauugaggccggcaccagauuuagccuugggcccgucacaaucacccugucugagccucggaauauucaacagaagcucccgcccgaacugaucacccugcauccuaaaauugaggacggauauuucgaucucaugcacgugcagaaggugauguccgcgagcacagucugcaagcugcagucuugcacgcauggcguucccggggaccuucaaaucuaccacgugggaaaccugcucaaaggcgaucgcgugaauggccaccugauccauaaggucgaaccucaccuuaacaccagcuggauguccugggacgggugugaucuggacuauuuuugcaauaugggagauuggcccucuuguacauacaccggcgugacacagcauaaccacgccgcuuucgccaaucuccugaacauugagaccgacuacacgaaaacauuucacuuccauagcaagagaguuaccgcucacggggacaccccgcagcuggaucucaaagcccggccucgcuauggagcgggcgaaaucacagugcuggucgagguggccgacauggagcuucauaccaagaaaguugaagugacagggcugaaguuugcuucccucacgugcagcggauguuacgccugcuccuccggcauuagcuguaaggucagaauccacguggaugagcccgacgaacugaccguccaugugaaaucuuccgauccugacauuguugcugccagcuccucucuuauggcccggaagaucgaguucggcguggauagcacauuuaaggcuuucuccucuaugcccaaggacagccugugcuuuuauaucgucgaacgcgauuacuguaacuccugcaaaaaugaggagacccagagaugugugaacgcgaagcucgaacaaccccagagcauucugaucgagcacacagggaccauuaucggaaagcagaaugacacgugcggcucucggaccuccugcuggcuggauagcuucaaaucuuucuuuuaugggcucaaguccaugcugagcggaauuuucggcaacguuuuucuugggaucuuccuguuucucgccccuuucgcucugcugcuguuuuucuuuuucuuuggcuggagaauccucuucuguuuuaaaugcugucgccggacaagaggacuguucaaguaccgccacauuaaagacgacgaagaggugggcuauaagaagaucauugagcggcugaauaacaaaaaggggaaacauagacuccuggauggagaacgccuugccgaccggaagaucgccgagcuguucucuaccaaaacacacauuggc

SEQ ID NO: 14058 - RNA, 1932 nt, Artificial Sequence
  derived and/or modified CDS sequence (opt5) from CCHFV(ArD8194)__DQ211626.1__Gc
uuccuggacagaaucgccaagggcaugaaaagccuccugaacuccaccucucuugagacaagccuguccauugaagcucccuggggagccaucaaugugcagucuacguuuaagccuaccgucagcgcggcuaacauugcccucuccuggucuagcguugagcacaaagggaauaagauccugguguccggccggagcgaaucuauuaugaaacuugaggaacgcacagggaucuccuggugccugggaguggaggaugccagcgagucuaagacccucacagucuccgugauggaccugagccaaauguacucuccgguuuucgaauaucuguccggcgauagacagguggaggaauggcccaaggcuaccuguacaggggacugcccugagcgguguggaugcaccagcuccacgugucuccauaaagaguggccccacucucgcaacuggagaugcaauccuaccugguguuggggcgucggcacagggugcaccuguugcggacuggaugugaaggaccuuuuuacagauuacaugcugguuaaauggaagguggaauauaucaaaaccgaggccauuaucugugucgaacucacgagccaggagcggcagugcucccugauugaagcuggcacacgcuucaaccuugggcccgugaccaucacacugagcgagccuagaaaugugcaacagcggcucccgcccgagauuaucacccugcauccuaagauugaagagggauuuuucgaccugaugcacguccagaagguuaugucugccuccaccgugugcaaacuccagagcuguacacauggcgugcccggggaucugcaagucuaccacgugggaaaccuucugaagggcgacaaaguuaauggccacucuauccauaagaucgaaagccaccucaacacguccuggaugucuugggaugggugcgaccuggauuauuuuuguaauaugggagacuggccuagcugcaccuacacaggcgugacccagcauaaccacgcggccuucauuaauaugcuuaacaucgagacagacuauaccaaaacguuucacuuccauuccaagcgcgucacagcucacggggauacaccccagcuggaccucaaagccagaccggcuuacggagccggcgaaauuaccgugcugguugagguggcggaucuggagcuccauaccaagaagaucgaagucagcgggcugaaauuugccucucuuuccuguagcggaugcuacgcuuguucuuccggcauuagcugcaaggugcggauccacgucaaugagccugacgaauuuaccgugcauguuaaauccaacgaucccgacguggucgccgcuggcucuagccugauggcccgcaagaucgaguccggggccgauucuacauuuaaggcuuucagcuccaugccuaaaaacagccucuguuucuauauuguggaaagagacuacugcucuagcuguacggaugacgauacccagaagugcguugacaucaaacuggagcacccccaaagcauucuuaucgagcacaagggaacaauuaucggcaaacagaaugauaccugccccacaaagaccucuuguuggcuggaauccaucaaauccuuuuucuaugggcucaagaacaugcugucuggaauuuuuggcaauguguuccuggggaugcuccuguuucuugcgccuuucauccugcucauucuguuuuucuuuuucggcuggcggcugcuuuucugccucaaguguugccgcagaacgcggaaacugcugaaguacaaacaucucagagacgaggaagagagcggauauaagaaaaucauugagcgccugaacgacaagaagggcaaaucccggcuuuucgauggggaaagacuggccgaccgcaagaucgcugagcucuuuagcaccaaaacacacauugga

SEQ ID NO: 14059 - RNA, 1932 nt, Artificial Sequence
  derived and/or modified CDS sequence (opt5) from CCHFV(ArD15786)__DQ211627.1__Gc
agccuggacuccaucgccaagggcaugaaaucucuccugaacagcaccucccuugagacaucucugagcauugaggcucccuggggagccaucaaugugcaguccacguucaagccuaccauuucugcggcuaacaucgcccucagcugguccagcgucgagcacaaagggaauaagauucugguuucuggcagauccgaaagcaucaugaaacuugaggaacggacagggaucucuuggugccugggaguggaggaugccuccgagagcaagacccucacagugucugucauggaccugucccaaauguacagcccgguguuugaauaucuguccggcgaucgccagguugaggaauggcccaaggcuaccuguacaggggacugcccugagagauguggaugcaccucuagcacgugucuccauaaagaguggccccacucccggaacuggcgcugcaauccuaccugguguuggggcgugggcacagggugcaccuguugcggacuggaugucaaggaccuuuucacagauuacaugcuggugaaauggaagguugaauauauuaaaaccgaggccaucauuuguguggaacucacgagccaggagagacagugcucucugaucgaagcuggcacacgguuuaaccuugggcccgucaccauuacacuguccgagccucgcaaugugcaacagagacucccgcccgagaucauuacccugcauccuaagaucgaagagggauucuuugaccugaugcacgugcagaaggucaugagcgccucuaccguuugcaaacuccagagcuguacacauggcgugcccggggaucugcaaguguaccacgucggaaaccuucugaagggcgacaaagugaauggccacuccauccauaagauugaaucucaccucaacacgagcuggauguccugggaugggugcgaccuggauuauuucuguaauaugggagacuggccuagcugcaccuacacaggcguuacccagcauaaccgggcggccuuuaucaauaugcuuaacauugagacagacuauaccaaaacguuccacuuucacucuaagcgcgugacagcucauggggauacaccccagcuggaccucaaagccagaccgaccuacggagcuggcgaaaucaccguccugguggagguugccgaucuggagcuccacaccaagaagauugaaguguccgggcugaaauucgcgagccuuacauguucuggaugcuacgccuguuccagcggcaucuccugcaagguccggauccaugugaaugagccugacgaauuuacgguccacgugaaaucuaacgaucccgacguuguggcugccggcagcucccugauggcucgcaagauugagucuggggccgauagcaccuucaaagccuuuuccagcaugccuaagaacucucucuguuucuauaucgucgaaagagacuacugcuccagcuguacagaugacgauacccagaagugcguggacauuaaacuggagcauccccaaucuauccuuauugagcacaagggaacaaucaucggcaaacagaaugauaccugccccacgaagaccuccuguuggcuggaaagcauuaaaucuuucuuuuaugggcucaagaacaugcugagcggaaucuucggcaauauuuuucuggggaugcuccuguuccuugcuccuuuuguucugcucauccuguucuuuuucuuuggcuggcggcugcuuuucugccucaaguguugccgcagaacacggaaacugcugaaguacaaacaccucagagacgaggaagaguccggauauaagaaaauuaucgagcgccugaacgacaagaagggcaaaagccggcuuuuugauggggaaagacuggcggaccgcaagauugccgaacucuucucuaccaaaacacauguggga

SEQ ID NO: 14060 - RNA, 1932 nt, Artificial Sequence
  derived and/or modified CDS sequence (opt5) from CCHFV(ArD39554)__DQ211628.1__Gc
uuccuggacagcaccgccaaguccaugaaaucucuccugaacagcacaucccuugagacgucucugagcaucgaagcucccuggggcgccauuaaugugcaguccaccuuuaagccuacagcgucuaccgcuaacaucgcccucagcugguccagcgucgagcacagagggaauaaaauucugguuacaggacggucugaauccaucaugaagcucgaggaacgcaccggcauuagcuggaaccuggggguggaggaugccucugaguccaaaacacucaccgugagcgucauggaccugucucaaauguacuccacgguguucgaauaucugagcggagauagacagguugaggaauggccgaaggcuaccugcacaggcgacugucccgagcggugcggguguaccuccucuacaugccuccauaaggccuggccucacagccgcaauuggagauguaaccccaccuggugcuggggagugggcacgggcuguacaugcugugggcuggaugucaaaaaucuuuuuaccgacuacaugcugaucaaguggaaaguggaguucaucaagacagaagcuauuguuugcguggagcucaccucccaggaacggcaguguagccugaucgaggccggaacccgcuuuaaccuuggcccugucacaauuacgcugucugaacccagaaauauccaacagaaacucccuccggagcuggugacccugcauccccggguggaggaaggguucuuugaucucaugcacguccagaagguucuguccgcgagcacagugugcaaacuucagucuugcacccauggagugccuggcgaccugcaagucuaucacguggggaaccuccugaagggagauaagauuaauggcaacagcuuccacaaaaucgagcccaaucuuaacacauccuggaugucuugggacggcugugaucuggacuacuauugcaauaugggggauuggccuagcuguaccuacacgggaguuacacagcauaaccacgccgcuuuugugaaccuccugaauauugaaaccgacuauaccaagaacuuccauuuucacuccaaacgcgucacagcccacggcgagacaccccagcuggaccucaaggcuagaccgaaauacggggccggagaagugaccguucugguggaggucgcggauauggagcuucauacgaagaagaucgaaaucagcggccugaaauucgccucucuuaccugcacaggguguuacgcuugcuccagcggaauuucuuguaaggugcggcugcacgucgacgagccugaugaacuuaccgugcauguuaaauccgacgaucccgacguggucgccgcuagcuccucucugauggcccgcaagaucgaguuuggcacagauagcaccuucaaagccuucuccucuaugccuaaggacaagcucugcuuuuauauuguggaaagagauuacuguagcuccugcagcaaagaggacacgcagaaguguguuaaugcuaaacuggagcaaccccagucuauccugauugaacacaagggcaccaucaucgggaaacagaacgauacaugcaccgugaaggcguccugcuggcucgagagcgucaagucuuucuuuuauggacugaaaaauaugcuuggcgggauuuucggaaacgugauccugggcauuaucauguuucucgcccccuucgcucugcugcuucucuuuuuccuguuuggguggcggauucuguucugucuccgcugcuguagacggacaagaggccuguuuaaguacaaacauaucaaggacgacgaagaguccggauauaaacgcaucauugagcggcuuaauaacaagaagggcaaaaauaagcuguucgauggggaaagacucgccgacaaaaagaucgccgagcuguuuagcaccaaaacgcacauugga

SEQ ID NO: 14061 - RNA, 1932 nt, Artificial Sequence
  derived and/or modified CDS sequence (opt5) from CCHFV(C-68031)__DQ211629.1__Gc
uucagcgacuccaucgugaagggcaugaaaaaccugcucaauucuaccagccuggagacaucccuuucuauugaagcccccuggggagcuaucaacguccagagcacguuuaagccuaccguuuccgccgcgaauauugcucugucuuggagcuccguggagcacagagggaacaaaauccucgugagcggccggucugaauccauuaugaagcuggaggaacgcacagggaucagcugggaucuuggagucgaggacgccucugaguccaaacugcucaccgugagcaucauggaucugucucaaauguacuccccgguuuucgaauaucugagcggcgacagacagguggaggaauggcccaaggccacaugcaccggggauuguccugagcggugcggauguacauccucuaccugccuccauaaggaguggccccacagccgcaauuggagauguaacccuacguggugcuggggcgucggcaccggguguacaugcuguggacuggacgugaaagaucuuuuuaccgacuacauguucguuaaguggaaaguggaauauauuaagacagaggcuaucgucugcguggaacugaccucccaggagcggcaguguagccucauugaagccggcacgcgcuuuaaucuggggcccgugacaaucacccuuucugagccuagaaacauucaacagaaacugccgcccgagaucgucacacuccauccucggauugaagagggauucuuugaucugaugcacguuaagaaggugcuguccgcuagcaccgugugcaaacuccagucuugcacccauggcguccccggggaccuucagguguaccacaucggaaaucugcugaagggcgauaaaguuaacggccaccucauccauaagauugaaccucacuucaauacaagcuggauguccugggacgggugugaucuggacuauuacugcaacaugggagacuggcccucuuguagcuauacgggcgugacccaacauaaucacgccgcguuugucaacaugcuuaauaucgagacagauuacaccaaaauuuuccacuuucauuccaagcgcgugacagcccacggggacaccccgcagcuggaucucaaagcuagaccuacguacggagccggcgaaaucacaguucugguggaggucgcugacauggagcugcauaccaagaagauugaaaucagcgggcucaaauucgccucucugaccugcacaggauguuaugcgugcuccagcggcaucucuuguaaggugcggauucacgucgaugagcccgacgaacuuaccgugcauguuaaauccgaggauccugacaucguggccgcuagcuccucucugauggcccgcaagcucgaauuuggcacagauagcacguucaaggcuuucuccgccaugcccaaaaccucucugugcuuuuacauugucgagagagaguauuguaagagcugcuccaaagaagacacacagaagugugugaacaccaaacuugagcagccccaaagcauccugauugaacacaaggggacaaucaucggaaaacagaacgauaccugcacgucuaaggccggcugcuggcucgaguccguuaagagcuucuuuuacgggcugaaaaauaugcugucuggaauuuucggcaacguguuuaucgggauuuuccucuuucuggcuccuuucauccuucugauucucuuuuucauguuuggcuggcggauccuguucuguuuuaagugcugucgcagaacccggggacuguucaaauauagacaccuuaaggacgacgaggaaacaggcuaccgcaaaauuaucgagcggcucaauaacaagaaggggaaaaauaagcugcuggauggagaaagacucgcggaccgcaaaaucgccgagcuguucuccaccaagacacauauuggc

SEQ ID NO: 14062 - RNA, 1932 nt, Artificial Sequence
  derived and/or modified CDS sequence (opt5) from CCHFV(Drosdov)__DQ211630.1__Gc
uuccuggacagcaccgugaagggcaugaaaaaccuccuuaauuccacaucucuugagacgagccuguccaucgaagcccccuggggagcuauuaacguccagucuaccuuuaagccuacaguuagcaccgccaauaucgcgcucuccuggucuagcguggagcacagagggaacaaaauucuggugacaggccgguccgaaagcaucaugaagcuggaggaacgcaccggggucucuugggaucugggaguggaggacgcuuccgagagcaaacuccugacaguuucuauuauggaucugucccaaauguacagcccgguguucgaauaucucucuggcgacagacaggucgaggaauggcccaaggcuaccugcacgggggauuguccugagcggugcggauguaccuccagcacaugccugcauaaggaguggccccacucccgcaauuggagauguaacccuaccuggugcuggggcgugggcacaggguguaccugcuguggaguugacgugaaagaucuuuuuacggaccauauguucgucaaguggaaaguggaauacaugaagacagaggccaucgugugcgucgaacugaccucucaggagcggcaguguagccucaucgaagccggcacacgcuuuaaucuggggcccguuaccauuacccuuuccgagccuagaaacauccaacagaaacugccgcccgagauuaucacacuccacccuaagauugaagagggauucuuugaucugaugcaugugcagaaggugcugagcgccucuacggucugcaaacuccaguccugcacccacggcauccccggggaccugcaaauuuaucacaucggaaaucuucugaagggcgaucgggugaacggccaucucauccacaaaauugaaccucauuucaauacaagcuggaugucuugggacgggugugaucuggacuacuauugcaacaugggaaauuggcccagcuguaccuacacaggcguuacccagcacaaccacgcugccuuugugaaucuucugaacaucgagacggacuauacaaagaccuuccauuuucacuccaaacgcgucaccgcgcauggggauacaccgcagcucgaccugaaggccagaccuaccuacggagcuggcgaaauuacagugcugguugagguggccgauauggagcuccacacgaaaaaggucgaaaucucugggcugaaguucgcuagccuugugugcaccggauguuacgccugcuccagcggcauuucuuguaaaguccggauccauguggacgagcccgaugaacugacaguucacgugaaguccagcgacccugaugucguggcggccucuaccucccucauggcucgcaaacuggaguuuggcacagacagcaucuucaaggccuucuccgcuaugcccaaaaccucucuuugcuuuuauauuguugaaagagaguacuguaagagcugcuccgaggaugacacgaagaaauguguggauaccaagcuggaacagccccaaucuauccucauugagcacaaagggacaaucauuggaaagcagaacgauaccugcacagccaaagccagcugcuggcuggaauccgucaagagcuucuuuuauggccugaagaauaugcucgggucuguguucggaaacuuuuucgugggcauccugcuuuuucuggcuccuuucguucuccugguccuguuuuucauguuuggguggaaaauccuuuucuguuuuaagugcugucggcgcaccagaggccucuucaaauaccggcaucugaaggacgacgaggagacgggauauagacgcauuaucgaacggcucaauuccaaaaagggcaagaacagacugcuggacggggagcgccuugcggaucggaaaauugccgaacuguucagcacaaagacccacaucgga

SEQ ID NO: 14063 - RNA, 1932 nt, Artificial Sequence
  derived and/or modified CDS sequence (opt5) from CCHFV(Kashmanov)__DQ211631.1__Gc
uuccuggacagcaucgugaagggcaugaaaaacucccucaauucuaccagccuggagacaucccuuucuauugaagcccccuggggagcuaucaacguccagagcacguuuaagccuaccguuuccacagccaauauugcgcugucuuggagcuccguggagcacagagggaacaaaauccucgugaccggccggagcgaaucuauuaugaagcuggaggaacgcacaggggucuccugggaucuuggaguggaggacgcuagcgagucuaaacugcucaccguuuccaucauggaucugagccaaauguacucuccgguguucgaauaucuguccggcgacagacaggucgaggaauggcccaaggccacaugcaccggggauuguccugagcggugcggauguacgagcucuaccugccuccauaaggaguggccccacucccgcaauuggagauguaacccuacauggugcuggggcgugggcaccggguguacaugcuguggaguugacgugaaagaucuguuuaccgaccauauguucgucaaguggaaaguggaauacaucaagacggaggccauugugugcgucgaacuuacaagccaggagcggcaguguucccugaucgaagcuggcacccgcuuuaaucucgggcccguuacaauuacccugagcgagccuagaaacauccaacagaaacuuccgcccgagauuaucacccugcacccuaagguggaagagggauucuuugaucucaugcaugugcagaagguccugucugccuccacagugugcaaacugcagagcugcacgcacggcauucccggggaccuccaaguuuaucacaucggaaaucugcuuaagggcgaucggaucaacggccaucugauucacaaaaucgaaccucauuucaauaccucuuggaugagcugggacgggugugaucucgacuacuauugcaacaugggagacuggcccuccuguacauacaccggcgugacacagcacaaucacgcugccuuugucaaccugcuuaauauugagaccgauuauacgaagacauuccauuuucacucuaaacgcgugaccgcgcauggggacaccccgcagcuggaucucaaggccagaccuacauacggagcuggcgaaaucaccguucugguggaggucgccgacauggagcugcacacaaagaagguggaaauuagcgggcucaaguucgcuucccuggccugcacgggauguuacgcgugcagcucuggcaucuccuguaaaguccggauccauguggaugagcccgacgaacuuaccguucacgugaaaagcucugauccugacgucguggccgcuuccacaagccugauggcccgcaaacucgaguuuggcaccgauuccacauucaaggcuuucucugccaugcccaaaaccagccugugcuuuuauauuguugaaagagaguacuguaaguccugcucugaggaagacacgcagaaguguguggauaccaaacuugagcaaccccagagcauccugauugaacacaaggggacaaucauuggaaaacagaacgauaccugcacagccaaggcuuccugcuggcucgagagcgucaaaucuuucuuuuauggccugaagaacaugcugggguccguguucggaaacuuuuucaucggcauccuccuguuucuugcgccuuucgugcugcucguucuguuuuucauguuuggguggaagauucuguucuguuuuaaaugcugucggcgcaccagaggccuucucaaguaccggcaucugaaagacgacgaggaaacgggauauagacgcaucauugagcggcugaauaauaagaaaggcaagaacagacuccuggacggggaacgccuugccgaucggaagaucgcugagcuguucagcacaaaaacccacauugga

SEQ ID NO: 14064 - RNA, 1932 nt, Artificial Sequence
  derived and/or modified CDS sequence (opt5) from CCHFV(Oman)__DQ211632.1__Gc
uuccuggacagcaucgccaagggcaugaaaaaccuccuuaauuccaccucucuugagacaagccuguccauugaagcucccuggggagccaucaacgugcagucuacguuuaagccuaccgucagcacagcgaauauugcucucuccuggucuagcguugagcacagagggaacaaaauccugguguccggccggagcgaaucuauuaugaagcuggaggaacgcaccgggaucuccugggaucugggaguggaggacgccagcgagucuaaacuccugacagucuccgugauggaucugagccaaauguacucuccgguuuucgaauaucucuccggcgacagacagguggaggaauggcccaaggcuaccugcacaggggauuguccugagcggugcggauguaccagcuccacgugccugcauaaggaguggccccacucucgcaauuggagauguaacccuaccuggugcuggggcgucggcacaggguguaccugcuguggacuugacgugaaagaucuguuuacagacuacauguucguuaaguggaaaguggaauauaucaagaccgaggccauugucugcguggaacucacgagccaggagcggcaguguucccugaucgaagccggcacacgcuuuaaucuugggcccgugaccauuacacugagcgagccuagaaacauccaacagaaacucccgcccgagauugucacccugcauccucggaucgaagagggauucuuugaucugaugcacguucagaaggugcucucugcuuccaccgugugcaagcugcagagcugcacacauggcguccccggggaccuucaaguguaccacauuggaaaucugcucaaaggcgauaagguuaacggccaccugauccauaaaguggaaccucacuucaauacgucuuggaugagcugggacgggugugaucuugacuauuacugcaacaugggagacuggcccuccuguaccuauacaggcgucacccagcauaaucacgccgcguuugugaaccugcucaauaucgagacagauuacaccaagaacuuccacuuucauucuaaacgcguuacggcccacggggacacaccgcagcuggaucugaaggcuagaccuaacuacggagccggcgaagugaccguccucguggaggucgcugacauggagcugcauaccaaaaagauugaaaucagcgggcuuaaguucgccucccugacaugcaccggauguuaugcgugcagcucuggcauuuccuguaaagugcggauccacguugaugagcccgacgaacucacagugcaugucaagagcgaggauccugacauuguggccgcuucuuccagccugauggcccgcaaacuugaauuuggcacggauuccaccuucaaggcuuucucugccaugcccaaaacaagccugugcuuuuacaucguugagagagaguauuguaaguccugcucuaaggaagacacccagaaaugugugaaugccaagcucgagcggccccaaagcauccugauugaacacaaagggacaaucauuggaaagcagaacgauaccugcacggcuaaagcguccugcuggcuggagagcgucaagucuuucuuuuacggccucaagaauaugcuguccgggaucuucggaaacguguuuauuggcaucuuccuuuuucuggccccuuucauccuccugauucuguuuuucauguuuggguggcgcauccuuuucuguuuuaaaugcuguagacggaccagaggccucuucaaguaucgccaccugaaagacgacgaggaaacaggauaccggaagauuaucgagagacugaauaacaaaaagggcaagaauaaacuccuggauggggaacgccuugcugaccggaagauugccgagcuguucagcaccaaaacacauaucgga

SEQ ID NO: 14065 - RNA, 1932 nt, Artificial Sequence
  derived and/or modified CDS sequence (opt5) from CCHFV(SPU97/85)__DQ211633.1__Gc
uuccuggacagcaucgugaagggcaaaaagaaccuccuuaauuccaccucucuggagacaagccuguccauugaagcccccuggggagcuaucaacguccagucuacguuuaaaccuaccguuagcgccgcgaauauugcucucuccuggucuagcguggagcacagagggaacaagauccugguguccggccggagcgaaucuauuaugaaacuugaggaacgcacagggaucuccugggaucugggagucgaggacgccagcgagucuaagcuccugaccguguccguuauggaucugagccaaauguacucuccgguguucgaauaucucuccggcgacagacaggucgaggaauggcccaaggccacaugcaccggggauuguccugagcggugcggauguacaagcucuaccugccugcauaaagaguggccccacucucgcaauuggagauguaacccuacguggugcuggggcgugggcaccggguguacaugcuguggacuugacguuaaggaucuguuuaccgacuacauguucgugaaauggaaggucgaauauaucaaaacagaggcuauugugugcguggaacucaccagccaggagcggcaguguucccugaucgaagccggcacgcgcuuuaaucuugggcccgucacaauuacccugagcgagccuagaaacauccaacagaagcucccgcccgagauuaucacacugcauccucggauugaagagggauucuuugaucugaugcacguucagaaggugcucucugcuuccaccgugugcaaacugcagagcugcacccauggcguccccggggaccuucaaguguaccacaucggaaaucugcucaagggcgauaaaguuaacggccaccugauccauaagauugaaccucacuucaauacaucuuggaugagcugggacgggugugaucuugacuauuacugcaacaugggagacuggcccuccuguacguauaccggcgugacacagcauaaucacgccgcguuugucaaccugcucaauaucgagaccgauuacacaaagaacuuccacuuucauucuaagcgcgugaccgcccacggggacacgccgcagcuggaucugaaagcuagaccuacauacggagccggcgaaguuaccgugcucgucgagguggcugacauggagcugcauaccaagaagauugaaaucagcgggcuuaaauucgccucccugagcugcacaggauguuaugcgugcuccuccggcauuagcuguaagguccggauccacguggaugagcccgacgaacucaccguucaugugaaaucugaggauccugacaucgucgccgcuggcuccagccugauggcccgcaaacuugaauuuggggcugauuccacauucaaagccuucucugccaugcccaagacgagccugugcuuuuacauuguggagagagaguauuguaaguccugcucucgggaagacacccagaaauguguuaacacaaagcucgagcgcccccaaagcauccugauugaacacaaaggaaccaucauuggcaagcagaaugauacaugcaccgcuaaagcguccugcuggcuggagagcgugaagucuuucuuuuacgggcucaaguccaugcugagcggaaucuucggcaacgucuuuaucgggauuuuccuuuuuaucgccccuuucgugcugcucauucuguuuuucauguuuggcuggagaauccuguucuguuuuaaaugcugucggagaacgcgcggacuuuucaaguaucggcaccucaaagacgacgaggaaaccggcuacagaaagauuaucgagcgccugaauaacaaaaaggggaagaauaaacugcucgauggagaacggcuggcugacagaaagauugccgagcuuuucucuacaaaaucccauaucggc

SEQ ID NO: 14066 - RNA, 1932 nt, Artificial Sequence
  derived and/or modified CDS sequence (opt5) from CCHFV(SPU103/87)__DQ211634.1__Gc
uuccuggacaacaucgugaagggcaugaaaaaucuccugaacagcaccucccuugagacaucucugagcauugaagcccccuggggagcuaucaauguccaguccacguacaagccuaccguuucuacagccaacauugcgcucagcugguccucuguggagcacagagggaauaaaauccuggugagcggccgguccgaaagcauuaugaaacuugaggaacgcaccgggaucucuugggaucugggagucgaggacgcuuccgagagcaaacuccugacagugucuguuauggaucugucccaaauguauagcccgguguuugaauaccucucuggcgacagacaggucgaggaauggcccaaggcuaccugcacaggggauuguccugagcggugcggauguaccuccagcacgugccugcauaaggaguggccccacucccgcaacuggagauguaauccuaccuggugcuggggcgugggcacaggguguaccugcuguggacuugacguuaaagaucuguucacagacuauauguuugugaaguggaaaaucgaauacauuaagaccgaggccaucgucugcguggaacucacgucucaggagcggcaguguagccugauugaagccggcacacgcuucaaccuugggcccgugaccaucacacuguccgagccuagaaauauucaacagaaacucccgagcgagaucauuacccugcauccccggaucgaagagggauuuuucgaucugaugcacguccagaagguucucucugccuccaccgugugcaagcugcagagcugcacacauggcgugccuggggaccuucaagucuaucacaucggaaaccugcucaaaggcgauaaggugaauggccaccugguucauaaaauugaaccccacuuuaacacgucuuggaugagcugggacgggugugaucuugacuacuauugcaauaugggagacuggccuuccuguaccuacacaggcgugacccagcauaaccacgcuucuuucgucaaucugcucaacaucgagacagauuacaccaagaacuuucacuuccauagcaaacgcgugacggcccacggggacacaccccagcuggaucugaaggcgagaccgaccuauggagccggcgaaauuaccguucucguggaggucgcugacauggagcugcauacaaagaagaucgaaauuuccgggcuuaaguuuaccagccugacaugcacgggauguuacgccuguucuuccggcaucagcugcaaagugcggauccacgucgaugagccugacgaacucaccgugcauguuaagucugaugaccccgauguggucgcugccuccagcucccugauggcgcgcaaacuugaguucggcacagacucuaccuuuaaggccuucagcgcuaugccuaaaacaucccugugcuucuauauuguggaaagagaguacuguaagucuugcagcgaggaagauacccagaaguguguuaauacgaaacucgagcaaccccaguccauccugauugaacacaaggggaccaucauuggaaaacagaacaauacaugcaaggcccgggcuggcugcuggcuggagagcgugaaauccuuuuucuaugggcucaagaacaugcugucuggaaucuuuggcaaugucuucaucgggauuuuucuuuuccuggcccccuuuauccuccugauucuguucuuuauguucggcuggcgcauccucuuuuguuucaagugcuguagacggaccagaggacuuuuuaaauaccgccaccugaaggacgacgaggaaacaggcuaucggaaaauuaucgagagacugaacaauaagaaagggaagaacaagcuccuggauggagaacgccuugccgaccggagaauugcugagcuguucagcaccaaaacgcauaucggc

SEQ ID NO: 14067 - RNA, 1932 nt, Artificial Sequence
  derived and/or modified CDS sequence (opt5) from CCHFV(SPU415/85)__DQ211635.1__Gc
uuccuggacagcaucgugaagggcaugaaaaaccuccugaauagcaccucucuugagacaagccuguccauugaagcccccuggggcgcuaucaacguccagucuacguuuaagccuaccguuagcgccgcgaauauugcucucuccuggucuagcguggagcacagaggaaacaaaauccugguguccggccggagcgaaucuauuaugaaacuugaggaacgcacagggaucuccugggaucugggagucgaggacgccagcgagucuaaacuccugaccguguccguuauggaucugagccaaauguacucuccgguguucgaauaucucuccggcgacagacaggucgaggaauggcccaaggccacaugcaccggggauuguccugagcggugcggauguacaagcucuaccugccugcauaaggaguggccccacucccgcaauuggagauguaacccuacguggugcuggggcgugggcaccggguguacaugcuguggacuugacguuaaagaucuguuuaccgacuacauguucgugaaguggaaagucgaauauaucaagacagaggcuauugugugcguggaacucaccagccaggagcggcaguguucccugaucgaagccggcacgcgcuuuaaucuugggcccgucacaauuacccugagcgagccuagaaacauccaacagaaacucccgcccgagauuaucacacugcauccucggauugaagagggauucuuugaucugaugcacguucagcgcgugcucucugcuuccaccgugugcaagcugcagagcugcacccauggcguccccggggaccuucaaguguaccacaucggaaaucugcucaagggcgauaaaguuaacggccaccugauccauaagauugaaccucacuucaauacaucuuggaugagcugggacgggugugaucuugacuauuacugcaacaugggagacuggcccuccuguacguauaccggcgugacacagcauaaucacgccgcguuugucaaccugcucaauaucgagaccgauuacacaaagaacuuccacuuucauucuaagagagugaccgcccacggggacacgccgcagcuggaucugaaagcucggccuacauacggagccggcgaaguuaccgugcucgucgagguggcugacauggagcugcauaccaagaaaauugaaaucagcgggcuuaaguucgccucccugacaugcaccggauguuaugcgugcagcucuggcauuuccuguaaggucaaaauccacguggaugagcccgacgaacucacaguucaugucaagagcgaggauccugacaucguggccgcugggucuucccugauggcccgcaaacuugaauuuggggcugauagcacguucaaggccuucuccgccaugcccaaaaccucucugugcuuuuacauuguggagagagaguauuguaagagcugcucccgggaagacacacgcaaguguguuaacaccaaacucgauagaccccagucuauccugauugagcacaagggaacaaucauuggcaaacaaaauaauaccugcacggcuaaggcgagcugcuggcuggaauccgugaaauccuucuuuuacgggcucaagaacaugcugucuggaaucuucggcaacgucuuuaucgggauuuuccuuuuuaucgccccuuucgugcugcucauucuguuuuucauguuuggcuggcggauccuguucuguuuuaagugcuguagacgcacccggggacuuuucaaauauagacaccucaaggacgacgaggagacaggcuaccgcaaaauuaucgaacggcugaauaacaagaaagggaagaauaagcugcucgauggagagagacuggcugaccgcaaaauugccgaacuuuucuccaccaagagccauaucggc

SEQ ID NO: 14068 - RNA, 1932 nt, Artificial Sequence
  derived and/or modified CDS sequence (opt5) from CCHFV(Turkey200310849)__DQ211636.1__Gc
uuccuggacagcaucgugaagggcaugaaaaaccuccugaauagcaccucucuugagacaagccuguccauugaagcccccuggggagcuaucaacguccagucuacguuuaagccugccguuagcaccgcgaauauugcucucuccuggucuagcguggagcacagagggaacaaaauccuggugacaggccgguccgaaagcauuaugaagcucgaggaacgcaccggggucucuugggaucugggaguggaggacgccuccgagagcaaacuccugacaguuucuaucauggaucugucccaaauguacagcccgguguucgaauaucucucuggcgacagacaggucgaggaauggcccaaggcuaccugcacaggggauuguccugagcggugcggauguaccuccagcacgugccugcauaaggaguggccccacucccgcaauuggagauguaacccuaccuggugcuggggcgugggcacaggguguaccugcuguggaguugacgugaaagaucuuuuuacagaccauauguucgucaaguggaaaguggaauacaucaagaccgaggccauugugugcgucgaacugacgucucaggagcggcaguguagccucaucgaagccggcacacgcuuuaaucuggggcccguuaccauuacacuuuccgagccuagaaacauccaacagaaacugccgcccgagauuaucacccuccacccuaagauugaagagggauucuuugaucugaugcaugugcagaaggugcugagcgcuucuaccgucugcaaacuccaguccugcacacacggcauccccggggaccugcaaguguaucacaucggaaaucuucugaagggcgaucggguuaacggccaucucauucacaaaaucgaaagccauuucaauacgucuuggaugagcugggacgggugugaucuggacuacuauugcaacaugggagacuggccuuccuguaccuacacaggcgugacccagcacaaucacgccgcguuugucaaccuucugaauauugagacagauuauaccaagacguuccauuuucacucuaaacgcgugacagcccauggggacacaccccagcucgaucugaaggcuagaccgaccuacggagccggcgaaaucaccguucugguggaggucgcugacauggagcuccacaccaaaaagguggaaauuagcgggcugaaguucgccucccuugcgugcacaggauguuacgccugcagcucuggcaucuccuguaaaguccggauccauguggaugagccugacgaacugacgguucacgugaaguccucugaucccgacgucguggcugccuccaccagccucauggcucgcaaacuggaguuuggcacagauuccaccuucaaggccuucucugccaugccuaaaacaagccuuugcuuuuauauuguugaaagagaguacuguaaguccugcucugaggacgauacccagaaguguguggacacgcggcuggaacaaccccagagcauccucauugagcacaaagggaccaucauuggaaagcagaacgacacaugcaccgcuaaagcguccugcuggcuggaaagcgucaagucuuucuuuuauggccugaaaaacaugcucggguccguguucggaaaucuguuuaucggcauccuucuguuccucgcccccuuugugcugcugguucuuuucuuuauguucggguggaagauucucuuuuguuucaagugcugucgcagaacacggggccuguuuaaauacagacaucugaaggaugacgaggagaccggauaucgccggaucauugaaagacucaacagcaaaaagggcaaaaaucgccugcuugauggggaccggcuggcugauagaaagaucgccgagcuuuucucuacgaagacacacauugga

SEQ ID NO: 14069 - RNA, 1932 nt, Artificial Sequence
  derived and/or modified CDS sequence (opt5) from CCHFV(Iran-52)__DQ446215.1__Gc
uuccuggacagcaucgugaagggcaugaaaaaccuccuuaauuccaccucucuugagacaagccuguccauugaagcccccuggggagcuaucaacguccagucuacguacaagccuaccguuagcacagccaauauugcgcucuccuggucuagcguggagcacagagggaacaaagugcuggucuccggccggagcgaaucuaucaugaagcuggaggaacgcaccgggauuuccugggaucugggaguggaggacgcuagcgagucuaaacuccugacaguuuccgugauggaucugagccaaauguauucuccggucuuugaauaccucuccggcgacagacagguggaggaauggcccaaggcuaccugcacaggggauuguccugagcggugcggauguaccagcuccacgugccugcauaaggaguggccccacucucgcaauuggagauguaacccuaccuggugcuggggcguuggcacaggguguaccugcuguggacuugacgugaaagaucuguucacagacuauauguuugucaaguggaaaguggaauacaucaagaccgaggccaucgugugcgucgaacucacgagccaggagcggcaguguucccugauugaagccggcacacgcuucaaucuugggagcguuaccaucacacugucugagcccagaaacauucaacagaaacucccuccggagaucauuacccugcaucccaagaucgaagagggauuuuucgaucugaugcacgugcagaaggugcucuccgccagcaccgucugcaaacugcagucuugcacacauggcgugccuggggaccuucaaguuuaucacauuggaaaucugcucaagggcgaucgggugaacggccaccugauccauaaaaucgaacagcacuuuaauacgagcuggauguccugggacgggugugaucuugacuacuauugcaacaugggagacuggcccucuuguaccuacacaggcgucacccagcauaaucacgcuagcuucgugaaccugcucaauauugagacagauuacaccaagacguuucacuuccauuccaaacgcguuacagcccacggggacaccccucagcuggaucugaaggcgagacccaccuauggagccggcgaaaucacagugcucgucgagguggcugacauggagcugcauaccaaaaagauugaaaucagcgggcuuaaguuugccggacugacaugcacgggcuguuacgcuuguucuuccggcauuagcugcaaaguccggauccacguggaggaaccggaugagcucaccguucaugugaagucugacgauccugacgucguggccgcguccagcucccugauggcccgcaaacuugaguucgggacagauucuaccuuuaaggcuuucagcgccaugcccaaaacaucccugugcuucuauaucguugaaagagaguacuguaagucuugcagcaaggaagacacccaaaaaugugugaacacgaagcucgagcagccucaguccauucugaucgaacacaaaggaaccauuaucggcaagcaaaacaauacaugcaccgcuaaagccagcugcuggcuggagucugucaaguccuuuuucuaugggcucaagaacaugcugggaggcauuuuugggaauguguucaucggcaucuuuacauuccuuacccccuuuauucugcucauccuguucuuuauguucggauggcggauucuguuuuguuucaaaugcugucgcagaacgcggggccuuuuuaaguacagacaccucaaagaugacgaggaaacaggguaucgcaagaucauugagcggcugaacaauaaaaagggaaagaacagacugcucgacggcgaacgccuggccgaucggaaaaucgcugagcuuuucagcaccaagacacauauuggg

SEQ ID NO: 14070 - RNA, 1932 nt, Artificial Sequence
  derived and/or modified CDS sequence (opt5) from CCHFV(Iran-53)__DQ446216.1__Gc
uuccuggacagcaucgugaagggcaugaaaaaccuccuuaauuccaccucucuugagacaagccuguccauugaagcccccuggggagcuaucaacguccagucuacguacaagccuaccguuagcacagccaauauugcgcucuccuggucuagcguggagcacagagggaacaaagugcuggucuccggccggagcgaaucuaucaugaagcuggaggaacgcaccgggauuuccugggaucugggaguggaggacgcuagcgagucuaaacuccugacaguuuccgugauggaucugagccaaauguauucuccggucuuugaauaccucuccggcgacagacagguggaggaauggcccaaggcuaccugcacaggggauuguccugagcggugcggauguaccagcuccacgugccugcauaaggaguggccccacucucgcaauuggagauguaacccuaccuggugcuggggcguuggcacaggguguaccugcuguggacuugacgugaaagaucuguucacagacuauauguuugucaaguggaaaguggaauacaucaagaccgaggccaucgugugcgucgaacucacgagccaggagcggcaguguucccugauugaagccggcacacgcuucaaucuugggagcguuaccaucacacugucugagcccagaaacauucaacagaaacucccuccggagaucauuacccugcaucccaagaucgaagagggauuuuucgaucugaugcacgugcagaaggugcucuccgccagcaccgucugcaaacugcagucuugcacacauggcgugccuggggaccuucaaguuuaucacauuggaaaucugcucaagggcgaucgggugaacggccaccugauccauaaaaucgaacagcacuuuaauacgagcuggauguccugggacgggugugaucuugacuacuauugcaacaugggagacuggcccucuuguaccuacacaggcgucacccagcauaaucacgcuagcuucgugaaccugcucaauauugagacagauuacaccaagacguuucacuuccauuccaaacgcguuacagcccacggggacaccccucagcuggaucugaaggcgagacccaccuauggagccggcgaagugacaguccucguggaggucgcugacauggagcugcauaccaaaaagaucgaaauuagcgggcuuaaguuugccggacugacaugcacgggcuguuacgcuuguucuuccggcaucagcugcaaagugcggauucacguugaugagccggacgaacucaccgugcaugucaagucugaugacccugaugugguugccgcguccagcucccugauggcccgcaaacuugaguucgggacagacucuaccuuuaaggcuuucagcgccaugcccaaaacaucccugugcuucuauaucguggaaagagaguacuguaagucuugcagcaaggaggauacccaaaaaugugucaacacgaagcucgaacagccucaguccauccugauugagcacaaaggaaccaucauuggcaagcaaaacaauacaugcaccgcuaaagccagcugcuggcuggaaucugugaaguccuuuuucuaugggcucaagaacaugcugggaggcaucuuugggaauguguucauuggcaucuuuacauuccuuacccccuuuauccugcucauucuguucuuuauguucggauggcggauccuguuuuguuucaaaugcugucgcagaacgcggggccuuuuuaaguacagacaccucaaagacgacgaggagacaggguaucgcaagauuaucgaacggcugaacaauaaaaagggaaagaacagacugcucgauggcgagcgccuggccgaccggaaaauugcugaacuuuucagcaccaagacacauaucggg

SEQ ID NO: 14071 - RNA, 1932 nt, Artificial Sequence
  derived and/or modified CDS sequence (opt5) from CCHFV(Kosova Hoti)__EU037902.1__Gc
uuccuggacagcaucgugaagggcaugaaaaaccuccuuaauuccaccucucuugagacaagccuguccauugaagcccccuggggagcuaucaacguccagucuacguuuaagccuaccguuagcacagccaauauugcgcucuccuggucuagcguggagcacagagggaacaaaauccuggugaccggccgguccgaaagcauuaugaagcuggaggaacgcacagggaucucuugggaucugggagucgaggacgcuuccgagagcaaacuccugaccgugucuaucauggaucugucccaaauguacagcccgguuuucgaauaucucucuggcgacagacagguggaggaauggcccaaggccacaugcaccggggauuguccucagcggugcggauguacguccucuaccugccugcauaaggaguggccccacucccgcaauuggagauguaacccuacauggugcuggggcgucggcaccggguguacaugcuguggaguggacguuaaagaucuuuuuaccgaccauauguucgugaaguggaaagucgaguacauuaagacggaagccaucgugugcguggagcugacaucucaggaacggcaauguagccucauugaggcuggcacccgcuuuaaucuggggcccgucacaaucacccuuuccgaaccuagaaacauucagcagaaacugccgcccgagaucauuacccuccacccuaagaucgaggaaggauucuuugaucugaugcauguucagaaggugcugagcgccucuacagugugcaaacuccaauccugcacgcacggcauccccggggaccugcaggucuaucacauuggaaaucuucugaagggcgaucgggugaacggccaucucauccacaaaauugagccucauuucaauaccagcuggaugucuugggacgggugugaucuggacuacuauugcaacaugggagacuggcccagcuguacauacaccggcguuacacagcacaaucacgcugccuuugugaaccuucugaauaucgaaaccgauuauacgaagacauuccauuuucacuccaaacgcgucaccgcgcauggggacaccccgcagcucgaucugaaggccagaccuacauacggagcuggcgagauuaccgugcugguugaaguggccgacauggagcuccacaccaaaaaggucgagaucucugggcugaaguucgcuagccuugccugcacgggauguuacgcgugcuccagcggcaucucuuguaaagugcggauucaugucgaugaacccgacgagcugaccgugcacguuaaguccagcgauccugacguggucgccgcuggcacaucucucauggcccgcaaacuggaauuugggaccgauuccacauucaaggcuuucagcgccaugcccaaaaccucccuuugcuuuuauaucguggagaaggaauacuguaagucuugcagcgaggacgauacgaaaaaguguguugacaccaaacuggagcaaccccaguccauucucaucgaacacagaggaacaauuaucggcaagcagaacgacacaugcacagccaaagcuagcugcuggcuggagagcgugaaguccuucuuuuaugggcugaagaacaugcucggaagcgucuucggcaacuuuuucaucgggauucugcuuuuucuggcgccuuucgugcuccuggugcuguuuuucauguuuggcuggaaaauccuuuucuguuuuaagugcugucggcgcaccagaggacucuucaaauaccggcaucugaaggaugacgaagagacgggcuauagacgcauuaucgagcggcugaauaauaaaaaggggaagaacagacuccuggauggagaacgccuugccgaccggaaaauugcugagcuguucucuacaaagacccacaucggc

SEQ ID NO: 14072 - RNA, 1932 nt, Artificial Sequence
  derived and/or modified CDS sequence (opt5) from CCHFV(YL04057)__FJ562094.1__Gc
uuccuggacagcaucgccaagggcaaaaagucccuccugaacucuaccagccuugagacaucccugucuauugaagcucccuggggagccaucaaugugcagagcacguuuaaaccuaccgucuccgcggcuaacauugcccucucuuggagcuccguugagcacagaggaaauaagauccuggugagcggccggucugaauccauuaugaaacuugaggaacgcacaggggugagcuggaaccugggagucgaggaugccucugaguccaagacccucacagugagcguuauggaccugucucaaauguacuccccgguguucgaauaucugagcggcgauagacaggucgaggaauggcccaaggcuaccugcacaggggacuguccugagcggugcggauguaccuccucuacgugccuccauaaagaguggccccacagccgcaauuggagauguuccccuaccuggugcuggggcgugggcacaggguguaccugcuguggacuggauguuaaggacuuuuucacagauuacaugcuugugaaauggaaggucgaauauaucaaaaccgaggccaucgugugcguggaacugacgagccaggagcggcaguguucucucauugaagcuggcacacgcuuuaaccuggggcccgucaccaucacacuuuccgagccuagaaauguucaacagcggcugccgcccgagauugugacccuccauccuaagaucgaagagggauucuuugaccugaugcacgugcagaagauucugagcgccucuaccgucugcaaacuccagagcugcacacauggcgugcccggggauuuccaaguuuaccacgugggaaaccugcuucgcggcgacaaggucaauggccacuccauccauaaaauugaaccucacuuuaacacgucuuggaugagcugggaugggugugaccuggauuauuucugcaauaugggagacuggcccuccuguaccuacacaggcgugacccagcauaacagagcggccuuuaucaauaugcucaacaucgagacagacuauaccaagacguuccacuuucacagcaaacggguuacagcucauggggauaccccgcagcuggaccuuaaggcccgcccugcuuacggagccggcgaagugaccguccugguggaggucgcggaucucgagcugcacaccaaaaagcuggaagugucugggcucaagauugccucccugacaugcagcggauguuacgcuuguucuuccggcaucagcugcaaaguucggauucaugugaaugagcccgacgaauuuacaguccacgugagauccucugauccugacguuguggccgcuggcagcucccuuauggcccgcaagaucgaguucggggccgauucuacguucaaggcuuucagcuccaugcccaaagacagccugugcuuuuauauugucgaaaaagauuacuguucuuccugcaccgacgaugacacacagaagugugugaacaccaagcucgaccauccccaaagcauccugaucgagcacaaaggaacaauuaucggcaagcagaacgauaccugcucuacgaaaaccuccugcuggcuugagagcgugaagggguucuuuuauggacugaaaaauaugcucucuggcauuuucgggaacguuuuucugggcauccuccuguuccuggcgccuuuuguccuucugauuuucuuuuucuuuuucggauggagacuccuguucugucugaagugcugucggagaacacgcggccuucucaaguacaaacaccugaaggacgaagaggaagccggguauaaaaagaucaucgagcggcugaaugggaaaaagggcaagagccagcucuuugauggggagagacuggcugaccgcaaaauugccgaacuuuucuccaccaagauccauauugga

SEQ ID NO: 14073 - RNA, 1932 nt, Artificial Sequence
  derived and/or modified CDS sequence (opt5) from CCHFV(V42/81)__GU477490.1__Gc
uuccuggacagcaucgugaagggcaaaaagaaccuccuuaauuccaccucucuugagacaagccuguccauugaagcccccuggggagcuaucaacauucagucuacguuuaaaccuaccgucagcgccgcgaauaucgcucucuccuggucuagcguugagcacagagggaacaagauucugguguccggccggagcgaaucuaucaugaaacuugaggaacgcacagggguguccuggaaucugggagucgaggaugccagcgagucuaagcuccugaccguguccaucauggaccugagccaaauguacucuccgguuuucgaauaucucuccggcgauagacagguggaggaauggcccaaggccacaugcaccggggacuguccugagcggugcggauguacaagcucuaccugccugcauaaagaguggccccacucucgcaacuggagauguaauccuacguggugcuggggcgucggcaccggguguacaugcuguggaguggauguuaaggaccuuuuuauugaucauauguucgugaaauggaaggucgaauacaucaaaaccgaggcuauugugugcguggaacugacaagccaggagcggcaguguucccucaucgaagccggcacccgcuuuaaccuggggcccgucacgauuacacuuagcgagccuagaaauauccaacagaagcugccgcccgagauuaucacccuccacccuaagaucgaagagggauucuuugaccugaugcauguucagaaagugcugucugcuuccacagugugcaagcuccagagcugcacccacggcauucccggggaucugcaagucuaucacaucggaaaccuucugaaaggcgaccgggugaauggccaucucauucacaagaucgaaccucauuucaacaccucuuggaugagcugggaugggugugaccuggauuacuauugcaauaugggagacuggcccuccuguacauacacgggcguuacccagcacaaccacgccgcguuugugaaucuucugaacauugagacagacuauaccaaaacauuccauuuucacucuaagcgcgucaccgcccauggggaaacgccgcagcucgaucugaaagcuagaccugccuacggagcuggcgagaucacagugcugguugagguggccgacauggaacuccacaccaagaaggucgagaucagcgggcugaaauucgcgucccuugccugcaccggauguuacgcuugcagcucuggcauuuccuguaaggugcggauccaugucgaugaacccgacgagcugacagugcacguuaaaagcaacgauccugacguggucgccgcuucuaccucccucauggcccgcaagcuggaaagcggcacagauuccacguuuaaagccuucucugcuaugcccaagaccagccuuugcuucuauauuguggagagagaguacuguaaguccugcucugaagacgauacacagaaauguguugagaccaagcuggaacaaccccagagcauccucauugagcacaaagggacaaucaucggaaagcagaaugauaccugcacggcgaaagccuccugcuggcuggagagcgugaaguccuuuuucuauggccugaagaacaugcucggguccgucuuuggaaauuucuuuauuggcauccugcuuuuccuggcuccuuuugugcuccuggugcuguucuuuauguucggguggaaaauucuguuuuguuucaagugcugucggcgcaccagaggccucuuuaaauaccggcaucugaaggaagacgaggaaacaggauauagacgcaucauugagcggcugaacagcaaaaagggcaagaauagacuccuggacggggaacgccuugccgaccggaaaaucgccgagcuguucucuaccaagacacacauugga

SEQ ID NO: 14074 - RNA, 1932 nt, Artificial Sequence
  derived and/or modified CDS sequence (opt5) from CCHFV(79121M18)__GU477493.1__Gc
uuccuggacagcaccgccaagggcaugaaaucccuccugaacucuacaagccuugagacgucccugucuaucgaagcucccuggggagccauuaaugugcagagcaccuuuaagccuacagucuccgcggcuaacaucgcccucucuuggagcuccguugagcacagagggaauaaaauucuggugagcggccggucugaauccaucaugaaacuugaggaacgcaccggggugagcuggaaccugggagucgaggaugccucugaguccaagacacucaccgugagcguuauggaccugucucaaauguacuccccgguguucgaauaucugagcggcgauagacaggucgaggaauggcccaaggcuacaugcaccggggacuguccugagcggugcggauguacguccucuaccugccuccauaaggaguggccccacagccgcaauuggagauguaacccuacauggugcuggggcgugggcaccggguguacaugcuguggacuggauguuaaagacuuuuucaccgauuacaugcuugugaaguggaaagucgaauauauuaagacggaggccaucgugugcguggaacugacaucccaggagcggcaguguagccucaucgaagcuggcacccgcuuuaaucuggggcccgucacaauuacccuuucugagccuagaaacguucaacagcggcugccgcccgagaucgugacccuccauccuaaaauugaagagggauucuuugaccugaugcacgugcagaagauccuguccgccagcacagucugcaagcuccagucuugcacgcauggcgugcccggggauuuccaaauuuaccacguuggaaaucugcuucgcggcgacaaagugaacggccacagcauccauaagauugaaccucacuuuaauaccuccuggaugucuugggaugggugugaccuggauuauuucugcaacaugggagacuggcccagcuguacauacaccggcgucacacagcauaauagagcggccuuuaucaacaugcucaauaucgagaccgacuauacgaaaacauuccacuuucacuccaagcgggugaccgcucauggggauaccccgcagcuggaccuuaaagcccgcccugcuuacggagccggcgaaguuacagugcuggucgagguggcggaucucgagcugcacaccaagaaacuggaagucagcgggcucaagauugccucucugacaugcuccggauguuacgcuugcagcucuggcaucuccuguaaggugcggauucauguuaacgagcccgacgaauuuacggugcacgucagaagcuccgauccugacgugguugccgcuggcucuagccuuauggcccgcaaaaucgaguucggggccgauuccaccuuuaaggcuuucucuagcaugcccaaagacucccugugcuuuuauauuguggaaaaggauuacuguagcucuugcacagacgaugacacccagaaaugugucaacacaaagcucgaccauccccaauccauccugaucgagcacaagggaaccauuaucggcaaacagaaugauacgugcagcaccaagacaucuugcuggcuugaguccgugaaaggguucuuuuauggacugaagaacaugcucagcggcauuuucgggaauguguuucugggcaucuuccuguuucucgcgccuuucguucugcuuauuuucuucuuuuucuucggauggagacugcucuuuugucugaaaugcugucggagaacccgcggccugcuuaaguacaagcaccucaaagacgaagaggaagccggguauaagaaaaucaucgagcggcugaacggaaagaaaggcaagucucagcuguucgauggggagagacucgcugaccgcaagauugccgaacuguuuagcacaaaaauccauauugga

SEQ ID NO: 14075 - RNA, 1932 nt, Artificial Sequence
  derived and/or modified CDS sequence (opt5) from CCHFV(Afg09-2990)__HM452306.1__Gc
uuccuggacagcaucgugaagggcaugaaaaaccuccuuaauuccaccucucuugagacaagccuguccauugaagcccccuggggagcuaucaacguccagucuacguacaagccuaccguuagcacagccaauauugcgcucuccuggucuagcguggagcacagagggaacaaagugcuggucuccggccggagcgaaucuaucaugaagcuggaggaacgcaccgggauuuccugggaucugggaguggaggacgcuagcgagucuaaacuccugacaguuuccgugauggaucugagccaaauguauucuccggucuuugaauaccucuccggcgacagacagguggaggaauggcccaaggcuaccugcacaggggauuguccugagcggugcggauguaccagcuccacgugccugcauaaggaguggccccacucucgcaauuggagauguaacccuaccuggugcuggggcguuggcacaggguguaccugcuguggacuugacgugaaagaucuguucacagacuauauguuugucaaguggaaaguggaauacaucaagaccgaggccaucgugugcgucgaacucacgagccaggagcggcaguguucccugauugaagccggcacacgcuucaaucuugggagcguuaccaucacacugucugagcccagaaacauucaacagaaacucccuccggagaucauuacccugcaucccaagaucgaagagggauuuuucgaucugaugcacgugcagaaggugcucuccgccagcaccgucugcaaacugcagucuugcacacauggcgugccuggggaccuucaaguuuaucacauuggaaaucugcucaagggcgaucgggugaacggccaccugauccauaaaaucgaacagcacuuuaauacgagcuggauguccugggacgggugugaucuugacuacuauugcaacaugggagacuggcccucuuguaccuacacaggcgucacccagcauaaucacgcuagcuucgugaaccugcucaauauugagacagauuacaccaagacguuucacuuccauuccaaacgcguuacagcccacggggacaccccucagcuggaucugaaggcgagacccaccuauggagccggcgaaaucacagugcucgucgagguggcugacauggagcugcauaccaaaaagauugaaaucagcgggcuuaaguuugccggacugacaugcacgggcuguuacgcuuguucuuccggcauuagcugcaaaguccggauccacguggaugagccggacgaacucaccguucaugugaagucugaugacccugaugucguggccgcguccagcucccugauggcccgcaaacuugaguucgggacagacucuaccuuuaaggcuuucagcgccaugcccaaaacaucccugugcuucuauaucguugaaagagaguacuguaagucuugcagcaaggaggauacccaaaaaugugugaacacgaagcucgaacagccucaguccauucugaucgagcacaaaggaaccauuaucggcaagcaaaacaauacaugcaccgcuaaagccagcugcuggcuggaaucugucaaguccuuuuucuaugggcucaagaacaugcugggaggcauuuuugggaauguguucaucggcaucuuuacauuccuuacccccuuuauucugcucauccuguucuuuauguucggauggcggauucuguuuuguuucaaaugcugucgcagaacgcggggccuuuuuaaguacagacaccucaaagacgacgaggagacaggguaucgcaagaucauugaacggcugaacaauaaaaagggaaagaacagacugcucgauggcgagcgccuggccgaccggaaaaucgcugaacuuuucagcaccaagacacauauuggg

SEQ ID NO: 14076 - RNA, 1932 nt, Artificial Sequence
  derived and/or modified CDS sequence (opt5) from CCHFV(Sudan Al-Fulah 3-2008)__HQ378184.1__Gc
uuccuggacagcaucgugaagggcaugaaaaaccuccuuaauuccaccucucuugagacaagccuguccauugaagcccccuggggagcuaucaacguccagucuacguacaagccuaccguuagcacagccaauauugcgcucuccuggucuagcguggagcacagagggaacaaaauccugguguccggccggagcgaaucuauuaugaagcuggaggaacgcaccgggaucuccugggaucugggagucgaggacgcuagcgagucuaaacuccugacaguguccguuauggaucugagccaaauguauucuccgguguuugaauaccucuccggcgacagacaggucgaggaauggcccaaggccacaugcacaggggauuguccugagcggugcggauguaccagcuccacgugccugcauaaggaguggccccacucucgcaauuggagauguaacccuaccuggugcuggggcgugggcacaggguguaccugcuguggacuugacguuaaagaucuguucacagacuauauguuugugaaguggaaagucgaauacaucaagaccgaggccauugugugcguggaacucacgagccaggagcggcaguguucccugaucgaagcuggcacacgcuucaaucuugggcccgucaccauuacacugagcgagccuagaaacauccaacagaaacucccgcccgagauuaucacccugcauccucggauugaagagggauuuuucgaucugaugcacguucagaaggugcucucugccuccaccgugugcaagcugcagagcugcacacauggcguccccggggaccuucaaguguaucacaucggaaaucugcucaaaggcgauaagguuaacggccaccugauccauaaaauugaaccucacuuuaauacgucuuggaugagcugggacgggugugaucuugacuacuauugcaacaugggagacuggcccuccuguaccuacacaggcgugacccagcauaaucacgcuucuuucgucaaccugcucaauaucgagacagauuacaccaagaacuuucacuuccauagcaaacgcgugacggcccacggggacacaccgcagcuggaucugaaggcgagaccuaccuauggagccggcgaaauuaccguucucguggaggucgcugacauggagcugcauaccaaaaagaucgaaauuuccgggcuuaaguuugccagccugaccugcacaggauguuacgcuuguucuuccggcaucagcugcaaagugcggauccacgucgaugagcccgacgaacucacggugcauguuaagucugaugacccugauguggucgccgcguccagcucccugauggcccgcaaacuugaguucggcaccgacucuacauuuaaggcuuucagcgccaugcccaaaaccucccugugcuucuauauuguggaaaaggaguacuguaagucuugcagcgaggaagauaccaaaaaguguguuaacaccaaacucgagcagccccaauccauccugauugaacacaaggggacgaucauuggaaaacagaauagcacaugcacagcuaaggugucuugcuggcuggaguccgccaagagcuuuuucuauggccucaaagacaugcugucugggaucuuuggaaacgucuucaucggcauuuuucuuuuccuggccccuuuugugcuccuggugcuguucuuuauguucggguggagaauccuucucuguuuucggugcugucgcagaacccggggccuguucaaguacagacaccugaaagacgaugaggaaacaggauaucgccggauuaucgagagacucaauaacaagaaaggcaagaauaagcugcuugacggggaacgccuggcugaucggaaaauugcggagcucuuuuccaccaagacgcauaucgga

SEQ ID NO: 14077 - RNA, 1932 nt, Artificial Sequence
  derived and/or modified CDS sequence (opt5) from CCHFV(Sudan AB1-2009)__HQ378187.1__Gc
uuccuggacagcaucgccaagggcaugaaaaaccuccuuaauuccaccucucuugagacaagccuguccauugaagcucccuggggagccaucaacgugcagucuacguacaagccuaccgucagcacagcgaauauugcucucuccuggucuagcguugagcacagagggaacaaaauccugguguccggccggagcgaaucuauuaugaaacuugaggaacgcaccgggaucuccugggaucugggaguggaggacgccagcgagucuaaacuccugacagucuccgugauggaucugagccaaauguauucuccgguuuuugaauaccucuccggcgacagacagguggaggaauggcccaaggcuaccugcacaggggauuguccugagcggugcggauguaccagcuccacgugccugcauaaggaguggccccacucucgcaauuggagauguaacccuaccuggugcuggggcgucggcacaggguguaccugcuguggacuugacgugaaagaucuguucacagacuauauguuuguuaaguggaaaguggaauacaucaagaccgaggccauugucugcguggaacucacgagccaggagcggcaguguucccugaucgaagccggcacacgcuucaaucuugggcccgugaccauuacacugagcgagccuagaaacauccaacagaaacucccgcccgagauuaucacccugcauccucggauugaagagggauuuuucgaucugaugcacguccagaagguucucucugcuuccaccgugugcaagcugcagagcugcacacauggcgugcccggggaccuucaagucuaucacaucggaaaucugcucaaaggcgauaaggugaacggccaccugauccauaaaauugaaccucacuuuaauacgucuuggaugagcugggacgggugugaucuugacuacuauugcaacaugggagacuggcccuccuguaccuacacaggcguuacccagcauaaucacgccucuuucgugaaccugcucaauaucgagacagauuacaccaagaacuuucacuuccauagcaaacgcgucacggcgcacggggacacaccgcagcuggaucugaaggccagaccuaccuauggagcuggcgaaauuaccgugcucguugagguggccgacauggagcugcauacaaagaagaucgaaauuuccgggcuuaaguuugcuagccugaccugcacaggauguuacgccugcuccuccggcaucagcuguaaaguccggauccacguggaugagcccgacgaacucacgguccaugugaagucugaugacccugauguuguggcggccuccagcucccugauggcucgcaaacuugaguucggcaccgacucuacauuuaaggccuucagcgcuaugcccaaaaccucccugugcuucuauauugucgaaagagagcacuguaagucuugcaacgaggaagauacaaagaaaugugugaauaccaagcucgagcagccccaaagcauccugauugaacacaaagggacgaucauuggaaagcagaacucuaccugcacagcccgggccagcugcuggcuggagucuguuaaauccuuuuucuacggccucaagaauaugcugagcgggaucuuuggaaacguguucaugggcaucuuucuuuuccuggcuccuuuuauucuccugauccuguucuuuauguucggguggcgcauucuguuuuguuucaagugcuguagacggaccagaggccucuuuaaauaucgccaucugaaggacgacgaggaaacaggauaccggagaaucauugagcgccugaauaacaaaaagggcaaaaauaagcuccuggauggggaacggcuugcggacagacgcaucgccgagcuguucucuaccaagacgcacauugga

SEQ ID NO: 14078 - RNA, 1932 nt, Artificial Sequence
  derived and/or modified CDS sequence (opt5) from CCHFV(NIVA 118595)__JN572083.1__Gc
uuccuggacagcaucgugaagggcaugaaaaaccuccuuaauuccaccucucuugagacaagccuguccauugaagcccccuggggagcuaucaacguccagucuacguacaagccuaccguuagcgccgcgaauauugcucucuccuggucuagcguggagcacagagggaacaaaauccugguguccggccggagcgaaucuauuaugaagcuggaggaacgcacagggaucuccugggaucugggagucgaggacgccagcgagucuaaacuccugaccguguccguuauggaucugagccaaauguauucuccgguguuugaauaccucuccggcgacagacaggucgaggaauggcccaaggccacaugcaccggggauuguccugagcggugcggauguacaagcucuaccugccugcauaaggaguggccccacucccgcaauuggagauguaacccuacguggugcuggggcgugggcaccggguguacaugcuguggacuugacguuaaagaucuguucaccgacuauauguuugugaaguggaaagucgaauacaucaagacagaggcuauugugugcguggaacucaccagccaggagcggcaguguucccugaucgaagccggcacgcgcuucaaucuugggagcgucacaauuacccugucugagcccagaaacauccaacagaaacucccuccggagauuaucacacugcauccccggauugaagagggauuuuucgaucugaugcacguucagaaggugcucuccgcuagcaccgugugcaagcugcagucuugcacccauggcgucccuggggaccuucaaguguaucacaucggaaaucugcucaaaggcgaucgcguuaacggccaccugauccauaagauugaacagcaccuuaauacaagcuggauguccugggacgggugugaucuggacuacuauugcaacaugggagacuggcccucuuguacguacaccggcgugacacagcauaaucacgccagcuuugucaaccuccugaauaucgagaccgauuacacaaaaaccuuccacuuucauuccaagagagugacggcgcacggggacacaccucagcuggaucucaaagcccggcccaccuauggagcuggcgaaauuaccguucugguggaggucgccgacauggagcuucauacaaagaaaaucgaaauuagcgggcugaaguucgcuucucucuccugcaccggauguuacgccugcagcucuggcaucuccuguaaggugcgcauccacgucgaugagccggacgaacugacagugcauguuaaaagcgaugacccugauguggucgcggccuccucuagccuuauggcuagaaagcuggaguccggcacggacucuaccuuuaaagccuucagcgcuaugcccaagacaucccucugcuuuuauauuguggaacgggaguacuguaaagggugcagcaaggaggauacccaaaaguguguuaacacaaaacuggaacagccucagucuauccugauugagcacaagggaaccaucauuggcaaacaaaacaauacgugcaccgccaaggccuccugcuggcucgaaagcgugaaaucuuucuucuaugggcugaagaacaugcuuuccggaaucuuuggcaaugucuuccuggggaucuuuagcuuccucgcucccuuugugcugcugauucuuuucuuuauguucggcuggcgcauccucuuuuguuucaagugcuguagacggacaagaggacuguuuaaauaccgccaccugaaggacgacgaggagaccggcuaucggaaaauuaucgaaagacucaacaauaagaaagggaagaacaagcugcuugauggagagcgccuggcggaccggaaaauugccgaacucuucucuacaaagacccauaucggc

SEQ ID NO: 14079 - RNA, 1932 nt, Artificial Sequence
  derived and/or modified CDS sequence (opt5) from CCHFV(NIV 112143)__JN572085.1__Gc
uuccuggacagcaucgugaagggcaugaaaaaccuccugaauagcaccucucuugagacaagccuguccauugaagcccccuggggagcuaucaacguccagucuacguacaagccuaccguuagcgccgcgaauauugcucucuccuggucuagcguggagcacagagggaacaaaauccugguguccggccggagcgaaucuauuaugaaacuugaggaacgcacagggaucuccugggaucugggagucgaggacgccagcgagucuaagcuccugaccguguccguuauggaucugagccaaauguauucuccgguguuugaauaccucuccggcgacagacaggucgaggaauggcccaaggccacaugcaccggggauuguccugagcggugcggauguacaagcucuaccugccugcauaaggaguggccccacucccgcaauuggagauguaacccuacguggugcuggggcgugggcaccggguguacaugcuguggacuugacguuaaagaucuguucaccgacuauauguuugugaaguggaaagucgaauacaucaagacagaggcuauugugugcguggaacucaccagccaggagcggcaguguucccugaucgaagccggcacgcgcuucaaucuugggagcgucacaauuacccugucugagcccagaaacauccaacagaaacucccuccggagauuaucacacugcauccccggauugaagagggauuuuucgaucugaugcacguucagaaggugcucuccgcuagcaccgugugcaagcugcagucuugcacccauggcgucccuggggaccuucaaguguaucacaucggaaaucugcucaaaggcgaucgcguuaacggccaccugauccauaagauugaacagcaccuuaauacaagcuggauguccugggacgggugugaucuggacuacuauugcaacaugggagacuggcccucuuguacguacaccggcgugacacagcauaaucacgccagcuuugucaaccuccugaauaucgagaccgauuacacaaaaaccuuccacuuucauuccaagagagugacggcgcacggggacacaccucagcuggaucucaaagcccggcccaccuauggagcuggcgaaauuaccguucugguggaggucgccgacauggagcuucauacaaagaaaaucgaaauuagcgggcugaaguucgcuucucucuccugcaccggauguuacgccugcagcucuggcaucuccuguaaggugcgcauccacgucgaugagccggacgaacugacagugcauguuaaaagcgaugacccugauguggucgcggccuccucuagccuuauggcuagaaagcuggaguuuggcacggacuccaccuucaaagccuuuucugcuaugcccaagacaagccucugcuucuauauuguggaacgggaguacuguaaagggugcuccaaggaggauacccaaaaguguguuaacacaaaacuggaacagccucagagcauccugauugagcacaagggaaccaucauuggcaaacaaaacaauacgugcaccgccaaggccucuugcuggcucgaauccgugaaauccuucuuuuaugggcugaagaacaugcuuucuggaaucuucggcaaugucuuucuggggaucuucuccuuucucgcucccuucgugcugcugauucucuuuuucauguuuggcuggcgcauccuuuucuguuuuaagugcuguagacggacaagaggacuguucaaauaccgccaccugaaggacgacgaggagaccggcuaucggaaaauuaucgaaagacucaacaauaagaaagggaagaacaagcugcuugauggagagcgccuggcggaccggaaaauugccgaacucuuuagcacaaagacccauaucggc

SEQ ID NO: 14080 - RNA, 1932 nt, Artificial Sequence
  derived and/or modified CDS sequence (opt5) from CCHFV(SCT ex Afghanistan)__KC344856.1__Gc
uuccugaacagcaucgugaagggcaugaaaaaucuccugaacuccaccaaucuugagacaucucugagcauugaagcccccuggggagcuaucaacguccaguccacguuuaagccuaccguuucuacagccaauauugcgcucagcugguccucuguggagcacagagggaacaaaauccuggugagcggccgguccgaaagcauuaugaagcucgaggaacgcaccgggaucucuugggaccugggagucgaggaugcuuccgagagcaaaucucucacaguguccguuauggaccugagccaaauguacucuccgguguucgaauaucuguccggcgauagacaggucgaggaauggcccaaggcuaccugcacaggggacuguccugagcggugcggauguaccagcuccacgugccuccauaaggaguggccccacucucgcaauuggagauguaacccuaccuggugcuggggcgugggcacaggguguaccugcuguggacuggauguuaaagaccuuuuuacagauuacauguucgugaaguggaaagucgaauauaucaagaccgaggccauugugugcguggaacugacgagccaggagcggcaguguucccucaucgaagccggcacacgcuuuaaucuggggcccgucaccauuacacuuagcgagccuagaaacauccaacagaaacugccgcccgagauuaucacccuccauccucggauugaagagggauucuuugaccugaugcacguucagaaggugcugucugccuccaccgugugcaagcuccagagcugcacacauggcguccccggggaucugcaaguguaccacaucggaaaucuucugaaaggcgacaagcucaacggccacaugauccauaaaauugaaccucacuucaauacgucuuggaugagcugggaugggugugaccuggauuauuacugcaacaugggagacuggcccuccuguaccuauacaggcguuacccagcauaaucacgcugccuuugugaaccuucugaacaucgagacagacuacaccaagaauuuccacuuucauucuaaacgcgucacggcgcacggggauacaccgcagcucgaccugaaggccagaccuaccuacggagcuggcgaaauuaccgugcugguugagguggccgauauggagcuccauacaaagaagaucgacauuagcgggcugaaguucgcuucccuuaccugcgccggauguuaugcgugcagcucuggcaucuccuguaaaguccggauccacguggaugaacccgacgagcugacaguccaugugaaaagcgaagauccugacauuguugccgcuucuacgucccucaucgcccgcaaacuggagcuuggcaccgauagcacauuuaaggcuuucuccgccaugcccaaaaccucucugugcuucuacauuguggaaagagaguauuguaagagcugcuccaaggaggacacacagaaaugugucaacaccaagcucgaacacccccaagggauccugauugagcacaaaggaacgaucaucggcaagcagaaugauaccugcacagccaaagcugggugcuggcuggaaucuguuaagagcuuuuucuacggacucaagaacaugcuguccggcauuuuugggaauguguucaucggcauuuuucuuuuccuggcgccuuuugugcuccugauccuguucuuuauguucggauggcggcuucucuuuuguuucaaaugcugucgcagaacccggggccuguuuaaguauagacaucugaaagaggacgaggaaagcggguaccgccggauuaucgagagacucaacaauaagaaaggaaagaacaagcugcuugacggcgaacgccuggccgaucggagaauugcugagcuuuucucuacaaaaacccacaucggg

SEQ ID NO: 14081 - RNA, 1932 nt, Artificial Sequence
  derived and/or modified CDS sequence (opt5) from CCHFV(Zahedan 2007)__KC867273.1__Gc
uuccuggacagcaucgugaaggauaugaaaaaccuccuuaauuccaccucucuugagacaagccuguccauugaagcccccuggggcgcuaucaacguccagucuacguacaagccuaccguuagcacagccaauauugcgcucuccuggucuagcguggagcacagagggaacaaagugcuggucuccggacggagcgaaucuaucaugaagcuggaggaacgcaccggcauuuccugggaccuggggguggaggaugcuagcgagucuaaacuccugacaguuuccgugauggaccugagccaaauguauucuccggucuuugaauaccucuccggagauagacagguggaggaauggcccaaggcuaccugcacaggcgacuguccugagcggugcggguguaccagcuccacgugccugcauaaggaguggccccacucucgcaauuggagauguaacccuaccuggugcuggggaguuggcacaggcuguaccugcugugggcuugaugugaaagaccuguucacagauuauauguuugucaaguggaaaguggaauacaucaagaccgaggccaucgugugcgucgaacucacgagccaggagcggcaguguucccugauugaagccggaacacgcuucaaucuuggcagcguuaccaucacacugucugagcccagaaacauucaacagaaacucccuccggagaucauuacccugcaucccaagaucgaagagggguuuuucgaccugaugcacgugcagaaggugcucuccgccagcaccgucugcaaacugcagucuugcacacauggagugccuggcgaucuucaaguuuaucacauugggaaucugcucaagggagaccgggugaacggccaccugauccauaaaaucgaacagcacuuuaauacgagcuggauguccugggauggcugugaccuugacuacuauugcaacaugggggauuggcccucuuguaccuacacaggagucacccagcauaaucacgcuagcuucgugaaccugcucaauauugagacagacuacaccaagacguuucacuuccauuccaaacgcguuacagcccacggcgauaccccucagcuggaccugaaggcgagacccaccuauggggccggagaaaucacagugcucgucgagguggcugauauggagcugcauaccaaaaagauugaaaucagcggccuuaaguuugccgggcugacaugcacgggauguuacgcuuguucuuccggcauuagcugcaaaguccggauccacguggacgagccggaugaacucaccguucaugugaagucugacgauccugacgucguggccgcguccagcucccugauggcccgcaaacuugaguucggcacagauucuaccuuuaaggcuuucagcgccaugcccaaaacaucccugugcuucuauaucguugaaagagaguacuguaagucuugcagcaaggaggacacccaaaaaugugugaacacgaagcucgaacagccucaguccauucugaucgagcacaaagggaccauuaucggaaagcaaaacaauacaugcaccgcuaaagccagcugcuggcuggaaucugucaaguccuuuuucuauggccucaagaacaugcuugggggaauuuuuggcaauguguucaucgggaucuuuacauuccugacccccuuuauucugcucaucuucuuuuucauguuuggcuggcggauucuguucuguuuuaaaugcugucgcagaacgcggggacuguucaaguacagacaccuuaaagacgaugaggagacaggcuaucgcaagaucauugaacggcucaacaauaaaaaggggaagaacagacugcuggacggagagcgccucgccgaucggaaaaucgcugaacuguucagcaccaagacacauauuggc

SEQ ID NO: 14082 - RNA, 1932 nt, Artificial Sequence
  derived and/or modified CDS sequence (opt5) from CCHFV(SPU 44/08)__KJ682805.1__Gc
uuccuggacagcaucgugaagggcaugaaaaaccuccuuaauuccaccucucuugagacaagccuguccauugaagcccccuggggagcuaucaacguccagucuacguuuaagccuaccguuagcgccgcgaauauugcucucuccuggucuagcguggagcacagagggaacaaaauccugguguccggccggagcgaaucuauuaugaagcuggaggaacgcacagggaucuccugggaucugggagucgaggacgccagcgagucuaaacuccugaccguguccguuauggaucugagccaaauguacucuccgguguucgaauaucucuccggcgacagacaggucgaggaauggcccaaggccacaugcaccggggauuguccugagcggugcggauguacaagcucuaccugccugcauaaggaguggccccacucucgcaauuggagauguaacccuacguggugcuggggcgugggcaccggguguacaugcuguggacuugacguuaaagaucuguuuaccgacuacauguucgugaaguggaaagucgauuauaucaagacagaagcuauugugugcguggagcucaccagccaggaacggcaguguucccugaucgaggccggcacgcgcuuuaaucuugggcccgucacaauuacccugagcgaaccuagaaacauccaacagaaacucccgcccgagauuguuacacugcauccucggaucgaggaaggauucuuugaccugaugcacauucagaaggugcucucugcuuccaccgugugcaagcugcagagcugcacccauggcguccccggggaucuucaaaucuaccacaucggaaaucugcucaaaggcgacaaggugaacggccaccugauucauaaaaucgagccucacuucaauacaucuuggaugagcugggaugggugugaccuugacuauuacugcaacaugggagauuggcccuccuguucuuauacgggcguuacccagcauaaucacgccgcguuugugaacaugcugaauauugaaacagacuacaccaagaacuuccacuuucauagcaaacgcgucacagcccacggggauaccccgcagcucgaccugaaggcuagaccuacguacggagccggcgagaucacagugcugguugaaguggcugauauggagcuccauaccaaaaagauugagaucuccgggcugaaguucgccagccuuaccugcacaggauguuaugcgugcuccuccggcaucagcuguaaaguccggauucacguggacgaacccgaugagcugaccguccaugugaagucugaagacccugauaucguugccgcuuccagcucccucauggcccgcaaacuggaguuuggcacagacucuacguucaaggcuuucagcgccaugcccaaaaccucccuuugcuuuuacauuguggaaagagaguauuguaagucuugcagcaaggaggauacacagaaaugugucaacaccaagcuggaacaaccccaguccauccucauugagcacaaagggacaaucaucggaaagcagaaugauaccugcacggccaaagcuagcugcuggcuggaaucuauuaaguccuucuuuuacggccugaagaacaugcucagcgggaucuucggaaauguguuuauuggcaucuuccuguuucuugcgccuuucauuaugcugauccucuuuuucauguuuggguggcggauucuguucuguuuuaaaugcugucgcagaacccggggccuguucaaguauagacaccuuaaagacgacgaggagaucggauaccgcaagaucauugaacggcucaacaauaaaaagggcaagaacaaacugcuggacggggagagacucgccgaucgcaagaucgcugaacuguucucuacaaaaacccauauugga

SEQ ID NO: 14083 - RNA, 1932 nt, Artificial Sequence
  derived and/or modified CDS sequence (opt5) from CCHFV(SPU 383/87)__KJ682806.1__Gc
uuccuggacagcaucgugaagggcaugaaaaaccuccuuaauuccaccucucuugagacaagccuguccauugaagcccccuggggagcuaucaacguccagucuacguuuaagccuaccguuagcgccgcgaauauugcucucuccuggucuagcguggagcacagagggaacaaaauccugguguccggccggagcgaaucuauuaugaagcuggaggaacgcacagggaucuccugggaucugggagucgaggacgccagcgagucuaaacuccugaccguguccguuauggaucugagccaaauguacucuccgguguucgaauaucucuccggcgacagacaggucgaggaauggcccaaggccacaugcaccggggauuguccugagcggugcggauguacaagcucuaccugccugcauaaggaguggccccacucucgcaauuggagauguaacccuacguggugcuggggcgugggcaccggguguacaugcuguggacuugacguuaaagaucuguuuaccgacuacauguucgugaaguggaaagucgauuauaucaagacagaagcuauugugugcguggagcucaccagccaggaacggcaguguucccugaucgaggccggcacgcgcuuuaaucuugggcccgucacaauuacccugagcgaaccuagaaacauccaacagaaacucccgcccgagauuguuacacugcauccucggaucgaggaaggauucuuugaccugaugcacauucagaaggugcucucugcuuccaccgugugcaagcugcagagcugcacccauggcguccccggggaucuucaaaucuaccacaucggaaaucugcucaaaggcgacaaggugaacggccaccugauucauaaaaucgagccucacuucaauacaucuuggaugagcugggaugggugugaccuugacuauuacugcaacaugggagauuggcccuccuguucuuauacgggcguuacccagcauaaucacgccgcguuugugaacaugcugaauauugaaacagacuacaccaagaacuuccacuuucauagcaaacgcgucacagcccacggggauaccccgcagcucgaccugaaggcuagaccuacguacggagccggcgagaucacagugcugguugaaguggcugauauggagcuccauaccaaaaagauugagaucuccgggcugaaguucgccagccuuaccugcacaggauguuaugcgugcuccuccggcaucagcuguaaaguccggauucacguggacgaacccgaugagcugaccguccaugugaagucugaagacccugauaucguugccgcuuccagcucccucauggcccgcaaacuggaguuuggcacagacucuacguucaaggcuuucagcgccaugcccaaaaccucccuuugcuuuuacauuguggaaagagaguauuguaagucuugcagcaaggaggauacacagaaaugugucaacaccaagcuggaacaaccccaguccauccucauugagcacaaagggacaaucuucggaaagcagaaugauaccugcacggccaaagcuagcugcuggcuggaaucugugaaguccuuuuucuacggccugaagaacaugcucagcgggaucuuuggaaauguuuucauuggcguguuucuguuccuugcgccuuuuaucaugcugauucucuucuuuauguucggguggcggauccuguuuuguuucaaaugcugucgcagaacccggggccuguucaaguauagacaccuuaaagacgacgaggagauuggauaccgcaagaucauugaacggcucaacaauaaaaagggcaagaacaaacugcuggacggggagagacucgccgaucgcaagaucgcugaacuguuuucuacaaaaacccauaucgga

SEQ ID NO: 14084 - RNA, 1932 nt, Artificial Sequence
  derived and/or modified CDS sequence (opt5) from CCHFV(SPU 130/89)__KJ682807.1__Gc
agccuggacuccaucgugaagggcaugaaaaaccuccuuaauucuaccagccuugagacaucccugucuauugaagcccccuggggagcuaucaacguccagagcacguucaagccuaccguuuccgccgcgaauauugcucucucuuggagcuccguggagcacagagggaacaaaauccuggugagcggccggucugaauccauuaugaaacuugaggaacgcacagggaucagcugggaucugggagucgaggacgccucugaguccaaacuccugaccgugagcguuauggaucugucucaaauguacuccccgguguuugaauaucucagcggcgacagacaggucgaggaauggcccaaggccacaugcaccggggauuguccugagcggugcggauguacauccucuaccugccugcauaaggaguggccccacagccgcaauuggagauguaacccuacguggugcuggggcgugggcaccggguguacaugcuguggacuugacguuaaagaucuguucaccgacuacauguuugugaaguggaaagucgauuauaucaagacagaagcuauugugugcguggagcucaccucccaggaacggcaguguagccugaucgaggccggcacgcgcuucaaucuugggcccgucacaauuacccugucugaaccuagaaacauccaacagaaacucccgcccgagauuguuacacugcauccucggaucgaggaaggauuuuucgaccugaugcacauucagaaggugcucuccgcuagcaccgugugcaagcugcagucuugcacccauggcguccccggggaucuucaaaucuaccacaucggaaaucugcucaaaggcgacaaggugaacggccaccugauucauaaaaucgagccucacuuuaauacaagcuggauguccugggaugggugugaccuugacuauuacugcaacaugggagauuggcccucuuguagcuauacgggcguuacccagcauaaucacgccgcguucgugaacaugcugaauauugaaacagacuacaccaagaacuuucacuuccauuccaaacgcgucacagcccacggggauaccccgcagcucgaccugaaggcuagaccuacguacggagccggcgagaucacagugcugguugaaguggcugauauggagcuccauaccaaaaaggucgagauuagcgggcugaaguuugccucucuuaccugcacaggauguuaugcgugcuccagcggcaucucuuguaaagugcggauccacgucgacgaacccgaugagcugaccgugcauguuaaguccgaagacccugauauuguggccgcuagcuccucucucauggcccgcaaacuggaguucggcacagacagcacguuuaaggcuuucuccgccaugcccaaaaccucucuuugcuucuacaucgucgaaagagagcacuguaagagcugcuccaaggaggauacacagcggugugugaacaccaaacuggaacaaccccagagcauucucaucgagcacaaggggacaauuaucggaaaacagaaugauaccugcacggccaaggcuucuugcuggcuggaauccaucaagagcuuuuucuauggccugaagaacaugcucucugggauuuuuggaaauguuuucaucggcguguuucuguuccuugcgccuuuuauuauccugauucucuucuuuauguucggguggcgcauccuguuuuguuucaagugcuguagacggaccagaggccugcuuaaauaccgccaucucaaggacgacgaggagauuggauaucggaaaaucaucgaaagacugaacaauaagaaaggcaagaacaagcugcucgacggggagcgccuggccgaucggaaaauugcugaacuguuuuccacaaagacccacaucgga

SEQ ID NO: 14085 - RNA, 1932 nt, Artificial Sequence
  derived and/or modified CDS sequence (opt5) from CCHFV(SPU 497/88)__KJ682808.1__Gc
uuccuggacagcaucgugaagggcaugagaaaccuccuuaauuccaccucucuggagacaagccuguccauugaagcccccuggggagcuaucaacguccagucuacguuuaaaccuaccguuagcgccgcgaauauugcucucuccuggucuagcguggagcaccgggggaacaagauccugguguccggccgcagcgaaucuauuaugaaacuugaggaaagaacagggaucuccugggaucugggagucgaggacgccagcgagucuaagcuccugaccguguccguuauggaucugagccaaauguacucuccgguguucgaauaucucuccggcgaccggcaggucgaggaauggcccaaagccacaugcaccggggauuguccugagcgcugcggauguacaagcucuaccugccugcauaaggaguggccccacucuagaaauuggcgguguaacccuacguggugcuggggcgugggcaccggguguacaugcuguggacuugacguuaaggaucuguuuaccgacuacauguucgugaaauggaaggucgauuauaucaaaacagaagcuauugugugcguggagcucaccagccaggaacgccaguguucccugaucgaggccggcacgagauuuaaucuugggcccgucacaauuacccugagcgaaccucggaacauccaacagaagcucccgcccgagauuguuacacugcauccucgcaucgaggaaggauucuuugaccugaugcacauucagaaagugcucucugcuuccaccgugugcaagcugcagagcugcacccauggcguccccggggaucuucaaaucuaccacaucggaaaucugcucaagggcgacaaagugaacggccaccugauucauaagaucgagccucacuucaauacaucuuggaugagcugggaugggugugaccuugacuauuacugcaacaugggagauuggcccuccuguucuuauacgggcguuacccagcauaaucacgccgcguuugugaacaugcugaauauugaaacagacuacaccaaaaacuuccacuuucauagcaagagagucacagcccacggggauaccccgcagcucgaccugaaagcucggccuacguacggagccggcgagaucacagugcugguugaaguggcugauauggagcuccauaccaagaaaauugagaucuccgggcugaaguucgccagccuuaccugcacaggauguuaugcgugcuccuccggcaucagcuguaagguccgcauucacguggacgaacccgaugagcugaccguccaugugaaaucugaagacccugauaucguugccgcuuccagcucccucauggccagaaagcuggaguuuggcacagacucuacguucaaggcuuucagcgccaugcccaaaaccucccuuugcuuuuacauuguggaacgggaguauuguaaaucuugcagcaaggaggauacacagaagugugucaacaccaaacuggaacaaccccaguccauccucauugagcacaaggggacaaucaucggaaaacagaaugauaccugcacggcccgcgcuagcugcuggcuggaaucuauuaaguccuucuuuuacggccugaaaaacaugcucagcgggaucuucggaaauguguuuauuggcaucuuccuguuuuucgcgccuuuuauuaugcuuauccuguucuuuauguucggguggcggauucucuuuuguuucaagugcuguagaagaacccgcggccuguucaaguaucggcaccugaaagacgacgaggagguuggauacagaaagaucaucgaacgccuuaacaauaaaaagggcaaaaacaagcuccuggacggggagcggcuggccgauagaaagauugcugaacucuuuucuacaaaaacccauaucgga

SEQ ID NO: 14086 - RNA, 1932 nt, Artificial Sequence
  derived and/or modified CDS sequence (opt5) from CCHFV(SPU 18/88)__KJ682810.1__Gc
uuccuggacagcaucgugaagggcaaaaagaaccuccuuaauuccaccucucuggagacaagccuguccauugaagcccccuggggagcuaucaacguccagucuacguuuaaaccuaccguuagcgccgcgaauauugcucucuccuggucuagcguggagcacagagggaacaagauccugguguccggccggagcgaaucuauuaugaaacuugaggaacgcacagggaucuccugggaucugggagucgaggacgccagcgagucuaagcuccugaccguguccguuauggaucugagccaaauguacucuccgguguucgaauaucucuccggcgacagacaggucgaggaauggcccaaggccacaugcaccggggauuguccugagcggugcggauguacaagcucuaccugccugcauaaagaguggccccacucucgcaauuggagauguaacccuacguggugcuggggcgugggcaccggguguacaugcuguggacuugacguuaaggaucuguuuaccgacuacauguucgugaaauggaaggucgauuauaucaaaacagaagcuauugugugcguggagcucaccagccaggaacggcaguguucccugaucgaggccggcacgcgcuuuaaucuugggcccgucacaauuacccugagcgaaccuagaaacauccaacagaagcucccgcccgagauuguuacacugcauccucggaucgaggaaggauucuuugaccugaugcacauucagaaggugcucucugcuuccaccgugugcaaacugcagagcugcacccauggcguccccggggaucuucaaaucuaccacaucggaaaucugcucaagggcgacaaagugaacggccaccugauucauaagaucgagccucacuucaauacaucuuggaugagcugggaugggugugaccuugacuauuacugcaacaugggagauuggcccuccuguucuuauacgggcguuacccagcauaaucacgccgcguuugugaacaugcugaauauugaaacagacuacaccaaaaacuuccacuuucauagcaagcgcgucacagcccacggggauaccccgcagcucgaccugaaagcuagaccuacguacggagccggcgagaucacagugcugguugaaguggcugauauggagcuccauaccaagaagauugagaucuccgggcugaaauucgccagccuuaccugcacaggauguuaugcgugcuccuccggcaucagcuguaagguccggauucacguggacgaacccgaugagcugaccguccaugugaaaucugaagacccugauaucguugccgcuuccagcucccucauggcccgcaagcuggaguuuggcacagacucuacguucaaggcuuucagcgccaugcccaaaaccucccuuugcuuuuacauuguggaaagagaguauuguaagucuugcagcaaagaggauacacagaagugugucaacaccaaacuggaacaaccccaguccauccucauugagcacaaggggacaaucaucggaaaacagaaugauaccugcacgggcaaggccgggugcuggcuggaaagcauuaagucuuucuuuuacggacugaaaaacaugcucuccggcaucuucgggaauguguuuauuggcaucuuccuguuucuugcuccuuucauuaugcugauccucuuuuucauguuuggauggcggauucuguucuguuuuaagugcugucgcagaacccggggccuguucaaauauagacaccuuaaggacgacgaggagaucggguaccgcaaaaucauugaacggcucaagaacaagaaaggaaagaauaaacugcuggacggcgagagacucgcggaucgcaagaucgccgaacuguucagcacaaaaacccauauuggg

SEQ ID NO: 14087 - RNA, 1932 nt, Artificial Sequence
  derived and/or modified CDS sequence (opt5) from CCHFV(SPU 431/85)__KJ682812.1__Gc
uuccuggacagcaucgugaagggcagaaagaaccuccugaauagcaccucucuugagacaagccuguccauugaagcccccuggggcgcuaucaacguccagucuacguuuaagccuaccguuagcgccgcgaauauugcucucuccuggucuagcguggagcaccggggaaacaaaauccugguguccggccgcagcgaaucuauuaugaaacuugaggaaagaacagggaucuccugggaucugggagucgaggacgccagcgagucuaaacuccugaccguguccguuauggaucugagccaaauguacucuccgguguucgaauaucucuccggcgaccggcaggucgaggaauggcccaaggccacaugcaccggggauuguccugagcgcugcggauguacaagcucuaccugccugcauaaggaguggccccacuccagaaauuggcgguguaacccuacguggugcuggggcgugggcaccggguguacaugcuguggacuugacguuaaagaucuguuuaccgacuacauguucgugaaguggaaagucgaauauaucaagacagaggcuauugugugcguggaacucaccagccaggagcgccaguguucccugaucgaagccggcacgagauuuaaucuugggcccgucacaauuacccugagcgagccucggaacauccaacagaaacucccgcccgagauuaucacacugcauccucgcauugaagagggauucuuugaucugaugcacguucagagagugcucucugcuuccaccgugugcaagcugcagagcugcacccauggcguccccggggaccuucaaguguaccacaucggaaaucugcucaagggcgauaaaguuaacggccaccugauccauaagauugaaccucacuucaauacaucuuggaugagcugggacgggugugaucuugacuauuacugcaacaugggagacuggcccuccuguacguauaccggcgugacacagcauaaucacgccgcguuugucaaccugcucaauaucgagaccgauuacacaaagaacuuccacuuucauucuaagcgggugaccgcccacggggacacgccgcagcuggaucugaaagcucgcccuacauacggagccggcgaaguuaccgugcucgucgagguggcugacauggagcugcauaccaagaaaauugaaaucagcgggcuuaaguucgccucccugacaugcaccggauguuaugcgugcagcucuggcauuuccuguaaggucaaaauccacguggaugagcccgacgaacucacaguucaugugaaaagcgaggauccugacaucgucgccgcugggucuucccugauggccagaaaacuugaauuuggggcugauagcacguucaaggccuucuccgccaugcccaaaaccucucugugcuuuuacauuguggagcgggaguauuguaagagcugcucccgcgaagacacaagaaaguguguuaacaccaaacucgaucggccccagucuauccugauugagcacaagggaacaaucauuggcaaacaaaauaauaccugcacggcuaaggcgagcugcuggcuggaauccgugaaauccuucuuuuacgggcucaagaacaugcugucuggaaucuucggcaacgucuuuaucgggauuuuccuuuuuaucgccccuuucgugcugcucauucuguuuuucauguuuggcuggagaauccuguucuguuuuaagugcugucgccggaccagaggacuuuucaaauaucgccaccucaaggacgacgaggagacaggcuaccggaaaauuaucgaaagacugaauaacaagaaagggaagaauaagcugcucgauggagagcgccuggcugaccggaaaauugccgaacuuuucuccaccaagagccauaucggc

SEQ ID NO: 14088 - RNA, 1932 nt, Artificial Sequence
  derived and/or modified CDS sequence (opt5) from CCHFV(SPU 48/90)__KJ682813.1__Gc
uucagagacagcaucgugaagggcaugaaaaaccugcucaauuccaccucucuggagacaagccuuuccauugaagcccccuggggagcuaucaacguccagucuacguacaagccuaccguuagcacagccaauauugcgcuguccuggucuagcguggagcaccgggggaacaaaauccucguguccggccgcagcgaaucuauuaugaagcuggaggaaagaaccgggaucuccugggaucuuggagucgaggacgcuagcgagucuaaacugcucacaguguccguuauggaucugagccaaauguauucuccgguguuugaauaccuguccggcgaccggcaggucgaggaauggcccaaggccacaugcacaggggauuguccugagcgcugcggauguaccagcuccacgugccuccauaaggaguggccccacucuagaaauuggcgguguaacccuaccuggugcuggggcgugggcacaggguguaccugcuguggacuggacguuaaagaucuuuucacagacuauauguuugugaaguggaaagucgaauacaucaagaccgaggccauugugugcguggaacugacgagccaggagcgccaguguucccucaucgaagcuggcacaagauucaaucuggggcccgucaccauuacacuuagcgagccucggaacauccaacagaaacugccgcccgagauuaucacccuccauccucgcauugaagagggauuuuucgaucugaugcacguucagaaggugcugucugccuccaccgugugcaagcuccagagcugcacacauggcguccccggggaccugcaaguguaucacaucggaaaucuucugaaaggcgauaagguuaacggccaccucauccauaaaauugaaccucacuuuaauacgucuuggaugagcugggacgggugugaucuggacuacuauugcaacaugggagacuggcccuccuguaccuacacaggcgugacccagcauaauagagcuucuuucgucaaccuucugaauaucgagacagauuacaccaagaacuuucacuuccacagcaaacgggugacggcccauggggacacaccgcagcucgaucugaaggcgcgcccuaccuauggagccggcgaaauuaccguucugguggaggucgcugacauggagcuccacaccaaaaagaucgaaauuuccgggcugaaguuugccagccuuaccugcacaggauguuacgcuuguucuuccggcaucagcugcaaagugagaauccaugucgaugagcccgacgaacugacggugcacguuaagucugaugacccugauguggucgccgcguccagcucccucauggcccggaaacuggaguucggcaccgacucuacauuuaaggcuuucagcgccaugcccaaaaccucccuuugcuucuauauuguggaaaaggaguacuguaagucuugcagcgaggaagauaccaaaaaguguguuaacaccaaacuggagcagccccaauccauccucauugaacauaaggggacgaucauuggaaaacagaauagcacaugcacagcuaaggugucuugcuggcuggaguccgccaagagcuuuuucuauggccugaaagacaugcucucugggaucuuuggaaacgucuucaucggcauuuuucuguuccuugccccuuuuauccugcucauucuguucuuuauguucggguggcgcauccugcuuuguuuuaagugcuguagacggaccagaggccucuucaaauaccgccaccugaaggacgaugaggaaacaggauaucggagaauuaucgagcgccugaauaacaaaaagggcaagaauaaacuccuggacggggaacggcuugcugauagacgcauugcggagcuguuuuccaccaagacgcacaucgga

SEQ ID NO: 14089 - RNA, 1932 nt, Artificial Sequence
  derived and/or modified CDS sequence (opt5) from CCHFV(SPU 187/90)__KJ682814.1__Gc
uuccuggacagcaucgugaagggcaugaaaaaccuccuuaauuccaccucucuugagacaagccuguccauugaagcccccuggggagcuaucaacguccagucuacguacaagccuaccguuagcacagccaauauugcgcucuccuggucuagcguggagcacagagggaacaaaauccugguguccggccggagcgaaucuauuaugaaacuugaggaacgcaccgggaucuccugggaucugggagucgaggacgcuagcgagucuaaacuccugacaguguccguuauggaucugagccaaauguauucuccgguguuugaauaccucuccggcgacagacaggucgaggaauggcccaaggcuaccugcacaggggauuguccugagcggugcggauguaccagcuccacgugccugcauaaggaguggccccacucucgcaauuggagauguaacccuaccuggugcuggggcgugggcacaggguguaccugcuguggacuugacguuaaagaucuguucacagacuauauguuugugaaguggaaagucgaauacaucaagaccgaggccauugugugcguggaacucacgagccaggagcggcaguguucccugaucgaagccggcacacgcuucaaucuugggcccgucaccauuacacugagcgagccuagaaacauccaacagaaacucccgcccgagauuaucacccugcauccucggauugaagagggauuuuucgaucugaugcacguucagaaggugcucucugccuccaccgugugcaagcugcagagcugcacacauggcguccccggggaccuucaaguguaucacaucggaaaucugcucaaaggcgauaagguuaacggccaccugauccauaaaauugaaccucacuuuaauacgucuuggaugagcugggacgggugugaucuugacuacuauugcaacaugggagacuggcccuccuguaccuacacaggcgugacccagcauaaucacgcuucuuucgucaaccugcucaauaucgagacagauuacaccaagaacuuucacuuccauagcaaacgcgugacggcccacggggacacaccgcagcuggaucugaaggcgagaccuaccuauggagccggcgaaauuaccguucucguggaggucgcugacauggagcugcauacaaagaagaucgaaauuuccgggcuuaaguuugccagccugaccugcacaggauguuacgcuugcucuagcggcaucagcuguaaagugcggauccacgucgaugagcccgacgaacucacggugcauguuaagucugaugacccugauguggucgccgcguccagcucccugauggcccgcaaacuugaguucggcaccgacucuauuuuuaaggcuuucagcgccaugcccaaaacaucccugugcuucuauaucguggaaagagagcacuguaagucuugcagcgaggaagauaccaagaaauguguuaacacaaagcucgagcagccccaauccauucugaucgaacacaaagggaccauuaucggaaagcagaauagcacgugcaccgcuaaaacaucuugcuggcuggaguccgugaaguccuuuuucuacggccucaagaacaugcugucugggaucuuuggaaaugucuucauuggcaucuuucuuuuccuggccccuuuuauucuccugauccuguucuuuauguucggguggcggauucuguuuuguuucaaaugcugucgcagaacccggggccucuuuaaguauagacaucugaaagacgacgaggaaacaggauaccgccggaucauugagagacugaacaauaagaaaggcaagaacaagcuccuggauggggaacgccuugccgaccggagaaucgcugagcuguucuccaccaaaacgcacaucgga

SEQ ID NO: 14090 - RNA, 1932 nt, Artificial Sequence
  derived and/or modified CDS sequence (opt5) from CCHFV(Haskovo-V46/13)__KR092379.1__Gc
uuccuggacagcaucgugaagggcaugaaaaaccuccuuaauuccaccucucuugagacaagccuguccauugaagcccccuggggagcuaucaacguccagucuacguuuaagccuaccguuagcacagccaauauugcgcucuccuggucuagcguggagcacagagggaacaaaauccuggugaccggccgguccgaaagcauuaugaagcuggaggaacgcacaggggucucuugggaucugggaguggaggacgcuuccgagagcaaacuccugaccguuucuaucauggaucugucccaaauguacagcccgguguucgaauaucucucuggcgacagacaggucgaggaauggcccaaggccacaugcaccggggauuguccugagcggugcggauguacguccagcacaugccugcauaaggaguggccccacucccgcaauuggagauguaacccuacauggugcuggggcgugggcaccggguguacaugcuguggaguugacgugaaagaucuuuuuaccgaccauauguucgucaaguggaaaguggaauacaucaagacggaggccauugugugcgucgaacugacaucucaggagcggcaguguagccucaucgaagcuggcacccgcuuuaaucuggggcccguuacaauuacccuuuccgagccuagaaacauccaacagaaacugccgcccgagauuaucacccuccacccuaagauugaagagggauucuuugaucugaugcaugugcagaaggugcugagcgccucuacagucugcaaacuccaguccugcacgcacggcauccccggggaccugcaaguguaucacaucggaaaucuucugaagggcgaucggguuaacggccaucucauucacaaaaucgaaccucauuucaauaccagcuggaugucuugggacgggugugaucuggacuacuauugcaacaugggagacuggcccagcuguacauacaccggcgugacacagcacaaucacgcugccuuugucaaccuucugaauauugagaccgauuauacgaagacauuccauuuucacuccaaacgcgugaccgcgcauggggacaccccgcagcucgaucugaaggccagaccuacauacggagcuggcgaaaucaccguucugguggaggucgccgacauggagcuccacaccaaaaagguggaaauuucugggcugaaguucgcuagccuuacgugcaccggauguuacgccugcuccagcggcaucucuuguaaaguccggauccauguggaugagcccgacgaacugacaguucacgugaaguccagcgauccugacgucguggcggccggcaccucucucauggcucgcaaacuggaguuugggacagauuccaccuucaaggccuucagcgcuaugcccaaaacgucccuuugcuuuuauauuguugaaagagaguacuguaagucuugcagcgaggacgauacccagaaguguguggacacaaaacuggaacaaccccaguccauccucauugagcacaagggaaccaucauuggcaaacagaacgacacaugcaccgcccgggccucuugcuggcuggaaagcgucaaguccuucuuuuaugggcugaaaaacaugcucggaagcguguucggcaauuuucugaucgggauccuucuguuccucgcuccuuuugugcugcugguucuuuucuuuauguucggcuggaagauucucuuuuguuucaagugcugucgcagaacgcggggacuguuuaaauacagacaucugaaggaugacgaggagacaggcuaucgccggaucauugaaagacucaacucuaaaaaggggaaaaaucgccugcuugauggagagcggcuggcggacagaaagaucgccgaacucuucuccaccaagacacacauuggc

SEQ ID NO: 14091 - RNA, 1932 nt, Artificial Sequence
  derived and/or modified CDS sequence (opt5) from CCHFV(24-R-2012)__KR814856.1__Gc
uuccuggacagcaucgugaagggcaugaaaaaccuccuuaauuccaccucucuugagacaagccuguccauugaagcccccuggggagcuaucaacguccagucuacguuuaagccuaccguuagcacagccaauauugcgcucuccuggucuagcguggagcacagagggaacaaaauccuggugaccggccgguccgaaagcauuaugaagcuggaggaacgcacaggggucucuugggaucugggaguggaggacgcuuccgagagcaaacuccugaccguuucuaucauggaucugucccaaauguacagcccgguguucgaauaucucucuggcgacagacaggucgaggaauggcccaaggccacaugcaccggggauuguccugagcggugcggauguacguccagcacaugccugcauaaggaguggccccacucccgcaauuggagauguaacccuacauggugcuggggcgugggcaccggguguacaugcuguggaguugacgugaaagaucuuuuuaccgaccauauguucgucaaguggaaaguggaauacaucaagacggaggccauugugugcgucgaacugacaucucaggagcggcaguguagccucaucgaagcuggcacccgcuuuaaucuggggcccguuacaauuacccuuuccgagccuagaaacauccaacagaaacugccgcccgagauuaucacccuccacccuaagguggaagagggauucuuugaucugaugcaugugcagaagguccugagcgccucuacagugugcaaacuccaguccugcacgcacggcauucccggggaccugcaaguuuaucacaucggaaaucuucugaagggcgaucgggugaacggccaucucauccacaaaauugaaccucauuucaauaccagcuggaugucuugggacgggugugaucuggacuacuauugcaacaugggagacuggcccagcuguacauacaccggcgucacacagcacaaucacgcugccuuugugaaccuucugaauaucgagaccgauuauacgaagacauuccauuuucacuccaaacgcguuaccgcgcauggggacaccccgcagcucgaucugaaggccagaccuacauacggagcuggcgaaauuaccgugcuggucgagguggccgacauggagcuccacaccaaaaaggucgaaaucucugggcugaaguucgcuagccuugccugcacgggauguuacgcgugcuccagcggcauuucuuguaaagugcggauccauguugaugagcccgacgaacugaccgugcacgucaaguccaacgauccugacgugguugccgcuagcacaucucucauggcccgcaaacuggaguuuggcaccgauuccacauucaaggcuuucagcgccaugcccaaaaccucccuuugcuuuuauaucguggaaagagaguacuguaagucuugcagcgaggaagacacgcagaagugugucgauaccaaacuggagcaaccccaguccauucucaucgaacacaaggggacaauuaucggaaaacagaacgauaccugcacagccaaggcuucuugcuggcuggagagcgugaaauccuucuuuuauggccugaagaauaugcucgggagcguguucggaaacuuuuucauuggcauccugcuuuuucuggcgccuuucguucuccugguccuguuuuucauguuuggguggaagauccuuuucuguuuuaaaugcugucggcgcaccagaggccuccugaaguaccggcugcucaaagacgacgaggaaacgggauauagacgcauuaucgagcggcugaauaacaagaaaggcaagaauagacuucuggacggggaacgccucgccgaucggaagauugcugagcuguucucuacaaaaacccauaucgga

SEQ ID NO: 14092 - RNA, 1932 nt, Artificial Sequence
  derived and/or modified CDS sequence (opt5) from CCHFV(36-ST-2014)__KR814857.1__Gc
uuccuggacagcaucgugaagggcaugaaaaaccuccuuaauuccaccucucuugagacaagccuguccauugaagcccccuggggagcuaucaacguccagucuacguuuaagccuaccguuagcacagccaauauugcgcucuccuggucuagcguggagcacagagggaacaaaauccuggugaccggccgguccgaaagcauuaugaaacuugaggaacgcacaggggucucuugggaucugggaguggaggacgcuuccgagagcaagcuccugaccguuucuaucauggaucugucccaaauguacagcccgguguucgaauaucucucuggcgacagacaggucgaggaauggcccaaggccacaugcaccggggauuguccugagcggugcggauguacguccagcacaugccugcauaaggaguggccccacucccgcaauuggagauguaacccuacauggugcuggggcgugggcaccggguguacaugcuguggaguugacgugaaagaucuuuuuaccgaccauauguucaucaaguggaaagucgaauacauuaagacggaggccaucgugugcguggaacugacaucucaggagcggcaguguagccucauugaagcuggcacccgcuuuaaucuggggcccgucacaaucacccuuuccgagccuagaaacauucaacagaaacugccgcccgagaucauuacccuccacccuaagaucgaagagggauucuuugaucugaugcauguucagaaggugcugagcgccucuacagugugcaaacuccaguccugcacgcacggcauccccggggaccugcaaauuuaucacaucggaaaucuucugaagggcgaucggcucaacggccaucugauucacaaaaucgaaccucauuucaauaccagcuggaugucuugggacgggugugaucuugacuacuauugcaacaugggagacuggcccagcuguacauacaccggcgucacacagcacaaucacgcugccuuugugaaccugcucaauauugagaccgauuauacgaagacauuccauuuucacuccaaacgcguuaccgcgcauggggacaccccgcagcuggaucugaaggccagaccuacauacggagcuggcgaaaucaccgugcucgucgagguggccgacauggagcugcacaccaaaaagguugaaaucucugggcuuaaguucgcuagccuggccugcacgggauguuacgcgugcuccagcggcauuucuuguaaagugcggauccaugucgaugagcccgacgaacucaccgugcacgucaaguccagcgauccugacgugguugccgcuucuacaucccugauggcccgcaaacuugaguuuggcaccgauagcacauucaaggcuuucuccgccaugcccaaaaccucucugugcuuuuauauuguggaaagagaguacuguaagagcugcuccgaggacgauacgaagaaaugugucgacaccaagcucgaccagccccaaucuauccugauugaacacaaagggacaaucaucggaaagcagaacgauaccugcacagccaaagcuagcugcuggcuggaguccguuaagagcuucuuuuauggccucaagaacaugcuggggucuguguucggaaauuucuucgugggcauucuucuguuucucgcgccuuucguccugcuggugcuguuuuucauguguggguggaaauuucucuucugcuuuaaguguugccggcgcaccagaggccuguucaaauaccggcaucugaaggacgaugaagagacgggauauagacgcaucauugagcggcucaacuccaaaaagggcaagaauagacugcuugacggggaacgccuggccgaucggaaaaucgcugagcucuuuagcacaaagucucacauugga

SEQ ID NO: 14093 - RNA, 1932 nt, Artificial Sequence
  derived and/or modified CDS sequence (opt5) from CCHFV(37-R-2013)__KR814858.1__Gc
uuccuggacagcaucgugaagggcaugaaaaaccuccuuaauuccaccucucuugagacaagccuguccauugaagcccccuggggagcuaucaacguccagucuacguuuaagccuaccguuagcacagccaauauugcgcucuccuggucuagcguggagcacagagggaacaaaauccuggugaccggccgguccgaaagcauuaugaagcuggaggaacgcacaggggucucuugggaucugggaguggacgaugcuuccgagagcaaacuccugaccguuucuaucauggaccugucccaaauguacagcccgguguucgaguaucucucuggcgauagacaggucgaagaguggcccaaggccacaugcaccggggacuguccugaacggugcggauguacguccagcacaugccugcauaaggaguggccccacucccgcaauuggagauguaacccuacauggugcuggggcgugggcaccggguguacaugcuguggaguugaugugaaagaccuuuuuaccgaucauauguucgucaaguggaaaguggaguacaucaagacggaagccauugugugcgucgagcugacaucucaggaacggcaguguagccucaucgaggcuggcacccgcuuuaaucuggggcccguuacaauuacccuuuccgaaccuagaaacauccaacagaaacugccgcccgagauuaucacccuccacccuaagguggaggaaggauucuuugaccugaugcaugugcagaagguccugagcgccucuacagugugcaaacuccaguccugcacgcacggcauucccggggaucugcaaguuuaucacaucggaaaucuucugaagggcgaccgggugaacggccaucucauccacaaaauugagccucauuucaauaccagcuggaugucuugggaugggugugaccuggacuacuauugcaacaugggagauuggcccagcuguacauacaccggcgucacacagcacaaucacgcugccuuugugaaccuucugaauaucgaaaccgacuauacgaagacauuccauuuucacuccaaacgcguuaccgcgcauggggauaccccgcagcucgaccugaaggccagaccuacauacggagcuggcgagauuaccgugcuggucgaaguggccgauauggagcuccacaccaaaaaggucgagaucucugggcugaaguucgcuagccuugccugcacgggauguuacgcgugcuccagcggcauuucuuguaaagugcggauccauguugacgaacccgaugagcugaccgugcacgucaaguccaacgacccugaugugguugccgcuagcacaucucucauggcccgcaaacuggaauuuggcaccgacuccacauucaaggcuuucagcgccaugcccaaaaccucccuuugcuuuuauaucguggagagagaauacuguaagucuugcagcgaggaggauacgcagaagugugucgacaccaaacuggaacaaccccaguccauucucaucgagcacaaggggacaauuaucggaaaacagaacgugaccugcacagccaaggcuucuugcuggcuggaaagcgugaaauccuucuuuuauggccugaagaauaugcucgggagcguuuucggaaacuuuuucauuggcauccugcuuuuucuggcgccuuucguccuccuggugcuguuuuucauguuuggguggaagauccuuuucuguuuuaaaugcugucggcgcaccagaggccuccugaaguaccggcugcucaaagacgaugaggagacgggauauagacgcauuaucgaacggcugaauaacaagaaaggcaagaauagacuucuggacggggagcgccucgccgaucggaagauugcugaacuguucucuacaaaaacccauaucgga

SEQ ID NO: 14094 - RNA, 1932 nt, Artificial Sequence
  derived and/or modified CDS sequence (opt5) from CCHFV(44-ST-2010)__KR814859.1__Gc
uuccuggacagcaucgugaagggcaugaaaaaccuccuuaauuccaccucucuugagacaagccuguccauugaagcccccuggggagcuaucaacguccagucuacguuuaagccuaccguuagcacagccaauauugcgcucuccuggucuagcguggagcacagagggaacaaaauccuggugaccggccgguccgaaagcauuaugaaacuugaggaacgcacaggggucucuugggaucugggaguggaggacgcuuccgagagcaagcuccugaccguuucuaucauggaucugucccaaauguacagcccgguguucgaauaucucucuggcgacagacaggucgaggaauggcccaaggccacaugcaccggggauuguccugagcggugcggauguacguccagcacaugccugcauaaggaguggccccacucccgcaauuggagauguaacccuacauggugcuggggcgugggcaccggguguacaugcuguggaguugacgugaaagaucuuuuuaccgaccauauguucaucaaguggaaagucgaauacauuaagacggaggccaucgugugcguggaacugacaucucaggagcggcaguguagccucauugaagcuggcacccgcuuuaaucuggggcccgucacaaucacccuuuccgagccuagaaacauucaacagaaacugccgcccgagaucauuacccuccacccuaagaucgaagagggauucuuugaucugaugcauguucagaaggugcugagcgccucuacagugugcaaacuccaguccugcacgcacggcauccccggggaccugcaaauuuaucacaucggaaaucuucugaagggcgaucggcucaacggccaucugauucacaaaaucgaaccucauuucaauaccagcuggaugucuugggacgggugugaucuugacuacuauugcaacaugggagacuggcccagcuguacauacaccggcgucacacagcacaaucacgcugccuuugugaaccugcucaauauugagaccgauuauacgaagacauuccauuuucacuccaaacgcguuaccgcgcauggggacaccccgcagcuggaucugaaggccagaccuacauacggagcuggcgaaaucaccgugcucgucgagguggccgacauggagcugcacaccaaaaagguugaaaucucugggcuuaaguucgcuagccuggccugcacgggauguuacgcgugcuccagcggcauuucuuguaaagugcggauccaugucgaugagcccgacgaacucaccgugcacgucaaguccagcgauccugacgugguugccgcuucuacaucccugauggcccgcaaacuugaguuuggcaccgauagcacauucaaggcuuucuccgccaugcccaaaaccucucugugcuuuuauauuguggaaagagaguacuguaagagcugcuccgaggacgauacgaagaaaugugucgacaccaagcucgaccagccccaaucuauccugauugaacacaaagggacaaucaucggaaagcagaacgauaccugcacagccaaagcuagcugcuggcuggaguccguuaagagcuucuuuuauggccucaagaacaugcuggggucuguguucggaaauuucuucgugggcauucuucuguuucucgcgccuuucguccugcuggugcuguuuuucauguguggguggaaaauccucuuuugcuucaaguguugccggcgcaccagaggccuguuuaaauaccggcaucugaaggacgaugaagagacgggauauagacgcauuaucgagcggcucaacuccaaaaagggcaagaauagacugcuugacggggaacgccuggccgaucggaaaauugcugagcucuuuagcacaaagucucacaucgga

SEQ ID NO: 14095 - RNA, 1932 nt, Artificial Sequence
  derived and/or modified CDS sequence (opt5) from CCHFV(46-ST-2012)__KR814860.1__Gc
uuccuggacagcaucgugaagggcaugaaaaaccuccuuaauuccaccucucuugagacaagccuguccauugaagcccccuggggagcuaucaacguccagucuacguuuaagccuaccguuagcacagccaauauugcgcucuccuggucuagcguggagcacagagggaacaaaauccuggugaccggccgguccgaaagcauuaugaagcuggaggaacgcacaggggucucuugggaucugggaguggaggacgcuuccgagagcaaacuccugaccguuucuaucauggaucugucccaaauguacagcccgguguucgaauaucucucuggcgacagacaggucgaggaauggcccaaggccacaugcaccggggauuguccugagcggugcggauguacguccagcacaugccugcauaaggaguggccccacucccgcaauuggagauguaacccuacauggugcuggggcgugggcaccggguguacaugcuguggaguugacgugaaagaucuuuuuaccgaccauauguucgucaaguggaaaguggaauacaucaagacggaggccauugugugcgucgaacugacaucucaggagcggcaguguagccucaucgaagcuggcacccgcuuuaaucuggggcccguuacaauuacccuuuccgagccuagaaacauccaacagaaacugccgcccgagauuaucacccuccacccuaagguggaagagggauucuuugaucugaugcaugugcagaagguccugagcgccucuacagugugcaaacuccaguccugcacgcacggcauucccggggaccugcaaguuuaucacaucggaaaucuucugaagggcgaucggaucaacggccaucucauucacaaaaucgaaccucauuucaauaccagcuggaugucuugggacgggugugaucuggacuacuauugcaacaugggagacuggcccagcuguacauacaccggcgugacacagcacaaucacgcugccuuugucaaccuucugaauauugagaccgauuauacgaagacauuccauuuucacuccaaacgcgugaccgcgcauggggacaccccgcagcucgaucugaaggccagaccuacauacggagcuggcgaaaucaccguucugguggaggucgccgacauggagcuccacaccaaaaagguggaaauuucugggcugaaguucgcuagccuugccugcacgggauguuacgcgugcuccagcggcaucucuuguaaaguccggauccauguggaugagcccgacgaacugaccguucacgugaaguccagcgauccugacgucguggccgcuucuacaucccucauggcccgcaaacuggaguuuggcaccgauagcacauucaaggcuuucuccgccaugcccaaaaccucucuuugcuuuuauauuguugaaagagaguacuguaagagcugcuccgaggaagacacgcagaaguguguggauacccggcuggagcaaccccagucuauccucauugaacacaaagggacaaucauuggaaagcagaacgauaccugcacagccaaagcuagcugcuggcuggaguccgucaagagcuucuuuuauggccugaaaaacaugcucgggucuguguucggaaauuucuucaucggcauccugcuuuuucuggcgccuuucgugcuccugguucuguuuuucauguuuggguggaagauucuuuucuguuuuaagugcugucgcagaacccggggccuccugaaauacagacaucugaaggacgacgaggaaacgggauaucgccggaucauugagagacucaacaauaaaaagggcaaaaaccgccugcuugacggggaacggcuggccgauagaaagaucgcugagcucuuuuccacaaagacccacauugga

SEQ ID NO: 14096 - RNA, 1932 nt, Artificial Sequence
  derived and/or modified CDS sequence (opt5) from CCHFV(47-ST-2013)__KR814861.1__Gc
uuccuggacagcaucgugaagggcaugaaaaaccuccuuaauuccaccucucuugagacaagccuguccauugaagcccccuggggagcuaucaacguccagucuacguuuaagccuaccguuagcacagccaauauugcgcucuccuggucuagcguggagcacagagggaacaaaauccuggugaccggccgguccgaaagcauuaugaagcuggaggaacgcacaggggucucuugggaucugggaguggaggacgcuuccgagagcaaacuccugaccguuucuaucauggaucugucccaaauguacagcccgguguucgaauaucucucuggcgacagacaggucgaggaauggcccaaggccacaugcaccggggaguguccugagcggugcggauguacguccagcacaugccugcauaaggaauggccccacucccgcaauuggagauguaacccuacauggugcuggggcgugggcaccggguguacaugcuguggaguugaugugaaagaccuuuuuaccgaucauauguucaucaaguggaaagucgaguacauuaagacggaagccaucgugugcguggagcugacaucucaggaacggcaguguagccucauugaggcuggcacccgcuuuaaucuggggcccgucacaaucacccuuuccgagccuagaaacauucaacagaaacugccgcccgaaaucauuacccuccacccuaagaucgaggaaggauucuuugaccugaugcauguucagaaggugcugagcgccucuacagugugcaaacuccaguccugcacgcacggcauccccggggaucugcaaauuuaucacaucggaaaucuucugaagggcgaccgggucaacggccaucucauucacaaaaucgagccucauuucaauaccagcuggaugucuugggaugggugugaccuggauuacuauugcaacaugggagacuggcccagcuguacauacaccggcgugacacagcacaaucacgcugccuuuguuaaccuucugaauauugaaaccgacuauacgaagacauuccauuuucacuccaaacgcgugaccgcgcauggggauaccccgcagcucgaccugaaggccagaccuacauacggagcuggcgagaucaccguccugguggagguugccgauauggaacuccacaccaaaaagguggaggucucugggcugaaguucgcuagccuugccugcacgggauguuacgcgugcuccagcggcaucucuuguaaagugcggauucaugucgacgaacccgaugagcugaccgugcacguuaaguccagcgacccugauguggucgccgcuucuacaucccucauggcccgcaaacuggaauuuggcaccgacagcacauucaaggcuuucuccgccaugcccaaaaccucucuuugcuuuuauaucguggagagagaguacuguaagagcugcuccgaagaugacacgaagaaauguguugauaccaagcuggagcagccccaaucuauucucaucgaacacaaagggacaauuaucggaaagcagaacgauaccugcacagccaaagcuagcugcuggcuggaguccgucaagagcuucuuuuauggccugaagaacaugcucgggucuguguucggaaauuucuuugugggcauccugcuuuuucuggcgccuuucgugcuccugguucuguuuuucauguuuggguggaaaauucuuuucuguuuuaagugcugucggcgcaccagaggccucuucaaauaccggcaucugaaggacgacgaggaaacgggauauagacgcaucauugagcggcugaacuccaaaaagggcaagaauagacuccuggacggggaacgccuugccgaucggaaaaucgcugagcuguucagcacaaagacccacauugga

SEQ ID NO: 14097 - RNA, 1932 nt, Artificial Sequence
  derived and/or modified CDS sequence (opt5) from CCHFV(52-R-2014)__KR814862.1__Gc
uuccuggacagcaucgugaagggcaugaaaaaccuccuuaauuccaccucucuugagacaagccuguccauugaagcccccuggggagcuaucaacguccagucuacguuuaagccuaccguuagcacagccaauauugcgcucuccuggucuagcguggagcacagagggaacaaaauccuggugaccggccgguccgaaagcauuaugaagcuggaggaacgcacaggggucucuugggaucugggaguggacgaugcuuccgagagcaaacuccugaccguuucuaucauggaccugucccaaauguacagcccgguguucgaguaucucucuggcgauagacaggucgaagaguggcccaaggccacaugcaccggggacuguccugaacggugcggauguacguccagcacaugccugcauaaggaguggccccacucccgcaauuggagauguaacccuacauggugcuggggcgugggcaccggguguacaugcuguggaguugaugugaaagaccuuuuuaccgaucauauguucgucaaguggaaaguggaguacaucaagacggaagccauugugugcgucgagcugacaucucaggaacggcaguguagccucaucgaggcuggcacccgcuuuaaucuggggcccguuacaauuacccuuuccgaaccuagaaacauccaacagaaacugccgcccgagauuaucacccuccacccuaagguggaggaaggauucuuugaccugaugcaugugcagaagguccugagcgccucuacagugugcaaacuccaguccugcacgcacggcauucccggggaucugcaaguuuaucacaucggaaaucuucugaagggcgaccgggugaacggccaucucauccacaaaauugagccucauuucaauaccagcuggaugucuugggaugggugugaccuggacuacuauugcaacaugggagauuggcccagcuguacauacaccggcgucacacagcacaaucacgcugccuuugugaaccuucugaauaucgaaaccgacuauacgaagacauuccauuuucacuccaaacgcguuaccgcgcauggggauaccccgcagcucgaccugaaggccagaccuacauacggagcuggcgagauuaccgugcuggucgaaguggccgauauggagcuccacaccaaaaaggucgagaucucugggcugaaguucgcuagccuugccugcacgggauguuacgcgugcuccagcggcauuucuuguaaagugcggauccauguugacgaacccgaugagcugaccgugcacgucaaguccaacgacccugaugugguugccgcuagcacaucucucauggcccgcaaacuggaauuuggcaccgacuccacauucaaggcuuucagcgccaugcccaaaaccucccuuugcuuuuauaucguggagagagaauacuguaagucuugcagcgaggaggauacgcagaagugugucgacaccaaacuggaacaaccccaguccauucucaucgagcacaaggggacaauuaucggaaaacagaacgauaccugcacagccaaggcuggcugcuggcuggaaucugugaaauccuucuuuuaugggcugaagaauaugcucggaagcguguucggcaacuuuuucauugggauccugcuuuuucuggcgccuuucguucuccugguccuguuuuucauguuuggcuggaagauccuuuucuguuuuaaaugcugucggcgcaccagaggacuccugaaguaccggcugcucaaagacgacgaggagacgggcuauagacgcauuaucgaacggcugaauaacaagaaagggaagaauagacuucuggauggagagcgccucgccgaccggaagauugcugaacuguucagcacaaaaacccauaucggc

SEQ ID NO: 14098 - RNA, 1932 nt, Artificial Sequence
  derived and/or modified CDS sequence (opt5) from CCHFV(75-R-2012)__KR814863.1__Gc
uuccuggacagcaucgugaagggcaugaaaaaccuccuuaauuccaccucucuugagacaagccuguccauugaagcccccuggggagcuaucaacguccagucuacguuuaagccuaccguuagcacagccaauauugcgcucuccuggucuagcguggagcacagagggaacaaaauccuggugaccggccgguccgaaagcauuaugaagcuggaggaacgcacaggggucucuugggaucugggaguggaggacgcuuccgagagcaaacuccugaccguuucuaucauggaucugucccaaauguacagcccgguguucgaauaucucucuggcgacagacaggucgaggaauggcccaaggccacaugcaccggggauuguccugagcggugcggauguacguccagcacaugccugcauaaggaguggccccacucccgcaauuggagauguaacccuacauggugcuggggcgugggcaccggguguacaugcuguggaguugacgugaaagaucuuuuuaccgaccauauguucgucaaguggaaaguggaauacaucaagacggaggccauugugugcgucgaacugacaucucaggagcggcaguguagccucaucgaagcuggcacccgcuuuaaucuggggcccguuacaauuacccuuuccgagccuagaaacauccaacagaaacugccgcccgagauuaucacccuccacccuaagguggaagagggauucuuugaucugaugcaugugcagaagguccugagcgccucuacagugugcaaacuccaguccugcacgcacggcauucccggggaccugcaaguuuaucacaucggaaaucuucugaagggcgaucgggugaacggccaucucauccacaaaauugaaccucauuucaauaccagcuggaugucuugggacgggugugaucuggacuacuauugcaacaugggagacuggcccagcuguacauacaccggcgucacacagcacaaucacgcugccuuugugaaccuucugaauaucgagaccgauuauacgaagacauuccauuuucacuccaaacgcguuaccgcgcauggggacaccccgcagcucgaucugaaggccagaccuacauacggagcuggcgaaauuaccgugcuggucgagguggccgacauggagcuccacaccaaaaaggucgaaaucucugggcugaaguucgcuagccuugccugcacgggauguuacgcgugcuccagcggcauuucuuguaaagugcggauccauguugaugagcccgacgaacugaccgugcacgucaaguccagcgauccugacgugguugccgcuucuacaucccucauggcccgcaaacuggaguuuggcaccgauagcacauucaaggcuuucuccgccaugcccaaaaccucucuuugcuuuuauaucguggaaagagaguacuguaagagcugcuccgaggaagacacgcagaagugugucgauaccaaacuggagcaaccccagucuauucucaucgaacacaaggggacaauuaucggaaaacagaacgauaccugcacagccaaggcuagcugcuggcuggaguccgugaaaucuuuccuguauggccucaagaacaugcuggggagcguguuuggaaauuucuuuauuggcauccuucuguuccucgcgccuuuuguucugcugguccuuuucuuuauguucggguggaagauccucuuuuguuucaaaugcugucggcgcaccagaggccugcugaaguaccggcuccugaaagacgacgaggaaacgggauauagacgcauuaucgagcggcuuaacaauaagaaaggcaagaacagacugcucgacggggaacgccuggccgaucggaagauugcugagcuguuuuccacaaaaacccauaucgga

SEQ ID NO: 14099 - RNA, 1932 nt, Artificial Sequence
  derived and/or modified CDS sequence (opt5) from CCHFV(75-ST-2010)__KR814864.1__Gc
uuccuggacagcaucgugaagggcaugaaaaaccuccugaauagcaccucucuugagacaagccuguccauugaagcccccuggggagcuaucaacguccagucuacguuuaagccuaccguuagcacagccaauauugcgcucuccuggucuagcguggagcacagagggaacaaaauccuggugaccggccgguccgaaagcauuaugaagcucgaggaacgcacaggggucucuugggaucugggaguggaggacgcuuccgagagcaaacuccugaccguuucuaucauggaucugucccaaauguacagcccgguguucgaauaucucucuggcgacagacaggucgaggaauggcccaaggccacaugcaccggggauuguccugagcggugcggauguacguccagcacaugccugcauaaggaguggccccacucccgcaauuggagauguaacccuacauggugcuggggcgugggcaccggguguacaugcuguggaguugacgugaaagaucuuuuuaccgaccauauguucgucaaguggaaaguggaauacaucaagacggaggccauugugugcgucgaacugacaucucaggagcggcaguguagccucaucgaagcuggcacccgcuuuaaucuggggcccguuacaauuacccuuuccgagccuagaaacauccaacagaaacugccgcccgagauuaucacccuccacccuaagguggaagagggauucuuugaucugaugcaugugcagaagguccugagcgccucuacagugugcaaacuccaguccugcacgcacggcauucccggggaccugcaaguuuaucacaucggaaaucuucugaagggcgaucgggugaacggccaucucauccacaaaauugaaccucauuucaauaccagcuggaugucuugggacgggugugaucuggacuacuauugcaacaugggagacuggcccagcuguacauacaccggcgucacacagcacaaucacgcugccuuugugaaccuucugaauaucgagaccgauuauacgaagacauuccauuuucacuccaaacgcguuaccgcgcauggggacaccccgcagcucgaucugaaggccagaccuacauacggagcuggcgaaauuaccgugcuggucgagguggccgacauggagcuccacaccaaaaaggucgaaaucucugggcugaaguucgcuagccuugccugcacgggauguuacgcgugcuccagcggcauuucuuguaaagugcggauccauguugaugagcccgacgaacugaccgugcacgucaaguccagcgauccugacgugguugccgcuucuacaucccucauggcccgcaaacuggaguuuggcaccgauagcacauucaaggcuuucuccgccaugcccaaaaccucucuuugcuuuuauaucguggaaagagaguacuguaagagcugcuccgaggaagacacgcagaagugugucgauaccaaacuggagcaaccccagucuauucucaucgaacacaaggggacaauuaucggaaaacagaacgauaccugcacagccaaggcuagcugcuggcuggaguccgugaaauccuucuuuuauggccugaagaacaugcucgggucuguguucggaaacuuuuucauuggcauccugcuuuuucuggcgccuuucguucuccugguccuguuuuucauguuuggguggaagauccuuuucuguuuuaaaugcugucggcgcgccagaggccuccugaaguaccggcaucugaaagacgacgaggaaaccggauauagaaagauuaucgagcgccucaauaauaaaaagggcaagaaccggcugcuugacggggaaagacuggcugaucgcaaaauugccgagcuuuucuccacgaagacacacaucgga

SEQ ID NO: 14100 - RNA, 1932 nt, Artificial Sequence
  derived and/or modified CDS sequence (opt5) from CCHFV(3756-ST-2007)__KR814866.1__Gc
uuccuggacagcaucgugaagggcaugaaaaaccuccuuaauuccaccucucuugagacaagccuguccauugaagcccccuggggagcuaucaacguccagucuacguuuaagccuaccguuagcacagccaauauugcgcucuccuggucuagcguggagcacagagggaacaaaauccuggugaccggccgguccgaaagcauuaugaagcuggaggaacgcacaggggucucuugggaucugggaguggaggacgcuuccgagagcaaacuccugaccguuucuaucauggaucugucccaaauguacagcccgguguucgaauaucucucuggcgacagacaggucgaggaauggcccaaggccacaugcaccggggauuguccugagcggugcggauguacguccagcacaugccugcauaaggaguggccccacucccgcaauuggagauguaacccuacauggugcuggggcgugggcaccggguguacaugcuguggaguugacgugaaagaucuuuuuaccgaccauauguucaucaaguggaaagucgaauacauuaagacggaggccaucgugugcguggaacugacaucucaggagcggcaguguagccucauugaagcuggcacccgcuuuaaucuggggcccgucacaaucacccuuuccgagccuagaaacauucaacagaaacugccgcccgagaucauuacccuccacccuaagaucgaagagggauucuuugaucugaugcauguucagaaggugcugagcgccucuacagugugcaaacuccaguccugcacgcacggcauccccggggaccugcaaauuuaucacaucggaaaucuucugaagggcgaucgggucaacggccaucucauucacaaaaucgaaccucauuucaauaccagcuggaugucuugggacgggugugaucuggacuacuauugcaacaugggagacuggcccagcuguacauacaccggcgugacacagcacaaucacgcugccuuuguuaaccuucugaauauugagaccgauuauacgaagacauuccauuuucacuccaaacgcgugaccgcgcauggggacaccccgcagcucgaucugaaggccagaccuacauacggagcuggcgaaaucaccguccugguggagguugccgacauggagcuccacaccaaaaagguggaaaucucugggcugaaguucgcuagccuuacgugcaccggauguuacgccugcuccagcggcauuucuuguaaaguccggauccauguggaugagcccgacgaacugacaguccacgugaaguccagcgauccugacguuguggcggccucuaccucccucauggcucgcaaacuggaguuuggcacagauagcaccuucaaggccuucuccgcuaugcccaaaacgucucuuugcuuuuauauugucgaaagagaguacuguaagagcugcuccgaggacgauaccaagaaauguguggacacaaagcuggaacagccccaaucuauccucauugagcacaaagggaccaucaucggaaagcagaacgacacaugcaccgccaaagccagcugcuggcuggaauccguuaagagcuucuuuuauggccugaagaacaugcucgggucuguguucggauccuuuuucgucggcauucugcuuuuucugacgccuuucgugcuccuggugcuguuuuucauguuuggguggaaaauccuuuucuguuuuaagugcugucggcgcacaagaggccucuucaaauaccggcaucugaaggaugacgaggagaccggauauagacgcauuaucgaacggcugaauagcaaaaagggcaagaacagacuccuggauggggagcgccuugcugaccggaaaauugcggaacuguucucuacaaagacccacaucgga

SEQ ID NO: 14101 - RNA, 1932 nt, Artificial Sequence
  derived and/or modified CDS sequence (opt5) from CCHFV(3809-ST-2007)__KR814867.1__Gc
uuccuggacagcaucgugaagggcaugaaaaaccuccugaauagcaccucucuugagacaagccuguccauugaagcccccuggggagcuaucaacguccagucuacguuuaagccuaccguuagcacagccaauauugcgcucuccuggucuagcguggagcacagagggaacaaaauccuggugaccggccgguccgaaagcauuaugaagcucgaggaacgcacaggggucucuugggaucugggaguggaggacgcuuccgagagcaaacuccugaccguuucuaucauggaucugucccaaauguacagcccgguguucgaauaucucucuggcgacagacaggucgaggaauggcccaaggccacaugcaccggggauuguccugagcggugcggauguacguccagcacaugccugcauaaggaguggccccacucccgcaauuggagauguaacccuacauggugcuggggcgugggcaccggguguacaugcuguggaguugacgugaaagaucuuuuuaccgaccauauguucgucaaguggaaaguggaauacaucaagacggaggccauugugugcgucgaacugacaucucaggagcggcaguguagccucaucgaagcuggcacccgcuuuaaucuggggcccguuacaauuacccuuuccgagccuagaaacauccaacagaaacugccgcccgagauuaucacccuccacccuaagguggaagagggauucuuugaucugaugcaugugcagaagguccugagcgccucuacagugugcaaacuccaguccugcacgcacggcauucccggggaccugcaaguuuaucacaucggaaaucuucugaagggcgaucgggugaacggccaucucauccacaaaauugaaccucauuucaauaccagcuggaugucuugggacgggugugaucuggacuacuauugcaacaugggagacuggcccagcuguacauacaccggcgucacacagcacaaucacgcugccuuugugaaccuucugaauaucgagaccgauuauacgaagacauuccauuuucacuccaaacgcguuaccgcgcauggggacaccccgcagcucgaucugaaggccagaccuacauacggagcuggcgaaauuaccgugcuggucgagguggccgacauggagcuccacaccaaaaaggucgaaaucucugggcugaaguucgcuagccuugccugcacgggauguuacgcgugcuccagcggcauuucuuguaaagugcggauccauguugaugagcccgacgaacugaccgugcacgucaaguccagcgauccugacgugguugccgcuucuacaucccucauggcccgcaaacuggaguuuggcaccgauagcacauucaaggcuuucuccgccaugcccaaaaccucucuuugcuuuuauaucguggaaaaggaguacuguagaagcugcuccgaggaagacacgcagaagugugucgauaccaaacuggagcaaccccagucuauucucaucgaacacaaggggacaauuaucggaaaacagaacgauaccugcacagccaaggcuagcugcuggcuggaguccgugaaauccuucuuuuauggccugaagaacaugcucgggucuguguucggaaacuuuuucauuggcauccugcuuuuucugaccccuuucguucuccugguccuguuuuucauguuuggguggaagauccuuuucuguuuuaaaugcugucggcgcacgagaggccuccugaaguaccggcaucugaaagacgacgaggaaacaggauauagacgcauuaucgagcggcucaauaauaagaaaggcaagaacagacugcuugacggggaacgccuggcggaucggaagauugccgagcuuuucuccaccaaaacacacaucgga

SEQ ID NO: 14102 - RNA, 1932 nt, Artificial Sequence
  derived and/or modified CDS sequence (opt5) from CCHFV(3820-ST-2007)__KR814868.1__Gc
uuccuggacagcaucgugaagggcaugaaaaaccuccuuaauuccaccucucuugagacaagccuguccauugaagcccccuggggagcuaucaacguccagucuacguuuaagccuaccguuagcacagccaauauugcgcucuccuggucuagcguggagcacagagggaacaaaauccuggugaccggccgguccgaaagcauuaugaagcuggaggaacgcacaggggucucuugggaucugggaguggaggacgcuuccgagagcaaacuccugaccguuucuaucauggaucugucccaaauguacagcccgguguucgaauaucucucuggcgacagacaggucgaggaauggcccaaggccacaugcaccggggauuguccugagcggugcggauguacguccagcacaugccugcauaaggaguggccccacucccgcaauuggagauguaacccuacauggugcuggggcgugggcaccggguguacaugcuguggaguugacgugaaagaucuuuuuaccgaccauauguucaucaaguggaaagucgaauacauuaagacggaggccaucgugugcguggaacugacaucucaggagcggcaguguagccucauugaagcuggcacccgcuuuaaucuggggcccgucacaaucacccuuuccgagccuagaaacauucaacagaaacugccgcccgagaucauuacccuccacccuaagaucgaagagggauucuuugaucugaugcauguucagaaggugcugagcgccucuacagugugcaaacuccaguccugcacgcacggcauccccggggaccugcaaauuuaucacaucggaaaucuucugaagggcgaucgggucaacggccaucucauucacaaaaucgaaccucauuucaauaccagcuggaugucuugggacgggugugaucuggacuacuauugcaacaugggagacuggcccagcuguacauacaccggcgugacacagcacaaucacgcugccuuuguuaaccuucugaauauugagaccgauuauacgaagacauuccauuuucacuccaaacgcgugaccgcgcauggggacaccccgcagcucgaucugaaggccagaccuacauacggagcuggcgaaaucaccguccugguggagguugccgacauggagcuccacaccaaaaagguggaaaucucugggcugaaguucgcuagccuuacgugcaccggauguuacgccugcuccagcggcauuucuuguaaaguccggauccauguggaugagcccgacgaacugacaguccacgugaaguccagcgauccugacguuguggcggccucuaccucccucauggcucgcaaacuggaguuuggcacagauagcaccuucaaggccuucuccgcuaugcccaaaacgucucuuugcuuuuauauugucgaaagagaguacuguaagagcugcuccgaggacgauaccaagaaauguguggacacaaagcuggaacagccccaaucuauccucauugagcacaaagggaccaucaucggaaagcagaacgacacaugcaccgccaaagccagcugcuggcuggaauccguuaagagcuucuuuuauggccugaagaacaugcucgggucuguguucggauccuuuuucgucggcauucugcuuuuucuggcuccuuucgugcuccuggugcuguuuuucauguuuggguggaaaauccuuuucuguuuuaagugcugucggcgcacgagaggccucuucaaauaccggcaucugaaggaugacgaggagacaggauauagacgcauuaucgaacggcugaauagcaaaaagggcaagaacagacuccuggauggggagcgccuugcggaccggaaaauugccgaacuguucucuaccaagacacacaucgga

SEQ ID NO: 14103 - RNA, 1932 nt, Artificial Sequence
  derived and/or modified CDS sequence (opt5) from CCHFV(4495-ST-2008)__KR814869.1__Gc
uuccuggacagcaucgugaagggcaugaaaaaccuccuuaauuccaccucucuugagacaagccuguccauugaagcccccuggggagcuaucaacguccagucuacguuuaagccuaccguuagcacagccaauauugcgcucuccuggucuagcguggagcacagagggaacaaaauccuggugaccggccgguccgaaagcauuaugaagcuggaggaacgcacagggaucucuugggaucugggagucgaggacgcuuccgagagcaaacuccugaccgugucuaucauggaucugucccaaauguacagcccgguuuucgaauaucucucuggcgacagacagguggaggaauggcccaaggccacaugcaccggggauuguccugagcggugcggauguacguccagcacaugccugcauaaggaguggccccacucccgcaauuggagauguaacccuacauggugcuggggcgucggcaccggguguacaugcuguggaguggacguuaaagaucuuuuuaccgaccauauguucgugaaguggaaagucgaauacauuaagacggaggccaucgugugcguggaacugacaucucaggagcggcaguguagccucauugaagcuggcacccgcuuuaaucuggggcccgucacaaucacccuuuccgagccuagaaacauucaacagaaacugccgcccgagaucauuacccuccacccuaagguugaagagggauucuuugaucugaugcaugugcagaaggugcugagcgccucuacagucugcaaacuccaguccugcacgcacggcauccccggggaccugcaaguguaucacaucggaaaucuucugaagggcgaucggguuaacggccaucucauucacaaaaucgaaccucauuucaauaccagcuggaugucuugggacgggugugaucuggacuacuauugcaacaugggagacuggcccagcuguacauacaccggcgugacacagcacaaucacgcugccuuugucaaccuucugaauauugagaccgauuauacgaagacauuccauuuucacuccaaacgcgugaccgcgcauggggacaccccgcagcucgaucugaaggccagaccuacauacggagcuggcgaaaucaccguucugguggaggucgccgacauggagcuccacaccaaaaagguggaaauuucugggcugaaguucgcuagccuugccugcacgggauguuacgcgugcuccagcggcaucucuuguaaaguccggauccauguggaugagcccgacgaacugaccguucacgugaaguccagcgauccugacgucguggccgcuucuacaucccucauggcccgcaaacuggaguuuggcaccgauagcacauucaaggcuuucuccgccaugcccaaaaccucucuuugcuuuuauauuguugaaagagaguacuguaagagcugcuccgaggaagacacgcagcgguguguggauaccaagcuggagcaaccccagucuauccucauugaacacaaagggacaaucauuggaaagcagaacgauaccugcacagccaaagcuagcugcuggcuggaguccgucaagagcuucuuuuauggccugaaaaacaugcucgggucuguguucggaaauuucuucaucggcauccugcuuuuucuggcgccuuucgugcuccugguucuguuuuucauguuuggguggaagauucuuuucuguuuuaagugcugucgcagagcccggggccuccugaaauacagacaucugaaggacgacgaggaaaccggauaucgcaaaaucauugagcggcucaacaauaagaaaggcaagaacagacugcuugacggggaacgccuggcugaucggaagaucgccgagcucuuuuccacgaaaacacacauugga

SEQ ID NO: 14104 - RNA, 1932 nt, Artificial Sequence
  derived and/or modified CDS sequence (opt5) from CCHFV(4691-ST-2009)__KR814871.1__Gc
uuccuggacagcaucgugaagggcaugaaaaaccuccuuaauuccaccucucuugagacaagccuguccauugaagcccccuggggagcuaucaacguccagucuacguuuaagccugccguuagcaccgcgaauauugcucucuccuggucuagcguggagcacagagggaacaaaauccuggugacaggccgguccgaaagcauuaugaagcuggaggaacgcaccggggucucuugggaucugggaguggaggacgccuccgagagcaaacuccugacaguuucuaucauggaucugucccaaauguacagcccgguguucgaauaucucucuggcgacagacaggucgaggaauggcccaaggcuaccugcacaggggauuguccugagcggugcggauguaccuccagcacgugccugcauaaggaguggccccacucccgcaauuggagauguaacccuaccuggugcuggggcgugggcacaggguguaccugcuguggaguugacgugaaagaucuuuuuacagaccauauguucaucaaguggaaagucgaauacauuaagaccgaggccaucgugugcguggaacugacgucucaggagcggcaguguagccucauugaagccggcacacgcuuuaaucuggggcccgucaccaucacacuuuccgagccuagaaacauucaacagaaacugccgcccgagaucauuacccuccacccuaagaucgaagagggauucuuugaucugaugcauguucagaaggugcugagcgcuucuaccgugugcaaacuccaguccugcacacacggcauccccggggaccugcaaauuuaucacaucggaaaucuucugaagggcgaucgggucaacggccaucucauucacaaaaucgaaccucauuucaauacgagcuggaugucuugggacgggugugaucuggacuacuauugcaacaugggagacuggcccagcuguaccuacacaggcgugacccagcacaaucacgccgcguuuguuaaccuucugaauauugagacagauuauaccaagacguuccauuuucacuccaaacgcgugacagcccauggggacaccccgcagcucgaucugaaggcuagaccuaccuacggagccggcgaaaucacaguccugguggagguugcugacauggagcuccacaccaaaaagguggaaaucucugggcugaaguucgccagccuugcgugcacaggauguuacgccugcuccagcggcauuucuuguaaaguccggauccauguggaugagcccgacgaacugacgguccacgugaaguccagcgauccugacguuguggcugccucuaccucccucauggcucgcaaacuggaguuuggcacagauagcaccuucaaggccuucuccgccaugcccaaaacaucucuuugcuuuuauauugucgaaagagaguacuguaagagcugcuccgaggacgauaccaagaaauguguggacacgaagcuggaacagccccaaucuauccucauugagcacaaagggaccaucaucggaaagcagaacgacacaugcaccgcuaaagcgagcugcuggcuggaauccguuaagagcuucuuuuauggccugaagaacaugcucgggucuguguucggaaauuucuuugucggcauucugcuuuuucuggccccuuucgugcuccuggugcuguuuuucauguuuggguggaaaauccuuuucuguuuuaagugcugucggcgcacaagaggccucuucaaauaccggcaucugaaggaugacgaggagaccggauauagacgcauuaucgaacggcugaacuccaaaaagggcaagaauagacuccuggauggggagcgccuugcugaccggaaaauugccgaacuguucagcacgaagacacacaucgga

SEQ ID NO: 14105 - RNA, 1932 nt, Artificial Sequence
  derived and/or modified CDS sequence (opt5) from CCHFV(4701-ST-2009)__KR814872.1__Gc
uuccuggacagcaucgugaagggcaugaaaaaccuccuuaauuccaccucucuugagacaagccuguccauugaagcccccuggggagcuaucaacguccagucuacguuuaagccuaccguuagcacagccaauauugcgcucuccuggucuagcguggagcacagagggaacaaaauccuggugaccggccgguccgaaagcauuaugaagcuggaggaacgcacaggggucucuugggaucugggaguggaggacgcuuccgagagcaaacuccugaccguuucuaucauggaucugucccaaauguacagcccgguguucgaauaucucucuggcgacagacaggucgaggaauggcccaaggccacaugcaccggggauuguccugagcggugcggauguacguccagcacaugccugcauaaggaguggccccacucccgcaauuggagauguaacccuacauggugcuggggcgugggcaccggguguacaugcuguggaguugacgugaaagaucuuuuuaccgaccauauguucaucaaguggaaagucgaauacauuaagacggaggccaucgugugcguggaacugacaucucaggagcggcaguguagccucauugaagcuggcacccgcuuuaaucuggggcccgucacaaucacccuuuccgagccuagaaacauucaacagaaacugccgcccgagaucauuacccuccacccuaagaucgaagagggauucuuugaucugaugcauguucagaaggugcugagcgccucuacagugugcaaacuccaguccugcacgcacggcauccccggggaccugcaaauuuaucacaucggaaaucuucugaagggcgaucgggucaacggccaucucauucacaaaaucgaaccucauuucaauaccagcuggaugucuugggacgggugugaucuggacuacuauugcaacaugggagacuggcccagcuguacauacaccggcgugacacagcacaaucacgcugccuuuguuaaccuucugaauauugagaccgauuauacgaagacauuccauuuucacuccaaacgcgugaccgcgcauggggacaccccgcagcucgaucugaaggccagaccuacauacggagcuggcgaaaucaccguccugguggagguugccgacauggagcuccacaccaaaaagguggaaaucucugggcugaaguucgcuagccuuacgugcaccggauguuacgccugcuccagcggcauuucuuguaaaguccggauccauguggaugagcccgacgaacugacaguccacgugaaguccagcgauccugacguuguggcggccucuaccucccucauggcucgcaaacuggaguuuggcacagauagcaccuucaaggccuucuccgcuaugcccaaaacgucucuuugcuuuuauauugucgaaagagaguacuguaagagcugcuccgaggacgauaccaagaaauguguggacacaaagcuggaacagccccaaucuauccucauugagcacaaagggaccaucaucggaaagcagaacgacacaugcaccgccaaagccagcugcuggcuggaauccguuaagagcuucuuuuauggccugaagaacaugcucgggucuguguucggaggcuuuuucgucgggauucugcuuuuucuggcuccuuucgugcuccuggugcuguuuuucauguuuggcuggaaaauccuuuucuguuuuaagugcugucggcgcacgagaggacucuucaaauaccggcaucugaaggaugacgaggagacaggcuauagacgcauuaucgaacggcucaauuccaaaaaggggaagaacagacugcuggauggagagcgccuugcggaccggaaaauugccgaacuguucagcaccaagacacacaucggc

SEQ ID NO: 14106 - RNA, 1932 nt, Artificial Sequence
  derived and/or modified CDS sequence (opt5) from CCHFV(Oman-199809166)__KR864901.1__Gc
uuccuggacagcaucgccaagggcaugaaaaaccuccuuaauuccaccucucuugagacaagccuguccauugaagcucccuggggagccaucaacgugcagucuacguuuaagccuaccgucagcacagcgaauauugcucucuccuggucuagcguugagcacagagggaacaaaauccugguguccggccggagcgaaucuauuaugaagcuggaggaacgcaccgggaucuccugggaucugggaguggaggacgccagcgagucuaaacuccugacagucuccgugauggaucugagccaaauguacucuccgguuuucgaauaucucuccggcgacagacagguggaggaauggcccaaggcuaccugcacaggggauuguccugagcggugcggauguaccagcuccacgugccugcauaaggaguggccccacucucgcaauuggagauguaacccuaccuggugcuggggcgucggcacaggguguaccugcuguggacuugacgugaaagaucuguuuacagacuacauguucguuaaguggaaaguggaauauaucaagaccgaggccauugucugcguggaacucacgagccaggagcggcaguguucccugaucgaagccggcacacgcuuuaaucuugggcccgugaccauuacacugagcgagccuagaaacauccaacagaaacucccgcccgagauugucacccugcauccucggaucgaagagggauucuuugaucugaugcacguucagaaggugcucucugcuuccaccgugugcaagcugcagagcugcacacauggcguccccggggaccuucaaguguaccacauuggaaaucugcucaaaggcgauaagguuaacggccaccugauccauaaaguggaaccucacuucaauacgucuuggaugagcugggacgggugugaucuugacuauuacugcaacaugggagacuggcccuccuguaccuauacaggcgucacccagcauaaucacgccgcguuugugaaccugcucaauaucgagacagauuacaccaagaacuuccacuuucauucuaaacgcguuacggcccacggggacacaccgcagcuggaucugaaggcuagaccuaacuacggagccggcgaaauuaccgugcucgucgagguggcugacauggagcugcauaccaaaaagaucgaaauuagcgggcuuaaguucgccucccugacaugcaccggauguuaugcgugcagcucuggcaucuccuguaaaguccggauucacguggaugagcccgacgaacucacaguucaugucaagagcgaggauccugacaucguggccgcuucuuccagccugauggcccgcaaacuugaauuuggcacggauuccaccuucaaggcuuucucugccaugcccaaaacaagccugugcuuuuacaucguggagagagaguauuguaaguccugcucuaaggaagacacccagaaauguguuaaugccaagcucgagcggccccaaagcauucugaucgaacacaaagggacaauuaucggaaagcagaacgauaccugcacggcuaaagcguccugcuggcuggagagcgugaagucuuucuuuuacggccucaagaauaugcuguccgggauuuucggaaacgucuuuaucggcaucuuccuuuuucuggccccuuucauucuccugauccuguuuuucauguuuggguggcgcauucuuuucuguuuuaaaugcuguagacggaccagaggccucuucaaguaucgccaccugaaagacgacgaggaaacaggauaccggaagaucauugagagacugaauaacaaaaagggcaagaauaaacuccuggauggggaacgccuugcugaccggaagaucgccgagcuguucagcaccaaaacacauauugga

SEQ ID NO: 14107 - RNA, 1932 nt, Artificial Sequence
  derived and/or modified CDS sequence (opt5) from CCHFV(200406546-Turkey)__KR864902.1__Gc
uuccuggacagcaucgugaagggcaugaaaaaccuccuuaauuccaccucucuggagacaagccuguccauugaagcccccuggggagcuaucaacguccagucuacguuuaagccuaccguuagcacagccaauauugcgcucuccuggucuagcaucgagcacagagggaacaaaauucuggugaccggccgguccgaaagcaucaugaaacuugaggaacgcacaggggugucuugggaucugggagucgaggacgcuuccgagagcaaacuccugaccgugucuaucauggaucugucccaaauguacagcccgguuuucgaauaucucucuggcgacagacagguggaggaauggcccaaggccacaugcaccggggauuguccugagcggugcggauguacguccucuaccugccugcauaaggaguggccccacucccgcaauuggagauguaacccuacauggugcuggggcgucggcaccggguguacaugcuguggaguggacguuaaagaucuuuuuaccgaccauauguucgugaaguggaaagucgaauacauuaagacggaggccaucgugugcguggaacugacaucucaggagcggcaguguagccucauugaagcuggcacccgcuuuaaucuggggcccgucacaaucacccuuuccgagccuagaaacauucaacagaaacugccgcccgagaucauuacccuccacccuaagguugaagagggauucuuugaucugaugcaugugcagaaggugcugagcgccucuacagucugcaaacuccaguccugcacgcacggcauccccggggaccugcaaguguaucacaucggaaaucuucugaagggcgaucggguuaacggccaucucauucacaaaaucgaaccucauuucaauaccagcuggaugucuugggacgggugugaucuggacuacuauugcaacaugggagacuggcccagcuguacauacaccggcgugacacagcacaaucacgcugccuuugucaaccuucugaauauugagaccgauuauacgaagacauuccauuuucacuccaaacgcgugaccgcgcauggggacaccccgcagcucgaucugaaggccagaccuacauacggagcuggcgaaaucaccguucugguggaggucgccgacauggagcuccacacaaagaagguggaaauuucugggcugaaguucgcuagccuugccugcacgggauguuacgcgugcuccagcggcaucucuuguaaaguccggauccauguggaugagcccgacgaacugaccguucacgugaaguccagcgauccugacgucguggccgcuucuacaucccucaccgcccgcaaacuggaguuuggcacagauagcaccuucaaggcuuucuccgccaugcccaaaacgucucuuugcuuuuauauuguugaaaaggaguacuguaagagcugcaacgaggacgauacccagaaauguguggacacaaagcuggaacaaccccaguccauccucauugagcacaaagggaccaucauuggaaagcagaacgacacaugcaccgccaaagcuagcugcuggcuggaaagcgucaaguccuucuuuuauggccugaagaauaugcucgggagcguguucggaaacuuuuucaucggcauccugcuuuuucuggcgccuuucgugcuccugguucuguuuuucauguuuggguggaaaauucuuuucuguuuuaagugcuguagacggacgcgcggccucuucaaauacagacaucugaaggaugacgaggagacaggauauaaacggaucauugaaagacugaauaacaagaagggcaaaaaucgccuccuggauggggagcggcuugccgacagaaagaucgcugaacuguucucuaccaaaacacacauugga

SEQ ID NO: 14108 - RNA, 1932 nt, Artificial Sequence
  derived and/or modified CDS sequence (opt5) from CCHFV(1-CR/HU-2015)__KU161584.1__Gc
uuccuggacagcaucgugaagggcaugaaaaaccuccuuaauuccaccucucuugagacaagccuguccauugaagcccccuggggagcuaucaacguccagucuacguuuaagccuaccguuagcacagccaauauugcgcucuccuggucuagcguggagcacagagggaacaaaauccuggugaccggccgguccgaaagcauuaugaagcuggaggaacgcacaggggucucuugggaucugggaguggaggacgcuuccgagagcaaacuccugaccguuucuaucauggaucugucccaaauguacagcccgguguucgaauaucucucuggcgacagacaggucgaggaauggcccaaggccacaugcaccggggauuguccugagcggugcggauguacguccagcacaugccugcauaaggaguggccccacucccgcaauuggagauguaacccuacauggugcuggggcgugggcaccggguguacaugcuguggaguugacgugaaagaucuuuuuaccgaccauauguucgucaaguggaaaguggaauacaucaagacggaggccauugugugcgucgaacugacaucucaggagcggcaguguagccucaucgaagcuggcacccgcuuuaaucuggggcccguuacaauuacccuuuccgagccuagaaacauccaacagaaacugccgcccgagauuaucacccuccacccuaagauugaagagggauucuuugaucugaugcaugugcagaaggugcugagcgccucuacagucugcaaacuccaguccugcacgcacggcauccccggggaccugcaaguguaucacaucggaaaucuucugaagggcgaucggguuaacggccaucucauucacaaaaucgaaccucauuucaauaccagcuggaugucuugggacgggugugaucuggacuacuauugcaacaugggagacuggcccagcuguacauacaccggcgugacacagcacaaucacgcugccuuugucaaccuucugaauauugagaccgauuauacgaagacauuccauuuucacuccaaacgcgugaccgcgcauggggacaccccgcagcucgaucugaaggccagaccuacauacggagcuggcgaaaucaccguucugguggaggucgccgacauggagcuccacaccaaaaagguggaaauuucugggcugaaguucgcuagccuugccugcacgggauguuacgcgugcuccagcggcaucucuuguaaaguccggauccauguggaugagcccgacgaacugaccguucacgugaaguccagcgauccugacgucguggccgcuucuacaucccucauggcccgcaaacuggaguuuggcaccgauagcacauucaaggcuuucuccgccaugcccaaaaccucucuuugcuuuuauauuguugaaagagaguacuguaagagcugcuccgaggacgauacgaagaaauguguggacaccaagcuggaacagccccaaucuauccucauugagcacaaagggacaaucauuggaaagcagaacgauaccugcacagccaaagcuagcugcuggcuggaauccgucaagagcuucuuuuauggccugaagaacaugcucgggucuguguucggaaacuuuuucaucggcauccugcuuuuucuggcgccuuucgugcuccugguucuguuuuucauguuuggguggaaaauucuuuucuguuuuaagugcugucggcgcaccagaggccucuucaaauaccggcaucugaaggacgacgaggagacgggauauagacgcaucauugaacggcugaauaauaaaaagggcaagaacagacuccuggauggggagcgccuugccgaccggaaaaucgcugaacuguucuccacaaagacccacauugga

SEQ ID NO: 14109 - RNA, 1932 nt, Artificial Sequence
  derived and/or modified CDS sequence (opt5) from CCHFV(Gaib)__KX013445.1__Gc
uucagcgacuccaucgugaagggcaugaaaaaccugcucaauucuaccagccuggagacaucccuuucuauugaagcccccuggggagcuaucaacguccagagcacguuuaagccuaccguuuccacagccaauauugcgcugucuuggagcuccaucgagcacagagggaacaaaauucucgugagcggccggucugaauccaucaugaagcuggaggaacgcaccgggaucagcugggaucuuggaguggaggacgcuucugaguccagacugcucacagucagcgugauggaucugucucaaauguacuccccgguuuucgaauaucugagcggcgacagacagguggaggaauggcccaaagcuaccugcacaggggauuguccugagcgcugcggauguaccuccucuacgugccuccauaaggaguggccccacagcagaaauuggcgguguaacccuaccuggugcuggggcgucggcacaggguguaccugcuguggacuggacgugaaggaucuuuuuacagacuacauguucguuaaauggaagguggaauauauuaaaaccgaggccaucgucugcguggaacugacgucccaggagcgccaguguagccucauugaagccggcacaagauuuaaucuggggcccgugaccaucacacuuucugagccucggaacauucaacagaagcugccgcccgagaucauuacccuccauccucgcaucgaagagggauucuuugaucugaugcacguccagaaaguucuguccgccagcaccgugugcaagcuccagucuugcacacauggcgugcccggggaccugcaagucuaccacaucggaaaucuucugaagggcgauaaagugaacggccaccucauucauaagaucgaaccucacuucaauacgagcuggauguccugggacgggugugaucuggacuauuacugcaacaugggagacuggcccucuuguaccuauacaggcguuacccagcauaaucacgcugccuuugugaaccuucugaauauugagacagauuacaccaaaaacuuccacuuucauagcaagagagucacggcgcacggggacacaccgcagcucgaucugaaagcccggccuaccuacggagcuggcgaaaucaccgugcugguugagguggccgacauggagcuccauacaaagaaaauugaaaucuccgggcugaaguucgcuagccuuaccugcacaggauguuaugccuguucuuccggcaucagcugcaagguccgcauucacguggaugagcccgacgaacugacgguccaugugaaaucugaggauccugacaucguugcggccuccagcucccucauggcuagaaagcuggaauuuggcaccgauucuacauucaaagccuucagcgcuaugcccaagaccucccuuugcuuuuacauuguggagcgggaguauuguaaaucuugcagccgcgaagacacacagaagugugucuccaccaagcuggagcaaccccagagcauccucauugaacacaaagggacgaucaucggaaagcagaacaauaccugcacaaccaaaacaaccugcuggcuggagucugugaaguccuucuuuuacggccugaaaaacaugcucagcucuauuuucgggaauguuuuugugggaaucuucuccuuucuggccccuuucauucuucugauccucuuuuucauguuuggcuggcggauucuguucuguuuuaagugcugucggagaacgcgcgggcuguucaaguaucggcaccuuaaagaugacgaggaaacaggcuacagacgcaucauugagcggcucaacaauaagaaaggaaagagcaaacugcuggacggcgaaagacucgccgaucgcaagaucgcugagcuguucucuaccaagacacauaucggg

SEQ ID NO: 14110 - RNA, 1932 nt, Artificial Sequence
  derived and/or modified CDS sequence (opt5) from CCHFV(Hodzha)__KX013448.1__Gc
uuccuggacagcaucgugaagggcaaaaagaaccuccuuaauuccaccucucuugagacaagccuguccauugaagcccccuggggagcuaucaacguccagucuacguacaaaccuaccguuagcacagccaauauugcgcucuccuggucuagcguggagcacagagggaacaagauccugguguccggccggagcgaaucuauuaugaaacuugaggaacgcaccgggaucuccugggaucugggagucgaggacgcuagcgagucuaagcuccugacaguguccguuauggaucugagccaaauguauucuccgguguuugaauaccucuccggcgacagacaggucgaggaauggcccaaggcuaccugcacaggggauuguagcgagcggugcggauguaccuccucuacgugccugcauaaagaguggccucacagccgcaauuggagauguaaccccaccuggugcuggggcgugggcacaggguguaccugcuguggacuugacguuaaggaucuguucacagacuauauguuugugaaauggaaggucgauuacaucaaaaccgaagccauugugugcguggagcucacgucccaggaacggcaguguagccuggucgaggcuggcacacgcuucaaucuugggccuguuaccaucacacugucugaacccagaaacauucaacagaagcucccuccggagaucauuacccugcauccccggaucgaggaaggauuuuucgaccugaugcacgugcagaaggugcucuccgccagcaccgucugcaaacugcagucuugcacacauggcgugccuggggaucuucaaguuuaucacauuggaaaucugcucaagggcgacaaagugaacggccaccugauccauaagaucgagccccacuuuaauacgagcuggauguccugggaugggugugaccuugacuacuauugcaacaugggagauuggccuucuuguaccuacacaggcgucacccagcauaaucacgcuagcuucgugaaccugcucaauauugaaacagacuacaccaaauccuuucacuuccauagcaagcgcguuacggcccacggggauacaccccagcuggaccugaaagcgagaccgaccuauggagccggcgagaucaccgugcucgucgaaguggcugauauggagcugcauacaaagaagauugagaucaccgggcuuaaauuugccucucugacaugcacgggauguuacgcuugcuccagcggcauuucuuguaagguccggauccacguggacgaaccugaugagcucaccguucaugugaaauccgacgaucccgacgucguggccgcgagcuccucucugauggcccgcaagcuggaauuuggcacagauagcaccuuuaaagccuucuccgccaugccuaagacaucucugugcuucuauaucguugagagagaauacuguaagagcugcuccaaagaggacacccagaagugugugaacacgaaacucgagcaaccccagagcauucugaucgaacagaaggggaccauuaucggaaaacaaaacaauacaugcaccgcuaaggccucuugcuggcuggaguccgucaagagcuuuuucuauggccucaaaaacaugcugucugggauuuuuggaaauguguucgugggcaucuuucuuuuccuggcccccuuuauccuccugauucuguucuuuauguucggguggcggauccuuuucuguuucaagugcugucgcagaacacggggccucuuuaaauacaagcaccugaaagacgaugaagagaccggauauagacgcauuaucgagcggcugaacaauaagaagggcaaaaacaagcuccuggacggggaaagacuugcugaucgccggauugcggagcuguucuccacgaaaacacacaucgga

SEQ ID NO: 14111 - RNA, 1932 nt, Artificial Sequence
  derived and/or modified CDS sequence (opt5) from CCHFV(IbAn7620)__KX013451.1__Gc
uuccuggacagcaucgccaagggcaugaaaaacccccucaauuccaccucucuggagacaagccuuuccauugaagcuccuuggggagccaucgaugugcagucuacguacaagccgaccgucagcacagcgaacauugcucuguccuggucuagcguugagcacagagggaauaaaauccucguguccggccggagcgaaucuauuaugaagcuggaggaacgcaccgggaucuccugggaccuuggaguggaggaugccagcgagucuaaacugcucacagucuccgugauggaccugagccaaauguauucucccguuuuugaauaccuguccggcgauagacagguggaggaauggccuaaggcuaccugcacaggggacugucccgagcggugcggauguaccagcuccacgugccuccauaaggaguggccucacucucgcaacuggagauguaaucccaccuggugcuggggcgucggcacaggguguaccugcuguggacuggaugugaaagaccuuuucacagauuauauguuuguuaaguggaaaguggaauacaucaagaccgaggccauugucugcguggaacugacgagccaggagcggcaguguucccucaucgaagccggcacacgcuucaaccuggggccugugaccauuacacuuagcgagccgagaaauauccaacagaaacugcccccugagauuaucacccuccauccccggauugaagagggauuuuucgaccugaugcacguccagaagguucugucugcuuccaccgugugcaagcuccagagcugcacacauggcgugccuggggaucugcaagucuaucacaucggaaaccuucugaaaggcgacaaggugaauggccaccucauccauaaaauugaaccccacuuuaacacgucuuggaugagcugggaugggugugaccuggacuacuauugcaauaugggagauuggccguccuguaccuacacaggcguuacccagcauaaccacgccucuuucgugaaucuucugaacaucgagacagacuacaccaagaauuuucacuuccauagcaaacgcgucacggcgcacggggauacaccucagcucgaccugaaggccagacccaccuauggagcuggcgaaauuaccgugcugguugagguggccaacauggagcuccauaccaaaaagaucgaaauuuccgggcugaaguuugcuagccuuaccugcacaggauguuacgccuguucuuccggcaucagcugcaaaguccggauccacguggaugagccugacgaacugacgguccaugugaagucugaugaccccgauguuguggcggccuccagcucccucauggcucgcaaacuggaguucggcaccgacucuacauuuaaggccuucagcgcuaugcccaaaaccucccuuugcuucuauauugucgaaagagagcacuguaagucuugcagcgaggaagauacaaagaaaugugugaacaccaagcuggagcagccucaauccauccucauugaacacaaagggacgaucauuggaaagcagaauagcacaugcacagccaaagccucuugcuggcuggaguccguuaagagcuuuuucuacggccugaagaacaugcucucugggaucuuuggaaauguguucaugggcaucuuucuguuccuugcuccguuuauucugcucauccuguucuuuauguucggguggcggauucuguuuuguuucaaaugcugucgcagaacccggggccuuuuuaaguauagacaucucaaagacgacgaggaaacaggauaccgccggaucauugagagacugaacaauaagaaaggcaagaacaagcugcucgauggggaacgccuggcggaccggagaaucgccgagcuuuucuccaccaaaacgcacauugga

SEQ ID NO: 14112 - RNA, 1932 nt, Artificial Sequence
  derived and/or modified CDS sequence (opt5) from CCHFV(K128_76)__KX013454.1__Gc
uuccaggacagcaucgugaagggcaugaaaaaccugcucaauuccaccucucuggagacaagccuuuccauugaagcccccuggggagcuaucaacguccaaucuacguacaagccugccguuagcgcggcuaauauugcccuguccuggucuagcguggagcacagaggguccaaaauccucgugagcggccggucugaauccauuaugaagcuggaggaacgcaccgggaucagcugggaucuuggagucgaggacgccucugaguccaaacugcucacagugagcguuauggaucugucucagauguauuccccgguguuugaauaccugagcggcgacagacaggucgaggaauggcccaaggcuaccugcacaggggauuguccugagcggugcggauguaccuccucuacaugccuccauaaggaguggccccacagccgcaacuggagauguaauccuaccuggugcuggggcgugggcacgggguguaccugcuguggacuggacguuaaagaucuuuucacagacuauauguuugugaaguggaaagucgaauacaucaagaccgaggccauugugugcguggaacugacaucccaggagcggcaauguagccucaucgaagcuggcacccgcuucaaccuggggcccgucacgauuacacuuucugagccuagaaauauccagcagaaacugccgcccgagauuaucacccuccauccucggauugaagagggauuuuucgaucugaugcacguucagaaggugcuguccgccagcacagugugcaagcuccaaucuugcacccauggcguccccggggaccuucagguguaucacaucggaaaccugcugaaaggcgaucgcguuaauggccaccucauccauaagauugaaccucacuuuaacaccagcuggauguccugggacgggugugaucuggacuacuauugcaauaugggagacuggcccucuuguacauacacgggcgugacccagcauaaccacgcgagcuucgucaaucuucugaacaucgagacagauuacaccaaauccuuucacuuccauagcaagagagugacagcccacggggacaccccgcagcucgaucugaaagcucggccuaauuauggagccggcgaaauuacgguucugguggaggucgcugacauggagcuccauacaaagaaaaucgaaauuucugggcugaaguuugccucccuuaccugcaccggauguuacgcgugcagcucuggcaucuccuguaaggugcgcauccacgucgaugagcccgacgaacugacagugcauguuaaaagcgaugacccugauguggucgccgcuuccucuagccucauggccagaaagcuggaguucggcaccgacuccacauuuaaggcuuucucugccaugcccaaaacgagccuuugcuucuauauuguggaacgggaguacuguaaauccugcagcaaggaggauacccaaaaguguguuaacacaaaacuggaacagccccagucuauccucauugagcacaaggggaccaucauuggaaaacaaaacaauacaugcaccgccaagacguccugcuggcuggaaagcgugaaauccuuuuucuauggccugaagaacaugcucucugggaucuuuggaaaugucuucgugggcaucuuucuguuccuugcuccuuuuauucugcucauccuguucuuuauguucggguggcgcauucuguuuuguuucaagugcuguagacggaccagaggccuuuuucgcuacaaacaccucgagaacgacgaggaaacaggauaucggagaaucauugagcgccugaauaacaagaaaggcaagaauaaacugcucgacggggaacggcuggcggauagacgcaucgccgagcuuuucagcaccaagacacauauugga

SEQ ID NO: 14113 - RNA, 1932 nt, Artificial Sequence
  derived and/or modified CDS sequence (opt5) from CCHFV(K168_40)__KX013457.1__Gc
uuccuggacggcaucgugaaggggaugaaaaaccuccugaauagcaccucccuugagacaucucugagcauugaagcccccuggggagcuaucaacguccaguccacguacaagccuaccguuucugccgcgaauauugcucucagcugguccucuguggagcacagaggcaacaaaauccuggugagcgggcgguccgaaagcauuaugaaacuugaggaacgcacaggaaucucuugggaucugggcgucgaggacgccuccgagagcaagcuccugaccgugucuguuauggaucugucccaaauguauagcccgguguuugaauaccucucuggggacagacaggucgaggaauggcccaaggccacaugcaccggagauuguccugagcggugcggcuguacauccucuaccugccugcauaaggaguggccccacucccgcaauuggagauguaacccuacguggugcuggggcguggggaccggauguacaugcuguggccuugacguuaaagaucuguucaccgacuauauguuugugaaguggaaagucgaauacaucaagacagaggcuauugugugcguggaacucaccucucaggagcggcaguguagccugaucgaagccgggacgcgcuucaaucuuggacccgucacaauuacccuguccgagccuagaaacauccaacagaaacucccgcccgagauuaucacacugcauccucggauugaagagggcuuuuucgaucugaugcacguucagaaggugcucagcgcuucuaccgugugcaagcugcaguccugcacccaugggguccccggagaccuucaaguguaucacaucggcaaucugcucaaaggcgauaagguuaacgggcaccugauccauaaaauugaaccucacuuuaauacaagcuggaugucuugggacggaugugaucuugacuacuauugcaacaugggcgacuggcccagcuguacguacaccggggugacacagcauaaucacgccuccuucaucaaccugcucaauauugagaccgauuacacaaagucuuuucacuuccauagcaaacgcgucaccgcgcacggagacacgccgcagcuggaucugaaggccagaccuaacuauggcgcuggggaaaucacagugcucguugagguggccgacauggagcugcauaccaaaaagauugaaaucuccggacuuaaguuugcuagccugaccugcacaggcuguuacgccugcagcuccggcaucagcuguaaaguccggauucacguggaugagcccgacgaacucaccguccaugugaagucugaugacccugauguuguggcggccuccagcucccugauggcucgcaaacuugaguucgggacagacucuacguuuaaggccuucagcgcuaugcccaaaaccucccugugcuucuauaucgucgaaagagaguacuguaagucuugcagcaaggaggauacacagaaaugugugaacaccaagcucgaacacccccaauccauucugaucgagcacaaaggaacaauuaucggcaagcagaauaauaccugcacggccaaaaccagcugcuggcuggaaucuguuaaguccuuuuucuaugggcucaagaacaugcugagcggaaucuuuggcaacguguucgucgggauuuuucuuuuccuggccccuuuuauccuccugauucuguucuuuauguucggcuggcggauccucuuuuguuucaaaugcugucgcagaacacggggacuuuuuagauacaagcaucuggaggacgacgaggaaaccggcuaucgccggauuaucgagagacugaauaacaaaaaggggaaaaauaagcuccuggauggagaacgccuugcugaccggagaauugcggagcuguucucuacaaagacccacaucggc

SEQ ID NO: 14114 - RNA, 1932 nt, Artificial Sequence
  derived and/or modified CDS sequence (opt5) from CCHFV(K168_125)__KX013460.1__Gc
uuccuggacagcaucgugaagggcaaaaagaaccuccuuaauuccaccucucuugagacaagccuguccauugaagcccccuggggagcuaucaacguccagucuacguacaaaccuaccguuagcgccgcgaauauugcucucuccuggucuagcguggagcacagagggaacaagauccugguguccggccggagcgaaucuauuaugaaacuugaggaacgcacagggaucuccugggaucugggagucgaggacgccagcgagucuaagcuccugaccguguccguuauggaucugagccaaauguauucuccgguguuugaauaccucuccggcgacagacaggucgaggaauggcccaaggccacaugcaccggggauuguccugagcggugcggauguacaagcucuaccugccugcauaaagaguggccccacucccgcaauuggagauguaacccuacguggugcuggggcgugggcaccggguguacaugcuguggacuugacguuaaggaucuguucaccgacuauauguuugugaaauggaaggucgaauacaucaaaacagaggcuauugugugcguggaacucaccagccaggagcggcaguguucccugaucgaagccggcacgcgcuucaaucuugggcccgucacaauuacccugagcgagccuagaaacauccaacagaagcucccgcccgagauuaucacacugcauccucggauugaagagggauuuuucgaucugaugcacguucagaaggugcucucugcuuccaccgugugcaaacugcagagcugcacccauggcguccccggggaccuucaaguguaucacaucggaaaucugcucaagggcgauaaaguuaacggccaccugauccauaagauugaaccucacuuuaauacaucuuggaugagcugggacgggugugaucuugacuacuauugcaacaugggagacuggcccuccuguacguacaccggcgugacacagcauaaucacgccucuuucaucaaccugcucaauauugagaccgauuacacaaagagcuuucacuuccauuccaagcgcgucaccgcgcacggggacacgccgcagcuggaucugaaagccagaccuaacuauggagcuggcgaaaucacagugcucguugagguggccgacauggagcugcauaccaagaagauugaaaucagcgggcuuaaauuugcuucucugaccugcacaggauguuacgccugcuccagcggcaucucuuguaagguccggauucacguggaugagcccgacgaacucaccguccaugugaaauccgaugacccugauguuguggcggccagcuccucucugauggcucgcaaacuugaguucggcacagacagcacguuuaaagccuucuccgcuaugcccaagaccucucugugcuucuauaucgucgaaagagaguacuguaagagcugcuccaaagaggauacacagaagugugugaacaccaaacucgaacacccccaaagcauucugaucgagcacaaggggacaauuaucggaaaacagaauaauaccugcacggccaagaccucuugcuggcuggaauccguuaagagcuuuuucuauggccucaaaaacaugcugucugggaucuuuggaaacguguucgucggcauuuuucuuuuccuggccccuuuuauccuccugauucuguucuuuauguucggguggcggauccuguuuuguuucaagugcugucgcagaacacggggccucuuuagauacaaacaucuggaggacgacgaggaaaccggauaucgccggauuaucgagagacugaauaacaagaaaggcaagaauaagcuccuggauggggaacgccuugcugaccggagaauugcggagcuguucuccacaaaaacccacaucgga

SEQ ID NO: 14115 - RNA, 1932 nt, Artificial Sequence
  derived and/or modified CDS sequence (opt5) from CCHFV(K229_194)__KX013463.1__Gc
uuccuggacagcaucgugaagggcaaaaagaaccuccuuaauuccaccucucuugagacaagccuguccauugaagcccccuggggagcuaucaacguccagucuacguuuaaaccuaccguuagcacagccaauauugcgcucuccuggucuagcguggagcacagagggaacaagauccuggugaccggccgguccgaaagcauuaugaaacuugaggaacgcacaggggucucuugggaucugggaguggaggacgcuuccgagagcaagcuccugaccguuucuaucauggaucugucccaaauguacagcccgguguucgaauaucucucuggcgacagacaggucgaggaauggcccaaggccacaugcaccggggauuguccugagcggugcggauguacguccagcacaugccugcauaaagaguggccccacucccgcaauuggagauguaacccuaccuggugcuggggcgugggcaccggguguacaugcuguggaguugacgugaaggaucuuuuuaccgaccauauguucaucaaauggaaggucgaauacauuaaaacggaggccaucgugugcguggaacugacaucucaggagcggcaguguagccucauugaagcuggcacccgcuuuaaucuggggcccgucacaaucacccuuuccgagccuagaaacauucaacagaagcugccgcccgagaucauuacccuccacccuaagaucgaagagggauucuuugaucugaugcauguucagaaagugcugagcgccucuacagugugcaagcuccaguccugcacgcacggcauccccggggaccugcaaauuuaucacaucggaaaucuucugaaaggcgaucggcucaacggccaucugauucacaagaucgaaccucauuucaauaccagcuggaugucuugggacgggugugaucuugacuacuauugcaacaugggagacuggcccagcuguacauacaccggcgucacacagcacaaucacgcugccuuugugaaccugcucaauauugagaccgauuauacgaaaacauuccauuuucacuccaagcgcguuaccgcgcauggggacaccccgcagcuggaucugaaagccagaccuacauacggagcuggcgaaaucaccgugcucgucgagguggccgacauggagcugcacacaaagaagguugaaaucucugggcuuaaauucgcuagccuggccugcacgggauguuacuccugcagcucuggcauuuccuguaaggugcggauccaugucgaugagcccgacgaacucaccgugcacgucaaaagcucugauccugacgugguugcggccuccacaagccugauggcucgcaaacuugaguuuggcaccgauuccacauucaaggccuucucugcuaugcccaagaccagccugugcuuuuauauuguggaaagagaguacuguaaguccugcucugaggacgauacgaaaaagugugucgacaccaaacucgaacagccccaaagcauccugauugagcacaaggggacaaucaucggaaaacagaacgauaccugcacagccaaggccuccugcuggcuggaaagcgugaagucuuucuuuuauggccucaaaaacaugcugggguccguuuucggaaacuuuuucgugggcauucuucuguuucucgcuccuuucguccugcuggugcuguuuuucauguuuggguggaagauccucuucuguuuuaaaugcugucggcgcaccagaggccuguucaaguaccggcaucugaaagacgacgaggagacgggauauagaaagauuaucgaacgccucaauagcaagaaaggcaagaaucggcugcuugauggggagagacuggcggaccgcaaaauugccgaacucuucucuacaaagacccacaucgga

SEQ ID NO: 14116 - RNA, 1932 nt, Artificial Sequence
  derived and/or modified CDS sequence (opt5) from CCHFV(K229_243)__KX013466.1__Gc
uuccuggacagcaucgugaagggcaugaaaaaccuccuuaauuccaccucucuugagacaagccuguccauugaagcccccuggggagcuaucaacguccagucuacguuuaagccuaccguuagcacagccaauauugcgcucuccuggucuagcguggagcacagagggaacaaaauccuggugaccggccgguccgaaagcauuaugaagcuggaggaacgcacaggggucucuugggaucugggaguggaggacgcuuccgagagcaaacuccugaccguuucuaucauggaucugucccaaauguacagcccgguguucgaauaucucucuggcgacagacaggucgaggaauggcccaaggccacaugcaccggggauuguccugagcggugcggauguacguccagcacaugccugcauaaggaguggccccacucccgcaauuggagauguaacccuacauggugcuggggcgugggcaccggguguacaugcuguggaguugacgugaaagaucuuuuuaccgaccauauguucgucaaguggaaaguggaauacaucaagacggaggccauugugugcgucgaacugacaucucaggagcggcaguguagccucaucgaagcuggcacccgcuuuaaucuggggcccguuacaauuacccuuuccgagccuagaaacauccaacagaaacugccgcccgagauuaucacccuccacccuaagguggaagagggauucuuugaucugaugcaugugcagaagguccugagcgccucuacagugugcaaacuccaguccugcacgcacggcauucccggggaccugcaaguuuaucacaucggaaaucuucugaagggcgaucgggugaacggccaucucauccacaaaauugaaccucauuucaauaccagcuggaugucuugggacgggugugaucuggacuacuauugcaacaugggagacuggcccagcuguacauacaccggcgucacacagcacaaucacgcugccuuugugaaccuucugaauaucgagaccgauuauacgaagacauuccauuuucacuccaaacgcguuaccgcgcauggggacaccccgcagcucgaucugaaggccagaccuacauacggagcuggcgaaauuaccgugcuggucgagguggccgacauggagcuccacaccaaaaaggucgaaaucucugggcugaaguucgcuagccuugccugcacgggauguuacgcgugcuccagcggcauuucuuguaaagugcggauccauguugaugagcccgacgaacugaccgugcacgucaaguccagcgauccugacgugguugccgcuucuacaucccucauggcccgcaaacuggaguuuggcaccgauagcacauucaaggcuuucuccgccaugcccaaaaccucucuuugcuuuuauaucguggaaaaggaguacuguaagagcugcuccgaggaagacacgcagaaaugugucgauaccaagcuggagcaaccccagucuauucucaucgaacacaaagggacaauuaucggaaagcagaacgauaccugcacagccaaagcuagcugcuggcuggaguccguuaagagcuucuuuuauggccugaagaacaugcucgggucuguguucggaaauuucuucauuggcauccugcuuuuucugaccccuuucgugcuccugguccuguuuuucauguuuggguggaaaauccuuuucuguuuuaagugcuguagacggacgcgcggccuccugaaauacagacaucugaaggacgacgaggaaacaggauaucggagaauuaucgagcgccucaacaauaaaaagggcaagaaccggcugcuugacggggaaagacuggcggaucgcaaaauugccgagcucuuuuccaccaagacacacaucgga

SEQ ID NO: 14117 - RNA, 1932 nt, Artificial Sequence
  derived and/or modified CDS sequence (opt5) from CCHFV(K315_14)__KX013469.1__Gc
uuccuggacagcaucgugaagggcaugaaaaagcuccugaacuccaccucucuugagacaagccuguccauugaagcccccuggggagcuaucaauguccagucuacguuuaaaccuaccguuagcacagccaacauugcgcucuccuggucuagcguggagcacagagggaauaagauccuggugaccggccgguccgaaagcauuaugaaacuugaggaacgcacaggggucucuugggaucugggaguggaggacgcuuccgagagcaagcuccugaccguuucuaucauggaucugucccaaauguacagcccgguguucgaauaucucucuggcgacagacaggucgaggaauggcccaaggccacaugcaccggggauuguccugagcggugcggauguacguccagcacaugccugcauaaagaguggccccacucccgcaacuggagauguaauccuaccuggugcuggggcgugggcaccggguguacaugcuguggaguugacgugaaggaucuuuuuaccgaccauauguucaucaaauggaaggucgaauacauuaaaacggaggccaucgugugcguggaacugacaucucaggagcggcaguguagccucauugaagcuggcacccgcuuuaaccuggggcccgucacaaucacccuuuccgagccuagaaauauucaacagaagcugccgcccgagaucauuacccuccacccuaagaucgaagagggauucuuugaucugaugcauguucagaaagugcugagcgccucuacagugugcaagcuccaguccugcacgcacggcauccccggggaccugcaaauuuaucacaucggaaaccuucugaaaggcgaucgggucaauggccaucucauucacaagaucgaaccucauuucaacaccagcuggaugucuugggacgggugugaucuggacuacuauugcaauaugggagacuggcccagcuguacauacaccggcgugacacagcacaaccacgcugccuuuguuaaucuucugaacauugagaccgauuauacgaaaacauuccauuuucacuccaagcgcgugaccgcgcauggggacaccccgcagcucgaucugaaagccagaccuacauacggagcuggcgaaaucaccguccugguggagguugccgacauggagcuccacacaaagaagguggaaaucucugggcugaaauucgcuagccuuacgugcaccggauguuacgccugcuccagcggcauuucuuguaagguccggauccauguggaugagcccgacgaacugacaguccacgugaaauccagcgauccugacguuguggcggccucuaccucccucauggcucgcaagcuggaguuuggcacagauagcaccuucaaagccuucuccgcuaugcccaagacgucucuuugcuuuuauauugucgaaagagaguacuguaagagcugcuccgaggacgauaccaaaaaguguguggacacaaaacuggaacagccccaaucuauccucauugagcacaaggggaccaucaucggaaaacagaaugacacaugcaccgccaaggccagcugcuggcuggaauccguuaagagcuucuuuuauggccugaaaaacaugcucgggucuguguucggauccuuuuucgucggcauucugcuuuuucuggcuccuuucgugcuccuggugcuguuuuucauguuuggguggaagauccuuuucuguuuuaaaugcugucggcgcacgagaggccucuucaaguaccggcaucugaaagaugacgaggagacaggauauagacgcauuaucgaacggcugaacagcaagaagggcaaaaauagacuccuggauggggagcgccuugcggaccggaagauugccgaacuguucucuaccaaaacacacaucgga

SEQ ID NO: 14118 - RNA, 1932 nt, Artificial Sequence
  derived and/or modified CDS sequence (opt5) from CCHFV(K323_27)__KX013472.1__Gc
uuccuggacagcaucgccaagggcaugaaaaaccuccuuaauuccaccucucuggagacaagccuguccauugaagcucccuggggagccaucaacgugcagucuacguuuaagccuaccgucagcacagcgaauauugcucucuccuggucuagcguugagcacagagggaacaaaauccuggugaccggccgguccgaaagcauuaugaaacuugaggaacgcacaggggugucuugggaucugggagucgaggacgccuccgagagcaaacuccugaccgugucuaucauggaucugucccaaauguacagcccgguuuucgaauaucucucuggcgacagacagguggaggaauggcccaaggccacaugcaccggggauuguccugagcggugcggauguacguccucuaccugccugcauaaggaguggccccacucccgcaauuggagauguaacccuacauggugcuggggcgucggcaccggguguacaugcuguggaguggacguuaaagaucuuuuuaccgaccauauguucaucaaguggaaaguggaauacauuaagacggaggcuaucgucugcguggaacugacaggccaggagcggcaguguucucucauugaagccgggacccgcuuuaaucugggacccgugacaaucacccuuagcgagccuagaaacauucaacagaaacugccgcccgagaucauuacccuccacccuaagaucgaagagggcuucuuugaucugaugcauguccagaagguucuguccgcuagcacagugugcaaacuccagucuugcacgcacgggauccccggagaccugcaaauuuaucacaucggcaaucuucugaagggcgaucgggugaacgggcaucucauucacaaaaucgaaccucauuucaauaccuccuggaugagcugggacggaugugaucuggacuacuauugcaacaugggcgacuggcccucuuguacauacaccggggucacacagcacaaucacgccgcguuugugaaccuucugaauauugagaccgauuauacgaagacauuccauuuucacagcaaacgcguuaccgcccauggagacaccccgcagcucgaucugaaggcuagaccuacauacggcgccggggaaaucaccgugcuggucgagguggcugacauggagcuccacacgaaaaagguugaaaucuccggacugaaguucgccucucuuacaugcaccggcuguuacgcgugcagcuccggcauuagcuguaaagugcggauccaugucgaugagcccgacgaacugacagugcacgucaagucuuccgauccugacgugguugccgcuagcaccucucucauggcccgcaaacuggaguuugggacagauuccaccuucaaggcuuucagcgccaugcccaaaacgucccuuugcuuuuauauuguggaaagagaguacuguaagucuugcagcgaggacgauaccaagaaaugugucgacacaaagcuggaacagccccaauccauccucauugagcacaaaggaaccaucaucggcaagcagaacgacacaugcaccgccaaggcuucuugcuggcuggaaagcgugaaguccuucuuuuaugggcugaagaacaugcucggaagcguuuucggcagcuuuuucguggggauucugcuuuuucuggcgccuuucguccuccuggugcuguuuuucauguuuggcuggaaaauccuuuucuguuuuaagugcugucggcgcacgagaggacucuucaaauaccggcaucugaaugaugacgaggagacaggcuauagacgcauuaucgaacggcugaacuccaagaaagggaagaauagacuccuggauggagagcgccuugccgaccggaagauugcugaacuguucagcaccaaaacacacaucggc

SEQ ID NO: 14119 - RNA, 1932 nt, Artificial Sequence
  derived and/or modified CDS sequence (opt5) from CCHFV(K340_6)__KX013475.1__Gc
agccuggacuccaucgugaagggcaugaaaaaccuccuuaauucuaccagccuugagacaucccugucuauugaagcccccuggggagcuaucaacguccagagcacguucaagccuaccguuuccacagccaauauugcgcucucuuggagcuccguggagcacagaggaaacaaaauccuggugaccggccggagcgaaucuauuaugaagcuggaggaacgcacaggggucuccugggaucugggaguggaggacgcuagcgagucuaaacuccugaccguuuccaucauggaucugagccaaauguacucuccgguguuugaauaucucuccggcgacagacaggucgaggaauggcccaaggccacaugcaccggggauuguccugagcggugcggauguacgagcucuaccugccugcauaaggaguggccccacucucgcaauuggagauguaacccuacauggugcuggggcgugggcaccggguguacaugcuguggaguugacgugaaagaucuuuucaccgaccauauguuuaucaaguggaaagucgaauacauuaagacggaggccaucgugugcguggaacugacaagccaggagcggcaguguucccucauugaagcuggcacccgcuucaaucuggggcccgucacaaucacccuuagcgagccuagaaacauucaacagaaacugccgcccgagaucauuacccuccacccuaagaucgaagagggauuuuucgaucugaugcauguucagaaggugcugucugccuccacagugugcaaacuccagagcugcacgcacggcauccccggggaccugcaaauuuaucacaucggaaaucuucugaagggcgaucgggucaacggccaucucauucacaaaaucgaaccucauuuuaauaccucuuggaugagcugggacgggugugaucuggacuacuauugcaacaugggagacuggcccuccuguacauacaccggcgugacacagcacaaucacgcugccuucguuaaccuucugaauauugagaccgauuauacgaagacauuucauuuccacucuaaacgcgugaccgcgcauggggacaccccgcagcucgaucugaaggccagaccuacauacggagcuggcgaaaucaccguccugguggagguuacagacauggagcuccacacgaaaaagguggaaaucagcgggcugaaguuugccucccuuaccugcacaggauguuacgcuugcagcucuggcauuuccuguaaaguccggauccauguggaugagcccgacgaacugaccguccacguuaagagcucugauccugacgugguggccgcguccacaagccucauggcccgcaaacuggaguucggcaccgauuccacguuuaaggcuuucucugccaugcccaaaaccagccuuugcuucuauauugucgaaagagaguacuguaaguccugcucugaggacgauacaaagaaauguguggacaccaagcuggaacagccccaaagcauccucauugagcacaaagggacaaucaucggaaagcagaacgauaccugcacggcuaaagccuccugcuggcuggaaagcguuaaguccuuuuucuauggccugaagaacaugcucggguccguguuugggagcuucuuugucggcauucugcuuuuccuggccccuuuugugcuccuggugcuguucuuuauguucggguggaaaauccuguuuuguuucaagugcugucggcgcacaagaggccucuuuaaauaccggcauuucaaggacgacgaggagaccggauauagacgcauuaucgaacggcuuaauucuaaaaagggcaagaacagacugcucgauggggagcgccuggcugaccggaaaauugcggaacuuuucuccacaaagacccacaucgga

SEQ ID NO: 14120 - RNA, 1932 nt, Artificial Sequence
  derived and/or modified CDS sequence (opt5) from CCHFV(Mamon)__KX013478.1__Gc
uuccuggacagcaucgugaagggcaugaaaaaccuccugaauagcaccucucuugagacaagccuguccauugaagcccccuggggagcuaucaacguccagucuacguuuaagccuaccguuagcacagccaauauugcgcucuccuggucuagcguggagcacagagggaacaaaauccuggugaccggccgguccgaaagcauuaugaagcucgaggaacgcacaggggucucuugggaucugggaguggaggacgcuuccgagagcaaacuccugaccguuucuaucauggaucugucccaaauguacagcccgguguucgaauaucucucuggcgacagacaggucgaggaauggcccaaggccacaugcaccggggauuguccugagcggugcggauguacguccagcacaugccugcauaaggaguggccccacucccgcaauuggagauguaacccuacauggugcuggggcgugggcaccggguguacaugcuguggaguugacgugaaagaucuuuuuaccgaccauauguucgucaaguggaaaguggaauacaucaagacggaggccauugugugcgucgaacugacaucucaggagcggcaguguagccucaucgaagcuggcacccgcuuuaaucuggggcccguuacaauuacccuuuccgagccuagaaacauccaacagaaacugccgcccgagauuaucacccuccacccuaagguggaagagggauucuuugaucugaugcaugugcagaagguccugagcgccucuacagugugcaaacuccaguccugcacgcacggcauucccggggaccugcaaguuuaucacaucggaaaucuucugaagggcgaucgggugaacggccaucucauccacaaaauugaaccucauuucaauaccagcuggaugucuugggacgggugugaucuggacuacuauugcaacaugggagacuggcccagcuguacauacaccggcgucacacagcacaaucacgcugccuuugugaaccuucugaauaucgagaccgauuauacgaagacauuccauuuucacuccaaacgcguuaccgcgcauggggacaccccgcagcucgaucugaaggccagaccuacauacggagcuggcgaaauuaccgugcuggucgagguggccgacauggagcuccacaccaaaaaggucgaaaucucugggcugaaguucgcuagccuugccugcacgggauguuacgcgugcuccagcggcauuucuuguaaagugcggauccauguugaugagcccgacgaacugaccgugcacgucaaguccagcgauccugacgugguugccgcuucuacaucccucauggcccgcaaacuggaguuuggcaccgauagcacauucaaggcuuucuccgccaugcccaaaaccucucuuugcuuuuauaucguggaaagagaguacuguaagagcugcuccgaggaagacacgcagaagugugucgauaccaaacuggagcaaccccagucuauucucaucgaacacaaggggacaauuaucggaaaacagaacgauaccugcacagccaagaccagcugcuggcuggaguccgugaaauccuucuuuuauggccugaagaacaugcucgggucuguguucggaaacuuuuucauuggcauccugcuuuuucuggcuccuuucguucuccugguccuguuuuucauguuuggguggaagauccuuuucuguuuuaaaugcugucggcgcacgagaggccuccugaaguaccggcaucugaaagacgacgaggaaacaggauauagacgcauuaucgagcggcucaauaauaagaaaggcaagaacagacugcuugacggggaacgccuggcggaucggaagauugccgagcuuuucuccaccaaaacacacaucgga

SEQ ID NO: 14121 - RNA, 1932 nt, Artificial Sequence
  derived and/or modified CDS sequence (opt5) from CCHFV(Min)__KX013481.1__Gc
uuccuggacagcaucgugaagggcaccaaaaaccuccucaauuccacaucucuugagacgagccuguccauugaagcccccuggggagcuaucaacguccagucuaccuuuaagccuacaguuagcaccgccaauauugcgcucuccuggucuagcguggagcacagagggaacaaaauccuggugacaggccgguccgaaagcauuaugaaacuugaggaacgcaccggggucucuugggaucugggaguggaggacgcuuccgagagcaaacuccugacaguuucuaucauggaucugucccaaauguacagcccgguguucgaauaucucucuggcgacagacaggucgaggaauggcccaaggcuaccugcacgggggauuguccugagcggugcggauguaccuccagcacaugccugcauaaggaguggccccacucccgcaauuggagauguaacccuaccuggugcuggggcgugggcacaggguguaccugcuguggaguugacgugaaagaucuuuuuacggaccauauguucgucaaguggaaaguggaauacaucaagacagaggccauugugugcgucgaacugaccucucaggagcggcaguguagccucaucgaagccggcacacgcuuuaaucuggggcccguuaccauuacccuuuccgagccuagaaacauccaacagaaacugccgcccgagauuaucacacuccacccuaagguggaagagggauucuuugaucugaugcaugugcagaagguccugagcgccucuacggugugcaaacuccaguccugcacccacggcauucccggggaccugcaaguuuaucacaucggaaaucuucugaagggcgaucggaucaacggccaucucauucacaaaaucgaaccucauuucaauacaagcuggaugucuugggacgggugugaucuggacuacuauugcaacaugggagacuggcccagcuguaccuacacaggcgugacccagcacaaucacgcugccuuugucaaccuucugaauauugagacggauuauacaaagaccuuccauuuucacuccaaacgcgugaccgcgcauggggacacaccgcagcucgaucugaaggccagaccuaccuacggagcuggcgaaaucacaguucugguggaggucgccgacauggagcuccacacgaaaaagguggaaauuucugggcugaaguucgcuagccuugccugcaccggauguuacgcgugcuccagcggcaucucuuguaaaguccggauccauguggaugagcccgacgaacugacaguucacgugaaguccagcgauccugacgucguggccgcuucuaccucccucauggcccgcaaacuggaguuuggcacagauagcaccuucaaggcuuucuccgccaugcccaaaacgucucuuugcuuuuauauuguugaaagagaguacuguaagagcugcuccgaggaagacacccagaaguguguggauacaaaacuggagcaaccccagucuauccucauugaacacaaggggaccaucauuggaaaacagaacgacacaugcaccgccaaggcuagcugcuggcuggaguccgucaagagcuucuuuuauggccugaagaacaugcucgggucuguguucggaaacuuuuucaucggcauccugcuuuuucuggcgccuuucgugcuccugguucuguuuuucauguuuggguggaagauucuuuucuguuuuaaaugcugucggcgcacgagaggccuccugaaguaccggcaucugaaagacgaugaggaaacaggauauagacgcaucauugagcggcucaauaauaagaaaggcaagaacagacugcuugacggggaacgccuggccgaucggaagaucgcugagcuguucuccaccaaaacacacauugga

SEQ ID NO: 14122 - RNA, 1932 nt, Artificial Sequence
  derived and/or modified CDS sequence (opt5) from CCHFV(Nakiwogo)__KX013484.1__Gc
uaccuggacagcaucgccaagggcaugaaaucccuccugaacucuaccaaucuugagacaagccuguccauugaagcucccuggggagccaucaacgugcagucuacguucaagccuaccgucagcgcggcuaauauugcccucuccuggucuagcguugagcacagagggaacaaaauccugguguccggccggagcgaaucuauuaugaaacuugaggaacgcacagggaucuccuggagccugggaguggaggaugccucugaguccaagacccucacagucagcgugauggaccugucucaaauguauuccccgguuuuugaauaccugagcggcgauagacagguggaggaauggcccaaggcuaccugcacaggggacuguccugagcggugcggauguaccuccucuacgugccuccauaaggaguggccccacagccgcaauuggagauguaacccuaccuggugcuggggcgucggcacaggguguaccugcuguggacuggaugugcgggaccuuuucacagauuauaugaugguuaaauggaagguggaauacgucaaaaccgaggccaucaugugcguggaacugacgucccaggagcgccaguguagccucauugaagcuggcacaagauuuaaucuggggcccgugaccaucacacuuucugagccucggaacguccaacagcgccugccguccgagauuguuacccuccaucccaagaucgaagagggauucuuugaccugaugcacgugcagaaagugcuguucugcaagcauagccuccaggccaccucuugcacacacggcgucccuggggaucugcaaguguaucacguuggaaaucuucugaagggcgacaaagugaacggccauagcauucacaagaucgaaucccauuuuaauacgucuuggaugagcugggaugggugugaccucgauuacuucugcaacaugggagacuggcccuccuguaccuauacaggcgucacccagcacaauagagcggccuuugugaacaugcugaauauugagacagacuacaccaaaacguuccacuuucauagcaagcggguuacagcucacggggauaccccucagcuugaccugaaagcccgccccaccuacggagcuggcgaagugacaguccucguggaggucgccgaucuggagcugcauaccaagaaaaucgaagugucugggcucaaguucgcgucccugacaugcagcggauguuaugccuguucuuccggcaucagcugcaagguucggauucacgugaacgagccggacgaauuuacgguccaugugaaauccaacgauccugacguuguggcugccggcucuagccuuauggcuagaaagaucgagcugggggccgauuccaccuucaaagccuucucuagcaugcccaaaaauucccucugcuuuuacauugucgaacgcgacuauuguagcucuugcacagaugacgauacccagaagugugugaacacaaagcuggagcacccucaauccauccuuauugagcacaagggaaccaucaucggcaaacagaaugacacgugccccaccaagacaagcugcuggcuggaaucugugaaauccuucuuuuacgggcucaagaacaugcugggaggcauuuucgggaauguuuuucugggcaucuuccucuuucuggcucccuucgcgcuucugauucucuuuuucuuuuucggauggagacugcuguuuugucuuaaaugcugucggagaacccgcggccuccugaaguauaagcagcugaaagacgaggaagaggccggguacaagaaaaucauugagcggcucaacgauaagaaaggaaagagcagacuguucgacggcgaacgccuugcugaucggaagaucgccgagcuguucucuacaaaaacccauaucggg

SEQ ID NO: 14123 - RNA, 1932 nt, Artificial Sequence
  derived and/or modified CDS sequence (opt5) from CCHFV(Saf)__KX013487.1__Gc
uucagcgacuccaucgugaagggcaugaaaaaccugcucaauucuaccagccuggagacaucccuuucuauugaagcccccuggggagcuaucaacguccagagcacguuuaagccuaccguuuccacagccaauauugcgcugucuuggagcuccguggagcacagagggaacaaaauccucgugaccggccggagcgaaucuauuaugaagcuggaggaacgcacaggggucuccugggaucuuggaguggaggacgcuagcgagucuaaacugcucaccguuuccaucauggaucugagccaaauguacucuccgguguucgaauaucuguccggcgacagacaggucgaggaauggcccaaggccacaugcaccggggauuguccugagcggugcggauguacgagcucuaccugccuccauaaggaguggccccacucccgcaauuggagauguaacccuacauggugcuggggcgugggcaccggguguacaugcuguggaguugacgugaaagaucuguuuaccgaccauauguucgucaaguggaaaguggaauacaucaagacggaggccauugugugcgucgaacuuacaagccaggagcggcaguguucccugaucgaagcuggcacccgcuuuaaucucgggcccguuacaauuacccugagcgagccuagaaacauccaacagaaacuuccgcccgagauuaucacccugcacccuaagguggaagagggauucuuugaucucaugcaugugcagaagguccugucugccuccacagugugcaaacugcagagcugcacgcacggcauucccggggaccuccaaguuuaucacaucggaaaucugcuuaagggcgaucgggugaacggccaucugauccacaaaauugaaccucauuucaauaccucuuggaugagcugggacgggugugaucucgacuacuauugcaacaugggagacuggcccuccuguacauacaccggcgucacacagcacaaucacgcugccuuugugaaccugcuuaauaucgagaccgauuauaugaagacguuccauuuucacucuaaacgcguuacagcgcauggggacaccccgcagcuggaucucaaggccagaccuaccuacggagcuggcgaaauuacagugcuggucgagguggccgacauggagcugcacaccaaaaaggucgaaaucagcgggcucaaguucgugucccuggcuugcacaggauguuacgccugcagcucuggcauuuccuguaaaguucggauccauguggaugagcccgacgaacuuacgguccacguuaagagcucugauccugacgugguggcggccuccaccagccugauggcucgcaaacucgaguuuggcacagauuccaccuucaaggccuucucugcuaugcccaaaacaagccugugcuuuuauaucgucgaaagagaguacuguaaguccugcucugaggaagacacccagaaguguguggauacgaaacuugagcaaccccagagcauucugaucgaacacaaggggaccauuaucggaaaacagaacgacacaugcaccgccaaggccuccugcuggcucgagagcgugaaaucuuucuuuuauggccugaagaacaugcugggguccguuuucggaaacuuuuucauuggcauccuccuguuucuugcuccuuucguccugcucgugcuguuuuucauguuuggguggaagauccuguucuguuuuaaaugcugucggcgcacaagaggccuucucaaguaccggcaucugaaagacgaugaggaaaccggauauagacgcauuaucgagcggcugaauaauaagaaaggcaagaacagacuccuggacggggaacgccuugcggaucggaagauugccgagcuguucagcacgaaaacacacaucgga

SEQ ID NO: 14124 - RNA, 1932 nt, Artificial Sequence
  derived and/or modified CDS sequence (opt5) from CCHFV(Ast199)__KX056051.1__Gc
uuccuggacagcaucgugaagggcaugaaaaaccuccuuaauuccaccucucuugagacaagccuguccauugaagcccccuggggagcuaucaacguccagucuacguuuaagccuaccguuagcacagccaauauugcgcucuccuggucuagcguggagcacagagggaacaaaauccuggugaccggccgguccgaaagcauuaugaaacuugaggaacgcacaggggucucuugggaucugggaguggaggacgcuuccgagagcaagcuccugaccguuucuaucauggaucugucccaaauguacagcccgguguucgaauaucucucuggcgacagacaggucgaggaauggcccaaggccacaugcaccggggauuguccugagcggugcggauguacguccagcacaugccugcauaaggaguggccccacucccgcaauuggagauguaacccuacauggugcuggggcgugggcaccggguguacaugcuguggaguugacgugaaagaucuuuuuaccgaccauauguucaucaaguggaaagucgaauacauuaagacggaggccaucgugugcguggaacugacaucucaggagcggcaguguagccucauugaagcuggcacccgcuuuaaucuggggcccgucacaaucacccuuuccgagccuagaaacauucaacagaaacugccgcccgagaucauuacccuccacccuaagaucgaagagggauucuuugaucugaugcauguucagaaggugcugagcgccucuacagugugcaaacuccaguccugcacgcacggcauccccggggaccugcaaauuuaucacaucggaaaucuucugaagggcgaucggcucaacggccaucugauucacaaaaucgaaccucauuucaauaccagcuggaugucuugggacgggugugaucuugacuacuauugcaacaugggagacuggcccagcuguacauacaccggcgucacacagcacaaucacgcugccuuugugaaccugcucaauauugagaccgauuauacgaagacauuccauuuucacuccaaacgcguuaccgcgcauggggacaccccgcagcuggaucugaaggccagaccuacauacggagcuggcgaaaucaccgugcucgucgagguggccgacauggagcugcacaccaaaaagguugaagugucugggcuuaaguucgcuagccuggccugcacgggauguuacgcgugcuccagcggcaucucuuguaaaguccggauucauguggaugagcccgacgaacucaccguccacgugaaguccagcgauccugacguuguggccgcuucuacaucccugauggcccgcaaacuugaguuuggcaccgauagcacauucaaggcuuucuccgccaugcccaaaaccucucugugcuuuuauaucgucgaaagagaguacuguaagagcugcuccgaggacgauacgaagaaauguguggacaccaagcucgaacagccccaaucuauucugaucgagcacaaagggacaauuaucggaaagcagaacgauaccugcacagccaaagcuagcugcuggcuggaauccguuaagagcuucuuuuauggccucaagaacaugcuggggucuguguucggaaacuuuuucgucggcauccuucuguuucucgcgccuuucgugcugcuggugcuguuuuucauuuuuggguggaaaauccucuucuguuuuaagugcugucggcgcaccagaggccuguucaaauaccggcaucugaaggacgacgaggagacgggauauagaaaaauuaucgaacgccucaauuccaagaagggcaaaaaucggcugcuugauggggagagacuggccgaccgcaagauugcugaacucuucagcacaaaaacccacaucgga

SEQ ID NO: 14125 - RNA, 1932 nt, Artificial Sequence
  derived and/or modified CDS sequence (opt5) from CCHFV(Ast149)__KX056054.1__Gc
uuccuggacagcaucgugaagggcaugaaaaaccuccuuaauuccaccucucuugagacaagccuguccauugaagcccccuggggagcuaucaacguccagucuacguuuaagccuaccguuagcacagccaauauugcgcucuccuggucuagcguggagcacagagggaacaaaauccuggugaccggccgguccgaaagcauuaugaaacuugaggaacgcacaggggucucuugggaucugggaguggaggacgcuuccgagagcaagcuccugaccguuucuaucauggaucugucccaaauguacagcccgguguucgaauaucucucuggcgacagacaggucgaggaauggcccaaggccacaugcaccggggauuguccugagcggugcggauguacguccagcacaugccugcauaaggaguggccccacucccgcaauuggagauguaacccuacauggugcuggggcgugggcaccggguguacaugcuguggaguugacgugaaagaucuuuuuaccgaccauauguucaucaaguggaaagucgaauacauuaagacggaggccaucgugugcguggaacugacaucucaggagcggcaguguagccucauugaagcuggcacccgcuuuaaucuggggcccgucacaaucacccuuuccgagccuagaaacauucaacagaaacugccgcccgagaucauuacccuccacccuaagaucgaagagggauucuuugaucugaugcauguucagaaggugcugagcgccucuacagugugcaaacuccaguccugcacgcacggcauccccggggaccugcaaauuuaucacaucggaaaucuucugaagggcgaucggcucaacggccaucugauucacaaaaucgaaccucauuucaauaccagcuggaugucuugggacgggugugaucuugacuacuauugcaacaugggagacuggcccagcuguacauacaccggcgucacacagcacaaucacgcugccuuugugaaccugcucaauauugagaccgauuauacgaagacauuccauuuucacuccaaacgcguuaccgcgcauggggacaccccgcagcuggaucugaaggccagaccuacauacggagcuggcgaaaucaccgugcucgucgagguggccgacauggagcugcacaccaaaaagguugaagugucugggcuuaaguucgcuagccuggccugcacgggauguuacgcgugcuccagcggcaucucuuguaaaguccggauucauguggaugagcccgacgaacucaccguccacgugaaguccagcgauccugacguuguggccgcuucuacaucccugauggcccgcaaacuugaguuuggcaccgauagcacauucaaggcuuucuccgccaugcccaaaaccucucugugcuuuuauaucgucgaaagagaguacuguaagagcugcuccgaggacgauacgaagaaauguguggacaccaagcucgaacagccccaaucuauucugaucgagcacaaagggacaauuaucggaaagcagaacgauaccugcacagccaaagcuagcugcuggcuggaauccguuaagagcuucuuuuauggccucaagaacaugcuggggucuguguucggaaacuuuuucgucggcauccuucuguuucucgcgccuuucgugcugcuggcccuguuuuucauuuuuggguggaaaauccucuucuguuuuaagugcugucggcgcaccagaggccuguucaaauaccggcaucugaaggacgacgaggagacgggauauagaaaaauuaucgaacgccucaauuccaagaagggcaaaaaucggcugcuugauggggagagacuggcugaccgcaagauugccgaacucuucagcacaaaaacccacaucgga

SEQ ID NO: 14126 - RNA, 1932 nt, Artificial Sequence
  derived and/or modified CDS sequence (opt5) from CCHFV(Ast137)__KX056057.1__Gc
uuccuggacagcaucgugaagggcaccaaaaaccuccuuaauuccacaucucuugagacgagccuguccauugaagcccccuggggagcuaucaacguccagucuaccuuuaagccuacaguuagcaccgccaauauugcgcucuccuggucuagcguggagcacagagggaacaaaauccuggugacaggccgguccgaaagcauuaugaaacuugaggaacgcaccggggucucuugggaucugggaguggaggacgcuuccgagagcaagcuccugacaguuucuaucauggaucugucccaaauguacagcccgguguucgaauaucucucuggcgacagacaggucgaggaauggcccaaggcuaccugcacgggggauuguccugagcggugcggauguaccuccagcacaugccugcauaaggaguggccccacucccgcaauuggagauguaacccuaccuggugcuggggcgugggcacaggguguaccugcuguggaguugacgugaaagaucuuuuuacggaccauauguucaucaaguggaaagucgaauacauuaagacagaggccaucgugugcguggaacugaccucucaggagcggcaguguagccucauugaagccggcacacgcuuuaaucuggggcccgucaccaucacccuuuccgagccuagaaacauucaacagaaacugccgcccgagaucauuacacuccacccuaagaucgaagagggauucuuugaucugaugcauguucagaaggugcugagcgccucuacggugugcaaacuccaguccugcacccacggcauccccggggaccugcaaauuuaucacaucggaaaucuucugaagggcgaucggcucaacggccaucugauucacaaaaucgaaccucauuucaauacaagcuggaugucuugggacgggugugaucuugacuacuauugcaacaugggagacuggcccagcuguaccuacacaggcgucacccagcacaaucacgcugccuuugugaaccugcucaauauugagacggauuauacaaagaccuuccauuuucacuccaaacgcguuaccgcgcauggggacacaccgcagcuggaucugaaggccagaccuaccuacggagcuggcgaaaucacagugcucgucgagguggccgacauggagcugcacacgaaaaagguugaagugucugggcuuaaguucgcuagccuggccugcaccggauguuacgcgugcuccagcggcaucucuuguaaaguccggauucauguggaugagcccgacgaacucacaguccacgugaaguccagcgauccugacguuguggccgcuucuaccucccugauggcccgcaaacuugaguuuggcacagauagcaccuucaaggcuuucuccgccaugcccaaaacgucucugugcuuuuauaucgucgaaagagaguacuguaagagcugcuccgaggacgauaccaagaaauguguggacacaaagcucgaacagccccaaucuauucugaucgagcacaaagggaccauuaucggaaagcagaacgacacaugcaccgccaaagcuagcugcuggcuggaauccguuaagagcuucuuuuauggccucaagaacaugcuggggucuguguucggaaacuuuuucgucggcauccuucuguuucucgcgccuuucgugcugcuggugcuguuuuucauuuuuggguggaaaauccucuucuguuuuaagugcugucggcgcacgagaggccuguucaaauaccggcaucugaaggaugacgaggagacaggauauagaaaaauuaucgaacgccucaauuccaagaagggcaaaaaucggcugcuugauggggagagacuggccgaccgcaagauugcugaacucuucagcaccaaaacacacaucgga

SEQ ID NO: 14127 - RNA, 1932 nt, Artificial Sequence
  derived and/or modified CDS sequence (opt5) from CCHFV(Ast133)__KX056060.1__Gc
uucagcgacuccaucgugaagggcaugaaaaaccugcucaauucuaccagccuggagacaucccuuucuauugaagcccccuggggagcuaucaacguccagagcacguuuaagccuaccguuuccacagccaauauugcgcugucuuggagcuccguggagcacagaggaaacaaaauccucgugaccggccggagcgaaucuauuaugaagcuggaggaacgcacaggggucuccugggaucuuggaguggaggacgcuagcgagucuaaacugcucaccguuuccaucauggaucugagccaaauguacucuccgguguucgaauaucuguccggcgacagacaggucgaggaauggcccaaggccacaugcaccggggauuguccugagcggugcggauguacgagcucuaccugccuccauaaggaguggccccacucccgcaauuggagauguaacccuacauggugcuggggcgugggcaccggguguacaugcuguggaguugacgugaaagaucuguuuaccgaccauauguucaucaaguggaaagucgaauacauuaagacggaggccaucgugugcguggaacuuacaagccaggagcggcaguguucccugauugaagcuggcacccgcuuuaaucucgggcccgucacaaucacccugagcgagccuagaaacauucaacagaaacuuccgcccgagaucauuacccugcacccuaagaucgaagagggauucuuugaucucaugcauguucagaaggugcugucugccuccacagugugcaaacugcagagcugcacgcacggcauccccggggaccuccaaauuuaucacaucggaaaucugcuuaagggcgaucgggucaacggccaucugauucacaaaaucgaaccucauuucaauaccucuuggaugagcugggacgggugugaucucgacuacuauugcaacaugggagacuggcccuccuguacauacaccggcgugacacagcacaaucacgcugccuuuguuaaccugcuuaauauugagaccgauuauacgaagacauuccauuuucacucuaaacgcgugaccgcgcauggggacaccccgcagcuggaucucaaggccagaccuacauacggagcuggcgaaaucaccguccugguggagguugccgacauggagcugcacacaaagaagguggaaaucagcgggcucaaguucgcuucccugacgugcaccggauguuacgccugcagcucuggcauuuccuguaaaguccggauccauguggaugagcccgacgaacuuacaguccacgugaaaagcucugauccugacguuguggcggccuccaccagccugauggcucgcaaacucgaguuuggcacagauuccaccuucaaggccuucucugcuaugcccaaaacgagccugugcuuuuauauugucgaaagagaguacuguaaguccugcucugaggacgauaccaagaaauguguggacacaaagcuggaacagccccaaagcauccugauugagcacaaagggaccaucaucggaaagcagaacgacacaugcaccgccaaagccuccugcuggcucgaaagcguuaagucuuucuuuuauggccugaagaacaugcugggguccguguucgggagcuuuuucgucggcauucuccuguuucuugcuccuuucgugcugcucgugcuguuuuucauguuuggguggaaaauccuguucuguuuuaagugcugucggcgcacgagaggccuuuucaaauaccggcaucucaaggaugacgaggagacaggauauagacgcauuaucgaacggcuuaauucuaaaaagggcaagaacagacugcucgauggggagcgccuggcggaccggaaaauugccgaacuuuucuccagcaagacccacaucgga

SEQ ID NO: 14128 - RNA, 1932 nt, Artificial Sequence
  derived and/or modified CDS sequence (opt5) from CCHFV(SK/2015/human)__KX458183.1__Gc
uuccuggacagcaucgugagaggcaugaagaaccuccuuaauuccaccucucuugagacaagccuguccauugaagcccccuggggagcuaucaacguccagucuacguacaaaccuaccguuagcacagccaauauugcgcucuccuggucuagcguggagcaccgggggaacaagauccugguguccggccgcagcgaaucuauuaugaaacuugaggaaagaaccggggucuccugggaucugggaguggaggacgcuagcgagucuaagcuccugacaguuuccgugauggaucugagccaaauguauucuccggucuuugaauaccucuccggcgacagacagguggaggaauggcccaaagcuaccugcacaggggauuguccugagcgcugcggauguaccacgucuaccugccugcauaaggaguggccccacuccagaaauuggcgguguaacccuacauggugcuggggcguuggcaccggguguacaugcuguggacuugacgugaaggaucuguucaccgacuauauguuugucaaauggaagguggaauacaucaaaacggaggccaucgugugcgucgaacucacaucucagggccgccaguguagccugauugaggcugggaccagauucaaucuuggauccguuacaaucacccugagcgaaccccggaacauucaacauaagcucccuccggagaucauuacccugcacccccgcaucgaggaaggcuuuuucgaucugaugcaugugcagaaagugcucucugccuccacagucugcaagcugcagagcugcacgcacggggugccuggagaccuucagguuuaucacauuggcaaucugcucaagggcgauaaagugaacgggcaucugauccacaagaucgagccccauuuuaauaccucuuggaugagcugggacggaugugaucuugacuacuauugcaacaugggcgacuggccuuccuguacauacaccggggucacacaacacaaucacgcuucuuucgugaaccugcucaauauugaaaccgauuacacgaaaaacuuucauuuccacagcaagagaguuacagcccauggagacacaccccagcuggaucugaaagcgcggccgaccuauggcgccggggagaucaccgugcucgucgaaguggcugacauggagcugcacaccaagaaaauugagaucuccggacuuaaguuugccagccugacaugcacgggcuguuacgcuugcagcuccggcauuagcuguaagguccgcauccauguggaugaaccugacgagcucaccguucacgugaaaucugaugaccccgaugucguggccgcguccagcucccugauggccagaaagcuggaguucgggacagacucuaccuuuaaagccuucagcgccaugccuaagacaucccugugcuucuauaucguugaacgggaauacuguaaaucuugcagcaaggaggauacccagaagugugugaacacgaaacucgagcagccccaauccauucugaucgaacaccgcggaaccauuaucggcaagcagaauaacacaugcauugcuaaagccagcugcuggcuggagucugucaaguccuuuuucuaugggcucaaaaauaugcugagcggaaucuuuggcaaccuuuuccuggggaucuuucucuuccuggcccccuuuauucugcuuauccucuucuuuauguucggcuggcggauucuguuuuguuucaagugcugucggagaacccgcggacuguuuaaguaccggcaucucaaagacgacgaagagacaggcuauagacgcaucauugagcggcugaauaacaagaaagggaagaauaaacuucuggauggagaaagacucgcugaccgccggaucgcggagcuguucucuaccaagacgcacauuggc

SEQ ID NO: 14129 - RNA, 1932 nt, Artificial Sequence
  derived and/or modified CDS sequence (opt5) from CCHFV(YL16070)__KY354081.1__Gc
uuccuggacagcaucgccaagggcaugaaaucccuccugaacucuaccagccuugagacaucccugucuauugaagcucccuggggagccaucaaugugcagagcacguuuaagccuaccgucuccgcggcuaacauugcccucucuuggagcuccguugagcacagagggaauaaaauccuggugagcggccggucugaauccauuaugaagcucgaggaacgcacaggggugagcuggaaccugggagucgaggaugccucugaguccaaaacccucacagugagcguuauggaccugucucaaauguacuccccgguguucgaauaucugagcggcgauagacaggucgaggaauggcccaaggcuaccugcacaggggacuguccugagcggugcggauguaccuccucuacgugccuccauaaggaguggccccacagccgcaauuggagauguaacccuaccuggugcuggggcgugggcacaggguguaccugcuguggacuggauguuaaagacuuuuucacagauuacaugcuugugaaguggaaagucgaauauaucaagaccgaggccaucgugugcguggaacugacgucccaggagcggcaguguagccucauugaagcuggcacacgcuuuaaucuggggcccgucaccaucacacuuucugagccuagaaacguucaacagcggcugccgcccgagauugugacccuccauccuaaaaucgaagagggauucuuugaccugaugcacgugcagaagauucuguccgccagcaccgucugcaagcuccagucuugcacacauggcgugcccggggauuuccaaguuuaccacgugggaaaucugcuucgcggcgacaaagucaacggccacagcauccauaagauugaaccucacuuuaauacguccuggaugucuugggaugggugugaccuggauuauuucugcaacaugggagacuggcccagcuguaccuacacaggcgugacccagcauaauagagcggccuuuaucaacaugcucaauaucgagacagacuauaccaaaacguuccacuuucacuccaagcggguuacagcucauggggauaccccgcagcuggaccuuaaagcccgcccugcuuacggagccggcgaagugaccguccugguggaggucgcggaucucgagcugcacacaaagaaacuggaagugagcgggcucaagauugccucucugaccugcuccggauguuacgcuugcagcucuggcaucuccuguaagguucggauucaugugaacgagcccgacgaauuuacaguccacgugagaagcuccgauccugacguuguggccgcuggcucuagccuuauggcccgcaaaaucgaguucggggccgauuccacguuuaaggcuuucucuagcaugcccaaagacucccugugcuuuuauauugucgaaaaggauuacuguagcucuugcaccgacgaugacacacagaaaugugugaacaccaagcucgaccauccccaauccauccugaucgagcacaagggaacaauuaucggcaaacagaaugauaccugcagcacgaagaccucuugcuggcuuaaauccuucaagggguuuuucuauggacugaaaaacaugcucagcggcauuuuugggaauguguuccugggcauccugcucuuucuggcgccuuucguucuucugauuuucuucuuuuucuucggauggagacuccuguuuugucugaagugcuguaagaaaacaaagggccuucucaaauacaagcaccugaaagacaaggaggaagccggguauaagaaaaucaucgagcggcugaacggaaagaaaggcaagucucagcuuuucgauggggaaagacuggcuaaucgcaaaauugccgagcuuuuuagcaccaagauccauauugga

SEQ ID NO: 14130 - RNA, 1932 nt, Artificial Sequence
  derived and/or modified CDS sequence (opt5) from CCHFV(Oman_812956)__KY362518.1__Gc
uucuuugacagcaucgccaagggcaugaaaaaccugcucaauuccaccucucuggagacaagccuuuccauugaagcucccuggggagccaucaacgugcagucuacguucaagccuaccgucagcacagcgaauauugcucuguccuggucuagcguugagcacagagggaacaaaauccucguguccggccggagcgaaucuauuaugaagcuggaggaacgcaccgggaucuccugggaucuuggaguggaggacgccagcgagucuaaacugcucacagucuccgugauggaucugagccaaauguacucuccgguuuuugaauaucuguccggcgacagacagguggaggaauggcccaaggcuaccugcacaggggauuguccugagcggugcggauguaccagcuccacgugccuccauaaggaguggccccacucucgcaauuggagauguaacccuaccuggugcuggggcgucggcacaggguguaccugcuguggacuggacgugaaagaucuuuucacagacuacauguuuguuaaguggaaaguggaauauaucaagaccgaggccauugucugcguggaacugacgagccaggagcggcaguguucccucaucgaagccggcacacgcuucaaucuggggcccgugaccauuacacuuagcgagccuagaaacauccaacagaaacugccgcccgagauugucacccuccauccucggaucgaagagggauuuuucgaucugaugcacguucagaaggugcugucugcuuccaccgugugcaagcuccagagcugcacacauggcguccccggggaccugcaaguguaccacauuggaaaucuucugaaaggcgauaagguuaacggccaccucauccauaaaguggaaccucacuuuaauacgucuuggaugagcugggacgggugugaucuggacuauuacugcaacaugggagacuggcccuccuguaccuauacaggcgucacccagcauaaucacgccgcguucgugaaccuucugaauaucgagacagauuacaccaagaacuuucacuuccauucuaaacgcguuacggcccacggggacacaccgcagcucgaucugaaggcuagaccuaacuacggagccggcgaaauuaccgugcuggucgagguggcugacauggagcuccauaccaaaaagaucgaaauuagcgggcugaaguuugccucccuuacaugcaccggauguuaugcgugcagcucuggcaucuccuguaaaguccggauucacguggaugagcccgacgaacugacaguucaugucaagagcgaggauccugacaucguggccgcuucuuccagccucauggcccgcaaacuggaauuuggcacggauuccaccuucaaggcuuuuucugccaugcccaaaacaagccuuugcuucuacaucguggagagagaguauuguaaguccugcucuaaggaagacacccagaaauguguuaaugccaagcuggagcggccccaaagcauucucaucgaacacaaagggacaauuaucggaaagcagaacgauaccugcacggcuaaagcguccugcuggcuggagagcgugaagucuuucuucuacggccugaagaauaugcucuccgggauuuuuggaaacgucuucaucggcaucuuucuguuccuugccccuuuuauucugcucauccuguucuuuauguucggguggcgcauucuguuuuguuucaaaugcuguagacggaccagaggccuuuucaaguaucgccaccucaaagacgacgaggaaacaggauaccggaagaucauugagagacugaauaacaaaaagggcaagaauaaacugcucgauggggaacgccuggcugaccggaagaucgccgagcuuuuuagcaccaaaacacauauugga

SEQ ID NO: 14131 - RNA, 1932 nt, Artificial Sequence
  derived and/or modified CDS sequence (opt5) from CCHFV(UCCR4405)__KY484029.1__Gc
uuccuggacagcaccgugaagggcaugaaaaaccuccuuaauuccacaucucuugagacgagccuguccaucgaagcccccuggggagcuauuaacguccagucuaccuuuaagccuacaguuagcaccgccaauaucgcgcucuccuggucuagcguggagcacagagggaacaaaauucuggugacaggccgguccgaaagcaucaugaagcuggaggaacgcaccggggucucuugggaucugggaguggaggacgcuuccgagagcaaacuccugacaguuucuauuauggaucugucccaaauguacagcccgguguucgaauaucucucuggcgacagacaggucgaggaauggcccaaggcuaccugcacgggggauuguccugagcggugcggauguaccuccagcacaugccugcauaaggaguggccccacucccgcaauuggagauguaacccuaccuggugcuggggcgugggcacaggguguaccugcuguggaguugacgugaaagaucuuuuuacggaccauauguucgucaaguggaaaguggaauacaucaagacagaggccaucgugugcgucgaacugaccucucaggagcggcaguguagccucauugaagccggcacacgcuuuaaucuggggcccguuaccaucacccuuuccgagccuagaaacauucaacagaaacugccgcccgagaucauuacacuccacccuaagaucgaagagggauucuuugaucugaugcaugugcagaaggugcugagcgccucuacggucugcaaacuccaguccugcacccacggcauucccggggaccugcaaaucuaucacaucggaaaucuucugaagggcgaucgggugaacggccaucucauucacaaaaucgaaccucauuucaauacaagcuggaugucuugggacgggugugaucuggacuacuauugcaacaugggaaauuggcccagcuguaccuacacaggcguuacccagcacaaccacgcugccuuugugaaucuucugaacauugagacggacuauacaaagaccuuccauuuucacuccaaacgcgucaccgcgcauggggauacaccgcagcucgaccugaaggccagaccuaccuacggagcuggcgaaaucacagugcugguugagguggccgauauggagcuccacacgaaaaaggucgaaauuucugggcugaaguucgcuagccuugugugcaccggauguuacgccugcuccagcggcaucucuuguaaaguccggauccauguggacgagcccgaugaacugacaguucacgugaaguccagcgacccugaugucguggcggccucuaccucccucauggcucgcaaacuggaguuuggcacagacagcauuuucaaggccuucuccgcuaugcccaaaaccucucuuugcuuuuauaucguugaaagagaguacuguaagagcugcuccgaggaugacacgaagaaauguguggauaccaagcuggaacagccccaaucuauucucaucgagcacaaagggacaauuaucggaaagcagaacgauaccugcacagccaaagccagcugcuggcuggaauccgucaagagcuucuuuuauggccugaagaauaugcucgggucuguguucggaaacuuuuucgugggcauccugcuuuuucuggcuccuuucguucuccugguccuguuuuucauguuuggguggaaaauucuuuucuguuuuaagugcugucggcgcaccagaggccucuucaaauaccggcaucugaaggacgacgaggagacgggauauagacgcaucauugaacggcucaauuccaaaaagggcaagaacagacugcuggacggggagcgccuugcggaucggaaaaucgccgaacuguucagcacaaagacccacauugga

SEQ ID NO: 14132 - RNA, 1932 nt, Artificial Sequence
  derived and/or modified CDS sequence (opt5) from CCHFV(UCCR4401)__KY484035.1__Gc
uuccuggacagcaccgccaagggcaugaaaaaccuccuuaauuccacaucucuugagacgagccuguccaucgaagcucccuggggagccauuaacgugcagucuaccuacaagccuacagucagcaccgcgaauaucgcucucuccuggucuagcguugagcacagagggaacaaaauucugguguccggccggagcgaaucuaucaugaaacuugaggaacgcacagggauuuccugggaucugggaguggaggacgccagcgagucuaaacuccugaccgucuccgugauggaucugagccaaauguauucuccgguuuuugaauaccucuccggcgacagacagguggaggaauggcccaaggccacaugcaccggggauuguccugagcggugcggauguacgagcucuaccugccugcauaaggaguggccccacucucgcaauuggagauguaacccuacauggugcuggggcgucggcaccggguguacaugcuguggacuugacgugaaagaucuguucaccgacuauauguuuguuaaguggaaaguggaauacaucaagacggaggcuaucgucugcguggaacucacaagccaggagcggcaguguucccugauugaagccggcacccgcuucaaucuugggcccgugacaaucacccugagcgagccuagaaacauucaacagaaacucccgcccgagaucauuacccugcauccucggaucgaagagggauuuuucgaucugaugcacguccagaagguucucucugcuuccacagugugcaagcugcagagcugcacgcauggcgugcccggggaccuucaagucuaucacauuggaaaucugcucaaaggcgauaaggugaacggccaccugauccauaaaaucgaaccucacuuuaauaccucuuggaugagcugggacgggugugaucuugacuacuauugcaacaugggagacuggcccuccuguacauacaccggcguuacacagcauaaucacgccucuuucgugaaccugcucaauauugagaccgauuacacgaagaacuuucacuuccauagcaaacgcgucacagcgcacggggacaccccgcagcuggaucugaaggccagaccuaccuauggagcuggcgaaaucacagugcucguugagguggccgacauggagcugcauaccaaaaagauugaaaucuccgggcuuaaguuugcuagccuggccugcacaggauguuacgcgugcuccuccggcauuagcuguaaaguccggauccacguggaugagcccgacgaacucacgguccaugugaagucugaugacccugauguuguggccgcuuccagcucccugauggcccgcaaacuugaguucggcaccgacucuacauuuaaggcuuucagcgccaugcccaaaaccucccugugcuucuauaucgucgaaagagagcacuguaagucuugcagcgaggaagauacaaagaaaugugugaacaccaagcucgagcagccccaauccauucugaucgaacacaaagggacgauuaucggaaagcagaauagcacaugcaccgccaaggcuucuugcuggcuggaguccguuaagagcuuuuucuacggccucaagaacaugcugucugggauuuuuggaaauguguucaugggcaucuuucuuuuccuggcgccuuuuauccuccugauucuguucuuuauguucggguggcggauccuguuuuguuucaaaugcugucgcagaacccggggccucuuuaaguauagacaucugaaagacgacgaggaaacaggauaccgccggauuaucgagaagcugaacaauaaaaagggcaagaacaaacuccuggauggggaaagacuugccgaccgccggauugcugagcuguucuccaccaagacgcacaucgga

SEQ ID NO: 14133 - RNA, 1932 nt, Artificial Sequence
  derived and/or modified CDS sequence (opt5) from CCHFV(UCCR4448)__KY484042.1__Gc
uuccuggacagcaucgugaagggcaugaaaaaccuccuuaauuccaccucucuugagacaagccuguccauugaagcccccuggggagcuaucaacguccagucuacguacaagccuaccguuagcacagccaauauugcgcucuccuggucuagcguggagcacagagggaacaaaauccugguguccggccggagcgaaucuauuaugaaacuugaggaaaagaccgggaucuccugggaucugggagucgaggacgcuagcgagucuaagcuccugacaguguccguuauggaucugagccaaauguauucuccgguguuugaauaccucuccggcgaccgccaggucgaggaauggcccaaggcuaccugcacaggggauuguccugagagaugcggauguaccagcuccacgugccugcauaaagaguggccccacucucggaauuggcgcuguaacccuaccuggugcuggggcgugggcacaggguguaccugcuguggacuugacguuaaggaucuguucacagacuauauguuugugaaauggaaggucgaauacaucaaaaccgaggccauugugugcguggaacucacgagccaggagagacaguguucccugaucgaagccggcacacgguucaaucuugggcccgucaccauuacacugagcgagccucgcaacauccaacagaagcucccgcccgagauuaucacccugcauccuagaauugaagagggauuuuucgaucugaugcacguucagaaggugcucucugccuccaccgugugcaaacugcagagcugcacacauggcguccccggggaccuucaaguguaucacaucggaaaucugcucaagggcgauaaaguuaacggccaccugauccauaagauugaaccucacuuuaauacgucuuggaugagcugggacgggugugaucuugacuacuauugcaacaugggagacuggcccuccuguaccuacacaggcgugacccagcauaaucacgcuucuuucgucaaccugcucaauaucgagacagauuacaccaaaaacuuucacuuccauagcaagcgggugacggcccacggggacacaccgcagcuggaucugaaagcgcgcccuaccuauggagccggcgaaauuaccguucucguggaggucgcugacauggagcugcauacaaagaagaucgaaauuuccgggcuuaaauuugccagccugaccugcacaggauguuacgcuuguucuuccggcaucagcugcaaggugagaauccacgucgaugagcccgacgaacucacggugcauguuaaaucugaugacccugauguggucgccgcguccagcucccugauggcccggaaacuugaguucggcaccgacucuacauuuaaggcuuucagcgccaugcccaagaccucccugugcuucuauauuguggaacgcgagcacuguaagucuugcagcgaggaagauaccaaaaaguguguuaacaccaaacucgagcagccccaauccauccugauugaacacaaggggacgaucauuggaaaacagaauagcacaugcacagcuaaggccucuugcuggcuggaguccgucaagagcuuuuucuacggccucaaaaacaugcugucugggaucuuuggaaauguguucaucggcauuuuucuuuuccuggccccuuuuauccuccugauucuguucuuuauguucggguggaagauccuguuuuguuucaaaugcuguagacggacccgcggccucuuuaaguauagacaucugaaagacgacgaggaaacaggauaccggagaauuaucgagcgccugaacaauaagaagggcaaaaacaagcuccuggauggggaaauucuugcugaccggagaaucgcggagcuguucuccaccaaaacgcacaucgga

SEQ ID NO: 14134 - RNA, 1932 nt, Artificial Sequence
  derived and/or modified CDS sequence (opt5) from CCHFV(U2-2-002/U-6415)__AY900144.1__Gc
uuccaggacagcaucgugaagggcaugaaaaaccugcucaauuccaccucucuggagacaagccuuuccauugaagcccccuggggagcuaucaacguccaaucuacguacaagccuaccguuagcgccgcgaauauugcucuguccuggucuagcguggagcacagagggaacaaaauccucguguccggccggagcgaaucuauuaugaagcuggaggaacgcacagggaucuccugggaucuuggagucgaggacgccagcgagucuaaacugcucaccguguccguuauggaucugagccagauguauucuccgguguuugaauaccuguccggcgacagacaggucgaggaauggcccaaggccacaugcaccggggauuguccugagcggugcggauguacaagcucuaccugccuccauaaggaguggccccacucccgcaauuggagauguaacccuacguggugcuggggcgugggcaccggguguacaugcuguggacuggacguuaaagaucuuuucaccgacuauauguuugugaaguggaaagucgaauacaucaagacagaggcuauugugugcguggaacugaccagccaggagcggcaauguucccucaucgaagccggcacgcgcuucaaucuggggcccgucacaauuacccuuagcgagccuagaaacauccagcagaaacugccgcccgagauuaucacacuccauccucggauugaagagggauuuuucgaucugaugcacguucagaaggugcugucugcuuccaccgugugcaagcuccaaagcugcacccauggcguccccggggaccuucagguguaucacaucggaaaucugcugaaaggcgauaagguuaacggccaccucauccauaaaauugaaccucacuuuaauacaucuuggaugagcugggacgggugugaucuggacuacuauugcaacaugggagacuggcccuccuguacguacaccggcgugacacagcauaaucacgccucuuucgucaaccuucugaauaucgagaccgauuacacaaagagcuuucacuuccauuccaaacgcgugaccgcgcacggggacacgccgcagcucgaucugaaggccagaccuagcuauggagcuggcgaaauuacaguucugguggaggucgccgacauggagcuccauaccaaaaagaucgaaauuucugggcugaaguuugcuucccuuaccugcacaggauguuacgccugcagcucuggcaucuccuguaaagugcggauccacgucgaugagcccgacgaguucaccgugcauguuaagagcgaugacccugauguggucgcggccuccucuagccugauggcucgcaaacucgaauuuggcacagacuccacguucaaggccuucucugcuaugcccaaaaccagccugugcuuuuauauuguggaaagagaguacuguaaguccugcagcgaggaagauacacaaaaguguguuaacaccaaacuugagcagccccagucuauccugauugaacacaaggggacaaucauuggaaaacaaaacaauaccugcacggccaaggccuccugcuggcucgagagcgugaaaucuuucuuuuauggccugaagaacaugcuguccgggaucuucggaaaugucuuugugggcaucuuccucuuucuggcuccuuucauucuucugauccucuuuuucauguuuggguggcggauucuguucuguuuuaagugcugucgcagaacccggggccuguucagauacaaacaccuugagaacgacgaagagacaggauaucgccggaucauugaaagacucaauaacaagaaaggcaagaauaaacugcuggacggggagcgccucgcggaucggagaaucgccgaacuguucagcaccaagacacauauugga

SEQ ID NO: 14135 - RNA, 1932 nt, Artificial Sequence
  derived and/or modified CDS sequence (opt5) from CCHFV(SPU 45/88)__KJ682809.1__Gc
uuccuggacagcaucgugaagggcaaaaagaaccuccuuaauuccaccucucuggagacaagccuguccauugaagcccccuggggagcuaucaacguccagucuacguuuaaaccuaccguuagcgccgcgaauauugcucucuccuggucuagcguggagcacagagggaacaagauccugguguccggccggagcgaaucuauuaugaaacuugaggaacgcacagggaucuccugggaucugggagucgaggacgccagcgagucuaagcuccugaccguguccguuauggaucugagccaaauguacucuccgguguucgaauaucucuccggcgacagacaggucgaggaauggcccaaggccacaugcaccggggauuguccugagcggugcggauguacaagcucuaccugccugcauaaagaguggccccacucucgcaauuggagauguaacccuacguggugcuggggcgugggcaccggguguacaugcuguggacuugacguuaaggaucuguuuaccgacuacauguucgugaaauggaaggucgauuauaucaaaacagaagcuauugugugcguggagcucaccagccaggaacggcaguguucccugaucgaggccggcacgcgcuuuaaucuugggcccgucacaauuacccugagcgaaccuagaaacauccaacagaagcucccgcccgagauuguuacacugcauccucggaucgaggaaggauucuuugaccugaugcacgugcagaaugugcucucugcuuccaccgucugcaagcugcagagcugcacccauggcgugcccggggaucuucaaauuuaccacaucggaaaccugcucaaaggcgacaagguuaauggccaccugauccauaaaauugagccucacuucaacacaucuuggaugagcugggaugggugugaccuugacuauuacugcaauaugggagauuggcccuccuguucuuauacgggcgugacccagcauaaccacgccgcguuugucaauaugcugaacaucgaaacagacuacaccaagaacuuccacuuucauagcaaacgcgugacagcccacggggauaccccgcagcucgaccugaaggcuagaccuacguacggagccggcgagauuacaguucugguggaagucgcugauauggagcuccauaccaaaaagaucgagauuuccgggcugaaguucgccagccuuaccugcacaggauguuaugcgugcuccuccggcaucagcuguaaagugcggauccacgucgacgaacccgaugagcugaccgugcauguuaagucugaagacccugauauuguggccgcuuccagcucccucauggcccgcaaacuggaguuuggcacagacucuacguucaaggcuuucagcgccaugcccaaaaccucccuuugcuuuuacaucgucgaaagagaguauuguaagucuugcagcaaggaggauacacagaaaugugugaauaccaagcuggaacaaccccaguccauucucaucgagcacaaagggacaauuaucggaaagcagaacgauaccugcacggccaaagcuagcugcuggcuggaaucuguuaaguccuucuuuuacggccugaagaauaugcucagcgggaucuucggaaacguguuuauuggcauccugcuuuuccuggcgccuuuuauuaugcucauccuguucuuuauguucggguggcggauucuguuuuguuucaaaugcugucgcagaacccggggccuuuuuaaguauagacaccucaaagacgacgaggagaucggauaccgcaagauuaucgaacggcugaauaacaaaaagggcaagaauaaacugcucgacggggagagacuggccgaucgcaagaucgcugaacuuuucucuacaaaaacccauauugga

SEQ ID NO: 14136 - RNA, 1932 nt, Artificial Sequence
  derived and/or modified CDS sequence (opt5) from CCHFV(SR3)__AJ538199.1__Gc
uuccuggacagcaucgugaagggcaugaaaaaccuccuuaauuccaccucucuugagacaagccuguccauugaagcccccuggggagcuaucaacguccagucuacguacaagccuaccguuagcacagccaauauugcgcucuccuggucuagcguggagcacagagggaacaaagugcuggucuccggccggagcgaaucuaucaugaagcuggaggaacgcaccgggauuuccugggaucugggaguggaggacgcuagcgagucuaaacuccugacaguuuccgugauggaucugagccaaauguauucuccggucuuugaauaccucuccggcgacagacagguggaggaauggcccaaggcuaccugcacaggggauuguccugagcggugcggauguaccagcuccacgugccugcauaaggaguggccccacucucgcaauuggagauguaacccuaccuggugcuggggcguuggcacaggguguaccugcuguggacuugacgugaaagaucuguucacagacuauauguuugucaaguggaaaguggaauacaucaagaccgaggccaucgugugcgucgaacucacgagccaggagcggcaguguucccugauugaagccggcacacgcuucaaucuugggagcguuaccaucacacugucugagcccagaaacauucaacagaaacucccuccggagaucauuacccugcaucccaagaucgaagagggauuuuucgaucugaugcacgugcagaaggugcucuccgccagcaccgucugcaaacugcagucuugcacacauggcgugccuggggaccuucaaguuuaucacauuggaaaucugcucaagggcgaucgggugaacggccaccugauccauaaaaucgaacagcacuuuaauacgagcuggauguccugggacgggugugaucuugacuacuauugcaacaugggagacuggcccucuuguaccuacacaggcgucacccagcauaaucacgcuagcuucgugaaccugcucaauauugagacagauuacaccaagacguuucacuuccauuccaaacgcguuacagcccacggggacaccccucagcuggaucugaaggcgagacccaccuauggagccggcgaaaucacagugcucgucgagguggcugacauggagcugcauaccaaaaagauugaaaucagcgggcuuaaguuugccggacugacaugcacgggcuguuacgcuuguucuuccggcauuagcugcaaaguccggauccacguggaugagccggacgaacucaccguucaugugaagucugaugacccugaugucguggccgcguccagcucccugauggcccgcaaacuugaguucgggacagacucuaccuuuaaggcuuucagcgccaugcccaaaacaucccugugcuucuauaucguugaaagagaguacuguaagucuugcaacaaggaggauacccaaaaaugugugaacacgaagcucgaacagccucagagcauucugaucgagcacaaaggaaccauuaucggcaagcaaaauaacacaugcaccgcuaaagccuccugcuggcuggaaagcgucaaguccuuuuucuaugggcucaagaauaugcugggaggcauuuuugggaacguguucaucggcaucuuuacauuccuuacccccuuuauucugcucauccuguucuuuauguucggauggcggauucuguuuuguuucaaaugcugucgcagaacgcggggccuuuuuaaguacagacaccucaaagacgacgaggagacaggguaucgcaagaucauugaacggcugaauaacaaaaagggaaagaauagacugcucgauggcgagcgccuggccgaccggaaaaucgcugaacuuuucucuaccaagacacauauuggg

SEQ ID NO: 14137 - RNA, 4656 nt, Artificial Sequence
  derived and/or modified CDS sequence (opt5) from DUGV(ArD44313)__NC_004158.1__GP
augagcaagagagugcugaucauugccgucguuguguaccucguguucaccacacagaaccaaaucacgggcaaucacaccacaauuaacuccucuagccccuccaccacagaggcuucuagcaccccuacagucucccggaccccgcagacgaccacaaccucuacagccgugagcaccacgaucacagcgaccacaacccccaccgcuuccuggacaacgcagagccaguauuuuaauaaaaccacacaacaucacuggcgcgaagagaccaugauuucuagaaacccuacaguucuggaccggcagucccgcgccagcucugugagagaacuucugaauaccaaguuccucaugcugcuuggguuuauccccaaaggagaggucaaccaucuggaaaaugccugcaaccgggagggcaagaauuguacggagcucauccugaaagaacgcauugcuagauucuuuuccgagacagaaaaggagagcugcuacaacaccuaucuggagaagcaccuccggucuguguccccugaaguuagccugacccccuaccgcgugcuugggcugagagaggauauccuccugaaagaaauugaccggcgcaucauuagauucgagacagauucccagcgggucaccugucuuucugccagccugcucaagccugacguguuuauccgcgaacagagaauugaugcuaaaccguccaauggacccaagaucgugccugucgacagcguugccugcaugaaccuggaggcgaauguggaugugcggucuaacaaacuggucauccaaucccucaugacaacggugaagauuagccugaagaauuguaaaguuguggucaacucuagacagugcauccaucagcagaccggcagcggggugauuaagguucccaaauucgagaagcaacagggaggcacaugguccucuuauaucgccggcguguacaccgcuacaauugaccuucuggaugaaaacaaucagaacuguaaacucuuuaccgagugcaucgucaaggggcgcgaacuggugaaaggacaaagcgagcuuaaguccuucaauaucgaaguccugcucccucgggugaugaagacgagacgcaaacugcuggccguuaccgacggcagcacagaguguaacucugggacccagcucauugagggaaaguccaucgaagugcacaaacaggauauuggcgggcccggaaagaaacugacaaucugcaauggcaccagcguccuugacgugccgcuggaugagggccacggguguuauacgauuaacguuaucacaucuaagcgggcuugcagaccuaaaaauuccaaacuccagugcagcaucgacaaggaacugaaacccugugacuccggaaagugccuuucuauuagccaaaaaggcgccgggcauaucaaggugucccgcggaaagaccauucugaucacagaguguaaagaacacugccagauuccuguccccaccggcaagggggauaucaugguggacuguucuggaggccggcagcauuaccucgaggugaacauuguugauauccacugccccaauaccaaauuucugggcgggaucaugcuguacuucuguagaaugagcucccgcccuacagucgcgcuccugcuuggaauuuggaucggcugcggguauauucugacguguaucuuuagcuuccuccuguaccaccugauucuuuucuuugccaacugcaucaagcagugucggaaaaagggagagagacucggcgaaaucugcgugaagugcgagcaacagaccgugaaucugauggaccaggaacugcaugaucucaacuguaauuucaaccugugcccguauuguugcaaucgcaugucugacgaggggaugucccggcacgucggcaaaugucccaagagacuugagcggcugaacgaaauugagcucuaccugacaaccagcgaaugccugugucuuucugugugcuaucagcuccugaucuccguuggaauuuuucugaaacgcacaaccuggcucgugguccugcuugugcugcucggccuggcuaucagcccuguucaaggggcccccacggaggugucuaacgucaagcaggauggagacuacagcauuuguuauuucaucuuuggcugccuggugacagcugcccuucuccugaaaguuaagagaaccaauuccaacgggaucguggucgugguggauagcuucggacgguguccuuacugcaaugaauuuaccgacucucuguucgaggagguccuccaugauacacugugcucccuuuguguuugccccuuuugugaaaaacaggcccuggaccucgugacccuggaggaacacgugaaggagugcuacaaggucgcuacaagaaaagacauuuucaagauccugggccgcaaauuuacgaacgcgcuugugcggagagaaaaacucuucaccacagggcugcagcuguuuauuaauaaaaccaacguuguggucuucgcccucaucauguguuuccugcuucugcucacaggccauaaugcuagcgccuuugauuccggagaccugccggauggcgugugggaggagucuagccaacugguuaaguccugcacccaguucuguuauauugaagaggacgugugcuacuguccugccgaagauggggucggacgcaaacuucuguuuuucaacggccuccaaaauucugugaagagacugagcgacucccacaagcuccugacgucuguuagcaucgaugcucccugggggcggaucaacguggaguccaccuggaaaccuacacuugccgcgagcaauauugcuaugucuugguccagcaccgacaucaagggagaaaaagucauucugucuggccgcuccacaagcaucauuaagcucaaggagaaaaccggggugauguggaagcuggugggcucuggacuggccuccgagaaaaagaaacccuuuagauucccuaucauggauuuugcccaggucuauaacagcguuuuccaguacauuacaggcgaccggcuucuguccgaauggcccaaggcugugugcaccggggauuguccgcaccgcugcggaugccagacgagcacauguauggccaaggagugccauacccaggaaugugugucuacccacaugguccucggcaucgggacaggaugcaccuguugcggcauggacguggagagaccuuuuaauaaauaucuggggguuaaguggagcacggaguaccuccggacagaagugcuggucuguguggagguuaccgaagaggaacgccauugcgagaucguggaggcuggcacaagauucaacauuggacccaucaccauuacaaucuccgauccccaaaauauuggcucuaaacuuccugaaagccugaugaccguccaggagaucgacgacuccaacuuuguggauaucaugcacgucgggaacgugauuucugccgacaauagcugucggcuccaguccugcacgcacggaucugcgguuaccacacgcuucaccgcccugacagcucugaucaaggaugaccauagcuccggccuuaaccuggccgugcucgauccgaaagucaauagcucuuggcuguccugggaagggugugacauggauuauuacugcaacgugggagacuggccuaccugcacguacacaggcguugugacccagaagcucagagaguuucugaaacuugaucaacaccggaagagacugcauacaacccugagcuucucucucaagaaaaaucuguccaagcgcagccacaccuccguccggcuugaaggcaaaacagugacgagaauggaggugaagguuaccgcucugauugaggucgacgggauggaacuccauucuaaaacaauccgccugagcggcauucggcucaccggacugaaguguuccgggugcuucagcuguacaucuggaaucuccugcagcgugaacgccaaacuuaccucucccgaugaguuuacgcugcaccugagaagcacaucccccaauguggucguggcggaaaccucuaucauugcccgcaagggcccuagcgcuaccacaucccgguucaagguguuuucuguuagagacaccaaaaagaucuguuucgaggucguggaacgcgaguauugcaaagauuguacacccgacgagcucacgaccugcacagggguugaacuggagccuaccaaggacauucuucuggaacaccggggaacaaucgugcagcaucagaacgauaccuguaagagcaaaauugacugcugguccaauagcaucucuuccuuugccagcggcauuggcgauuucuuuaagcacuacaucggguccaucgcugucggagugcucggcacgguucugcccuucgcccuccugauucuguuuuucaucuauggggacaaaaugcuuuggccguuuaagguguucuguagaccuugccggcgcugcuguagaaagaacgagggauacaauaagcuggccgaggaagaggaacuccgggauauuauccgcaaguucucuaaaagcggcgagcugauuaacaaggacgcuaaagauaagagaacccuugcgcggcuguuuauguccgacaaucccaaacucaagaaggaaaagaagcugucugagaucgccuga

SEQ ID NO: 14138 - RNA, 4656 nt, Artificial Sequence
  derived and/or modified CDS sequence (opt5) from DUGV(IbAr1792)__KU925456.1__GP
augagcaagagagugcugaucauugccgucguugugugccucguguucaccacacagaaccaaaucgcuggcaaucacacgaccgccaacuccgggucucccagcacaaaagaggcguccucuaugccuaccgucagcgacacaccgcagaccacaaccacguccaccgcugugucuacaaccauuacagccaccacgacacccaccgccagcuggacaacccagucccaguacuuuaauaagaccacacaacaucacuggcgggaagagacgaugguuagccgcaacccuaccgugcugaauagacagcggcgcgcuucuuccgucaaagaacuucugaacacaaaguuccucaugcugcuuggauuuauccccaaaggcgaggugaaucaucuggaaaacgccuguaauagagaggggaagaacugcaccgagcucauucugaaggaacggaucgcucgcuucuuuagcgagacagaaaaagagucuuguuauaauaccuaccuggagaagcaccucugcuccguuagcccugaagugucucugacgcccuauagaguccuuggacugcgggaggauauccuccugaaaaagauugaccgcagaaucauucgguucgaagccgauucccagcgcgugacaugucuuagcgcgucccugcucaaaccugacguguuuaucagagagcagcggauugaugccaagccgucuaacggccccaagaucgucccuguugacagcgugcgcugcauuaaucuggaagcuaacguggaugucagauccaauaaacuggugauccaaagccucaugaccaccguuaagaucucucugaaaaacuguaagguggucgugaacucccggcagugcauucaucagcagacagggagcggaguuaucaaagugcccaaguucgagaaacaacagggcggcaccuggucuagcuacauugccggggucuauacagcuacgaucgaccuucuggaugagaagaaucagaacuguaagcucuuuaccgaaugcauugugaaaggaagagagcuggucaagggccaauccgaacuuaaaucuuucaauaucgaggugcugcucccucgcguuaugaagacacggagaaaacugcuggccgugaccgacgggagcacagaauguaacuccggaacccagcucaucgagggcaagagcauugagguccacaagcaggauaucgggggacccggcaaaaagcugacgauuugcaauggcaccucugugcuugacguuccgcuggaugaagggcacggaugcuacacaaucaacgugauuaccuccaaacgcgcgugucggccuaagaauagcaaacuccagugcucuaucgacaaggagcugaagcccugugacuccggcaaaugccuuagcaucucccaaaagggggccggacauauuaaagucucuagaggcaagacaauccugauuaccgaauguaaagagcacugccagaucccugugcccacggggaagggagauauuaugguggacuguagcggcggccgccagcauuaucucgaaguuaacaucgucgauauucacugccccaauacaaaguuucuugggggaaucaugcuguacuucugucggauguccucuagaccuaccguggcucuccugcuuggcaucuggauugggugcggauacauccugacauguauuuuuagcuuccuccuguaucaccugauccuuuucuuugccaacugcauuaaacagugccgcaagaaaggcgagcggcucggggagaucugugugaagugcgaacaacagaccgucaaucugauggaccaggagcugcaugaucucaacuguaauuucaaccugugcccguacuguugcaauagaauguccgacgaaggcaugagccgccacgugggaaaaugucccaagcggcuugagagacugaacgagaucgaacucuaucugaacuacaaacggguuccuucuugccugcgcuguaugcuuuccaccagcauuucugugggcaucuuucucaagagaacaacguggcuggucgugcugcucguucugcuugggcuggcuauuucccccgugcagggagccccugccgaggucagcaaugugaagcaagauggcgacuauucuaucugcuacuucauuuuugggugucucguuaccgcugcgcugcugcuuaaagugaagcggacaaacagcaauggaaucgucgugguggucgauuccuucggcagaugccccuauugcaacgaauuuaccgacagccucuucgaggaaguucugcaugauacacuguguucucucugcguguguccguuuugcgagaaacaggcccuggaccuugugacccuggaggaacacgucaaggaguguuacaaagugacgacacgcaaggacaucuucaagauucucgggcggaaauuuaccaaugcucugguuagacgcgaaaagcuguucaccacaggccuucagcucuuuaucaacaaaaccaauguggucguguucgcccugauuaugugcuuccugcuccugcuuacaggacauaacgccuccgcuuuugauagcggcgaccugccugaugggaucugggaggaauccucucagcucguuaagagcuguacgcaauucugcuacauugaggaggacguguguuauugccccgccgaaaauggagucggcagaaaacugcuguuuuucaacgggcuucaaaauuccgugaagcggcugucugauagccacaagcuccugaccuccguuucuaucgacgcgccuuggggagcuaucaacguggagagcacauggaaacccacccucgccgccuccaauauugcuaugagcuggucuuccacagauaucaagggcgaaaaagucauucugagcgggcgcucuaccuccaucauuaaacuuaaggagaagacgggcgugaugugggaacugggaagcgagcucgccucugagaagaaaaagcugcugguguccaucauggacuuugcucaggucuacaacagcguuuuccaguauauuaccggcgauagacuucuguccgaauggccuaaagccguguguacaggggacugcccccaccggugcggaugucagaccagcacaugcauggcgaaggaguggccgcauacccgcaauuggagauguaacccuacauggugcuggggcaucgggaccggauguacgugcuguggcauggauguggaacggcccuuuaacaaauaccucggggucaaguggucuacagaguaucugcgcaccgaggugcucguuugcguggaagucaccgacgaggaaagacacugugagaucguggaagccggcacacgguucaauauuggacccaucaccauuacgaucagcgauccucagaacauuggcuccaaacugccggagucucuuaugacaguucaggagaucgacgacagcaauuuuguggauaucaugcaugucgggaacgugauuuccgcugacaauucuugccgccugcaaagcuguacccacggauccgccggcgauuaccagaucuauucuacagacagccucauuaaggaugaccacuccagcgggcugaaccuggcuguccuugaucccaagguuaauucuuccuggcugagcugggaaggaugcgacauggauuacuacugcaacgugggcgacuggccuaccuguacauauaccggcguggucacgcaaaauucugaguccuucagcaaccucaucaauauugaaaaagauuacacccagagauuucauuuccacuccaagcggaucucugccaaagggcauacacugcagcucgaccugaaggcgagacccaaccaggauggaggcgaggugaccgcccuuaucgaaguugacgggauggagcugcacagcaaaacaauucgccuguccggaauccggcucaccggccugaagugcagcggguguuuuucuugcacguccggaauuagcuguucugugaaugcuaaacuuacaagcccugacgaguucacccugcaucucagauccacaucucccaacgucgugguggccgaaaccagcaucauugcucgcaagggcccuuccgccaccacaucuaaguucaaaguuuuuagcguccgggauacgaagaaaaucugcuucgaggugguggaaagagaguauuguaaggacugcucccccgaugaacugaccacauguaccggcgucgagcucgagccgccuaaggacauucugcuugaacaccgcgggacaaucgugcagcaccagaaugauaccugcaaaagcaagaucgacuguuggucuaacuccauuagcuccuuugccucuggaaucggcgauuucuuuaaacauuacauugggagcaucgcuguuggcauucugggaacggugcugcccuucgcgcuccugauccuguuuuucaucuauggggacaagaugcuguggccuuuuaaagucuucugccggcccugcagacgcuguugccggaagaacgagggauacaauaagcucgccgaagaggaggaacugagagauauuauccggaaauuuuccaagucuggcgagcucauuaacaaagacgcuaaggauaaacgcacacuggccagacuuuucaugagcgacaauccgaagcugaagaaagaaaagaaacuguccgagaucgccuga

SEQ ID NO: 14139 - RNA, 4884 nt, Artificial Sequence
  derived and/or modified CDS sequence (opt5) from NSDV(Jilin)__NC_034391.1__GP
auggugagccuggagaagggccucauccugcuucugcucaugcacauugccaucgcuuccaccgggggaucucugggccuucccgggcugaacggagaagaccauacagaugacccugaggucggcggggauggaccgacggaagaguacaccgaagacgaucccgagagcacaaccguuuccauuccuacaacacccccugugcucggccagggcacagaggaagugcccgccaccucuggggaggcggaagcuggauauagcacgaccgacgucccugauacaguguccgagaaaguugaggacgaacaagauaccacaccgucuacccaggugacgcccgaccagccugagcagagcacaaccucccugcccgauccuuggacagccaucagcaccagaauuggccgggaacugcucucugucgaguccgacaccacaaagagcucucuggugacgguugggcacccccaacagccgaucuuccuugauggacagccuguggaagaggucacccaucccgugaaugagcgcgacgugacagaagcccugagaaaauacgacaagaugaaaaagcuccugucccagcggauccuuagcaagaugggcauggcucgcgauuuuaccgacgaggaacuggaugucuggugccacgagagauucgacaacuguucuuccaaugauauugaaaaccggauccgcgacuuuuuccucauuagcgaucaaacagagugcuuugacgagguucuggugaaaagacugugugaauccaccaauccuaucgugggggagcccuggcaggucgccggaauuaaggaagagaucgugcggcgcgaaaugggcagacggauuuuccgcuuuuucacgcccacacucaaaguuaccugcgugucuggcagccugaacccuuccgaucaguuugucagauucuaugacccggugaucgagcggaccagcgggcccacaauccagaauuacgauucuaugcauugucuuaacauugagaauggacuggcuaagccuuccaaaaugguugugcucaacguccugaugaccacaguggaaguccgccuugagagcugcagagccuuuaucaaugcgcaccaauguauuuauacgcagcacgccgacggccaggugaugguucccaccuucguggaccauucugggacacggagaaccaucggagcuuacacaaugagcuuuaaccugaccgaugaacgcaaucgggccugcauuaucagaacgaccugugucgugaagggcaaggagguuaaaaaggggcaaucccagcuccgcggauucccuacaucuauccggcuguucaaaagcgugaccggcaagagacgccugauggcugaggaaggcgacuggacagauugcggguccggaacccagcucgacaugacgauggccgucagcgugcacaacgauaaaaagggcgggcccggaaagaagcugacaauuuguaauggcaccacagugucugacuccacccuuaacgaggggcugggcugcuauaccaucaacaagguuauuacaggaaaagcgugcaaggucggcaauagcacggggucuugugaagugcagaccgagcuccaaaaaugcgaaacaggaaaguguauccuggugaaacagaaguccaagggcgucgugaaacuuaagcgggggaaaaccguuauuaucacagagugccagggaagcugucuguuugccaucccgcaggauaccggcgacauuacgaucgauugcuccgggggcagacaacauuaccucgagauuaacaucguggacauucacuguccuggaaaggauaaauggaagggcuucaugcuguacaucugccgcgucucuagccggccccugauugcucucacauuugggcuguggcuugccgcuggauaucugaucaccugucucguguccuucaucauuuacaaugccguucugcugcuuucuaucgccauuaagaaagugagacagggccgcgaaaagaaaggggaccucugcaucaagugugagcagcacugcaugaaccuguaugaucaggaacugcaugagcucaauugcagcuuuaaccuguguccuuacugcgcuaaucggcuuuccgacgaaggacugcccagacacgucccucggugucccaaaaagagcgagcgccucgaggaaauugagcuguauaucaacuacaccagagugccgugcauccugcgguggauucuuucuacauccguucaagugggcaccgcggucaagagacucagcugguucucugugcuggugacacuguuuauccucacgauuuccccuguccagggguucccccuggaaucucccccuaucggcgccgcuaccgacagccgcauuauguauggaguugugggcuuuauguucgcccuuaucaugaugcugaaucucaaaaagagccauuacggguccaucuuucacgugauugauggauucggccgguguaaccugugcgacacaagaaucgauagccugauggaggaaaccgcccaugaccuuuguugcauguuugauuguugcccguacugucaccgcgucucugaguccaaugggagccacugcuuccaugugagaauuugcguugcuaaagagaucuccaagaaaaugcucaaggccggaggccggcuguucacaaacaaacuggugucucgcgaagggaccuuugcgaaucggauucagcuccuguauagacgcagcaaggucguguccacgcuuguugugaccguccugcuccugcuggugcuucucaagcccacaaccgcuuucgacucuggcccucugcccgauggaacaugggaggaagaggagaaacugguuagaaacuguggccaggaaugcauccucgaccaaggggagugucugugcccuggagaacaccgggccggccgcaaacuucuguuucucaaugggcugcaggaugccgcuagacggaugaccgagagccaucgccugcuuacauccgugucuaucgacgcccccuggggagcuauuaacaucgaaagcaccuucaaaccuguccuggccgcguccaacauugaucucagcuggaacucugccgaggagcagggcgacaagaucauucuguccggcagaagcacggggaucauuaaacuccaagaacggacaggacugauguggaagaugucuuccgagaaggcuagcgaaucuaaaaaucuucugguguccgugauggauuuuagccagcucuacaauuccaucuuccaguauaucaccggcgacagaagccugucugaguggcccaaggccgucuguaccggggacugcccggaucgcuguggaugccagacaagcaccuguuaccacaaagaauggccucacacgcggaacuggagaugcaaucccacaugguguuggggcauugggaccggaugcacaugcuguggcauggacguugagcgcuauuuuaacaaguacuucggcgugaaaugggcucuggaguaugugcggaccgaugucgugguuugcguggaacuuacaaaugaggaaagacauugugaccugguccaagccgggucccgcuuuucuaucggaccugugagcguuacccucuccgauccccagaacguggucaaucggcugucuagcaacauuaugacgauccaggagauugcggacaauggcauccucgaucugaugcacguguccaaggucaucucugccgaaaacgcuugcaaacuucagagcuguacccauggguccccgggagaccugcaaauucuccacacagauaaucugaucaagggcgacaugagcgggggaauuaaccuggcccaucuugauccucaggugaauaccucuuggauguccugggagggcugcgaccuggacuacuacuguacaguuggcgauuggcccagcugcaccuauacgggggugaacucuaucaacacagacuccuucaccaaucucauuaacacagagaccgauuacaccggaaaguuucacuuccacagcaaaagaaucuccgcucgcgacgauacacugcagauggaccucaaggcccggccuaauucuggcgggggagaaaugacgguccugguggagguuaacggccuugaacugcauagcaaaagaaucucccugaaggggcuccggcugaccaaucuuaagugugauggaugcuuugccuguagccagggccugacaugcaccauuacagcuaaacucgagucucccgacgaguucaccauccaucugcgcuccacgagcagagauguggucguggcggaaacaucugugaccgcccggaagguugagaccggcgcucgcagcggguucagagccuuugccguccgggacgugaaaaagcucugccuggaaguggucgagaaagauuauugucccuccugcacaguggaagaccuuaagauuuguguugaugugucucuggagccuccgaaagacauccugauugagcacaagggaaccaucauucaacacuacaacaagagcugcgacgaaggcuauaauuguugggucggguccgugucuggauucuuuguuggcgugaaagauuucuuugagaagaaccucgggggaguccugaucggccuugugagcacaauccugccccucguucugacgguccucuucuuuauuuacggcaaaaagcuguucugccuuuguagacugugccauaaaaaguguugccgcggguccggacggggcagagacggguauagccgccugucucaggaagaggaaaucaaggagauuaucaaaaaguuuucccggaauggagagcuccugggcaaaggggaaaacgauaagagaaccguggcucgcauguucauggacggacagagcaccaaaaaggccauuaaggagguggcguga

SEQ ID NO: 14140 - RNA, 4884 nt, Artificial Sequence
  derived and/or modified CDS sequence (opt5) from NSDV(708)__EU697952.1__GP
auggugagccuggagaagggcuucuuuuuccuccugcuucugcacaucgucaccgccuccacagggggacccccuggccucccggggcccaacggaaaagaccagacggauggcccugaagggggaggcgacggccccaccgaggaauacacagaggaugacuuugaaucuaccacauucagcauuccuaccacacccccuguuuccgagcaagaugcuaaggaggugucugccaccagcgaagaggcggaaguggaggacuccacgcugaucgucccgaaaaccaugucugagaaggugggggaugaacagagcacaaccuccaauaugcagguuacaaccagccagcccgagcaaucuacgacaggaaugccuggccccuggauggcuuccagcauuaaaaucgggagagaacuucugucuguggaguccgacaccacaaagagcucucucgucaccgugggauauccucagcagcccauuuuucuggauggccagccgguugaagaggugacccauccugucuccgagcgggacguggccgaagcccugcgcaaguacgauaaaaugaagaaacuccugagccaaagaauccuuuccaagauggggauggcucgggacuucacagaugacgagcuggacgccuggugccacgaacgcuuugauaacuguucuagcaaugacaucgagaacagaauuaaagauuucuuucucaucuccgaccagacggaaugcuucgaugaggugcuggucaagcggcuuugugagagcaccaaucccauuaucggagaaccuuggcagguugcuggcauuaaggaggaaguggugcgcagagagaugggccggcgcaucuuuagauucuuuacacccacccugaaagucacaugcgugucugggucccucaaccccagcgaccaguucguucgguucuauaauccugugauugaacgcaccucuggaccgacgauccaaaacuacgauagcaugcauugucugaauaucgagaacggccugauuaagcccuccaaagucgugauccucaauguucugaugacaaccguggaggucagacuugaaucuugccgggccuuugugaacgcgcaccaguguauuuauacccagcaugccgacgggcaaguccgcgugccuacauucguugaucacagcggaaccaagagaacaaucggcgcuuacacgauguccuuuaaucugaccgacgagcggaacaaagccugcauuaucagaacaaccuguguggucaaggggaaagaagugaagaagggacagagccagcuccgcggcuuccccacaucuauccggcuguuuaaauccguuaccggcaagagacgccuuauggcugaggagggggauuggacggacugcggaagcggcacccagcuggacaugacaaccgccgugucuguccacaaugaucggaaagggggaccuggcaagaaacucacaauuuguaacgggaccacgguguccgacagcacacugaacgaaggccugggaugcuauaccaucaauaaggugaugacaggcaaggcgugcaaaguugggaacuccaccggaucuugugagguccaacccgaacuccagaagugcgagaccggcaaauguauucuggugaagcagaaaaauaaggggguggucaagcugaaaagaggaaagacagugaucauuacggaaugccagggcagcugucuguucgccaucccgcaagauaccggggacaucacaauugauugcuccggcggacgccagcauuaccucgagguuaacaucguggacauucacuguccuggcaaagauaaguggaaaggguuuaugcuguacaugugccgggucucuagcagaccccuuaucgcucugaccuucggacucuggcuggccgcuggcuaucugauuacaugucucguguccuuuaucauuuacaaugccguucugcuucugagcaucgccaucaagaaggugcgccaggggcgggagagaaaaggagaccucugcauuaagugugaacagcauugcaugaaccuguaugaucaagagcugcacgaacuuaauugcucuuucaaccucuguccuuacugcgcuaaucgccuguccgacgagggccugccccggcacgucccuagaugucccaaaaagaccgaacggcucgaggagaucgaacuguauauuaacuacacgcgcgugccgugcauccuuagauggauucugagcacaucuguucagguggggaccgcggucaaacggcucuccugguuuagcgugcuggugauccuguucguccuuaccaucucuccuguucagggcuuuccccucgagaauacacccauuggaagcaccacagauuccagaaucauuuauggcguggugggguucaucuucgcccugauuaugaugcugaaccucaagaaaagccauuacggaucuaucuuucacgucaucgacggcuucgggcgcuguaaucugugcgauacgcggauugacucccuuauggaagagaccgcucaugaccuguguugcaucuuugauuguugcccuuacugucacagagugagcgaauccaacggaucucauugcuuccacguucgcaugugcguggccaaggagauuagcaagaaaaugcucaaggccgcuggcagacuguuuacaaauaaacuggucucccgggaggggaucuucgccaaccgcgugcagcuucucuauagacggucuaagguugugagcaccuuugucgugacaguucugcugcuccugguguuccuucgcccggcgaccgcuuuugacuccggcccccugccugauggaacgugggaagaggaagagagacucguccggaacuguggccaagagugcgugcuggaccaggaugaaugucugugccccggggagaaucgcgccggaagacggcuucucuuccugaacggccugcaggacgccgugcgcagaaugaccgaaucucaccggcuccugacaagcgucuccauugaugcuccuuggggagccaucaauaucgagagcaccuuuaaacccguucuugcugccucuaacauugaccuguccuggaauagcgcggaagaacaaggagauaagaucauucucucuggcagauccacaggcaucauuaagcugcaggagcgcaccgggcugauguggcggaugagcucugaaaaagccuccgagagcaagaaccuucugguguccgugauggacuucagccagcucuacaauucuaucuuucaguauauuacaggagauagaagccuguccgaauggccuaaagcugucuguaccggcgacugccccgaucgcugugggugccaaacgucuacauguuaccauaaggaguggccgcacacccggaacuggagaugcaauccuaccugguguuggggaaucggcacaggguguaccugcugcggaauggacguggaaaaauauuucaacaaguacuucggcguuaagugggcccucgaguaugugcgcacggacgucgugguuugcguggagcugacaaaugaggagcggcauugugaucuuguccaggcuggcagcagauuuuccaucgggcccgugucugucacccugagcgacccucagaacgugguuaaucgccucuccucuaacauuaugacaauccaggaaauugccgauaauggaauccuggaccugaugcacgugagcaaagucauuuccgcggagaacgccugcaaacuucaaagcuguacccacggcucucccggggaucugcagauccuccauacagacaaccugaucaagggagauauguccggcgggauuaaucucgcucaccuggacccucaggugaacaccagcuggaugucuugggaaggaugcgaucuugacuacuacuguacgguuggcgauuggccguccugcaccuauacaggcgugaauagcaucaacaccgacuccuucacaaaucugauuaacaccgagacggacuacacaucuaaguuucauuuccacagcaaacggaucuccgccagagaugacacccuccagauggaucugaaggcucggcccaauacagggggaggcgagaugaccguccugguggaagugaacgggcuugagcugcauagcaagcgcauuaaucucaaaggacugagacucaccaaccugaagugugacggcugcuuugccuguucucaagggcuuacaugcacgguuaucgccaaacuggucuccccugaugaguucaccauccaucugcggagcacaucucgcgacgugguggucgcugaaaccagcauuacagcgagaaagguggauaccggagcccgguccucuuuuagagcuuucgccguucgcgacgugaaaaagcucugccuggaggucguggaaaaagauuauugucccagcugcacgguugacgaucuuaagauguguguggacgucucccuggagcccccuaaggauauccucauugaacacaaaggcacaaucauucagcacuacaauaagucuugcgacgagggcuauaacuguuggguggggagcguuuccggauuuuucgugggcgucaaagacuuuuucgaaaagaaucuugggggagugcucaucggccugguggggaccauucuuccgcugguccugaccauccucuucuuuaucuacgggaaaaagcuguucuaucuuugccggcugugucacaagaaaugcuguaagggcagcggcagagggcgcgauggauacucucggauuuccagagaggaggaaaucaaagagauuaucaagaaauuuagccgcaacggcgaacuccuggggaagggagagaaugacaagcggacaguugccagaauguucauggauggccaguccaccaaaaaggcuauuaaagaaguggccuga

SEQ ID NO: 14141 - RNA, 4875 nt, Artificial Sequence
  derived and/or modified CDS sequence (opt5) from NSDV(779)__HQ286599.1__GP
auggcccugguggcuaagggccucauccugaugcuucugcucuacauguucaaagccagcgaggucaaccuggaacuucccuccuggaacucuaccgaggggacagaauaugcggacgagcugccuacggaaccgcccagcgaggaggaaccuaagcucgcugccguuuccaccgugacaacccccgccccucccaaagagucuacagaagauaccauugagagcccugacggaggcgagacaauggcuccgaccacgcccgccccugugaccgauuccgcuucuaagcuggaagaggaacccgggacaacccagcaagcccagagcacacagaugcagaacucccaagcgccuaucggaaugcccgaggccuggagcaccucuccguccagagucggccggaaaccucugagcgcuucucccgacguguccgaaccugaucagaauacggaggcccagacacacccucccguuuuucucgacgggcgccccguggaggaagaggaacauagcgucggaaccagagauguggcuucugaccugcgggaguacaaccagaugaagcaacuucugucccagcgcauucucgccaagaugggcauggcgguugauuucacagacgaugaacuggacaccuggugcuauagacgguacagcaauuguuccucuaacgauaucgagagccgcauuagagacuuuuuccuuaucaccgaccgguccgagugcuuugaugaagugcuggucaaacgccucugugagacaacgagcccgaucauugacagagccuggaagaucgcuggccugaaagaagagguggugcugcgggaaauggggcgcagaauuuuccgguuuuucacccccgcccucaaggucacaugcaugucuggaucccugaauccuagcaaccaguuuguucgcuucuauaaucccacccuugagagaacaucuggcccuaccauccagaacuacgaugggaugcacugucugaauauugagaacggacucaucaaacccagcaaggugguggucauuaaugugcugaugacgacaguugacauccggcuugaauccugcagagcuuuuaucaacgcccaacaguguaccuauacccagcaugccgauggccuggugcgcgucccgacauucguggggccucacggagagaagcggauuaucggcgcuuacaccaugucuuuuaaucucacagacgaaaagaauaaggcgugcacgauuaaaaccacauguguugugaagggcaaagaggucaagaaagggcaaagccagcugagaggauuccccaccacaauccgccuguucaaguccgugaccggcaagcggagacucaugagcaacgaggaagaguggacggaaugcgggucuggaacccagcugaauauggccacagcugucuccgugcauaacgauaaacuuggcgggccuggaaagaaacugaccauuuguaauggcacaaccguuagcgacaucgcccucaacgagggccuggggugcuacacgaucaauaagauuaucacaggaaaagugugcaagaccggcaacacaaccgggucuugugaaguccagcccgagcuucaaaagugcgagaccggaaaauguauucugaucaagcagaaaaauaagggcgugguuaaacucaagcgcgggaagacagugauuaucacggaaugccagggcuccugucuguuugccaucccucaggauaccggagacauuacaaucgauugcagcggcgggcggcaacacuaucuggagauuaacaucgucgacauucacugucccggaaaagacaaguggaaaggcuucaugcucuacaucugcagaguguccucucgcccgcugguggcucuuaccuuugggauuuggcugacagccggauaucucaucaccugucuggcgagcuucauccuguacaaugcuauucuucucaucuccauugccaucaagaaacugaagcagaagcgggagaaaaagggcgaucugugcauuaaaugugaacagcauugcaugaaccucuaugaccaggaacugcacgagcuuaauugcucuuuuaaccuguguccuuacugcgccaauagacucagcgaugacgggcugccccgccauguuccccgguguccuaagagaggcgagcggcuggaagagaucgaacuuuauaucaacuacacgcgcgucccgugccuccugagaugggcucuguccacaagcgugcaagugggaaccgucauuaaacggcucucuugguucggcgugcugcuuacccuguuuuuccucacaaucucccccguucagggguuuccucuggagaaucccccuauuggaaccgccacagauagcaacaucauuuacggccuggcuggguucaucuuugcccuugugcucaugcugaaccugaagaaaacgcacuauggaucugucuuccacgugaucgacggccucgggcuguguucccuuugcgauaccagaauugacagccugauggaagagacagcgcaugagcucuguugcgccuuugauuguugccccuacugucaccagguuucugaaagcaauggcucccauugcuuccacaugcgcaucugcgugagcaaggagauuucuaagaaaaugcugaaggcugccggaaaacuguucaccaacaaacuugucucccgggaaggcuuuuucgcuaauaaaauccagcuccuguaucaaagaagcaaggugguuuccacacugauucucaccgugcugcuucugcucaucauccugaagccugccgcggccuuugacucugggccccugccggauggaacgugggaggaggaagagagccuuauucgcuccugugaccaggaaugcguccuggagcaggaugaaugucucugcccuggcgagcauagagcugggcggcgccuccuguuccugucuggacuucaagacgccgcuagacggaugaccgagagccaccgccugcucacauccgugucuaucgacgcccccuggggcgccauuaacaucgaaagcaccuuuaaaccucugcuggcugcguccaauauugaucuuagcuggaacucugccgaggaacagggggacaagaucgugcuguccggcagaagcacaggaauuaucaaacuccaggagcggaccggccugauguggaagaugucuuccgaaaaagcuagcgagucuaagaaucuccuggucuccaucauggauuucagccagcuuuacaacuccauuuuucaauauaucacaggggaccgcagccugucugaguggcccaaggccguuuguaccggagaaugcccggauagauguggcugccagacgagcacauguuaccacaaagaguggccucauacccggaauuggcgcugcaaccccaccugguguugggggauuggaacaggcuguaccugcugcggcauggacguggaaagauauuucaauaaguacuuuggggugaaaugggcccucgaguacguccggacggaugugguugugugcgucgaacugacaaacgaggagagacacugugaccuggugcaggcuggaucccgcuucucuaucggcccuguuagcgugacccuuuccgauccccagaaugucgugaaccggcugucuagcuccauuaugacaauccaagaaaucucugacaaugggauucucgauguuaugcaugugagcaaggucaucuccgccgagaacgcgugcaaacugcagagcuguacccacggaucucccggcgaccuccagauucugcacacagauaaccuuaucaagggggaaauguccagcggaauuaaucuggcucaucuggacccucaggugaacaccucuuggauguccugggagggcugcgaccucgauuauuuuuguacggugggcgacuggccgagcugcaccuacacaggggucaauuccaucaacaccgauucuuucacaaaucugaucaacaccgagacggacuauacaagcaaguuucacuuccauuccaaaagaauuagcgcccgcggagauacccuucaaauggaccugaaggcccggcccaauguuggcgggggagaaaugacagugcucguggaggucaacggccuggaacuccacucuaaaaagaucucccugaaagggcuuaagcugagcaaucugaaauguucuggaugcuucgcuuguagcccuggccucuccugcaccgugauugccagacuggagucucccgaugaauuuaccauccaucuucgcagcacaucccgggacguuguggucgcggagacgucugugaccgcuagaaaggccgagacaggcgccaagagcuccuuccgcgcuuuugccguuaaagaugugaaggaaauuugccuggaggucguggaaaaagaguacuguccuagcugcucuaucgaagaccucaagauuuguaucuccgucacccuggagcccccuaaagauauccucauugagcacaaggggacaaucgugcagcacuauaacaagagcugcgacgaaggauacaauuguuggauuggcuccguuucuggguucuuugugggagucaaagacuucuuugagaagaacuucggcagcgugaucauugggaucguuuccaccgugcugccgcuuauccugacgguccuguuuuucguguauggacggagacucuuuugccugugucggcuuugccauaaaaaguguugccgcggcucuagcagaggccgggauggguacucccgccugagccaggaagaggaaauuaaagagaucauuaagaaguucaauagaaacggagagcuccugggcagaggggaaaaugacaaacggacaguggcucgcauguucauggauucucaauccgcccggaaggcgguuaaagaggucgccuga

SEQ ID NO: 14142 - RNA, 4302 nt, Artificial Sequence
  derived and/or modified CDS sequence (opt5) from BUNV__NC_001926.1__GP
augagaauccugauucuccugcuugccgugacccagcuggcugucagcucccccguuaucacacggugcuuccacggcgggcaacucauugccgagcgcaagucucagacgagcaucuccgaauuuuguauuaaagacgaugugucuaugcuuaagagcgagaucguguacaccaaaaacgacacaggaaucuucggccauuccaaggucuuuagacacuggaccauuacagauuggaaagcgugcaauccugugguuaccgcugggggaucuaucaacgugauugaagucgacaagaaucugaaccuggugacacggaauuauguuuguaccggcgauugcacgaucaccguggaccgcaagaacgcccagauuaucuuccagacagauaaacucaaucauuuugaggucaccgggacaaccauuagcacgggaugguucaaguccaaagccagcgugacacuggacagaaccugugaacacaucaaggugucuugcggcaaaaagacacugcaauuucaugcuuguuucaagcagcacauguccugcguccgguuucuccaccgcagcauccugccgggcucuauggccauuuccaucugucagaacauugagcuuaucauuaucaccauccuggcucucugcauuuucaucauuaugaucauucugaccaaaacauacaucuguuauguucuuauccccguguuuaugccuauugccuucgcguacgggugggccuauaauagaagcugcaagaaaugcacguguugcggacuggcuuaccaucccuuuaccaacuguggcucuuauugcguguguggguccaaguucgagacaagcgaucggaugcgcaugcacagagaauccggacucugccagggcuucaaaucucugcgggucgcccgcagacuguguaagagcaaaggguccagccucaucauuucuauccugcuuuccgugcugauucucagcuuuguuaccccuaucgagggaacacugaccaauuaccccacggaccaaaaguacacacuugaugaaauugcugacgugcugcaggccaagacccaugaggauucuaccaaauauuacaucauccucuauacaagccuguucggcgcgggccugaccauuaucuuugccggggucgcucucggacugacaauuauccuugaggugcugacgaagauuaacguuaucuucugcaaugaauguaacauguaccacuccaaaaagucuaucaaauaugugggcgacuuuaccaauaagugcggguucuguacaugcggacuccuggaggacccugaaggcgucgugguccacaaggccaaaaagagcugcaccuacuccuaucagauuaacugggugcgggggaucaugauuuuuguugcuuuccuuuuugugauccagaacacaauuaucauggucgccgccgaggaagauuguuggaaaaaugaggagcugaaggaagacugcgugggaccgcucaucgcucccaaagauuguaccgacaaggaucauaagacguaccugagcgaggcgucucugcucgccaccgcuaaaaagauuacacaaguugacgccgaaaacguggagauccugggcaaaaccauggaauccgccauucgcgucaucgagagacagaagacauaccaccggaugcaucuucuggaggcuguguuccucaauaaacacugcgauuauuacaagauguuugaacauaacagcggcuauucucaggugaaguggagaaugaugauuaaaacccaacacuucgacaucugugcccugcaggccaauuccccuuuuugcgcucaguguaucgccgauaacagcugcgcccagggguccugggaguucgacacgcacaugaacucuacauacagcuccaagguugauaauuucaaacaugacuuuucucuguuccuucgcauuuuugaagcugccuuccccggaaccgcuuauguccaccuccugacaaauaucaaggagaaaaagccuuaccaagccgugagcaugauugaaaagaucaagaagaaauuucccaacaauaagcugcucauuggcuaucuggacuucgggaaauaccuucugggacucucccaugcgagcaccuacgagcugcagcagcggcagcuggauaaacuuuaucaaccgaccgagcucacaagaucuggcgggcagcagacgucccuggccaacagcguggucggccaggcuaccaaagaauguaagaaguacaaagacgugucuugccuguccccucgcuuuggaaucccccucgaggaucugauuagcuguugcgaccaaccuaauuauaacaucuacaagaaacccaagaaaguuuauaaggcccacgauaaggaagagacauggugcaucaaugaccagcacugucuuguggauuucguccccgcugaggccgacaccguggaaaaacugaagccuaugaaaugcuggcucguugauccgggcaagaacgacgauguguacucuauugcgaucaaaacaugucgggucguggacaaggggguuugcaccgugaacagccagaaguggaauauuaucaaaugugauuccggaccccuguauuacagcgaccauauuccuggcgaggacacggggaacgauaucggacacuacugcgucucugccggcuguaagacagacagauaucccaucaauccugauguggugaccgacugcgucugggaauuuaccucccgcaaaagccaguacauugggaagaucuccaugcaaucucuggaggauuaugaaaaagcucuuacagaccggcucacccauacacuggagacguacagcuucgcgccccuggagaaccucccgcacauuaagccuguuuauaaauacaucaccgcucagggcguggaaaauuccgauggaauugagggcgccuuuaucacagccucuauccccgcugccgggggaaccagcauuggcuauaacgugagauccaaggacggguucccucugcuugaucugaucgucuuugugaagucugcgguuauuaaaagcacauacaaucauaucuacgacaccggacccacgauuuccaucaacaccaagcacgaugaacacuguacaggccagugcccuagcaauauugagcaugaagcuaacuggcucaccuucucucaagagcgcacaucccggugggggugugaggaguucggcugccuggccgugaauaccggaugcgucuuuggcagcugucaggacgugaucagacccgaaacaaaaguuuaucgcaaggccguggaugaagucgugauccugaccguuugcauuacguacccggggcacacauucuguaccgagaucaacgcuauugaaccuaaaaucaccgaggagauugaacuucaguuuaagacaguggacaccaagacgcuccccuauaucgucgccgugaauaaccauaaacuguacucuggacagaucaaugaccugggcacauucgggcaaaugugcggaaacgugcagaagaccaacuccagcauucucggcacagggacccccaaauuugauuauacaugucacggcgcgucucggaaggacaucauugucagacggugcuacaauaacaauuucgauuccuguaaacugcuuaaggaggaaacccagcugaucuuuaacgacgaucaugacacgauuaccguuuauaauacaaaccaccucaucggagagcuggcuaucaagcugauucuuggcgauauccaguacaaacuguucaccgagacacucgaccugcaaauugaugccaagugcgugggguguccugacugcuuugaaagcuacuccuguaauuuccagaucgugagcaacauugauaccaucugcucucucgagggaccgugcgacacguuucacaaucgcauuagcaucaaagccaugcagcagaacuaugcugucaagcuguccugucaaaaagaccccagaccuucuggcacauucaagaucugcaaucgggaauacaccgugguuuuccauacaguggccaaggaugacaaaauugagaucaacgucggggaucagaccagcuuuauuaaggaaaaagacgauagauguaagaccuggcuuugccgcgugcgggacgagggaaucuccguuauuuucgagcccaucaaagcguuuuucggcucuuauuuuagcaucuucuuuuacauuaucguggucguggucgugggcuuccugauuaucuauauuuuuaugccuauguucaugaagcucaaggaaguucugaaagcuaaugagaagcuguaccuucaggaaaucaaacaaaaguga

SEQ ID NO: 14143 - RNA, 4311 nt, Artificial Sequence
  derived and/or modified CDS sequence (opt5) from BUNV(SFCrEq231)__KP063893.1__GP
augaagaugauccugcucauuaucauucugugcgugaaccuugccgcugccaaucccgucgcgaccagauguuuccacggcgggcagcugaucgcugagacacggagcgccacguccauuucugaauuuugccucaaagacgauguuagcaugaucaaguccgagaucaccuacacaaagaacgacaccggaauuuucggccauucuaagaucuauaaaagcuggcugauuaaggauuggaaacuuuguaauccugugccgacagccgggggauccaucaacgugauugaagucaauucugaccugagccucaccacaaaggcuuacgugugcucccgcgauuguaccaucacgauugacaaggaggaagcccaaaucaucuuucagaccgauaaacugaaccacuucgagguuagcggcacaacccugucuuccgggugguuuaagacaaaagcuagcgugacccucgacagaacgugcgagcauauuaaggucacauguggaaagaaaacccugcaguuccacgccugcuuucggcaucacaugucuugugugcgcuucuuucacaauacaauccuucccggcaccaugguuaacuccaugugccagaauauugaacugaucauuauccucggccugacccuuaucauuuucacacugauggugauccucacgaagaccuauauuuguuacauccugaugccucuguuuaugcccauugcguaugccuacgggugggcuuauaacaaaagcugcaagaaaugcaauuguugcggacucgccuaccauccuuucacaaacuguggcucucacugcgucugugggcugaaguuugaggcuuccgauagaaugcggauccaucgcgaaagcggacuuugccaaggcuacaaaucccugagaaucgcccggcuccuguguaagucuaaggggagcucccuuauuaucagcacccugcucucuaugcugcugcucuccuucauuacacccaucgagggaaccaugacgaauuauccugagacacgccaguacagccuggaagagauugcggacgugguggaaggccuucugucugagcagaacaucaaagaauaugucguuuucuacaccagccucuuuggcucccugauucuucugcucgccuucauccugucuaucacccugacaaaggugaccaaugcucucgccagaacaaacgugauuuauugcgaggaguguagcauguaccacgcuaaaaaggggaucaaauauaacggagauuuuacgaauaagugcggcuucuguaccugcgacgaacaggaggaugaagaggggauuaucauucacaaggucuccaaaaagugcacauaccgguaccaacugcagugggccaaaaucaucaugauuauccuugugaugcugcucaugaugcagaacaccauucugaucguugccgcugaaacagacuguuggaccaagaauagccuggagcuugacugcauuggaccgcuccugacgaucucugauuguuccaacaaagagagcaagaauuaugaagaggaagcggccaagcuggugucucaguccaaaaucacccaagcugacgccgagcaggucacaauucucggcaacaccaucgauacagcccugaaggcuauucgcagccagaaaaccuaccaaacgaugcaucuucuggaauccguguuucucaugaagaauugcgacuauuacucuagcuucgagcccaacuccggguauucucaggccaaauggagacugaucgcgaagacaagccacuuugauauuuguucccggcauagcaugcaccauuucugccgcuguguugcugacggaaccaagugccagaauggcgauugggacuuugccggcgagaugaacaauaucuacucuaccaaaaacgauuucuaucugcacgaccuuaaucucuuuuucacacugcacgaaaccgccuuuccugggacaacggagucccuguucuaccagcucaucgcuaagaaaaacaccacaggagccagcaagcugcuuggcaaacugauuaccaaguacgggaauaacaaacucuucgugggaaucuggaaguuuggccaauaucugcugacacuucccuacgucaacaccacggaacucucuaagacaagacgggagaccauucugaaaacccaucagauccugacaagaucccagggaggccgcagcgagucuaugagcuccgcugaagugggacagauugccaaggagugugcgaaugccaaaaacgucggcugcaucagcccucgguucgggauucccaucggaaaucucaccgcuuguggcaacucuccgaauuauaagaucuacaaaacaccuaacaagauuuauaaguccaauaacagaggggaaguguggugcagcgaggauguucacugccuggccgacuuugaacccgcugacacggagguggucaauaaagugaagaaaaugaccuguuuccuuuccgauguuaacacacgcgccgacaucuuuucuauugcgaucagcgccugccggaugguggauaagggagucuguaccgugaauggcgcuaaauggaacauucugaagugcgaguccgggcucuacuauuucacagaccauagagaaggccaagauaccggaaaugacuuuggcgaguacuguaucucucacagcugcaacacggaacgcuacccuaucaaucccgauauucugaaggaguguaucugggaauaucacucccggaaaucuaaguacauuagcaccaucaaccuggagucccuugaggaguucaaaagagccaugagcgacaagcucucucauacacugaugguguauaacuuuaaacccaccgcuaaucugccucacauuaagccguccuacaaguucaucacagccaacgggaucgaaaauagcgauggacucgaaucugccuauauucuguccagcauccccgcuauuggcgggaugucuaucggauacaacauucagaccaaagacaauuuuccucuucuggaucucaucguuuucgucaaguccgcggugauuaaaacaaccuauaaccauaucuacgacacgggccccacaaucgggauuaauaccaaccacgaugagcauugcaccggcccuugucccacaaucauuccgcacaaggaaaauuggcugaccuuuagccaggagcgcacgucccgguggggaugcgaggaguucggcugucuggccaucaacacagggugcguguucggaagcugccaggacgucauucacccugaaaccaaaaucuacagaaaggcuguggaagaggagguugugcuuacagucuguaucaauuuucccggcaacaccuucugcacagaaauuaaugccaucgagccuaaaauuaccgacgaaaucgagcugcaauuuaagacgguggauaccaagacacuccccaaccugcucgccguucagaaucauaaacuguauucugggcagauuaacgaccuugggagcuucucccagggcugugggaacgugcaaaagaccaaucagucuauccugggcgcuggaacagucaaauuugauuacgugugccacggcgccagccgcaaggacaucauuguucggagauguuauaccaacaauuacgauuccugcaaacuccugaaggaggaacggucucugaucuucgcggacaaccaugagacgcuugaaguggcuaauacacgccaccugauuggggagcuccaguuuaagaucaugcugggagauauuagauauaaagccuucgccgaaaagccugagcucgaaaucgacgcuaaaugugucggcugccccagcuguuuugaguccuacucuugcaacuuccaaauugugaccagcaucgauacaguguguuccgucgaggggccgugcacccuguuucauaaucggaucauuaucaccgccgcgaagcagagcuauggaguuaaaaugucuugcaagacaaagccuggccccguggaagaguucacgauuuguaacagaaauuaccgcguguccuucgcuaccaucgacaaaaacgauaagauugaaaucaauacaggcgaccagaccagcuacaucgucgagaaagauucucggugcaagacauggcuuuguagagugcgcgacgaagggauuuccguuaucuuugagccccugaaagccuucuuuggaagcuauuucuccauugccuuuuacaucauuaucggcaucgcugcccucuuccugauuaucuauauuuuucugccuauguucuuuaaacuuagagacgugcugaagaaaaacgaguaccucuaucugcaggaacucaagcacaaauga

SEQ ID NO: 14144 - RNA, 4302 nt, Artificial Sequence
  derived and/or modified CDS sequence (opt5) from BUNV(GSA/S4/11232/WT)__KM507339.1__GP
augagaauccugauucuccugcuugccgugaccaagcuggcugucggcagccccguugugacacggugcuuccacgggggacagcucaucgccgagcgcaaaucccaaacgucuauuagcgaauuuuguaucaaggacgauguguccaugcugaaaucugagauugucuacaccaagaacgacacaggcaucuucgggcauagcaaaguguuuagacacuggaccaucacagauuggaaggcgugcaauccuguugugaccgcuggaggcuccauuaacgucaucgaaguggacaagaaucuuaaccugguuacacggaauuauguguguaccggggauugcacgauuaccgucgacaaagagaacgcccagaucauuuuccagacagaucgccucaaucauuuugaagugaccggaacaaccaucucuacgggcugguucaagagcaaagccuccgugacacuggacagaaccugugagcacauuaaggucagcugcggcaaaaagacacugcaguuucaugcuuguuucaagcaacacaugucuugcguucgguuucuccaccgcuccauccugccggggagcauggccaucucuauuugucagaacaucgagcuuauuaucauuaccauccuggcucucugcaucuucauuaucaugauuauccugaccaaaacauacauuuguuaugugcuuauccccguguuuaugccuaucgccuucgcguacggaugggccuauaauagauccugcaagaaaugcacguguugcggccuggcuuaccaucccuuuaccaacugugggagcuauugcgucuguggaucuaaguucgaaacauccgaucggaugcgcaugcacagagagagcggccucugccagggguucaaaucccugcggguggcccgcagacuguguaagucuaaaggaagcucccucauuaucagcauucugcuuucuguucugauccucuccuuugugaccccuauugaaggcacacugaccaauuaccccacggaccagaaguacacacuugaugagaucgcugacguccugcaagccaagacccaugaggauagcaccaaauauuacauuauccucuauacaucucuguucggcgcggggcugaccaucauuuuugccggaguggcucucggccugacaaucauucuugaaguucugacgaagaucaacgugauuuucugcaaugaguguaacauguaccacagcaaaaaguccaucaaauaugucggggacuuuaccaauaagugcggauucuguacaugcggccuccuggaagacccugaggggguggucgugcacaaggccaaaaagucuugcaccuacagcuaucagaucuccuggguuaaaggaauuaugaucuuuguggcuuuccuuuuugucauucagaacacaaucauuaugguggccgccgaagaggauuguuggaagaacgaggaacugaaagaggacugcguuggcccgcucaucgcucccaaggauuguaccgacaaggaucggaaaacguaccugagcgaagcgucucugcucgccaccgcuaagaaaaucacacagguggacgccgagaaugucgaaauucugggcaagaccauggaguccgccauccgcgugauugagagacaaaagacauaccaucggaugcaccuucuggaagcuguguuccucaacaagcauugcgauuauuacaagauguuugagcacaauagcggguauucucagguuaaauggagaaugaugaucaagacccagcauuucgacauuugugcccugcaagcguccagcccuuuuugcgcucaguguaucgccgauaacuccugcgcccagggaucuugggaguucgacacgcacaugaauagcacauacuccucuaaagucgauaacuucaagcacgacuuuagccuguuccuucgcaucuuugaagcugccuuccccggcaccgcuuaugugcaucuccugacaaauauuaaagaaaagaaaccuuaccaggccguguccaugaucgagaagauuaagaaaaaguuucccaacaauaaacugcucaucggguaucuggacuucggaaaguaccuucugggccucagccacgcgucuaccuacgagcugcaacagucccagcuggauaaacuuuaucagccgaccgaacucacacggagcgggggccaacagacgucucuggccuccagcgucgugggacaggcuaccaaggaguguaagaaauacaaggacguuucuugccugagcccuagauuuggcauuccccucgaagaucugaucuccuguggggaccagccuaacuauaauauuuacaaaaagcccaaaaagguguauaaggcccauaacaaagaggagacauggugcaucaaugaucaacacugccuugucgacuucgugcccgcugaagccgauaccguugagaagcugaaaccuaugaaguguuggcucguggacccgggaaagaacgaugacgucuacagcaucgcgauuaagacaugccgcgugaucgauaagggcguuuguaccgucaauucucagaaauggaacauuaucaagugcgacuccgaucugcuguauuacagcgaccacgugcccggggaagacacgggaaacgauauuggccauuacuguguguccgccgggugcaaaacagaccgguauccuaucaaucccgauguggucaccgacuguguuugggaguuuaccucuagacgcagccaguacaucggcaagauuuccaugcagucucuugaagauuauaaaaaggcucucacagaccggcugacccacacacuggagacguacagcuucgccccucucgagaaccugccccauaucaaaccgguguauaaguacauuaccgcucaaggaguggaaaauuccgauggcaucgagggggccuuuauuacagccucuaucccugcugcgggaggcaccagcaucggguauaacgucagauccaaggacggauucccccuucuggaucucauuguguuuguuaaaagcgccgugaucaagucuacauacaaucacauuuacgacaccggcccuacgaucuccauuaacaccaaacaugaugaacacugcacagggcagugucccagcaauaucgagcacgaagcuaacuggcugaccuucucucaggagcgcacaucccgguggggcugcgaggaguucggaugucuggccgucaauaccggcugcguguuugggagcugccaagacguuauuagaccugaaacaaagguguaucgcaaagccgucgaugaaaucgugauccuuaccguuuguauuacguaccccggacauacauucugcaccgagaucaacgcuauugaaccgaagaucaccgaggagauugaacuccaguuuaagacaguggacaccaaaacgcugccuuauaucgucgccgugaauaaccacaagcuguacucuggccagaucaaugaccucgggacauucggacagauguguggcaacgugcagaaaaccaauuccagcauucuggggacaggcacccccaaguuugauuauacaugccauggagcgucccggaaagacaucauugucagacgguguuacaacaacaauuucgauagcugcaaacuucugaaggaggaaacccaacucaucuuuaacgacgaucacgacacgauuaccguuuauaauacaaaccaucugaucggcgagcuggcuaucaaacuuauucugggggauauccaguacaaacucuucaccgagacacuggaccuccagauugaugccaaaugugugggaugccccgacuguuuugaaucuuacagcugcaauuuccaaaucguguccaacauugauaccaucuguaaucuggagggcccuugcgacacguuucacaaccgcauuucuaucaaggccaugcagcagaauuaugcugucaaacuuagcugccagaaggacccggggcccuccggaacauucaagaucuguaacagagaauacaccgugguuuuccacacaguggccaaagaugacaagauugagaucaaugucggcgaucaaaccucuuuuauuaaagaaaaggacgaucggugcaaaaccuggcuguguagagugcgcgacgagggcaucagcguuauuuucgagccuaucaaggcguuuuucggguccuauuuuucuaucuucuuuuacauuaucauuaucguggucgugggauuccucauuaucuauaucuuuaugcccauguucaugaagcugaaagaaguccugaaggcuaacgagaaacuuuaccugcaggaaauuaagcagaaauga

SEQ ID NO: 14145 - RNA, 4302 nt, Artificial Sequence
  derived and/or modified CDS sequence (opt5) from BUNV(MGD/S1/12060/WT)__KM507340.1__GP
augagaauccugauucuccugcuugccgugaccaagcuggcugucggcagccccguugugacacggugcuuccacgggggacagcucaucgccgagcgcaaaucccaaacgucuauuagcgaauuuuguaucaaggacgauguguccaugcugaaaucugagauugucuacaccaagaacgacacaggcaucuucgggcauagcaaaguguuuagacacuggaccaucacagauuggaaggcgugcaauccuguugugaccgcuggaggcuccauuaacgucaucgaaguggacaagaaucuuaaccugguuacacggaauuauguguguaccggggauugcacgauuaccgucgacaaagagaacgcccagaucauuuuccagacagaucgccucaaucauuuugaagugaccggaacaaccaucucuacgggcugguucaagagcaaagccuccgugacacuggacagaaccugugagcacauuaaggucagcugcggcaaaaagacacugcaguuucaugcuuguuucaagcaacacaugucuugcguucgguuucuccaccgcuccauccugccggggagcauggccaucucuauuugucagaacaucgagcuuauuaucauuaccauccuggcucucugcaucuucauuaucaugauuauccugaccaaaacauacauuuguuaugugcuuauccccguguuuaugccuaucgccuucgcguacggaugggccuauaauagauccugcaagaaaugcacguguugcggccuggcuuaccaucccuuuaccaacugugggagcuauugcgucuguggaucuaaguucgaaacauccgaucggaugcgcaugcacagagagagcggccucugccagggguucaaaucccugcggguggcccgcagacuguguaagucuaaaggaagcucccucauuaucagcauucugcuuucuguucugauccucuccuuugugaccccuauugaaggcacacugaccaauuaccccacggaccagaaguacacacuugaugagaucgcugacguccugcaagccaagacccaugaggauagcaccaaauauuacauuauccucuauacaucucuguucggcgcggggcugaccaucauuuuugccggaguggcucucggccugacaaucauucuugaaguucugacgaagaucaacgugauuuucugcaaugaguguaacauguaccacagcaaaaaguccaucaaauaugucggggacuuuaccaauaagugcggauucuguacaugcggccuccuggaagacccugaggggguggucgugcacaaggccaaaaagucuugcaccuacagcuaucagaucuccuggguuaaaggaauuaugaucuuuguggcuuuccuuuuugucauucagaacacaaucauuaugguggccgccgaagaggauuguugggagaacgaggagcugaaggaagacugcguuggcccgcucaucgcucccaaagauuguaccgacaaggaucggaagacguaccugagcgaggcgucucugcucgccaccgcuaaaaagaucacacagguggacgccgaaaaugucgagauucugggcaaaaccauggaguccgccauccgcgugauugaaagacaaaagacauaccaucggaugcaccuucuggaggcuguguuccucaacaaacauugcgauuauuacaagauguuugaacacaauagcggguauucucagguuaaguggagaaugaugaucaaaacccagcauuucgacauuugugcccugcaagcguccagcccuuuuugcgcucaguguaucgccgauaacuccugcgcccagggaucuugggaguucgacacgcacaugaauagcacauacuccucuaaggucgauaacuucaaacacgacuuuagccuguuccuucgcaucuuugaagcugccuuccccggcaccgcuuaugugcaucuccugacaaauauuaaggagaaaaagccuuaccaggccguguccaugaucgagaaaauuaagaagaaauuucccaacaauaagcugcucaucggguaucuggacuucggaaaauaccuucugggccucagccacgcgucuaccuacgaacugcaacagucccagcuggauaaacuuuaucagccgaccgagcucacacggagcgggggccaacagacgucucuggccuccagcgucgugggacaggcuaccaaggaauguaagaaguacaaagacguuucuugccugagcccuagauuuggcauuccccucgaggaucugaucuccuguggggaccagccuaacuauaauauuuacaagaaacccaagaaaguguauaaggcccauaacaaggaggaaacauggugcaucaaugaucaacacugccuugucgacuucgugcccgcugaggccgauaccguugaaaaacugaagccuaugaaauguuggcucguggacccgggaaagaacgaugacgucuacagcaucgcgauuaaaacaugccgcgugaucgauaagggcguuuguaccgucaauucucagaaguggaacauuaucaaaugcgacuccgaucugcuguauuacagcgaccacgugcccggggaggacacgggaaacgauauuggccauuacuguguguccgccgggugcaagacagaccgguauccuaucaaucccgauguggucaccgacuguguuugggaauuuaccucuagacgcagccaguacaucggcaaaauuuccaugcagucucuugaggauuauaagaaagcucucacagaccggcugacccacacacuggagacguacagcuucgccccucucgaaaaccugccccauaucaagccgguguauaaauacauuaccgcucaaggaguggaaaauuccgauggcaucgaaggggccuuuauuacagccucuaucccugcugcgggaggcaccagcaucggguauaacgucagauccaaggacggauucccccuucuggaucucauuguguuuguuaagagcgccgugaucaaaucuacauacaaucacauuuacgacaccggcccuacgaucuccauuaacaccaagcaugaugagcacugcacagggcagugucccagcaauaucgaacacgaggcuaacuggcugaccuucucucaggagcgcacaucccgguggggcugcgaagaguucggaugucuggccgucaauaccggcugcguguuugggagcugccaagacguuauuagaccugaaacaaaaguguaucgcaaggccgucgaugagaucgugauccuuaccguuuguauuacguaccccggacauacauucugcaccgaaaucaacgcuauugagccgaaaaucaccgaggaaauugagcuccaguuuaagacaguggacaccaagacgcugccuuauaucgucgccgugaauaaccacaaacuguacucuggccagaucaaugaccucgggacauucggacagauguguggcaacgugcaaaagaccaauuccagcauucuggggacaggcacccccaaauuugauuauacaugccauggagcgucccggaaggacaucauugucagacgguguuacaacaacaauuucgauagcugcaaacuucugaaggaagagacccagcucaucuuuaacgacgaucacgacacgauuaccguuuauaauacaaaccaucugaucggcgagcuggcuaucaagcugauucuuggggauauccaguacaaacucuucaccgaaacacuggaccuccagauugaugccaagugugugggaugccccgacuguuuugagucuuacagcugcaauuuccaaaucguguccaacauugauaccaucuguaaucuggaaggcccuugcgacacguuucacaaccgcauuucuaucaaagccaugcagcagaauuaugcugucaaacuuagcugccagaaggacccggggcccuccggaacauucaagaucuguaacagagaguacaccgugguuuuccacacaguggccaaggaugacaaaauugaaaucaaugucggcgaucaaaccucuuuuauuaaggagaaagacgaucggugcaagaccuggcuguguagagugcgcgacgagggcaucagcguuauuuucgaaccuaucaaagcguuuuucggguccuauuuuucuaucuucuuuuacauuaucauuaucguggucgugggauuccucauuaucuauaucuuuaugcccauguucaugaagcugaaggagguccugaaagcuaacgaaaaacuuuaccugcaggagauuaagcagaaguga

SEQ ID NO: 14146 - RNA, 4308 nt, Artificial Sequence
  derived and/or modified CDS sequence (opt5) from Ab-BUNV(Cu20-XJ)__KJ710423.1__GP
auggccaucagcauugugcugaugaucauuuucuccaccacaucuugccucgcuagagccgcgcccagcaucuccaaguguuuucaggacggcguccugauugcugagaaaaagucuagcuccgggaucucugaguucugcaucaaagaugacauuagcauccuuaaguccgaaauuaacuacagcaaaaaugauacgggaaucuuuaugcacucuaagguuuuccggcauuggaccguggccgacuggaagcaaugucagccuauuccguccgccggcgggagcaucaacgugcuggaagucgauaaaaaucucaaccugguggcuaagaauuauaugugcacacgccccuguguuauuaccaucgacaaagagaacgcccagcuucuguuucagacagaacaacucaaucaguucgaggugaccggaacaaccaucucuacgggcugguuuaaguccaaaaccagcgucucucuggauaacacaugcgagcacauuaaggugaccugugggaagaaaucccugcaguuccaugcuugcuuuaagcagcacaugagcuguguuagauuccuccaucgguccgugcugccuggauacauggccaauucuaucugccaaaacauugaacuuaucauuaucaucacacugacccucgcgauuuuuaucuucauguguauuaucacgcgcacauauauuugcuacaucaugcugccccuuuuugccccuaucgcuuauauuuacggcuggcuguauaauagaagcugcaaaaaguguaucugcuguggccucgccuaccaccccuucaccaacugcggguccuacugugucugcggaagccgguucgagacaucugaccgcaugagacugcaccgggaauccggccugugucagggguuuaaaagccuccgcguggcuagaacccugugcaagucuaaaggaagcucccuugugauuucuguccugaccgccaugcucauccugagcuucguuacaccucuugaggcgauuuccacgaauuauccgaccgaucggaaguacacacugaacgaggugaaugacaucgugcucggcaaggggaccgaaaacgagcugaaaacaagcauucuggcccucgucucuaucuguggaaucggcauuaucauuaucuuuauugcucugaccaugcuucuggauaucgugcucgaagccaucgcuaagcgcuccacgauuuucugcacagaguguaaccugauccaugacaaaaaggccaugaaauuuguuggcgauuucaccaauaagugcggguuuugccccuguggagaacuugaggacccugagggccuggugauucacaccacaagaaagagcugcaccuauuacaucaaaauucggaaccucaagcugaucaugcuggucuucucuaucgccauucucaugcagaauacagcuaugcuggugguugcggacgaaaacuguuggacgaauaccgagaucaaagccgauugcguggggccccuuauuggaccuacaaccuguacaaacaagggcuccaaaaccuauaaggcugucgcccaggaacuggugacgagcaauaagaucacccaacucgacgccgauaaauacacacugcugggggacaccauugaguccgcucuuucugccaucacagaacagaagcauuauagcgcgauccaccuccuggagaccauuuuucugaugaaacacugcgauuacuacaaggucuaugagcauaacuccggauacucucagacgaaauggcgccucaucgcuaagacaaauagcuucgacauuuguuccauccccagcaccccgaacuuuugcaagugucugucugauuccagcugcucuacauccacccuuaauuucgccaccagcaugaacucuacauauacgagcaaagccgaauacuuuaaucacgacuucacccuguuccucaacauuuuugaggcugccuucccuggcuccgcuacagccuuucuguucaagaaaaucaaggaaaaagcgcccuaucaagccuuugagaugaugggcaagauugcuaauaaauacccuaacaacaagcugcuugugguucuccugaaguaugggcaguacauggugggacugagccaugccucuaccuaccagcucaaacaggaauggaucgcuaagucccugagccuugucagauccacaaaaaccggccugaagauggccaugacgaaugcggagcccgggcccgccacaaaagaguguucugaugcuaagaccaucgccugccucaccccuaaguuccaaguggaaguuaacaaucugaugagcugcggagcuuccccgaacuuuaaaauuuauaugaagucuggcgagcuguacaaagcccacgaccggaauagcguguggugucuuaacgauaugcauugccucacacccuauaccccugccaaugcugaacuggucgcgacaaugaagaaaauggaguguuggcaggacaaccccaagcagccuacgaaugacuacgccacccccagacgcuccugccagaugaaggaucgggggcuguguaacgugggcgcugacaaauggaaggugaucaaaugcgaugacgaucucauguucuauacagacgcccuggagucuccggauccugccgcugacauuggacaauacuguuuuagcgaaaagugccagaucgagagauaucccauuaauccuaccucccuuacaaacugugaauggcuguaccgcgccguuaaaccccaguacaucaagcggcucagccugcagaccaucgaggaauauaagaaagcgauuacggauaagcugacccacacacuucaacucuaccacuucgcuccucuggagaaucugccccauaucagaccgaccuaugaguacauuacagcccagggcaccuauacagccgacgggaucgaaggagcuucuauuaucaccuccaucccugcccucagcggcacgucugucggguuuaaaauuaacgcgaaggauggaacagcucugcuugacaucgugguguacauuaaauccagcgucgugaagucuguuuauaaucacaucuacgauaccggccccaccauuaacaucaacuccaaacaugacgagcugugcacagggcagugucccaagcgcauuccugccgacccgaauuggcucaccuucagccaggaacggacguccagauggggcugcgaggaauuuggaugccuggccaucaacacaggcuguguguacgggagcugccaagaugucauccgcaccgagacaaagguguaucggaaagcuaaugaggaaaccguuaugcugacaguguguauuaccuaccccggacacacguucugcaccgacgucaacgcccuugagccuaagaucacagaugaacuggagcuccaguucaaaaccauugacaucaagucucugcccaaucucguggcuauuacaaaccacaaacuguauaccggccagaucaaugaucuugggacguuuggacaaauguguggcaacguucagaagacaaauaccagcauccugggggccggcacaccuaaguucgacuacacaugcuauuccgcgucuagaaaagauauuaucauucgccgguguuacaacaauaacuaugacagcugcagacuccugaagcaggaaggagaucugcuuuuugacgauaaucaugagacccugaucguguacaacaauaaacggcucaacggcgagcugacaaugaagcuccugcuuggggacauucaguacaaacuguauacggaaaacauggagcucgaacuggaggccaagugugucggaugcgugggcuguuucgaguccuaccaaugcaaucugcagaucaccucuagccuugaugggaacugcgcuaucuccggacccugugaaacauuucacgaccgcauucagaucaagaccaccaaaaaggacuaugcccugaaacucgcuugcaccaaggauccuggcgacaaagccacguucagagugugugggaaggauuacgacuuuaauuuccauacagucguuaagaacgauaaaauugaggugaaugugggcgacgaaaccucuuauaucaaggagaaagaugcccggugcggaaccuggcuguguagaguccgcgacgaaggccucagcgugauuuuugagccccugaagaacuucuuugggaauuaccuuaacauguuccuguauauccugggaggcguucuccugcuuuuccugucccucuacauuaucaugccggugugcgcucggcugagagaugagcucaaaaagaaugaaaagcugcaccagauggagaugaaaaagcgcuga

SEQ ID NO: 14147 - RNA, 4305 nt, Artificial Sequence
  derived and/or modified CDS sequence (opt5) from ANADV(EIV-13128Kam)__KT313718.1__GP
auguuccugauccucgugcugcuuauucccuuuuacaucaccgccacaccugucacgaccagaugcuuccacggcgggcagcugauugcugagagcaagucccucacagccaucucugaauuuugucugaaagacgauguuagcaccgugaaguccgagauuacauaucuuaaaaacgacaccggaaucuucgcgcauucuaaggugcugcggaauuggaucauuaaagauuggaagaacugcaauccgguccccacagcuggcgggagcaucaacgugauugaaguuaauaccgaccucucccugucuacgaagaccuacguguguagccgcgauugcacaaucaccgucgacaaagaggaugcccaaauuaucuuucagacagacaagcugaaccacuucgaaguguccggaaccacgcucagcucuggcugguuuaaaacaaaggccuccguuacccuggauagaacaugugagcauauuaaagugaccugcgggaagaagacccuucaguuccacgcuuguuuuaaacaucacaugagcugcauccgguucuuucacaauacaauccugccuggaacgauggccgucucuauuugucagaacaucgagcucauuaucauuaccucccugacacuuaucaucuucauucugauggugauccucaccaagacauauauuugcuacgugcugaugccccuguuuaugccugucgcuuaucucuacggcugggccuauaaucgcagcuguaaaaagugcucuugcuguggccuggcguaccaucccuucaccaacugcgggucccacuguguuugcggacuuaaauucgaagccagcgacagaaugcggauccaucgcgaguccggccugugucaaggguacaagucucucagaguggcucggcugcuuugcaaaagcaagggauccagccugauuaucucuauccuccuguccgugcugauucucagcuuugucacgccuaucgaaggcacacugaccaauuauccggagucuaagaaauacagccuugaggaaauugccgaugugaucgagggguucauugcugaaaagggaaucaaagaguauauuguucuguacaccuccaucuuuggcgcccuccugcuucugaucgcgcucauuaucacagugucucugaaccgcauuaccgaauaucugacaaaucucaacgucaucuacugucacgagugcagcauguaucacuccaagaaaaauauuaaguacaucggcgacuucacgaacaaguguggguuuugcaccuguggagagcuggaagaucaggagggccuuaacaugcauaaagugagcaagaaaugcaucuacagauaucagcugacauggucuaagguuauuaugaccauccucgugugccugcugauugcccagaauacaguccuuaucguggcugccaacgacgacuguugggcuaaacaaucccucgaaauugagugcgucgggccccugcaacagguggaugccugugaagacaagagcucucgguccuacaauggagaggccaagaaacugguuggcaccagcaaggugacggagcucgaugcugggcaggucaaccugcuuggacagaccaucgaauccgcgaucauugccauccgcaaacagagaacauaugcuaccaugcacuuccuggagucuguguuucucggccggcauugcgacuacuauaagguuuucgaacacaauagcggcuacucccaggccaaauggcgccugcuggccaagacaaaccauuuugauauuuguucuagacacagcacccaccauuucugccgguguauguccgacgggacgaagugcgagaauggaaacugggauuuugcuggcgaaaugaauacaaccuaucacagcaaaagagacuucuuuaagcaugauuucaaccuuuucuguacacuccuggagaaugccuuuccugggaccaccgagucucuguacuaccaacuccuguccaaacgcaacacaacgggagcgagcaaacuucugggcaagcucaucaccaaguucgggaauaacaaucuguuugugggcauuuggaaauucggacaguuucugcuuucucuccccuaugucaacaacacagaacuguccgcucugcagagcucuaagauccucgagagcccugaaccccugcuucgguccgccagcggcagacaggagucucuguccagcaccacaccgggggaggccuccaaggaaugccgcaaugcuaaaaagaucucuuguauuagcccucgguucggagugcccauggagaaccucaccgccugcggcgaauccccuaauuacaaaaucuauaagacgcccacaagaauuuacaaaucuaacaauaagggggagaucuggugcgcuggagacgugcacuguuuucaagaauuuacccccguucugcaggaggucguggauaagcugaaaaagaugaccugcuuucuuacagagccugaagccgaggaagacgcguucagcauugccaucgcuauguguaaaauucucgacaagggcgugugcaccaucaacuccgagcgcuggaauaucauuaaaugugauucugggcugauguauuacacagaccagcgggauggccaggacacgggaaacgauuuuggcgaauauugcaucagccacaauuguaagaccgagagauucccgauuaaccccuccaucauuagcgacugcaucugggaguaccauucucgcaagucccgguacaucagcacacugaaucucgaaucucuggaggaauuuaaaagagccauuuccgagaaacuuagccacacccuggucguguaucaauucaagccuacaucuaaccucccccauaugaagccuguuuacaaauauaucaccgcucaggggguggaaaauuccgauggaauugacagcgccuucaucacggcguccaugcccgcccugagcggcaccucuauuggguacaacgucaugagcaaggauaauuuuccgcuguucgacaucaucauuuuuaucaaguccgcugugauuaaaacaaccuauaaccacaucuacgauacaggaccuaccauuggcaucaacguuaugcaugacgagcacuguacagggcagugccccauugagaucccucacaaggaaaauuggcuuaccuucucucaggagcgcacgagccgguggggcugugaagaguuuggaugccuggccaucaacacaggcugcguguucggguccugucaagauauuaucagacccgagaccaaagucuaucggaaggcuauugaagagucugugcuccugaccguuugcgugacauacccuggaaauaccuuuuguacggaaaucaacgccauugagcccaaaaucacagacgaacucgagcugcaguucaagaccgucgacacaaaaacccuuccgaaucugcucgccgugcagaaccauaagcuguacagcggccagaucaaugaucugggguccuuugcucaaggaugcggcaacauucagaagacaaaucuuucugugaucgggaccggcacggcgaaauucgacuauauuugucacggagccagccgcaaggauaucgucguuagacggugcuacaacaauaacuaugaguccuguaaacugcucaaggaggaaccuagccugauuuucucugacaaucaugaaaccaucgagguggcuaacaucagacaccuccugggcgaacuucaguucaaacugaugcucggggaucugcgcuacaaguccuucgccgagaaucccgagcuggaaauugaggccaagugcgugggaugucccagcugcuuuucuuccuauagcuguaacuuccggaucuccucuagcauugacacagucugcgcuaucgauggcccuugcaccauuuuucauaacagacuuaucauuuccagcacaaaacaagacuacgggaucaagaugucuuguaaagaaaagccgaaucccguggagaaauucaacaucugcaagcgcauuuauuccguucuguuuaccacgaucgauaagagcgacaaaauugaaaucaauacaggagaucagaccucuuucauucaggagaaggacgauagauguaaaacauggcucugccgggugcgcgacgagggcaucagcgucaucuuugaaccuauuaaggccuucuuuggcuccuacuucucuaucgcguuuuacgugguuauugggaucauugcucuguucaucaccaucuauauuuuucuccccaugguguucaaacugaaggacauccuuaagaaaaacgagcugcuguaccuccaggaaaugaaguauaaauga

SEQ ID NO: 14148 - RNA, 4305 nt, Artificial Sequence
  derived and/or modified CDS sequence (opt5) from ANADV(EIV-13130Kam)__KT313721.1__GP
auguuccugauccucgugcugcuuauucccuuuuacaucaccgccacaccugucacgaccagaugcuuccacggcgggcagcugauugcugagagcaagucccucacagccaucucugaauuuugucugaaagacgauguuagcaccgugaaguccgagauuacauaucuuaaaaacgacaccggaaucuucgcgcauucuaaggugcugcggaauuggaucauuaaagauuggaagaacugcaauccgguccccacagcuggcgggagcaucaacgugauugaaguuaaugccgaccucucccugucuaccaagacguacguguguagccgcgauugcaccaucacagucgacaaagaggaugcccaaauuaucuuucagaccgacaagcugaaccacuucgaaguguccggaacaacccucagcucuggcugguuuaaaacgaaggcuuccguuacacuggauagaaccugugagcauauuaaagugacaugcgggaagaagacccuucaguuccacgccuguuuuaaacaucacaugagcugcauccgguucuuucacaauaccauccugccuggaacaauggcugucucuauuugucagaacaucgagcucauuaucauuacgucccugacccuuaucaucuucauucugauggugauccucacaaagaccuauauuugcuacgugcugaugccccuguuuaugccugucgccuaucucuacggcugggcguauaaucgcagcuguaaaaagugcucuugcuguggccuggccuaccaucccuucacaaacugcgggucccacuguguuugcggacuuaaauucgaagcuagcgacagaaugcggauccaucgcgaguccggccugugucaaggguacaagucucucagaguggcccggcugcuuugcaaaagcaagggauccagccugauuaucucuauccuccuguccgugcugauucucagcuuugucaccccuaucgaaggcacgcugacaaauuauccggagucuaagaaauacagccuugaggaaauugcugaugugaucgagggguucauugccgaaaagggaaucaaagaguauauuguucuguacaccuccaucuuuggcgcgcuccugcuucugaucgcccucauuaucaccgugucucugaaccgcauuacagaauaucugaccaaucucaacgucaucuacugucacgagugcagcauguaucacuccaagaaaaauauuaaguacaucggcgacuucacaaacaaguguggguuuugcacguguggagagcuggaagaucaggagggccuuaacaugcauaaagugagcaagaaaugcaucuacagauaucagcugaccuggucuaagguuauuaugacaauccucgugugccugcugauugcucagaauaccguccuuaucguggccgcuaacgacgacuguugggccaaacaaucccucgaaauugagugcgucgggccccugcaacagguggaugccugugaagacaagagcucucgguccuacaauggagaggcuaagaaacugguuggcacaagcaaggugaccgagcucgaugcggggcaggucaaccugcuuggacagacgaucgaauccgccaucauugcuauccgcaaacagagaaccuaugccacaaugcacuuccuggagucuguguuucucggccggcauugcgacuacuauaagguuuucgaacacaauagcggcuacucccaggccaaauggcgccugcuggcuaagaccaaccauuuugauauuuguucuagacacagcacacaccauuucugccgguguauguccgacgggaccaagugcgagaauggaaacugggauuuugccggcgaaaugaauacgacauaucacagcaaaagagacuucuuuaagcaugauuucaaccuuuucuguacccuccuggagaaugcguuuccugggacaaccgagucucuguacuaccaacuccuguccaaacgcaacaccacaggagcuagcaaacuucugggcaagcucaucacgaaguucgggaauaacaaucuguuugugggcauuuggaaauucggacaguuucugcuuucucuccccuaugucaacaacaccgaacuguccgcccugcagagcucuaagauccucgagagcccugaaccccugcuucgguccgccagcggcagacaggagucucuguccagcgcuacaccgggggaggccuccaaggaaugccgcaaugcuaaaaagaucucuuguauuagcccucgguucggagugcccauggagaaccucaccgccugcggcgaauccccuaauuacaaaaucuauaagacacccaccagaauuuacaaaucuaacaauaagggggagaucuggugcgcgggagacgugcacuguuuucaagaguucacgcccguucugcaggaggucguggauaagcugaaaaagaugacaugcuuucuuaccgagccugaagccgaggaagacgcuuucagcauugccaucgcuauguguaaaauucucgacaagggcgugugcaccaucaacuccgagcgcuggaauaucauuaaaugugauucugggcugauguauuacacagaccagcgggauggccaggacaccggaaacgauuuuggcgaauauugcaucagccacaauuguaagacagagagauucccgauuaaccccuccaucauuagcgacugcaucugggaguaccauucucgcaagucccgguacaucagcacgcugaaucucgaaucucuggaggaauuuaaaagagccauuuccgagaaacuuagccacacccugaucgucuaucaauucaagccuacaucuaaccucccccauaugaagccuguguacaaauauauuaccgcgcaggggguugaaaauuccgauggaaucgacagcgccuucauuacagcuuccaugcccgcccugagcggcaccucuaucggguacaacgugaugagcaaggauaauuuuccgcuguucgacaucauuaucuuuauuaaguccgcugucaucaaaacgaccuauaaccacauuuacgauacaggaccuaccaucggcauuaacgugaugcaugacgagcacuguacagggcagugccccaucgagaucccucacaaggaaaauuggcuuaccuucucucaggagcgcacaagccgguggggcugugaagaguuuggaugccuggccauuaacaccggcugcguuuucggguccugucaagauaucauuagacccgagacgaaaguguaucggaaggccaucgaagagucuguccuccugacagugugcguuaccuacccuggaaauaccuuuuguacagaaauuaacgcuaucgagcccaaaaucaccgacgaacucgagcugcaguucaagacgguggacacaaaaacccuuccgaaucugcucgcgguccagaaccauaagcuguacagcggccagauuaaugaucugggguccuuugcccaaggaugcggcaacauccagaagacaaaucuuucugugauugggaccggcacagcuaaauucgacuauaucugucacggagccagccgcaaggauauuguggucagacggugcuacaacaauaacuaugaguccuguaaacugcucaaggaagaaccuagccugaucuuuucugacaaucaugaaaccaucgagguugccaacauuagacaccuccugggcgaacuucaguucaaacugaugcucggggaucugcgcuacaaguccuucgcugagaaucccgagcuggaaaucgaggccaagugcgugggaugucccagcugcuuuucuuccuauagcuguaacuuccggauuuccucuagcaucgacacggugugcgcgauugauggcccuugcaccaucuuucauaacagacuuauuaucuccagcacaaaacaagacuacgggaucaagaugucuuguaaagaaaagccgaaucccgucgagaaauucaacauuugcaagcgcguguauuccguucuguuuaccacaaucgauaagaaugacaaaauugaaaucaacaccggagaucagacgagcuucauucaggagaaggacgauagauguaaaacauggcucugccgggugcgcgacgagggcaucucugucaucuuugaaccuauuaaggcuuucuuuggcagcuacuucuccaucgccuuuuacgugguuauugggaucauugcccuguucaucaccaucuauauuuuucuccccaugguguucaaacugaaggacauccuuaagaaaaaugagcugcuguaccuccaggaaaugaaguauaaauga

SEQ ID NO: 14149 - RNA, 4305 nt, Artificial Sequence
  derived and/or modified CDS sequence (opt5) from ANADV(EIV-13395Mg)__KU159765.1__GP
auguuccugauccucgugcugcuuauucccuuuuacaucaccgccacaccugucacgaccagaugcuuccacggcgggcagcugauugcugagagcaagucccucacagccaucucugaauuuugucugaaagacgauguuagcaccgugaaguccgagauuacauaucuuaaaaacgacaccggaaucuucgcgcauucuaaggugcugcggaauuggaucauuaaagauuggaagaacugcaauccgguccccacagcuggcgggagcaucaacgugauugaaguuaaugccgaccucucccugucuaccaagacguacguguguagccgcgauugcaccaucacagucgacaaagaggaugcccaaauuaucuuucagaccgacaagcugaaccacuucgaaguguccggaacaacccucagcucuggcugguuuaaaacgaaggcuuccguuacacuggauagaaccugugagcauauuaaagugacaugcgggaagaagacccuucaguuccacgccuguuuuaaacaucacaugagcugcauccgguucuuucacaauaccauccugccuggaacaauggcugucucuauuugucagaacaucgagcucauuaucauuacgucccugacccuuaucaucuucauucugauggugauccucacaaagaccuauauuugcuacgugcugaugccccuguuuaugccugucgccuaucucuacggcugggcguauaaucgcagcuguaaaaagugcucuugcuguggccuggccuaccaucccuucacaaacugcgggucccacuguguuugcggacuuaaauucgaagcuagcgacagaaugcggauccaucgcgaguccggccugugucaaggguacaagucucucagaguggcccggcugcuuugcaaaagcaagggauccagccugauuaucucuauccuccuguccgugcugauucucagcuuugucaccccuaucgaaggcacgcugacaaauuauccggagucuaagaaauacagccuugaggaaauugcugaugugaucgagggguucauugccgaaaagggaaucaaagaguauauuguucuguacaccuccaucuuuggcgcgcuccugcuucugaucgcccucauuaucaccgugucucugaaccgcauuacagaauaucugaccaaucucaacgucaucuacugucacgagugcagcauguaucacuccaagaaaaauauuaaguacaucggcgacuucacaaacaaguguggguuuugcacguguggagagcuggaagaucaggagggccuuaacaugcauaaagugagcaagaaaugcaucuacagauaucagcugaccuggucuaagguuauuaugacaauccucgugugccugcugauugcucagaauaccguccuuaucguggccgcuaacgacgacuguugggccaaacaaucccucgaaauugagugcgucgggccccugcaacagguggaugccugugaagacaagagcucucgguccuacaauggagaggcuaagaaacugguuggcacaagcaaggugaccgagcucgaugcggggcaggucaaccugcuuggacagacgaucgaauccgccaucauugcuauccgcaaacagagaaccuaugccacaaugcacuuccuggagucuguguuucucggccggcauugcgacuacuauaagguuuucgaacacaauagcggcuacucccaggccaaauggcgccugcuggcuaagaccaaccauuuugauauuuguucuagacacagcacacaccauuucugccgguguauguccgacgggaccaagugcgagaauggaaacagagauuuugccggcgaaaugaauacgacauaucacagcaaacgcgacuucuuuaagcaugauuucaaccuuuucuguacccuccuggagaaugcguuuccugggacaaccgagucucuguacuaccaacuccuguccaaacggaacaccacaggagcuagcaaacuucugggcaagcucaucacgaaguucgggaauaacaaucuguuugugggcauuuggaaauucggacaguuucugcuuucucuccccuaugucaacaacaccgaacuguccgcccugcagagcucuaagauccucgagagcccugaaccccugcuuagauccgccagcggccgccaggagucucuguccagcgcuacaccgggggaggccuccaaggaaugccggaaugcuaaaaagaucucuuguauuagcccuagauucggagugcccauggagaaccucaccgccugcggcgaauccccuaauuacaaaaucuauaagacacccacccgcauuuacaaaucuaacaauaagggggagaucuggugcgcgggagacgugcacuguuuucaagaauuuacgcccguucugcaggaggucguggauaagcugaaaaagaugacaugcuuucuuaccgagccugaagccgaggaagacgcuuucagcauugccaucgcuauguguaaaauucucgacaagggcgugugcaccaucaacuccgagcgguggaauaucauuaaaugugauucugggcugauguauuacacagaccagagagauggccaggacaccggaaacgauuuuggcgaauauugcaucagccacaauuguaagacagagcgcuucccgauuaaccccuccaucauuagcgacugcaucugggaguaccauucucggaaguccagauacaucagcacgcugaaucucgaaucucuggaggaauuuaaacgcgccauuuccgagaaacuuagccacacccuggucguguaucaauucaagccuacaucuaaccucccccauaugaagccuguuuacaaauauaucaccgcgcaggggguggaaaauuccgauggaauugacagcgccuucaucacagcuuccaugcccgcccugagcggcaccucuauuggguacaacgucaugagcaaggauaauuuuccgcuguucgacaucaucauuuuuaucaaguccgcugugauuaaaacgaccuauaaccacaucuacgauacaggaccuaccauuggcaucaacguuaugcaugacgagcacuguacagggcagugccccauugagaucccucacaaggaaaauuggcuuaccuucucucaggagcggacaagcagauggggcugugaagaguuuggaugccuggccaucaacaccggcugcguguucggguccugucaagauauuauccggcccgagacgaaagucuaucgcaaggccauugaagagucugugcuccugacaguuugcgugaccuacccuggaaauaccuuuuguacagaaaucaacgcuauugagcccaaaaucaccgacgaacucgagcugcaguucaagacggucgacacaaaaacccuuccgaaucugcucgcggugcagaaccauaagcuguacagcggccagaucaaugaucugggguccuuugcccaaggaugcggcaacauucagaagacaaaucuuucugugaucgggaccggcacagcuaaauucgacuauauuugucacggagccagcagaaaggauaucgucguucggagaugcuacaacaauaacuaugaguccuguaaacugcucaaggaggaaccuagccugauuuucucugacaaucaugaaaccaucgagguggccaacauccgccaccuccugggcgaacuucaguucaaacugaugcucggggaucugcgguacaaguccuucgcugagaaucccgagcuggaaauugaggccaagugcgugggaugucccagcugcuuuucuuccuauagcuguaacuucagaaucuccucuagcauugacacggucugcgcgaucgauggcccuugcaccauuuuucauaaccgccuuaucauuuccagcacaaaacaagacuacgggaucaagaugucuuguaaagaaaagccgaaucccguggagaaauucaacaucugcaagagaguuuauuccgugcuguuuaccacaauugauaagaaugacaaaaucgaaauuaacaccggagaucagacgagcuucauccaggagaaggacgaucgguguaaaacauggcucugccgcgucagagacgagggcauuucugugaucuuugaaccuaucaaggcuuucuuuggcagcuacuucuccauugccuuuuacguugugaucgggauuaucgcccuguucauuaccaucuauaucuuucuccccauggucuucaaacugaaggacauucuuaagaaaaaugagcugcuguaccuccaggaaaugaaguauaaauga

SEQ ID NO: 14150 - RNA, 4305 nt, Artificial Sequence
  derived and/or modified CDS sequence (opt5) from ANADV(EIV-16002Mg)__KT313724.1__GP
auguuccugauccucgugcugcuuauucccuuuuacaucaccgccacaccugucacgaccagaugcuuccacggcgggcagcugauugcugagagcaagucccucacagccaucucugaauuuugucugaaagacgauguuagcaccgugaaguccgagauuacauaucuuaaaaacgacaccggaaucuucgcgcauucuaaggugcugcggaauuggaucauuaaagauuggaagaacugcaauccgguccccacagcuggcgggagcaucaacgugauugaaguuaaugccgaccucucccugucuaccaagacguacguguguagccgcgauugcaccaucacagucgacaaagaggaugcccaaauuaucuuucagaccgacaagcugaaccacuucgaaguguccggaacaacccucagcucuggcugguuuaaaacgaaggcuuccguuacacuggauagaaccugugagcauauuaaagugacaugcgggaagaagacccuucaguuccacgccuguuuuaaacaucacaugagcugcauccgguucuuucacaauaccauccugccuggaacaauggcugucucuauuugucagaacaucgagcucauuaucauuacgucccugacccuuaucaucuucauucugauggugauccucacaaagaccuauauuugcuacgugcugaugccccuguuuaugccugucgccuaucucuacggcugggcguauaaucgcagcuguaaaaagugcucuugcuguggccuggccuaccaucccuucacaaacugcgggucccacuguguuugcggacuuaaauucgaagcuagcgacagaaugcggauccaucgcgaguccggccugugucaaggguacaagucucucagaguggcccggcugcuuugcaaaagcaagggauccagccugauuaucucuauccuccuguccgugcugauucucagcuuugucaccccuaucgaaggcacgcugacaaauuauccggagucuaagaaauacagccuugaggaaauugcugaugugaucgagggguucauugccgaaaagggaaucaaagaguauauuguucuguacaccuccaucuuuggcgcgcuccugcuucugaucgcccucauuaucaccgugucucugaaccgcauuacagaauaucugaccaaucucaacgucaucuacugucacgagugcagcauguaucacuccaagaaaaauauuaaguacgugggcgacuucacaaacaaguguggguuuugcacguguggagagcuggaagaucaggagggccuuaacaugcauaaaguuagcaagaaaugcaucuacagauaucagcugaccuggucuaaggugaucaugacaauucucgucugccugcugaucgcucagaauaccgugcuuauugucgccgcuaacgacgacuguugggccaaacaaucccucgaaaucgagugcguggggccccugcagcagguugaugccugugaagacaagagcucucgguccuacaauggagaggcuaagaaacuggugggcacaagcaaggucaccgagcucgaugcgggacaggugaaccugcuugggcaaacgauugaauccgccaucaucgcuauucgcaaacagagaaccuaugccacaaugcacuuccuggagucuguuuuucucggccggcauugcgacuacuauaagguguucgaacacaauagcggcuacucccaggccaaauggcgccugcuggcuaagaccaaccauuuugauaucuguucuagacacagcacacaccauuucugccgguguauguccgacgggaccaagugcgagaauggaaacugggauuuugccggcgaaaugaauacgacauaucacagcaaaagagacuucuuuaagcaugauuucaaacuuuucuguacccuccuggagaacgcguuuccugggacaaccgagucucuguacuaccaacuccuguccaagcgcaauaccacaggagcuagcaaacuucugggcaagcucauuacgaaauucgggaacaauaaccuguuugucggcaucuggaaguucggacaguuucugcuuucucuccccuaugugaauaacaccgaacuguccgcccugcagagcucuaagauucucgagagcccugaaccccugcuucgguccgccagcggcagacaggagucucuguccagcgcuacaccgggggaggccucccgcgaaugccggaacgcuaaaaagaucucuuguaucagcccuagauucggagugcccauggagaaucucaccgccugcggcgaauccccuaacuacaaaauuuauaagacacccgcgcgcaucuacaaaucuaauaacaagggggagauuuggugcgccggagacguucacuguuuucaagaguucacccccguccugcaggaggugguggauaagcugaaaaagaugacgugcuuucuuacagagccugaagcugaggaagacgccuucagcaucgcuauugccauguguaaaauccucgacaagggcgucugcaccauuaauuccgagcgguggaacaucaucaaaugugauucugggcugauguauuacaccgaccagagagauggccaggacacaggaaaugauuuuggcgaauauugcauuagccacaacuguaagaccgagcgcuucccgaucaaucccuccauuaucagcgacugcauuugggaguaccauucucggaaguccagauacaucagcacacugaaccucgaaucucuggaggaauuuaaacgcgcgaucuccgagaaacuuagccacacgcuggugguuuaucaauucaagccuaccucuaaucucccccauaugaagccuguguacaaauauauuacagcccagggggucgaaaacuccgauggaaucgacagcgcuuucauuaccgccuccaugcccgcucugagcggcacaucuaucggguacaaugugaugagcaaggauaacuuuccgcuguucgacauuaucaucuuuauuaaguccgccguuaucaaaaccacguauaaucacauuuacgauaccggaccuacaaucggcauuaacgugaugcaugacgagcacuguaccgggcagugccccaucgagauuccucacaaggaaaacuggcuuacauucucucaggagcggaccagcagauggggcugugaagaguuuggaugccuggccaucaauacaggcugcgucuucggguccugucaagauaucauucggcccgagaccaaaguguaucgcaaggcuaucgaagagucuguucuccugacggugugcgucacauacccuggaaacaccuuuuguaccgaaauuaaugcgaucgagcccaaaauuacagacgaacucgagcugcaguucaagaccguggacacgaaaacacuuccgaaccugcucgccgugcagaaucauaagcuguacagcggccagaucaacgaucugggguccuuugcucaaggaugcggcaauauccagaagaccaaccuuucugucauugggacaggcaccgccaaauucgacuauaucugucacggagccagcagaaaggauauuguugugcggagaugcuacaauaacaauuaugaguccuguaaacugcucaaggaagaaccuagccugaucuuuucugacaaccaugaaacaauugagguggcuaauauccgccaccuccugggcgaacuucaguucaaacugaugcucggggaucugcgguacaaguccuucgccgagaaccccgagcuggaaaucgaggcgaagugcgucggaugucccagcugcuuuucuuccuauagcuguaauuucagaauuuccucuagcaucgacaccgugugcgcuauugauggcccuugcacgguuuuucauaaccgccuuaucauuuccagcaccaaacaagacuacgggaucaagaugucuuguaaagaaaagccgaaccccguggagaaauucaauauuugcaagagagucuauuccgugcuguuuacaaccaucgauaagaacgacaaaaucgaaauuaauacaggagaucagaccagcuucauccaggagaaggacgaucgguguaaaacguggcucugccgcguuagagacgagggcauuucugugaucuuugaaccuauuaaggccuucuuuggcagcuacuucuccaucgccuuuuacgucgugaucgggauuaucgcucuguucauuacaaucuauauuuuucuccccaugguuuucaaacugaaggacauccuuaagaaaaacgagcugcuguaccuccaggaaaugaaguauaaauga

SEQ ID NO: 14151 - RNA, 4305 nt, Artificial Sequence
  derived and/or modified CDS sequence (opt5) from ANADV(EIV-16199Mg)__KT313730.1__GP
auguuccugauccucgugcugcuuauucccuuuuacaucaccgccacaccugucacgaccagaugcuuccacggcgggcagcugauugcugagagcaagucccucacagccaucucugaauuuugucugaaagacgauguuagcaccgugaaguccgagauuacauaucuuaaaaacgacaccggaaucuucgcgcauucuaaggugcugcggaauuggaucauuaaagauuggaagaacugcaauccgguccccacagcuggcgggagcaucaacgugauugaaguuaaugccgaccucucccugucuaccaagacguacguguguagccgcgauugcaccaucacagucgacaaagaggaugcccaaauuaucuuucagaccgacaagcugaaccacuucgaaguguccggaacaacccucagcucuggcugguuuaaaacgaaggcuuccguuacacuggauagaaccugugagcauauuaaagugacaugcgggaagaagacccuucaguuccacgccuguuuuaaacaucacaugagcugcauccgguucuuucacaauaccauccugccuggaacaauggcugucucuauuugucagaacaucgagcucauuaucauuacgucccugacccuuaucaucuucauucugauggugauccucacaaagaccuauauuugcuacgugcugaugccccuguuuaugccugucgccuaucucuacggcugggcguauaaucgcagcuguaaaaagugcucuugcuguggccuggccuaccaucccuucacaaacugcgggucccacuguguuugcggacuuaaauucgaagcuagcgacagaaugcggauccaucgcgaguccggccugugucaaggguacaagucucucagaguggcccggcugcuuugcaaaagcaagggauccagccugauuaucucuauccuccuguccgugcugauucucagcuuugucaccccuaucgaaggcacgcugacaaauuauccggagucuaagaaauacagccuugaggaaauugcugaugugaucgagggguucauugccgaaaagggaaucaaagaguauauuguucuguacaccuccaucuuuggcgcgcuccugcuucugaucgcccucauuaucaccgugucucugaaccgcauuacagaauaucugaccaaucucaacgucaucuacugucacgagugcagcauguaucacuccaagaaaaauauuaaguacaucggcgacuucacaaacaaguguggguuuugcacguguggagagcuggaagaucaggagggccuuaacaugcauaaagugagcaagaaaugcaucuacagauaucagcugaccuggucuaagguuauuaugacaauccucgugugccugcugauugcucagaauaccguccuuaucguggccgcuaacgacgacuguugggccaaacaaucccucgaaauugagugcgucgggccccugcaacagguggaugccugugaagacaagagcucucgguccuacaaugaggaggcuaagaaacugguuggaacaagcaaggugaccgaacucgaugcgggccaggucaaccugcuugggcagacgaucgaguccgccaucauugcuauccgcaaacagagaaccuaugccacaaugcacuuccuggaaucuguguuucucggacggcauugcgacuacuauaagguuuucgagcacaauagcggcuacucccaggccaaauggcgccugcuggcuaagaccaaccauuuugauauuuguucuagacacagcacacaccauuucugccgguguauguccgacggcaccaagugcgaaaaugggaacugggauuuugccggagagaugaauacgacauaucacagcaaaagagacuucuuuaagcaugauuucaaccuuuucuguacccuccuggagaaugcguuuccuggcacaaccgaaucucuguacuaccaacuccuguccaaacgcaacaccacaggggcuagcaaacuucugggaaaacucaucacgaaguucggcaauaacaaucuguuuguggggauuuggaaauucggccaguuucugcuuucucuccccuaugucaacaacaccgagcuguccgcccugcagagcucuaagauccucgaaagcccugagccccugcuucgguccgccagcggaagacaggagucucuguccagcgcuacaccgggcgaagccuccaaggagugccgcaaugcuaaaaagaucucuuguauuagcccucgguucggggugcccauggaaaaccucaccgccugcggagaguccccuaauuacaaaaucuauaagacacccaccagaauuuacaaaucuaacaauaagggcgaaaucuggugcgcgggggacgugcacuguuuucaagaguucacgcccguucugcaggaggucguggauaagcugaaaaagaugacaugcuuucuuaccgaaccugaggccgaagaggacgcuuucagcauugccaucgcuauguguaaaauucucgacaagggagugugcaccaucaacuccgaacgcuggaauaucauuaaaugugauucuggccugauguauuacacagaccagcgggaugggcaggacaccggcaacgauuuuggagaguauugcaucagccacaauuguaagacagagagauucccgauuaaccccuccaucauuagcgacugcaucugggaauaccauucucgcaagucccgguacaucagcacgcugaaucucgagucucuggaagaguuuaaaagagccauuuccgaaaaacuuagccacacccugaucgucuaucaauucaagccuacaucuaaccucccccauaugaagccuguguacaaauauauuaccgcgcagggcguugaaaauuccgaugggaucgacagcgccuucauuacagcuuccaugcccgcccugagcggaaccucuaucggcuacaacgugaugagcaaggauaauuuuccgcuguucgacaucauuaucuuuauuaaguccgcugucaucaaaacgaccuauaaccacauuuacgauacagggccuaccaucggaauuaacgugaugcaugacgagcacuguacaggccagugccccaucgagaucccucacaaggagaauuggcuuaccuucucucaggaacgcacaagccggugggggugugaggaguuuggcugccuggccauuaacaccggaugcguuuucggcuccugucaagauaucauuagacccgaaacgaaaguguaucggaaggccaucgaggaaucuguccuccugacagugugcguuaccuacccugggaauaccuuuuguacagagauuaacgcuaucgaacccaaaaucaccgacgagcucgagcugcaguucaagacgguggacacaaaaacccuuccgaaucugcucgcgguccagaaccauaagcuguacagcggacagauuaaugaucugggcuccuuugcccaagggugcggaaacauccagaagacaaaucuuucugugauuggcaccgggacagcuaaauucgacuauaucugucacggcgccagccgcaaggauauuguggucagacggugcuacaacaauaacuaugaauccuguaaacugcucaaggaggaaccuagccugaucuuuucugacaaucaugagaccaucgaaguugccaacauuagacaccuccugggagagcuucaguucaaacugaugcucggcgaucugcgcuacaaguccuucgcugagaaucccgaacuggagaucgaagcccggugcguggggugucccagcugcuuuucuuccuauagcuguaacuucagaauuuccucuagcaucgacacggugugcgcgauugauggaccuugcaccaucuuucauaaccgccuuauuaucuccagcacaaagcaagacuacggcaucaaaaugucuuguaaggagaaaccgaaucccgucgaaaaguucaacauuugcaaaagaguguauuccguucuguuuaccacaaucgauaagaaugacaagauugagaucaacaccggggaucagacgagcuucauucaggagaaagacgaucgguguaagacauggcucugccgcgugagagacgaaggaaucucugucaucuuugagccuauuaaggcuuucuuuggcagcuacuucuccaucgccuuuuacgugguuauuggcaucauugcccuguucaucaucauuuauaucuuucuccccaugguguucaagcugaaagacauucuuaagaagaaugaacugcuguaccuccaggagaugaaauauaaguga

SEQ ID NO: 14152 - RNA, 4305 nt, Artificial Sequence
  derived and/or modified CDS sequence (opt5) from ANADV(EIV-16208Mg)__KT313733.1__GP
auguuccugauccucgugcugcuuauucccuuuuacaucaccgccacaccugucacgaccagaugcuuccacggcgggcagcugauugcugagagcaagucccucacagccaucucugaauuuugucugaaagacgauguuagcaccgugaaguccgagauuacauaucuuaaaaacgacaccggaaucuucgcgcauucuaaggugcugcggaauuggaucauuaaagauuggaagaacugcaauccgguccccacagcuggcgggagcaucaacgugauugaaguuaaugccgaccucucccugucuaccaagacguacguguguagccgcgauugcaccaucacagucgacaaagaggaugcccaaauuaucuuucagaccgacaagcugaaccacuucgaaguguccggaacaacccucagcucuggcugguuuaaaacgaaggcuuccguuacacuggauagaaccugugagcauauuaaagugacaugcgggaagaagacccuucaguuccacgccuguuuuaaacaucacaugagcugcauccgguucuuucacaauaccauccugccuggaacaauggcugucucuauuugucagaacaucgagcucauuaucauuacgucccugacccuuaucaucuucauucugauggugauccucacaaagaccuauauuugcuacgugcugaugccccuguuuaugccugucgccuaucucuacggcugggcguauaaucgcagcuguagaaaaugcucuugcuguggccuggccuaccaucccuucacaaacugcgggucccacuguguuugcggacuuaaguucgaagcuagcgaccggaugcgcauccauagagaguccggccugugucaaggguacaaaucucuccggguggcccgccugcuuugcaagagcaaaggauccagccugauuaucucuauccuccuguccgugcugauucucagcuuugucaccccuaucgaaggcacgcugacaaauuauccggagucuaagaaguacagccuugaggaaauugcugaugugaucgagggguucauugccgaaaaaggaaucaaggaguauauuguucuguacaccuccaucuuuggcgcgcuccugcuucugaucgcccucauuaucaccgugucucugaacagaauuacagaauaucugaccaaucucaacgucaucuacugucacgagugcagcauguaucacuccaaaaagaauauuaaauacaucggcgacuucacaaacaaguguggguuuugcacguguggagagcuggaagaucaggagggccuuaacaugcauaaggugagcaaaaagugcaucuaccgguaucagcugaccuggucuaaaguuauuaugacaauccucauuugccugcugaucgcucagaaugccgugcuuauugucgcugccaacgacgacuguugggccaagcaaucccucgaaaucgagugcguggggccccugcagcaggucgaugcuugugaagacaaaagcucucgcuccuacaauggagaggcgaagaagcuggugggcaccagcaaaguuacagagcucgaugccggacaggugaaccugcuugggcaaaccaucgaauccgcuauuaucgccauuagaaagcagcggacguaugccaccaugcacuuccuggagucugucuuucucggccgccauugcgacuacuauaaaguguucgaacacaauagcggcuacucccaggcuaaguggagacugcuggccaaaacaaaccauuuugauaucuguucucggcacagcacccaccauuucugcagauguauguccgacgggacaaagugcgagaauggaaacugggauuuugcgggcgaaaugaauaccacguaucacagcaagcgcgacuucuuuaaacaugauuucaaacuuuucuguacacuccuggagaacgcuuuuccugggaccacagagucucuguacuaccaacuccuguccaagcggaauaccaccggagccagcaaacuucugggcaagcucauuacaaaguucgggaacaauaaccuguuuguuggcaucuggaaauucggacaguuucugcuuucucuccccuaugugaauaacacggaacuguccgcccugcagagcucuaagauccucgagagcccugaaccccugcuuagauccgcuagcggccgccaggagucucuguccagcgccaccccgggggaggcuuccaaggaaugccggaacgccaaaaagauuucuuguaucagcccuagauucggaguccccauggagaaucucacagcgugcggcgaauccccuaacuacaaaauuuauaagacccccacacgcaucuacaaaucuaauaacaagggggagauuuggugcgccggagacgugcacuguuuucaagaguucacccccgugcugcaggagguugucgauaagcugaaaaagaugacgugcuuucuuacagagccugaagcugaggaagacgccuucagcaucgcuauugccauguguaaaauccucgacaagggcgugugcaccaucaauuccgagcgguggaacauuaucaaaugugauucugggcugauguauuacaccgaccagagagauggccaggacacaggaaaugauuuuggcgaauauugcauuagccacaacuguaagaccgagcgcuucccgaucaaucccuccauuaucagcgacugcaucugggaguaccauucucggaaguccaaauacauuagcacacugaaccucgaaucucuggaggaauuuaagagagcgaucuccgagaaacuuagccacacgcugguggucuaucaauucaagccuaccucuaaucucccccauaugaaaccuguguacaaguauauuacagcccaggggguugaaaacuccgauggaaucgacagcgcuuucauuaccgccuccaugcccgcucugagcggcacaucuaucggguacaaugugaugagcaaggauaacuuuccgcuguucgacaucauuaucuuuauuaaauccgccgucaucaagaccacguauaaucacauuuacgauaccggaccuacaaucggcauuaacgugaugcaugacgagcacuguaccgggcagugccccaucgagaucccucacaaagaaaacuggcuuacauucucucaggagcgcaccagccgguggggcugugaagaguuuggaugccuggccauuaauacaggcugcguuuucggguccugucaagauaucauuagacccgagaccaagguguaucggaaagcuaucgaagagucuguccuccugacggugugcguuacauacccuggaaacaccuuuuguaccgaaauuaaugcgaucgagcccaagaucacagacgaacucgagcugcaguucaaaaccguggacacgaagacacuuccgaaccugcucgccguccagaaucauaagcuguacagcggccagauuaacgaucugggguccuuugcucaaggaugcggcaauauccagaaaaccaaccuuucugugauugggacaggcaccgccaaguucgacuauaucugucacggagccagccgcaaagauauuaucgugagacggugcuacaauaacaauuaugaguccuguaagcugcucaaagaagaaccuagccugaucuuuucugacaaccaugaaacaauugaggucgcuaauaucagacaccuccugggcgaacuucaguucaagcugaugcucggggaucugcgcuacaaguccuucgccgagaaccccgagcuggaaauugaggcgaaaugcguuggaugucccagcugcuuuucuuccuauagcuguaauuuccggaucuccucuagcauugacaccgugugcgcuaucgauggcccuugcacgauuuuucauaacagacuuaucaucuccagcaccaagcaagacuacgggauuaaaaugucuuguaaggaaaaaccgaacuccguggagaaguucaauaucugcaagcgcgucuauagcgugcuguuuacaaccauugauaaaaacgacaagaucgaaauuaauacaggagaucagaccucuuucauccaggagaaagacgauagauguaagacguggcucugccggguucgcgacgagggcaucagcgugauuuuugaacccaucaaagccuucuuuggcuccuacuucucuauugccuuuuacgucgugaucgggauuaucgcucuguucaucauuaucuauauuuuucucccuaugguuuucaagcugaaggacauccuuaaaaagaacgagcugcuguaccuccaggaaaugaaauauaaguga

SEQ ID NO: 14153 - RNA, 4305 nt, Artificial Sequence
  derived and/or modified CDS sequence (opt5) from ANADV(EIV-16356Mg)__KT313736.1__GP
auguuccugauccucgugcugcuuauucccuuuuacaucaccgccacaccugucacgaccagaugcuuccacggcgggcagcugauugcugagagcaagucccucacagccaucucugaauuuugucugaaagacgauguuagcaccgugaaguccgagauuacauaucuuaaaaacgacaccggaaucuucgcgcauucuaaggugcugcggaauuggaucauuaaagauuggaagaacugcaauccgguccccacagcuggcgggagcaucaacgugauugaaguuaaugccgaccucucccugucuaccaagacguacguguguagccgcgauugcaccaucacagucgacaaagaggaugcccaaauuaucuuucagaccgacaagcugaaccacuucgaaguguccggaacaacccucagcucuggcugguuuaaaacgaaggcuuccguuacacuggauagaaccugugagcauauuaaagugacaugcgggaagaagacccuucaguuccacgccuguuuuaaacaucacaugagcugcauccgguucuuucacaauaccauccugccuggaacaauggcugucucuauuugucagaacaucgagcucauuaucauuacgucccugacccuuaucaucuucauucugauggugauccucacaaagaccuauauuugcuacgugcugaugccccuguuuaugccugucgccuaucucuacggcugggcguauaaucgcagcuguaaaaagugcucuugcuguggccuggccuaccaucccuucacaaacugcgggucccacuguguuugcggacuuaaauucgaagcuagcgacagaaugcggauccaucgcgaguccggccugugucaaggguacaagucucucagaguggcccggcugcuuugcaaaagcaagggauccagccugauuaucucuauccuccuguccgugcugauucucagcuuugucaccccuaucgaaggcacgcugacaaauuauccggagucuaagaaauacagccuugaggaaauugcugaugugaucgagggguucauugccgaaaagggaaucaaagaguauauuguucuguacaccuccaucuuuggcgcgcuccugcuucugaucgcccucauuaucaccgugucucugaaccgcauuacagaauaucugaccaaucucaacgucaucuacugucacgagugcagcauguaucacuccaagaaaaauauuaaguacaucggcgacuucacaaacaaguguggguuuugcacguguggagagcuggaagaucaggagggccuuaacaugcauaaagugagcaagaaaugcaucuacagauaucagcugaccuggucuaagguuauuaugacaauccucgugugccugcugauugcucagaauaccguccuuaucguggccgcuaacgacgacuguugggccaaacaaucccucgaaauugagugcgucgggccccugcaacagguggaugccugugaagacaagagcucucgguccuacaauggagaggcuaagaaacugguuggcacaagcaaggugaccgagcucgaugcggggcaggucaaccugcuuggacagacgaucgaauccgccaucauugcuauccgcaaacagagaaccuaugccacaaugcacuuccuggagucuguguuucucggccggcauugcgacuacuauaagguuuucgaacacaauagcggcuacucccaggccaaauggcgccugcuggcuaagaccaaccauuuugauauuuguucuagacacagcacacaccauuucugccgguguauguccgacgggaccaagugcgagaauggaaacugggauuuugccggcgaaaugaauacgacauaucacagcaaaagagacuucuuuaagcaugauuucaaacuuuucuguacccuccuggagaacgcguuuccugggacaaccgagucucuguacuaccaacuccuguccaagcgcaauaccacaggagcuagcaaacuucugggcaagcucaucacgaaauucgggaacaauaaccuguuugugggcauuuggaaguucggacaguuucugcuuucucuccccuaugucaauaacaccgaacuguccgcccugcagagcucuaagauccucgagagcccugaaccccugcuucgguccgccagcggcagacaggagucucuguccagcgcuacaccgggggaggccuccaaagaaugccgcaacgcuaagaaaaucucuuguauuagcccucgguucggagugcccauggagaaucucaccgccugcggcgaauccccuaacuacaagaucuauaaaacacccaccagaauuuacaagucuaauaacaagggggagaucuggugcgcgggagacgugcacuguuuucaagaauuuacgccccugcugcaggagguugucgauaaacuuaagaaaaugacaugcuuucucaccgagccugaagccgaggaagacgcuuucagcauugccaucgcuauguguaagauucuggacaaaggcgugugcaccaucaauuccgagcgcuggaacaucauuaagugugauucugggcugauguauuacacagaccagcgggauggccaggacaccggaaaugauuuuggcgaauauugcaucagccacaacuguaagacagagagauucccgauuaaucccuccaucauuagcgacugcaucugggaguaccauucucgcaaaucccgguacaucagcacgcucaaccuggaaucucuugaggaauuuaagagagccauuuccgagaaacugagccacacccucguggucuaucaauucaagccuacaucuaaucugccccauaugaaaccuguguacaaguauaucaccgcgcaggggguugaaaacuccgauggaauugacagcgccuucaucacagcuuccaugcccgcccugagcggcaccucuauuggguacaaugugaugagcaaggauaacuuuccgcuuuucgacaucaucauuuuuaucaaauccgcugucauuaagacgaccuauaaucacaucuacgauacaggaccuaccauuggcaucaacgugaugcaugacgagcacuguacagggcagugccccauugagaucccucacaaagaaaacuggcugaccuucucucaggagcgcacaagccgguggggcugugaagaguuuggaugccucgccaucaauaccggcugcguuuucggguccugucaagauauuaucagacccgagacgaagguguaucggaaagccauugaagagucuguccugcucacagugugcguuaccuacccuggaaacaccuuuuguacagaaaucaaugcuauugagcccaagaucaccgacgaacuggagcuucaguucaaaacgguggacacaaagacccugccgaaccuccuggcgguccagaaucauaagcuguacagcggccagaucaacgaucuuggguccuuugcccaaggaugcggcaauauucagaaaacaaaccugucugugaucgggaccggcacagcuaaguucgacuauauuugucacggagccagccgcaaagauaucguggucagacggugcuacaauaacaauuaugaguccuguaagcuccugaaagaggaaccuagccucauuuucucugacaaccaugaaaccaucgagguugccaauaucagacaucugcuuggcgaacugcaguucaagcucaugcugggggaucugcgcuacaaguccuucgcugagaaccccgagcuugaaauugaggccaaaugcgugggaugucccagcugcuuuucuuccuauagcuguaauuuccggaucuccucuagcauugacacggugugcgcgaucgauggcccuugcaccauuuuucacaacagacugaucauuuccagcacaaagcaagacuacgggaucaaaaugucuuguaaggaaaaaccgaaccccgucgagaaguucaauaucugcaagcgcguguauuccguucucuuuaccacaauugauaaaaacgacaagaucgaaauuaauaccggagaucagacgagcuucauccaggagaaagacgauagauguaagacauggcugugccgggugcgcgacgagggcauuucugucaucuuugaaccuaucaaggcuuucuuuggcagcuacuucuccauugccuuuuacgugguuaucgggauuaucgcccucuucauuaccaucuauaucuuucugcccaugguguucaaacuuaaggacauucugaaaaagaacgagcugcucuaccugcaggaaaugaaauauaaguga

SEQ ID NO: 14154 - RNA, 4305 nt, Artificial Sequence
  derived and/or modified CDS sequence (opt5) from ANADV(EIV-17769Yak)__KT313739.1__GP
auguuccugauccucgugcugcuuauucccuuuuacaucaccgccacaccugucgcuacgagaugcuuccacggcgggcagcugauugccgagagcaagucccucaccgcgaucucugaauuuugucugaaagacgauguuagcacagugaaguccgagauuaccuaucuuaaaaacgacacaggaaucuucgcucauucuaaggugcugcggaauuggaucauuaaagauuggaagaacugcaauccgguccccaccgccggcgggagcaucaacgugauugaaguuaaugccgaccucucccugucuacaaagaccuacguguguagccgcgauugcacgaucaccgucgacaaagaggaugcucaaauuaucuuucagacagacaaccugaaucacuucgaaguguccggaaccacacucagcucuggcugguuuaagaccaaagccuccguuacgcuggauagaacaugugagcauauuaaggugaccugcgggaaaaagacacuucaguuccacgcuuguuuuaagcaucacaugagcugcauccgguucuuucacaacaccauccugccuggaaccauggccgucucuauuugucagaauaucgagcucauuaucauuacaucccugacgcuuaucaucuucauucugauggugauccucaccaaaacauauauuugcuacgugcugaugccccuguuuaugccugucgcguaucucuacggcugggccuauaaccgcagcuguaagaaaugcucuugcuguggccuggcuuaccaucccuucaccaauugcgggucccacuguguuugcggacuuaaguucgaagccagcgacagaaugcggauccaucgcgaguccggccugugucaaggguacaaaucucucagaguggcucggcugcuuugcaagagcaaaggauccagccugauuaucucuauccuccuguccgugcugauucucagcuuugucacaccuaucgaaggcacccugacgaacuauccggagucuaagaaguacagccuugaggaaauugccgaugugaucgagggguucauugcggaaaaaggaaucaaggaguauauuguucuguacacauccaucuuuggcgcccuccugcuucugaucgcucucauuaucaccgugucucugaaucgcauuaccgaauaucugacaaaccucaaugucaucuacugucacgagugcagcauguaucacuccaaaaagaacauuaaauacgugggcgacuucaccaacaaguguggguuuugcacauguggagagcuggaagaucaggagggccuuaauaugcauaagguuagcaaaaagugcaucuacagauaucagcugacguggucuaaagugaucaugaccauucucgucugccugcugaucgcccagaacacagugcuuauugucgcugccaaugacgacuguugggccaagcaaucccucgaaaucgagugcguggggccccugcagcagguugaugcuugugaagacaaaagcucucgguccuacaacggagaggcgaagaagcuggugggcaccagcaaagucacagagcucgaugccggacaggugaaucugcuugggcaaaccauugaauccgcuaucaucgccauucgcaagcagagaacguaugccaccaugcacuuccuggagucuguuuuucucggccggcauugcgacuacuauaaaguguucgaacacaacagcggcuacucccaggcuaaguggcgccugcuggccaaaacaaaucauuuugauaucuguucuagacacagcacccaccauuucugccgguguauguccgacgggacaaagugcgagaacggaaauagagauuuugcgggcgaaaugaacaccacguaucacagcaagcgcgacuucuuuaaacaugauuucaaucuuuucuguacacuccuggagaacgcuuuuccugggaccacagagucucuguacuaccaacuccuguccaagcggaauaccaccggagccagcaaacuucugggcaagcucauuacaaaauucgggaacaauaaccuguuugucggcaucuggaaguucggacaguuucugcuuucucuccccuaugugaacaauacggaacuguccgcccugcagagcucuaaaauucucgagagcccugaaccccugcuuagauccgcuagcggccgccaggagucucuguccagcgccaccccgggggaggcuucccgggaaugcagaaacgccaagaagaucucuuguaucagcccucgcuucggagugcccauggagaaucucacagcgugcggcgaauccccuaacuacaaaauuuauaagacccccacacggaucuacaaaucuaauaacaagggggagauuuggugcgccggagacguucacuguuuucaagaguucacccccguccugcaggaggugguggauaaacugaagaagaugacgugcuuucuuacagagccugaagcugaggaagacgccuucagcaucgcuauugccauguguaaaauccucgacaagggcgucugcaccauuaauuccgagagauggaacaucaucaaaugugauucugggcugauguauuacaccgaccagcgcgauggccaggacacaggaaaugauuuuggcgaauauugcauuagccacaacuguaagaccgagcgguucccgaucaaucccuccauuaucagcgacugcauuugggaguaccauucuagaaaaucccgcuacaucagcacacugaaccucgaaucucuggaggaauuuaagcgggcgaucuccgagaaacuuagccacacgcuggugguuuaucaauucaagccuaccucuaaucucccccauaugaagccuguguacaaauauauuacagcccagggggucgaaaacuccgauggaaucgacagcgcuuucauuaccgccuccaugcccgcucugagcggcacaucuaucggguacaaugugaugagcaaggauaacuuuccgcuguucgacauuaucaucuuuauuaaauccgccguuaucaagaccacguauaaccacauuuacgauaccggaccuacaaucggcauuaaugugaugcaugacgagcacuguaccgggcagugccccaucgagauuccucacaaggaaaacuggcuuacauucucucaggagagaaccagccgguggggcugugaagaguuuggaugccuggccaucaauacaggcugcgucuucggguccugucaagauaucauucgccccgagaccaaaguguauagaaaggcuaucgaagagucuguucuccugacggugugcgucacauacccuggaaacaccuuuuguaccgaaauuaaugcgaucgagcccaaaauuacagacgaacucgagcugcaguucaagaccguggacacgaaaacacuuccgaaccugcucgccgugcagaaucauaagcuguacagcggccagaucaacgaucugggguccuuugcucaaggaugcggcaauauccagaaaaccaaccuuucugucauugggacaggcaccgccaaguucgacuauaucugucacggagccagccggaaggauauuguugugagacgcugcuacaauaacaauuaugaguccuguaaacugcucaaggaagaaccuagccugaucuuuucugacaaccaugaaacaauugagguggcuaauauccggcaccuccugggcgaacuucaguucaaacugaugcucggggaucugagauacaaguccuucgccgagaaccccgagcuggaaaucgaggcgaaaugcgucggaugucccagcugcuuuucuuccuauagcuguaacuuccgcauuuccucuagcaucgacaccgugugcgcuauugauggcccuugcacgaucuuucauaauagacuuauuaucuccagcaccaagcaagacuacgggauuaagaugucuuguaaagaaaagccgaaccccguugagaaauucaauaucugcaagcggguguauuccguccuguuuacaaccaucgauaaaaacgacaagauugaaaucgauacaggagaccagaccagcuucauucaggagaaggaugaccgcuguaaaacguggcucugcagagugcgggacgagggcaucucuguuauuuuugaaccuaucaaggccuucuuuggcagcuacuucuccaucgccuuuuacguggucauugggaucauugcucuguucaucacaauuuauaucuuucuccccaugguguucaaacugaaggauauccuuaaaaagaaugagcugcuguaccuccaggaaaugaaguauaaauga

SEQ ID NO: 14155 - RNA, 4305 nt, Artificial Sequence
  derived and/or modified CDS sequence (opt5) from ANADV(EIV-18098Yak)__KT313742.1__GP
auguuccugauccucgugcugcuuauucccuuuuacaucaccgccacaccugucacgaccagaugcuuccacggcgggcagcugauugcugagagcaagucccucacagccaucucugaauuuugucugaaagacgauguuagcaccgugaaguccgagauuacauaucuuaaaaacgacaccggaaucuucgcgcauucuaaggugcugcggaauuggaucauuaaagauuggaagaacugcaauccgguccccacagcuggcgggagcaucaacgugauugaaguuaaugccgaccucucccugucuaccaagacguacguguguagccgcgauugcaccaucacagucgacaaagaggaugcccaaauuaucuuucagaccgacaagcugaaccacuucgaaguguccggaacaacccucagcucuggcugguuuaaaacgaaggcuuccguuacacuggauagaaccugugagcauauuaaagugacaugcgggaagaagacccuucaguuccacgccuguuuuaaacaucacaugagcugcauccgguucuuucacaauaccauccugccuggaacaauggcugucucuauuugucagaacaucgagcucauuaucauuacgucccugacccuuaucaucuucauucugauggugauccucacaaagaccuauauuugcuacgugcugaugccccuguuuaugccugucgccuaucucuacggcugggcguauaaucgcagcuguaaaaagugcucuugcuguggccuggccuaccaucccuucacaaacugcgggucccacuguguuugcggacuuaaauucgaagcuagcgacagaaugcggauccaucgcgaguccggccugugucaaggguacaagucucucagaguggcccggcugcuuugcaaaagcaagggauccagccugauuaucucuauccuccuguccgugcugauucucagcuuugucaccccuaucgaaggcacgcugacaaauuauccggagucuaagaaauacagccuugaggaaauugcugaugugaucgagggguucauugccgaaaagggaaucaaagaguauauuguucuguacaccuccaucuuuggcgcgcuccugcuucugaucgcccucauuaucaccgugucucugaaccgcauuacagaauaucugaccaaucucaacgucaucuacugucacgagugcagcauguaucacuccaagaaaaauauuaaguacgugggcgacuucacaaacaaguguggguuuugcacguguggagagcuggaagaucaggagggccuuaacaugcauaaaguuagcaagaaaugcaucuacagauaucagcugaccuggucuaaggugaucaugacaauucucgucugccugcugaucgcucagaauaccgugcuuauugucgccgcuaacgacgacuguugggccaaacaaucccucgaaaucgagugcguggggccccugcagcagguugaugccugugaagacaagagcucucgguccuacaauggagaggcuaagaaacuggugggcacaagcaaggucaccgagcucgaugcgggacaggugaaccugcuugggcaaacgauugaauccgccaucaucgcuauucgcaaacagagaaccuaugccacaaugcacuuccuggagucuguuuuucucggccggcauugcgacuacuauaagguguucgaacacaauagcggcuacucccaggccaaauggcgccugcuggcuaagaccaaccauuuugauaucuguucuagacacagcacacaccauuucugccgguguauguccgacgggaccaagugcgagaauggaaacugggauuuugccggcgaaaugaauacgacauaucacagcaaaagagacuucuuuaagcaugauuucaaccuuuucuguacccuccuggagaaugcguuuccugggacaaccgagucucuguacuaccaacuccuguccaaacgcaacaccacaggagcuagcaaacuucugggcaagcucauuacgaaguucgggaauaacaaucuguuugucggcaucuggaaauucggacaguuucugcuuucucuccccuaugugaacaacaccgaacuguccgcccugcagagcucuaagauucucgagagcccugaaccccugcuucgguccgccagcggcagacaggagucucuguccagcgcuacaccgggggaggccucccgcgaaugccggaaugcuaagaaaaucucuuguaucagcccuagauucggagugcccauggagaaccucaccgccugcggcgaauccccuaauuacaagauuuauaaaacacccgcgcgcaucuacaagucuaacaauaaaggggagauuuggugcgccggagacguucacuguuuucaagaguucacccccguccugcaggaggugguggauaagcugaagaaaaugacgugcuuucuuacagagccugaagcugaggaagacgccuucagcaucgcuauugccauguguaagauccucgacaaaggcgucugcaccauuaacuccgagcgguggaauaucaucaagugugauucugggcugauguauuacaccgaccagagagauggccaggacacaggaaacgauuuuggcgaauauugcauuagccacaauuguaaaaccgagcgcuucccgaucaaccccuccauuaucagcgacugcauuugggaguaccauucucggaaguccagauacaucagcacacugaaucucgaaucucuggaggaauuuaagcgcgcgaucuccgagaaacuuagccacacgcuggugguuuaucaauucaagccuaccucuaaccucccccauaugaaaccuguguacaaguauauuacagcccagggggucgaaaauuccgauggaaucgacagcgcuuucauuaccgccuccaugcccgcucugagcggcacaucuaucggguacaacgugaugagcaaagauaauuuuccgcuguucgacauuaucaucuuuauuaaguccgccguuaucaagaccacguauaaccacauuuacgauaccggaccuacaaucggcauuaacgugaugcaugacgagcacuguaccgggcagugccccaucgagauuccucacaaagaaaauuggcuuacauucucucaggagcggaccagcagauggggcugugaagaguuuggaugccuggccaucaacacaggcugcgucuucggguccugucaagauaucauucggcccgagaccaagguguaucgcaaagcuaucgaagagucuguucuccugacggugugcgucacauacccuggaaauaccuuuuguaccgaaauuaacgcgaucgagcccaagauuacagacgaacucgagcugcaguucaaaaccguggacacgaagacacuuccgaaucugcucgccgugcagaaccauaaacuguacagcggccagaucaaugaucugggguccuuugcucaaggaugcggcaacauccagaagaccaaucuuucugucauugggacaggcaccgccaaguucgacuauaucugucacggagccagcagaaaagauauuguugugcggagaugcuacaacaauaacuaugaguccuguaagcugcucaaagaagaaccuagccugaucuuuucugacaaucaugaaacaauugagguggcuaacauccgccaccuccugggcgaacuucaguucaagcugaugcucggggaucugcgguacaaauccuucgccgagaaucccgagcuggaaaucgaggcgaagugcgucggaugucccagcugcuuuucuuccuauagcuguaacuucagaauuuccucuagcaucgacaccgugugcgcuauugauggcccuugcacgguuuuucauaaccgccuuaucauuuccagcaccaagcaagacuacgggaucaaaaugucuuguaaggaaaaaccgaaucccguggagaaguucaacauuugcaaaagagucuauuccgugcuguuuacaaccaucgauaagaaugacaagaucgaaauuaacacaggagaucagaccagcuucauccaggagaaagacgaucgguguaagacguggcucugccgcguuagagacgagggcauuucugugaucuuugaaccuauuaaagccuucuuuggcagcuacuucuccaucgccuuuuacgucgugaucgggauuaucgcucuguucauuacaaucuauauuuuucuccccaugguuuucaagcugaaagacauccuuaagaagaaugagcugcuguaccuccaggaaaugaaauauaaguga

SEQ ID NO: 14156 - RNA, 4305 nt, Artificial Sequence
  derived and/or modified CDS sequence (opt5) from ANADV(EIV-18136Yak)__KT313745.1__GP
auguuccugauccucgugcugcuuauucccuuuuacaucaccgccacaccugucacgaccagaugcuuccacggcgggcagcugauugcugagagcaagucccucacagccaucucugaauuuugucugaaagacgauguuagcaccgugaaguccgagauuacauaucuuaaaaacgacaccggaaucuucgcgcauucuaaggugcugcggaauuggaucauuaaagauuggaagaacugcaauccgguccccacagcuggcgggagcaucaacgugauugaaguuaaugccgaccucucccugucuaccaagacguacguguguagccgcgauugcaccaucacagucgacaaagaggaugcccaaauuaucuuucagaccgacaagcugaaccacuucgaaguguccggaacaacccucagcucuggcugguuuaaaacgaaggcuuccguuacacuggauagaaccugugagcauauuaaagugacaugcgggaagaagacccuucaguuccacgccuguuuuaaacaucacaugagcugcauccgguucuuucacaauaccauccugccuggaacaauggcugucucuauuugucagaacaucgagcucauuaucauuacgucccugacccuuaucaucuucauucugauggugauccucacaaagaccuauauuugcuacgugcugaugccccuguuuaugccugucgccuaucucuacggcugggcguauaaucgcagcuguaaaaagugcucuugcuguggccuggccuaccaucccuucacaaacugcgggucccacuguguuugcggacuuaaauucgaagcuagcgacagaaugcggauccaucgcgaguccggccugugucaaggguacaagucucucagaguggcccggcugcuuugcaaaagcaagggauccagccugauuaucucuauccuccuguccgugcugauucucagcuuugucaccccuaucgaaggcacgcugacaaauuauccggagucuaagaaauacagccuugaggaaauugcugaugugaucgagggguucauugccgaaaagggaaucaaagaguauauuguucuguacaccuccaucuuuggcgcgcuccugcuucugaucgcccucauuaucaccgugucucugaaccgcauuacagaauaucugaccaaucucaacgucaucuacugucacgagugcagcauguaucacuccaagaaaaauauuaaguacaucggcgacuucacaaacaaguguggguuuugcacguguggagagcuggaagaucaggagggccuuaacaugcauaaagugagcaagaaaugcaucuacagauaucagcugaccuggucuaagguuauuaugacaauccucgugugccugcugauugcucagaauaccguccuuaucguggccgcuaacgacgacuguugggccaaacaaucccucgaaauugagugcgucgggccccugcaacagguggaugccugugaagacaagagcucucgguccuacaauggagaggcuaagaaacugguuggcacaagcaaggugaccgagcucgaugcggggcaggucaaccugcuuggacagacgaucgaauccgccaucauugcuauccgcaaacagagaaccuaugccacaaugcacuuccuggagucuguguuucucggccggcauugcgacuacuauaagguuuucgaacacaauagcggcuacucccaggccaaauggcgccugcuggcuaagaccaaccauuuugauauuuguucuagacacagcacacaccauuucugccgguguauguccgacgggaccaagugcgagaauggaaacugggauuuugccggcgaaaugaauacgacauaucacagcaaaagagacuucuuuaagcaugauuucaaacuuuucuguacccuccuggagaacgcguuuccugggacaaccgagucucuguacuaccaacuccuguccaagcgcaauaccacaggagcuagcaaacuucugggcaagcucaucacgaaauucgggaacaauaaccuguuugugggcauuuggaaguucggacaguuucugcuuucucuccccuaugucaauaacaccgaacuguccgcccugcagagcucuaagauccucgagagcccugaaccccugcuucgguccgccagcggcagacaggagucucuguccagcgcuacaccgggggaggccuccaaagaaugccgcaacgcuaagaaaaucucuuguauuagcccucgguucggagugcccauggagaaucucaccgccugcggcgaauccccuaacuacaagaucuauaaaacacccaccagaauuuacaagucuaauaacaagggggagaucuggugcgugggagacguucacuguuuucaagaguucacgcccguccugcaggaggugguggauaaacugaagaaaaugacaugcuuucuuaccgagccugaagcggaggaagacgccuucagcauugcuaucgccauguguaagauucucgacaaaggcgucugcaccaucaauuccgagcgcuggaacaucaugaagugugauucugggcugauguauuacacagaccagcgggauggccaggacaccggaaaugauuuuggcgaauauugcauuagccacaacuguaagacagagagauucccgaucaaucccuccauuaucagcgacugcauuugggaguaccauucucgcaaaucccgguacaucgggacgcugaaccucgaaagccuggaggaauuuaagagagcuaucucugagaaacuuucccacacccuggugguuuaucaauucaagccuacaagcaaucucccccauaugaaaccuguguacaaguauauuaccgcccagggagucgaaaacucugauggcaucgacuccgcguucauuacagccagcaugcccgcucuguccgggaccagcaucggauacaaugugaugucuaaggauaacuuuccgcuguucgacauuaucaucuuuauuaaaagcgccguuaucaagacgaccuauaaucacauuuacgauacaggcccuaccaucgggauuaacgugaugcaugacgagcacuguacaggccagugccccaucgagauuccucacaaagaaaacuggcuuaccuucucccaggagcgcacaucucgguggggaugugaagaguuuggcugccuggcuaucaauaccgggugcgucuucggaagcugucaagauaucauuagacccgagacgaagguguaucggaaagccaucgaagaguccguucuccugacagugugcgucaccuacccuggcaacaccuuuuguacagaaauuaaugccaucgagcccaagauuaccgacgaacucgagcugcaguucaaaacgguggacacaaagacccuuccgaaccugcucgcugugcagaaucauaagcuguacucugggcagaucaacgaucugggcagcuuugcgcaaggaugcgggaauauccagaaaacaaaccuuuccgucauuggcaccggaacagccaaguucgacuauaucugucacggcgcuucucgcaaagauauuguugugagacggugcuacaauaacaauuaugagagcuguaagcugcucaaagaagaaccuucccugaucuuuagcgacaaccaugaaaccauugagguggccaauaucagacaccuccugggggaacuucaguucaagcugaugcucggagaucugcgcuacaagucuuucgccgagaaccccgagcuggaaaucgaggcucggugcgucggcugucccuccugcuuuagcucuuauuccuguaauuucagaauuagcuccucuaucgacacggugugcgccauugaugggccuugcaccaucuuucauaaccgccuuauuaucagcuccacaaaacaagacuacggaauuaagaugagcuguaaagaaaagccgaaccccguugagaaauucaauaucugcaagagaguguauucuguccuguuuaccacaaucgauaagaacgacaaaauugaaaucaauaccggcgaucagacguccuucauucaggagaaggacgaucgguguaaaacauggcucugccgcgugagagacgagggcaucagcguuauuuuugaaccuaucaaggcguucuuugggucuuacuucagcaucgcuuuuuacguggucauuggaaucauugcccuguucaucauuaucuauaucuuucuccccaugguguucaaacugaaggacauucuuaagaaaaacgagcugcuguaccuccaggaaaugaaguauaaauga

SEQ ID NO: 14157 - RNA, 4305 nt, Artificial Sequence
  derived and/or modified CDS sequence (opt5) from ANADV(EIV-18146Yak)__KT313748.1__GP
auguuccugauccucgugcugcuuauucccuuuuacaucaccgccacaccugucacgaccagaugcuuccacggcgggcagcugauugcugagagcaagucccucacagccaucucugaauuuugucugaaagacgauguuagcaccgugaaguccgagauuaucuaucuuaaaaacgacacaggaaucuucgcgcauucuaaggugcugcggaauuggauuaucaaagauuggaagaacugcaauccgguccccaccgcuggcgggagcauuaacgugaucgaaguuaaugccgaccucucccugucuacaaagaccuacguguguagccgcgauugcacgauuaccgucgacaaagaggaugcccaaaucauuuuucagacagacaagcugaaccacuucgaaguguccggaaccacacucagcucuggcugguuuaaaaccaaggcuuccguuacgcuggauagaacaugugagcauaucaaagugaccugcgggaagaagacacuucagcugcacgccuguuucaaacaucacaugagcugcauccgguuuuuccacaauaccauucucccuggaaccauggcugucucuaucugucagaacauugagcugaucauuaucacaucccuuacgcugaucauuuuuauccucauggugauucugaccaagacauauaucugcuacgugcugaugccccucuucaugccugucgccuaucuguacggcugggcguauaaucgcagcuguaaaaagugcucuugcuguggccuugccuaccaucccuuuaccaacugcgggucccacuguguuugcggacugaaauucgaagcuagcgacagaaugcggauucaucgcgaguccggccucugucaaggguacaagucucugagaguggcccggcuucugugcaaaagcaagggauccagccucaucgugucuauccugcuguccguccucauucugagcuucgugacaccuaucgaaggcacccuuacgaauuauccggagucuaagaaauacagccuggaggaaauugcugauguuaucgagggguuuauugccgaaaagggaaucaaagaguauauugugcucuacacauccaucuucggcgcgcugcuucugcucaucgcccugauuaucaccgucucucugaaccgcauuaccgaauaucucacaaaucugaacgugaucuacugucacgagugcagcauguaucacuccaagaaaaauauuaaguacaucggcgacuuuaccaacaaguguggguucugcacauguggagagcuugaagaucaggagggccugaacaugcauaaaguuagcaagaaaugcaucuacagauaucagcucacguggucuaaggugauuaugaccauccuggucugccugcuuauugcucagaauacagugcucaucgucgccgcuaacgacgacuguugggccaaacaaucccuggaaauugagugcguggggccccugcagcagguugaugccugugaagacaagagcucucgguccuacaaugaggaggcuaagaaacucgugggaaccagcaaggucacagaacuggaugcgggccaggugaaccuucuggggcaaaccaucgaguccgccaucauugcuauccgcaaacagagaacguaugccaccaugcacuuucucgaaucuguuuuccugggacggcauugcgacuacuauaagguguuugagcacaauagcggcuacucccaggccaaauggcgccugcuugcuaagacaaaccauuucgauauuuguucuagacacagcacccaccauuuuugccgguguauguccgacggcacaaagugcgaaaaugggaacugggauuucgccggagagaugaauaccacguaucacagcaaaagagacuuuuucaagcaugauuuuaaccucuucuguacacugcuggagaaugcguucccuggcaccacagaaucucucuacuaccaacugcuuuccaaacgcaacaccaccggggcuagcaagcugcucggaaaacugaucacaaaguuuggcaauaacaaucuguucgucgggauuuggaaauuuggccaguuccuucucucucugcccuaugugaacaacacggagcuguccgcccuccagagcucuaagauccuggaaagcccugagccccuucugcgguccgccagcggaagacaggagucucucuccagcgcuaccccgggcgaagccuccaaggagugccgcaaugcuaaaaagaucucuuguauuagcccucgguuuggggugcccauggaaaaccugacagccugcggagaguccccuaauuacaaaaucuauaagacccccacaagaauuuacaaaucuaacaauaagggcgaaaucuggugcgcgggggacguucacuguuuccaagaguuuacccccguccugcaggaggugguggauaagcucaaaaagaugacgugcuuccucacagaaccugaggccgaagaggacgcuuuuagcauugccaucgcuauguguaaaauucuggacaagggagucugcaccaucaacuccgaacgcuggaauaucauuaaaugugauucuggccugauguauuacaccgaccagcgggaugggcaggacacaggcaacgauuucggagaguauugcaucagccacaauuguaagaccgagagauuuccgauuaaccccuccaucauuagcgacugcaucugggaauaccauucucgcaagucccgguacaucagcacacucaaucuggagucucuugaagaguucaaaagagccauuuccgaaaagcugagccacacgcucaucguguaucaauuuaaaccuaccucuaaccugccccauaugaagccuguuuacaaauauauuacagcgcagggcguggaaaauuccgaugggaucgacagcgccuucauuaccgcuuccaugcccgcccugagcggaacaucuaucggcuacaacgucaugagcaaggauaauuucccgcuuuuugacaucauuaucuucauuaaguccgcugugaucaaaaccacguauaaccacauuuacgauaccgggccuacaaucggaauuaacguuaugcaugacgagcacuguaccggccagugccccaucgagaucccucacaaggagaauuggcugacauuuucucaggaacgcaccagccggugggggugugaggaguucggcugccucgccauuaacacaggaugcguguuuggcuccugucaagauaucauuagacccgaaaccaaagucuaucggaaggccaucgaggaaucugugcugcucacgguuugcgugacauacccugggaauaccuucuguaccgagauuaacgcuaucgaacccaaaaucacagacgagcuggagcuucaguuuaagaccgucgacacgaaaacacugccgaaucuccuggcggugcagaaccauaagcuguacagcggacagauuaaugaucuuggcuccuucgcccaagggugcggaaacauccagaagaccaaucugucugugauuggcacagggaccgcuaaauuugacuauaucugucacggcgccagccgcaaggauauugucguuagacggugcuacaacaauaacuaugaauccuguaaacuccugaaggaggaaccuagccucaucuucucugacaaucaugagacaaucgaaguggccaacauuagacaucugcuuggagagcugcaguuuaaacucaugcugggcgaucugcgcuacaaguccuucgcugagaaucccgaacuugagaucgaagcccggugcguggggugucccagcugcuucucuuccuauagcuguaacuuuagaauuuccucuagcaucgacaccgucugcgcgauugauggaccuugcacgaucuuccacaaccgccugauuaucuccagcaccaagcaagacuacggcaucaaaaugucuuguaaggagaaaccgaaucccguggaaaaguuuaacauuugcaaaagaguuuauuccgugcuuuucacaaccaucgauaagaaugacaagauugagaucaacacaggggaucagaccagcuuuauucaggagaaagacgaucgguguaagacguggcugugccgcgucagagacgaaggaaucucugugaucuucgagccuauuaaagccuuuuucggcagcuacuuuuccaucgcuuucuacguugugauuggcaucauugcccucuuuaucaucauuuauaucuuccugcccauggucuuuaaacuuaaggacauucugaagaagaaugaacugcucuaccugcaggagaugaaauauaaguga

SEQ ID NO: 14158 - RNA, 4305 nt, Artificial Sequence
  derived and/or modified CDS sequence (opt5) from ANADV(EIV-18353Yak)__KT313751.1__GP
auguuccugauccucgugcugcuuauucccuuuuacaucaccgccacaccugucacgaccagaugcuuccacggcgggcagcugauugcugagagcaagucccucacagccaucucugaauuuugucugaaagacgauguuagcaccgugaaguccgagauuaucuaucuuaaaaacgacacaggaaucuucgcgcauucuaaggugcugcggaauuggauuaucaaagauuggaagaacugcaauccgguccccaccgcuggcgggagcauuaacgugaucgaaguuaaugccgaccucucccugucuacaaagaccuacguguguagccgcgauugcacgauuaccgucgacaaagaggaugcccaaaucauuuuucagacagacaagcugaaccacuucgaaguguccggaaccacacucagcucuggcugguuuaaaaccaaggcuuccguuacgcuggauagaacaugugagcauaucaaagugaccugcgggaagaagacacuucaguuccacgccuguuuuaaacaucacaugagcugcauccgguucuuucacaauaccauucugccuggaaccauggcugucucuaucugucagaacauugagcucaucauuaucacaucccugacgcuuaucauuuucauccugauggugauucucaccaagacauauaucugcuacgugcugaugccccuguuuaugccugucgccuaucucuacggcugggcguauaaucgcagcuguaaaaagugcucuugcuguggccuggccuaccaucccuucaccaacugcgggucccacuguguuugcggacuuaaauucgaagcuagcgacagaaugcggauucaucgcgaguccggccugugucaaggguacaagucucucagaguggcccggcugcuuugcaaaagcaagggauccagccugaucaucucuauucuccuguccgugcugauccucagcuuugucacaccuauugaaggcacccugacgaauuauccggagucuaagaaauacagccuugaggaaaucgcugaugugauugagggguucaucgccgaaaagggaauuaaagaguauaucguucuguacacauccaucuuuggcgcgcuccugcuucugauugcccucaucauuaccgugucucugaaccgcaucaccgaauaucugacaaaucucaacgucauuuacugucacgagugcagcauguaucacuccaagaaaaauaucaaguacaucggcgacuucaccaacaaguguggguuuugcacauguggagagcuggaagaucaggagggccuuaacaugcauaaagugagcaagaaaugcauuuacagauaucagcugacguggucuaagguuaucaugaccauucucgugugccugcugaucgcucagaauacaguccuuauuguggccgcuaacgacgacuguugggccaaacaaucccucgaaaucgagugcgucgggccccugcaacagguggaugccugugaagacaagagcucucgguccuacaaugaggaggcuaagaaacugguuggaaccagcaaggugacagaacucgaugcgggccaggucaaccugcuugggcagaccaucgaguccgccauuaucgcuauucgcaaacagagaacguaugccaccaugcacuuccuggaaucuguguuucucggacggcauugcgacuacuauaagguuuucgagcacaauagcggcuacucccaggccaaauggcgccugcuggcuaagacaaaccauuuugauaucuguucuagacacagcacccaccauuucugccgguguauguccgacggcacaaagugcgaaaaugggaacugggauuuugccggagagaugaauaccacguaucacagcaaaagagacuucuuuaagcaugauuucaaccuuuucuguacacuccuggagaaugcguuuccuggcaccacagaaucucuguacuaccaacuccuguccaaacgcaacaccaccggggcuagcaaacuucugggaaaacucauuacaaaguucggcaauaacaaucuguuuguggggaucuggaaauucggccaguuucugcuuucucuccccuaugucaacaacacggagcuguccgcccugcagagcucuaagauccucgaaagcccugagccccugcuucgguccgccagcggaagacaggagucucuguccagcgcuaccccgggcgaagccuccaaggagugccgcaaugcuaaaaagauuucuuguaucagcccucgguucggggugcccauggaaaaccucacagccugcggagaguccccuaauuacaaaauuuauaagacccccacaagaaucuacaaaucuaacaauaagggcgaaauuuggugcgcgggggacgugcacuguuuucaagaguucacccccguucugcaggaggucguggauaagcugaaaaagaugacgugcuuucuuacagaaccugaggccgaagaggacgcuuucagcaucgccauugcuauguguaaaauccucgacaagggagugugcaccaucaacuccgaacgcuggaauauuaucaaaugugauucuggccugauguauuacaccgaccagcgggaugggcaggacacaggcaacgauuuuggagaguauugcauuagccacaauuguaagaccgagagauucccgaucaaccccuccauuaucagcgacugcaucugggaauaccauucucgcaagucccgguacauuagcacacugaaucucgagucucuggaagaguuuaaaagagccaucuccgaaaaacuuagccacacgcugauugucuaucaauucaagccuaccucuaaccucccccauaugaagccuguguacaaauauaucacagcgcagggcguugaaaauuccgaugggauugacagcgccuucaucaccgcuuccaugcccgcccugagcggaacaucuaucggcuacaacgugaugagcaaggauaauuuuccgcuguucgacauuaucauuuuuaucaaguccgcugucauuaaaaccacguauaaccacaucuacgauaccgggccuacaauuggaaucaacgugaugcaugacgagcacuguaccggccagugccccaucgagauuccucacaaggagaauuggcuuacauucucucaggaacgcaccagccggugggggugugaggaguuuggcugccuggccaucaacacaggaugcguuuucggcuccugucaagauauuaucagacccgaaaccaaaguguaucggaaggccauugaggaaucuguccuccugacggugugcguuacauacccugggaauaccuuuuguaccgagaucaacgcuaucgaacccaaaauuacagacgagcucgagcugcaguucaagaccguggacacgaaaacacuuccgaaucugcucgcgguccagaaccauaagcuguacagcggacagaucaaugaucugggcuccuuugcccaagggugcggaaacauucagaagaccaaucuuucugugaucggcacagggaccgcuaaauucgacuauauuugucacggcgccagccgcaaggauaucguggucagacggugcuacaacaauaacuaugaauccuguaaacugcucaaggaggaaccuagccugaucuuuucugacaaucaugagacaauugaaguugccaacaucagacaccuccugggagagcuucaguucaaacugaugcucggcgaucugcgcuacaaguccuucgcugagaaucccgaacuggagauugaagcccggugcguggggugucccagcugcuuuucuuccuauagcuguaacuucagaaucuccucuagcauugacaccgugugcgcgaucgauggaccuugcacgauuuuucauaaccgccuuaucaucuccccgaccaagcaagacuacggcauuaaaaugagcuguaaggagaaacccaauccugucgaaaaguucaacaucugcaaaagaguguauucuguucuguuuacaaccauugauaagaaugacaagaucgagauuaacacaggggaucagaccuccuucauccaggagaaagacgaucgguguaagacguggcucugccgcgugagagacgaaggaaucagcgucauuuuugagcccaucaaggcuuucuuuggcucuuacuucagcauugccuuuuacgugguuaucggcauuaucgcccuguucaucauuaucuauauuuuucucccuaugguguucaagcugaaagacauccuuaagaagaaugaacugcuguaccuccaggagaugaaauauaaguga

SEQ ID NO: 14159 - RNA, 4305 nt, Artificial Sequence
  derived and/or modified CDS sequence (opt5) from ANADV(EIV-18560Yak)__KT313754.1__GP
auguuccugauccucgugcugcuuauucccuuuuacaucaccgccacaccugucacgaccagaugcuuccacggcgggcagcugauugcugagagcaagucccucacagccaucucugaauuuugucugaaagacgauguuagcaccgugaaguccgagauuaucuaucuuaaaaacgacacaggaaucuucgcgcauucuaaggugcugcggaauuggauuaucaaagauuggaagaacugcaauccgguccccaccgcuggcgggagcauuaacgugaucgaaguuaaugccgaccucucccugucuacaaagaccuacguguguagccgcgauugcacgauuaccgucgacaaagaggaugcccaaaucauuuuucagacagacaagcugaaccacuucgaaguguccggaaccacacucagcucuggcugguuuaaaaccaaggcuuccguuacgcuggauagaacaugugagcauaucaaagugaccugcgggaagaagacacuucaguuccacgccuguuuuaaacaucacaugagcugcauccgguucuuucacaauaccauucugccuggaaccauggcugucucuaucugucagaacauugagcucaucauuaucacaucccugacgcuuaucauuuucauccugauggugauucucaccaagacauauaucugcuacgugcugaugccccuguuuaugccugucgccuaucucuacggcugggcguauaaucgcagcuguaaaaagugcucuugcuguggccuggccuaccaucccuucaccaacugcgggucccacuguguuugcggacuuaaauucgaagcuagcgacagaaugcggauucaucgcgaguccggccugugucaaggguacaagucucucagaguggcccggcugcuuugcaaaagcaagggauccagccugaucaucucuauucuccuguccgugcugauccucagcuuugucacaccuauugaaggcacccugacgaauuauccggagucuaagaaauacagccuugaggaaaucgcugaugugauugagggguucaucgccgaaaagggaauuaaagaguauaucguucuguacacauccaucuuuggcgcgcuccugcuucugauugcccucaucauuaccgugucucugaaccgcaucaccgaauaucugacaaaucucaacgucauuuacugucacgagugcagcauguaucacuccaagaaaaauaucaaguacaucggcgacuucaccaacaaguguggguuuugcacauguggagagcuggaagaucaggagggccuuaacaugcauaaagugagcaagaaaugcauuuacagauaucagcugacguggucuaagguuaucaugaccauucucgugugccugcugaucgcucagaauacaguccuuauuguggccgcuaacgacgacuguugggccaaacaaucccucgaaaucgagugcgucgggccccugcaacagguggaugccugugaagacaagagcucucgguccuacaaugaggaggcuaagaaacugguuggaaccagcaaggugacagaacucgaugcgggccaggucaaccugcuugggcagaccaucgaguccgccauuaucgcuauucgcaaacagagaacguaugccaccaugcacuuccuggaaucuguguuucucggacggcauugcgacuacuauaagguuuucgagcacaauagcggcuacucccaggccaaauggcgccugcuggcuaagacaaaccauuuugauaucuguucuagacacagcacccaccauuucugccgguguauguccgacggcacaaagugcgaaaaugggaacagagauuuugccggagagaugaauaccacguaucacagcaaacgcgacuucuuuaagcaugauuucaaccuuuucuguacacuccuggagaaugcguuuccuggcaccacagaaucucuguacuaccaacuccuguccaaacggaacaccaccggggcuagcaaacuucugggaaaacucauuacaaaguucggcaauaacaaucuguuuguggggaucuggaaauucggccaguuucugcuuucucuccccuaugucaacaacacggagcuguccgcccugcagagcucuaagauccucgaaagcccugagccccugcuuagauccgccagcggacgccaggagucucuguccagcgcuaccccgggcgaagccuccaaggagugccggaaugcuaaaaagauuucuuguaucagcccuagauucggggugcccauggaaaaccucacagccugcggagaguccccuaauuacaaaauuuauaagacccccacacgcaucuacaaaucuaacaauaagggcgaaauuuggugcgcgggggacgugcacuguuuucaagaguucacccccguucugcaggaggucguggauaagcugaaaaagaugacgugcuuucuuacagaaccugaggccgaagaggacgcuuucagcaucgccauugcuauguguaaaauccucgacaagggagugugcaccaucaacuccgaacgguggaauauuaucaaaugugauucuggccugauguauuacaccgaccagagagaugggcaggacacaggcaacgauuuuggagaguauugcauuagccacaauuguaagaccgagcgcuucccgaucaaccccuccauuaucagcgacugcaucugggaauaccauucucggaaguccagauacauuagcacacugaaucucgagucucuggaagaguuuaaacgcgccaucuccgaaaaacuuagccacacgcugauugucuaucaauucaagccuaccucuaaccucccccauaugaagccuguguacaaauauaucacagcgcagggcguugaaaauuccgaugggauugacagcgccuucaucaccgcuuccaugcccgcccugagcggaacaucuaucggcuacaacgugaugagcaaggauaauuuuccgcuguucgacauuaucauuuuuaucaaguccgcugucauuaaaaccacguauaaccacaucuacgauaccgggccuacaauuggaaucaacgugaugcaugacgagcacuguaccggccagugccccaucgagauuccucacaaggagaauuggcuuacauucucucaggaacggaccagcagaugggggugugaggaguuuggcugccuggccaucaacacaggaugcguuuucggcuccugucaagauauuauccggcccgaaaccaaaguguaucgcaaggccauugaggaaucuguccuccugacggugugcguuacauacccugggaauaccuuuuguaccgagaucaacgcuaucgaacccaaaauuacagacgagcucgagcugcaguucaagaccguggacacgaaaacacuuccgaaucugcucgcgguccagaaccauaagcuguacagcggacagaucaaugaucugggcuccuuugcccaagggugcggaaacauucagaagaccaaucuuucugugaucggcacagggaccgcuaaauucgacuauauuugucacggcgccagcagaaaggauaucgugguccggagaugcuacaacaauaacuaugaauccuguaaacugcucaaggaggaaccuagccugaucuuuucugacaaucaugagacaauugaaguugccaacauccgccaccuccugggagagcuucaguucaaacugaugcucggcgaucugcgguacaaguccuucgcugagaaucccgaacuggagauugaagccagaugcguggggugucccagcugcuuuucuuccuauagcuguaacuuccgcaucuccucuagcauugacaccgugugcgcgaucgauggaccuugcacgauuuuucauaacagacuuaucaucuccccgaccaagcaagacuacggcauuaaaaugagcuguaaggagaaacccaauccugucgaaaaguucaacaucugcaaacggguguauucuguucuguuuacaaccauugauaagaaugacaagaucgagauuaacacaggggaucagaccuccuucauccaggagaaagacgaucgcuguaagacguggcucugcagagugcgggacgaaggaaucagcgucauuuuugagcccaucaaggcuuucuuuggcucuuacuucagcauugccuuuuacgugguuaucggcauuaucgcccuguucaucauuaucuauauuuuucucccuaugguguucaagcugaaagacauccuuaagaagaaugaacugcuguaccuccaggagaugaaauauaaguga

SEQ ID NO: 14160 - RNA, 4305 nt, Artificial Sequence
  derived and/or modified CDS sequence (opt5) from ANADV(EIV-18715Yak)__KT313757.1__GP
auguuccugauccucgugcugcuuauucccuuuuacaucaccgccacaccugucacgaccagaugcuuccacggcgggcagcugauugcugagagcaagucccucacagccaucucugaauuuugucugaaagacgauguuagcaccgugaaguccgagauuacauaucuuaaaaacgacaccggaaucuucgcgcauucuaaggugcugcggaauuggaucauuaaagauuggaagaacugcaauccgguccccacagcuggcgggagcaucaacgugauugaaguuaaugccgaccucucccugucuaccaagacguacguguguagccgcgauugcaccaucacagucgacaaagaggaugcccaaauuaucuuucagaccgacaagcugaaccacuucgaaguguccggaacaacccucagcucuggcugguuuaaaacgaaggcuuccguuacacuggauagaaccugugagcauauuaaagugacaugcgggaagaagacccuucaguuccacgccuguuuuaaacaucacaugagcugcauccgguucuuucacaauaccauccugccuggaacaauggcugucucuauuugucagaacaucgagcucauuaucauuacgucccugacccuuaucaucuucauucugauggugauccucacaaagaccuauauuugcuacgugcugaugccccuguuuaugccugucgccuaucucuacggcugggcguauaaucgcagcuguaaaaagugccccugcuguggccuggccuaccauccuuucacaaacugcgggucucacuguguuugcggacuuaaauucgaggcuuccgacagaaugcggauccaucgcgagagcggccugugucaaggguacaagucccucagaguggcccggcugcuuugcaaaucuaagggaagcucccugauuaucagcauccuccugucugugcugauucucuccuuugucaccccgaucgaaggcacgcugacaaauuaucccgagagcaagaaauacucucuugaggaaauugcugaugugaucgagggguucauugccgaaaagggaaucaaagaguauauuguucuguacaccagcaucuuuggcgcgcuccugcuucugaucgcccucauuaucaccgugucccugaaccgcauuacagaauaucugaccaaucucaacgucaucuacugucacgagugcucuauguaucacagcaagaaaaauauuaaguacaucggcgacuucacaaacaaguguggguuuugcacguguggagagcuggaagaucaggagggccuuaacaugcauaaaguguccaagaaaugcaucuacagauaucagcugaccuggagcaagguuauuaugacaauccucauuugccugcugaucgcucagaauaccgugcuuauugucgccgcuaacgacgacuguugggccaaacaaucucucgaaaucgagugcguggggccucugcagcaggucgaugccugugaagacaaguccagccggucuuacaauggagaggcuaagaaacuggugggcacaucccgcguuaccgagcucgaugcgggacaggugaaccugcuugggcaaacgaucgaaagcgccauuaucgcuauuagaaagcagcggaccuaugccacaaugcacuuccuggaguccgucuuucucggccgccauugcgacuacuauaaaguguucgaacacaauucuggcuacagccaggccaaguggagacugcuggcuaaaaccaaccauuuugauaucuguucccggcacucuacacaccauuucugcagauguaugagcgacgggaccaagugcgagaauggaaacugggauuuugccggcgaaaugaauacgacauaucacuccaagcgcgacuucuuuaaacaugauuucagccuuuucuguacccuccuggagaacgcguuucccgggacaaccgagucucuguacuaccaacuccuguccaagcggaauaccacaggagcuagcaaacuucugggcaagcucauuacgaaauucgggaacaauaaccuguuuguuggcaucuggaaguucggacaguuucugcuuucucucccuuaugugaauaacaccgaacuguccgcccugcagagcucuaaaauccucgagagccccgaaccgcugcuuagauccgccagcggccgccaggagucucuguccagcgcuacaccuggggaggccuccaaggaaugccggaacgcuaagaaaauuucuuguaucagccccagauucggagucccuauggagaaucucaccgccugcggcgaaucccccaacuacaagauuuauaaaacacccacccgcaucuacaagucuaauaacaaaggggagauuuggugcgcgggagacgugcacuguuuucaagaauuuacgccugugcugcaggagguugucgauaagcugaagaaaaugacaugcuuucuuaccgagccggaagccgaggaagacgcuuucagcaucgccauugcuauguguaagauccucgacaaaggcgugugcaccaucaauuccgagcgguggaacauuaucaagugugauucugggcugauguauuacacagaccagagagauggccaggacaccggaaaugauuuuggcgaauauugcauuagccacaacuguaaaacagagcgcuuccccaucaauccuuccauuaucagcgacugcgugugggaguaccauucucggaaguccagauacaucagcacgcugaaccucgaaucucuggaggaauuuaagcgcgccauuuccgagaaacuuagccacacccuggucguguaucaauucaagcccacaucuaaucucccucauaugaaacccguuuacaaguauaucaccgcgcaggggguggaaaacuccgauggaauugacagcgccuucaucacagcuuccaugccggcccugagcggcaccucuauuggguacaaugucaugagcaaagauaacuuuccucuguucgacaucaucauuuuuaucaaguccgcugugauuaagacgaccuauaaucacaucuacgauacaggacccaccauuggcaucaacguuaugcaugacgagcacuguacagggcagugcccuauugagaucccccacaaagaaaacuggcuuaccuucucucaggagcggacaagcagauggggcugugaagaguuuggaugccuggccaucaauaccggcugcguguucggguccugucaagauauuauccggccugagacgaaggucuaucgcaaagccauugaagagucugugcuccugacaguuugcgugaccuaccccggaaacaccuuuuguacagaaaucaaugcuauugagccgaagaucaccgacgaacucgagcugcaguucaaaacggucgacacaaagacccuuccuaaccugcucgcggugcagaaucauaaacuguacagcggccagaucaacgaucugggguccuuugcccaaggaugcggcaauauucagaagacaaaccuuucugugaucgggaccggcacagcuaaguucgacuauauuugucacggagccagcagaaaagauaucgucguucggagaugcuacaauaacaauuaugaguccuguaagcugcucaaagaagaacccagccugauuuucucugacaaccaugaaaccaucgagguggccaauauccgccaccuccugggcgaacuucaguucaagcugaugcucggggaucugcgguacaaauccuucgcugagaaccccgagcuggaaauugaggccagaugcgugggauguccuagcugcuuuucuuccuauagcuguaauuuccgcaucuccucuagcauugacacggucugcgcgaucgauggcccgugcaccauuuuucauuccagacuuaucauuagcucuacaaagcaagacuacgggaucaagauguccuguaaagaaaagcccaacccuguggagaaauucaacaucugcaagcggguuuauagcgugcuguuuaccacaauugauaaaaaugacaagaucgaaauuaacaccggagaucagacgucuuucauccaggagaaggacgaucgcuguaaaacauggcucugcagaguccgggacgagggcauuagcgugaucuuugaacccaucaaggcuuucuuuggcuccuacuucucuauugccuuuuacguugugaucgggauuaucgcccuguucauuaucaucuauauuuuucucccuauggucuucaaacugaaggacauccuuaaaaagaaugagcugcuguaccuccaggaaaugaaguauaaauga

SEQ ID NO: 14161 - RNA, 4305 nt, Artificial Sequence
  derived and/or modified CDS sequence (opt5) from ANADV(EIV-23263Tyum)__KT313760.1__GP
auguuccugauccucgugcugcuuauucccuuuuacaucaccgccacaccugucacgaccagaugcuuccacggcgggcagcugauugcugagagcaagucccucacagccaucucugaauuuugucugaaagacgauguuagcaccgugaaguccgagauuacauaucuuaaaaacgacaccggaaucuucgcgcauucuaaggugcugcggaauuggaucauuaaagauuggaagaacugcaauccgguccccacagcuggcgggagcaucaacgugauugaaguuaaugccgaccucucccugucuaccaagacguacguguguagccgcgauugcaccaucacagucgacaaagaggaugcccaaauuaucuuucagaccgacaagcugaaccacuucgaaguguccggaacaacccucagcucuggcugguuuaaaacgaaggcuuccguuacacuggauagaaccugugagcauauuaaagugacaugcgggaagaagacccuucaguuccacgccuguuuuaaacaucacaugagcugcauccgguucuuucacaauaccauccugccuggaacaauggcugucucuauuugucagaacaucgagcucauuaucauuacgucccugacccuuaucaucuucauucugauggugauccucacaaagaccuauauuugcuacgugcugaugccccuguuuaugccugucgccuaucucuacggcugggcguauaaucgcagcuguaaaaagugcucuugcuguggccuggccuaccaucccuucacaaacugcgggucccacuguguuugcggacuuaaauucgaagcuagcgacagaaugcggauccaucgcgaguccggccugugucaaggguacaagucucucagaguggcccggcugcuuugcaaaagcaagggauccagccugauuaucucuauccuccuguccgugcugauucucagcuuugucaccccuaucgaaggcacgcugacaaauuauccggagucuaagaaauacagccuugaggaaauugcugaugugaucgagggguucauugccgaacgcggaaucaaggaguauauuguucuguacaccuccaucuuuggcgcgcuccugcuucugaucgcccucauuaucaccgugucucugaacagaauuacagaauaucugaccaaucucaacgucaucuacugucacgagugcagcauguaucacuccaaaaagaauauuaaauacaucggcgacuucacaaacaaguguggguuuugcacguguggagagcuggaagaucaggagggccuuaacaugcauaaggugagcaaaaagugcaucuaccgguaucagcugaccuggucuaaaguuauuaugacaauccucgugugccugcugauugcucagaauaccguccuuaucguggccgcuaacgacgacuguugggccaagcaaucccucgaaauugagugcgucgggccccugcaacagguggaugccugugaagacaaaagcucucgcuccuacaauggagaggcuagaaagcugguuggcacaagcaaggugaccgagcucgaugcggggcaggucaaccugcuuggacagacgaucgaauccgccaucauugcuauccggaaacagcgcaccuaugccacaaugcacuuccuggagucuguguuucucggcagacauugcgacuacuauaagguuuucgaacacaauagcggcuacucccaggccaaauggcggcugcuggcuaagaccaaccauuuugauauuuguucuagacacagcacacaccauuucugccgcuguauguccgacgggaccaaaugcgagaauggaaacugggauuuugccggcgaaaugaauacgacauaucacagcaagcgggacuucuuuaagcaugauuucaaacuuuucuguacccuccuggagaacgcguuuccugggacaaccgagucucuguacuaccaacuccuguccaagagaaauaccacaggagcuagcaaacuucugggcaagcucaucacgaaauucgggaacaauaaccuguuugugggcauuuggaaguucggacaguuucugcuuucucuccccuaugucaauaacaccgaacuguccgcccugcagagcucuaaaauccucgagagcccugaaccccugcuucgcuccgccagcggccggcaggagucucuguccagcgcuacaccgggggaggccuccaaggaaugcagaaacgcuaagaaaaucucuuguauuagcccucgcuucggagugcccauggagaaucucaccgccugcggcgaauccccuaacuacaagaucuuuaaaacacccacccggauuuauaagucuaauaacaaaggggagaucuggugcgcgggagacgugcacuguuuccaagaauuuacgcccauucugcaggagguugucgauaagcugaagaaaaugacaugcuuccuuaccgagccugaagccgaggaagacgcuuuuagcaucgccauugcuauguguaagauccucgacaaaggcgugugcaccaucaauuccgagagauggaacauuaucaagugugauucugggcugauguacuauacagaccagcgcgauggccaggacaccggaaaugauuucggcgaauacugcauuagccacaacuguaaaacagagcgguuuccgaucaaucccuccauuaucagcgacugcaucugggaguaucauucuagaaagucccgcuacauuagcacgcugaaccucgaaucucuggaggaauuuaagcgggccaucuccgagaaacuuagccacacccugguggucuaccaauucaagccuacaucuaaucucccccauaugaaaccuguguauaaguacauuaccgcgcaggggguugaaaacuccgauggaaucgacagcgccuuuauuacagcuuccaugcccgcccugagcggcaccucuaucggguauaaugugaugagcaaagauaacuucccgcuguuugacaucauuaucuucauuaaguccgcugucaucaagacgaccuacaaucacauuuaugauacaggaccuaccaucggcauuaacgugaugcaugacgagcacuguacagggcagugccccaucgagaucccucacaaagaaaacuggcuuaccuuuucucaggagagaacaagccgguggggcugugaagaguucggaugccuggccauuaauaccggcugcguuuuuggguccugucaagauaucauucgccccgagacgaagguguacagaaaagccaucgaagagucuguccuccugacagugugcguuaccuauccuggaaacaccuucuguacagaaauuaaugcuaucgagcccaagaucaccgacgaacucgagcugcaguuuaaaacgguggacacaaagacccuuccgaaccugcucgcgguccagaaucauaaacuguacagcggccagauuaacgaucugggguccuucgcccaaggaugcggcaauauccagaagacaaaccuuucugugauugggaccggcacagcuaaguuugacuacaucugucacggagccagccggaaagauauuguggucagacgcugcuauaauaacaauuacgaguccuguaagcugcucaaagaggaaccuagccugaucuucucugacaaccaugaaaccaucgagguugccaauauucggcaccuccugggcgaacuucaguucaagcugaugcucggggaucugagauauaaauccuuugcugagaaccccgagcuggaaaucgaggcccgcugcgugggaugucccagcugcuucucuuccuacagcuguaauuuuagaauuuccucuagcaucgacacggugugcgcgauugauggcccuugcaccaucuuccauaaccggcuuauuaucuccagcacaaagcaagacuaugggaucaagaugucuuguaaagaaaagccgaaccccgucgagaaauuuaauauuugcaagcgcguguacuccguucuguucaccacaaucgauaaaaacgacaagauugaaaucaauaccggagaucagacgagcuuuauucaggagaaggacgauagauguaaaacauggcucugccgggugcgcgacgagggcaucucugucaucuucgaaccuauuaaggcuuucuucggcagcuauuuuuccaucgccuucuacgugguuauugggaucauugcccuguuuaucaucauuuacaucuuccuccccaugggauucaaacugaaggacauucuuaaaaagaacgagcugcuguaucuccaggaaaugaaguacaaauga

SEQ ID NO: 14162 - RNA, 4305 nt, Artificial Sequence
  derived and/or modified CDS sequence (opt5) from BATV(804992)__FJ436801.1__GP
augcugcuccugcuugugcugcucauccccugcugugucagcgccuccccuguuauuaccagaugcuuccacggcgggcagcugaucgcugagcggaagucucaagccgcgauuagcgaauuuugucuuaaagacgauguguccacaaucaagucugagauuaucuacgaaaagaacgacacgggacuguucgcucauaauaaggugcuccgcaacuggaucauuaaagauuggaagaauugcaacccgguccccaccgccggcgggagcaucaaugugauugagguuaacacagaccugucccugaccacaaagaccuauguguguucuagagauugcacaaucaccgucgacaaagaagaugcccagauuaucuuucagacggagaagcucaaucacuucgaggugagcggaaccacacuguccagcggcugguuuaaaaccaaggcuucuguuacacuugaccggaccugugaacauauuaaagugacgugcgggaagaagacacugcaguuccacgccuguuuuaaacaucacauguccugcauccgcuucuuucacggaaccauccucccuggcacaauggcuaccagcauuugucaaaacaucgagcugauuaucauuaucucucuuacccugaucauuuucauccucauggucauucugacaaagacguacaucugcuaucugcucaugccccuguuuaugccuauugccuacuucuauggcugguccuacaauaaaagcugcaagaaaugucccugcugugggcuugcguaucauccuuuuaccaacugcggaucucacugugugugcggccugaaguucgaagccuccgauagaaugcggauccaucgcgagagcgggcucugucagggauacaaaucccugagaguggcucggcuucugugcaagucuaagggcagcucccucaucauuagcauccugcugucuaugcucauucuguccuucgucacaccgaucgaggggacccuuacaaauuaccccgaaagccgcaaauaugaccuggaggaaauugccgauguucucgagggauuugugguggaaaagggcaucaaagaguacgucguguucuauaccucuauuuuuggcgcucuguuccuucugauggcccucaucguuaucauugcgcugaacagagugacggaguaccugacaaauaucaacguccucuauugucacgaaugcagcauguaccacuccaagaaaaauauuaaguauaucggggacuuuaccaacaaguguggauucuguaccugcggcgagcuggaagaucaggaggggcuuaaaauucauaaggugucucggaaaugcaucuacaaguaccagcugacauggagcaaaguuaucaugaugauucucgugugccugcugaucgcccaaaacaccauucuuaucgucgcugccuccgacgacuguuggacaaagaagucccucgaaauggagugcauuggaccucugcaacagguggauacgugugacgauaaaaccucucgcuccuauagcggcgaggcuaagaaacuggucagagccucuaagaucuccgaccucgaugccgcucagguggggcugcuuggaagcacaaucgaauccgcgauugccucuauccggcgccaaagaaccuacagcacaaugcaucugcucgaguccguuuuucugggcaaacacugcgacuauuacaagguguucgaacacaauucuggcuauagccaggcuaaguggcggcugaccgccaaaacgcaucacuuugauauuuguuccagacacagcacccaucacuucugccgcuguaucucugacgggacaaagugccagaacggagauugggacuuugccggcgagaugaauagcauuuaccaaagcaaaaaggauuucuuuaaacaugacuucaaacuuuucuguacccucgucgaaaacgcuuuucccgggacaaccgagucucuguucuaugagaugcuguccaaaaagaauacgacaggaaucaccaagcuccuggacaaacuuacaaagaaauuuggcaacaauaacauguucguggggaucuggaaguuuggccaguaccugaugagccucccuuacguuaaugaaaccucucugagccccauucagcuggccaaagugcuugaggucaccgaucagcaccaccgguccgugagcggaagacaagaaucucucgcguccgcuacaccgggcagcaaguccucugagugcgaccaugccaagaaagugagcugcaucuccccucgcuucggggcccccauggagggacugauggcuuguggcaacucuccuaauuauaagauuuacaaaacgcccgccaagcuguauaaaagcaacaauaagggggaaguuuggugcuccggagauguccacuguuuucaggagcucacccccgcuucucaggaaagcguggaccggaucaagcagaugacaugcuuccugaccgagccugaagugaacgaugacgucuuuuccauugccaucgcgauguguaaagugcaagauaagggcguuugcacaauuaaugaggacagauggaacaucaucaaaugugauagcgggcuuauuuacuauaccgaccagcgcgagggccaggauacgggaaacgacuucggcgaauacugccugucucauuccugucggaucgagagauuuccgauuaaucccgccaucauuagcgauugccucugggaauaucacucucgcaaguccaaauacaucacaagccuggaccuggagucucuugaagaguucaagcgggcuaucuccgagaagcucagccauacccugguggucuacaacuuuaaaccuaccgccaaucugccccacauuaagccuguguauaaauacaucacaguucaggggguggaaaacuccgacggagucgauagcgcuuauauuaccgccucuaugcccgcgcucagcggcacauccaucggguacaauauuaugucuagagacaacuucccgcuguucgauaucaucauuuuuaucaagagcgccauuaucaaagcuacguauaaucacauuuacgacaccggaccuacaaucggcauuaacgugaugcaugaugagcacuguaccgggcaaugccccacagacaucccucauaaggaaaauuggaucaccuucgcccaggagcgcacgucccgguggggcugcgaagaguuuggaugucuugcuguuaacaccggcugcguguucgggucuugucaggauauuaucagacccgagacaaaagucuaucggaaggccguggaagagagcgugcugcucaccgucugcauuacauacccuggaaagaccuuuuguacagaaaucaaugccauugagcccaaaaucaccgacgagcuggaacugcaguucaagacgguugauacaaaaacccuuccgaacauccuggcugugcaaaaucacaagcucuacuccggccagauuaacgaccuggggucuuuuagccagggaugcggcaauauccagaaaaccaacuccagcauuaucgggacaggcaccgcgaaguucgauuaugugugucauggagccucucgcaaggacauuaucgucagacggugcuacaacaauaacuaugaguccuguaaacuccugaaggaggaacagagccuuauguuugcugauaaucacgaaacgaucgacguggccaacguuagacaucugcucggcgaccugcaguucaaacugaugcuuggggaucugcgcuacaagucuuuugccgagaauccugaccucgagauugaagcuaaaugcgugggaugucccuccugcuucacaagcuauuccugcucuuucaagaucgucagcaacauugauaccguguguuccaucgagggccccugcacaaccuuucacaaucggcugaugauuacaagcaccaagcaggacuacgggaucaaaaugucuuguaagacgaaaccuggacucaccgaagaguuccaaauuugcaagaaaacauauaccguucuguuugccacaguggaaaagaacgauaagaucgagaucuccaccggcgaccagacgagcuucauucaggagagagaugaccgcuguaaaacauggcuuugcagaguccgggaugaaggcaucucugugauuuuugagccgauccgcgcguucuuugggagcuacuucuccauugcuuuuuacaucguuaucggaauuaucgugcuguuccucgucauuuauaucuuucugcccaugauguucaagcugagagacgugcuuaaacggaaugaauaccuguaucuccaggagauuaagcacaaauga

SEQ ID NO: 14163 - RNA, 4305 nt, Artificial Sequence
  derived and/or modified CDS sequence (opt5) from BATV(8627-11)__FJ436799.1__GP
augcugcuccugcuugugcugcucauccccugcugugucagcgccuccccuguuauuaccagaugcuuccacggcgggcagcugaucgcugagcggaagucucaagccgcgauuagcgaauuuugucuuaaagacgauguguccacaaucaagucugagauuaucuacgaaaagaacgacacgggacuguucgcucauaauaaggugcuccgcaacuggaucauuaaagauuggaagaauugcaacccgguccccaccgccggcgggagcaucaaugugauugagguuaacacagaccugucccugaccacaaagaccuauguguguucuagagauugcacaaucaccgucgacaaagaagaugcccagauuaucuuucagacggagaagcucaaucacuucgaggugagcggaaccacacuguccagcggcugguuuaaaaccaaggcuucuguuacacuugaccggaccugugaacauauuaaagugacgugcgggaagaagacacugcaguuccacgccuguuuuaaacaucacauguccugcauccgcuucuuucacggaaccauccucccuggcacaauggcuaccagcauuugucaaaacaucgagcugauuaucauuaucucucuuacccugaucauuuucauccucauggucauucugacaaagacguacaucugcuaucugcucaugccccuguuuaugccuauugccuacuucuauggcugguccuacaauaaaagcugcaagaaaugucccugcugugggcuugcguaucauccuuuuaccaacugcggaucucacugugugugcggccugaaguucgaagccuccgauagaaugcggauccaucgcgagagcgggcucugucagggauacaaaucccugagaguggcucggcuucugugcaagucuaagggcagcucccucaucauuagcauccugcugucuaugcucauucuguccuucgucacaccgaucgaggggacccuuacaaauuaccccgaaagccgcaaauaugaccuggaggaaauugccgauguucucgagggauuugugguggaaaagggcaucaaagaguacgucguguucuauaccucuauuuuuggcgcucuguuccuucugauggcccucaucguuaucauugcgcugaacagagugacggaguaccugacaaauaucaacguccucuauugucacgaaugcagcauguaccacuccaagaaaaauauuaaguauaucggggacuuuaccaacaaguguggauucuguaccugcggcgagcuggaagaucaggaggggcuuaaaauucauaaggugucucggaaaugcaucuacaaguaccagcugacauggagcaaaguuaucaugaugauucucgugugccugcugaucgcccaaaacaccauucuuaucgucgcugccuccgacgacuguuggacaaagcgcagccucgaaauggagugcauuggaccucugcaacagguggauacgugugacgauaagaccucuagauccuauagcggcgaggcuaaaaagcugguccgggccucuaaaaucuccgaccucgaugccgcucagguggggcugcuuggaagcacaaucgaauccgcgauugccucuauccgcagacaacggaccuacagcacaaugcaucugcucgaguccguuuuucugggcaagcacugcgacuauuacaaaguguucgaacacaauucuggcuauagccaggcuaaguggagacugaccgccaagacgcaucacuuugauauuuguucccgccacagcacccaucacuucugccgguguaucucugacgggacaaaaugccagaacggagauugggacuuugccggcgagaugaauagcaccuaccaaagcaagaaagauuucuuugaacaugacuucaaacuuuucuguacacucgucgagaacgcuuuucccgggaccacggagucucuguucuaugaaaugcuguccaaaaagaauacaaccggaauuacaaaacuccuggacaaacuuaccaagaaguuuggcaacaauaacauguucguggggaucuggaaguuuggccaguaccugaugagccucccuuacguuaaugagaccucucugagccccacacagcuggccaaagugcuugaagucacggaucagcaccacagauccgugagcggacgccaagagucucucgcguccgcuaccccgggcagcaaguccucugagugcgaccaugccaaaaaggugagcugcaucuccccucgguucgggguucccauggaaggacugauggccuguggcaacucuccuaauuauaagauuuacaaaacacccgcuaagcuguauaaaagcaacaauaagggggaggucuggugcuccggaaacgugcacuguuuucaggaacucaaucccgccucucaggagagcguggauagaaucaaacagaugaccugcuuccugacagaaccugaggucaacgacgauguguuuuccauugcuaucgccauguguaagguucaagacaagggcgugugcaccauuaacaaagaucgcuggaauaucauuaagugugacagcgggcuuaucuacuauacggaucagcgggagggccaggacacaggaaacgauuucggcgaauacugccugucucauuccuguagaaucgagcgcuuuccgauuaaucccgcgaucauuagcgacugccucugggaauaucacucucggaaauccaaguacaucaccagccuggaucuggagucucuugaagaguucaaaagagccauuuccgagaagcucagccauacccuggucguguacaacuuuaagccuacagcuaaucugccccacaucaaaccuguuuaugaauacaucaccgugcagggggucgagaacuccgacggaguggacagcgccuauauuacagcuucuaugcccgcccucagcggcacguccaucggguacaauauuaugucucgcgauaacuucccgcuguucgacaucauuaucuuuaucaagagcgcgauuaucaaagccaccuauaaucacauuuacgauacaggaccuaccaucggcauuaacguuaugcaugacgaacacuguacagggcaaugccccaccgauaucccucauaaggagaauuggauuacguucgcucaggaacggaccuccagauggggcugcgaggaguuuggaugucuugccgugaacacaggcugcgucuucgggucuugucaggacaucauccggcccgaaaccaaaguguaucgcaaggcuguggaggaaagcguccugcucacaguuugcauuaccuacccuggaaaaacauuuuguaccgagaucaaugccauugagcccaagaucacggaugaacuggagcugcaguucaagacaguggacaccaaaacccuuccgaacauucuggccgugcaaaaucacaagcucuacuccggccagaucaacgaucuggggucuuuuagccagggaugcggcaacauccagaaaacaaauuccagcauuaucgggaccggcacggcuaaguucgacuaugucugucauggagcgucuagaaaagauauuaucgugcggagaugcuacaacaauaacuaugaauccuguaagcuccugaaggaggaacagagccuuauguuugccgacaaucacgagacaauugauguugcuaacgugcgccaucugcucggcgaccugcaguucaaacugaugcuuggggaccugcgguacaagucuuuugccgagaauccugaucucgaaaucgaggccaaaugcgucggaugucccuccugcuucaccagcuauuccugcucuuucaagaucgugagcaacauugacacaguuuguuccaucgaaggccccugcaccacauuucacaauagacugaugauuaccagcacgcgccaggauuacgggaucaaaaugucuuguaagaccaagccuggacucacagaggaauuucaaauuugcaaaaagaccuauacagugcuguucgcuaccgucgagaaaaacgacaagaucgagauuuccacgggcgaucagacauccuucauccaggaaagagacgaucgguguaaaaccuggcuuugccgcgugagagacgagggcaucucuguuauuuuugaaccgauccgggccuucuuugggagcuacuucuccauugcguuuuacaucgugauuggaaucaucguccuguuccucgugauuuauaucuuucugcccaugauguucaagcugcgcgaugugcuuaagagaaaugaguaccuguaucuccaggaaauuaaacacaaguga

SEQ ID NO: 14164 - RNA, 4305 nt, Artificial Sequence
  derived and/or modified CDS sequence (opt5) from BATV(Chittoor/IG-20217)__JX846599.1__GP
augcugcuccugcuugugcugcucauccccugcugugucagcgccuccccuguuauuaccagaugcuuccacggcgggcagcugaucgcugagcggaagucucaagccgcgauuagcgaauuuugucuuaaagacgauguguccacaaucaagucugagauuaucuacgaaaagaacgacacgggacuguucgcucauaauaaggugcuccgcaacuggaucauuaaagauuggaagaauugcaacccgguccccaccgccggcgggagcaucaaugugauugagguuaacacagaccugucccugaccacaaagaccuauguguguucuagagauugcacaaucaccgucgacaaagaagaugcccagauuaucuuucagacggagaagcucaaucacuucgaggugagcggaaccacacuguccagcggcugguuuaaaaccaaggcuucuguuacacuugaccggaccugugaacauauuaaagugacgugcgggaagaagacacugcaguuccacgccuguuuuaaacaucacauguccugcauccgcuucuuucacggaaccauccucccuggcacaauggcuaccagcauuugucaaaacaucgagcugauuaucauuaucucucuuacccugaucauuuucauccucaugauuauccugacaaagacguacauuugcuaucugcucaugccccuguuuaugccuaucgccuacuucuauggcugguccuacaauaaaagcugcaagaaaugucccugcugugggcuugcguaucauccuuuuaccaacugcggaucucacugugucugcggccugaaguucgaagccuccgauagaaugcggauccaucgcgagagcgggcucugucagggauacaaaucccugagaguggcucggcuucugugcaagucuaagggcagcucccucauuaucagcauucugcugucuaugcucauccuguccuucgugacaccgauugaggggacccuuacaaauuaccccgaaagccgcaaauaugaccuggaggaaaucgccgauguccucgagggauuuguuguggaaaagggcauuaaagaguacguggucuucuauaccucuaucuuuggcgcucuguuccuucugauggcccucaucgugauuaucgcgcugaacagaguuacggaguaccugacaaauauuaacgugcucuauugucacgaaugcagcauguaccacuccaagaaaaauaucaaguauauuggggacuuuaccaacaaguguggauucuguaccugcggcgagcuggaagaucaggaggggcuuaaaauccauaaggucucucggaaaugcaucuacaaguaccagcugacauggagcaaagugauuaugaugauccucguuugccugcugauugcccaaaacaccauccuuauuguggcugccuccgacgacuguuggacaaagaagucccucgaaauggagugcaucggaccucugcagcaggucgauacgugugacgauaaaaccucucgcuccuauagcggcgaggcuaagaaacuggugagagccucuaagaucuccgaccucgaugccgcucaggucgggcugcuuggaagcacaauugaauccgcgaucgccucuauucggcgccaaagaaccuacagcacaaugcaucugcucgaguccguguuucugggcaaacacugcgacuauuacaagguuuucgaacacaauucuggcuauagccaggcuaaguggcggcugaccgccaaaacgcaucacuuugauaucuguuccagacacagcacccaucacuucugccgcuguauuucugacgggacaaagugccagaacggagauugggacuuugccggcgagaugaauagcaccuaccaaagcaaacgggauuucuuugaacaugacuucaaacuuuucuguacacucaucgagaacgcuuuucccgggaccacggagucucuguucuaugaaaugcuguccaaaaagaauacaaccggaaucacaaaacuccuggacaaacuuaccaagaaauuuggcaacaauaacauguucguggggauuuggaaguuuggccaguaccugaucagccucccuuacgucaaugagaccucucugagccccacacagcuggccaaagugcuugaaguuacggaucagcaccacagauccauuagcggacgccaagagucucucgcguccgcuaccccgggcagcaaguccucugagugcgaccaugccaaaaaggccagcugcaucuccccucgguucggggugcccauggaaggacugauggcuuguggcaacucuccuaauuauaagauuuacaaaacacccgccaagcuguauaaaagcaacaauaagggggaggucuggugcuccggaaacuuucacuguuuccaggaacucauccccgcuucucaggagagcguggauagaauuaaacagaugaccugcuuucugacagaaccugaggugaaugacgauguuuucuccaucgccaucgcgauguguaagguccaagacaagggcgugugcaccauuaacaaagaucgcuggaacgugaucaagugugacagcgggcuuauuuacuauacggaucagcgggagggccaggacacaggaaaugauuuuggcgaauacugccugucucauuccuguagaaucgagcgcuucccgauuaaccccgccaucaucagcgacugccucugggaauaucacucucggaaauccaaguacauuaccagccuggaucuggagucucuugaagaguuuaaaagagcuaucuccgagaagcucagccauacccugauugucuacaauuucaagccuacagccaaccugccccacaucaaaccuguguauaaguacauuaccguucaggggguggaaaauuccgacggagucgacagcgcuuauaucacagccucuaugcccgcgcucagcggcacguccaucggguacaacauuaugucucgcgauaauuucccgcuguuugacaucauuaucuucauuaaaagcgccaucauuaaggcuaccuauaaccacaucuacgauacaggaccuaccaucggcauuaaugugaugcaugacgagcacuguacagggcaaugccccaccgauaucccucauaaagaaaacuggauuacguuugcccaggagcggaccuccagauggggcugcgaagaguucggaugucuugcuguuaauacaggcugcguguuugggucuugucaggacaucauucggcccgagaccaaggucuaucgcaaagccguggaagagagcguucugcucacagugugcaucaccuacccuggaaagacauucuguaccgaaaucaacgccauugagcccaagaucacggaugagcuggaacugcaguuuaaaacagucgacauuaagacccuuccgaauauccuggcugugcaaaaccacaaacucuacuccggccagauuaaugaucuggggucuuucagccagggaugcggcaacauccaaaagaccaacuccagcaucauugggacaggcaccgcgaaauuugacuaugugugucauggagccucuagaaaggauaucauuguccggagaugcuacaauaacaauuaugaguccuguaagcuccugaaagaggaacagagccuuauguucgcugacaaccacgaaacgaucgauguugccaaugugcgccaucugcucggcgaccugcaguuuaagcugaugcuuggggaccugcgguacaaaucuuucgccgagaacccugaucucgagauugaagcuaagugcgugggaugucccuccugcuucacaagcuauuccugcucuuuuaaaaucgucagcaauauugacaccguguguuccaucgagggccccugcacaaccuuccacaacagacugaugaucacaagcaccaagcaggauuacgggauuaagaugucuuguaaaacgaagccuggacucaccgaagaguuucaaaucugcaaaaagacauauaccguucuguucgccacaguggaaaagaaugacaagauugagaucuccaccggcgaucagacgagcuuuauucaggagcgcgacgauagauguaagacauggcuuugccggguccgcgacgaaggcaucucugugaucuucgagccgauuagagcguuuuucgggagcuacuuuuccaucgcuuucuacauuguuaucggaauuaucgugcuguuucucgucaucuauauuuuccugcccaugauguuuaaacugcgggaugugcuuaagcgcaacgaauaccuguaucuccaggagaucaaacacaaguga

SEQ ID NO: 14165 - RNA, 4305 nt, Artificial Sequence
  derived and/or modified CDS sequence (opt5) from BATV(41.3)__KM507322.1__GP
augcuucucuuccugauccuucugauucccugcuacgccagcgcuuccccuguggucaccagauguuuucacggcgggcagcucaucgccgagucucggagcccgacagcgguuuccgaauuuugccugaaggacgaugugucuacgauuaaaagcgagaucauuuaugugaagaacgacaccggacuuuuugcucauaauaaaguccugcgcaacuggaucaucaaggauuggaaaaauuguaaccccgugccuacagccggcggguccauuaauguuaucgaagugaacaccgaccucucucugagcacaaagaccuacgucugcuccagagauuguacaauuaccguggacaaggaggaugcccaaaucauuuuccagacggaaaaacugaaucacuuugagguuagcggaaccacacucucuuccggcugguucaagaccaaagcuagcgugacacuggaccggaccugcgagcauaucaaggucacgugugggaaaaagacacuucaguuucacgccugcuucaagcaucacaugucuuguauucgcuuuuuccacuccaccauccugcccggaacaauggcuaccagcaucugccagaacauugaacucaucauuaucauuucucugacccuucugaucuuuauccucauggccauucugacaaaaacguauaucuguuaccugcucaugccucuguucaugcccauugcguaucuuuacggcugguccuauaauagaagcugcaagaaaugcuccuguugcggccuggccuaccauccuuuuaccaacugugggucucacugcguguguggacucaaguucgaggcuagcgaucggaugcgcauccauagagaauccggccugugccaaggguacaaaagccuucggguggcccgccugcucuguaagucuaaaggauccagccugauuaucucuauccugcucagcaugcugauucuuuccuucgucacaccgaucgagggcacccugacaaauuaucccgagucuagaaaguacgaccucgaagagauugcugauguucuggaaggguuuaucaccgagaagggaauuaaagaauaugugguguucuacacgagcaucuuuggcggccuuuuccugcuccuggcccugauuaucaucauugcgcucaaccgggucacagaguaucugaccaauaucaacguguuuuacugccacgaguguuccauguaucacagcaagaaaaauauuaaguacaucggggacuucaccaacaaaugcggauuuuguacaugcggcgaacuugaggaucaggaagggcugaagauucauaagguuucucgcaaaugcaucuacaaguaucagcucaccugguccaaaaucauuaugaucauucuggugugucugcuuaucgcccagaacacaauucucaucgucgcugccagcaaugacugcugggcuaagaaaucucuggagauggaauguaucggaccucugcaacagguggaguccugcgacgauaaggccagcagauccuacucuggcgaggccaagaaacucguucgggcuagcaagauuuccgaccuggaugcggcccagguggggcuucugggaucuacgaucgaaagcgcuauugccuccauccgcaaacagagaaccuaucccacaaugcaccuccuggagagcgucuuccuggccaagcauugugacuacuauaaaucuuuugaacacaacuccggcuacagccaagcuaaguggcggcuuaccgccaagacacaucacuucgauauuugcucuagacacuccacccaucacuuuugucgcugcaucagcgacggcacgaaaugucagaauggggauugggacuucgcgggagagaugaacucuaccuaucagagcaagaaagauuucuucgaacaugacuucaagcucuuuugcacacugcuggagaaugcuuucccuggcaccacagaguccuuuuacuaccaaaugcuccagaaaaagaacaccacggggguggucaaacugcuugaugaacugacaaagaaguucggaaauaacaauauguuugugggcaucuggaaauucgggcaguaucucaugagccugcccuacauuaacgagaccucucugacaccgcuucagcucuccaagauccuggaagccagcaaucaacaccaccgguccauuucuggcagacaggagagccuggccaacgcugccuccggaggcaaaucuaaggagugugaccaugcuaaaaagguuagcugcaucuccccucgcuuuggggugcccauggaaggacucauugccugcggcucuagcccuaauuauaagaucuacaaaaugcccaccaagcuguauaaauccaacaauaagggggaggucugguguagcggagacgugcacugcuuccaggaacuuaaccccgcgucucaggaguccguugaucggauuaaacaaaugaccuguuuucugacagaaccugagacgaacgaggacguguucagcaucgccaucucuaugugcaagguccaggauaagggcguguguaccauuaaugaagagagauggaacgugaucaaaugcgacuccgggcucauuuacuauacagaucagcgcgacggccaggauaccggaaaugacuuuggcgaauacugucugagccauaacugccggaucgagagauucccgauuaaucccacaaucaucaacgauugucugugggaauaccacucucgcaaguccaaauauauuaccagccuugaccucgagucccuggaggaauuuaagcgggcuaucagcgagaaacugucucauacgcucauuguuuacaauuucaagccuacagccaaccugccccacaucaagccugucuauaaauacauuaccgugcaagggguggaaaauagcgauggagucgacuccgcuuauaucaccgccucuaugcccgcgcuuagcggcacauccaucggguacaacauuaugucuaaggauaauuucccgcuguuugacaucauuaucuucauuaaaagcgccgugaucaaggcuaccuauaaccacauuuacgacacaggaccuacgaucggcaucaauguuaugcaugaugagcacugcaccgggcagugucccacagacauuccucauaaagaaaacuggaucaccuuuucccaggagagaacaucucgcuggggcugcgaggaauuuggaugccucgccgugaauaccggcugugucuuugggagcugccaggauauuauccggcccgagacgaagguguacagaaaagcuauugaagaguccguucugcugaccguguguaucacauauccuggaaagaccuucugcacagagaucaacgccauugaacccaagaucaccgacgagcuugaacugcaauuuaaaacagucgauaccaagacgcucccgaacauucuggccgugcagaaucacaaacucuacagcggccagaucaacgaccuggggucuuucucccaaggauguggcaauauucagaagacaaacagcucuaucaucgggaccggcaccgcuaaauuugauuauguuugccauggagcgucccggaaggacauuaucgugcgcagauguuacaauaacaauuaugagagcugccggcuucugaaggaggaacagucccucauguucgccgauaaccacgagacaauugacgucgcuaaugugagacaucugcugggcgaucuucaguuuaaacugaugcucggggaccugcgcuacaagucuuucgccgaagauccugaccucgagaucgaagccaaaugugugggaugccccagcuguuucaccuccuauagcugcaacuuucggauugucucuaauaucgacacgguuugcuccauugagggccccuguacaaccuuccacaacagacugaugaucacaagcaccaagcaagauuacgggaucaaaaugucuugcaagggaaagccuggcagcacagaagaguuucagauuuguaaaaagaccuacacggugcuuuucaccacaguggagaaaaaugacaagaucgaaauuaacaccggcgaucagacauccuuuauccaggagcgcgacgauagaugcaaaaccuggcugugucggguccgcgacgaagggauuucugugaucuucgagccgaucagagcuuucuucggaagcuauuuuuccauugccuucuacaucguugugggcauuaucguccucuuucugaugauuuauaucuuccugcccauggcguuuaagcugcgggaugugcugaagcgcaaugaauaccucuaucugcaagagaucaaacacaaguga

SEQ ID NO: 14166 - RNA, 4305 nt, Artificial Sequence
  derived and/or modified CDS sequence (opt5) from BATV(EIV-1217Astr)__KT313699.1__GP
augcugcucuuucugauccuucugauucccugcuacgccagcgcuuccccuguggucaccagauguuuucacggcgggcagcucaucgccgagucucggagcccgacagcgguuuccgaauuuugccugaaggacgaugugucuacgauuaaaagcgagaucauuuaugugaagaacgacaccggacuuuuugcucauaauaaaguccugcgcaacuggaucaucaaggauuggaaaaauuguaaccccgugccuacagccggcggguccauuaauguuaucgaagugaacaccgaccucucucugagcacaaagaccuacgucugcuccagagauuguacaauuaccguggacaaggaggaugcccaaaucauuuuccagacggaaaaacugaaucacuuugagguuagcggaaccacacucucuuccggcugguucaagaccaaagcuagcgugacacuggaccggaccugcgagcauaucaaggucacgugugggaaaaagacacuucaguuucacgccugcuucaagcaucacaugucuuguauucgcuuuuuccacggaaccauccugcccggcacaauggcuaccuccaucugccagaacauugaacucaucauuaucauuagccugacccuucugaucuuuauccucauggccauucugacaaaaacguauaucuguuaccugcucaugccucuguucaugcccauugcguaucuuuacggcuggucuuauaauagauccugcaagaaaugcagcuguugcgggcuggccuaccauccuuuuaccaacuguggaucccacugcguguguggccucaaguucgaggcuucugaucggaugcgcauccauagagaaagcgggcugugccaaggauacaaaucccuucggguggcccgccugcucuguaagagcaaagggucuucccugauuaucagcauccugcucucuaugcugauucuuagcuucgucacaccgaucgagggcacccugacaaauuaucccgaguccagaaaguacgaccucgaagagauugcugauguucuggaaggauuugugaccgagaagggcaucaaagaauauguggucuucuacacgucuauuuuuggcgggcuuuuccugcuccuggcccugaucauuaucaucgcgcucaaccgggugacagaguaucugaccaauauuaacguuuucuacugccacgaguguagcauguaucacuccaagaaaaauaucaaguacauuggagacuucaccaacaaaugcggcuuuuguacaugcggggaacuugaggaucaggaaggacugaagauccauaaggugagccgcaaaugcauuuacaaguaucagcucaccuggucuaaaaucaucaugauuauccuggucugucugcuuauugcccagaacacaauccucauuguggcugccuccaaugacugcugggcuaagaaaagccuggagauggaauguaucggcccucugcaacagauggagucuugcgacgauaaggccuccagaagcuacuccggggaggccaagaaacucguucgggcuucuaagaucagcgaccuggaugcggcccaggugggacuucugggcuccacgauugaaucugcuaucgccagcauucgcaaacagagaaccuaucccacaaugcaccuccuggaguccgucuuccuggccaagcauugugacuacuauaagagcuuugaacacaacucuggcuacucccaagcuaaauggcggcuuaccgccaagacacaucacuucgauaucugcagcagacacucuacccaucacuuuugucgcugcauuuccgacgggacgaaaugucagaauggagauugggacuucgcgggcgagaugaacagcaccuaucagucuaagaaagauuucuucaagcaugacuucaaacucuuuugcacacugcuggaaaaugcuuucccugggaccacagagagcuuuuacuaccaaaugcuccagaagaaaaacaccacgggaguggucaagcugcuugaugagcugacaaagaaauucggcaauaacaauauguuuguggggaucuggaaguucggccaguaucucaugucccugcccuacaucaacgaaaccagccugacaccgcuucagcucucuaaaauucuggaggccuccgaccaacaccaccggagcaucuccggaagacaggaaucucuggccaaugcugccagcggcgggaaguccaaagagugugaccaugcuaagaagguuucuugcauuagcccucgcuuuggagugcccauggagggccucaucgccugcgggggauccccuaacuauaaaauuuacaagaugcccaccaaacuguauaagucuaauaacaaaggcgaagucugguguagcggggaugugcacugcuuccaggagcuuaaucccgcgcugcaggaauccguugaccggaucaagcaaaugaccuguuuucucacagagccugaaacgaacgaggauguguucagcauugccaucucuaugugcaagguccaggacaaaggcguguguaccaucaacgaggaaagauggaaugugauuaagugcgauuccggacugaucuacuauacagaccagcgcgauggccaggacaccgggaacgauuuuggagaguacugucugagccauaauugccggauugaaagauucccgaucaaccccacaauuaucaaugacugucuuugggaguaccacucucgcaaauccaaguauaucaccagccucgaucuggaaucucuggaggaguuuaaacgggcuauuuccgaaaagcucagccauacgcugaucguuuacaacuucaagccuacagccaaucuuccccacauuaaaccugucuauaaguacaucaccgugcaaggcguggagaacuccgacggggucgauagcgcuuauauuaccgccucuaugcccgcgcugagcggaacauccaucggcuacaauaucaugucuaaagacaacuucccgcucuuugacauuaucauuuucaucaagagcgccgugauuaaagcuaccuauaaucacaucuacgauacagggccuacgauuggcaucaacguuaugcaugacgaacacugcaccggacagugucccacagauaucccucauaaggagaauuggauuaccuuuucccaggaaagaacaucucgcuggggcugcgaggaguucgggugccuggccgugaacaccggaugugucuuuggcagcugccaggacaucauucggcccgaaacgaaaguguacagaaaggcuaucgaggaauccguucugcuuaccguguguauuacauauccugggaagaccuucugcacagagaucaaugccaucgagcccaaaauuaccgaugaacuggagcuccaauuuaagacagucgacaccaaaacgcugccgaacauccucgccgugcagaaccacaagcuguacucuggacagauuaaugaucuuggcagcuucucccaaggguguggcaacauccagaaaacaaauagcucuauuaucggaaccggcaccgcuaaguuugacuauguuugccauggggcgucccggaaggauaucauugugcgcagauguuacaacaauaacuaugaaagcugccggcugcucaaagaggaacagucucugauguucgccgacaaucacgagacaaucgaugucgcuaacgugagacaucugcuuggagaccugcaguuuaagcucaugcugggcgaucuccgcuacaaauccuucgccgaggacccugaccuggaaauugaggccaaguguguggggugccccagcuguuucaccuccuauucuugcaauuuucggaucgucagcaacauugauacgguuugcuccaucgaaggacccuguacaaccuuccacaauagacuuaugauuacaagcaccaaacaagacuacggcaucaagaugucuugcaagggcaaaccuggguccacagaggaauuucagaucuguaagaaaaccuacacggugcuguucaccacaguggagaagaacgauaaaauugagaucaauaccggagaccagaccagcuuuauucaggaacgcgaugacagaugcaagacauggcucugucggguccgcgaugagggcaucucugugguuuucgaaccgauuagagccuuuuucgggagcuauuuuuccaucgcuuucuacaucguggucggaauuaucgugcuguuucugguuauuuauaucuuccuucccauggcguuuaagcugcgggacgugcucaaacgcaacgaguaccuguaucuccaagaaauuaagcacaaauga

SEQ ID NO: 14167 - RNA, 4305 nt, Artificial Sequence
  derived and/or modified CDS sequence (opt5) from BATV(EIV-12497Bl)__KT313692.1__GP
augcuccuguuccugauccuucugauucccugcuacgccagcgcuuccccuguggucaccagauguuuucacggcgggcagcucaucgccgagucucggagcccgacagcgguuuccgaauuuugccugaaggacgaugugucuacgauuaaaagcgagaucauuuaugugaagaacgacaccggacuuuuugcucauaauaaaguccugcgcaacuggaucaucaaggauuggaaaaauuguaaccccgugccuacagccggcggguccauuaauguuaucgaagugaacaccgaccucucucugagcacaaagaccuacgucugcuccagagauuguacaauuaccguggacaaggaggaugcccaaaucauuuuccagacggaaaaacugaaucacuuugagguuagcggaaccacacucucuuccggcugguucaagaccaaagcuagcgugacacuggaccggaccugcgagcauaucaaggucacgugugggaaaaagacacuucaguuucacgccugcuucaagcaucacaugucuuguauucgcuuuuuccacggaaccauccugcccggcacaauggcuaccuccaucugccagaacauugaacucaucauuaucaccagccugacacuucugauuuuuauccucauggccauccugacgaaaaccuauauuuguuaccugcucaugccucuguucaugcccaucgcguaucuuuacggcuggucuuauaauagauccugcaagaaaugcagcuguugcgggcuggccuaccauccuuuuacaaacuguggaucccacugcguguguggccucaaguucgaggcuucugaucggaugcgcauucauagagaaagcgggcugugccaaggauacaaaucccuucggguggcccgccugcucuguaagagcaaaggcagcucccugaucauuagcauccugcucucuaugcugauccuuagcuucgucaccccgauugaggggacacugaccaauuaucccgaguccagaaaguacgaccucgaagagaucgcugauguucuggaaggauuuauuacggagaagggcaucaaagaauaugugguguucuacacaucuauuuuuggcgggcuuuuccugcuccuggcccugaucauuaucaucgcgcucaaccgggucaccgaguaucugaccaauauuaacguguuuuacugccacgaguguagcauguaucacuccaagaaaaauaucaaguacauuggagacuucacaaacaaaugcggcuuuuguaccugcggggaacuugaggaucaggaaggacugaagauccauaagguuagccgcaaaugcauuuacaaguaucagcucacauggucuaaaaucaucaugauuauccuggugugucugcuuauugcccagaacacgauccucauugucgcugccuccaaugacugcugggcuaagaaaagccuggagauggaauguaucggcccucugcaacagguggagucuugcgacgauaaggccuccagaagcuacuccggggaggccaagaaacucguucgggcuucuaagaucagcgaccuggaugcggcccaggcuggacuucugggcuccaccauugaaucugccaucgccagcauucgcaaacagagaacauaucccaccaugcaccuccuggaguccguguuccuggcuaagcauugugacuacuauaaaucuuuugaacacaacucuggcuacucccaagccaaguggcggcuuacagcgaagacccaucacuucgauaucugcagcagacacucuacgcaucacuuuugucgcugcauuuccgacgggaccaaaugucagaauggagauugggacuucgcuggcgagaugaacagcacauaucagucuaagaaagauuucuucgaacaugacuucaagcucuuuugcacccugcuggagaaugccuucccugggacaaccgagagcuuuuacuaccaacuccugcagaaaaagaacacgacaggagucgugaaacuucuggaugaacucaccaagaaguucggcaauaacaauauguuugucgggaucuggaaauucggccaguaucugaugucccugcccuacaucaacgagacaagccuuaccccgcuccagcugucuaagauucuggaagccuccgaccaacaccaccggagcaucuccggaagacaggagucucucgcuagcgccgcuuccggcgggaaaucuaaggagugugaccaugccaaaaaggugagcugcauuuccccucgcuuuucuguucccauggaaggacugaucgcgugcggcagcuccccuaauuauaagauuuaccggaugcccaccaaacuuuauaagagcaacaauaaaggggaggugugguguucuggagauguccacugcuuccaggaacugaaccccgccucccaggagagcguggacagaaucaagcaaaugauuuguuuucucacagaaccugagguuaaugaggauguguucucuaucgcuaucuccaugugcaaaguccaggacaagggcguguguacgauuaacgaagaacgcuggaacgugaucaagugcgauagcgggcugauuuacuauaccgaccagcgggauggccaggacacaggaaaugauuuuggcgaauacugucugucucauaacugcagaaucgagcgcuucccgauuaaucccaccaucaucaacgacugucuuugggaauaccacucccggaaaagcaaguauauuacaucccucgaucuggagagccuggaggaauuuaaaagagccaucucugagaagcucagccauacccugauuguuuacaauuucaaaccuacggcuaaccuuccccacaucaagccugucuauaaguacauuacagugcaagggguggaaaauuccgacggagucgauucugccuauaucaccgcgagcaugcccgcccuguccggcaccucuaucggguacaacauuaugagccgcgacaauuucccgcucuuugacaucauuaucuucauuaaauccgcugugaucaaggccacauauaaccacauuuacgauaccggaccuacaaucggcaucaauguuaugcaugacgagcacugcacggggcagugucccaccgauauuccucauaaagaaaacuggaucacauuuucucaggagcggaccagcagauggggcugcgaggaguucggaugccuggcugugaauacaggcugugucuuuggguccugccaggacauuauccggcccgagaccaagguguaccgcaaagccguugaagagagcgugcugcuuacggucuguauuaccuauccuggaaagacauucugcaccgagaucaacgccaucgaacccaaaauuacagaugagcuggaacuccaauuuaagaccguggacacaaagacccugccgaauauccucgcuguucagaaccacaaacuguacucuggccagauuaacgaucuuggguccuucagccaaggauguggcaauauccagaagacgaacucuuccauuaucgggacaggcaccgcgaaauuugacuaugugugccauggagccagcagaaaggauaucauuguccggagauguuacaauaacaauuaugaguccugccgccugcucaaagaggaacagucucugauguucgcugacaaccacgagaccaucgauguggccaaugugcggcaucugcuuggcgaccugcaguuuaagcucaugcugggggaucucagauacaagagcuucgccgaagacccuggacuggagauugaagcuaaaugugucggcugccccuccuguuucacaagcuauucuugcaacuuucgcaucguuuccaauauugacaccgugugcagcaucgaggggcccuguacgacauuccacaacagacuuaugauuaccucuacaaagcaagauuacggaaucaaaaugagcugcaagggcaaaccuggcuccaccgaagaguuucagaucuguaagaagacauacaccgugcuguucacgaccauugagaaaaaugacaagaucgaaauuaacacaggggaucagaccucuuuuguccaggagcgggacgaucgcugcaaaacauggcucuguagagugcgggacgaaggaaucagcguuauuuucgagccgauccgcgccuuuuucggcuccuauuuuucuaucgcguucuacauuguggucgggaucauugugcuguuucugguuaucuauauuuuccuucccauggcuuuuaagcugagagaugugcucaaacggaaugaauaccuguaucuccaagagaucaagcacaaguga

SEQ ID NO: 14168 - RNA, 4305 nt, Artificial Sequence
  derived and/or modified CDS sequence (opt5) from BATV(EIV-12845Ms)__KT313690.1__GP
augcuucucuuccugauccuucugauucccugcuacgccagcgcuuccccuguggucaccagauguuuucacggcgggcagcucaucgccgagaaccggucuccgacagcgguuagcgaauuuugccugaaggacgauguguccacgauuaaaucugagaucauuuaugugaagaaugacaccggacuuuuugcucauaacaaaguccugcgcaauuggaucaucaaggauuggaaaaacuguaaucccgugccuacagccggcgggagcauuaacguuaucgaagugaauaccgaccucucccugucuacaaagaccuacgucugcagcagagauuguacaauuaccguggacaaggaggaugcccaaaucauuuuccagacggaaaaacugaaccacuuugagguuuccggaaccacacucagcucuggcugguucaagaccaaagcuagcgugacacuggaccggaccugcgagcauaucaaggucacgugugggaaaaagacacuucaguuucacgccugcuucaagcaucacaugagcuguauucgcuuuuuccacucuaccauccugcccggaacaauggcuaccuccaucugccagaauauugaacucaucauuaucauuagccugacccuucugaucuuuauccucauggccauucugacaaaaacguauaucuguuaccugcucaugccucuguucaugcccauugcguaucuuuacggcuggucuuauaacagauccugcaagaaaugcagcuguugcggccuggccuaccauccuuuuaccaauugugggucccacugcguguguggacucaaguucgaggcuucugaucggaugcgcauccauagagaaagcggccugugccaaggguacaaaucccuucggguggcccgccugcucuguaagagcaaaggaucuucccugauuaucagcauccugcucucuaugcugauucuuagcuucgucacaccgaucgagggcacccugacaaacuaucccgaguccagaaaguacgaccucgaagagauugcugauguucuggaaggguuuaucaccgagaagggaauuaaagaauaugugguguucuacacgucuaucuuuggcggccuuuuccugcuccuggcccugauuaucaucauugcgcucaaucgggucacagaguaucugaccaacaucaauguguuuuacugccacgaguguagcauguaucacuccaagaaaaacauuaaguacaucggggacuucaccaacaaaugcggauuuuguacaugcggcgaacuugaggaucaggaagggcugaagauucauaagguuagccgcaaaugcaucuacaaguaucagcucaccuggucuaaaaucauuaugaucauucuggugugucugcuuaucgcccagaauacaauucucaucgucgcugccuccaacgacugcugggcuaagaaaagccuggagauggaauguaucggaccucugcaacagguggagucuugcgacgauaaggccuccagaagcuacuccggcgaggccaagaaacucguucgggcuucuaagauuagcgaccuggaugcggcccagguggggcuucugggauccacgaucgaaucugcuauugccagcauccgcaaacagagaaccuaucccacaaugcaccuccuggaguccgucuuccuggccaagcauugugacuacuauaaauccuuugaacacaauucuggcuacucccaagcuaaguggcggcuuaccgccaagacacaucacuucgauauuugcagcagacacucuacccaucacuuuugucgcugcaucuccgacggcacgaaaugucagaacggggauugggacuucgcgggagagaugaauagcaccuaucagucuaagaaagauuucuucgaacaugacuucaagcucuuuugcacacugcuggagaacgcuuucccuggcaccacagagagcuuuuacuaccaaaugcuccagaaaaagaauaccacggggguggucaaacugcuugaugaacugacaaagaaguucggaaacaauaacauguuugugggcaucuggaaauucgggcaguaucucaugucccugcccuacauuaaugagaccagccugacaccgcuucagcucucuaagauccuggaagccuccgaccaacaccaccggagcauuuccggcagacaggagucucuggccaacgcugccagcggauccaaaucuaaggagugugaccaugcuaaaaagguuagcugcaucuccccucgcuuuggcgugcccauggaagggcucauugccugcggaucuagcccuaauuauaagaucuacaaaaugcccaccaagcuguauaaauccaacaauaagggcgaggucugguguagcggggaugugcacugcuuccaggaacuuaaccccgcgucucaggaguccguugaccggauuaaacaaaugaccuguuuucugacagaaccugagacgaacgaggauguguucagcaucgccaucucuaugugcaagguccaggacaagggaguguguaccauuaaugaagagagauggaacgugaucaaaugcgauuccggccucauuuacuauacagaccagcgcgaugggcaggacaccggcaaugauuuuggagaauacugucugagccauaacugccggaucgagagauucccgauuaaucccacaaucaucaacgacugucugugggaauaccacucucgcaaguccaaauauauuaccagccuugaucucgagucccuggaggaauuuaagcgggcuaucagcgagaaacugucucauacgcucauuguuuacaauuucaagccuacagccaaccugccccacaucaagccugucuauaaauacauuaccgugcaaggcguggaaaauagcgacggggucgauuccgcuuauaucaccgccucuaugcccgcgcuuagcggaacauccaucggcuacaacauuaugucuaaggacaauuucccgcuguuugacaucauuaucuucauuaaaagcgccgugaucaaggcuaccuauaaccacauuuacgauacagggccuacgaucggaaucaauguuaugcaugacgagcacugcaccggccagugucccacagauauuccucauaaagaaaacuggaucaccuuuucccaggagagaacaucucgcugggggugcgaggaauuuggcugccucgccgugaauaccggaugugucuuuggcagcugccaggacauuauccggcccgagacgaagguguacagaaaagcuauugaagaguccguucugcugaccguguguaucacauauccugggaagaccuucugcacagagaucaacgccauugaacccaagaucaccgaugagcuugaacugcaauuuaaaacagucgacaccaagacgcucccgaacauucuggccgugcagaauuacaaacucuauagcggacagaucaacgaucugggcucuuucucccaaggguguggaaauauucagaagacaaacagcucuaucaucggcaccgggaccgcuaaauuugacuacguuugccacggcgcgucccggaaggauauuaucgugcgcagauguuauaauaacaauuacgagagcugccggcuucugaaggaggaacagucccucauguucgccgacaaccaugagacaauugaugucgcuaaugugagacaucugcugggagaccuucaguuuaaacugaugcucggcgaucugcgcuauaagucuuucgccgaagacccugaccucgagaucgaagccaaauguguggggugccccagcuguuucaccuccuacagcugcaacuuucggauugucucuaauaucgauacgguuugcuccauugagggacccuguacaaccuuccacaacagacugaugaucacaagcaccaagcaagacuacggcaucaaaaugucuugcaaggggaagccuggaagcacagaagaguuucagauuuguaaaaagaccuauacggugcuuuucaccacaguggagaaaaaugauaagaucgaaauuaacaccggcgaccagacauccuuuauccaggagcgcgaugacagaugcaaaaccuggcugugucggguccgcgaugaaggcauuucugugaucuucgagccgaucagagcuuucuucgggagcuacuuuuccauugccuucuauaucguugugggaauuaucguccucuuucuggugauuuacaucuuccugcccauggcguuuaagcugcgggacguucugaagcgcaaugaauaucucuaccugcaagagaucaaacacaaguga

SEQ ID NO: 14169 - RNA, 4305 nt, Artificial Sequence
  derived and/or modified CDS sequence (opt5) from BATV(EIV-2077Astr)__KT313702.1__GP
augcuccuguuccugauccuucugauucccugcuacgccagcgcuuccccuguggucaccagauguuuucacggcgggcagcucaucgccgagucucggagcccgacagcgguuuccgaauuuugccugaaggacgaugugucuacgauuaaaagcgagaucauuuaugugaagaacgacaccggacuuuuugcucauaauaaaguccugcgcaacuggaucaucaaggauuggaaaaauuguaaccccgugccuacagccggcggguccauuaauguuaucgaagugaacaccgaccucucucugagcacaaagaccuacgucugcuccagagauuguacaauuaccguggacaaggaggaugcccaaaucauuuuccagacggaaaaacugaaucacuuugagguuagcggaaccacacucucuuccggcugguucaagaccaaagcuagcgugacacuggaccggaccugcgagcauaucaaggucacgugugggaaaaagacacuucaguuucacgccugcuucaagcaucacaugucuuguauucgcuuuuuccacggaaccauccugcccggcacaauggcuaccuccaucugccagaacauugaacucaucauuaucauuagccugacccuucugaucuuuauccucauggccauucugacaaaaacguauaucuguuaccugcucaugccucuguucaugcccauugcguaucuuuacggcuggucuuauaauagauccugcaagaaaugcagcuguugcgggcuggccuaccauccuuuuaccaacuguggaucccacugcguguguggccucaaguucgaggcuucugaucggaugcgcauccauagagaaagcgggcugugccaaggauacaaaucccuucggguggcccgccugcucuguaagagcaaagggucuucccugauuaucagcauccugcucucuaugcugauucuuagcuucgucacaccgaucgagggcacccugacaaauuaucccgaguccagaaaguacgaccucgaagagauugcugauguucuggaaggauuugugaccgagaagggcaucaaagaauauguggucuucuacacgucuauuuuuggcgggcuuuuccugcuccuggcccugaucauuaucaucgcgcucaaccgggugacagaguaucugaccaauauuaacguuuucuacugccacgaguguagcauguaucacuccaagaaaaauaucaaguacauuggagacuucaccaacaaaugcggcuuuuguacaugcggggaacuugaggaucaggaaggacugaagauccauaaggugagccgcaaaugcauuuacaaguaucagcucaccuggucuaaaaucaucaugauuauccuggucugucugcuuauugcccagaacacaauccucauuguggcugccuccaaugacugcugggcuaagaaaagccuggagauggaauguaucggcccucugcaacagauggagucuugcgacgauaaggccuccagaagcuacuccggggaggccaagaaacucguucgggcuucuaagaucagcgaccuggaugcggcccaggugggacuucugggcuccacgauugaaucugcuaucgccagcauucgcaaacagagaaccuaucccacaaugcaccuccuggaguccgucuuccuggccaagcauugugacuacuauaagagcuuugaacacaacucuggcuacucccaagcuaaauggcggcuuaccgccaagacacaucacuucgauaucugcagcagacacucuacccaucacuuuugucgcugcauuuccgacgggacgaaaugucagaauggagauugggacuucgcgggcgagaugaacagcaccuaucagucuaagaaagauuucuucgaacaugacuucaagcucuuuugcacacugcuggagaaugcuuucccugggaccacagagagcuuuuacuaccaaaugcuccagaaaaagaacaccacgggaguggucaaacugcuugaugaacugacaaagaaguucggcaauaacaauauguuuguggggaucuggaaauucggccaguaucucaugucccugcccuacaucaacgagaccagccugacaccgcuucagcucucuaagauucuggaagccuccgaccaacaccaccggagcaucuccggaagacaggagucucuggccaaugcugccagcggcgggaaauccaaggagugugaccaugcuaaaaagguuucuugcauuagcccucgcuuuggagugcccauggaaggccucaucgccugcgggggauccccuaacuauaagauuuacaaaaugcccaccaagcuguauaaaucuaauaacaagggcgaggucugguguagcggggaugugcacugcuuccaggaacuuaaucccgcgcugcaggaguccguugaccggaucaaacaaaugaccuguuuucucacagaaccugagacgaacgaggauguguucagcauugccaucucuaugugcaagguccaggacaagggcguguguaccaucaacgaagagagauggaaugugauuaaaugcgauuccggacugaucuacuauacagaccagcgcgauggccaggacaccgggaacgauuuuggagaauacugucugagccauaauugccggauugagagauucccgaucaaccccacaauuaucaaugacugucuuugggaauaccacucucgcaaguccaaauauaucaccagccucgaucuggagucucuggaggaauuuaagcgggcuauuuccgagaaacucagccauacgcugaucguuuacaacuucaagccuacagccaaucuuccccacauuaagccugucuauaaauacaucaccgugcaaggcguggaaaacuccgacggggucgauagcgcuuauauuaccgccucuaugcccgcgcugagcggaacauccaucggcuacaauaucaugucuaaggacaacuucccgcucuuugacauuaucauuuucaucaaaagcgccgugauuaaggcuaccuauaaucacaucuacgauacagggccuacgauuggcaucaacguuaugcaugacgagcacugcaccggacagugucccacagauaucccucauaaagaaaauuggauuaccuuuucccaggagagaacaucucgcuggggcugcgaggaauuugggugccuggccgugaacaccggaugugucuuuggcagcugccaggacaucauucggcccgagacgaagguguacagaaaagcuaucgaagaguccguucugcuuaccguguguauuacauauccugggaagaccuucugcacagagaucaaugccaucgaacccaagauuaccgaugagcuggaacuccaauuuaaaacagucgacaccaagacgcugccgaacauccucgccgugcagaaccacaaacuguacucuggacagauuaaugaucuuggcagcuucucccaaggguguggcaacauccagaagacaaauagcucuauuaucggaaccggcaccgcuaaauuugacuauguuugccauggggcgucccggaaggauaucauugugcgcagauguuacaacaauaacuaugagagcugccggcugcucaaggaggaacagucucugauguucgccgacaaucacgagacaaucgaugucgcuaacgugagacaucugcuuggagaccugcaguuuaaacucaugcugggcgaucuccgcuacaaguccuucgccgaagacccugaccuggagauugaagccaaauguguggggugccccagcuguuucaccuccuauucuugcaauuuucggaucgucagcaacauugauacgguuugcuccaucgagggacccuguacaaccuuccacaauagacuuaugauuacaagcaccaagcaagacuacggcaucaaaaugucuugcaagggcaagccuggguccacagaagaguuucagaucuguaaaaagaccuacacggugcuguucaccacaguggagaaaaacgauaagauugaaaucaauaccggagaccagaccagcuuuauucaggagcgcgaugacagaugcaaaacauggcucugucggguccgcgaugaaggcaucucugugguuuucgagccgauuagagccuuuuucgggagcuauuuuuccaucgcuuucuacaucguggucggaauuaucgugcuguuucugguuauuuauaucuuccuucccauggcguuuaagcugcgggacgugcucaagcgcaacgaauaccuguaucuccaagagauuaaacacaaguga

SEQ ID NO: 14170 - RNA, 4305 nt, Artificial Sequence
  derived and/or modified CDS sequence (opt5) from BATV(Italy-2009)__KC168047.1__GP
augcuccuguuccugauccuucugauucccugcuacgccagcgcuuccccuguggucaccagauguuuucacggcgggcagcucaucgccgagucucggagcccgacagcgguuuccgaauuuugccugaaggacgaugugucuacgauuaaaagcgagaucauuuaugugaagaacgacaccggacuuuuugcucauaauaaaguccugcgcaacuggaucaucaaggauuggaaaaauuguaaccccgugccuacagccggcggguccauuaauguuaucgaagugaacaccgaccucucucugagcacaaagaccuacgucugcuccagagauuguacaauuaccguggacaaggaggaugcccaaaucauuuuccagacggaaaaacugaaucacuuugagguuagcggaaccacacucucuuccggcugguucaagaccaaagcuagcgugacacuggaccggaccugcgagcauaucaaggucacgugugggaaaaagacacuucaguuucacgccugcuucaagcaucacaugucuuguauucgcuuuuuccacuccaccauccugcccggaacaauggcuaccagcaucugccagaacauugaacucaucauuaucauuucucugacccuucugaucuuuauccucauggccauucugacaaaaacguauaucuguuaccugcucaugccucuguucaugcccauugcguaucuuuacggcugguccuauaauagaagcugcaagaaaugcuccuguugcggccuggccuaccauccuuuuaccaacugugggucucacugcguguguggacucaaguucgaggcuagcgaucggaugcgcauccauagagaauccggccugugccaaggguacaaaagccuucggguggcccgccugcucuguaagucuaaaggauccagccugauuaucucuauccugcucagcaugcugauucuuuccuucgucacaccgaucgagggcacccugacaaauuaucccgagucuagaaaguacgaccucgaagagauugcugauguucuggaaggguuuaucaccgagaagggaauuaaagaauaugugguguucuacacgagcaucuuuggcggccuuuuccugcuccuggcccugauuaucaucauugcgcucaaccgggucacagaguaucugaccaauaucaacguguuuuacugccacgaguguuccauguaucacagcaagaaaaauauuaaguacaucggggacuucaccaacaaaugcggauuuuguacaugcggcgaacuugaggaucaggaagggcugaagauucauaagguuucucgcaaaugcaucuacaaguaucagcucaccugguccaaaaucauuaugaucauucuggugugucugcuuaucgcccagaacacaauucucaucgucgcugccagcaaugacugcugggcuaagaaaucucuggagauggaauguaucggaccucugcaaagaguggaguccugcgacgauaaggccagccgguccuacucuggcgaggccaagaaacucguucgcgcuagcaagauuuccgaccuggaugcggcccagguggggcuucugggaucuacgaucgaaagcgcuauugccuccaucagaaaacagcggaccuaucccacaaugcaccuccuggagagcgucuuccuggccaagcauugugacuacuauaaaucuuuugaacacaacuccggcuacagccaggcuaaguggagacuuaccgccaagacacaucacuucgauauuugcucucgccacuccacccaucacuuuugucggugcaucagcgacggcacgaaaugucaaaauggggauugggacuucgcgggagagaugaacucuaccuaucagagcaagaaagauuucuucgaacaugacuucaagcucuuuugcacacugcuggagaaugcuuucccuggcaccacagaguccuuuuacuaccagaugcuccagaaaaagaacaccacggggguggucaaacugcuugaugaacugacaaagaaguucggaaauaacaauauguuugugggcaucuggaaauucgggcaauaucucaugagccugcccuacauuaacgagaccucucugacaccgcuucagcucuccaagauccuggaagccagcaaucagcaccacagauccauuucuggccgccaagagagccuggccaacgcugccuccggaggcaaaucuaaggagugugacaaugcuaaaaagguuagcugcaucuccccucgguuuggggugcccauggaaggacucauugccugcggcucuagcccuaacuauaagaucuacaaaaugcccaccaagcuguauaaauccaauaacaagggggaggucugguguagcggagacgugcauugcuuccaggaacuuaaccccgcgucucaggaguccguugauagaauuaaacagaugaccuguuuucugacagaaccugagacgaaugaggacguguucagcaucgccaucucuaugugcaagguccgcgauaagggcguguguaccauuaacgaagaacgguggaaugugaucaaaugcgacuccgggcucauuuacuauacagaucaaagagacggccaggauaccggaaacgacuuuggcgaauacugucugagccacaauugccgcaucgagcgguucccgauuaaccccgcuaucaucaaugauugucugugggaauaccauucuagacgcuccaaguauauuacaagccuugaccucgagucccuggaggaauuuaaacgggccaucagcgagaagcugucucacacccucauuguuuacaacuucaaaccuacggcuaaucugccccauaucaagccugucuauaaguacauuacagugcaggggguggaaaacagcgauggagucgacuccgccuauaucaccgcgucuaugcccgcccuuagcggcaccuccaucggguacaauauuaugucuaaagauaacuucccgcuguuugacaucauuaucuucauuaagagcgcugugaucaaagccacauauaaucacauuuacgacaccggaccuacaaucggcaucaacguuaugcacgaugagcauugcacggggcagugucccaccgacauuccucacaaggaaaauuggaucacauuuucccaagagagaaccucucgguggggcugcgaggaguucggaugccucgcugugaacacaggcugugucuuugggagcugccaggauauuauccgccccgagaccaaaguguacagaaaggccauugaagagaacguucugcugacgguguguaucaccuauccuggaaaaacauucugcaccgagaucaaugccauugaacccaagaucacagacgagcuugaacugcaguuuaagaccgucgauacaaaaacccucccgaacauucuggcugugcagaaucauaagcucuacuccggccaaaucaacgaccuggggagcuucucucagggauguggcaauauucagaaaacgaacuccagcaucaucgggacaggcaccgcgaaguuugauuauguuugccacggagccucucggaaagacauuaucgugagacgcuguuacaauaacaauuaugaguccugccggcuucugaaggaggaacaaagccucauguucgcugauaaccaugagaccauugacgucgccaaugugagacaucugcugggcgaucuucaguuuaagcugaugcucggggaccugcgcuacaaauccuucgccgaagauccugaccucgagaucgaagcuaagugugugggaugccccucuuguuucacaagcuauuccugcaacuuuagaauugucagcaauaucgacaccguuugcucuauugagggccccuguacgacauuccacaaccggcugaugaucaccuccacaaaacaggauuacgggaucaagaugagcugcaaaggaaagccuggcucuaccgaagaguuucagauuuguaagaaaacauacaccgugcuuuucacgaccguggagaagaaugacaaaaucgaaauuaacacaggcgaucaaaccagcuuuauccaggagcgcgacgauagaugcaagacauggcugugucggguccgcgacgaagggauuuccgugaucuucgagccgaucagagccuuuuucggaucuuauuuuagcauugcguucuacaucguugugggcauuaucguccucuuucugaugauuuauaucuuccugcccauggcuuuuaaacuucgggaugugcugaagcgcaacgaauaccucuaucugcaggagaucaagcacaaauga

SEQ ID NO: 14171 - RNA, 4305 nt, Artificial Sequence
  derived and/or modified CDS sequence (opt5) from BATV(MM2222)__AB257763.1__GP
augcugcuccugcuugugcugcucaucagcugcugugucuccgccucucccguuauuaccagaugcuuccacggcgggcagcugaucgcugagcggaaaagccaaacagccauuuccgaauuuugucuuaaagacgaugugucuacgaucaagagcgagauuaucuacgaaaagaacgacaccggacuguucgcgcauaauaaggugcuccgcaacuggaucauuaaagauuggaagaauugcaacccugucccgacagcuggcggguccaucaaugugauugagguuaacaccgaccugucucugacaaccaagacauauguguguagcagagauugcaccaucacggucgacaaagaagaugcccagauuguguuucagaccgagaagcucaaucacuucgagguuuccggaacaacccugagcucuggcugguuuaaaacaaaggccuccgugacccuugaccggacgugugaacauaucaaagucacaugcgggaagaagacccugcaguuccacgcuuguuuuaaacaucacaugagcugcauucgcuucuuucacggaacaauccuccccggcaccauggccaccucuaucugucaaaacauugagcugaucauuaucauuucccuuacacugaucaucuucauucucauggugauccugacgaagaccuacauuugcuaucugcucaugccucuguuuaugcccaucgcuuacuucuauggcuggagcuacaauaaaucuugcaagaaauguccuugcugugggcuugccuaucaucccuuuacaaacugcggaucccacugugugugcggccugaaguucgaagcgagcgauagaaugcggauucaucgcgaguccgggcucugucagggauacaaaucucugagagucgcccggcuucugugcaagagcaagggcuccagccucaucaucucuauucugcuguccaugcucauccugagcuucguuaccccuauugaggggacacuuaccaauuacccggaaucucgcaaauauaaccuggaggaaaucgcugacgugcucgagggauuuguggucgaaaagggcauuaaagaguacgugguuuucuauacgagcaucuuuggcgcccuguuccuucugauggcucucauugugaucaucgcccugaauagagucacagaguaccugaccaacauuaaugugcucuauugucacgaaugcuccauguaccacucuaagaaaaacaucaaguauauuggggauuuuaccaacaaguguggauucugcacaugcggcgagcuggaagaccaggaggggcuuaaaauccauaagguuagccggaaauguauuuacaaguaccagcugaccugguccaaaaucaucaugaugauucucgugugccugcugaucgcgcaaaauacaauucuuaucgucgccgcuagcgaugacuguuggacgaagaagucucucgaaauggagugcauuggaccccugcaacagguggacaccugugaggauaaaacaucccgcagcuauucuggcgaagccaagaaacuggucagagcuuccaagaucagcgaccucgaugccgcccagguggggcugcuuggauccaccaucgagucugcuauugcgagcauccggcgccagagaacauacuccaccaugcaccuucucgaaucuguuuuucugggcaaacauugcgacuauuacaagguguucgagcacaacagcggcuauucccaggccaaguggcggcugacggcuaaaacccaucacuuugauauuuguagcagacacucuacacaucacuucugccgcuguaucuccgacgggaccaagugccagaauggagauugggacuuugccggcgaaaugaacagcauuuaccaaucuaaacgggauuucuuuaagcaugacuucaaacuuuucuguacacucaucgaggaugccuuuccugggaccacggagucccuguucuaugaaaugcugagcaagaaaaauacaaccggaaucacaaagcuccuggacaagcugaccaaaaaguuuggcaacaauaacauguucgucgggauuuggaaauuuggccaguaccugaugucucuccccuacgugaaugagaccagccuguccccuacacagcuggcuaagguucuugaagugacggaccaccaccauagaagcaucucuggacgccaggagucccucgccagcgcgaccuccggcucuaaaagcuccgagugcgaucacgcuaagaaggucucuugcauuagcccccgguucggggugccgauggaaggacugaucgccuguggcaacuccccuaauuauaaaauuuacaagacacccgccaaacuguauaagucuaacaauaaaggggagguguggugcagcggagacguucauuguuuucaagaacucaucccugcuucccaggagagcgucgauagaauuaagcagaugaccugcuuccugacagaacccgaggugaacgacgauguguuuucuaucgccaucuccauguguaagguccaggacaaaggcgugugcaccauuaaugaggaucgcuggaacguuaucaagugugacagcgggcuuauuuacuauacggaucaacgggaaggccaggacacaggaaacgauuucggcgaguacugccugucucacuccuguagaaucgaacgcuuucccauuaauccuaccaucaucagcgacugccucugggaguaucauucucggaaauccaaguacauuaccagccuggaucuggaaucccuugaggaguucaaaagagcuaucagcgaaaagcucucucacacacugauuguguacaacuuuaagccgaccgccaaucugccccacaucaaaccugucuauaaguacauuacagugcaggggguugagaacagcgacggaguggacuccgcguauaucacggccucuaugcccgcucucagcggcaccuccaucggguacaauauuaugucucgcgauaacuucccucuguucgacaucauuaucuuuauuaaaagcgccaucauuaaggcuacauauaaucauaucuacgauaccggacccacaaucggcauuaacgucaugcacgacgaacauuguaccgggcagugcccgacggauaucccucacaaagagaauuggauuaccuucgcccaagaacggacauccagauggggcugcgaggaguuuggaugucuugcggugaacaccggcugcguuuucgggucuugucaggacaucauucggcccgaaacaaagguguaucgcaaagccgucgaggaaagcgugcugcucaccgugugcaucacauacccuggaaagaccuuuuguacggagaucaaugcuauugagcccaagaucacagaugaacuggagcugcaguucaaaaccgucgacaccaagacacuuccuaacauucuggccguucagaaucauaaacucuacuccggccaaaucaacgaucuggggagcuuuucucagggaugcggcaauauucagaagaccaacuccagcaucaucgggacgggcacagcuaaauucgacuaugugugucacggagccucuagaaaggauauuaucgugcggagaugcuacaacaauaacuaugaauccuguaagcuccugaaagaggaacaaagccuuauguuugccgacaaucacgagaccauugaugucgcuaacgugcgccaucugcucggcgaccugcaguucaagcugaugcuuggggaccugcgguacaaauccuuugcggagaaucccgaucucgaaaucgaggccaagugcguuggauguccgucuugcuucacaagcuauuccugcagcuucaaaauugugucuaacaucgacaccgucuguuccauugaaggcccuugcacaaccuuucacaauagacugaugaucacgagcaccaagcaggauuacgggaucaagaugucuuguaaaacaaagcccggacccauugaggaauuucagaucugcaaaaagaccuauacaauucucuucaccacgguggagaaaaacgacaagaucgagauuagcacaggcgaucaaaccuccuucauccaggaaaaggacgaucgcuguaaaacauggcugugcagaguucgggacgagggcaucucugugauuuuugaaccuauccgcgcuuucuuugggagcuacuucuccauugccuuuuacaucgucauuggaaucaucgugcuuuuccugguuauuuauaucuuucucccgaugauguucaagcugagagaugugcugaaacggaaugaguaccuuuaucugcaggaaauuaagcauaaauga

SEQ ID NO: 14172 - RNA, 4305 nt, Artificial Sequence
  derived and/or modified CDS sequence (opt5) from BATV(MM2222)__AY772534.1__GP
augcugcuccugcuugugcugcucaucagcugcugugucuccgccucucccguuauuaccagaugcuuccacggcgggcagcugaucgcugagcggaaaagccaaacagccauuuccgaauuuugucuuaaagacgaugugucuacgaucaagagcgagauuaucuacgaaaagaacgacaccggacuguucgcgcauaauaaggugcuccgcaacuggaucauuaaagauuggaagaauugcaacccugucccgacagcuggcggguccaucaaugugauugagguuaacaccgaccugucucugacaaccaagacauauguguguagcagagauugcaccaucacggucgacaaagaagaugcccagauuguguuucagaccgagaagcucaaucacuucgagguuuccggaacaacccugagcucuggcugguuuaaaacaaaggccuccgugacccuugaccggacgugugaacauaucaaagucacaugcgggaagaagacccugcaguuccacgcuuguuuuaaacaucacaugagcugcauucgcuucuuucacggaacaauccuccccggcaccauggccaccucuaucugucaaaacauugagcugaucauuaucauuucccuuacacugaucaucuucauucucauggugauccugacgaagaccuacauuugcuaucugcucaugccucuguuuaugcccaucgcuuacuucuauggcuggagcuacaauaaaucuugcaagaaauguccuugcugugggcuugccuaucaucccuuuacaaacugcggaucccacugugugugcggccugaaguucgaagcgagcgauagaaugcggauucaucgcgaguccgggcucugucagggauacaaaucucugagagucgcccggcuucugugcaagagcaagggcuccagccucaucaucucuauucugcuguccaugcucauccugagcuucguuaccccuauugaggggacacuuaccaauuacccggaaucucgcaaauauaaccuggaggaaaucgcugacgugcucgagggauuuguggucgaaaagggcauuaaagaguacgugguuuucuauacgagcaucuuuggcgcccuguuccuucugauggcucucauugugaucaucgcccugaauagagucacagaguaccugaccaacauuaaugugcucuauugucacgaaugcuccauguaccacucuaagaaaaacaucaaguauauuggggauuuuaccaacaaguguggauucugcacaugcggcgagcuggaagaccaggaggggcuuaaaauccauaagguuagccggaaauguauuuacaaguaccagcugaccugguccaaaaucaucaugaugauucucgugugccugcugaucgcgcaaaauacaauucuuaucgucgccgcuagcgaugacuguuggacgaagaagucucucgaaauggagugcauuggaccccugcaacagguggacaccugugaggauaaaacaucccgcagcuauucuggcgaagccaagaaacuggucagagcuuccaagaucagcgaccucgaugccgcccagguggggcugcuuggauccaccaucgagucugcuauugcgagcauccggcgccagagaacauacuccaccaugcaccuucucgaaucuguuuuucugggcaaacauugcgacuauuacaagguguucgagcacaacagcggcuauucccaggccaaguggcggcugacggcuaaaacccaucacuuugauauuuguagcagacacucuacacaucacuucugccgcuguaucuccgacgggaccaagugccagaauggagauugggacuuugccggcgaaaugaacagcauuuaccaaucuaaacgggauuucuuuaagcaugacuucaaacuuuucuguacacucaucgaggaugccuuuccugggaccacggagucccuguucuaugaaaugcugagcaagaaaaauacaaccggaaucacaaagcuccuggacaagcugaccaaaaaguuuggcaacaauaacauguucgucgggauuuggaaauuuggccaguaccugaugucucuccccuacgugaaugagaccagccuguccccuacacagcuggcuaagguucuugaagugacggaccaccaccauagaagcaucucuggacgccaggagucccucgccagcgcgaccuccggcucuaaaagcuccgagugcgaucacgcuaagaaggucucuugcauuagcccccgguucggggugccgauggaaggacugaucgccuguggcaacuccccuaauuauaaaauuuacaagacacccgccaaacuguauaagucuaacaauaaaggggagguguggugcagcggagacguucauuguuuucaagaacucaucccugcuucccaggagagcgucgauagaauuaagcagaugaccugcuuccugacagaacccgaggugaacgacgauguguuuucuaucgccaucuccauguguaagguccaggacaaaggcgugugcaccauuagcgaggaucgcuggaauguuaucaagugugacucugggcuuauuuacuauacggaucaacgggaaggccaggacacaggaaacgauuucggcgaguacugccugucccacagcuguagaaucgaacgcuuucccauuaacccuaccaucaucucugacugccucugggaguaucauucccggaaaagcaaguacauuaccucccuggaucuggaaagccuugaggaguucaaaagagcuaucucugaaaagcucagccacacacugauuguguacaauuuuaagccgaccgccaaccugccccacaucaaaccugucuauaaguacauuacagugcaggggguugaaaauuccgacggaguggacucugcguauaucacggccagcaugcccgcucucuccggcaccucuaucggguacaacauuaugagccgcgauaauuucccucuguucgacaucauuaucuuuauuaaauccgccaucauuaaggcuacauauaaccauaucuacgauaccggacccacaaucggcauuaaugucaugcacgacgaacauuguaccgggcagugcccgacggauaucccucacaaagagaacuggauuaccuucgcccaagaacggacaucuagauggggcugcgaggaguuuggaugucuugcggugaauaccggcugcguuuucgggagcugucaggacaucauucggcccgaaacaaagguguaucgcaaagccgucgaggaauccgugcugcucaccgugugcaucacauacccuggaaagaccuuuuguacggagaucaacgcuauugagcccaagaucacagaugaacuggagcugcaguucaaaaccgucgacaccaagacacuuccuaauauucuggccguucagaaccauaaacucuacagcggccaaaucaaugaucuggggucuuuuucccagggaugcggcaacauucagaagaccaauagcucuaucaucgggacgggcacagcuaaauucgacuaugugugucacggagccuccagaaaggauauuaucgugcggagaugcuacaacaacaauuaugaaagcuguaagcuccugaaagaggaacaaucccuuauguuugccgacaaccacgagaccauugaugucgcuaaugugcgccaucugcucggcgaccugcaguucaagcugaugcuuggggaccugcgguacaaaucuuuugcggagaaccccgaucucgaaaucgaggccaagugcguuggauguccgagcugcuucacauccuauagcugcucuuucaaaauuguguccaauaucgacaccgucuguagcauugaaggcccuugcacaaccuuucacaacagacugaugaucacgucuaccaagcaggauuacgggaucaagaugagcuguaaaacaaagcccggacccauugaggaguuccagaucugcaaaaagaccuauacaauucucuuuaccacgguggagaaaaaugacaagaucgagauuuccacaggcgaucaaaccucuuucauccaggaaaaggacgaucgcuguaaaacauggcugugcagaguucgggacgagggcaucagcgugauuuuugaaccuauccgcgcuuucuuuggguccuacuucucuauugccuuuuacaucgucauuggaaucaucgugcuuuuccugguuauuuauaucuuucucccgaugauguucaagcugagagaugugcugaaacggaacgaguaccuuuaucugcaggaaauuaagcauaaauga

SEQ ID NO: 14173 - RNA, 4305 nt, Artificial Sequence
  derived and/or modified CDS sequence (opt5) from BATV(MM2222)__JX846596.1__GP
augcugcuccugcuugugcugcucaucagcugcugugucuccgccucucccguuauuaccagaugcuuccacggcgggcagcugaucgcugagcgcaagagccaaacagccauuuccgaauuuugucuuaaagacgaugugucuacgaucaagagcgagauuaucuacgaaaagaacgacaccggacuguucgcgcauaauaaggugcuccggaacuggaucauuaaagauuggaagaauugcaacccugucccgacagcuggcggguccaucaaugugauugagguuaacaccgaccugucucugacaaccaagacauauguguguagcagagauugcaccaucacggucgacaaagaagaugcccagauuguguuucagaccgagaagcucaaucacuucgagguuuccggaacaacccugagcucuggcugguuuaaaacaaaggccuccgugacccuugaccggacgugugaacauaucaaagucacaugcgggaagaagacccugcaguuccacgcuuguuuuaaacaucacaugagcugcauucgcuucuuucacggaacaauccuccccggcaccauggccaccucuaucugucaaaacauugagcugaucauuaucauuucccuuacacugaucaucuucauucucauggugauccugacgaagaccuacauuugcuaucugcucaugccucuguuuaugcccaucgcuuacuucuauggcuggagcuacaauaaaucuugcaagaaauguccuugcugugggcuugccuaucaucccuuuacaaacugcggaucccacugugugugcggccugaaguucgaagcgagcgauagaaugcggauucaucgcgaguccgggcucugucagggauacaaaucucugagagucgcccggcuucugugcaagagcaagggcuccagccucaucaucucuauucugcuguccaugcucauccugagcuucguuaccccuauugaggggacacuuaccaauuacccggaaucucgcaaauauaaccuggaggaaaucgcugacgugcucgagggauuuguggucgaaaagggcauuaaagaguacgugguuuucuauacgagcaucuuuggcgcccuguuccuucugauggcucucauugugaucaucgcccugaauagagucacagaguaccugaccaacauuaaugugcucuauugucacgaaugcuccauguaccacucuaagaaaaacaucaaguauauuggggauuuuaccaacaaguguggauucugcacaugcggcgagcuggaagaccaggaggggcuuaaaauccauaagguuagccggaaauguauuuacaaguaccagcugaccugguccaaaaucaucaugaugauucucgugugccugcugaucgcgcaaaauacaauucuuaucgucgccgcuagcgaugacuguuggacgaagaagucucucgaaauggagugcauuggaccccugcaacagguggacaccugugaggauaaaacaucccgcagcuauucuggcgaagccaagaaacuggucagagcuuccaagaucagcgaccucgaugccgcccagguggggcugcuuggauccaccaucgagucugcuauugcgagcauccggcgccagagaacauacuccaccaugcaucugcucgaaucuguuuuucugggcaaacacugcgacuauuacaagguguucgagcacaacagcggcuauucccaggccaaguggcggcugacggcuaaaacccaucacuuugauauuuguagcagacacucuacacaucacuucugccgcuguaucuccgacgggaccaagugccagaauggagauugggacuuugccggcgaaaugaacagcauuuaccaaucuaaacgggauuucuuuaagcaugacuucaaacuuuucuguacacucaucgaggaugccuuuccugggaccacggagucccuguucuaugaaaugcugagcaagaaaaauacaaccggaaucacagagcuccuggacaaacuuaccaagaaauuuggcaacaauaacauguucgucgggauuuggaaguuuggccaguaccugaugucucuccccuacgugaaugaaaccagccuguccccuacacagcuggcuaaaguucuugaggugacggaccaccaccauagaagcaucucuggacgccaggagucccucgccagcgcgaccuccggcucuaagagcuccgaaugcgaucacgcuaaaaaggucucuugcauuagcccccgguucggggugccgauggagggacugaucgccuguggcaacuccccuaauuauaagauuuacaaaacacccgccaagcuguauaaaucuaacaauaagggggaaguguggugcagcggagacguucauuguuuucaagagcucaucccugcuucccaggaaagcgucgauagaauuaaacagaugaccugcuuccugacagagcccgaggugaacgacgauguguuuucuaucgccaucuccauguguaagguccaggacaagggcgugugcaccauuaaugaagaucgcuggaacguuaucaaaugugacagcgggcuuauuuacuauacggaucaacgggagggccaggacacaggaaacgauuucggcgaauacugccugucucacuccuguagaaucgagcgcuuucccauuaauccuaccaucaucagcgacugccucugggaauaucauucucggaaguccaaauacauuaccagccuggaucuggagucccuugaggaguucaagagagcuaucagcgagaaacucucucacacacugauuguguacaacuuuaagccgaccgccaaucugccccacaucaagccugucuauaaauacauuacagugcaggggguugaaaacagcgacggaguggacuccgcguauaucacggccucuaugcccgcucucagcggcaccuccaucggguacaauauuaugucucgcgauaacuucccucuguucgacaucauuaucuuuauuaagagcgccaucauuaaagcuacauauaaucauaucuacgauaccggacccacaaucggcauuaacgucaugcacgacgagcauuguaccgggcagugcccgacggauaucccucacaaggaaaauuggauuaccuucgcccaagagcggacauccagauggggcugcgaggaauuuggaugucuugcggugaacaccggcugcguuuucgggucuugucaggacaucauucggcccgagacaaaaguguaucgcaaggccgucgaagagagcgugcugcucaccgugugcaucacauacccuggaaaaaccuuuuguacggagaucaaugcuauugaacccaagaucacagaugagcuggaacugcaguucaagaccgucgacaccaaaacacuuccuaacauucuggccguucagaaucauaagcucuacuccggccaaaucaacgaucuggggagcuuuucucagggaugcggcaauauucagaaaaccaacuccagcaucaucgggacgggcacagcuaaguucgacuaugugugucacggagccucuagaaaagauauuaucgugcggagaugcuacaacaauaacuaugaguccuguaagcuccugaaggaagaacaaagccuuauguuugccgacaaucacgagaccauugaugucgcuaacgugcgccaucugcucggcgaccugcaguucaaacugaugcuuggggaccugcgguacaaguccuuugcggaaaaucccgaucucgagaucgaagccaaaugcguuggauguccgucuugcuucacaagcuauuccugcagcuucaagauugugucuaacaucgacaccgucuguuccauugagggcccuugcacaaccuuucacaauagacugaugaucacgagcaccaaacaggauuacgggaucaagaugucuuguaagacaaaacccggacccauugaagaguuccagaucugcaagaaaaccuauacaauucucuuuaccacgguggagaagaacgacaaaaucgaaauuagcacaggcgaucaaaccuccuucauccaggagaaggacgaucgcuguaagacauggcugugcagaguucgggacgaaggcaucucugugauuuuugagccuauccgcgcuuucuuugggagcuacuucuccauugccuuuuacaucgucauuggaaucaucgugcuuuuccugguuauuuauaucuuucucccgaugauguucaaacugagagaugugcugaagcggaaugaauaccuuuaucugcaggagauuaaacauaaguga

SEQ ID NO: 14174 - RNA, 4305 nt, Artificial Sequence
  derived and/or modified CDS sequence (opt5) from BATV(MS50)__JX846605.1__GP
augaagaugcugacccucaucauuaucgugagcugcugggucgccacacugcagaacccccuuauuuccagauguuuccacggcgggcaacugaucgcugagaaaaagucucucacgagcauuuccgaauuuugcaucaaagacgauguuucuaugcugaaaagcgaggugaucuaccagaaaaaugacaccggaauuuauggccauuccaagguguuccggcacuggacaaucgccgauuggaaguacuguaacccugucccgaccgcugggggaucuauuaaugugaucgaacuugacaaaaaccugaaucucauugcuaagaacuauguuugcacacgcgauuguaccaucacaguggacaaagagaaugcccagauugucuuucagaccgauaagcugaaccauuucgaagugacgggcaccacaaucagcaccgggugguuuaaaacaaaggccuccguugcucuggacagaaccugcgagcacaucaaggugagcuguggaaagaagacgcuccaauuccaugccugcuuuaaacagcacaugucuuguguccgguuccugcaccgcuccaugcuucccggcagcauggcuaauucuauuugccagaacaucgagcugauuaucauuaucacacucacccuggugaucuuuauucuuaugcugaucgccacaagauucuacauuuguuaucuccugaucccuguguuuaugcccauugcguacgccuauggcugggcuuacaaucgguccugcaagaaaugcagcuguugcgggcuggccuaccauccuuucaccaacuguggaucuuauugcgucuguggcgcucgcuuugaaaccuccgauagaaugcggcuccaccgcgagagcgggcugugccagggauucaagucccuuagaauggcccggcgccuguguaaaucuaagggcagcucccucguuaucagcauccugcuugcgacacugauucucucuuucgugacgcccaucgaagggaccaugacaaauuacccuaccaacgagaaguauucccuggacgagauugccgaugugcugaaauggaaggaacaagagagcgaauacaaauauuacgcuauccucuaugccucuauuaucggagcuugcuuuacaguccuguucgccggcaccgcccuugcucugaauauugugcucgagcugcuuacgaagaucaacguuaucuacugugaagagugcagcauguaccauuccaaaucuaacauuaaguauaucggcgacuuuacaaauaaguguggguucuguaccugcggacugcucgaggauccggacggcguggucgugcacaaaguuaagagaagcugcaccuaccaguauaaacugacaugggugaagaccauuaugaucguccuguccauucucuuucugcuucagaacaucaucgugauugucgcggccgacagcgauugcuggacaaaugaggaacugaaacccgaauguguggggccucucaucgcucccgccgacugcacggagaaggauaagaaaaccuaccugacagaagccgcugcccugguuaagaccaaaaagauuucucagguggacgcggauaacgucgagauccuuggaaaaacaauugaguccgcuaucaaggccaucgaaaagcagaaaaccuaucaccggaugcaucuccuggaggccguguuccugaauaagcacugugacuacuauaaacucuuugaacauaacagcggcuacucucaaguuaaguggcgcaugcuggcuaaaacgcagcacuucgauauuugcgccuuugcuaaggaguccaaauucuguaagugcauggccgggggagcgugugccgaagacagcugggauuuugacaccacaaugaacuccaccuacacaucuaagggcgauaauuucaaacaugacaugagccuuuuucugaagaucuucgaggcugccuucccuggcaccuccuauguguacaugcucaauaaaauuaaggagaaaaagcccuaucaaucugucacgaugaucgacaagauuaaaacaaaguacccgaacaauaaaaugcugguggcuuaucuggaauuugggaagugccuuaugggagugggccacgccagcaccuucgagcuccagcagucccagcuggaaagacuguaccaaccugcggagcucagccggucuguugggcagcugacaucccuuagcaacgcccaggucggaaccaucaccaaagaguguucuaaguauaaggauaucuccugccugagccccagauuuggcauuccuauggaaaauaugguggcuugcggggacucucccaacuacaaaaucuacaagaaacccauuaagguguauaaagcccacgaucgcgucgagacaugguguaucaaggaccagcauugccucguggauuacacgccugcugaagccgacguugugaagaaacugaagaccaugaaauguuggcugaaugauccgggcacagagaccgacgccuauacaaccgcuauuaagagcugccggaucauggauaaaggagucuguacggugaacggccaaaagugguccauuaucaaaugcgacagcgaucuucucuacuauacagaccacaucgaaggggaggauaccggaaacgacauuggccauuacuguaucucuguugggugcaagaccgacagauaucccauuaauccugauaucgugacagacuguaccugggaguucaagucccgcaaaagcuccuacauuggaaagaucucuaugcagagccuggaagauuacaaaaaggcgcugacagacaaacucacgcacacccuggagacauauuccuuugcccccaccgcugaucuuccucacaucaagcccauuuacaaguauaucacagcccagggcgucgaaaacucugacgggauugagggcgccuacaucaccgcuacgauuccggcccugggaggcaccagcaucggguauuccgugcagucuaaagauggauucccucuccuggaccugaucauuuacaucaaggcggcuguuauucggagcacauauauccaucuuuacgauaccggccccacaauuuccaucaauaccaaacacgacgaaaagugcacagggcaauguccugccgagauugagcaugaagccaacuggcucaccuuuagccaggagagaacgucucgcuggggaugcgaagaguucggcugccuggcuaucaauacaggguguguguuuggcuccugccaggaugucauccggcccgaaaccaaaguguacagaaagagcguggaggaggaagucguucugaccguguguauuaacuauccuggaaauacauucugcaccgagaucaacgccauugaacccaagaucacggaggagguggaacuccaguuuaaaacagucgacaccaagacacugccgacccuucuggcggugacaaaucacaaacucuucucuggccaaauuaacgaucuggggaccuuuggacagauguguggcaauguucagaagacgaacuccagcauccuggggucuggaaccccuaaauucgacuacacaugccauggcgcuucccgcaaggacaucauugugcggaaguguuauaauaacaauuacgauagcugcaaacuucugaaggaggaaaaacaacucgucuucaacgacgaucacgagaccaucacagugguuaacaauagacaccuggugggggaacucgccauuaagcugauccuuggcgacauucaguauaaacuguuuaccgagaagcucgaucugcagaucgacgccaagugugucggaugccccgauuguuucgaguccuacgcuugcaacuuucagaucgugagcaauauugacacgguuugcgccaucaacggccccugugauauuuuccauaaucgcaucucuauucggagcacacaacagaacuauggggugaaaauguccugcaagagaaccccugaccagaaugaaaaauuugucaucuguggacgggaguacucuguguucuuucacacagugcagaagaacgauaaaauugaaaucaauaccggcgaccaaaccagcuacaucaaggagauggacacacgcugcaaaacguggcuguguagaguccgggaugaagggcuuuccguuauuuucgagccgaucaaggcguuuuucggaucuuauuuuagcauugccuucuacaucgugcuguucauuaucaucgcguuucucgugauuuauaucuucaugcccauguuuaugaagcugagagacauucucaaacagaacgagaagcuguaccuucaggaaaucaaacagaaguga

SEQ ID NO: 14175 - RNA, 4305 nt, Artificial Sequence
  derived and/or modified CDS sequence (opt5) from BATV(NM/12)__KJ187039.1__GP
augcugcuccugcuugugcugcucauccccugcugugucagcgccuccccugcuauuaccagaugcuuccacggcgggcagcugaucgccgagcggaagucucaaacagcgauuagcgaauuuugucuuaaagacgauguuuccacgaucaagucugagauuaucuacgagaaaaacgacaccggacuguucgcucauaauaaggugcuccgcaacuggaucauuaaagauuggaagaauugcaacccggugcccacagccggcgggagcaucaaugucauugaagugaacaccgaccugucccugacaaccaagacauauguuuguucuagagauugcaccaucacgguggacaaagaagaugcccagauuaucuuucggaccgagaagcucaaucacuucgaggucagcggaacaacccuguccagcggcugguuuaaaacaaaggcuucugugacccuugaccgcacgugugaacauauuaaaguuacaugcgggaagaagacccugcaguuccacgccuguuuuaaacaucacauguccugcaucagauucuuucacggaacaauccucccuggcaccauggcuaccagcauuugucagaacaucgagcugauuaucauuaucucucuuacacugaucauuuucauccucauggugauucugacgcggaccuacaucugcuaucugcucaugccccuguuuaugccuauugccuacuucuauggcugguccuacaauaagagcugcaaaaagugucaaugcugugggcuugcguaucaucccuuuacaaacugcggaucucacugugucugcggccugaaauucgaagccuccgaucgcaugagaauccaucgggagagcgggcucugucagggauacaagucccugcgcguggcuagacuucugugcaaaucuaagggcagcucccucaucauuagcauccugcugucuaugcucauucuguccuucgugaccccuaucgaggggacacuuaccaauuacccggaaagccggaaguaugaccuggaggaaauugccgauguccucgagggauuuguuguggaaaaaggcaucaaggaguacguggucuucuauacgucuauuuuuggcgcucuguuccuucugauggcccucaucaucauuaucgcgcugaaccgcgugacagaguaccugaccaauauuaacguguuuuauugucacgaaugcagcauguaccacuccaaaaagaauaucaaauauauuggggacuucaccaacaaguguggauuuugcacaugcggcgagcucgaagaucaggaggggcugaagauccauaaaguuucuagaaaguguaucuacaaauaccagcuuaccuggagcaagauuaucaugaugauucuggucugccuccugaucgcccaaaacacaauucugaucguggcugccuccgacgacuguuggacgaaacggagccuugaaaugggaugcaucggcccccuccagcagguugauaccugugacgauaagacaucucgcuccuauagcggggaggcuaagaaacuggugagagccucuaagauuuccgaccuggaugccgcucaggucggacuccugggcagcaccaucgaguccgcgauugccucuauccggaaacaaagaacauacagcaccaugcaccuucuggaauccguguuccucggcaagcauugcgacuauuacaaagucuuugagcacaauucuggguauagccaggcuaaguggcgccugacggccaagacccaucacuucgauauuuguucccggcacagcacacaucacuuuugcagauguaucucugacggaaccaaaugccagaacggcgauugggacuucgccuccgaaaugaauagcacauaccaaucuaagcgcgacuuuuucgagcaugauuucaaacaguuuuguacccugaucgaaaacgcuuucccugggacgacagagucccucuuuuaugagaugcucagcaagaaaaauaccacaggaauuaccaagcugcuggacaaacucaccaagaaguucggcaacaauaacauguuuguggggaucuggaaauucggccaguaccugaugucucuucccuacguuaaugaaacaagccuguccccuacgcagcucgccaaggugcuggaggucaccgaucaccaccaucggagcauuucuggaagacaagaaucccuggcgagcgcugcccccggcuccaaaucuagcgagugcgaccacgcccgccggguguccugcaucucuccgagauuugggguuccuauugagggacuuacagcuuguggcagcucccccaacuauaagaucuacaaaaccccugccaagcucuauaagucuaauaacaaaggggaaguguggugcagcggagauguccauugucugcaggagcugauucccgcuccccaggaauccguggaccgcaucaagcagaugacaugcuuccucaccgagccuggcgugaaugaugacaucuuuagcauugccaucucuauguguaaaguucaagauaagggggucugcacgauuaacgaagaccgguggaauguggugaaaugugauagaggccugaucuacuauacagaccagcgcgagggacaggauaccggcaacgacuucgggaaguacugccuuucccacagcugucggauugagagauuuccgaucaaccccgcgaucauuaaugauugccugugggaauaucauucucggaaguccaaauacaucaccagccucgaccuggagucucuggaagaguucaagcgcgccauuuccgaaaaacuuagccacacacucaucguccacaacuuuaagccuaccgcuaaucugccccauauuaaaccuguguacaaguauaucacaguucagggaguggagaacuccgacggcgucgauagcgccuacaucacggcuucuaugcccgcccugagcgggaccuccauuggauauaauaucaugucuagagacaacuucccgcuuuucgauauuaucauuuuuaucaagagcgcgauuaucaaagccacauacaaucacaucuaugacaccggcccuacaauugggaucaacgugauucaugaugagcacuguaccggccaaugccccacggacaucccucauaaggaaaauuggauuaccuucgcucaggagcggacauccagauggggaugcgaagaguuuggcugucuggccaucaacaccgggugcguuuucggaucuugucaggauaucauucgccccgaaacaaaaguguaccggaaggcugucgaggagagcgugcuucugaccguuugcaucacauauccuggcaaaaccuuuuguacggaaauuaaugccaucgagcccaagauuacagacgaacucgagcugcaguucaaaaccguggauaccaagacacugccgaacauccuugccguccaaaaucacaagcuguacuccgggcagaucaacgaccucggaucuuuuagccagggcugcgggaauauucagaaaaccaacuccagcaucauuggcacgggaacagcuaaguucgauuacgugugucacggcgcgucuagaaaagacaucauugugcgcagaugcuauaacaauaacuacgaguccuguaagcugcucaaagaggaacaaagccugauguuugccgauaaucaugaaaccaucgacgucgcuaacguucggcaccuucugggggaccuccaguucaagcugaugcugggagaucuucgcuauaagucuuuugccgagaauccugaccuggaaauugaggccaaaugcgugggcugucccuccugcuucacaagcuacuccugcucuuucaagaucgugagcaacaucgauaccgucuguuccauugaggggcccugcacaaucuuucauagcagacucaugauuaccucuacgaaacaggacuauggaaucaagauguccuguaaaaccaagccuggcccgacagaagaguuccaaauuugcaagaaaaccuacacaauccuguuuaccacgaucgaaaagaaugauaaaauugagaucagcacaggcgaccagaccucuuucauucaggaacgggaugaccgcuguagaacauggcucugccgggugcgcgaugaggggaucggaguuauuuuugagcccaucagagcuuucuuuggcagcuauuucuccaucgccuuuuacauugugaucgggauuaucauucuguuccuugucaucuacauuuuucugccuaugguguucaagcuccgggacguucugaaacgcaacgaauaucuguaccuucaggagaucaagcacaaguga

SEQ ID NO: 14176 - RNA, 4305 nt, Artificial Sequence
  derived and/or modified CDS sequence (opt5) from BATV(ON-1/E/94)__AB257764.1__GP
augcuccuguuccuggugcuucugaucagcugcuacgucuccgccucucccguuauuaccagauguuuucacggcgggcagcucaucgcugagcgcaagagccaaacagccauuuccgaguucugccugaaagacgaugugucuacgaucaagagcgaaauuaucuaugaaaagaacgacaccggacuuuuugcgcauuccaaggugcugcggaauuggaucauuaaagauuggaagaacuguaauccugucccgacagcuggcgggucuaucaacgugauugagguuaaugccgaccucagccuggccaccaagacauacgugugcuccagagauuguaccaucacagucgacaaagaagaugcucagauuguguuccagaccgagaagcugaaccacuuugagguuagcggaacgacccucucuuccggcugguucaaaacaaaggccagcgugacccuggaccggacaugcgaacauaucaaagucaccugugggaagaagacgcuucaguuucacgcuugcuucaaacaucacaugucuuguauucgcuuuuuccacggaacaauccugcccggcaccauggccacauccaucugccaaaauauugagcucaucauuaucauuagccugacccuuaucaucuuuauucugauggugauccucaccaagacauauauuuguuaccugcugaugccucucuucaugcccaucgcguauuuuuacggcuggucuuauaacaaauccugcaagaaaugcagcuguugcgggcuggccuaccauccuuucacgaauuguggaucccacugcguguguggccuuaaguucgaggcuucugauagaaugcggauucaucgcgaaagcgggcugugccagggauacaaaucccucagagucgcccggcugcuuuguaagagcaaggggucuucccugaucaucagcauucuccugucuaugcugauccucagcuuuguuacccccauugagggcacacugaccaacuauccugaaucccgcaaauacgaccuugaggaaaucgcugaugugcuggagggauucguggucgaaaagggcauuaaagaguaugugguguuuuacacaucuaucuucggcgcccucuuucugcuuauggcgcugauugugaucaucgcccucaauagagucaccgaguaucugacgaacauuaaugugcuguacugccacgaauguagcauguaucacuccaagaaaaacaucaaguacauuggggacuucacaaauaagugcggauuuuguaccugcggcgagcucgaagaucaggaggggcugaaaauccauaagguuagccggaaaugcauuuacaaguaucagcuuaccuggucuaaaaucaucaugauuauccuggugugucuccugauugcucaaaacacaauccugauugucgccgcuuccgacgacugcuggaccaaaaagagccuugaaauggagugugugggaccgcuccagcaggucgauacaugcgaggacaaaacgucucgcuccuacagcggcgaagccaagaaacuggugagagccuccaagaucucugaucuggacgcugcgcagguugggcuccugggaagcaccaucgaguccgccauugcuucuauccggaaacaacgcacauauagcaccaugcaccuucuggaauccguguuccucggcaagcauugugauuacuauaaggucuuugagcacaacagcggcuacucucaggccaaauggagacugacagccaagacccaucacuucgacauuugcucccggcacagcacgcaucacuuuuguagaugcaucucugaugggaccaaaugucagaauggagacugggauuucgcuggcgaaaugaacuccacauaucaaagcaagcgcgacuuuuucgagcaugauuucaaacuguuuugcacccuuauugagaaugccuuccccgggacaaccgaaucucucuuuuacgagaugcugagcaagaaaaacacgacaggaaucaccaagcugcucgacaagcugacaaagaaguucggcaauaacaauauguuuguggggaucuggaaauucggccaguaccuuaugucccugccuuauguuaacgaaaccagccucucucccacccagcuggcgaaggugcuggaggucacagaccaccuucaccgguccauuagcggaagacaggagcuccugacguccgcuaccccuggcucuaaaagcuccgaaugugaucaugccaagaaggugucuugcaucagcccccgcuuuggggugccgauggagggacugauugccugcggcaauuccccuucuuacaaaaucuauaagacacccaccaaacucuacaagagcaacaauaaaggggaaguuugguguuccggagacguccacugcuuccaagagcugauuccugcuagccaggaaucuguggaucggaucaagcagaugacauguuuucuuaccgagcccgagguguccgacgaugucuucagcauugccaucucuaugugcaaggugcaggacaaaggcguuuguacgaucaacgaagauagauggaaugugauuaagugcgacuccgggcugaucuauuacacagaucaacgcgagggccaggacaccggaaacgaucucggcgaauauugucugagccauucuugccggauugagagauuucccaucaauccuauuaucaucuccgacugucugugggaauaccacagccgcaaauccaaguacauuaccagccuugaucucgagucucuggaggaguucaaacgggcuaucagcgaaaagcugucccauacacucauugucuauaacuuuaagccgaccgccaaccugccccacaucaaaccuguguacaaguauauuacaguucaggggguggaaaauucugacggagucgacagcgcguacaucacggccuccaugcccgcucuuucuggcaccagcaucggguauaacauuauguccagagauaauuucccucuguucgacaucauuaucuuuauuaaaucugccaucauuaaggcuacauacaaccacaucuaugauaccggacccacaaucggcauuaaugugaugcaugacgagcacugcaccgggcaguguccgacggauaucccucauaaagaaaacuggauuaccuucgcccaagagcgcacaagccgguggggcugcgaggaauuuggaugccucgcgguuaauaccggcuguguguucggguccugccaggacaucauuagacccgagacaaaggucuaccggaaagccguggaagagagcgugcugcugaccgucuguaucacauacccuggaaagaccuuuugcacggagaucaacgcuauugaacccaagaucacagaugagcuugaacugcaguucaaaaccguugacaccaagacacucccuaauauucuggccgugcagaaccacaaacucuauucuggccaaaucaaugaucugggguccuuuagccagggauguggcaacauucagaagaccaauucuuccaucaucgggacgggcacagcuaaauucgacuacgugugccauggagccagccgcaaggauauugucgugagacgguguuauaacaauaacuacgaguccugcaaacuucugaaagaggaacaaucucucauguuugccgacaaccacgagaccaucgauguugcuaaugugagacaucugcugggcgaccuucaguucaagcugaugcucggggaccugcgcuauaagagcuuugcggaaaaccccgaucucgagauugaagccaagugugucggaugcccguccuguuucacaagcuacucuugcuccuucaaaaucgugagcaauauugacaccguuugcucuaucgagggcccuuguacaaccuuucacaaccggcugaugauuacgagcaccaagcaggauuaugggaucaagauguccugcaaaacaaagcccggacccaccgaagaguuccagaucuguaaaaagacauacaccauucuuuuuacgacaguggagaaaaaugacaagaucgaaauuucuaccggcgaucaaaccagcuucauccaggagaaggacgauagaugcaaaacauggcugugucgcgucagagacgaaggcauuuccgugaucuuugagccuauccgggcuuucuuugggucuuacuucagcauugccuuuuauaucguuauuggaaucauuguucucuuccuggucaucuacaucuuucugccgaugauuuucaaacuucgcgaugugcugaaaagaaacgaauaucucuaccugcaggagaucaagcacaaauga

SEQ ID NO: 14177 - RNA, 4305 nt, Artificial Sequence
  derived and/or modified CDS sequence (opt5) from BATV(ON-7/B/01)__AB257765.1__GP
augcugcuccugcuugugcugcucauccccugcugugucagcgccuccccuguuauuaccagaugcuuccacggcgggcagcugaucgcugagcggaagucucaagccgcgauuagcgaauuuugucuuaaagacgauguguccacaaucaagucugagauuaucuacgaaaagaacgacacgggacuguucgcucauaauaaggugcuccgcaacuggaucauuaaagauuggaagaauugcaacccgguccccaccgccggcgggagcaucaaugugauugagguuaacacagaccugucccugaccacaaagaccuauguguguucuagagauugcacaaucaccgucgacaaagaagaugcccagauuaucuuucagacggagaagcucaaucacuucgaggugagcggaaccacacuguccagcggcugguuuaaaaccaaggcuucuguuacacuugaccggaccugugaacauauuaaagugacgugcgggaagaagacacugcaguuccacgccuguuuuaaacaucacauguccugcauccgcuucuuucacggaaccauccucccuggcacaauggcuaccagcauuugucaaaacaucgagcugauuaucauuaucucucuuacccugaucauuuucauccucauggucauucugacaaagacguacaucugcuaucugcucaugccccuguuuaugccuauugccuacuucuauggcugguccuacaauaaaagcugcaagaaaugucccugcugugggcuugcguaucauccuuuuaccaacugcggaucucacugugugugcggccugaaguucgaagccuccgauagaaugcggauccaucgcgagagcgggcucugucagggauacaaaucccugagaguggcucggcuucugugcaagucuaagggcagcucccucaucauuagcauccugcugucuaugcucauucuguccuucgucacaccgaucgaggggacccuuacaaauuaccccgaaagccgcaaauaugaccuggaggaaauugccgauguucucgagggauuuaucguggaaaagggcauuaaagaguacguggucuucuauaccucuaucuuuggcgcucuguuccuucugaucgcccucauugugaucauugcgcugaacagaguuacggaguaccugacaaauaucaacgugcucuauugucacgaaugcagcauguaccacuccaagaaaaauauuaaguauaucggggacuuuaccaacaaguguggauucuguaccugcggcgagcuggaagaucaggaggggcuuaaaauccauaaggucucucggaaaugcauuuacaaguaccagcugacauggagcaaagugaucaugaugauucucguuugccugcugaucgcccaaaacaccauucuuaucguggcugccuccgacgacuguuggacaaagaaaagccucgaaaugggaugcaucggcccucugcagcaggucgauacgugugacgauaaggcuucucgcuccuauagcggggaggccaagaaacuggugagagccucuaagauuuccgaccucgaugcugcgcaggucggacaacugggcagcaccaucgaguccgccauugcuucuauccggcgccagagaacauacagcaccaugcaccuucuggaauccguguuucucggcaaacauugcgacuauuacaagguuuucgagcacaauucuggguauagccaggccaaguggcggcugacagccaaaacccaucacuuugauauuuguuccagacacagcacgcaucacuucugccgcuguaucucugacggaaccaagugccaaaacggcgauugggacuuugcuggggaaaugaacuccacauaccagagcaaacgggauuucuuugagcaugacuucaaucuguucuguacccuuaucgaaaaugccuuucccggaacaaccgagucucucuucuaugagaugcuguccaagaaaaacacgacaggcauuaccaagcugcucgacaaacugacaaagaaguuugggaauaacaauauguucgugggcaucuggaaauuuggacaguaccuuauuagccugccuuacgucaacgaaaccucucucagccccacccagcuggcgaaggugcugguugugacagaucaacaccacagauccaucagcggccgccaggagucucuugcuuccgccacgccggggagcaaauccucugaaugcggacaugccaagaaagucagcugcauuuccccucgguucggcgugcccauggaggggcucauggcuuguggaucuagcccuaauuauaagaucuacaagacccccgccaaacuguauaaguccaacaauaaaggcgagguguggugcucuggggacguucacuguuuucaggaucugauucccgcuagccaggaauccgucgacagaaucaagcaaaugacaugcuuccucaccgagccugaagugaacgaugacguguuuagcaucgccauugcgauguguaaaguccaggauaagggcgugugcacaaucaaugaggaccgcuggaaccugauuaagugugauucuggacuuaucuacuauaccgaccagcgggaaggccaggauacggggaacgacuucggagaguacugccugucccauaauuguaaaauggagagauuuccgauuaaccccgccaucaucagcgauugccucugggaauaucacucucgcaaguccaaauacauuacaagccuggaccuggagucucuugaagaguucaagcgggcuaucuccgaaaaacucagccauacccugguuguguacaauuuuaagccuaccgccaaccugccccacauuaagccugucuauaaauacaucacagugcaaggcguugaaaauuccgacgggguggauagcgcuuauauuaccgccucuaugcccgcgcucagcggaacauccaucggcuacaacaucaugucuagagacaauuucccgcuguucgauauuaucauuuuuaucaagagcgccauuaucaaagcuacguauaaccacauuuacgacaccgggccuacaaucggcaucaaugucaugcaugaugagcacuguaccggacagugccccacagacauuccucauaaggaaaacuggaucaccuucgcccaggagcgcacgucccgguggggcugcgaagaguuugggugucuugcugugaauaccggaugcguuuucggcucuugucaggauauuaucagacccgaaacaaaaguguaucggaaggccgucgaggagagcgugcugcucaccgugugcauuacauacccugggaaaaccuuuuguacagaaaucaacgccaucgagcccaagauuaccgacgaacuggagcugcaauucaagacggucgauacaaaaacccuuccgaauauccuggcuguucagaaccacaagcucuacuccggacagauuaaugaccugggcucuuuuagccaagggugcggcaacauccagaaaaccaaccucuccauuaucggaacaggcaccgcgaaguucgauuaugugugucauggggccagccgcaaagacaucauugugagacggugcuacaauaacaauuaugagucuuguaagcugcuuaaggaggagcagucccugauguuugcugauaaccacgaaacgaucgacgucgccaaugugagacaccuccugggagaccugcaguucaaacuuaugcugggcgaucuccgcuacaagagcuuugccgagaacccugaccuggaaauugaggcuaaaugcguugggugucccucuugcuucacauccuauagcugcaauuucaagaucguguccaacauugauaccgucuguucuaucgagggacccugcacaaccuuucauaaucggcucaugauuacaagcgccaaacaagacuacggcaucaagauguccuguaagaccaaaccuggccugacggaagaguuccagaucugcaagaaaaccuauacagugcuuuuugcgaccguugaaaagaacgaugagauugaaaucagcacaggggaccagaccucuuucauucaggagagagaugaccgcuguaaaacguggcugugcagagugcgggaugagggaaucuccgucauuuuugaaccgauccgcgcuuucuuuggcagcuacuucucuaucgccuuuuacauugugaucgggauuaucguucucuuccuggugauuuauaucuuucugcccauggucuucaaacuuagagacgugcugaagcggaaugaguaccucuaucugcaagaaaucaaacacaaguga

SEQ ID NO: 14178 - RNA, 4305 nt, Artificial Sequence
  derived and/or modified CDS sequence (opt5) from BATV(UgMP-6830)__DQ436460.1__GP
augcugcuccugcuugugcugcucauccccugcuacgucagcgccuccccuguugugaccagauguuuccacggcgggcagcugauugcugagaagaaaucucaaacagccgugagcgaauuuugccuuaaggacgaugucuccacgaucaaaucugagauuaccuaugaaaagaacaauacaggacuguucgcgcauaacaaagugcuccggaauuggaucauuaaggacuggaagaacuguaauccgguucccaccgcuggcgggagcaucaacgugaucgaggucaauacagaucugucccugaccacaaaaaccuacgugugcucucgcgacuguacgauuaccguugauaaggaagacgcccagaucauuuuucagacagagaaacucaaccacuucgaggugagcggaaccacacuguccagcggcugguuuaagaccaaagccucugucacgcuugauagaacaugcgaacauaucaaggugaccugugggaagaaaacacugcaguuccacgcuugcuuuaagcaucacauguccuguauucgguucuuucacggaaccauccucccuggcaccauggccacaagcauuugccaaaauaucgagcugaucauuaucauuucucuuacgcugaucauuuucauccucauggugauccugaccaaaacauauauuuguuaccugcucaugccccuguuuaugccuaucgcuuauuucuacggcugguccuauaacaagagcugcaaaaagugcucuuguugcgggcuugccuaccaucccuuuaccaauuguggaucccacugcgucuguggccugaaauucgaagcgagcgaccgcaugcggauucauagagaguccgggcucugccagggauacaagucucugcgcguugccagacuucuguguaagagcaaaggcuccagccucaucauuucuauccugcuguccaugcucauccugagcuucgugacaccuauugaggggacccuuacgaacuauccggaaucucggaaguacgaucuggaggaaaucgcugacgugcucgagggauuuauugucgaaaaaggcaucaaggaguaugugguuuucuacacaagcauuuuuggcgcccuguuccuucugauggcucucgugaucauuaucgcccugaauaaagucaccgaguaucugaccaacaucaaugugcucuacugccacgaauguuccauguaucacucuaagaagaacauuaaauacaucggggauuuuacaaacaagugcggauucuguaccugcggcgagcuggaagaccaggaggggcuuaaaauucauaagguuagccgcaaaugcaucuacaaguaucagcugacaugguccaagauuaucaugaugauccucgugugucugcugauugcgcaaaauacgauccuuauugucgccgcuagcgaugacugcuggaccaaaaagucucucgaaauggaguguaucggaccccugcaacagguggacacaugcgaugacaaauccagcagaucuuacuccggcgaggccaagaaacugguccgggcuagcaagauuuccgaucucaacgccgcccagguggggcugcuuggaucuaccaucgaaagcgcuaucgcguccauucgcaagcagagaacauauucuaccaugcaccuucucgagagcguuuuucugggcaaacauugugacuacuauaaggccuucgaacacaauuccggcuacagccaggcuaaauggcggcugacggccaagacccaucacuuugauaucugcucucgccacuccacacaucacuucuguagaugcauuagcgacgggaccaaaugucagaacggagauugggacuuugccggcgagaugaauagcacauaucaauccaagaaagauuucuuugaacaugaccuuaaacucuucugcacccugguggagaacgcuuucccugggacgacagagagccuguuuuacgaaaugcucucuaagaagaauaccacaggagucaagaaacugcuugauaagcugaccaaaaaguucggcaacaauaacauguuuguggggaucuggaaguucggccaguaccucaugagccugcccuauguuaaugagaccucccugacgccugcccagcuugcgaaaauucucgaagugacagaccagcaccaccggagcaucucuggaagacaagagucccuggcuagcgccacccccggcuccaagucuaaagagugugggcaugccaagaaagucagcugcaucuccccgcgcuuuggagugccuauggaaggccugcucgcuugcggggacucucccaacuacaagauuuauaagaccccugccaaacuguacaagagcaauaacaaaggagaggugugguguuccggcgauguucacugcucucaggaacuuagccccgcuucccaggagagcgucgaccggaucaagcagauuacauguuuccugacagaacccgaggugucugaugacguguuuuccaucgccauuucuaccugcaaaguccaagauaaggggguguguacgguuaaugaggacagauggaacgugaucaagugcgauucuggccucauuuauuacacagaccagcgcgauggacaggacaccggcaacgauuucggggaauauugucugucccauagcugccggaucgagagauuuccuaucaauccggcgauuaucucugacugucugugggaauaccacucccgcaaaagcaaguacauuaccucccuugaucucgagagccuggaagaguucaaacgggccaucucugagaagcugagccauacacucauugucuauaacuuuaaacccaccgcuaaucugccucacaucaagcccaucuacaaauauauuacagugcagggaguugaaaacuccgacggcguggacucugccuacaucacggcuagcaugccugcccuuuccgggaccucuauuggauauaauaucaugagcagagauaacuucccccuguuugacauuaucaucuucauuaaguccgcgaucauuaaggccacauacaaucacaucuaugauaccggcccgacaauugggaucaacgucaugcaugacgagcacugcaccggccaauguccuacggauauuccccauaaagaaaauuggaucaccuucgcucaggagcgcacaucucgguggggaugcgaagaguuuggcugccucgccgugaacaccggguguguuuucggaagcugccaggacaucauuagaccugagacaaagguguaccgcaaagcugucgaagaguccgugcugcugaccguguguaucacauaccccggcaagaccuuuugcacggaaauuaaugccaucgagccuaaaauuacagaugagcuugaacugcaguucaagaccgucgacaccaagacacuccccaacauccuggccguucaaaaucacaaacucuauagcgggcagaucaacgaucugggaucuuuuucccagggcugugggaauauucaaaagaccaacagcucuaucauuggcacgggaacagcuaaauucgacuacgugugccauggcgcgucccggaaggauaucauugugagacgguguuauaacaauaacuacgagagcugcaaacuucugaaggaggaacagucccucauguuugccgacaaucacgaaaccaucgaugucgcuaacgugcgccaucugcugggggaccuucaguucaagcugaugcucggagaccugagauauaaaucuuuugccgagaauccggaucucgagaucgaagccaaguguguuggcugcccuagcuguuucacauccuacagcugcucuuuuaaaauuguguccaacaucgacaccgucugcagcauugaggggcccuguacaaccuuccacaaucggcugaugaucacgucuaccaagcaggauuauggaauuaaaaugagcugcaagacaaagcccgaagagaccgaagaguuccaaaucuguaaaaagacauacaccgugcuuuuuacgacaguugagaaaaacgacaagauugaaaucuccaccggcgaucagacaucuuucauccaggagagagacgaucgcugcaaaaccuggcugugucgggugagagacgaaggcauuagcgucaucuuugagccuauucgcgcuuucuuuggguccuacuucucuaucgccuuuuaugugguugugagcauuaucguccucuuccuggcgaucuacauuuuucugccgaugguguucaagcugagagaugugcugaagaaaaaugaauaucucuaccugcaggagaucaagcacaaauga

SEQ ID NO: 14179 - RNA, 4305 nt, Artificial Sequence
  derived and/or modified CDS sequence (opt5) from BATV(ZJ2014)__KU746870.1__GP
augcuggugcuccugguccuucugauccccugcuguguuagcgccuccccugcuauuaccagaugcuuccacggcgggcagcucaucgccgagcggaagucucaaacagcgauuagcgaauuuugucugaaagacgauguguccacgaucaagucugagauuaucuacgagaaaaacgacaccggacuuuucgcucauaauaaggugcugcgcaacuggaucauuaaagauuggaagaauugcaacccgguccccacagccggcgggagcaucaaugugauugagguuaacaccgaccucucccugacaaccaagacauauguguguucuagagauugcaccaucacggucgacaaagaagaugcccagauuaucuuucagaccgagaagcugaaucacuucgaggugagcggaacaacccucuccagcggcugguuuaaaacaaaggcuucuguuacccuggaccggacgugugaacauauuaaagugacaugcgggaagaagacccuucaguuccacgccuguuuuaaacaucacauguccugcauccgcuucuuucacggaacaauccugccuggcaccauggcuaccagcauuugucaaaacaucgagcucauuaucauuaucucucugacacuuaucauuuucauccugauggucauucucacgagaaccuacaucugcuaucugcugaugccccucuuuaugccuauugccuacuucuauggcugguccuacaauaagagcugcaaaaagugucagugcugugggcuggcguaucaucccuuuacaaacugcggaucucacugugugugcggccuuaaauucgaagccuccgaucggaugcgcauccauagagagagcgggcugugucagggauacaagucccuccggguggcucgccugcuuugcaaaucuaagggcagcucccugaucauuagcauccuccugucuaugcugauucucuccuucgucaccccuaucgaggggacacugaccaauuacccggaaagcagaaaguaugaccuugaggaaauugccgauguucuggagggauuugugguggaaaaaggcaucaaggaguacgucguguucuauacgucuauuuuuggcgcucucuuccugcuuauggcccugaucguuaucauugcgcucaaccgggugacagaguaccugaccaauaucaacgucuuuuauugucacgaaugcagcauguaccacuccaaaaagaauauuaaauauaucggggacuucaccaacaaguguggauuuugcacaugcggcgagcuggaagaucaggaggggcucaagauucauaaagugucucgcaaguguaucuacaaauaccaacugaccuggagcaagaucauuaugaugauccuuguuugccugcucauugcccagaacacaauccugauuguggcugccuccgacgacuguuggacgaaaaagagccuggaaaugggaugcaucggcccccuucagcaggucgauaccugugacgauaagacaucuagauccuauagcggggaggcuaaaaagcucgugcgggccucuaaaaucuccgaccuggaugccgcucaagucggacugcucggcagcaccauugaguccgcgaucgccucuauucgcaagcagagaacauacagcaccaugcaccuucuugaauccguguuccugggcaaauauugcgacuacuauaagguuuuugagcauaauucuggguacagccaggcuaaguggcggcucacggccaaaacccaccauuucgauaucuguuccagacacagcacacaccauuuuugccgcuguauuucugacggaaccaagugccaaaacggcgauugggacuucgccuccgaaaugaauagcacauaucagucuaaacgggauuucuucgagcacgacuucaagguguuuuguacccugaucgaaaacgcuuucccugggacgacagagucccuguuuuacgagaugcuuagcaaaaagaauaccacaggaaucaccaaacuccuggacaagcugaccaagaaauucggcaacaauaacauguuugucgggauuuggaaguucggccaguaccucaugucucugcccuaugugaaugaaacaagccuuuccccuacgcagcuggccaaaguucucgaggugaccgaucaucaccacagaagcaucucuggacgccaagaaucccuggcgagcgcugcccccggcuccaagucuagcgagugcgaccaugccaaaaaggucuccugcauuucuccgcgguuuggggugccuaucgagggacugacagcuuguggcagcucccccaacuacaagauuuauaaaaccccugccaagcuguacaaaucuaauagcaagggggaaguguggugcuccggagauguucacugucuccaggagcugauccccgcuagccaggaaucugucgacagaauuaaacagaugacaugcuuccugaccgagcccggcgugaacgaugacaucuuuuccaucgccauuagcauguguaaggugcaagauaagggggucugcacgaucaaugaagaccgcuggaacgugguuaaaugugauucuggccucauuuauuacacagaccagcgggagggacaggauaccggcaaugacuucggggaguauugccugucccauagcuguagaaucaagcgcuuuccuauuaacccggcgaucaucaacgauugccuuugggaauaccacucucggaaauccaaguacauuaccagccuggaccucgagucccuggaagaguucaaaagagccaucagcgaaaagcugucucauacacuuauuguguauaauuuuaagcccaccgcuaaccucccucacaucaaacccgucuacaaguauauuacagugcagggaguugagaauagcgacggcguggauuccgccuacaucacggcuucuaugccugcccugagcgggaccuccaucggauauaacauuaugucucgcgacaauuucccccuguucgauaucauuaucuuuauuaaaagcgcgaucauuaaggccacauacaaccacaucuaugacaccggcccgacaaucgggauuaaugucauccaugaugagcacuguaccggccaaugcccuacggacauuccccauaaagaaaacuggaucaccuucgcucaggagcggacauccagauggggaugcgaagaguuuggcugucucgccauuaauaccgggugcguguucggaucuugucaggauaucauccggccugaaacaaagguuuaccgcaaagcuguggaggagagcguccugcuuaccgugugcauuacauaccccggcaagaccuuuuguacggaaaucaacgccauugagccuaagaucacagacgaacuggagcuccaguucaaaaccguggauaccaagacacugcccaauauucuggccguccaaaaccacaaacuuuauuccgggcagaucaaugaccugggcagcuuuucucagggaugcgggaacauccaaaagaccaauuccagcauuaucggcacgggaacagcuaaauucgauuacguuugucauggcgcgucuagaaaggacauuaucgugcggagaugcuauaacaacaauuacgaguccuguaagcuccugaaagaagaacagagccucauguuugccgauaaccacgaaaccauugacguggcuaauguccgccaucugcuuggggaccugcaguucaagcucaugcugggagaucugcgguauaaauccuuugccgagaacccggaccuugaaaucgaggccaagugcgugggcuguccuucuugcuucacaagcuacuccugcagcuucaaaauuguuucuaauaucgauaccguguguuccaucgacgggcccugcacaauuuuucacaacagacugaugaucaccagcacgaagcaggauuauggaauuaagaugucuuguaaaaccaagcccggcccuacagaggaauuucaaaucugcaaaaagaccuacacaauucucuuuaccacgaucgagaaaaaugacaagaucgaaauuagcacaggcgaucagaccuccuucauccaggagcgcgacgauagaugucggacauggcugugccgcgucagagacgaagggauuucugugaucuuugagccgauucgggcuuucuuuggaagcuacuucuccaucgccuuuuauaucguuauuggcaucauuauccucuuccuggugauuuacaucuuucuucccauggucuucaagcugcgcgaugugcucaaaagaaacgaguaucuguaccugcaggaaauuaagcacaaauga

SEQ ID NO: 14180 - RNA, 4305 nt, Artificial Sequence
  derived and/or modified CDS sequence (opt5) from CVV__AF082576.1__GP
augcuguuccuccugauccuugccuuucugggcuucagcaccuccaaccccauugcuacaagaugcuuucacgggggacagcucaucgccgagucuaagagcgcgacguccauuucugaguucugucugaaagacgaugugagcaugcuuaaguccgaagucguuuacaucaaaaaugacaccggccuguuugggcauaacaagguguuccggucuuggacaauuaaagauuggaagcucugcaauccuaucccgaccgcuggaggcacaaucaacgugauugaagucaauaaggaccugagccugaugaccaaaacauauaucuguucccgcgauugcaccauuacgaucgacaaggaggaagcccaaauuaucuuucagaccgauaaacucaaccacuucgaggugagcgggacaacccugucuuccggaugguuuaagagcaaagccucuguuacacuugacagaaccugugagcaugugaaggucacgugcggcaagaaaucccugcaguuccacgcuuguuuuaagcaucacaugagcugcgugcgguucuuucacaauacaauucuccccggcaacaugaucaccucuaugugucagaauaucgaacugauuaucauucuugggcugacacucgccaucuucauucugaugguuaugcugaccaaaaccuacaucugcuaucuccugaugccuaucuucaugcccauugcuuaccuuuauggaugggccuacaacaaguccuguaaaaagugcaauugcuguggccuggcguaucauccuuuuacaaacugcgggagccacugugugugcggacucaaauucgaggccuccgaucgcaugagaauccaucgggaaucuggccugugucaaggguacaagagccuucgcauugcuagacugcucugcaaguccaaaggaagcucucuggucaucuccggccugcucagcaugcugauucuuucuuuugugacgcccaucgagggcaccaucacaagcuacccugagucccggaaguauacccuggaagagauuacagacguggucgaagggcucguuucugagcagaauaucaaagaauacauuguguucuauaccagccuguuuggaucccuuauccugcuccuggccuucauuaugagcaucacgcugucuaagauuacauccauccucgcuaaacgcaacgugaucuacugugaggagugcagcauguaucacucuaagagaggcauuaaguacaauggggauuuuaccaacaaauguggauucugcaccuguaacgaacaggaggacacagaaggccuggucauccacaagguguccaaacggugcaccuauaaguaccagcuuaaaugggccaagguucugaugauuacacucgugcugcugcuuaucgcgcaaaauacgauucucaucgucgccgcugagaccgauugcuggacaaagaaaagccuggacaucgacuguauugggccgaugcuggauaucggauccugcaccaacaagaauacacgcucuuacgacgccgaagcucagaaacucgugagccaguccaagauuucucagcuggaugccgaccaagccagccuucugggcaacuccaucgauagcgcuauuaaagcgaucagagcccagaagaccuaucccacgaugcaucuccuggagaccaucuuucugaugaagaauugugacuacuauacaucuuucaaccacaauuccggcuacagccaggcuaaauggcggcuuauugccaagaccgggcauuuugauaucugcucucgccacuccacacaucacuucugucaaugcauuaacgacggaaccaaaugucagaauggcgauugggacuuugccggggagaugaacgaaacguauaauagcaagaacgauuucuacucucacgaccucaaucuguucuauacaaucuuugagaacgcuuucccuggaaccacagaaagccuguuuuaccagcucauucagaaaaagaauaccaccggcgccuccaaaguucuggggaaacuuaucacaaaguacggcaacaacaauauguucgugggaaucuggaaauuuggccaauaucugcucacgcugcccuacauuaacaauaccgagcugagccagaacagacggcuuacaauccucgcgacccaggaacugcugucuagaucccauagcgggcgccaggaguccaugucuaaugcuauucaaggaagcaucacaaaggagugccacaacgccaaaggcgucggguguauuuccccucaguucggaauccccauuggcaaucucaccgccugcggggacucuccgaacuauaagaucuacaaaacgccugaaaagcuguauaagagcaauaacaaaggcgaggugugguguuccaaugauguccauugccuuaacgacuuugaacccgcugaugaggaggugguuaauaagaucaaaaagcugacaugcuuccucaccgacgugucugucgaaguggauauuuuuagcguugccgcuuccaccuguaaaauggccgacaagggagugugcacagucaacggcgcgaaguggaauaucauuaaaugugauagcgggcuguacuauuucaccgaccaccgggagggacaggauacaggcaacgacuuuggggaauacugcaucucucacuccuguaacacggagagauucccuauuaaucccgauacccugaaggacugcacaugggaauuucauagccgcaaaucuaaguacaucuccaccaucagccuugagucucucgaggaguuccggagagccauggcugaaaaacugucccacacacugaccauuuauaacuucaagcccacggccaaucucccucauauccgcccgaccuacaaguuuauuacagcuaacggaguggaaaauagcgauggcaucgaguccgccuauauucugagcucuauccccgcgcuugggggcaucagcgugggauacaacguucagaccaaagacaauuucccucugcucgacauuaucgucuuuauuaaguccgccgugauccggacaaccuauaaccacauuuacgauacaggccccaccaucgggauuaauacgcaacaugacgaacacuguacaggaccuugccccgcuguggucccgcacaaagagaacuggaugaccuucucucaggagagaaccagccgcuggggcugugaagaguuugggugccuggccaucaauacaggauguguguucggcuccugccaggauaucauucauccugaaaccaagguuuaucggaaagcuguggaggaagaggucgugcugacgguuugcaucaacuuucccgggaauaacuacuguacagagauuaaugccaucgaaccuaagauuaccgacgagaucgaacuucaguucaaaacaguggauaccaagacacugcccaaccuccuggccguccaaaaccacaagcucuacucuggccagaucaaugaccugggcagcuuuucccagggaugcgggaacgugcaaaagaccaaucauucuauucuuggaaugggcacgguuaaguucgauuaugugugucacggggcuagcagaaaagacgucaucgugcgccggugcuacaacaauaacuuugauuccuguaagcugcucaaagaggagaccagccugauuuucgcggacaaucaugaaacacuggagguggcccacaccaagcaccuuaucggagaacugcaguucaagauuaugcucggcgauaucagauauaaaucuuuugcugaguccccugaacuggagaucgacgccaagugcgucggcugucccagcugcuucgagucuuacuccuguaacuuucagauuguuagcaauaucgauacagugugcuccguggaagggccguguacccucuuccauaaccggauuaucauuucugccaauaaacagagcuauggacugaagauguccugccaaacgaaaccuaaccagaaugaggaauuuaucauuugcaaccgcaaguacagcguccuuuucacaaccaucgacaagaaugacaaaaucgaggugaacacaggcgaucagaccucuuauauuuacgaaaaggacuccagauguaaaaccuggcugugccggguuagagaugaggggaucagcgugcucuuugagccccugaaggcuuucuuuggaucuuacuucagcauuaucuuuuaugucgugguuggcauuaucgugcuguuccuuaucauuuacaucuuucugcccauguucuucaaacucaaggacguccugaagcgcaaugaauaucucuaccugcaggagcuuaaacacaaguga

SEQ ID NO: 14181 - RNA, 4305 nt, Artificial Sequence
  derived and/or modified CDS sequence (opt5) from CVV(Montgomery County/VA/2015 4b)__KX583998.1__GP
augcuguuccuccugauccuugccuuucugggcuucagcaccuccaaccccauugcuacaagaugcuuucacgggggacagcucaucgccgagucuaagagcgcgacguccauuucugaguucugucugaaagacgaugugagcaugcuuaaguccgaagucguuuacaccaaaaaugacacaggccuguuugggcauaacaagguguuccggucuuggaccaucaaagauuggaagcucugcaauccuauuccgacagcuggaggcaccaucaacgugaucgaagucaauaaggaccugagccugaugacaaaaaccuauauuuguucccgcgauugcacgaucaccauugacaaggaggaagcccaaaucauuuuucagacagauaaacucaaccacuucgaggugagcgggaccacacuuaauucuggaugguuuaaguccaaagccagcguuacccuugacagaacgugugagcaugugaaggucacaugcggcaagaaaucucugcaguuccacgcuuguuuuaagcaucacauguccugcgugcgguucuuucacaacaccauccuccccggcaauaugauuaacagcaugugucagaauaucgaacugaucauuauccuugggcugacacucgccauuuucauccugaugguuaugcugaccaaaaccuacauuugcuaucuccugaugccuaucuucaugcccaucgcuuaccuuuauggaugggccuacaacaagucuuguaaaaagugcaauugcuguggccuggcguaucauccuuuuacaaacugcgggucccacugugugugcggacucaaauucgaggccagcgaucgcaugcggauucauagagaauccggccugugucaaggguacaagucucuucgcaucgcuagacugcucugcaagagcaaaggauccagccuggucauuucuggccugcucuccaugcugauccuuagcuuugugacgcccauugagggcaccaucacaucuuacccugagagccggaaguauacccuggaagagaucacagacguggucgaagggcucguuuccgagcagaauauuaaagaauacaucguguucuauaccucucuguuuggaagccuuauucugcuccuggccuucaucauguccauuacgcugagcaagaucacaucuauucucgcucgcagaaacgugaucuacugugaggagugcuccauguaucacagcaaacggggcaucaaguacaacggggauuuuaccaauaaguguggauucugcaccuguaacgaacaggaggacgccgaaggccuggucauucacaaagugucuaagcgcugcacauauaaauaccagcuuaagugggcgaaaguucugauggugacccucguccugcugcuuaucgcccaaaauacaauucucaucguggcugccgggacggauugcugggcuaagaagucccuggacauggacuguauuggaccgaugcuggauaucggcagcugcaccaacaaaaauacaagaaacuacgacaccgaggcccagaagcucguuucccagucuaaagugagccagcuggaugccgaccaagcgucccuucugggcaauucuaucgauagcgcuauuaaggccauccgggcucagaaaacauaucccaccaugcaucuccuggaaacgauuuuucugaugaagaacugugacuacuauaccuccuucaaucacaacagcggguacucucaggccaaguggcgccuuaucgccaaaacaggacauuuugauauuugcuccagacacagcacccaucacuucugucggugcaucaaugacggcacaaagugucaaaacggggauugggacuuugcuggagagaugaaugagaccuauaacucuaaaaaugauuucuacucccacgaccucaaccuguucuauacgaucuuugaaaacgccuucccuggcacaaccgagagccuguuuuaccagcucauucagaagaaaaauacaaccggggcgucuaagauccugggcaaacuuauuaccaaguacggaaacaauaacauguucgucggcguguggaaguuugggcaguaucugcucacacugcccuacaucaauaacacggaacugagccaaaauagacgccagaccauucuugcuacacaggagucccucagccggucucauuccggaagacaggaaagcauguccucugccauccaaggcagcgucaccaaagagugccacaacgccaaggacgugggguguaucuccccucgcuucggcauucccaucggaaaucugacagcuugcggggauucuccgaacuauaaaauuuacaagaccccugagaaacuguauaagagcaauaacaagggcgaaguuugguguuccaaugacgugcauugccucaacgauuuugagcccgccgacgaagaggucgugaauaaaguuaagaaacugacgugcuuccuuacagaugugucugucaagaccgacaucuuuagcguggcuguguccaccuguaaaauggccgauaagggaacaugcaccguuaaggacgcgaaauggaacauuaucaagugugauagcggccuguacuauuucacagaccaccgggaggggcaggauacgggaaacgacuuuggcgaauacugcauuucucacuccuguaauaccgagagauucccuaucaaccccgauauccucaaagacugcacaugggaauuucauagccgcaagucuaaauacauuuccaccaucagccuggagucucuggaagaguuccggagagccaugacagagaagcugucccacacccucacgauuuauaauuucaagcccaccgcuaaccugccucauauccgcccgacauacaaauuuauuaccgccaauggggucgaaaacagcgacggaaucgaguccgcuuauauccugagcucuauucccgcccucggcgggaucagcgugggcuacaaugugcagacaaaggauaacuucccucugcuugacauuaucgucuuuauuaaauccgcggugauccggaccacauauaaucacaucuacgauaccggacccacgauuggcaucaacacacagcaugacgaacacuguaccgggccuugccccgccguugugccgcacaaggagaauuggauuaccuucucucaagaaagaacaagccgcuggggaugugaggaguuuggcugccuggcuaucaacaccgggugugucuucggauccugccaggauauuauccauccugaaacgaaaguguaucggaaggccguugaggaagaggugguccucacagugugcauuaauuuucccggcaacaauuacuguaccgaaaucaacgcuguugagccuaaaaucacagacgagauugaacugcaguucaagaccguggauacaaagacccugcccaaccuucuggccguccagaauagaaaacucuacucugggcaaaucaacgaccugggcagcuuuucccagggaugcggcaaugugcagaagacgaaccacucuauucucgggaugggaaccgccaaauucgauuaugugugucauggcgcuagccggaaggacgucaucguucgcagaugcuacaauaacaauuuugauuccugucggcugcuuaaagaggaaacaagccugauuuucgcggacaaccacgagacccucgagguggcccauacaaagcaccugaucggggaacugcaauucaagaucaugcuuggagauauuagauauaaaucuuuugcugaguccccugaacuggagaucgacgccaagugcgugggcugucccagcugcuucgaaucuuacuccuguaauuuucagauugucaccaacaucgacacggugugcagcguugagggcccguguacacucuuccacaaucgcauuaucaucuccgccaacaaacagucuuaugggcugaagaugagcugccagaccaaaccuaaucaaaacgaggaauuuauuaucugcaaucggaaguacuccguccucuucacaaccauugauaagaacgacaaaaucgaggugaauaccggagaucagacaagcuauauuuacgaaaaggacucuagauguaaaacguggcugugccgcgugagagaugagggcaucuccguucuuuuugaaccccugaaggcuuucuuugggagcuacuucucuauuaucuuuuauguggucgugggaaucauuguucucuuccugaucauuuacaucuuucugcccauguucuucaaacuuaaggacgugcugaagcggaacgaguaucucuaccugcaggagcucaaacauaaguga

SEQ ID NO: 14182 - RNA, 4305 nt, Artificial Sequence
  derived and/or modified CDS sequence (opt5) from CVV(Montgomery County/VA/2015 K)__KX583999.1__GP
augcuguuccuccugauccuugccuuucugggcuucagcaccuccaaccccauugcuacaagaugcuuucacgggggacagcucaucgccgagucuaagagcgcgacguccauuucugaguucugucugaaagacgaugugagcaugcuuaaguccgaagucguuuacaccaaaaaugacacaggccuguuugggcauaacaagguguuccggucuuggaccaucaaagauuggaagcucugcaauccuauuccgacagcuggaggcaccaucaacgugaucgaagucaauaaggaccugagccugaugacaaaaaccuauauuuguucccgcgauugcacgaucaccauugacaaggaggaagcccaaaucauuuuucagacagauaaacucaaccacuucgaggugagcgggaccacacuuaauucuggaugguuuaaguccaaagccagcguuacccuugacagaacgugugagcaugugaaggucacaugcggcaagaaaucucugcaguuccacgcuuguuuuaagcaucacauguccugcgugcgguucuuucacaacaccauccuccccggcaauaugauuaacagcaugugucagaauaucgaacugaucauuauccuugggcugacacucgccauuuucauccugaugguuaugcugaccaaaaccuacauuugcuaucuccugaugccuaucuucaugcccaucgcuuaccuuuauggaugggccuacaacaagucuuguaaaaagugcaauugcuguggccuggcguaucauccuuuuacaaacugcgggucccacugugugugcggacucaaauucgaggccagcgaucgcaugcggauucauagagaauccggccugugucaaggguacaagucucuucgcaucgcuagacugcucugcaagagcaaaggauccagccuggucauuucuggccugcucuccaugcugauccuuagcuuugugacgcccauugagggcaccaucacaucuuacccugagagccggaaguauacccuggaagagaucacagacguggucgaagggcucguuuccgagcagaauauuaaagaauacaucguguucuauaccucucuguuuggaagccuuauucugcuccuggccuucaucauguccauuacgcugagcaagaucacaucuauucucgcucgcagaaacgugaucuacugugaggagugcuccauguaucacagcaaacggggcaucaaguacaacggggauuuuaccaauaaguguggauucugcaccuguaacgaacaggaggacgccgaaggccuggucauucacaaagugucuaagcgcugcacauauaaauaccagcuuaagugggcgaaaguucugauggugacccucguccugcugcuuaucgcccaaaauacaauucucaucguggcugccgggacggauugcugggcuaagaagucccuggacauggacuguauuggaccgaugcuggauaucggcagcugcaccaacaaaaauacaagaaacuacgacaccgaggcccagaagcucguuucccagucuaaagugagccagcuggaugccgaccaagcgucccuucugggcaauucuaucgauagcgcuauuaaggccauccgggcucagaaaacauaucccaccaugcaucuccuggaaacgauuuuucugaugaagaacugugacuacuauaccuccuucaaucacaacagcggguacucucaggccaaguggcgccuuaucgccaaaacaggacauuuugauauuugcuccagacacagcacccaucacuucugucggugcaucaaugacggcacaaagugucaaaacggggauugggacuuugcuggagagaugaaugagaccuauaacucuaaaaaugauuucuacucccacgaccucaaccuguucuauacgaucuuugaaaacgccuucccuggcacaaccgagagccuguuuuaccagcucauucagaagaaaaauacaaccggggcgucuaagauccugggcaaacuuauuaccaaguacggaaacaauaacauguucgucggcguguggaaguuugggcaguaucugcucacacugcccuacaucaauaacacggaacugagccaaaauagacgccagaccauucuugcuacacaggagucccucagccggucucauuccggaagacaggaaagcauguccucugccauccaaggcagcgucaccaaagagugccacaacgccaaggacgugggguguaucuccccucgcuucggcauucccaucggaaaucugacagcuugcggggauucuccgaacuauaaaauuuacaagaccccugagaaacuguauaagagcaauaacaagggcgaaguuugguguuccaaugacgugcauugccucaacgauuuugagcccgccgacgaagaggucgugaauaaaguuaagaaacugacgugcuuccuuacagaugugucugucaagaccgacaucuuuagcguggcugccuccaccuguaaaauggcggauaagggaacaugcaccgugaacgacgccaaguggaacauuaucaaaugugauagcggccuguacuauuucacagaccaccgggaggggcaggauacgggaaaugacuuuggcgaauacugcauuucucacuccuguaacaccgagagauucccuaucaaucccgauauccucaaggacugcacaugggaauuucauagccgcaaaucuaaguacauuuccaccaucagccuggagucucuggaagaguuccggagagcuaugacagagaaacuuucccacacccucacgauuuauaacuucaagcccaccgccaaucugccucauauccgcccgacauacaaguuuauuaccgcuaacgggguugaaaauagcgacggaaucgaguccgccuauauccugagcucuauucccgcgcucggcgggaucagcgucggcuacaacgugcagacaaaagauaauuucccucugcuugacauuaucguguuuauuaaguccgccgucauccggaccacauauaaccacaucuacgauaccggacccacgauuggcaucaauacacagcaugacgaacacuguaccgggccuugccccgcugugguuccgcacaaagagaacuggauuaccuucucucaagaaagaacaagccgcuggggaugugaggaguuuggcugccuggccaucaauaccggguguguguucggauccugccaggauauuauccauccugaaacgaaggucuaucggaaagcuguggaggaagagguugugcucacagucugcauuaacuuucccggcaauaacuacuguaccgaaaucaacgccguggagccuaagaucacagacgagauugaacugcaguucaaaaccguugauacaaagacccugcccaaucuucuggccgugcagaaccacaagcucuacucugggcaaaucaaugaccugggcagcuuuucccagggaugcggcaacguccagaaaacgaaucauucuauucucgggaugggaaccgcuaaguucgauuaugugugucacggcgcgagcagaaaagacgugaucguccggcgcugcuacaacaauaacuuugauuccuguagacugcuuaaggaggaaacaagccugauuuucgccgacaaucaugagacccucgagguugcucacacaaaacaccugaucggggaacugcaauucaagaucaugcuuggagauauucgguauaagucuuuugccgaguccccugaacuggagaucgacgccaaaugcgugggcugucccagcugcuucgaaucuuacuccuguaacuuucagauugugaccaauaucgacacggucugcagcguggagggcccguguacacucuuccauaacagaauuaucaucuccgcuaauaagcagucuuaugggcugaaaaugagcugccagaccaagccuaaccaaaaugaggaauuuauuaucugcaaccgcaaauacuccguucucuucacaaccauugauaagaaugacaagaucgaggugaacaccggagaucagacaagcuauauuuacgaaaaagacucucgguguaagacguggcugugcagaguccgcgaugagggcaucuccgugcuuuuugaaccccugaaagccuucuuugggagcuacuucucuauuaucuuuuauguuguggucggaaucauuguucucuuccugaucauuuacaucuuucugcccauguucuucaagcugaaagacgugcugaagagaaacgaguaucucuaccugcaggagcucaagcacaaauga

SEQ ID NO: 14183 - RNA, 4305 nt, Artificial Sequence
  derived and/or modified CDS sequence (opt5) from CVV(1156)__EU583730.1__GP
augcuguuccuccugauccuugccuuucugggcuucagcaccuccaaccccauugcuacaagaugcuuucacgggggacagcucaucgccgagucuaagagcgcgacguccauuucugaguucugucugaaagacgaugugagcaugcuuaaguccgaagucguuuacaucaaaaaugacaccggccuguuugggcauaacaagguguuccggucuuggacaauuaaagauuggaagcucugcaauccuaucccgaccgcuggaggcacaaucaacgugauugaagucaauaaggaccugagccugaugaccaaaacauauaucuguucccgcgauugcaccauuacgaucgacaaggaggaagcccaaauuaucuuucagaccgauaaacucaaccacuucgaggugagcgggacaacccugucuuccggaugguuuaagagcaaagccucuguuacacuugacagaaccugugagcaugugaaggucacgugcggcaagaaaucccugcaguuccacgcuuguuuuaagcaucacaugagcugcgugcgguucuuucacaauacaauucuccccggcaacaugaucaccucuaugugucagaauaucgaacugauuaucauucuugggcugacacucgccaucuucauucugaugguuauccugaccaaaaccuacaucugcuaucuccugaugccuauuuucaugcccaucgcuuaccuuuauggaugggccuacaacaaguccuguaaaaagugcaauugcuguggccuggcguaucauccuuuuacaaacugcgggagccacugugugugcggacucaaauucgaggccuccgaucgcaugcggauucauagagaaucuggccugugucaaggguacaagagccuucgcaucgcuagacugcucugcaaguccaaaggaagcucucuggucauuuccggccugcucagcaugcugauccuuucuuuugugacgcccaucgagggcaccauuacaagcuacccugagucccggaaguauacccuggaagagaucacagacguggucgaagggcucguuucugagcagaauauuaaagaauacaucguguucuauaccagccuguuuggaucccuuauucugcuccuggccuucaucaugagcauuacgcugucuaagaucacauccauccucgcuaaacgcaacgugauuuacugugaggagugcagcauguaucacucuaagagaggcaucaaguacaauggggauuuuaccaacaaauguggauucugcaccuguaacgaacaggaggacacagaaggccuggucauucacaagaucuccaaacggugcaccuauaaguaccagcuuaaaugggccaaggugcugaugauuacacucguucugcugcuuaucgcgcaaaauacgauccucauuguggccgcugagaccgauugcuggacaaagaaaagccuggacaucgacuguauugggccgaugcuggauaucggauccugcaccaacaagaauacacgcucuuacgacgccgaagcucagaaacucgucagccaguccaagauuucucagcuggaugccgaccaagugagccuucugggcaacuccaucgauagcgccaucaaagcuauuagagcgcagaagaccuaucccacgaugcaucuccuggagaccaucuuucugaugaagaauugugacuacuauacaucuuucaaccacaauuccggcuacagccaggccaaauggcggcuuauugcuaagaccgggcauuuugauaucugcucucgccacuccacacaucacuucuguagaugcauuaacgacggaaccaaaugucaaaauggcgauugggacuuugccggggagaugaacgaaacguauaauagcaagaacgauuucuacucucacgaccucaaucuguucuauacaaucuuugagaacgccuucccuggaaccacagaaagccuguuuuaccagcucauccagaaaaagaauaccaccggcgcuuccaaaguucuggggaagcucauuacaaaguacggcaacaacaauauguucgugggagucuggaaauuuggccaguaucugcucacgcugcccuacaucaacaauaccgagcugagccaaaaccggagacuuacaauucucaccacacaggaacugcugucucgcucccauagcgggcggcaggaguccaugucuaaugccauccagggaagcauuaccaaggagugccacaacgcgaaaggcgugggguguaucuccccuagauucggcauucccaucggaaaucucacggcuugcggggacucuccgaacuauaagaucuacaaaacaccugaaaagcuguauaagagcaauaacaaaggcgaggucugguguuccaaugaugugcauugccuuaacgacuuugaacccgccgaugaggagguugugaauaagauuaaaaagcugaccugcuuccucaccgacgucucuguggaaguugauaucuuuagcguggccgcuuccacauguaaaauggccgacaagggagucugcaccgugaacggcgcuaaguggaauauuaucaaaugugauagcgggcuguacuauuucacagaccaccgcgagggacaagauacgggcaacgacuuuggggaauacugcauuucucacuccuguaacaccgagcgguucccuaucaaucccgauauccugaaggacugcacaugggaauuucauagcagaaaaucuaaguacauuuccaccaucagccuugagucucucgaggaguuccgccgggccauggcggaaaaacugucccacacacugaccauuuauaacuucaagcccacggccaaucucccucauaucagaccgaccuacaaguuuauuacagcuaacggaguggaaaauagcgauggcaucgaguccgccuauauccugagcucuauucccgcucuugggggcaucagcguuggauacaacguccagaccaaagacaauuucccucugcucgacauuaucguguuuauuaaguccgccgugauccgcacaaccuauaaccacauuuacgauacaggccccaccaucgggaucaauacgcagcaugacgaacacuguacaggaccuugccccgcggucgugccgcacaaagagaacuggaugaccuucucucaggagcggaccagcagauggggcugugaagaguuugggugccuggccauuaauacaggauguguuuucggcuccugccaagauaucauucauccugaaaccaagguguaucgcaaagcugucgaggaagaggugguucugacggugugcaucaacuuucccgggaauaacuacuguacagagauuaaugccaucgaaccuaagaucaccgacgagauugaacuucaguucaaaacagucgauaccaagacacugcccaaccuccuggcugugcagaaccacaagcucuacucuggccagaucaaugaccugggcagcuuuucccaaggaugcgggaacguucagaaaaccaaucauucuauucuuggaaugggcacggugaaguucgauuaugucugucacggggccagccggaaagacgugaucgugagacggugcuacaacaauaacuuugauuccuguaagcugcucaaagaggagaccagccugauuuucgccgacaaucaugaaacacuggaggucgcucacaccaagcaccuuaucggagaacugcaguucaagaucaugcucggcgauauucgcuauaaaucuuuugcggaguccccugaacuggagaucgacgccaagugcguuggcugucccagcugcuucgagucuuacuccuguaacuuucaaauugugacaaauaucgauaccgugugcagcgucgaagggccguguacgcuuuuccauaacagaauuaucauuuccgcuaauaaacagucuuauggacugaagaugagcugccagacaaaaccuaaccagaaugaggaauuuaucaucugcaaccggaaguacuccgugcuuuucaccacaauugacaagaaugacaaaaucgagguuaacaccggcgaucaaaccagcuauauuuacgaaaaggacucuagauguaaaacauggcugugccgcgugcgggaugaggggaucuccguccucuuugagccccugaaggccuucuuuggaagcuacuucucuauuaucuuuuaugugguuaucggcauuaucgugcuguuccuuauuaucuacauuuuucugcccauguucuucaaacucaaggacguccugaagagaaaugaauaucucuaccugcaggagcuuaaacacaaguga

SEQ ID NO: 14184 - RNA, 4305 nt, Artificial Sequence
  derived and/or modified CDS sequence (opt5) from CVV(6V633)__KX100134.1__GP
augcuguuccuccugauccuugccuuucugggcuucagcaccuccaaccccauugcuacaagaugcuuucacgggggacagcucaucgccgagucuaagagcgcgacguccauuucugaguucugucugaaagacgaugugagcaugcuuaaguccgaagucguuuacaucaaaaaugacaccggccuguuugggcauaacaagguguuccggucuuggacaauuaaagauuggaagcucugcaauccuaucccgaccgcuggaggcacaaucaacgugauugaagucaauaaggaccugagccugaugaccaaaacauauaucuguucccgcgauugcaccauuacgaucgacaaggaggaagcccaaauuaucuuucagaccgauaaacucaaccacuucgaggugagcgggacaacccugucuuccggaugguuuaagagcaaagccucuguuacacuugacagaaccugugagcaugugaaggucacgugcggcaagaaaucccugcaguuccacgcuuguuuuaagcaucacaugagcugcgugcgguucuuucacaauacaauucuccccggcaacaugaucaccucuaugugucagaauaucgaacugauuaucauucuugggcugacacucgccaucuucauucugaugguuaugcugaccaaaaccuacaucugcuaucuccugaugccuaucuucaugcccauugcuuaccuuuauggaugggccuacaacaaguccuguaaaaagugcaauugcuguggccuggcguaucauccuuuuacaaacugcgggagccacugugugugcggacucaaauucgaggccuccgaucgcaugagaauccaucgggaaucuggccugugucaaggguacaagagccuucgcauugcuagacugcucugcaaguccaaaggaagcucucuggucaucuccggccugcucagcaugcugauucuuucuuuugugacgcccaucgagggcaccaucacaagcuacccugagucccggaaguauacccuggaagagauuacagacguggucgaagggcucguuucugagcagaauaucaaagaauacauuguguucuauaccagccuguuuggaucccuuauccugcuccuggccuucauuaugagcaucacgcugucuaagauuacauccauccucgcuaaacgcaacgugaucuacugugaggagugcagcauguaucacucuaagagaggcauuaaguacaauggggauuuuaccaacaaauguggauucugcaccuguaacgaacaggaggacacagaaggccuggucauccacaagguguccaaacggugcaccuauaaguaccagcuuaaaugggccaagguucugaugauuacacucgugcugcugcuuaucgcgcaaaauacgauucucaucgucgccgcugagaccgauugcuggacaaagaaaagccuggacaucgacuguauugggccgaugcuggauaucggauccugcaccaacaagaauacacgcucuuacgacgccgaagcucagaaacucgugagccaguccaagauuucucagcuggaugccgaccaagccagccuucugggcaacuccaucgauagcgcuauuaaagcgaucagagcccagaagaccuaucccacgaugcaucuccuggagaccaucuuucugaugaagaauugugacuacuauacaucuuucaaccacaauuccggcuacagccaggcuaaauggcggcuuauugccaagaccgggcauuuugauaucugcucucgccacuccacacaucacuucuguagaugcauuaacgacggaaccaaaugucaaaauggcgauugggacuuugccggggagaugaacgaaacguauaauagcaagaacgauuucuacucucacgaccucaaucuguucuauacaaucuuugagaacgcuuucccuggaaccacagaaagccuguuuuaccagcucauucagaaaaagaauaccaccggcgccuccaaaguucuggggaagcucaucacaaaguacggcaacaacaauauguucgugggaaucuggaaauuuggccaguaucugcucacgcugcccuacauuaacaauaccgagcugagccaaaaccggagacuuacaauccucgcgacccaggaacugcugucucgcucccauagcgggcggcaggaguccaugucuaaugcuauucagggaagcaucacaaaggagugccacaacgccaaaggcgucggguguauuuccccuagauucggaauccccauuggcaaucucaccgccugcggggacucuccgaacuauaagaucuacaaaacgccugaaaagcuguauaagagcaauaacaaaggcgaggugugguguuccaaugauguccauugccuuaacgacuuugaacccgcugaugaggaggugguuaauaagaucaaaaagcugacaugcuuccucaccgacgugucugucgaaguggauauuuuuagcguugccgcuuccaccuguaaaauggccgacaagggagugugcacagucaacggcgcgaaguggaauaucauuaaaugugauagcgggcuguacuauuucaccgaccaccgcgagggacaagauacaggcaacgacuuuggggaauacugcaucucucacuccuguaacacggagcgguucccuauuaaucccgauacccugaaggacugcacaugggaauuucauagcagaaaaucuaaguacaucuccaccaucagccuugagucucucgaggaguuccgccgggccauggcugaaaaacugucccacacacugaccauuuauaacuucaagcccacggccaaucucccucauaucagaccgaccuacaaguuuauuacagcuaacggaguggaaaauagcgauggcaucgaguccgccuauauucugagcucuauccccgcgcuugggggcaucagcgugggauacaacguucagaccaaagacaauuucccucugcucgacauuaucgucuuuauuaaguccgccgugauccgcacaaccuauaaccacauuuacgauacaggccccaccaucgggauuaauacgcagcaugacgaacacuguacaggaccuugccccgcuguggucccgcacaaagagaacuggaugaccuucucucaggagcggaccagcagauggggcugugaagaguuugggugccuggccaucaauacaggauguguguucggcuccugccaagauaucauucauccugaaaccaagguuuaucgcaaagcuguggaggaagaggucgugcugacgguuugcaucaacuuucccgggaauaacuacuguacagagauuaaugccaucgaaccuaagauuaccgacgagaucgaacuucaguucaaaacaguggauaccaagacacugcccaaccuccuggccguccagaaccacaagcucuacucuggccagaucaaugaccugggcagcuuuucccaaggaugcgggaacgugcagaaaaccaaucauucuauucuuggaaugggcacgguuaaguucgauuaugugugucacggggcuagccggaaagacgucaucgugagacggugcuacaacaauaacuuugauuccuguaagcugcucaaagaggagaccagccugauuuucgcggacaaucaugaaacacuggagguggcccacaccaagcaccuuaucggagaacugcaguucaagauuaugcucggcgauauccgcuauaaaucuuuugcugaguccccugaacuggagaucgacgccaagugcgucggcugucccagcugcuucgagucuuacuccuguaacuuucaaauuguuacaaauaucgauaccgugugcagcguggaagggccguguacgcuuuuccauaacagaauuaucauuuccgccaauaaacagucuuauggacugaagaugagcugccagacaaaaccuaaccagaaugaggaauuuaucauuugcaaccggaaguacuccguccuuuucaccacaaucgacaagaaugacaaaaucgaggugaacaccggcgaucaaaccagcuauauuuacgaaaaggacucuagauguaaaacauggcugugccgcguucgggaugaggggaucuccgugcucuuugagccccugaaggcuuucuuuggaagcuacuucucuauuaucuuuuaugucgugguuggcauuaucgugcuguuccuuaucauuuacaucuuucugcccauguucuucaaacucaaggacguccugaagagaaaugaauaucucuaccugcaggagcuuaaacacaaguga

SEQ ID NO: 14185 - RNA, 4305 nt, Artificial Sequence
  derived and/or modified CDS sequence (opt5) from CVV(807270)__AF186243.1__GP
augcuguuccuccugauccuugccuuucugggcuucagcaccuccaaccccauugcuacaagaugcuuucacgggggacagcucaucgccgagucuaagagcgcgacguccauuucugaauuuugucugaaagacgaugugagcaugcuuaaguccgaggucguuuacaucaaaaaugacaccggccuguuugggcauaacaagguguuccggucuuggacaauuaaagauuggaagcucugcaauccuaucccgaccgcuggaggcacaaucaacgugauugaagucaauaaggaccugagccugaugaccaaaacauauaucuguucccgcgauugcaccauuacgaucgacaaggaggaagcccaaauuaucuuucagaccgauaaacucaaccacuucgaggugagcgggacaacccugucuuccggaugguuuaagagcaaagccucuguuacacuugacagaaccugugagcaugugaaggucacgugcggcaagaaaucccugcaguuccacgcuuguuuuaagcaucacaugagcugcgugcgguucuuucacaauacaauucuccccggcaacaugaucaccucuaugugucagaauaucgaacugauuaucauucuugggcugacacucgccaucuucauucugaugguuauccugaccaaaaccuacaucugcuaucuccugaugccuauuuucaugcccaucgcuuaccuuuauggaugggccuacaacaaguccuguaaaaagugcaauugcuguggccuggcguaucauccuuuuacaaacugcgggagccacugugugugcggacucaaauucgaggccuccgaucgcaugcggauucauagagaaucuggccugugucaaggguacaagagccuucgcaucgcuagacugcucugcaaguccaaaggaagcucucuggucauuuccggccugcucagcaugcugauccuuucuuuugugacgcccaucgagggcaccauuacaagcuacccugagucccggaaguauacccuggaagagaucacagacguggucgaagggcucguuucugagcagaauauuaaagaauacaucguguucuauaccagccuguuuggaucccuuauucugcuccuggccuucaucaugagcauuacgcugucuaagaucacauccauccucgcuaaacgcaacgugauuuacugugaggagugcagcauguaucacucuaagagaggcaucaaguacaauggggauuuuaccaacaaauguggauucugcaccuguaacgaacaggaggacacagaaggccuggucauucacaagguguccaaacggugcaccuauaaguaccagcuuaaaugggccaagguucugaugaucacacucgugcugcugcuuauugcgcaaaauacgauccucaucgucgccgcugagaccgauugcuggacaaagaaaagccuggacauugacuguaucgggccgaugcuggauauuggauccugcaccaacaagaauacacgcucuuacgacgccgaagcucagaaacucgugagccaguccaagaucucucagcuggaugccgaccaaguuagccuucugggcaacuccauugauagcgccaucaaagcuaucagagcgcagaagaccuaucccacgaugcaucuccuggagaccauuuuucugaugaagaauugugacuacuauacaucuuucaaccacaauuccggcuacagccaggccaaauggcggcuuaucgcuaagaccgggcauuuugauauuugcucucgccacuccacacaucacuucugucaaugcaucaacgacggaaccaaaugucagaauggcgauugggacuuugccggggagaugaacgaaacguauaauagcaagaacgauuucuacucucacgaccucaaucuguucuauacaauuuuugagaacgccuucccuggaaccacagaaagccuguuuuaccagcucauccagaaaaagaauaccaccggcgcuuccaaagugcuggggaaacuuaucacaaaguacggcaacaacaauauguucgucggaguguggaaguuuggccaauaucugcucacgcugcccuacauuaacaauaccgagcugagccagaacagacggcuuacaauccucgccacccaggaacugcugucuagaucccauagcgggcgccaggaguccaugucuaaugcgauucaaggaagcaucacaaaggagugccacaacgcuaaaggcgucggguguauuuccccucgguucggaauccccauuggcaaucucaccgccugcggggacucuccgaacuauaagaucuacaaaacgccugaaaagcuguauaagagcaauaacaaaggcgaggugugguguuccaaugauguucauugccuuaacgacuuugaacccgccgaugaggagguggucaauaagaucaaaaagcugacaugcuuccucaccgacgugucuguugaaguggauauuuuuagcgucgcugccuccaccuguaaaauggcugacaagggagugugcacagugaacggcgccaaguggaauaucauuaaaugugauagcgggcuguacuauuucaccgaccacagagagggacaggauacaggcaacgacuuuggggaauacugcaucucucacuccuguaacacggagcgcuucccuauuaaucccgauauccugaaggacugcaccugggaauuucauagccggaaaucuaaguacaucuccacaauuagccuugagucucucgaggaguucagacgcgcgauggccgaaaaacugucccacacccugacaaucuauaacuucaagcccaccgcuaaucucccucauauucggccgacguacaaguuuaucaccgccaacggaguugaaaauagcgauggcauugaguccgcuuauauccugagcucuauccccgcccuugggggcauuagcgucggauacaacgugcagacaaaagacaauuucccucugcucgacaucauuguguuuaucaaguccgcggucauuagaaccacauauaaccacaucuacgauaccggccccacaauugggaucaauacccagcaugacgaacacuguacgggaccuugccccgccgugguuccgcacaaagagaacuggaugacauucucucaagagcgcaccagccgguggggcugugaagaguuugggugccuggcuaucaauaccggauguguguucggcuccugccaggauauuauccauccugaaacaaaggucuauagaaaagccguggaggaagagguugugcugaccgucugcauuaacuuucccgggaauaacuacuguacggagaucaaugcuauugaaccuaagaucacagacgagaucgaacuucaguucaaaaccguggauacaaagacccugcccaaccuccuggccguucagaaccacaagcucuacucuggccaaauuaaugaccugggcagcuuuucccagggaugcgggaacgugcagaaaacaaaucauucuauccuuggaaugggcaccgucaaguucgauuaugugugucacggggccagccgcaaagacgugauuguccggagaugcuacaacaauaacuuugauuccuguaagcugcucaaagaggagacgagccugaucuucgcugacaaucaugaaacccuggagguugcgcacacaaagcaccuuauuggagaacugcaauucaagaucaugcucggcgauauccgguauaaaucuuuugccgaguccccugaacuggagauugacgcuaagugcgugggcugucccagcugcuucgagucuuacuccuguaacuuucagaucgugaccaauauugauacagucugcagcguggaagggccguguacccucuuccauaaccgcaucauuaucuccgccaauaaacagucuuauggacugaagaugagcugccagacgaaaccuaaccaaaaugaggaauuuauuaucugcaacagaaaguacuccguucuuuucacaaccaucgacaagaaugacaaaauugaggugaacacaggcgaucagaccagcuauaucuacgaaaaggacucucgguguaaaaccuggcugugcagaguccgcgaugaggggauuuccgugcucuuugagccccugaaggccuucuuuggaagcuacuucucuaucauuuucuauguuguggucggcaucaucgugcuguuccuuauuaucuacauuuuucugcccauguucuucaaacucaaggacguucugaagcggaaugaauaucucuaccugcaggagcuuaaacacaaguga

SEQ ID NO: 14186 - RNA, 4305 nt, Artificial Sequence
  derived and/or modified CDS sequence (opt5) from CVV(856 clone 1)__EU583732.1__GP
augcuguuccuccugauccuugccuuucugggcuucagcaccuccaaccccauugcuacaagaugcuuucacgggggacagcucaucgccgagucuaagagcgcgacguccauuucugaguucugucugaaagacgaugugagcaugcuuaaguccgaagucguuuacaucaaaaaugacaccggccuguuugggcauaacaagguguuccggucuuggacaauuaaagauuggaagcucugcaauccuaucccgaccgcuggaggcacaaucaacgugauugaagucaauaaggaccugagccugaugaccaaaacauauaucuguucccgcgauugcaccauuacgaucgacaaggaggaagcccaaauuaucuuucagaccgauaaacucaaccacuucgaggugagcgggacaacccugucuuccggaugguuuaagagcaaagccucuguuacacuugacagaaccugugagcaugugaaggucacgugcggcaagaaaucccugcaguuccacgcuuguuuuaagcaucacaugagcugcgugcgguucuuucacaauacaauucuccccggcaacaugaucgccucuaugugucagaauaucgaacugauuaucauucuugggcugacccucgcuaucuucauucugaugguuauccugacaaaaaccuacaucugcuaucuccugaugccuauuuucaugcccaucgccuaccuuuauggaugggcguacaacaaguccuguaaaaagugcaauugcuguggccuggccuaucauccuuuuaccaacugcgggagccacugugugugcggacucaaauucgaggcuuccgaucgcaugcggauucauagagaaucuggccugugucaaggguacaagagccuucgcaucgccagacugcucugcaaguccaaaggaagcucucuggucauuuccggccugcucagcaugcugauccuuucuuuugugacacccaucgagggcacgauuaccagcuacccugagucccggaaguauacacuggaagagaucaccgacguggucgaagggcucguuucugagcagaauauuaaagaauacaucguguucuauacaagccuguuuggaucccuuauucugcuccuggcuuucaucaugagcauuacccugucuaagaucacguccauccucgccaaacgcaacgugauuuacugugaggagugcagcauguaucacucuaagagaggcaucaaguacaauggggauuuuacaaacaaauguggauucugcaccuguaacgaacaggaggacaccgaaggccuggucauucacaagguguccaaacggugcacauauaaguaccagcuuaaaugggcgaagguucugaugaucacccucgugcugcugcuuauugcccaaaauacaauccucaucgucgcugccgagacggauugcuggauuaagaaaagccuggacaucgacuguauugggccgaugcuggauaucggauccugcaccaacaagaauacacgcucuuacgacgcugaagcccagaaacucgugagccaguccaagauuucucagcuggaugccgaccaaguuagccuucugggcaacuccaucgauagcgcuaucaaagcgauuagagcccagaagaccuaucccacaaugcaucuccuggagaccaucuuucugaugaagaauugugacuacuauacgucuuucaaccacaauuccggcuacagccaggcuaaauggcggcuuauugccaagaccgggcauuuugauaucugcucucgccacuccacacaucacuucuguagaugcauuaacgacggaaccaaaugucaaaauggcgauugggacuuugccggggagaugaacgaaacauauaauagcaagaacgauuucuacucucacgaccucaaucuguucuauaccaucuuugagaacgcuuucccuggaacgacagaaagccuguuuuaccagcucauccagcggaaaaauaccacaggcgccuccaaggugcuggggaaacuuauuaccaaguacggcaacaacaauauguucgucggaguguggaaguuuggccaguaucugcucacccugcccuacaucaacaauacagagcugagccaaaacagacgccuuacgauucucaccacacaggaacugcugucucggucccauagcgggagacaggaguccaugucuaaugcgauccagggaagcauuaccaaagagugccacaacgcuaagggcgucggguguaucuccccucgcuucggcauucccaucggaaaucucacagccugcggggacucuccgaacuauaaaaucuacaagaccccugaaaaacuguauaagagcaauaacaagggcgaggugugguguuccaaugauguucauugccuuaacgacuuugaacccgccgaugaggagguggucaauaaaauuaagaaacugacgugcuuccucacagacgugucuguugaaguggauaucuuuagcgucgcugccuccaccuguaagauggcugacaaaggagugugcaccgugaacggcgccaaguggaauauuaucaagugugauagcgggcuguacuauuucacagaccaccgggagggacaagauaccggcaacgacuuuggggaauacugcauuucucacuccuguaacacagagagauucccuaucaaucccgauauccugaaagacugcacgugggaauuucauagccgcaagucuaaauacauuuccaccaucagccuugagucucucgaggaguuccggagagcgauggccgaaaagcugucccacacacugaccauuuauaacuucaaacccacagcuaaucucccucauauccgcccgaccuacaaguuuauuacggccaacggaguugaaaauagcgauggcaucgaguccgcuuauauccugagcucuauucccgcccuugggggcaucagcgucggauacaacgugcagaccaaggacaauuucccucugcucgacauuaucguguuuauuaaauccgcggucauccggacaaccuauaaccacauuuacgauacaggccccaccaucgggaucaauacacagcaugacgaacacuguaccggaccuugccccgccgugguuccgcacaaggagaacuggaugacguucucucaggagagaacaagccgcuggggcugugaagaguuugggugccuggcuauuaauaccggauguguguucggcuccugccaagauaucauucauccugaaaccaaagucuaucggaaggccguggaggaagagguugugcugacagucugcaucaacuuucccgggaauaacuacuguaccgagauuaaugcuaucgaaccuaaaaucacggacgagauugaacuucaguucaagacaguggauaccaaaacacugcccaaccuccuggccguucagaaccacaagcucuacucuggccagaucaaugaccugggcagcuuuucccaaggaugcgggaacgugcagaagaccaaucauucuauucuuggaaugggcacagucaaauucgauuaugugugucacggggccagcagaaaggacgugaucguccggcgcugcuacaacaauaacuuugauuccuguaaacugcucaaggaggagaccagccugauuuucgcugacaaucaugaaacgcuggagguugcgcacaccaaacaccuuaucggagaacugcaguucaagaucaugcucggcgauauuagauauaagucuuuugccgaguccccugaacuggagaucgacgcuaaaugcgugggcugucccagcugcuucgagucuuacuccuguaacuuucaaauugugacaaauaucgauaccgucugcagcguggaagggccguguacacucuuccauaaccggauuaucauuuccgccaauaagcagucuuauggacugaaaaugagcugccagaccaagccuaaccagaaugaggaauuuaucaucugcaacagaaaauacuccguucuuuucacgacaauugacaagaaugacaagaucgaggugaacaccggcgaucaaacaagcuauauuuacgaaaaagacucucgcuguaagaccuggcugugccgggucagagaugaggggaucuccgugcucuuugagccccugaaagccuucuuuggaagcuacuucucuauuaucuuuuauguugugaucggcauuaucguccuguuccuuauuaucuacauuuuucugcccauguucuucaagcucaaagacgugcugaagcgcaaugaauaucucuaccugcaggagcuuaagcacaaauga

SEQ ID NO: 14187 - RNA, 4305 nt, Artificial Sequence
  derived and/or modified CDS sequence (opt5) from CVV(856 clone 3)__EU583731.1__GP
augcuguuccuccugauccuugccuuucugggcuucagcaccuccaaccccauugcuacaagaugcuuucacgggggacagcucaucgccgagucuaagagcgcgacguccauuucugaguucugucugaaagacgaugugagcaugcuuaaguccgaagucguuuacaucaaaaaugacaccggccuguuugggcauaacaagguguuccggucuuggacaauuaaagauuggaagcucugcaauccuaucccgaccgcuggaggcacaaucaacgugauugaagucaauaaggaccugagccugaugaccaaaacauauaucuguucccgcgauugcaccauuacgaucgacaaggaggaagcccaaauuaucuuucagaccgauaaacucaaccacuucgaggugagcgggacaacccugucuuccggaugguuuaagagcaaagccucuguuacacuugacagaaccugugagcaugugaaggucacgugcggcaagaaaucccugcaguuccacgcuuguuuuaagcaucacaugagcugcgugcgguucuuucacaauacaauucuccccggcaacaugaucgccucuaugugucagaauaucgaacugauuaucauucuugggcugacccucgcuaucuucauucugaugguuauccugacaaaaaccuacaucugcuaucuccugaugccuauuuucaugcccaucgccuaccuuuauggaugggcguacaacaaguccuguaaaaagugcaauugcuguggccuggccuaucauccuuuuaccaacugcgggagccacugugugugcggacucaaauucgaggcuuccgaucgcaugcggauucauagagaaucuggccugugucaaggguacaagagccuucgcaucgccagacugcucugcaaguccaaaggaagcucucuggucauuuccggccugcucagcaugcugauccuuucuuuugugacacccaucgagggcacgauuaccagcuacccugagucccggaaguauacacuggaagagaucaccgacguggucgaagggcucguuucugagcagaauauuaaagaauacaucguguucuauacaagccuguuuggaucccuuauucugcuccuggcuuucaucaugagcauuacccugucuaagaucacguccauccucgccaaacgcaacgugauuuacugugaggagugcagcauguaucacucuaagagaggcaucaaguacaauggggauuuuacaaacaaauguggauucugcaccuguaacgaacaggaggacaccgaaggccuggucauucacaagguguccaaacggugcacauauaaguaccagcuuaaaugggcgaagguucugaugaucacccucgugcugcugcuuauugcccaaaauacaauccucaucgucgcugccgagacggauugcuggauuaagaaaagccuggacaucgacuguauugggccgaugcuggauaucggauccugcaccaacaagaauacacgcucuuacgacgcugaagcccagaaacucgugagccaguccaagauuucucagcuggaugccgaccaaguuagccuucugggcaacuccaucgauagcgcuaucaaagcgauuagagcccagaagaccuaucccacaaugcaucuccuggagaccaucuuucugaugaagaauugugacuacuauacgucuuucaaccacaauuccggcuacagccaggcuaaauggcggcuuauugccaagaccgggcauuuugauaucugcucucgccacuccacacaucacuucuguagaugcauuaacgacggaaccaaaugucaaaauggcgauugggacuuugccggggagaugaacgaaacauauaauagcaagaacgauuucuacucucacgaccucaaucuguucuauaccaucuuugagaacgcuuucccuggaacgacagaaagccuguuuuaccagcucauccagcggaaaaauaccacaggcgccuccaaggugcuggggaaacuuauuaccaaguacggcaacaacaauauguucgucggaguguggaaguuuggccaguaucugcucacccugcccuacaucaacaauacagagcugagccaaaacagacgccuuacgauucucaccacacaugaacugcugucucggucccacagcgggagacaggaguccaugucuaaugcgauccagggaagcauuaccaaagagugccauaacgcuaagggcgucggguguaucuccccucgcuucggcauucccaucggaaaucucacagccugcggggacucuccgaacuauaaaaucuacaagaccccugaaaaacuguauaagagcaauaacaagggcgaggugugguguuccaaugauguucacugccuuaacgacuuugaacccgccgaugaggagguggucaauaaaauuaagaaacugacgugcuuccucacagacgugucuguugaaguggauaucuuuagcgucgcugccuccaccuguaagauggcugacaaaggagugugcaccgugaacggcgccaaguggaauauuaucaagugugauagcgggcuguacuauuucacagaccaccgggagggacaggauaccggcaacgacuuuggggaauacugcauuucucauuccuguaacacagagagauucccuaucaaucccgauauccugaaagacugcacgugggaauuucacagccgcaagucuaaauacauuuccaccaucagccuugagucucucgaggaguuccggagagcgauggccgaaaagcugucccauacacugaccauuuauaacuucaaacccacagcuaaucucccucacauccgcccgaccuacaaguuuauuacggccaacggaguugaaaauagcgauggcaucgaguccgcuuauauccugagcucuauucccgcccuugggggcaucagcgucggauacaacgugcaaaccaaggacaauuucccucugcucgacauuaucguguuuauuaaauccgcggucauccggacaaccuauaaccauauuuacgauacaggccccaccaucgggaucaauacacagcacgacgaacacuguaccggaccuugccccgccgugguuccgcauaaggagaacuggaugacguucucucaggagagaacaagccgcuggggcugugaagaguuugggugccuggcuauuaauaccggauguguguucggcuccugccaggauaucauucacccugaaaccaaagucuaucggaaggccguggaggaagagguugugcugacagucugcaucaacuuucccgggaauaacuacuguaccgagauuaaugcuaucgaaccuaaaaucacggacgagauugaacuucaauucaagacaguggauaccaaaacacugcccaaccuccuggccguucagaaccauaagcucuacucuggccagaucaaugaccugggcagcuuuucccagggaugcgggaacgugcaaaagaccaaucacucuauucuuggaaugggcacagucaaauucgauuaugugugucauggggccagcagaaaggacgugaucguccggcgcugcuacaacaauaacuuugauuccuguaaacugcucaaggaggagaccagccugauuuucgcugacaaucacgaaacgcuggagguugcgcacaccaaacaucuuaucggagaacugcaguucaagaucaugcucggcgauauuagauauaagucuuuugccgaguccccugaacuggagaucgacgcuaaaugcgugggcugucccagcugcuucgagucuuacuccuguaacuuucagauugugacaaauaucgauaccgucugcagcguggaagggccguguacacucuuccacaaccggauuaucauuuccgccaauaagcaaucuuauggacugaaaaugagcugccagaccaagccuaaccagaaugaggaauuuaucaucugcaacagaaaauacuccguucuuuucacgacaauugacaagaaugacaagaucgaggugaacaccggcgaucagacaagcuauauuuacgaaaaagacucucgcuguaagaccuggcugugccgggucagagaugaggggaucuccgugcucuuugagccccugaaagccuucuuuggaagcuacuucucuauuaucuuuuauguugugaucggcauuaucguccuguuccuuauuaucuacauuuuucugcccauguucuucaagcucaaagacgugcugaagcgcaaugaauaucucuaccugcaagagcuuaagcauaaauga

SEQ ID NO: 14188 - RNA, 4305 nt, Artificial Sequence
  derived and/or modified CDS sequence (opt5) from CVV(CK102)__AF186242.1__GP
augcuguuccuccugauccuugccuuucugggcuucagcaccuccaaccccauugcuacaagaugcuuucacgggggacagcucaucgccgagucuaagagcgcgacguccauuucugaguucugucugaaagacgaugugagcaugcuuaaguccgaagucguuuacaucaaaaaugacaccggccuguuugggcauaacaagguguuccggucuuggacaauuaaagauuggaagcucugcaauccuaucccgaccgcuggaggcacaaucaacgugauugaagucaauaaggaccugagccugaugaccaaaacauauaucuguucccgcgauugcaccauuacgaucgacaaggaggaagcccaaauuaucuuucagaccgauaaacucaaccacuucgaggugagcgggacaacccugucuuccggaugguuuaagagcaaagccucuguuacacuugacagaaccugugagcaugugaaggucacgugcggcaagaaaucccugcaguuccacgcuuguuuuaagcaucacaugagcugcgugcgguucuuucacaauacaauucuccccggcaacaugaucaccucuaugugucagaauaucgaacugauuaucauucuugggcugacacucgccaucuucauucugaugguuauccugaccaaaaccuacaucugcuaucuccugaugccuauuuucaugcccaucgcuuaccuuuauggaugggccuacaacaaguccuguaaaaagugcaauugcuguggccuggcguaucauccuuuuacaaacugcgggagccacugugugugcggacucaaauucgaggccuccgaucgcaugcggauucauagagaaucuggccugugucaaggguacaagagccuucgcaucgcuagacugcucugcaaguccaaaggaagcucucuggucguguccggccugcucagcaugcugauucuuucuuuugugacgcccaucgagggcaccaucacaagcuacccugagucccggaaguauacccuggaagagauuacagacgucguugaagggcucgugucugagcagaauaucaaagaauacauuguguucuauaccagccuguuuggaucccuuauccugcuccuggccuucauuaugagcaucacgcugucuaagauuacauccauccucgcuaaacgcaacgucaucuacugugaggagugcagcauguaucacucuaagagaggcauuaaguacaauggggauuuuaccaacaaauguggauucugcaccuguaacgaacaggaggacacagaaggccuggugauccacaagguuuccaaacggugcaccuauaaguaccagcuuaaaugggccaaggugcugaugauuacacucguccugcugcuuaucgcgcaaaauacgauucucaucguggccgcugagaccgauugcuggacaaagaaaagccuggacaucgacuguauugggccgaugcuggauaucggauccugcaccaacaagaauacacgcucuuacgacaccgaagcccagaaacucguuagccaguccaagauuucucagcuggaugcugaccaagugagccuucugggcaacuccaucgauagcgccauuaaagccaucagagcucagaagacguaucccaccaugcaucuccuggagacaaucuuucugaugaagaauugugacuacuauaccucuuucaaccacaauuccggcuacagccaggcgaaauggcggcuuauugccaagacagggcauuuugauaucugcucucgccacuccacccaucacuucuguagaugcauuaacgacggaacgaaaugucaaaauggcgauugggacuuugcuggggagaugaacgaaacauauaauagcaagaacgauuucuacucucacgaccucaaucuguucuauaccaucuuugagaacgccuucccuggaacaaccgaaagccuguuuuaccagcucauucagaaaaagaauaccacaggcgccuccaaaguccuggggaaacuuaucacgaaguacggcaacaacaauauguucgugggagucuggaaguuuggccaguaucugcucacccugcccuacaucaacaauacagagcugagccaaaaccggagacuuaccauucucgcuacacaggaacugcugucucgcucccauagcgggcggcaggaguccaugucuaaugccauccagggaagcauuaccaaggagugccacaacgcgaaaggcgugggguguaucuccccuagauucggcauucccaucggaaaucucacggcuugcggggacucuccgaacuauaagauuuacaaaacaccugaaaagcuguauaagagcaauaacaaaggcgagguuugguguuccaaugaugugcauugccuuaacgacuuugaacccgccgaugaggaggucgugaauaagaucaaaaagcugaccugcuuccucaccgacguuucuguggaagucgauaucuuuagcguggccgcuuccacauguaaaauggccgacaagggagugugcaccguuaacggcgcuaaguggaauauuaucaaaugugauagcgggcuguacuauuucacagaccaccgcgagggacaagauacgggcaacgacuuuggggaauacugcauuucucacuccuguaacaccgagcgguucccuaucaaucccgauauucugaaggacugcacaugggaauuucauagcagaaaaucuaaguacaucuccaccaucagccuugagucucucgaggaguuccgccgggccauggcggaaaaacugucccacacacugaccauuuauaacuucaagcccacggccaaucucccucauaucagaccgaccuacaaguuuauuacagcuaacggagucgaaaauagcgauggcaucgaguccgccuauauucugagcucuauccccgcucuugggggcaucagcgugggauacaacgugcagaccaaagacaaucugccucuccuggacauuaucgucuucauuaaguccgccgugauccgcacaaccuauaaccacauuuacgauacaggccccaccaucgggauuaauacgcagcaugacgaacacuguacaggaccuugccccgcgguugugccgcacaaagagaacuggaugaccuuuucucaggagcggaccagcagauggggcugugaagaguucgggugccuggccaucaauacaggaugugucuuuggcuccugccaagauaucauucauccugaaaccaagguguaucgcaaagcuguugaggaagaggugguccuuacggugugcaucaacuuccccgggaauaacuacuguacagagauuaaugccaucgaaccuaagauuaccgacgagaucgaacugcaguuuaaaacaguugauaccaagacacuccccaaccugcucgcugugcagaaccacaagcuguacucuggccagaucaaugaccuuggcagcuucucccaaggaugcgggaacguccagaaaaccaaucauucuauucugggaaugggcacggugaaguuugauuaugugugucacggggccagccggaaagacgucaucguuagacggugcuacaacaauaacuucgauuccuguaagcuccugaaagaggagaccagccugauuuuugccgacaaucaugaaacacuugagguggcucacaccaagcaccugaucggagaacuccaguucaagauuaugcugggcgauauccgcuauaaaucuuucgcggaguccccugaacucgagaucgacgccaagugcgugggcugucccagcugcuuugagucuuacuccuguaacuuccaaauugucacaaauaucgauaccgugugcagcguugaagggccguguacgcuguuucauaacagaauuaucauuuccgcuaauaaacagucuuauggacuuaagaugagcugccagacaaaaccuaaccagaaugaggaguucaucauuugcaaccggaaguacuccgugcuguuuaccacaaucgacaagaaugacaaaaucgaagucaacaccggcgaucaaaccagcuauauuuacgaaaaggacucuagauguaaaacauggcucugccgcgugcgggaugaggggaucuccguucuguucgagccccugaaggccuuuagcggaucuuacuucagcauuaucuuuuauguggucgugggcauuaucguucuuuuccugaucauuuacaucuuucuccccauguucuuuaaacugaaggacgugcucaagagaaaugaauaucuguaccuucaggagcugaaacacaaguga

SEQ ID NO: 14189 - RNA, 4305 nt, Artificial Sequence
  derived and/or modified CDS sequence (opt5) from CVV(CK-102)__KX100146.1__GP
augcuguuccuccugauccuugccuuucugggcuucagcaccuccaaccccauugcuacaagaugcuuucacgggggacagcucaucgccgagucuaagagcgcgacguccauuucugaguucugucugaaagacgaugugagcaugcuuaaguccgaagucguuuacaucaaaaaugacaccggccuguuugggcauaacaagguguuccggucuuggacaauuaaagauuggaagcucugcaauccuaucccgaccgcuggaggcacaaucaacgugauugaagucaauaaggaccugagccugaugaccaaaacauauaucuguucccgcgauugcaccauuacgaucgacaaggaggaagcccaaauuaucuuucagaccgauaaacucaaccacuucgaggugagcgggacaacccugucuuccggaugguuuaagagcaaagccucuguuacacuugacagaaccugugagcaugugaaggucacgugcggcaagaaaucccugcaguuccacgcuuguuuuaagcaucacaugagcugcgugcgguucuuucacaauacaauucuccccggcaacaugaucaccucuaugugucagaauaucgaacugauuaucauucuugggcugacacucgccaucuucauucugaugguuauccugaccaaaaccuacaucugcuaucuccugaugccuauuuucaugcccaucgcuuaccuuuauggaugggccuacaacaaguccuguaaaaagugcaauugcuguggccuggcguaucauccuuuuacaaacugcgggagccacugugugugcggacucaaauucgaggccuccgaucgcaugcggauucauagagaaucuggccugugucaaggguacaagagccuucgcaucgcuagacugcucugcaaguccaaaggaagcucucuggucguguccggccugcucagcaugcugauucuuucuuuugugacgcccaucgagggcaccaucacaagcuacccugagucccggaaguauacccuggaagagauuacagacgucguugaagggcucgugucugagcagaauaucaaagaauacauuguguucuauaccagccuguuuggaucccuuauccugcuccuggccuucauuaugagcaucacgcugucuaagauuacauccauccucgcuaaacgcaacgucaucuacugugaggagugcagcauguaucacucuaagagaggcauuaaguacaauggggauuuuaccaacaaauguggauucugcaccuguaacgaacaggaggacacagaaggccuggugauccacaagguuuccaaacggugcaccuauaaguaccagcuuaaaugggccaaggugcugaugauuacacucguccugcugcuuaucgcgcaaaauacgauucucaucguggccgcugagaccgauugcuggacaaagaaaagccuggacaucgacuguauugggccgaugcuggauaucggauccugcaccaacaagaauacacgcucuuacgacaccgaagcccagaaacucguuagccaguccaagauuucucagcuggaugcugaccaagugagccuucugggcaacuccaucgauagcgccauuaaagccaucagagcucagaagacguaucccaccaugcaucuccuggagacaaucuuucugaugaagaauugugacuacuauaccucuuucaaccacaauuccggcuacagccaggcgaaauggcggcuuauugccaagacagggcauuuugauaucugcucucgccacuccacccaucacuucuguagaugcauuaacgacggaacgaaaugucaaaauggcgauugggacuuugcuggggagaugaacgaaacauauaauagcaagaacgauuucuacucucacgaccucaaucuguucuauaccaucuuugagaacgccuucccuggaacaaccgaaagccuguuuuaccagcucauucagaaaaagaauaccacaggcgccuccaaaguccuggggaaacuuaucacgaaguacggcaacaacaauauguucgugggagucuggaaguuuggccaguaucugcucacccugcccuacaucaacaauacagagcugagccaaaaccggagacuuaccauucucgcuacacaggaacugcugucucgcucccauagcgggcggcaggaguccaugucuaaugccauccagggaagcauuaccaaggagugccacaacgcgaaaggcguggaauguaucuccccuagauucgggauucccaucggaaaucucacggcuugcggcgacucuccgaacuauaagauuuacaaaacaccugagaagcuguauaagagcaauaacaaaggggaaguuugguguuccaaugaugugcauugccuuaacgacuuugagcccgccgaugaggaagucgugaauaagaucaaaaagcugaccugcuuccucaccgacguuucuguggaggucgauaucuuuagcguggccgcuuccacauguaaaauggccgacaagggcgugugcaccguuaacggagcuaaguggaauauuaucaaaugugauagcggccuguacuauuucacagaccaccgcgaagggcaagauacgggaaacgacuuuggcgaguacugcauuucucacuccuguaacaccgaacgguucccuaucaaucccgauauucugaaggacugcacaugggaguuucauagcagaaaaucuaaguacaucuccaccaucagccuugagucucucgaagaguuccgccgggccauggcggaaaaacugucccacacacugaccauuuauaacuucaagcccacggccaaucucccucauaucagaccgaccuacaaguuuauuacagcuaacggggucgagaauagcgauggaaucgaauccgccuauauucugagcucuauccccgcucuuggcgggaucagcgugggcuacaacgugcagaccaaagacaaucugccucuccuggacauuaucgucuucauuaaguccgccgugauccgcacaaccuauaaccacauuuacgauacaggacccaccaucggcauuaauacgcagcaugacgagcacuguacagggccuugccccgcgguugugccgcacaaagagaacuggaugaccuuuucucaggaacggaccagcagauggggaugugaggaguucggcugccuggccaucaauacagggugugucuuuggauccugccaagauaucauucauccugaaaccaagguguaucgcaaagcuguugaagaggaggugguccuuacggugugcaucaacuuccccggcaauaacuacuguacagaaauuaaugccaucgagccuaagauuaccgacgaaaucgagcugcaguuuaaaacaguugauaccaagacacuccccaaccugcucgcugugcagaaccacaagcuguacucugggcagaucaaugaccuuggcagcuucucccaaggaugcggcaacguccagaaaaccaaucauucuauucuggggaugggaacggugaaguuugauuaugugugucacggcgccagccggaaagacgucaucguuagacggugcuacaacaauaacuucgauuccuguaagcuccugaaagaggaaaccagccugauuuuugccgacaaucaugagacacuugaaguggcucacaccaagcaccugaucggggagcuccaguucaagauuaugcugggagauauccgcuauaaaucuuucgcggaauccccugagcucgagaucgacgccaagugcgugggcugucccagcugcuuugaaucuuacuccuguaacuuccaaauugucacaaauaucgauaccgugugcagcguugagggcccguguacgcuguuucauaacagaauuaucauuuccgcuaauaaacagucuuaugggcuuaagaugagcugccagacaaaaccuaaccagaaugaagaguucaucauuugcaaccggaaguacuccgugcuguuuaccacaaucgacaagaaugacaaaaucgaagucaacaccggagaucaaaccagcuauauuuacgagaaggacucuagauguaaaacauggcucugccgcgugcgggaugagggcaucuccguucuguucgaaccccugaaggccuuuuucgggagcuacuuuucuauuaucuucuauguggucgugggaauuaucguucuuuuucugaucauuuacaucuuccuccccauguuuuucaaacugaaggacgugcucaagagaaaugaguaucuguaccuucaggaacugaaacacaaguga

SEQ ID NO: 14190 - RNA, 4305 nt, Artificial Sequence
  derived and/or modified CDS sequence (opt5) from CVV(MI80-1-450)__AF186241.1__GP
augcuguuccuccugauccuugccuuucugggcuucagcaccuccaaccccauugcuacaagaugcuuucacgggggacaucucaucgccgagucuaagagcgcgacguccauuucugaauuuugucugaaagacgaugugagcaugcuuaaguccgaggucguuuacaucaaaaaugacaccggccuguuugggcacaacaagguguuccggucuuggacaauuaaagauuggaagcucugcaauccuaucccgaccgcuggaggcacaaucaacgugauugaagucaauaaggaccugagccugaugaccaaaacauauaucuguucccgcgauugcaccauuacgaucgacaaggaggaagcccagauuaucuuucaaaccgauaaacucaaccauuucgaggugagcgggacaacccugucuuccggaugguuuaagagcaaagccucuguuacacuugacagaaccugugagcacgugaaggucacgugcggcaagaaaucccugcaguuccaugcuuguuuuaagcaccacaugagcugcgugcgguucuuucauaauacaauucuccccggcaacaugaucaccucuaugugucagaauaucgaacugauuaucauucuugggcugacacucgccaucuucauucugaugguuauccugaccaaaaccuacaucugcuaucuccugaugccuauuuucaugcccaucgcuuaccuuuauggaugggccuacaacaaguccuguaaaaagugcaauugcuguggccuggcguaucacccuuuuacaaacugcgggagccauugugugugcggacucaaauucgaggccuccgaucgcaugcggauucacagagaaucuggccugugucagggguacaagagccuucgcaucgcuagacugcucugcaaguccaaaggaagcucucuggucauuuccggccugcucagcaugcugauccuuucuuuugugacgcccaucgagggcaccauuacaagcuacccugagucccggaaguauacccuggaagagaucacagacguggucgaagggcucguuucugagcaaaauauuaaagaauacaucguguucuauaccagccuguuuggaucccuuauucugcuccuggccuucaucaugagcauuacgcugucuaagaucacauccauccucgcuaaacgcaacgugauuuacugugaggagugcagcauguaucacucuaagagaggcaucaaguacaauggggauuuuaccaacaaauguggauucugcaccuguaacgaacaggaggacacagaaggccuggucauucauaagguguccaaacggugcaccuauaaguaccagcuuaaaugggccaagguucugaugaucacacucgugcugcugcuuauugcgcagaauacgauccucaucgucgccgcugagaccgauugcuggacaaagaaaagccuggacauugacuguaucgggccgaugcuggauauuggauccugcaccaacaagaauacacgcucuuacgacgccgaagcucaaaaacucgugagccaguccaagaucucucagcuggaugccgaccagguuagccuucugggcaacuccauugauagcgccaucaaagcuaucagagcgcaaaagaccuaucccacgaugcaccuccuggagaccauuuuucugaugaagaauugugacuacuauacaucuuucaaccauaauuccggcuacagccaggccaaauggcggcuuaucgcuaagaccgggcacuuugauauuugcucucgccauuccacacaccacuucuguagaugcaucaacgacggaaccaaaugucagaauggcaacugggauuuugccggggagaugaaugaaacguauaacagcaagaaugacuucuacucucaugaucucaaccuguucuauacaauuuuugagaaugccuucccuggaaccacagaaagccuguuuuaccaacucauccagaaaaagaacaccaccggcgcuucccaggugcuggggaaacuuaucacaaaguacggcaacaauaacauguucgucggaguguggaaguuuggccaguaucugcucacgcugcccuacauuaauaacaccgagcugagccaaaaucggagacuuacaauccucgccacccaggaacugcugucucgcucccacagcgggcggcaggaguccaugucuaacgcgauucagggaagcaucacaaaagagugccauaaugcuaagggcgucggguguauuuccccuagauucggaauccccauuggcaaccucaccgccugcggggacucuccgaauuauaaaaucuacaagacgccugaaaaacuguauaagagcaacaauaagggcgaggugugguguuccaacgacguucacugccuuaaugauuuugaacccgccgacgaggagguggucaacaaaaucaagaaacugacaugcuuccucaccgaugugucuguugaaguggacauuuuuagcgucgcugccuccaccuguaagauggcugauaaaggagugugcacagugaauggcgccaaguggaacaucauuaagugugacagcgggcuguacuauuucaccgaucaccgcgagggacaagacacaggcaacgauuuuggggaauacugcaucucucauuccuguaauacggagcgguucccuauuaaccccgacauccugaaagauugcaccugggaauuucacagcagaaagucuaaauacaucuccacaauuagccuugagucucucgaggaguuccgccgggcgauggccgaaaagcugucccauacccugacaaucuauaauuucaaacccaccgcuaaccucccucacauuagaccgacguacaaguuuaucaccgccaauggaguugaaaacagcgacggcauugaguccgcuuauauccugagcucuauccccgcccuugggggcauuagcgucggauacaaugugcagacaaaggauaacuucccucugcucgacaucauuguguuuaucaaauccgcggucauucgcaccacauauaaucauaucuacgacaccggccccacaauugggaucaacacccagcacgaugaacacuguacgggaccuugccccgccgugguuccgcauaaggagaauuggaugacauucucucaggagcggaccagcagauggggcugugaagaguuugggugccuggcuaucaacaccggauguguguucggcuccugccaagacauuauccacccugaaacaaaagucuaucgcaaggccguggaggaagagguugugcugaccgucugcauuaauuuucccgggaacaauuacuguacggagaucaacgcuauugaaccuaaaaucacagaugagaucgaacuucaguucaagaccguggacacaaaaacccugcccaaccuccuggccguucagaaucauaagcucuacucuggccagauuaacgaucugggcagcuuuucccaaggaugcgggaaugugcagaagacaaaccacucuauccuuggaaugggcaccgucaaauucgacuaugugugucauggggccagccggaaggaugugauugucagacggugcuacaauaacaauuuugacuccuguaaacugcucaaggaggagacgagccugaucuucgcugauaaccacgaaacccuggagguugcgcacacaaaacaucuuauuggagaacugcaguucaagaucaugcucggcgacauccgcuauaagucuuuugccgaguccccugaacuggagauugaugcuaaaugcgugggcugucccagcugcuucgagucuuacuccuguaauuuucaaaucgugaccaacauugacacagucugcagcguggaagggccguguacccucuuccacaauagaaucauuaucuccgccaacaagcagucuuauggacugaaaaugagcugccagacgaagccuaaucagaacgaggaauuuauuaucugcaaucggaaauacuccguucuuuucacaaccaucgauaagaacgacaagauugaggugaauacaggcgaccaaaccagcuauaucuacgaaaaagauucuagauguaagaccuggcugugccgcguccgggacgaggggauuuccgugcucuuugagccccugaaagccuucuuuggaagcuacuucucuaucauuuucuauguuguggucggcaucaucgugcuguuccuuauuaucuacauuuuucugcccauguucuucaagcucaaagauguucugaagagaaacgaauaucucuaccugcaggagcuuaagcauaaauga

SEQ ID NO: 14191 - RNA, 4305 nt, Artificial Sequence
  derived and/or modified CDS sequence (opt5) from CVV(MI80-1-450)__KX100149.1__GP
augcuguuccuccugauccuugccuuucugggcuucagcaccuccaaccccauugcuacaagaugcuuucacgggggacagcucaucgccgagucuaagagcgcgacguccauuucugaauuuugucugaaagacgaugugagcaugcuuaaguccgaggucguuuacaucaaaaaugacaccggccuguuugggcauaacaagguguuccggucuuggacaauuaaagauuggaagcucugcaauccuaucccgaccgcuggaggcacaaucaacgugauugaagucaauaaggaccugagccugaugaccaaaacauauaucuguucccgcgauugcaccauuacgaucgacaaggaggaagcccaaauuaucuuucagaccgauaaacucaaccacuucgaggugagcgggacaacccugucuuccggaugguuuaagagcaaagccucuguuacacuugacagaaccugugagcaugugaaggucacgugcggcaagaaaucccugcaguuccacgcuuguuuuaagcaucacaugagcugcgugcgguucuuucacaauacaauucuccccggcaacaugaucaccucuaugugucagaauaucgaacugauuaucauucuugggcugacacucgccaucuucauucugaugguuauccugaccaaaaccuacaucugcuaucuccugaugccuauuuucaugcccaucgcuuaccuuuauggaugggccuacaacaaguccuguaaaaagugcaauugcuguggccuggcguaucauccuuuuacaaacugcgggagccacugugugugcggacucaaauucgaggccuccgaucgcaugcggauucauagagaaucuggccugugucaaggguacaagagccuucgcaucgcuagacugcucugcaaguccaaaggaagcucucuggucauuuccggccugcucagcaugcugauccuuucuuuugugacgcccaucgagggcaccauuacaagcuacccugagucccggaaguauacccuggaagagaucacagacguggucgaagggcucguuucugagcagaauauuaaagaauacaucguguucuauaccagccuguuuggaucccuuauucugcuccuggccuucaucaugagcauuacgcugucuaagaucacauccauccucgcuaaacgcaacgugauuuacugugaggagugcagcauguaucacucuaagagaggcaucaaguacaauggggauuuuaccaacaaauguggauucugcaccuguaacgaacaggaggacacagaaggccuggucauucacaagguguccaaacggugcaccuauaaguaccagcuuaaaugggccaagguucugaugaucacacucgugcugcugcuuauugcgcaaaauacgauccucaucgucgccgcugagaccgauugcuggacaaagaaaagccuggacauugacuguaucgggccgaugcuggauauuggauccugcaccaacaagaauacacgcucuuacgacgccgaagcucagaaacucgugagccaguccaagaucucucagcuggaugccgaccaaguuagccuucugggcaacuccauugauagcgccaucaaagcuaucagagcgcagaagaccuaucccacgaugcaucuccuggagaccauuuuucugaugaagaauugugacuacuauacaucuuucaaccacaauuccggcuacagccaggccaaauggcggcuuaucgcuaagaccgggcauuuugauauuugcucucgccacuccacacaucacuucuguagaugcaucaacgacggaaccaaaugucaaaauggcaacugggauuuugccggggagaugaaugaaacguauaacagcaagaaugacuucuacucucacgaucucaaccuguucuauacaauuuuugagaaugccuucccuggaaccacagaaagccuguuuuaccagcucauccagaaaaagaacaccaccggcgcuucccaggugcuggggaaacuuaucacaaaguacggcaacaauaacauguucgucggaguguggaaguuuggccaauaucugcucacgcugcccuacauuaauaacaccgagcugagccagaaucggagacuuacaauccucgccacccaggaacugcugucucgcucccauagcgggcggcaggaguccaugucuaacgcgauucaaggaagcaucacaaaagagugccacaaugcuaagggcgucggguguauuuccccuagauucggaauccccauuggcaaccucaccgccugcggggacucuccgaauuauaaaaucuacaagacgccugaaaaacuguauaagagcaacaauaagggcgaggugugguguuccaacgacguucauugccuuaaugauuuugaacccgccgacgaggagguggucaacaaaaucaagaaacugacaugcuuccucaccgaugugucuguugaaguggacauuuuuagcgucgcugccuccaccuguaagauggcugauaaaggagugugcacagugaauggcgccaaguggaacaucauuaagugugacagcgggcuguacuauuucaccgaucaccgcgagggacaggacacaggcaacgauuuuggggaauacugcaucucucacuccuguaauacggagcgguucccuauuaaccccgacauccugaaagauugcaccugggaauuucauagcagaaagucuaaauacaucuccacaauuagccuugagucucucgaggaguuccgccgggcgauggccgaaaagcugucccacacccugacaaucuauaauuucaaacccaccgcuaaccucccucauauuagaccgacguacaaguuuaucaccgccaauggaguugaaaacagcgacggcauugaguccgcuuauauccugagcucuauccccgcccuugggggcauuagcgucggauacaaugugcagacaaaggauaacuucccucugcucgacaucauuguguuuaucaaauccgcggucauucgcaccacauauaaucacaucuacgacaccggccccacaauugggaucaacacccagcaugaugaacacuguacgggaccuugccccgccgugguuccgcacaaggagaauuggaugacauucucucaagagcggaccagcagauggggcugugaagaguuugggugccuggcuaucaacaccggauguguguucggcuccugccaggacauuauccauccugaaacaaaagucuaucgcaaggccguggaggaagagguugugcugaccgucugcauuaauuuucccgggaacaauuacuguacggagaucaacgcuauugaaccuaaaaucacagaugagaucgaacuucaguucaagaccguggacacaaaaacccugcccaaccuccuggccguucagaaucacaagcucuacucuggccaaauuaacgaucugggcagcuuuucccagggaugcgggaaugugcagaagacaaaccauucuauccuuggaaugggcaccgucaaauucgacuaugugugucacggggccagccggaaggaugugauugucagacggugcuacaauaacaauuuugacuccuguaaacugcucaaggaggagacgagccugaucuucgcugauaaccaugaaacccuggagguugcgcacacaaaacaccuuauuggagaacugcaauucaagaucaugcucggcgacauccgcuauaagucuuuugccgaguccccugaacuggagauugaugcuaaaugcgugggcugucccagcugcuucgagucuuacuccuguaauuuucagaucgugaccaacauugacacagucugcagcguggaagggccguguacccucuuccauaauagaaucauuaucuccgccaacaagcagucuuauggacugaaaaugagcugccagacgaagccuaaucaaaacgaggaauuuauuaucugcaaucggaaauacuccguucuuuucacaaccaucgauaagaacgacaagauugaggugaauacaggcgaccagaccagcuauaucuacgaaaaagauucuagauguaagaccuggcugugccgcguccgggacgaggggauuuccgugcucuuugagccccugaaagccuucuuuggaagcuacuucucuaucauuuucuauguuguggucggcaucaucgugcuguuccuuauuaucuacauuuuucugcccauguucuucaagcucaaagauguucugaagagaaacgaauaucucuaccugcaggagcuuaagcacaaauga

SEQ ID NO: 14192 - RNA, 4305 nt, Artificial Sequence
  derived and/or modified CDS sequence (opt5) from CVV(MNZ-92011)__KC436107.1__GP
augcuguuccuccugauccuugccuuucugggcuucagcaccuccaaccccauugcuacaagaugcuuucacgggggacagcucaucgccgagucuaagagcgcgacguccauuucugaguucugucugaaagacgaugugagcaugcuuaaguccgaagucguuuacaccaaaaaugacacaggccuguuugggcauaacaagguguuccggucuuggaccaucaaagauuggaagcucugcaauccuauuccgacagcuggaggcaccaucaacgugaucgaagucaauaaggaccugagccugaugacaaaaaccuauauuuguucccgcgauugcacgaucaccauugacaaggaggaagcccaaaucauuuuucagacagauaaacucaaccacuucgaggugagcgggaccacacuuaauucuggaugguuuaaguccaaagccagcguuacccuugacagaacgugugagcaugugaaggucacaugcggcaagaaaucucugcaguuccacgcuuguuuuaagcaucacauguccugcgugcgguucuuucacaacaccauccuccccggcaauaugauuaacagcaugugucagaauaucgaacugaucauuauccuugggcugacacucgccauuuucauccugaugguuaugcugaccaaaaccuacauuugcuaucuccugaugccuaucuucaugcccaucgcuuaccuuuauggaugggccuacaacaagucuuguaaaaagugcaauugcuguggccuggcguaucauccuuuuacaaacugcgggucccacugugugugcggacucaaauucgaggccagcgaucgcaugcggauucauagagaauccggccugugucaaggguacaagucucuucgcaucgcuagacugcucugcaagagcaaaggauccagccuggucauuucuggccugcucuccaugcugauccuuagcuuugugacgcccauugagggcaccaucacaucuuacccugagagccggaaguauacccuggaagagaucacagacguggucgaagggcucguuuccgagcagaauauuaaagaauacaucguguucuauaccucucuguuuggaagccuuauucugcuccuggccuucaucauguccauuacgcugagcaagaucacaucuauucucgcucgcagaaacgugaucuacugugaggagugcuccauguaucacagcaaacggggcaucaaguacaacggggauuuuaccaauaaguguggauucugcaccuguaacgaacaggaggacgccgaaggccuggucauucacaaagugucuaagcgcugcacauauaaauaccagcuuaagugggcgaaaguucugauggugacccucguccugcugcuuaucgcccaaaauacaauucucaucguggcugccgggacggauugcugggcuaagaagucccuggacauggacuguauuggaccgaugcuggauaucggcagcugcaccaacaaaaauacaagaaacuacgacaccgaggcccagaagcucguuucccagucuaaagugagccagcuggaugccgaccaagcgucccuucugggcaauucuaucgauagcgcuauuaaggccauccgggcucagaaaacauaucccaccaugcaucuccuggaaacgauuuuucugaugaagaacugugacuacuauaccuccuucaaucacaacagcggguacucucaggccaaguggcgccuuaucgccaaaacaggacauuuugauauuugcuccagacacagcacccaucacuucugucggugcaucaaugacggcacaaagugucaaaacggggauugggacuuugcuggagagaugaaugagaccuauaacucuaaaaaugauuucuacucccacgaccucaaccuguucuauacgaucuuugaaaacgccuucccuggcacaaccgagagccuguuuuaccagcucauucagaagaaaaauacagcgggggcuucuaagauccugggcaaacuuauuaccaaguacggaaacaauaacauguucgucggcguguggaaguuugggcaguaucugcucacccugcccuacaucaauaacacagaacugagccaaaauagacgccagacgauucuugccacccaggagucccucagccggucucauuccggaagacaggaaagcauguccucugccauccaaggcagcgucacaaaagagugccacaacgcuaaggacgugggguguaucuccccucgcuucggcauucccaucggaaaucugaccgccugcggggauucuccgaacuauaaaauuuacaagacaccugagaaacuguauaagagcaauaacaagggcgaaguuugguguuccaaugacgugcauugccucaacgauuuugagcccgcugacgaagaggucgugaauaaaguuaagaaacugaccugcuuccuuacggaugugucugucaagacagacaucuuuagcguggccgcguccaccuguaaaauggccgauaagggaauuugcaccgugaacgacgcuaaguggaacaucauuaaaugugauagcggccuguacuauuucacagaccaccgggaggggcaggauaccggaaaugacuuuggcgaauacugcaucucucacuccuguaacacagagagauucccuaucaaucccgauauucucaaggacugcacgugggaauuucauagccgcaaaucuaaguacaucuccaccauuagccuggagucucuggaagaguuccggagagccaugacagagaaacuuucccacacccucacaaucuauaacuucaagcccaccgcuaaucugccucauauucgcccgacguacaaguuuaucaccgccaacgggguugaaaauagcgacggaaucgaguccgcguauauucugagcucuauccccgcccucggcgggauuagcgucggcuacaacgugcagacaaaagauaauuucccucugcuugacaucauuguguuuaucaaguccgcugucauccggaccacauauaaccacauuuacgauaccggacccacaaucggcauuaauacccagcaugacgaacacuguacggggccuugccccgccgugguuccgcacaaagagaacuggaucacauucucucaagaaagaaccagccgcuggggaugugaggaguuuggcugccuggcuauuaauaccggguguguguucggauccugccaggauaucauucauccugaaacaaaggucuaucggaaagccguggaggaagagguugugcucaccgucugcaucaacuuucccggcaauaacuacuguacggaaaucaacgccguggagccuaagauuacagacgagaucgaacugcaguucaaaaccguugauacaaagacccugcccaaucuucuggcugugcagaaccacaagcucuacucugggcaaauuaaugaccugggcagcuuuucccagggaugcggcaacguccagaaaacaaaucauucuauccucgggaugggaaccgcgaaguucgauuaugugugucacggcgccagcagaaaagacgugauuguccggcgcugcuacaacaauaacuuugauuccuguagacugcuuaaggaggaaacgagccugaucuucgcugacaaucaugagacccucgagguugcccacacaaaacaccugaucggggaacugcaauucaagauuaugcuuggagauauccgguauaagucuuuugccgaguccccugaacuggagauugacgcuaaaugcgugggcugucccagcugcuucgaaucuuacuccuguaacuuucagaucgugaccaauauugacacagucugcagcguggagggcccguguacccucuuccauaacagaaucaucauuuccgccaauaagcagucuuaugggcugaaaaugagcugccagacgaagccuaaccaaaaugaggaauuuaucauuugcaaccgcaaauacuccguucucuucacaaccaucgauaagaaugacaagauugaggugaacacaggagaucagaccagcuauaucuacgaaaaagacucucgguguaagaccuggcugugcagaguccgcgaugagggcauuuccgugcuuuuugaaccccugaaagcguucuuugggagcuacuucucuaucaucuuuuauguuguggucggaauuaucguucucuuccugauuaucuacauuuuucugcccauguucuucaagcugaaagacgugcugaagagaaacgaguaucucuaccugcaggagcucaagcacaaauga

SEQ ID NO: 14193 - RNA, 4305 nt, Artificial Sequence
  derived and/or modified CDS sequence (opt5) from CVV(MPB1-1551)__KX100143.1__GP
augcuguuccuccugauccuugccuuucugggcuucagcaccuccaaccccauugcuacaagaugcuuucacgggggacagcucaucgccgagucuaagagcgcgacguccauuucugaauuuugucugaaagacgaugugagcaugcuuaaguccgaggucguuuacaucaaaaaugacaccggccuguuugggcauaacaagguguuccggucuuggacaauuaaagauuggaagcucugcaauccuaucccgaccgcuggaggcacaaucaacgugauugaagucaauaaggaccugagccugaugaccaaaacauauaucuguucccgcgauugcaccauuacgaucgacaaggaggaagcccaaauuaucuuucagaccgauaaacucaaccacuucgaggugagcgggacaacccugucuuccggaugguuuaagagcaaagccucuguuacacuugacagaaccugugagcaugugaaggucacgugcggcaagaaaucccugcaguuccacgcuuguuuuaagcaucacaugagcugcgugcgguucuuucacaauacaauucuccccggcaacaugaucaccucuaugugucagaauaucgaacugauuaucauucuugggcugacacucgccaucuucauucugaugguuaugcugaccaaaaccuacaucugcuaucuccugaugccuaucuucaugcccauugcuuaccuuuauggaugggccuacaacaaguccuguaaaaagugcaauugcuguggccuggcguaucauccuuuuacaaacugcgggagccacugugugugcggacucaaauucgaggccuccgaucgcaugagaauccaucgggaaucuggccugugucaaggguacaagagccuucgcauugcuagacugcucugcaaguccaaaggaagcucucuggucaucuccggccugcucagcaugcugauucuuucuuuugugacgcccaucgagggcaccaucacaagcuacccugagucccggaaguauacccuggaagagauuacagacguggucgaagggcucguuucugagcagaauaucaaagaauacauuguguucuauaccagccuguuuggaucccuuauccugcuccuggccuucauuaugagcaucacgcugucuaagauuacauccauccucgcuaaacgcaacgugaucuacugugaggagugcagcauguaucacucuaagagaggcauuaaguacaauggggauuuuaccaacaaauguggauucugcaccuguaacgaacaggaggacacagaaggccuggucauccacaagguguccaaacggugcaccuauaaguaccagcuuaaaugggccaagguucugaugauuacacucgugcugcugcuuaucgcgcaaaauacgauucucaucgucgccgcugagaccgauugcuggacaaagaaaagccuggacaucgacuguauugggccgaugcuggauaucggauccugcaccaacaagaauacacgcucuuacgacgccgaagcucagaaacucgugagccaguccaagauuucucagcuggaugccgaccaagccagccuucugggcaacuccaucgauagcgcuauuaaagcgaucagagcccagaagaccuaucccacgaugcaucuccuggagaccaucuuucugaugaagaauugugacuacuauacaucuuucaaccacaauuccggcuacagccaggcuaaauggcggcuuauugccaagaccgggcauuuugauaucugcucucgccacuccacacaucacuucuguagaugcauuaacgacggaaccaaaugucaaaauggcgauugggacuuugccggggagaugaacgaaacguauaauagcaagaacgauuucuacucucacgaccucaaucuguucuauacaaucuuugagaacgcuuucccuggaaccacagaaagccuguuuuaccagcucauucagaaaaagaauaccaccggcgccuccaaaguucuggggaaacuuaucacaaaguacggcaacaacaauauguucgugggagucuggaaguuuggccaguaucugcucacgcugcccuacaucaacaauaccgagcugagccaaaaccggagacuuacaauucucgcgacccaggaaauccugucucgcucccauagcgggcggcaggaguccaugucuaaugcuauucagggaagcaucacaaaggagugccacaacgccaaaggcgugggguguauuuccccuagauucggaauccccauuggcaaucugaccgccugcggggacucuccgaacuauaagaucuacaaaacgccugaaaagcucuauaagagcaauaacaaaggcgaggucugguguuccaaugaugugcauugccugaacgacuuugaacccgcugaugaggagguuaucaauaagauuaaaaagcugacaugcuuccugaccgacgugucugucgaaguggauaucuuuagcguugccgcuuccaccuguaaaauggccgacaagggagugugcacagucaacggcgcgaaguggaauauuaucaaaugugauagcgggcucuacuauuucaccgaccaccgcgagggacaagauacaggcaacgacuuuggggaauacugcauuucucacuccuguaacacggagcgguucccuaucaaucccgauacccugaaggacugcacaugggaauuucauagcagaaaaucuaaguacaucuccaccauuagccuggagucucuugaggaguuccgccgggccauggcugaaaaacucucccacacacugaccaucuauaacuucaagcccacggccaaucugccucauauuagaccgaccuacaaguuuaucacagcuaacggaguggaaaauagcgauggcauugaguccgccuauauccucagcucuauccccgcgcuugggggcauuagcgugggauacaacguucagaccaaagacaauuucccucuucuggacaucauugucuuuaucaaguccgccgugauucgcacaaccuauaaccacaucuacgauacaggccccaccauugggaucaauacgcagcaugacgaacacuguacaggaccuugccccgcuguggucccgcacaaagagaacuggaugaccuucucucaggagcggaccagcagauggggcugugaagaguuugggugccucgccaucaauacaggauguguguucggcuccugccaagauauuauccauccugaaaccaagguuuaucgcaaagcuguggaggaagaggucgugcugacgguuugcauuaacuuucccggcaauucuuacuguacagagaucaacgccauugaaccuaagaucaccgacgagaucgaacugcaguucaaaacaguggauaccaagacacuucccaaucugcucgccguccagaaccacaagcuguacagcgggcagauuaacgaccucggauccuuuucucaaggcugcgggaaugugcagaaaaccaaccauagcauccugggaaugggcacgguuaaguucgauuaugugugucacggggcuucccggaaagacgucauugugagacggugcuacaauaacaauuuugauagcuguaaacuucugaaggaggagaccucucucaucuucgcggacaaccaugaaacacuggagguggcccacaccaagcaccugauuggagaacuucaguucaagaucaugcugggcgauauccgcuauaaauccuuugcugagagcccugaacucgagauugacgccaagugcgucggcugucccucuugcuucgaguccuacagcuguaauuuucaaaucguuacaaacauugauaccgugugcuccguggaagggccguguacgcuguuccauaauagaaucauuaucucugccaacaaacagagcuauggacucaagauguccugccagacaaaaccuaaucagaacgaggaauuuauuaucugcaaucggaaguacagcguccuguucaccacaaucgacaagaacgacaaaauugaggugaauaccggcgaucaaaccucuuauaucuacgaaaaggacuccagauguaaaacauggcuuugccgcguucgggaugaggggauuagcgugcuguuugagccccucaaggcuuucuuuggaucuuacuucagcaucauuuucuaugucgugguuggcaucaucgugcuguuccugauuaucuacauuuuucuucccauguucuucaaacugaaggacguccucaagagaaacgaauaucuguaccuccaggagcugaaacacaaguga

SEQ ID NO: 14194 - RNA, 4305 nt, Artificial Sequence
  derived and/or modified CDS sequence (opt5) from CVV(W308-67)__KX100140.1__GP
augcuguuccuccugauccuugccuuucugggcuucagcaccuccaaccccauugcuacaagaugcuuucacgggggacagcucaucgccgagucuaagagcgcgacguccauuucugaauuuugucugaaagacgaugugagcaugcuuaaguccgaggucguuuacaucaaaaaugacaccggccuguuugggcauaacaagguguuccggucuuggacaauuaaagauuggaagcucugcaauccuaucccgaccgcuggaggcacaaucaacgugauugaagucaauaaggaccugagccugaugaccaaaacauauaucuguucccgcgauugcaccauuacgaucgacaaggaggaagcccaaauuaucuuucagaccgauaaacucaaccacuucgaggugagcgggacaacccugucuuccggaugguuuaagagcaaagccucuguuacacuugacagaaccugugagcaugugaaggucacgugcggcaagaaaucccugcaguuccacgcuuguuuuaagcaucacaugagcugcgugcgguucuuucacaauacaauucuccccggcaacaugaucaccucuaugugucagaauaucgaacugauuaucauucuugggcugacacucgccaucuucauucugaugguuacccugaccaaaacauacaucugcuaucuccugaugccuaucuucaugcccauugcuuaccuuuauggaugggccuacaacaaguccuguaaaaagugcaauugcuguggccuggcguaucauccuuuuacgaacugcgggagccacugugugugcggacucaaauucgaggccuccgaucgcaugagaauccaucgggaaucuggccugugucaaggguacaagagccuucgcauugcuagacugcucugcaaguccaaaggaagcucucuggucaucuccggccugcucagcaugcugauucuuucuuuugugacccccaucgagggcacaaucaccagcuacccugagucccggaaguauacacuggaagagauuaccgacguggucgaagggcucguuucugagcagaauaucaaagaauacauuguguucuauacgagccuguuuggaucccuuauccugcuccuggccuucauuaugagcaucacacugucuaagauuaccuccauccucgcuaaacgcaacgugaucuacugugaggagugcagcauguaucacucuaagagaggcauuaaguacaauggggauuuuaccaacaaauguggauucugcacauguaacgaacaggaggacaccgaaggccuggucauccacaagguguccaaacggugcacauauaaguaccagcuuaaaugggccaagguucugaugauuacgcucgugcugcugcuuaucgcgcaaaauaccauucucaucgucgccgcugagacagauugcuggaccaagaaaagccuggacaucgacuguauugggccgaugcuggauaucggauccugcacaaacaagaauacccgcucuuacgacgccgaagcucagaaacucgugagccaguccaagauuucucagcuggaugccgaccaagccagccuucugggcaacuccaucgauagcgcuauuaaagcgaucagagcccagaagacguaucccaccaugcaucuccuggagacaaucuuucugaugaagaauugugacuacuauaccucuuucaaccacaauuccggcuacagccaggcuaaauggcggcuuauugccaagacagggcauuuugauaucugcucucgccacuccacccaucacuucuguagaugcauuaacgacgagacgaaaugucaaaauggagauugggacuuugccggcgaaaugaacgagacauauaagagcaaaaaugauuucuacucucacgaccucaaccuguucuauaccaucuuugaaaaugcuuucccugggacaaccgagagccuguuuuaccagcucauucagaagaaaaacaccacaggagccuccaagguucugggcaaacuuaucacgaaauacgggaauaacaacauguucgugggcgucuggaaguuuggacaguaucugcucacccugcccuacaucaauaacacagaacugagccaaaaucggagacuuaccauucucgcgacacaggagauccugucucgcuccuauagcggccggcaggaguccaugucuaacgcuauucaggggagcaucaccaaagaaugccauaaugccaagggagugggcuguauuuccccuagauucgggauccccauuggaaaccugacggccugcggcgacucuccgaauuacaaaaucuauaagacaccugagaagcucuacaaaagcaacaauaagggggaagucugguguuccaacgaugugcacugccugaaugacuuugagcccgcugaugaggaaguuaucaacaaaauuaagaaacuuaccugcuuccugaccgacgugucugucgagguggauaucuuuagcguugccgcuuccacauguaagauggccgacaagggcgugugcaccgucaauggagcgaaauggaacauuaucaagugugauagcggccucuauuacuucacagaccaucgcgaagggcaagauacgggaaaugacuuuggcgaguacugcauuucucacuccuguaacaccgaacgguucccuaucaaccccgauacacugaaagacugcaccugggaguuucacagcagaaagucuaaauauaucuccacaauuagccuggagucucuugaagaguuccgccgggccauggcugaaaagcucucccauacccugacgaucuacaauuucaagcccaccgccaaccugccucacauuagaccgacauauaaauuuaucaccgcuaaugggguggagaacagcgauggaauugaauccgccuacauccucagcucuauccccgcgcugggcgggauuagcgugggcuauaauguucagacaaaggacaacuucccucuucuggacaucauugucuuuaucaaauccgccgugauucgcaccacauacaaucauaucuaugauaccggacccacgauuggcaucaacacacagcacgacgagcauuguaccgggccuugccccgcuguggucccgcacaaggagaauuggaugaccuucucucaggaacggacaagcagauggggaugugaggaauuuggcugccucgccaucaacaccggguguguguucggauccugccaagauauuauccacccugagacgaaaguuuaccgcaaggcuguggaagaggaggucgugcugacaguuugcauuaauuuucccggcaacaauuacuguaccgaaaucaacgccauugagccuaaaaucacagacgaaaucgagcugcaguucaagaccguggauacaaagacccuucccaaucugcucgccguccagaaccauaaacuguauucugggcagauuaacgaccucggcagcuuuucccaaggaugcggcaaugugcagaagacgaaccacucuauccuggggaugggaaccguuaaauucgauuacgugugucauggcgcuagccggaaggacgucauugugagacggugcuauaauaacaauuuugauuccuguaaacuucugaaggaggaaacaagccucaucuucgcggacaaccacgagacccuggaaguggcccauacaaagcaccugauuggggagcuucaguucaaaaucaugcugggagauauccgcuacaagucuuuugcugaauccccugagcucgagauugacgccaaaugcgucggcugucccagcugcuucgaaucuuauuccuguuacuuucaaaucguuaccaauauugauacggugugcagcguggagggcccguguacacuguuccacaacagaaucauuaucuccgccaauaagcagucuuaugggcucaaaaugagcugccagaccaagccuaaccagaaugaagaguuuauuaucugcaaccggaaguacuccguccuguucacaaccaucgacaaaaaugacaagauugaagugaacaccggagaucaaacaagcuacaucuaugagaaagacucuagauguaagacguggcuuugccgcguucgggaugagggcauuuccgugcuguuugaaccccucaaggcuuucuuugggagcuacuucucuaucauuuucuaugucgugguuggaaucaucgugcuguuccugauuaucuacauuuuucuucccauguucuucaagcugaaggacguccucaaaagaaaugaguaucuguaccuccaggaacugaagcauaaauga

SEQ ID NO: 14195 - RNA, 4305 nt, Artificial Sequence
  derived and/or modified CDS sequence (opt5) from CVV(W728-67)__KX100137.1__GP
augcuguuccuccugauccuugccuuucugggcuucagcaccuccaaccccauugcuacaagaugcuuucacgggggacagcucaucgccgagucuaagagcgcgacguccauuucugaauuuugucugaaagacgaugugagcaugcuuaaguccgaggucguuuacaucaaaaaugacaccggccuguuugggcauaacaagguguuccggucuuggacaauuaaagauuggaagcucugcaauccuaucccgaccgcuggaggcacaaucaacgugauugaagucaauaaggaccugagccugaugaccaaaacauauaucuguucccgcgauugcaccauuacgaucgacaaggaggaagcccaaauuaucuuucagaccgauaaacucaaccacuucgaggugagcgggacaacccugucuuccggaugguuuaagagcaaagccucuguuacacuugacagaaccugugagcaugugaaggucacgugcggcaagaaaucccugcaguuccacgcuuguuuuaagcaucacaugagcugcgugcgguucuuucacaauacaauucuccccggcaacaugaucaccucuaugugucagaauaucgaacugauuaucauucuugggcugacacucgccaucuucauucugaugguuaugcugaccaaaaccuacaucugcuaucuccugaugccuaucuucaugcccauugcuuaccuuuauggaugggccuacaacaaguccuguaaaaagugcaauugcuguggccuggcguaucauccuuuuacaaacugcgggagccacugugugugcggacucaaauucgaggccuccgaucgcaugagaauccaucgggaaucuggccugugucaaggguacaagagccuucgcauugcuagacugcucugcaaguccaaaggaagcucucuggucaucuccggccugcucagcaugcugauucuuucuuuugugacgcccaucgagggcaccaucacaagcuacccugagucccggaaguauacccuggaagagauuacagacguggucgaagggcucguuucugagcagaauaucaaagaauacauuguguucuauaccagccuguuuggaucccuuauccugcuccuggccuucauuaugagcaucacgcugucuaagauuacauccauccucgcuaaacgcaacgugaucuacugugaggagugcagcauguaucacucuaagagaggcauuaaguacaauggggauuuuaccaacaaauguggauucugcaccuguaacgaacaggaggacacagaaggccuggucauccacaagguguccaaacggugcaccuauaaguaccagcuuaaaugggccaagguucugaugauuacacucgugcugcugcuuaucgcgcaaaauacgauucucaucgucgccgcugagaccgauugcuggacaaagaaaagccuggacaucgacuguauugggccgaugcuggauaucggauccugcaccaacaagaauacacgcucuuacgacgccgaagcucagaaacucgugagccaguccaagauuucucagcuggaugccgaccaagccagccuucugggcaacuccaucgauagcgcuauuaaagcgaucagagcccagaagaccuaucccacgaugcaucuccuggagaccaucuuucugaugaagaauugugacuacuauacaucuuucaaccacaauuccggcuacagccaggcuaaauggcggcuuauugccaagaccgggcauuuugauaucugcucucgccacuccacacaucacuucuguagaugcauuaacgacggaaccaaaugucaaaauggcgauugggacuuugccggggagaugaacgaaacguauaauagcaagaacgauuucuacucucacgaccucaaucuguucuauacaaucuuugagaacgcuuucccuggaaccacagaaagccuguuuuaccagcucauucagaaaaagaauaccaccggcgccuccaaaauccuggggaaacuuaucacaaaguacggcaacaacaauaugguugugggagucuggaaguucggccaguaucugcucacgcugcccuacauuaacaauaccgagcugagccaaaaccggagacuuacaauccucgcgacccaggaacugcugucucgcucccauagcgggcggcaggaguccaugucuaaugcuauucagggaagcaucacaaaggagugccacaacgccaaaggcgugggguguauuuccccuagauuuggaauccccauuggcaaucucaccgccugcggggacucuccgaacuauaagaucuacaaaacgccugaaaagcuguauaagagcaauaacaaaggcgaggucugguguuccaaugaugugcauugccuuaacgacuucgaacccgcugaugaggagguugugaauaagaucaaaaagcugacaugcuuucucaccgacgucucuguggaaguugauauuuucagcguggccgcuuccaccuguaaaauggccgacaagggagucugcacagugaacggcgcgaaguggaauaucauuaaaugugauagcgggcuguacuauuuuaccgaccaccgcgagggacaagauacaggcaacgacuucggggaauacugcaucucucacuccuguaacacggagcgguuuccuauuaaucccgauacccugaaggacugcacaugggaguuccauagcagaaaaucuaaguacaucuccaccaucagccuugaaucucucgaggaauuucgccgggccauggcugagaaacugucccacacacugaccauuuauaacuucaagcccacggccaaucucccucauaucagaccgaccuacaaguucauuacagcuaacggaguggaaaauagcgauggcaucgaguccgccuauauucugagcucuauccccgcgcuugggggcaucagcguuggauacaacguccagaccaaagacaauuuuccucugcucgacauuaucguguucauuaaguccgccgugauccgcacaaccuauaaccacauuuacgauacaggccccaccaucgggauuaauacgcagcaugacgaacacuguacaggaccuugccccgcugucgugccgcacaaagagaacuggaugaccuuuucucaggagcggaccagcagauggggcugugaagaguucgggugccuggccaucaauacaggauguguuuuuggcuccugccaagauaucauucauccugaaaccaagguguaucgcaaagcugucgaggaagaggugguucugacggugugcaucaacuuccccgggaauaacuacuguacagagauuaaugccaucgaaccuaagauuaccgacgagaucgaacuucaguuuaaaacagucgauaccaagacacugcccaaccuccuggccgugcagaaccacaagcucuacucuggccagaucaaugaccugggcagcuucucccaaggaugcgggaacguucagaaaaccaaucauucuauucuuggaaugggcacggugaaguuugauuaugucugucacggggcuagccggaaagacgugaucgugagacggugcuacaacaauaacuucgauuccuguaagcugcucaaagaggagaccagccugauuuuugcggacaaucaugaaacacuggaggucgcccacaccaagcaccuuaucggagaacugcaguucaagauuaugcucggcgauauccgcuauaaaucuuucgcugaguccccugaacuggagaucgacgccaagugcguuggcugucccagcugcuuugagucuuacuccuguaacuuccaaauugugacaaauaucgauaccgugugcagcgucgaagggccguguacgcucuuucauaacagaauuaucauuuccgccaauaaacagucuuauggacugaagaugagcugccagacaaaaccuaaccagaaugaggaguucaucauuugcaaccggaaguacuccgugcuuuuuaccacaaucgacaagaaugacaaaaucgaaguuaacaccggcgaucaaaccagcuauauuuacgaaaaggacucuagauguaaaacauggcugugccgcgugcgggaugaggggaucuccguccucuucgagccccugaaggcuuucuucggaagcuacuuuucuauuaucuucuaugugguugugggcauuaucguccuguuucuuaucauuuacaucuuccugcccauguuuuucaaacucaaggacgugcugaagagaaaugaauaucucuaccugcaggagcuuaaacacaaguga

SEQ ID NO: 14196 - RNA, 4305 nt, Artificial Sequence
  derived and/or modified CDS sequence (opt5) from CVV(WI-03BS7669)__KX100152.1__GP
augcuguuccuccugauccuugccuuucugggcuucagcaccuccaaccccauugcuacaagaugcuuucacgggggacagcucaucgccgagucuaagagcgcgacguccauuucugaguucugucugaaagacgaugugagcaugcuuaaguccgaagucguuuacaucaaaaaugacaccggccuguuugggcauaacaagguguuccggucuuggacaauuaaagauuggaagcucugcaauccuaucccgaccgcuggaggcacaaucaacgugauugaagucaauaaggaccugagccugaugaccaaaacauauaucuguucccgcgauugcaccauuacgaucgacaaggaggaagcccaaauuaucuuucagaccgauaaacucaaccacuucgaggugagcgggacaacccugucuuccggaugguuuaagagcaaagccucuguuacacuugacagaaccugugagcaugugaaggucacgugcggcaagaaaucccugcaguuccacgcuuguuuuaagcaucacaugagcugcgugcgguucuuucacaauacaauucuccccggcaacaugaucaccucuaugugucagaauaucgaacugauuaucauucuugggcugacacucgccaucuucauucugaugguuauccugaccaaaaccuacaucugcuaucuccugaugccuauuuucaugcccaucgcuuaccuuuauggaugggccuacaacaaguccuguaaaaagugcaauugcuguggccuggcguaucauccuuuuacaaacugcgggagccacugugugugcggacucaaauucgaggccuccgaucgcaugcggauucauagagaaucuggccugugucaaggguacaagagccuucgcaucgcuagacugcucugcaaguccaaaggaagcucucuggucauuuccggccugcucagcaugcugauccuuucuuuugugacgcccaucgagggcaccauuacaagcuacccugagucccggaaguauacccuggaagagaucacagacguggucgaagggcucguuucugagcagaauauuaaagaauacaucguguucuauaccagccuguuuggaucccuuauucugcuccuggccuucaucaugagcauuacgcugucuaagaucacauccauccucgcuaaacgcaacgugauuuacugugaggagugcagcauguaucacucuaagagaggcaucaaguacaauggggauuuuaccaacaaauguggauucugcaccuguaacgaacaggaggacacagaaggccuggucauucacaagguguccaaacggugcaccuauaaguaccagcuuaaaugggccaagguucugaugaucacacucgugcugcugcuuauugcgcaaaauacgauccucaucgucgccgcugagaccgauugcuggauuaagaaaagccuggacaucgacuguauugggccgaugcuggauaucggauccugcacaaacaagaauacccgcucuuacgacacagaagcccagaaacucgugagccaguccaagauuucucagcuggaugcugaccaaguuagccuucugggcaacuccaucgauagcgccaucaaagccauuagagcucagaagaccuauucuacgaugcaucuccuggagaccaucuuucugaugaagaauugugacuacuauacauccuucaaccacaauagcggcuacucucaggcgaaauggcggcuuauugccaagaccgggcauuuugauaucugcucccgccacagcacacaucacuucuguagaugcauuaacgacggaaccaaaugucaaaauggcgauugggacuuugcuggggagaugaacgaaacguauaauucuaagaacgauuucuacagccacgaccucaaucuguucuauacaaucuuugagaacgccuuccccggaaccacagaaucccuguuuuaccagcucauccagaaaaagaauaccaccggcgccagcaaagugcuggggaagcucauuacaaaguacggcaacaacaauauguucgucggaguguggaaauuuggccaguaucugcucacgcugccuuacaucaacaauaccgagcugucucaaaaccggagacuuacaauucucaccacacaggaacugcugucccgcagccauuccgggcggcaggagucuaugagcaaugcuauccagggauccauuaccaaggagugccacaacgccaaaggcgucggguguaucucucccagauucggcauuccuaucggaaaucucacggcgugcggggacagccccaacuauaagaucuacaaaacaccggaaaagcuguauaaguccaauaacaaaggcgaggugugguguucuaaugauguucauugccuuaacgacuuugaaccugcugaugaggagguggucaauaagauuaaaaagcugaccugcuuccucaccgacgugagcguugaaguggauaucuuuuccgucgccgccagcacauguaaaauggcugacaagggagugugcaccgugaacggcgccaaguggaauauuaucaaaugugauucugggcuguacuauuucacagaccaccgcgagggacaagauacgggcaacgacuuuggggaauacugcauuucccacagcuguaacaccgagcgguuccccaucaauccugauauccugaaggacugcacaugggaauuucauucuagaaaauccaaguacauuagcaccaucucucuugagucccucgaggaguuccgccgggcuauggccgaaaaacugagccacacacugaccauuuauaacuucaagcccacggcgaaucucccccauaucagaccuaccuacaaguuuauuacagccaacggaguugaaaauuccgauggcaucgagagcgcuuauauccugucuagcauuccggcccuugggggcaucuccgucggauacaacgugcagaccaaagacaauuucccccugcucgacauuaucguguuuauuaagucugcugucauccgcacaaccuauaaccacauuuacgauacaggcccuaccaucgggaucaauacgcagcaugacgaacacuguacaggacccugcccugccgugguuccccacaaagagaacuggaugaccuucagccaggagcggaccuccagauggggcugugaagaguuugggugccuggcgauuaauacaggauguguguucggcucuugccaagauaucauucauccggaaaccaaggucuaucgcaaagccguggaggaagagguugugcugacggucugcaucaacuuuccugggaauaacuacuguacagagauuaaugcuaucgaacccaagaucaccgacgagauugaacuucaguucaaaacaguggauaccaagacacugccuaaccuccuggccguucagaaccacaagcucuacagcggccagaucaaugaccugggauccuuuucucaaggcugcgggaacgugcagaaaaccaaucauagcauucuuggaaugggcacggucaaguucgauuaugugugucacggggcuucccggaaagacgugaucgucagacggugcuacaacaauaacuuugauagcuguaagcugcucaaagaggagaccucucugauuuucgccgacaaucaugaaacacuggagguugcccacaccaagcaccuuaucggagaacugcaguucaagaucaugcucggcgauauucgcuauaaauccuuugcugagagccccgaacuggagaucgacgcgaagugcgugggcuguccuucuugcuucgaguccuacagcuguaacuuucaaauugugacaaauaucgauaccgucugcuccguggaagggcccuguacgcuuuuccauaacagaauuaucauuucugccaauaaacagagcuauggacugaagauguccugccagacaaaaccgaaccagaaugaggaauuuaucaucugcaaccggaaguacagcguucuuuucaccacaauugacaagaaugacaaaaucgaggugaacaccggcgaucaaaccucuuauauuuacgaaaaggacuccagauguaaaacauggcugugccgcguccgggaugaggggaucagcgugcucuuugagccucugaaggcuuucuuuggaucuuacuucagcauuaucuuuuauguuguggucggcaucauugugcuguuccuuaucauuuacaucuuucugcccauguucuucaaacucaaggacguucugaagagaaaugaauaucucuaccugcaggagcuuaaacacaaguga

SEQ ID NO: 14197 - RNA, 4317 nt, Artificial Sequence
  derived and/or modified CDS sequence (opt5) from CHLV(CHLV-Mex07)__JN808310.1__GP
auggagcccagcaucaagcuguuccucauucuggccaucgcugccgcggcugugcacucccuuccugccucuagaugcuuuagcgaaggcauugucaucaaagagaagcaggacuccaaagccguuucugaguucugucugaaggaugacgugagcaugauuaaaucccauguggucuacucuaagaacgagagcgggaucuuugcuaauucccaaauccuccggaaguggauuaucaaagauuggaagcugugcagcccgcuucccaccgccggaggccagauuaacgugaucgaaauuaaucacgaccugacacucucuacgaaaaccuauguuuguacaaccgauugcacaaucgggauugacaaggagaacgcucagaucaccuuccagacaaauaaacugaacuacuuugagguguccggaaccacgaucagcucuggcugguucaaguccaagaccagcgucucucuggaucaaacaugugaacaucucaaaguguccugcgggaagaaaagcaugcaguuucacgccuguuucaagcagcauauguccugcauucgcuaucugcacagaaccgcgcuuccuggauacauggccgcuucuaucuguagcaauauugagcugaucauuaugacaacccucacgcuggccaucuuuauccuucugugcauuaucacaaaaaccuauauuuguuaccuccugaugccccuguucaugccuaucgcuuauauuuacggcuggcucuacaacaaguccugcaaaaagugcaauuguugcggccugagcuaucaccccuuuacaaacugugggucuuacugcguuuguggagccaaguucgaaaccuccgaccggaugcgcauccauagagagagcggccuuugccagggguauaaaucucugcggguggcgcgcaagcucuguaaaagcaagggauccucucuggucaucagcauuacccuuuccguguuuaucuucagcuucauuacaccuaucggcggggccauuaucaaugauaaacugucugaggaaaaguacuccauuaaccaaaugauggacgcuaucguggaucucgagaauuuuagccacaacgucucuggaacgcagcagguuaucuccgugauuuuccugcugaucagcugccucuuucugcuucugaccuaucaucucaauaagauuauccagcaccuggccagauucggccuucuguuuugugaagagugcuccauguaccacucuaaaaaggacauuaaauauaacggcgauuucacaaacaaguguggguuuuguaccugcggacaaccggaagaccccgagggccucaaucugcauauccugagccagaacugcacauacaaacagcaauucaagugggugaagaucauuaucuccauucuccugucucuuaucauuaucgagaauagcaugauccuggcugccgccgaaaccgacugcuuuuccgagaaacagauuagcgaguucugucucgggccucugcugucuaucuccagcugcgaagauaagaacucucggacguuuaaaggagaagcucagaaacuugucgcgcucaaaaagauuacauccgacgaggccaugcugaucgagagcaugggcgcuaauguggaaggggcccuggagaugauucaggcccaaaagucucccgauagcauguacaccauggaauauguuuuccucaacaccuacugugacuauuacucccuguuugagcacaauagcggauauucucaggugaaauggcgcuacauccuuaagacacaucaguucgaugcuugcgccagacacuccaacagccauuucugucggugcauguccgacggcaugcacuguccuucuagcgauugggacaucgcggaugaacuggacaauaccuauauuacaaaacccaacuuuuucaagcacgauuacaaucuccugcuggacgucaucacggcugccuuuccgggcaccggggccguguucguuauugacgcuugcaaaaaggccaacgcuacagccaucaaaaccuuuuccaauaacauuaucgcgcgcuucccuuacaauaaccuucucaagggagugaugaaguuucugcaguauauuucuaaacaucccagcuucaagaaauaccaaccugauacaagacacuaugaccugauccccgucgcccccaccgcucggggccgcucccucgggagaucuaacagcuacaauaacgcccagaucggauccccuacgaaggauugucagaugcugaaagaggugggcugccuuagcccgaaguuugggcugccccucgagucuauuaucuccugcggcagcucuccuaauuauaagcuguacaaaaagccccagaaauauuacaaguccaacaauaaagaaaacaccugguguagcaaggacguccauugccugcacgauuucgagccuauuacagaagacgugcuugagaagguuaaagugaugaccuguugggagaucgaacccggaacaauugaggauaucuuuaccaucgcuucugaaacgugcaagauuaaugaccggggcgucugugaggugaacgccgcgaaauggaagaucguuaaaugcgaaacagggcucuacuauuacaccgaucacagagagggagacgauacaggcuccgaccuggggcauuauugucugacccacaagugcgccggaggccgcuacccgauuaauccugagauccuccaaaacugugugugggaguuccauagccagaagucccaguauauuaaucaggucgaucuggaacaaaucgaagaguacaaaaaggcucuuaccgaaaaacugacacacacgcucaaccauuauaauuuucugcccaccaagaaccugccucacaucagccccaauuacaaauacgugacacuuaacgggcaggagaccucugacggcauugagaacagcuauaucguguccgaaauuccugccaucgcuggaacaucuauuggccucaagguucagaccaaaacgaaugacgauaucuucgaccugauuaucuacgucaagcgggccgauaucauugccagcuauaaccacaucuacgacacagggcccaccauuggacauaauguggagcacgaagaacugugcaccggccaauguccgcagcauaucccugcuaaggcgaacuggcucacauucucccaggaaagaaccucucgcugggggugcgaggaguuuggaugccuggccauuaauacaggcuguguguaugggagcugccaggauaucaucaaacccgucgcuaagguguaccggaaauccacggaagagaagguugaacuugagcuguguauugugcuccccgacaaaaacuucugcaccacacugaaugcccuggagccuaagaucaccgaagagauugaacuucaauuuaagacaaucgaucagaugucucugccgaacauuguccuccugagagaccacaaacucuucaagggccagaucaaugaucugggaaccuuuggccagaacugugggaaugugcaaaagacgaaccagagcauccuuggagccggcaccguucgcuucgacuaucugugccauuccgcuagccggaaggauauuaucauuagacgcuguuacaauaacaauuacgacucuugcaaccaccuccagcuggccgagucccugaucuuucuugauaaccacgaaacacuggaggugcggaaacccaaucauauucucgggacccugagcaugaagcucaugcugggagacuuccaguauaagacauuugcgaaagacaucgagcuugauuucaccggcagaugugucgggugcauuggcuguuuugaaggauucgugugcgagaugcacaucacaaccacgguugaagcuacaugcaaccuggaggccucuugucaauucuuucauaaucagcuccacaucaagccugacgugcugaaauacuauaccaagaugaccugccagacagaugaauacauucccuccaaaaucaagauuuguaacaaggaguauaaaaucaccgucggcaaggugcagaaaaaugacaagauugagaucgauaacagcgaccaaacguccuacaucaaagaaaaggaugagcgcugcaagacauggcugugucgggugagagacgaagggauuucugucaucuucgagccucuucugaauauuuuuggaaacuauggccggaucgccguugcugugauuagcgccauccucgcgcugaucauucucguguacauccugaugcccauuugcaugcgcaucagagauauucuuaaaaccaaugaacgggaguuccugaucgaguccaaguacaaauga

SEQ ID NO: 14198 - RNA, 4305 nt, Artificial Sequence
  derived and/or modified CDS sequence (opt5) from FSV(86MSP18)__KX100131.1__GP
augcugagccuccugauccuugcccugcucggccuguccaccucuaaccccauugcuacaagaugcuuccacgggggacagcuuaucgccgagagcaaguccgcgacgucuauuagcgaauuuugucugaaagacgauguguccaugcucaagucugaggucaucuacaccaaaaaugacacaggccuguucgggcauaacaagguuuuucggagcuggaccauuaaagauuggaagcugugcaauccuaucccgacagcuggaggcaccaucaacgugauugaagugaauaaggaccucucccugaugacaaaaaccuauaucuguagccgcgauugcacgauuaccaucgacaaggaggaagcccaaauuaucuuccagacagauaaacuuaaccacuuugaggucucugggaccacacuguccagcggaugguucaagucuaaagccuccgugacccucgacagaacgugugagcauguuaaggugacaugcggcaagaaaagccugcaguuucacgcuuguuucaagcaucacaugucuugcguccgguuuuuccacaauaccauucuucccggcaacaugaucacauccaugugucagaauaucgaacugauuaucauucucgggcugacccuggccaucuuuauucucauggugaugaucaccaaaacauacaucugcuaucugcuuaugccuauuuucaugcccaucgcuuaccuguauggaugggccuacaacaagagcuguaaaaagugcaauugcuguggccucgcguaucauccuuuuacgaacugcgggucccacuguguuugcggacugaaauucgaggccucugaucgcaugcggauucauagagaaagcggccuuugucaaggguacaagucccugcgcaucgcuagacuccugugcaagagcaaaggaucuucccuggugauuagcggccuccugucuaugcuuauccugagcuucgucacccccaucgagggcacaauuaccaauuacccugacucccggaaguauacacucgaggaaaucaccgaugugguggaggggcugauuucugaacagaacaucaaagaguacauugucuuuuauacgagccuuuucggaucccugauccuccugcuggccuuuauuaugagcaucacacucucuaagaucaccuccauucuggcucgcagaaauguuaucuacugugaagagugcagcauguaucacucuaaacggggcauuaaguacaacggggacuucaccaacaaguguggauuuugcacauguaaugagcaggaagaugccgagggcguggugauccacaaagucuccaagcgcugcaccuauaaauaccagcuuaagugggcgaaagugcugaugauuacacucguucugcugcuuaucgcccaaaacacgauccucauuguggcugccgaaaccgacugcugggcuaaaaagagccuggacaucaauuguauugggccgaugcugaacaucggauccugcacaaauaagaacaccagaucuuacgauacagaggcccagaagcucgucagccaguccaaagugucucagcuggacgccgaucaagcuagccuucugggcuccagcauugacucugcgaucaaggccauccgggcucagaaaaccuaucccgccaugcaucuccuggaaacgauuuuccugaugaagaauugugauuacuauaccuccuuuaaccacaauagcggcuacucucaggccaaguggcgccuuaucgcuaaaacagggcauuucgacauuugcuccagacacagcacccaucacuuuugucggugcaucaacgauggaacaaagugucaaaauggcgacugggauuucgccggggagaugaacgagaccuauaauucuaaaaacgacuuuuaccuccacgaucugaaucuguucuauacgauuuuugaaaacgcguucccuggaacaaccgagagccucuucuaccagcugauccagaagagaaacacaaucggcgcuuccaaaguucuugggaagcugauuaccaaauacggcgacaauaacauguuugugggagucuggaaguucggccaguaucuccugacccugcccuacaucaauaacacagaacuuagccaaaaucgccggcagacgauucucgccgcccaggagcugucuuccagaagccauccugggcgccaggaauccaugucuagcgcuauccaaggauccgugaccaaggagugccacaacgccaaagacgucggcuguauuucuccccgguuugggaucccgauuggaaaucugacagcuugcggcgauagcccuaacuauaagaucuacaaaacccccgagaagcucuauaaauccaauaacaagggggaagugugguguucuaaugacguucauugccugaacgauuucgagccugccgacgaagagguggucaauaaggugaaaaagcugacaugcuuucuuaccgauguuagcgugaaaacggacaucuucuccgucgcggccagcacauguaagauggcugauaaaggcgugugcaccgugaacgacgccaaguggaauauuaucaagugugauucuggacucuacuauuuuaccgaccacagagagggccaggauacagggaacgacuucggagaauacugcauuucccacagcuguaacaccgagcgcuuucccaucaaucccgauauucugaaagacugcacaugggaauuucauucucggaaguccaaauacaucagcacgaucucucuggagucccuugaagaguuuagacgcgcuaugaccgagaagcucagccacacacugaccauuuauaacuucaaaccuacagccaaucugccgcauauccggcccaccuacaaguuuauuacggcgaacggcguugaaaauuccgacgggaucgagagcgccuauauucucucuagcaucccugcucugggaggcaucuccgucggguacaacgugcagaccaaggauaauuucccccuucuggacauuaucguguucgucaaaucugccgugauuagaacaaccuauaaccacaucuacgauacaggcccuaccauuggaaucaauacacagcaugacgaacacuguaccggccccugcccggcuguugugccucacaaggagaacuggauuacguuuagccaagaacgcacaucccggugggggugugaggaguucggaugccucgccaucaauaccggcugugucuuugggucuugccaggauaucauucaucccgaaaccaaaguguauagaaaggccguugaggaagaggugguccugacagugugcaucaacuucccuggaaauaacuacuguaccgaaauuaaugcuaucgagcccaaaauuacggacgagaucgaacugcaguuuaagacaguugauaccaaaacacuuccuaaccugcucgcggugcagaaccacaagcuguacagcggccaaaucaaugaccucggguccuucucucagggcugcggaaacguccagaagaccaaucauagcauucugggcauggggacagccaaauuugauuaugugugucacggagcuucccggaaggacgugaucguccgcagaugcuacaacaauaacuucgauagcuguaaacuucugaaggaggaaaccucucucguuuuugccgacaaucaugagacgcuggagguggcccacaccaaacaccugauuggcgaacuucaauucaagaucaugcugggggauauucgguauaaguccuuugcugagagccccgaacucgagaucgacgccaaaugcgugggauguccgucuugcuucgaauccuacagcuguaacuuccagaucgucacaaauauugacaccgugugcuccguugagggcccuuguacacuguuucauaacagaaucauuaucucugcgagcaagcaguccuauggccucaaaaugagcugccagaccaagcccucucaaaaugaggaguucauuaucugcaaccgcaaauacuccgugcuguuuacgacaauugauaagaaugacaagaucgaagucaacaccggggaucagacaagcuauaucuacgaaaaagacucucgguguaagaccuggcuuugcaaagugagagaugagggaauuagcguucuguucgaaccccucaaggcuuucuucggcuccuacuuuucuaucauuuucuauguggucguggggaucauuguucuguuucuggugaucuacaucuuccuuccuauguuuuucaaacugaaggacguccucaagaaaaaugaguaucuguaccuccaggagcugaagcaccgcuga

SEQ ID NO: 14199 - RNA, 4314 nt, Artificial Sequence
  derived and/or modified CDS sequence (opt5) from GERV__M21951.1__GP
auggccaucagcaccucccugcucauuguggcucugcuuaucaagcugugccucgucaacacagcgcccccuauuucuaaauguuuccaggacggcauccugauugccgagcuuaagagcuccucugggaucagcgaauuuugcaucaaagaugacauuuccauccugaagucugagauuacguacagcaaaaaugauaccggaaucuucaugcacuccaagguuuuuagacauuggacaguggcugacuggaagcaauguaaccacaccagcgccggcgggucuacaaaugugcucgaagucgauaaaaaccugaaucugguggccaagaacuauaugugcacccggccguguguuauuacaaucgacaaagagaaugcucagcuccuguuccagaccgaacagcuuaaccaauuugaggugacgggaaccacaauuuccaccggcugguucaagagcaaaacaucugucucccuggauaauaccugcgagcauaucaaggugacgugugggaagaaaagccuccaguuucacgccugcuucaagcagcauaugucuuguguucgcuuucugcacagauccgugcuucccggauacauggcuagcuccaucugccagaacauugaacugaucauuaucauuauccucacacuggccaucuucauuuuuauguguaucauuacccggacauauaucugcuaccugaugcucccucuguucgcgcccauugccuaucuuuacggcuggcuguauaaucgcucuugcaaaaaguguaucugcuguggccucgcuuaccacccuuuuaccaacugcgggagcuacugugucugcggauccagauucgagaccagcgaccggaugcgccugcauagagaaucuggccuuugucaaggguucaaaucccugcggguggcccgcagccucugcaagucuaaaggaagcucccuggugaucucuauucugacagcuaugcucauccugagcuuuauuacgccccuugaggccaugaccacaaauuauccugaugacaagaaguucacccugaaagaggucaacgauaucguucucggcagagacauggaacaggagcugaaguccagcauucuuauccugaugucuauuugugggaucggaaucauucucaucuuuuucggccugacagugcugcucgaaauugugcuggagcuuaucgcgaaacgguccaccaucuuuugcaaggaauguaaucugauucacgauaaaaagagcaugacguaccgcggcgacuucacaaacaagugcggguuuugcccguguggagagcucgaggaccccgaaggccuggucauccauaccaccagaaaaucuugcacauauuacauuaagauccggaaccugaaacuuauuaugcucaucuucuccauugugauccugaugcagaaugccaccaugcugguuguggcuggggagaacuguuggacaaauacggaaaucaaggccgauugcgucggaccucucauuggccccagcgcuuguaccaacaaaggguccaagacauauaagaccguggcccaggagcugguuacagccucuaaaaucacccaacuugacgcugauaaguacgugcugcucggagacacgauugaaagcgcgcuggaugccaucaccucccagaaacacuauucugcuaugcaucugcuugagacaauguuucucaugaagcacugcgacuacuacaaagucuaugagcacaauagcggcuacucccagaccaaguggcgccugauugccaucgccaacagcuucgauaucuguacaaauaccccuacgcccaacuuuugcaagugucugucugacuccagcugcucuacaaccacacucaauuucgcuaccuccaugaacgccaccuauacaagcaaaguggaauuuuucaaucaugauuucacgcuguuucuugacauuuucgaggcggcuuuuccgggcucugccaccgccuuccuguuuaagaaaaucaaggaaaagaacccuuaccaggcuuucgagaugauggggaagauugccaauaaauaucccaacaauaagcuccuggucgugauccugaaguacggacaauauaugguuggccuuagccacgcuuccacauaccagcucaaacaggaauggguggccaagagccugucucugaccagagcgcaacggacagggcucaaaauguccauggccaacgcugagccuggacccgccaccaaggaguguagcgaugcuaaaacgauugccugccugacacccaaguuucaggucgaagugaacaaucuuauguccugcggcgcgucuccuaacuucaagaucuacguuaaaaccggggagcuguauaaggcccaugacagaaauagcguguggugucucaacgacaugcacugccugaccccguacacacccgcuaaugccgaaauuaucaccacaaugaaaaagauggauuguuggcaggacaacccuaaacagcccacggaugaguaugcuaucccuaagcgcuccugccaaaugaaggaccggggccuguguaauucuggagccgauaaauggaagauuaucaaaugcgacaaccacaagcucuuuuacaccgaugcccuugagagacgcgaccccgcuagcauugucggcuccaaucauuguuucucugaaaaaugccagaucgagcgguauccgauuaacccuacaagccugaccaauugugaauggcuguacagagcggugcgccccgaguauaucaagaagcucucccugcagacaaucgaagaguacaaaaaggccauugcugauaaacuuacccacacgcugcagcucuaccauuuugccccucugcuggagaaccuuccccacaucaagccuaccuauaaauacauuacagcccaagggaccuauacagcugacggaaucgaaggcgccagcauuaccacaucuauccccgcgcuguccgggaccagcgugggauucaagaucaaugcuaaagauggcacggaccuccuggauauuguugucuacaucaaggccucuguggugaaguccauuuauaaccacaucuacgacacagggccgaccauuaauaucaacagcaaacaugacgagcucugcaccggccaguguccuaagaaaauucccgccgaucccaacuggcugacauuuucucaggaacggaccuccagauggggaugcgaggaguucggcugccuugcuaucaauacggggugugucuauggaagcugccaggacgugauccgcacagaaaccaagguuuaccggaaagccaacgaggaaacagugaugcugaccgucuguauuacauacccuggccacaccuucugcacggaugugaaugcgcaugagccgaagaucaccgacgaacucgagcugcaauuuaagacaauugauaucaaaucccugcccaaccuuguugcugugaccaaucacaagcuguauacagggcagauuaacgaccucggaaccuucggccagaugugugggaauguccagaaaacgaacacaagccauaccggcgccggaacaccuaaguuugauuauaccugcuacucugccagcagaaaagacaucaucauucgccgguguuacaauaacaauuaugauuccugcagacugcucaaccaagaaucugaccugcuuuucgaugacaaucacgagacccuggugguuuacaacaauaagcggcucaacggcgagcuggcucugaaacuucugcucggggauauccaguauaaacuguacacagaaaacauggagcucgaacuggaggccaagugugugggaugcgucggcuguuuugagagcuaccagugcaaucuucaaauuacguccucucuggacgaaaccgcucuguaucucgugcccgugagccacuuccaugaccgcauccagauuaaaacaaccaagaaagauuacgccaugaagaucuccugcacaagagacccuggggauaaggcgucuuuucgggucuguggaaaaagcuaugacuucaacuuucacaccguucccaagaaugauaaaaucgaggugaacgugggcgacgaaacguccuacauuaaggagaaagauaauagaugcgggcgcuggcugugucgggucagagacgaaggccuuagcgugaucuucgagccucugaacaacuuuuucggaaauuaucucaauauguuccuguacauucucggcgggaucauucugcuuuuucuggcccuguauauccucaugcccaugugcgcucgccugagagaugagcuuaagcggaacgaacgccugcaucagauggagaugaagaaaagauga

SEQ ID NO: 14200 - RNA, 4260 nt, Artificial Sequence
  derived and/or modified CDS sequence (opt5) from IACOV(BeAn314206)__JN572066.1__GP
augagagugaucgcccuguuccaccucgucaugguuauuaccgcuaaccccguguuucaucggugcuuccagggcgggcaacugauccuugagaagaaaagccacguguccaugucugaauuuugucugaaggacgaugucagcauggugaaauccguuguggaguacgaaaagacaaauaacucuauugucggaacgaauaaaguguaucgccaguggguugugagcgacuggaagcucugccauccuaucaaggccgagggcgggggaauuaacaucaucgaagucgagaaagaucugaccauuaaguccaauacauacaucuguaccacagacugcaccauuacaguggauaaagagaacgcgcagaucauuuuccagaccucuaaacuuaaucacuuugaagugacgggcaccacacugagcaccgggugguucaaaacaaaggcugccgucacccucgaccaaacgugugagcauaucagaguuuccugcggaaagaaaagcauucaguuucacgccuguuuccggcagcacaugacaugcgugcgcuuucugcauagaucucugcucccgggcuccauggcuaacagcaucugucagaauguggaacugaucauuaucauuguccuuacccugcucaucuucauugugcugaacaucaucgccaagacauauauuugcuaccuuaugcugcccaucuuuaugccuauugcuuauaucuacggcuggauuuauaaucggucuuguaaaaagugcguuaacugcgggcucgccuaccaccccuucuccaauuguggaagccauugcguguguggcgcgaucuuucaaaccucugaucgcaugagaaugcaccgggaguccgggcugugcagcggauucaaaucccugcgcgucgccagagugcucuguaagucuaaaagcuccagccugguuaucgcuauucuuucuucccugcucauccugagcuucgugaccccuauugagggccuugaccuggaagagaagaaguacucucucagcgaucugcccgacaucuauacaaaagaacugaacacgcucuccgagaagauugccaucaauuuuuacauuucuaucaccaacaugcugaucacaauuauccuucugauugucgcuuucugcagccacuguaucaccaacaaaauugugaaguauaaagccuuucucugcacagaaugugauauguaccauaccuauaagaauauccgguacaacggggacuucugcaauaaguguggauccugcacgugcggcacaauggaggauccuaacuauaccaccaugcacaaagucagcgaccugugucuugcggagccgaagcgcaucauucagaaaaagcugaugaucauucucaucauuuuugugaucaucgaaaauggcgccugccuggcuucugccgaggaaaaauguuucaaggagcaugacuacaacauugaaugcaucgggccccugauuacaaugagaccuuguaccaagaaaacaauccaggagguugcucggacgcucgugaccgauaagcagauugcccaagaggacacagaaaagaucgagcugcuucccgauuccaucguccaggccuggaauaugauugacaaccagcugaauuacgaucaaauguuucucauggaauaugcuuuccugaagcgcgagugcagcuuuuucgaagaguuugagcacaacucuggagugaaucagaucauguggagaaccauugcgaaaacaggccauuucgacaucugugccauucgguccagccagagauuuugcaaguguauguccgaaucuguuuacugcaaggaugcuaacugggacaucgccaaugagaugaacgauaccuauagcuucaaaccucuguucuaccgccacgacgugaaacuuuauuccaagauuuuuaaggccgcuuuccaggggacgacccucaaaacauacgaaaaguuucugaaugccaaaaacaagaccgagcugaucaacaugcucaagaaacugggaaagcgguuccccuauaauaaccuucugaugggcuuucucaaauucggggagcugcuguuugaucuuacacucuucgacgcgcugccgaaggacaaaaccucuagaacgagcuccacaaccgcuaagcgcgaauacgagaaucugcaagaugccaaggucggagaaccuacaagcgaguguaaagacaugaagcuccugcagugcaucucuccccgguaccagguguccgugggcagcguuauuaaaugcggcgauaccgaaaagaaaaucuaugacuuucacaccccugucuacaaacuugccacagaugagacgaagugguguagauucgacaagcauugccugcacgagugggugcccauugauaacgcucgccucgaaaugcugaagaaacugaauuguugguauaccgaccccacagagaugguggauaucuacaccacaucucggaaguccugcagaaugauuaacaaagggaccuguaauaucaagaacgccccuaugacggucaugcagugcgacgaugaccuuaucuuuuauacagaucaucgcagcucugcugacacccaaggagacauuggcgaauacugucucagccagaauugcgaugugucccgguauccgaucaacguuauggacgggaugaccuguacaugggaguacaauaccgugaagcccaaauaccugagcaagacagaacugaaaacgcucgaggaguauaagagaacccugcaggauaaacuuucucacaaccuggaagucuaccacuuccauaugacagccaauuuuccucacauuaagcccguguauaaauacaucaccgcgggaggcguugagacauccgacgggauugaaggcgccuucauccucguggaucugccugcucugagcggaaccuccgucggccuuacggugcucucuaaggacgauguuccccugauggacgugaucauuuauaucaagagcgccgucauuaaagcuaccuacaaccauaucuaugauacagggccgaccauuggaaucaaugugaagcacgaggaacugugcacaggcccuuguccccagaacauuccucaucaagagcaguggcucaccuucucccaggagcgcacaucucggugggggugcgaagaguuuggaugccuggccgugggcgaagggugugucuacggcagcugccaggacaucaucaaaaaggagaccagaguuuacaaaaagguguccgaggaaauuaacgagaucacguucuguauuaucuuucaaacaaauaccuauugccagaccaugaacgcgauugaaccccagaucacaccuucucuugaggugcaacuggaaggacucgauaccaagauccugcccaauauucuggcccuucagaaccacaaacuguacagcggccagaucaaugaccucggguccuucggacuggcuuguggcaacguccagcaagugaauaagacgauuuauggggccggacagccgaaauuugauuaccucugccacggcgcuaagcggaaagacaucauuguucgcaaguguuauaacaauaacuucgggagcugcaagcugcuuacaaucgaggacaaucugaucguggaggauaacuacaauaccauuaacgucaucaauacaaaacaucucauuggcaccgugaagucuaaacugaaccugggagacaucagauauaaacuuuuuaacaagaagccugaguucgaacuggaagcccacuguguuggcugcgugggguguuuugccaauuacaacugcgagauuaagaucgaauccacaauugauaugaccugccccaucagcggacccugugaguucuuucauaauaacaucuucauucaggcugagcacacgaaauacgcgaugaagaugaucugcaaaaagcagccugaccaaaccacagaguucaccauuugugauaaaaaguaucauuuuaucauugacacagucgaaaagcacgaucagaucgaaaucgacgugggcgaucagaccucuuacauucucgagaaagacaaucggugcgggacguggauguguaagguucuggaugaaggacucuccgugaucuucgagccgcugaaacuucugcucggcaacuauuuucacauggccauugucaucauuaucgggcugaucgcucuggccgugauuaucuacauucuucugcccauguucaugaagcucagagacacacugaaagccaaugagaucgcuuaucagaaggaaaugaaaauuaaguga

SEQ ID NO: 14201 - RNA, 4305 nt, Artificial Sequence
  derived and/or modified CDS sequence (opt5) from ILEV(KO/2)__AY859372.1__GP
augcuguuccccaucauucuccugaugauccagcuugugagcuccaccccucugucuacaagaugcuuucacgagggcacgcucgucaaggaaaagauuagcaccacauccaucucugaguucugucugaaagacgauguuagcaugauuaaauccgaaaucaccuaccaaaagaacgacacagggguguauggacauucuaaaaucuaccggaauuggauugugaaggaguggaaggccugcaacccgguccccagcgcuggcggguccaucaaugugauugaaguuaacgaggauaugagccuugccaccaaaaauuauaucuguacacgcgacugcgugauuaccgucgauaaggaggacgcgcagaucguguuucagacggauaaccugaaucacuucgaaguuucuggaaccacacucuccagcggcugguuuaaaaccaaggcuucugugacacuggacagaaccugugagcauauuaaagucuccugcgggaagaagacggugcaguuccacgccuguuuucggaaccauaugagcugcgugcgcuucuuucacaauacaauccugccuggauacauggccaccucuaucugucaaaacauugaacucaucauuaucauuguccugacaaucgcuaucuucauuaugcuuguuauccugaccaaaaccuauauuugcuaccuccugaugccccuuuuuaugccuaucgccuauuguuacggcugggcuuacaauaaguccugcaaaaagugcaacuguugcggccuggccuaucaccccuucacaaauugugggagcuuuugcguguguggacucaaauucgaggcguccgauagaaugcggauucaucgcgagucuggccugugccagggguacaagagccugagaguggcccggcgccucuguaaauccaagggaagcucuuucgucaucuccauccugcuuagccuguuuauucucucuuucgugacgccuaucgaaggcaccaugacaaacuauccggaggaaagaaaguacacccuggaggaaauugcugacguuaucgagggguuuuaucaggaggccaaaauuaaggaauacaucguguucuauagcuccauuuuuggaucuuucauccuuaucagcuccaugcugauucucuacaaacugcagaauaucacauacuuucugagcaaguucaacgucauguauugcucugaguguuccauguaccacagcaaaaagaacauuaaguaucucggcgauuuuaccaauaaaugcggcuucuguacgugcggggaacuggaggacgcugaaggacuuucuauccauaaggugacaaaacggugcaccuacgccuaucaaaugaccuggacaaagauuauccuggcgacccuccugauccuucugauuggccagaacacacuccugguuguguccgcccaggcugauuguugggagaaaacggagaucaccauugacugcaucgggcccauuuuugccccuaauacauguaucaagcaggaagagaagaccuacgcuaaagaagcccaaacacuggucgaccagaacaagaucagccaggccgaugcuaaacaaguggacaugcucggagcgaccauugaugacgccaucaaggcuauucgcucccagaaaacguauaccacaaugcacaugcuggaggccaucuuccuuucuaaguacugcgauuacuauagccuguuugaacacaauuccggcuacucucaggggaaguggagacucauugccaaaaccgagagcuucgacaucuguucccggcauacaacccaccauuucugccgcuguaugagcgaugagacgaagugcaaaaacggagacugggauuuugcuggcgaaaugaacucuacauaucacuccaagagcaauuuccugcugcaugaccuuagacucuuuuacaaaaucuauucugccgcguuccccggccuguccgaggcuaugcuguacaaguuucucagcgaaaaagauaccacaaaugccauuaagcugcuugagaagcuguucaccaaauauucuuacaacaaucuccuggucgggauccugcgguuuggaaaguuccuuuuuagcauguccauuuucaacaccacagagcucggcggggcccagaaagcuaugauccugagaccuacggacgaacugcgcaccacauacagcggaaagcaagagucucucuccaauagcgugguuggcgaacagaccuccgacugugugaacaugaaaaagauuucuugcaucagcccccgguuuaauauuccgcuguccucuaugaucgccugugggaaccagccuaacuaucagaucuacaaggagcccagcaaauauuacaaguccaauaacaaaccuaauacauggugcaacaaggauauucacugccuuaaugacuucgaaucuaucgaucaaagcgcucuggacagacucaaaaccaugacguguuuucugauugaucccaucacaaccgaggacgucuauuccauugccauccacagcugcaaggugaaggauaaaggccaguguaccauccgcgacaagaaauggaacauuaucaagugcgauucugagcugcuuuacuauacagaccaucgggaaggagaggauaccggcaaugaaauugggcacuacugucucucccauaaaugcggaacagacagauaccccaucaacccugagauuaucaaggauuguaucugggaauuucgcagccggaagucugaguauauuaauagaguugaccuggagucccuggaagaguucaaacgcgcgcucagcgacaagcugacgcacacccuuacaaucuacaacuuuaaaccgaccgccaaucugccccacauuaagccuaucuauaaauacauuacagcucucggcguggaaaacucugaugggcuggaggccgcuuauauccugaccuccauucccgcccuuggaggcacgagcaucggguacaauaucaugaccaaggacaacuucccugucauggaugugauuaucuaugugaaauccgcgguuauucagacaaccuacaaucauaucuacgacacaggccccaccauuggaaucaacagcaagcacgaugaaaagugcacaggcucuuguccgcagaacaucacccaugaccaaaauuggcucacguuuagccaggagcgggccuccagaugggggugcgaggaguucggaugucuggcuauuaacacaggcugcgucuuugggucuugccaggauaugauccgcagcgacaccaaaguguauaagaaagcccuggaagaaaccgugguccucacaguguguauuaauuacccuggaaacaccuucugcacggagguuaauuccguggagacaaagaugaccgaugacgucgaacugcaguuuaaaacaguggauaccaagacacuucccaaccugcucgcuguuaccaaucacaagcuguauucuggccaaaucaacgaccuggggagcuucucccagauguguggcaaugugcagaaaacgaacucuaccgucaugggagccggcacagugaaguuugauuacauuugccauggggccagccggaaagacaucaucauuagacgguguuauaugaauaacuacgcuuccugcagccuucugaaggaggaaaaagaccucaucuucgcggauaaucacgagaccauuacaguuucuaacuccaagcaccuggugggagaacuccaaaucaagcugaugcuuggcgacauucgcuauaaacuguuugccgagagaccugagcucgaagucgaugcuaaguguguggggugccccagcuguuucgagucuuacuccugcaauuuccagaucgugaccaacauugacacggucuguacacuggaaggaccuugcaccaucuuucauaaccggaucauuaucagcuccacaaaacagucuuacggcauuaagaugagcugccccaccaaaccgaaucacaucgagaaguucaagauuuguaaccaugaauaugauauccuguuugacaccguugccaaaaaugauaagaucgagauugacacaggggaucagacgcuuuucgugagagagaaagacacccgcugcaagacauggcugugucgggugaaagaugaaggcaucuccgucauuuuugagccucucagagccuucuuuggaagcuacuucucuaucauuuucuauaucauccuggcugccauucucaucuucgugggcguuuacauuuuucugcccauguucaugcgccuuagagacgugcugaagcggaacgaacaccucuaucugcaagagaucaagcauaaauga

SEQ ID NO: 14202 - RNA, 4305 nt, Artificial Sequence
  derived and/or modified CDS sequence (opt5) from ILEV(R5964)__KF234074.1__GP
augcuguuccccaucauucuccugaugauccagcuugugagcuccaccccucugucuacaagaugcuuucacgagggcacgcucgucaaggaaaagauuagcaccacauccaucucugaguucugucugaaagacgauguuagcaugauuaaauccgaaaucaccuaccaaaagaacgacacagggguguauggacauucuaaaaucuaccggaauuggauugugaaggaguggaaggccugcaacccgguccccagcgcuggcggguccaucaaugugauugaaguuaacgaggauaugagccuugccaccaaaaauuauaucuguacacgcgacugcgugauuaccgucgauaaggaggacgcgcagaucauuuuucagacggauaaccugaaucacuucgaagugucuggaaccacacucuccagcggcugguuuaaaaccaaggcuucuguuacacuggacagaaccugugagcauaucaaaguguccugcgggaagaagacgguccaguuccacgccuguuuucggaaccauaugagcugcgugcgcuucuuucacaauacaauccugccuggauacauggccaccucuauuugucaaaacaucgaacucauuaucauuaucgugcugacaaucgcuauuuucaucaugcuugucauucugaccaaaaccuauaucugcuaccuccugaugccccuuuuuaugccuauugccuauuguuacggcugggcuuacaauaaguccugcaaaaagugcaacuguugcggccuggccuaucaccccuucacaaauugugggagcuuuugcguuuguggacucaaauucgaggcguccgauagaaugcggauccaucgcgagucuggccugugccagggguacaagagccugagaguggcccggcgccucuguaaauccaagggaagcucuuucgugaucuccauucugcuuagccuguuuauccucucuuucgucacgccuauugaaggcaccaugacaaacuauccggaggaaagaaaguacacccuggaggaaaucgcugacgugauugagggguuuuaucaggaggccaaaaucaaggaauacauuguuuucuauagcuccaucuuuggaucuuucauccuuauuagcuccaugcugauccucuacaaacugcagaauauuacauacuuucugagcaaguucaacgugauguauugcucugaguguuccauguaccacagcaaaaagaacaucaaguaucucggcgauuuuaccaauaaaugcggcuucuguacgugcggggaacuggaggacgcugaaggacuuucuauucauaaggucacaaaacggugcaccuacgccuaucaaaugaccuggacaaagaucauccuggcgacccuccugauucuucugaucggccagaacacacuccuggugguuuccgcccaggcugauuguugggagaaaacggagauuaccaucgacugcauugggcccaucuuugccccuaauacauguaucaagcaggaagagaagaccuacgcuaaagaagcccaaacacugguggaccagaacaagauuagccaggccgaugcugagcaagucgacaugcucggagcgaccaucgaugacgccauuaaagcuauccgcucccagaagacguauaccacaaugcacaugcuggaagccauuuuccuuucuaaauacugcgauuacuauagccuguuugagcacaauuccggcuacucucaggggaaguggagacucaucgccaagaccgagagcuucgacaucuguucccggcauacaacccaccauuucugccgcuguaugagcgaugaaacgaaaugcaagaacggagacugggauuuugcuggcgagaugaacucuacauaucacuccaaaagcaauuuccugcugcaugaccuuagacucuuuuacaagauuuauucugccgcguuccccggccuguccgaagcuaugcuguacaaauuucucagcgagaaggauaccacaaaugccaucaaacugcuugagaagcuguucaccaaguauucuuacaacaaucuccugguggggauucugcgguuuggaaaauuccuuuuuagcauguccaucuucaacaccacagaacucggcggggcccagaaggcuaugauucugagaccuacggacgagcugcgcaccacauacagcggaaaacaagaaucucucuccaauagcgucgugggcgagcagaccuccgacuguguuaacaugaagaaaaucucuugcauuagcccccgguuuaauaucccgcuguccucuaugaucgccugugggaaccagccuaacuaucagauuuacaaggaacccagcaaguauuacaaauccaauaacaagccuaauacauggugcaacaaagauauccacugccuuaaugacuucgagucuauugaucaaagcgcucuggacagacucaagaccaugacguguuuucugaucgaucccauuacaaccgaggacguguauuccaucgccauccacagcugcaaagucaaggauaagggccaguguaccauucgcgacaaaaaguggaacaucauuaaaugcgauucugaacugcuuuacuauacagaccaucgggagggagaagauaccggcaaugagaucgggcacuacugucucucccauaagugcggaacagacagauaccccauuaacccugaaaucaucaaagauuguauuugggaguuccgcagccggaagucugaguauaucaauagaguggaccuggaaucccuggaggaguucaagcgcgcgcucagcgacaaacugacgcacacccuuacaauuuacaacuuuaagccgaccgccaaucugccccacaucaaaccuauuuauaaguacaucacagcucucggcguugaaaacucugaugggcuggaagccgcuuauauucugaccuccauccccgcccuuggaggcacgagcaucggguacaauauuaugaccaaagacaacuucccugugauggaugucaucauuuaugugaaguccgcggugauccagacaaccuacaaucauauuuacgacacaggccccaccaucggaaucaacagcaaacacgaugagaagugcacaggcucuuguccgcagaacauuacccaugaccaaaauuggcucacguuuagccaggagcggacauccagaugggggugcgaagaguucggaugucuggccaucaacaccggcugcguuuuugggucuugccaggauaugauucgcagcgacaccaaggucuauaaaaaggcucuggaagagacaguggugcucaccgucuguaucaauuacccuggaaacacguucugcacagagguuaauuccguggaaaccaaaaugacagaugacguggagcugcaguuuaagaccgucgauacaaaaacccuucccaaccugcucgccgugacgaaucacaagcuguauucuggccaaauuaacgaccuggggagcuucucccagauguguggcaauguucagaagaccaacucuacagugaugggagcuggcaccgucaaauuugauuacaucugccauggggccagccggaaggacaucauuaucagacgguguuauaugaauaacuacgccuccugcagccuucugaaagaagagaaggaccucauuuucgcugauaaucacgaaacaaucaccgugucuaacuccaaacaccugguuggagagcuccaaauuaagcugaugcuuggcgacauccgcuauaagcuguuugcggagagaccugaacucgagguggaugccaaaugugucgggugccccagcuguuucgaaucuuacuccugcaauuuccagauugugacgaacaucgacacaguguguacccuggagggaccuugcacaaucuuucauaaccggauuaucauuagcuccaccaagcagucuuacggcaucaaaaugagcugccccaccaagccgaaucacauugaaaaauucaagaucuguaaccaugaguaugauauccuguuugacacagucgcuaagaaugauaaaauugagaucgacacgggggaucagacccuuuucguuagagaaaaggacacacgcugcaaaaccuggcugugucgggugaaggaugagggcauuuccgugaucuuugaaccucucagagccuucuuuggaagcuacuucucuauuaucuuuuauaucauucuggccgcuauccucauuuucgucggcguguacaucuuucugcccauguucaugcgccuuagagacguucugaaacggaacgagcaccucuaucugcaagaaauuaagcauaaguga

SEQ ID NO: 14203 - RNA, 4305 nt, Artificial Sequence
  derived and/or modified CDS sequence (opt5) from MAGV__AY286443.1__GP
auggagcugcucaucauuauccugcuucugggcagcgccgcuuccucucccauuagcaccagaugcuuccacgggggacagcucaucgccgaauccaagucugcgacaagcauuuccgaguuuugucugaaagacgaugugucuaugaucaagagcgaagucacguacaucaaaaacgacaccggcauuuaugggcauaauaagguuuuccgguccuggacaaucaaagauuggaagcucugcaacccuauuccgaccgcuggaggcagcaucaaugugauugaggugaacucugaccugucccucgccacacgcgccuacgucuguagcagagauugcaccaucacaauugacaaggaagaugcucaaaucaucuuucagaccgacaaacugaaucacuucgaggugucugggacgacccuguccagcggaugguuuaagacaaaagccucuguuacccucgaucggacaugugagcauauuaaggugaccugcggcaaaaagucccugcaguuccacgcuuguuuuaagcaucacaugagcugcauccgcuucuuucaccauacgauucuucccggcacaauggucuccucuaugugucagaacaucgaacugauuaucaucauugggcucacccuggugaucuucauucuuaugguuauccugacaaaaaccuauauuugcuaccuccugaugccuguguuuaugcccgucgccuauaucuacggaugggcguauaauaagagcuguaaaaagugcaacugcuguggccuggccuaccacccuuucaccaauugcgggucccauugugugugcggacucaaauuugaggcuagcgacagaaugcggcugcaccgcgaaucuggccuuugucaaggguacaagucccugagaaucgcccggaugcucugcaaaagcaagggaucuagccuggugauuuccggccuucugucuaugcuccugcugagcuucaucacacccauugagggcacgcucaccaacuauccuaaugagaagcaguacacacuggaagagaucgcugaugucguugaagggauuaucaccgagcagcaccuuaaagaauaugugguguucuacacaucccuguuuggaggccucauucugcuucugacccucauccugagcaucacgauuaacaaggucacagaccugcucgccucuaccaaugugaucuauugugaggagugcuccauguaccauagcaaaaaggggauuaaauauaacggagauuucaccaauaaguguggcuuuugcacauguucugaacaggaggacguugaaggggugaucauucacaaggucucccgcaaaugcaccuacaaguaccaacugaaaugggugagaguuaucaugaucauucuugcgcugcuccugacaauccagaacacggugcugauugucgccgcugagguggacugcuggaccaagaaaagcaucgaaauugauuguaucggaccgcuucucaacaucggcuccugcacagacaagucuagccggaccuaugagacagaggucaauaagcuggugcgccaguccaaaguuacccaugccgaugcugaacagauuucuauccugggcagcacgcucgacaacgccauuaaggccgugagaucccaaaagaccuacgagacaaugcacuuccuggaaaccgucuuucuuaugaagaauugugauuauuacaacagcuucgagcauaauucuggguauucccagacaaaauggcggcugaucgcuaagaccagccacuuugacauuugcucucgccacuccacgcaucacuucuguagaugcgugaacgaaggaacaaagugucagaauggcgauugggacuuugcgggggagaugaacgauaccuacaauagcaaaaacgacuucuaucuccaugaucuggaccuguuuuacacacuucucgagaaugccuuccccggaaccaccgaaucucuguuuuaccaacugcuccagaagaaaaacacaacgggcgcuagcaagcugcuugggaaacugaucaccaaguauggcaauaacaauauguucguugagaucuggaaauucggacaguaccuccugaagcugccuuauauuaacgacacagaacuuuccaccgauagaaagagcacaaucauuaaaucucagcaagugcucucccggagccagaccggccgccaggagucccugucuagcgccacgcccgggacagccaccaaggagugcuccaacgcuaaagacaucggauguauuucuccucgguuuggcauccccauugggaaucugaccgccugcggagauagcccgaacuacaaggucuauaaaacaccugaaaagaucuacaaguccaauaacagaggcgaggugugguguucugacgaugugcacugccucaccgacuucgaacccgcggaggaagagguugucaaucgcaucaaacagaugacaugcuuucugacggaugugaccacaaagaccgacguguucagcgucgcuauuuccacauguaaaaugguggauaaggggguuugcaccgugaacgacgccaaauggaauauccuuaaguguaacagcggccuguauuacuuuacggaucaccggggaggccaagacaccgggaaugauuucggagaguacugcauuucucauuccuguaacacagaaagauuuccuaucaaucccgacguccucaaggacugcauuugggaguaucacagccgcaaaucuaaguacaucuccaccgugagccuggaaucucuggaugaguuccggagagccauguccgacaaacuuagccauacacucaugaucuauaacuuuaagcccaccgcuaaucugccucacauuaaaccgacauacaaguucaucaccgccaacggcauugaaaauuccgaugggaucgacagcgcuuauauucugucuagcauccccgcccucggaggcauguccguuggguacaacauccagacgaaggauaacuuuccucugcuugacauuaucguguucauuaaaucugcgaucauuaagacaaccuauaaucauaucuacgauaccggccccacaauuggaaucaacacccagcacgacgagcacuguacgggcccuugccccacacugaucccgcauaaagagaauuggcucaccuuuagccaggaacgcacaucccggugggggugugaggaguucggaugccuggccauuaacaccggcugugucuucgggucuugccaagauaucauucacccugaagcuaagguguacagaaaagccaucgaagaggagguugugcugacagucugcauuaccuuucccggaaauacguauuguaccgaaaucaacgcuaucgagccuaagauuacagacgaaaucgagcuucaguucaaaaccguggauacaaagacccugcccaaucuccugauggugcagaaccauaagcucuacagcggccagauuaaugaccugggguccuuuucucaaggcugcggaaacguccagaaaacgaaucagagcguuaucggcgccgggacagcgaaguucgauuaugugugucacggagccucccgcaaagacgugauuguccggagaugcuacaacaauaacuaugagagcuguaaacuucugaaagaagagaccucucucaucuuugcugacaaucaugaaacacuggagguggccaacaccaagcaccugaucggcgaacuucaauucaagauuaugcugggggauauccgguacaaauccuuugcugagagcccugagcucgaaguugacgccaagugcgugggaugucccucuugcuucgaguccuauagcuguaacuuucagauugucaccaauaucgauacagugugcuccguugacggcccguguacgcuguuccacaaccgccucauuaucucugccaccaaacagagcuacggcuuuaagauguccugcccuagaaaacccgaacccacagaggaguuccagauuugcaaucggaaguacaacgugcuguucaccacaaucgauaagaaugacaaaaucgaaauuaacaccggggaucaaacgagcuauaucuacgagaaggacaauagauguaaaacauggcuuugccgcguccgggaugaaggaauuucugugaucuuugagccucugaaggcuuucuuuggcuccuauuucagcauuaucuuuuacguuguggucgggaucauugugcuuuuccugaccaucuauauuuuucugccgauguucuuuaaacuuagagacauccugaagcgcaacgaauaccucuaucugcaggagcucaagcauaaauga

SEQ ID NO: 14204 - RNA, 4305 nt, Artificial Sequence
  derived and/or modified CDS sequence (opt5) from MAGV(ts8)__AY286444.1__GP
auggagcugcucaucauuauccugcuucugggcagcgccgcuuccucucccauuagcaccagaugcuuccacgggggacagcucaucgccgaauccaagucugcgacaagcauuuccgaguuuugucugaaagacgaugugucuaugaucaagagcgaagucacguacaucaaaaacgacaccggcauuuaugggcauaauaagguuuuccgguccuggacaaucaaagauuggaagcucugcaacccuauuccgaccgcuggaggcagcaucaaugugauugaggugaacucugaccugucccucgccacacgcgccuacgucuguagcagagauugcaccaucacaauugacaaggaagaugcucaaaucaucuuucagaccgacaaacugaaucacuucgaggugucugggacgacccuguccagcggaugguuuaagacaaaagccucuguuacccucgaucggacaugugagcauauuaaggugaccugcggcaaaaagucccugcaguuccacgcuuguuuuaagcaucacaugagcugcauccgcuucuuucaccauacgauucuucccggcacaauggucuccucuaugugucagaacaucgaacugauuaucaucauugggcucacccuggugaucuucauucuuaugguuauccugacaaaaaccuauauuugcuaccuccugaugccuguguuuaugcccgucgccuauaucuacggaugggcguauaauaagagcuguaaaaagugcaacugcuguggccuggccuaccacccuuucaccaauugcgggucccauugugugugcggacucaaauuugaggcuagcgacagaaugcggcugcaccgcgaaucuggccuuugucaaggguacaagucccugagaaucgcccggaugcucugcaaaagcaagggaucuagccuggugauuuccggccuucugucuaugcuccugcugagcuucaucacacccauugagggcacgcucaccaacuauccuaaugagaagcaguacacacuggaagagaucgcugaugucguugaagggauuaucaccgagcagcaccuuaaagaauaugugguguucuacacaucccuguuuggaggccucauucugcuucugacccucauccugagcaucacgauuaacaaggucacagaccugcucgccucuaccaaugugaucuauugugaggagugcuccauguaccauagcaaaaaggggauuaaauauaacggagauuucaccaauaaguguggcuuuugcacauguucugaacaggaggacguugaaggggugaucauucacaaggucucccgcaaaugcaccuacaaguaccaacugaaaugggugagaguuaucaugaucauucuugcgcugcuccugacaauccagaacacggugcugauugucgccgcugagguggacugcuggaccaagaaaagcaucgaaauugauuguaucggaccgcuucucaacaucggcuccugcacagacaagucuagccggaccuaugagacagaggucaauaagcuggugcgccaguccaaaguuacccaugccgaugcugaacagauuucuauccugggcagcacgcucgacaacgccauuaaggccgugagaucccaaaagaccuacgagacaaugcacuuccuggaaaccgucuuucuuaugaagaauugugauuauuacaacagcuucgagcauaauucuggguauucccagacaaaauggcggcugaucgcuaagaccagccacuuugacauuugcucucgccacuccacgcaucacuucuguagaugcgugaacgaaggaacaaagugucagaauggcgauugggacuuugcgggggagaugaacgauaccuacaauagcaaaaacgacuucuaucuccaugaucuggaccuguuuuacacacuucucgagaaugccuuccccggaaccaccgaaucucuguuuuaccaacugcuccagaagaaaaacacaacgggcgcuagcaagcugcuugggaaacugaucaccaaguauggcaauaacaauauguucguugagaucuggaaauucggacaguaccuccugaagcugccuuauauuaacgacacagaacuuuccaccgaucggaaaagcacaaucauuaaaucucagcaagugcucuccagaagccagaccggccgccaggagucccugucuagcgccacgcccgggacagccaccaaggagugcuccaacgcuaaagacaucggauguauuucuccucgguuuggcauccccauugggaaucugaccgccugcggagauagcccgaacuacaaggucuauaaaacaccugaaaagaucuacaaguccaauaacagaggcgaggugugguguucugacgaugugcacugccucaccgacuucgaacccgcggaggaagagguugucaaucgcaucaaacagaugacaugcuuucugacggaugugaccacaaagaccgacguguucagcgucgcuauuuccacauguaaaaugguggauaaggggguuugcaccgugaacgacgccaaauggaauauccuuaaguguaacagcggccuguauuacuuuacggaucaccgggacggacaagauaccggcaaugacuucggggaguacugcauuucucauuccuguaacacagaaagauuuccuaucaaucccgacguccucaaggauugcauuugggaguaucacagccgcaaaucuaaguacaucuccaccgugagccuggaaucucuggacgaguuccggagagccauguccgauaaacuuagccauacacucaugaucuauaacuuuaagcccaccgcuaaucugccucacauuaaaccgacauacaaguucaucaccgccaacggaauugaaaauuccgacggcaucgauagcgcuuauauucugucuagcauccccgcccucgggggaauguccguuggcuacaacauccagacgaaggacaacuuuccucugcuugauauuaucguguucauuaaaucugcgaucauuaagacaaccuauaaucauaucuacgacaccgggcccacaauuggcaucaacacccagcacgaugagcacuguacgggaccuugccccacacugauccuccauaaagagaauuggcugaccuuuagccaggaacgcacaucccgguggggcugugaggaguucgggugccuggccauuaacaccggaugugucuucggcucuugccaagacaucauucacccggaagcuaagguguacagaaaagccaucgaagaggagguugugcuuacagucugcauuaccuuuccugggaauacguauuguaccgaaaucaacgcuaucgagcccaagauuacagaugaaaucgagcugcaguucaaaaccguggacacaaagacccucccuaaucugcucauggugcagaaccauaagcuguacagcggacagauugaugaccuuggcuccuuuucucaagggugcggcaauguccagaaaacgaaccagagcguuaucggagccggcacagcgaaguucgacuaugugugucacggggccucccgcaaagaugugauuguccggagaugcuacaauaacaauuaugagagcuguaagcugcucaaagaagagaccucucugaucuuugcugacaaccaugaaacacuggagguggccaauaccaagcaccuuaucggagaacugcaauucaagauuaugcucggcgauauccgguacaaauccuuugcugagagccccgagcuggaaguugacgccaagugcgugggguguccuucuugcuucgaguccuauagcuguaacuuucagauugucaccaacaucgauacagugugcuccguugacggacccuguacgcuuuuccacaaucgccugauuaucucugccaccaaacagagcuacggcuuuaagauguccugcccgagaaaaccugaacccacagaggaguuccagauuugcaaccggaaguacaaugugcuuuucaccacaaucgauaagaacgacaaaaucgaaauuaauaccggcgaucaaacgagcuauaucuacgagaaggacaacagauguaaaacauggcugugccgcguccgggaugaagggauuucugugaucuuugagccccucaaggcuuucuuuggauccuauuucagcauuaucuuuuacguuguggucggcaucauugugcuguuccugaccaucuauauuuuucuuccuauguucuuuaaacugagagacauccucaagcgcaaugaauaccuguaucuccaggagcugaagcauaaauga

SEQ ID NO: 14205 - RNA, 4311 nt, Artificial Sequence
  derived and/or modified CDS sequence (opt5) from MAGV(AG83-1746)__KX100113.1__GP
augaagaugauccugcucauuaucauucugugcgugaaccuugccgcugccaaucccgucgcgaccagauguuuccacggcgggcagcugaucgcugagacacggagcgccacguccauuucugaauuuugccucaaagacgauguuagcaugaucaaguccgagaucaccuacacaaagaacgacaccggaauuuucggccauucuaagaucuauaaaagcuggcugauuaaggauuggaaacuuuguaauccugugccgacagccgggggauccaucaacgugauugaagucaauucugaccugagccucaccacaaaggcuuacgugugcucccgcgauuguaccaucacgauugacaaggaggaagcccaaaucaucuuucagaccgauaaacugaaccacuucgagguuagcggcacaacccugucuuccgggugguuuaagacaaaagcuagcgugacccucgacagaacgugcgagcauauuaaggucacauguggaaagaaaacccugcaguuccacgccugcuuucggcaucacaugucuugugugcgcuucuuucacaauacaauccuucccggcaccaugguuaacuccaugugccagaauauugaacugaucauuauccucggccugacccuuaucauuuucacacugauggugauccucacgaagaccuauauuuguuacauccugaugccucuguuuaugcccauugcguaugccuacgggugggcuuauaacaaaagcugcaagaaaugcaauuguugcggacucgccuaccauccuuucacaaacuguggcucucacugcgucugugggcugaaguuugaggcuuccgauagaaugcggauccaucgcgaaagcggacuuugccaaggcuacaaaucccugagaaucgcccggcuccuguguaagucuaaggggagcucccuuauuaucagcacccugcucucuaugcugcugcucuccuucauuacacccaucgagggaaccaugacgaauuauccugagacacgccaguacagccuggaagagauugcggacgugguggaaggccuucugucugagcagaacaucaaagaauaugucguuuucuacaccagccucuuuggcucccugauucuucugcucgccuucauccugucuaucacccugacaaaggugaccaaugcucucgccaaaacaaacgugauuuauugcgaggaguguagcauguaccacgcuaagaaagggaucaaguauaacggagauuuuacgaauaagugcggcuucuguaccugcgacgaacaggaggaugaagaggggauuaucauucacaaagucuccaagaaaugcacauacagauaccaacugcagugggccaagaucaucaugauuauccuugugaugcugcucaugaugcagaacaccauucugaucguugccgcugaaacagacuguuggaccaaaaauagccuggagcuugacugcauuggaccgcuccugacgaucucugauuguuccaacaaggagagcaagaauuaugaagaggaagcggccaaacuggugucucaguccaagaucacccaagcugacgccgagcaggucacaauucucggcaacaccaucgauacagcccugaaagcuauucggagccagaagaccuaccaaacgaugcaucuucuggaauccguguuucucaugaaaaauugcgacuauuacucuagcuucgagcacaacuccggguauucucaggccaaguggcgccugaucgcgaagacaagccauuuugauauuuguuccagacacagcaugcaucacuucugccgguguguugcugacggaaccaaaugccagaauggcaacugggauuuugccggcgagaugaauaacacauacucuaccaagaaugacuucuaucugcacgaucuuaaccucuuuuucacccugcaugaaacagccuuucccgggacgaccgagucccuguucuaccagcucaucgcuaaaaagaauacaaccggagccagcaaacugcuuggcaagcugaucacaaaauacgggaacaacaaacucuucgugggaauuuggaaguuuggccaauaucugcugacccuuccuuacgucaauacgacagaacucucuaaaacccgcaaggagaccauccugaaaccccaccagauucugacaagaucccaagggggccggccugagagcaugucuagcgcugaagugggacagaccgccaaggagugugcgaacgccaaaaaugucggcugcaucucccccagauucggggugccgauuggaaaccucacagcuuguggcaauagcccuaacuauaagaucuacaagacgcccaauaaaauuuauaagucuaacaaucgcggggaaguuuggugcuccgaggacgugcauugccuggccgauuuugaaccugcugacaccgaggucgugaacaaaguuaagaaaaugacauguuuccuuagcgacgugaauacccgggccgauaucuuuuccaucgcgauuucugccugcagaauggucgacaagggaguguguacagugaacggcgcuaaguggaauauccugaaaugcgagagcgggcucuacuauuucaccgaucaccgcgaaggccaggacacgggaaacgauuuuggcgaguacuguauuucccacucuugcaauaccgaacgguaccccaucaaccccgacauucugaaggaguguaucugggaauaucauagcagaaaauccaaguacaucucuacaauuaaccuggagagccuugaggaguucaaacgcgccauguccgauaagcucagccacacccugaugguuuauaauuuuaagccuacagcuaaccugccgcauaucaaacccucuuacaaguucauuaccgccaaugggaucgagaacuccgacggacucgaaagcgccuauauucugucuuccaucccugcuaucggcgggaugagcauuggauacaauauccagacaaaagauaacuuuccccuucuggaccucauugucuucgugaagucugcggugaucaaaaccacguauaaucacauuuacgauacaggcccuaccaucgggauuaacaccaaucaugacgagcacugcacaggccccuguccgaccaucaucccucacaaggaaaacuggcugacguuuucccaggagcggacaagcagauggggaugcgaggaguucggcugucuggccauuaauaccgggugcgucuucggauccugccaggaugugauccaucccgaaacaaaaauuuaccgcaaggcuguugaagaggaggugguccuuaccguguguaucaacuuuccuggcaauacauucugcaccgaaauuaacgccaucgagcccaagaucacggacgaaauugagcugcaauuuaaaaccguugacacaaagacccucccuaaucugcucgccgugcagaaccacaaacuguauagcgggcagaucaacgaucuuggaucuuucagccagggcugugggaauguccaaaagacaaaccaguccauucugggcgcuggaaccgugaaauuugacuacguuugccauggcgccucucggaaggauaucauugugagacgcuguuauacgaauaacuacgacagcugcaagcuccugaaagaagaacggucccugaucuucgcggauaaucacgagacacuugaagucgcuaacaccagacaucugaucggggagcuccaguuuaagauuaugcugggagacauccgguauaaagccuucgccgaaaagcccgagcucgaaauugaugcuaaaugugugggcugcccgucuuguuuugagagcuacuccugcucuuuccaaaucgugacaagcauugacaccgucuguuccguugaggggccuugcacccuguuucacaaucgcaucauuaucacagccgcgaagcagagcuauggagugaagaugucuugcaaaacgaagcccggccccguggaagaguucagaaucuguaaccggaauuacagagucuccuucgcuaccauugauaaaaacgacaagaucgaaauuaauacaggcgaucagaccagcuacaucguggagaaagacucucgcugcaagacauggcuuugucggguuagagaugaagggauuuccgugaucuuugagccucugaaggccuucuuuggaagcuauuucuccgucgccuuuuacaucauuaucggcauugcugcccucuuccugaucauuuauaucuuucugccgauguucuuuaaacuucgcgacgugcugaagaaaaacgaguaccucuaucugcaggaacucaagcacaaauga

SEQ ID NO: 14206 - RNA, 4305 nt, Artificial Sequence
  derived and/or modified CDS sequence (opt5) from MAGV(BeAr 7272)__KX100104.1__GP
auggagcugcucaucauuauccugcuucugggcagcgccgcuuccucucccauuagcaccagaugcuuccacgggggacagcucaucgccgaauccaagucugcgacaagcauuuccgaguuuugucugaaagacgaugugucuaugaucaagagcgaagucacguacaucaaaaacgacaccggcauuuaugggcauaauaagguuuuccgguccuggacaaucaaagauuggaagcucugcaacccuauuccgaccgcuggaggcagcaucaaugugauugaggugaacucugaccugucccucgccacacgcgccuacgucuguagcagagauugcaccaucacaauugacaaggaagaugcucaaaucaucuuucagaccgacaaacugaaucacuucgaggugucugggacgacccuguccagcggaugguuuaagacaaaagccucuguuacccucgaucggacaugugagcauauuaaggugaccugcggcaaaaagucccugcaguuccacgcuuguuuuaagcaucacaugagcugcauccgcuucuuucaccauacgauucuucccggcacaauggucuccucuaugugucagaacaucgaacugauuaucaucauugggcucacccuggugaucuucauucuuaugguuauccugacaaaaaccuauauuugcuaccuccugaugccuguguuuaugcccgucgccuauaucuacggaugggcguauaauaagagcuguaaaaagugcaacugcuguggccuggccuaccacccuuucaccaauugcgggucccauugugugugcggacucaaauuugaggcuagcgacagaaugcggcugcaccgcgaaucuggccuuugucaaggguacaagucccugagaaucgcccggaugcucugcaaaagcaagggaucuagccuggugauuuccggccuucugucuaugcuccugcugagcuucaucacacccauugagggcacgcucaccaacuauccuaaugagaagcaguacacacuggaagagaucgcugaugucguugaagggauuaucaccgagcagcaccuuaaagaauaugugguguucuacacaucccuguuuggaggccucauucugcuucugacccucauccugagcaucacgauuaacaaggucacagaccugcucgccucuaccaaugugaucuauugugaggagugcuccauguaccauagcaaaaaggggauuaaauauaacggagauuucaccaauaaguguggcuuuugcacauguucugaacaggaggacguugaaggggugaucauucacaaggucucccgcaaaugcaccuacaaguaccaacugaaaugggugagaguuaucaugaucauucuugcgcugcuccugacaauccagaacacggugcugauugucgccgcugagguggacugcuggaccaagaaaagcaucgaaauugauuguaucggaccgcuucucaacaucggcuccugcacagacaagucuagccggaccuaugagacagaggucaauaagcuggugcgccaguccaaaguuacccaugccgaugcugaacagauuucuauccugggcagcacgcucgacaacgccauuaaggccgugagaucccaaaagaccuacgagacaaugcacuuccuggaaaccgucuuucuuaugaagaauugugauuauuacaacagcuucgagcauaauucuggguauucccagacaaaauggcggcugaucgcuaagaccagccacuuugacauuugcucucgccacuccacgcaucacuucuguagaugcgugaacgaaggaacaaagugucagaauggcgauugggacuuugcgggggagaugaacgauaccuacaauagcaaaaacgacuucuaucuccaugaucuggaccuguuuuacacacuucucgagaaugccuuccccggaaccaccgaaucucuguuuuaccaacugcuccagaagaaaaacacaacgggcgcuagcaagcugcuugggaaacugaucaccaaguauggcaauaacaauauguucguugagaucuggaaauucggacaguaccuccugaagcugccuuauauuaacgacacagaacuuuccaccgauagaaagagcacaaucauuaaaucucagcaagugcucucccggagccagaccggccgccaggagucccugucuagcgccacgcccgggacagccaccaaggagugcuccaacgcuaaagacaucggauguauuucuccucgguuuggcauccccauugggaaucugaccgccugcggagauagcccgaacuacaaggucuauaaaacaccugaaaagaucuacaaguccaauaacagaggcgaggugugguguucugacgaugugcacugccucaccgacuucgaacccgcggaggaagagguugucaaucgcaucaaacagaugacaugcuuucugacggaugugaccacaaagaccgacguguucagcgucgcuauuuccacauguaaaaugguggauaaggggguuugcaccgugaacgacgccaaauggaauauccuuaaguguaacagcggccuguauuacuuuacggaucaccgggacggacaagauaccggcaaugacuucggggaguacugcauuucucauuccuguaacacagaaagauuuccuaucaaucccgacguccucaaggauugcauuugggaguaucacagccgcaaaucuaaguacaucuccaccgugagccuggaaucucuggacgaguuccggagagccauguccgauaaacuuagccauacacucaugaucuauaacuuuaagcccaccgcuaaucugccucacauuaaaccgacauacaaguucaucaccgccaacggaauugaaaauuccgacggcaucgauagcgcuuauauucugucuagcauccccgcccucgggggaauguccguuggcuacaacauccagacgaaggacaacuuuccucugcuugauauuaucguguucauuaaaucugcgaucauuaagacaaccuauaaucauaucuacgacaccgggcccacaauuggcaucaacacccagcacgaugagcacuguacgggaccuugccccacacugaucccgcauaaagagaauuggcucaccuuuagccaggaacgcacaucccgguggggcugugaggaguucgggugccuggccauuaacaccggaugugucuucggcucuugccaagacaucauucacccugaagcuaagguguacagaaaagccaucgaagaggagguugugcugacagucugcauuaccuuucccgggaauacguauuguaccgaaaucaacgcuaucgagccuaagauuacagaugaaaucgagcuucaguucaaaaccguggacacaaagacccugcccaaucuccugauggugcagaaccauaagcucuacagcggacagauuaaugaucugggcuccuuuucucaagggugcggcaacguccagaaaacgaaucagagcguuaucggagccggcacagcgaaguucgacuaugugugucacggggccucccgcaaagacgugauuguccggagaugcuacaacaauaacuaugagagcuguaaacuucugaaagaagagaccucucucaucuuugcugauaaucaugaaacacuggagguggccaacaccaagcaccugaucggagaacuucaauucaagauuaugcugggcgacauccgguacaaauccuuugcugagagcccugagcucgaaguugaugccaagugcguggggugucccucuugcuucgaguccuauagcuguaacuuucagauugucaccaauaucgacacagugugcuccguugauggaccguguacgcuguuccacaaccgccucauuaucucugccaccaaacagagcuacggcuuuaagauguccugcccuagaaaacccgaacccacagaggaguuccagauuugcaaucggaaguacaacgugcuguucaccacaaucgacaagaaugauaaaaucgaaauuaacaccggcgaccaaacgagcuauaucuacgagaaggauaauagauguaaaacauggcuuugccgcguccgggacgaagggauuucugugaucuuugagccucugaaggcuuucuuuggauccuauuucagcauuaucuuuuacguuguggucggcaucauugugcuuuuccugaccaucuauauuuuucugccgauguucuuuaaacuuagagauauccugaagcgcaacgaauaccucuaucugcaggagcucaagcauaaauga

SEQ ID NO: 14207 - RNA, 4311 nt, Artificial Sequence
  derived and/or modified CDS sequence (opt5) from MAGV(CbaAr 426)__KX100110.1__GP
augaagaugauccugcucauuaucauucugugcgugaaccuugccgcugccaaucccgucgcgaccagauguuuccacggcgggcagcugaucgcugagacacggagcgccacguccauuucugaauuuugccucaaagacgauguuagcaugaucaaguccgagaucaccuacacaaagaacgacaccggaauuuucggccauucuaagaucuauaaaagcuggcugauuaaggauuggaaacuuuguaauccugugccgacagccgggggauccaucaacgugauugaagucaauucugaccugagccucaccacaaaggcuuacgugugcucccgcgauuguaccaucacgauugacaaggaggaagcccaaaucaucuuucagaccgauaaacugaaccacuucgagguuagcggcacaacccugucuuccgggugguuuaagacaaaagcuagcgugacccucgacagaacgugcgagcauauuaaggucacauguggaaagaaaacccugcaguuccacgccugcuuucggcaucacaugucuugugugcgcuucuuucacaauacaauccuucccggcaccaugguuaacuccaugugccagaauauugaacugaucauuauccucggccugacccuuaucauuuucacacugauggugauccucacgaagaccuauauuuguuacauccugaugccucuguuuaugcccauugcguaugccuacgggugggcuuauaacaaaagcugcaagaaaugcaauuguugcggacucgccuaccauccuuucacaaacuguggcucucacugcgucugugggcugaaguuugaggcuuccgauagaaugcggauccaucgcgaaagcggacuuugccaaggcuacaaaucccugagaaucgcccggcuccuguguaagucuaaggggagcucccuuauuaucagcacccugcucucuaugcugcugcucuccuucauuacacccaucgagggaaccaugacgaauuauccugagacacgccaguacagccuggaagagauugcggacgugguggaaggccuucugucugagcagaacaucaaagaauaugucguuuucuacaccagccucuuuggcucccugauucuucugcucgccuucauccugucuaucacccugacaaaggugaccaaugcucucgccagaacaaacgugauuuauugcgaggaguguagcauguaccacgcuaaaaaggggaucaaauauaacggagauuuuacgaauaagugcggcuucuguaccugcgacgaacaggaggaugaagaggggauuaucauucacaaggucuccaaaaagugcacauaccgguaccaacugcagugggccaaaaucaucaugauuauccuugugaugcugcucaugaugcagaacaccauucugaucguugccgcugaaacagacuguuggaccaagaauagccuggagcuugacugcauuggaccgcuccugacgaucucugauuguuccaacaaagagagcaagaauuaugaagaggaagcggccaagcuggugucucaguccaaaaucacccaagcugacgccgagcaggucacaauucucggcaacaccaucgauacagcccugaaggcuauucgcagccagaaaaccuaccaaacgaugcaucuucuggaauccguguuucucaugaagaauugcgacuauuacucuagcuucgagcacaacuccggguauucucaggccaaauggagacugaucgcgaagacaagccauuuugauauuuguucccggcacagcaugcaucacuucugccgcuguguugcugacggaaccaagugccagaauggcgauugggacuuugccggcgagaugaacaauacauacucuaccaaaaacgauuucuaucugcacgaccuuaaucucuuuuucacccugcaugaaacagccuuucccgggacgaccgagucccuguucuaccagcucaucgcuaagaaaaacacaaccggagccagcaagcugcuuggcaaacugaucacaaaguacggaaauucuaaacucuucguggggauuuggaaguuuggccaauaucugcugacccuuccuuacgucaacacgacagaacucuccaagaccagacgggagaccauccugaaaacacaccagauucugaccagaagccaagggggccgcucugagagcauguccagcgcugaagugggacagaucgccaaggagugugcgaacgccaaaaaugucggcugcauuucuccccgguucgggaucccuauuggaaaccucacagcuuguggcaauucccccaacuauaagaucuacaaaacgccgaauaagaucuauaagagcaacaauagaggggaaguguggugcuccgaggauguucauugccuggccgacuuugaaccugcugacaccgagguggucaacaaagugaagaaaaugacauguuuccuuucugauguuaauacccgcgccgacauuuuuagcaucgcgauuuccgccugccggaugguggauaagggagucuguacagugaacggcgcuaaauggaauauccugaagugcgagucugggcucuacuauuucaccgaccacagagaaggccaggauacgggaaacgacuuuggcgaguacuguauuagccacuccugcaauaccgaacgcuaccccaucaacccugauauccugaaggaguguauuugggaauaucauucucggaaaagcaaguacaucuccacaauuaaucuggagagccuugaggaguucaaaagagccaugucugacaagcucucccacacccugaugguguauaacuuuaaacccacagcuaaccugccccauaucaagccuagcuacaaguucauuaccgccaaugggaucgaaaacucugauggacucgaauccgccuauauccugagcucuauuccggcuaucggcgggauguccauuggauacaauauccagacaaaagacaacuuuccccuucuggaucucauuguuuucgucaagagcgcggugaucaaaaccacguauaaucacauuuacgacacaggcccuaccaucgggaucaacaccaaucaugaugagcacugcacaggccccuguccuaccauuaucccccacaaggaaaacuggcugacguuuucccaggagcgcacaagccgguggggaugcgaggaguucggcugucuggccauuaauaccgggugcguguucggaucuugccaggacgucauccauccggaaacaaaaauuuacagaaaggcuguggaagaggagguugugcuuaccgucuguaucaacuuuccuggcaauacauucugcaccgaaaucaacgccauugagcccaaaaucacggacgaaauugagcugcaauuuaagaccguggauacaaagacccucccuaaucugcucgccguucagaaccacaaacuguauagcgggcagaucaaugaccuuggauccuucucucagggcugugggaacgugcaaaagacaaaccagagcauucugggcgcuggaaccgucaaauuugauuacgugugccauggcgccucccgcaaggacaucaucguucggagauguuauacgaauaacuacgauucuugcaaacuccugaaggaggaacggagccugauuuucgcggacaaucacgagacacuugaaguggcuaacacccgccaucugaucggggagcuccaguuuaagauuaugcugggagauaucagauauaaagccuucgccgaaaagcccgagcucgaaauugacgcuaaaugugucggcugcccuuccuguuuugagucuuacagcugcaauuuccaaaucgugacauccauugauaccguguguagcgucgaggggcccugcacccuguuucacaaccggaucaucauuacagccgcgaagcagucuuauggaguuaaaauguccugcaagacgaagccgggcccuguggaagaguucaccaucuguaauagaaacuaccgcgugagcuucgcuacaauugacaaaaaugauaagaucgaaauuaacaccggcgaccagacaucuuacaucgucgagaaagauucccggugcaagaccuggcuuuguagagugcgcgacgaagggaucagcguuauuuuugagccccugaaagccuucuuuggauccuauuucucuaucgccuuuuacauuaucauuggcaucgcugcccucuuccugaucauuuauaucuuucugcccauguucuuuaaacuuagagacgugcugaagaaaaaugaguaccucuaucugcaggaacucaagcacaaauga

SEQ ID NO: 14208 - RNA, 4305 nt, Artificial Sequence
  derived and/or modified CDS sequence (opt5) from MAGV(CoAr 3363)__KX100107.1__GP
augcugagccuccugauccuugccuuccugggccucuccaccucuaaccccauugcuacaagaugcuuucacgggggacagcugaucgccgagagcaaguccgcgacgucuauuagcgaguucugucuuaaagacgauguguccaugcugaagucugaagucguuuacaccaaaaaugacacaggccucuuugggcauaacaagguguuccggagcuggaccaucaaagauuggaagcugugcaauccuauuccgacagcuggaggcaccaucaacgugaucgaagucaauaaggaccugucccucaugacaaaaaccuauauuuguagccgcgauugcacgaucaccauugacaaggaggaagcccaaaucauuuuucagacagauaaacugaaccacuucgaggugucugggaccacacuuuccagcggaugguuuaagucuaaagccuccguuacccuggacagaacgugugagcaugugaaggucacaugcggcaagaaaagccuccaguuccacgcuuguuuuaagcaucacaugucuugcgugcgguucuuucacaauaccauccugcccggcaacaugauuacauccaugugucagaauaucgaacuuaucauuauccuggggcucacccuggccauuuucauccugaugguuaugcucaccaaaacauacauuugcuaucugcuuaugccuaucuuuaugcccaucgcuuaccuguauggaugggccuacaacaagagcuguaaaaagugcaauugcuguggccucgcguaucauccuuucacgaacugcgggucccacugugugugcggacugaaauucgaggccucugaucgcaugcggauucauagagaaagcggccuuugucaaggguacaagucccugcgcaucgcuagacuccugugcaagagcaaaggaucuucccuggucauuagcggccuccugucuaugcuuauccugagcuuugugacccccauugagggcacaaucaccuccuacccugagucucggaaguauacacucgaagagaucaccgacguggucgaagggcugguuagcgagcagaauauuaaagaauacaucguguucuauacgucccuuuuuggaagccugauucuccugcuggccuucaucaugucuauuacacucuccaagaucaccagcauucuggcucgcagaaacgugaucuacugugaggagugcucuauguaucacuccaaacggggcaucaaguacaauggggauuuuaccaacaaguguggauucugcacauguaacgaacaggaggacgccgaaggccuugucauucacaaagugagcaagcgcugcaccuauaaaugccagcugaagugggcgaaaguucucaugaucacacuggugcugcuucucauugcccaaaauacgauccugauugucgcugccaagaccgauuguuggacaaagaaaucccuggacaucgacugcaucgggccgaugcucgauauuggaucuuguaccaacaagaauacaagaagcuacgacaccgaggcucagaaacuggugacgcaguccaagguuucucagcuugaugccgaccaagccagccugcucggcuccagcaucgauucugcuauuaaagcgauccggacccagaagacauaccccaccaugcaucugcuggaaacaauuuuucuuaugaagaacugcgacuauuacaccuccuucaaucacaacagcggcuauucucaggcccgcuggagacucaucgcuaaaacggggcauuuugauaucuguucccggcacagcacacaucacuucugcagauguauuucugacggaaccaagugccaaaauggcgauugggacuuugccggggagaugaacgagccuuacaauagcaaaaacgauuucuaucugcacgaccugaaucucuuuuacacaaucuucgaaaacgccuuccccggaaccaccgagucccuguuuuaucagcuuauucagaagcgcgacacaacgggcgcuagcaaagugcuggggaagcucaucaccaaauacggcaauaacaauauguucgucggaguguggaaguuuggccaguaccugcugacacuuccuuauauuaacaacaccgaacucucucaaaaucggaagcagacaauccuggccacccaggagccccuguccagaagccauccggggcgccaggaauccaugucuagcgcgauccaaggauccgucacgaaagagugucacaacgcuaaggaugugggcugcauuucuccucgguucgggauccccauuggaaaucucacagccuguggcgacagcccuaacuacaaaaucuauaagacccccgagaaacuguacaaguccaauaacaagggggaaguuuggugcucuaaugaugugcauugccuuaacgacuuugagcccgccgaugaagaggucgugaauaaaguuaagaaacugaccuguuuccucacagacgugcuggucaagaccgauauuuuuagcguggcugccuccacaugcaaaauggcugacaagggcaucuguacggugaacgaugccaaguggaauauuaucaaaugcgacagcggacuguauuacuucaccgaucacagagagggccaggacacagggaacgauuuuggagaauauuguaucucucacuccugcaauaccgagcgcuucccuauuaacccggacauccuuaaggacuguacaugggaauuucauagccggaaaucuaaguacauuuccaccaucagccucgagucucuggaagaguucagacgcgcgauggccgagaaacugucccacacgcucaccauuuacaauuuuaagcccacagcuaaccugccucauauccggcccaccuauaaguucaucacagccaacggcguugaaaauagcgaugggauugaguccgcuuacauccuuagcucuauuccugcccugagcggaaucuccgucggcuauaacgugcagaccaaagacaauuucccccuccuggauauuaucguguuuaucaagucugcggucauuagaacaaccuacaaccacaucuaugacacggggccgacaauuggcaucaauacccagcaugaugaacacugcaccggaccuugucccgccgugguuccucacaaagagaacuggauuacauucagccaagaacgcaccucccgguggggcugcgaggaguuugggugucuggcuaucaauacgggaugcguguucggcucuugccaggacauuauccaucccgaaacaaaggucuacagaaaagccguggaggaagagguugugcuuaccgucuguaucaacuuuccugggaauaacuauugcacagaaauuaaugcuaucgagcccaagauuaccgaugagaucgaacugcaguucaaaacaguggacaccaagacgcucccgaaccugcucgccguucagaaucacaagcuguacagcggacaaauuaacgaucuuggcuccuuuucucagggguguggcaaugugcagaaaaccaaccauagcauccugggaaugggcacagccaaguucgacuacgucugccacggggcuucccggaaagaugugaucgugcgcagauguuauaacaauaacuuugacagcugcaagcuccugaaagaggaaaccucucugauuuucgcggauaaucaugagacacuugaggucgcccacaccaagcaccugaucggagaacuccaauuuaagauuaugcugggcgacauccgguacaaauccuucgcugagagcccugaacucgagauugacgccaaguguguugggugccccucuuguuucgaauccuauagcugcaacuuucagaucgugacgaauaucgauacaguguguuccgucgagggacccugcacccuguuccauaacagaauuaucauuucugccaauaaacagagcuacggccuuaagauguccugccagacaaaaccuaaccaaaaugaggaauuuaucauuuguaaccgcaaguauagcgugcuguucaccaccaucgacaagaaugauaaaauugagguuaacacaggcgaccagacgucuuacaucuaugaaaaggauucccggugcaaaaccuggcucuguagagugcgcgacgaggggaucagcguccuguuugaaccgcugaaggcuuucuuuggaucuuacuucagcauuaucuuuuacgugguuauuggcaucauugugcuuuuccugaucgucuauaucuuucuccccauguucuuuaaacugaaggaugugcucaagaaaaaugaguaccuguaucuucaggagcugaagcacaaauga

SEQ ID NO: 14209 - RNA, 4305 nt, Artificial Sequence
  derived and/or modified CDS sequence (opt5) from MAGV(OBS 6657)__KX100116.1__GP
auggagcugcucaucauuauccugcuucugggcagcgccgcuuccucucccgugagcaccagaugcuuccacgggggacagcucauugccgaauccaagucugcgacaagcaucuccgaguuuugucugaaagacgaugucucuaugauuaagagcgaaguuacguacaccaaaaacgacacaggcaucuaugggcauaauaagguguuccgguccuggaccaucaaagauuggaaacuuugcaacccuauuccgacagcuggaggcagcaucaaugugauugaggucaacucugaccugucccucgccaccaaggccuacguguguagccgcgauugcacaaucaccauugacaaggaagaugcucaaaucauuuuucagacggacaagcugaaucacuucgagguuucugggaccacacuguccagcggaugguuuaaaaccaaggccucugugacacucgauagaaccugugagcauaucaaagucacgugcggcaagaagucccugcaguuccacgcuuguuuuaaacaucacaugagcugcauccgguucuuucaccauacaauucuucccggcaccaugguguccucuaugugucagaacaucgaacugauuaucauuaucgggcucacacugguucuuuucauccugauggugauucucaccaagaccuauaucugcuaccugcugaugccuauuuuuaugcccaucgccuauauuuacggaugggcguauaauaaaagcuguaagaaaugcaacugcuguggccucgccuaccacccuuucacaaauugcgggucccauugugucugcggacugaaguuugaggcuagcgaccgcaugagaauccaccgggaaucuggccuuugucaaggguacaaaucccugcgcaucgccagaaugcucugcaagagcaagggaucuagccuggugauuuccggccuucugucuaugcuccugcugagcuucaucacgcccauugagggcacccucacaaacuauccuaaugagcggcaguacacccuggaagagaucgcugauguggucgaagggauucuuacagagcagcaccugaaagaauauguuguguucuacaccucccucuuuggaggccugauccuucugcucacgcugauucugagcaucacaaucaacaaggugaccgaccuccuggccucuaccaaugucauuuauugugaggagugcuccauguaccauagcaaaaaggggaucaaauauaacggagauuucacaaauaaguguggcuuuugcaccuguucugaacaggaggacauugaaggggugguuauccacaaggugucccgcaaaugcacauacaaguaccaacuuaaaugggucagagugauuaugaucauccuggcgcuccugcugacgcuucagaacaccguucucauuguggccgcugaggucgacugcuggacaaagaaaagcaucgaaauugauuguaucggaccgcugcugaacauugggaccugcacagacaaguccucucggaccuaugagacggaggugaauaagcucguccgccagagcaaagugacccaggccgaugcugaacaaguuuccauccugggcucuacacuugacagcgccaucaaggccauuagaucccagaaaaccuacgagacaaugcauuuccuggaaaccguguuucucaugaagaacugugauuauuacagcucuuucgagcacaauuccggcuauagccagacgaaauggcggcugaucgcuaagacaucucauuuugacauuugcucccgccacagcgcgcaccauuucuguagaugcgucaacgaaggaaccaagugucaaaauggcgauugggacuuugcccgggagaugaacgauacauacaauucuaaaaacgacuucuaucugcacgaucuugaccucuuuuacacccuguucgagaaugcuuuucccgggaccacagaaagccuguucuaccagcuccugcagaagaaaaacacgaccggagccuccaaacuucugggcaagcucaucacaaaguaugggaauaacaaucuguucgugggcauuuggaaauuuggacaguaccugcuuaagcucccuuauaucaacgacaccgagcugagcacagauagaaagucuaccaucaugaaaucccaacagaugcugagccgcucccagacgggccggcaggaaucucucagcuccgccacacccgggaccgcuaccaaggagugcucuaaugccaaagacauuggauguaucagcccuagauucggcauucccaucgggaaccugacagcgugcggagauuccccgaacuacaagauuuauaaaaccccugagaagaucuacaagucuaauaacaaaggcgaaguuugguguagcgacgaugugcauugccuugcugacuuugagcccgccgaagaggaagucgugaaucgcauuaagcaaaugacaugcuuccugacggaugugaccacaaaaaccgacguguuuuccgucgccaucagcacauguaagauggcugauaaaggggugugcaccgugaacgacgccaaguggaauauccucaaguguaacucuggccuguauuacuucacggaucaccgggacggacaggauaccggcaaugacuuuggggaguacugcauuucccacagcuguaacacagagagauucccuaucaaucccgacguccugaaagauugcauuugggaauaucauucucgcaaguccaaauacaucagcaccauuucucuugagucccucgacgaauuucggagagcuaugagcgauaagcugucccacacacugaugaucuauaacuucaaacccaccgccaaucucccucauaucaagccgacauacaaguuuauuaccgcgaacggaaucgagaauagcgacggcauugauucugccuauauccugagcuccauucccgcucuugggggaaugucugugggcuacaacguucagacgaaagacaauuucccucugcucgauaucaucguguuuauuaagagcgccaucauuaaaacaaccuauaaccacaucuacgacaccgggcccacaauuggcaucaacacccagcaugaugaacacuguacgggaccuugccccacacugauuccgcacaaggagaauuggcugaccuucucccaagagcgcacaucucgguggggcugugaagaguucgggugccuugcuaucaacaccggaugugucuuuggcagcugccaggacaucauucauccugaagccaaaguguacagaaaggcgaucgaggaagagguugugcugacagucugcauuaccuuccccgggaauacguauuguaccgagaucaacgccauugaaccuaaaaucacagaugagaucgaacuccaguuuaagaccguggacacaaagacccugcccaaucuccugaugguucagaaccacaaacuuuacuccggacaaauuaaugaucugggcucuuucagccaggggugcggcaacgugcagaagacgaaucaauccgucaucggaacaggcaccgcuaaauuugacuaugugugucauggggccagccgcaaggacgugauuguccggagaugcuacaacaauaacuaugagucuuguaaacuccugaaggaggaauccagccugaucuucgcugauaaucacgagacacuugaaguugccaacaccaagcaucugauuggagagcuccaguuuaaaaucaugcugggcgacauccgguacaagucuuucgccgaauccccugagcucgagguggaugcuaaaugcguggggugucccagcugcuuugaauccuauucuuguaauuuccagauugucaccaacaucgacacagugugcagcguugauggaccguguacgcuguuucacaaccgccuuauuaucuccgcggccaagcagagcuacggccugaaaaugucuugcuccagacggccugagcaaaccgaagaguuccagauuugcaauagaaaguacagcguucucuucacaaccaucgacaagaacgauaaaauugaaaucaauacaggcgaccagaccucuuauaucuacgagaaggauaaccgcuguaaaacguggcugugccgggucagagacgaggggauuagcgugaucuuugaaccccugaaggcuuucuuuggauccuauuucucuauuaucuuuuacguuauugugggcaucaucguccuuuuccugauuaucuauauuuuucuccccauguucuuuaaacugcgcgauauccucaagagaaaugaguaccuguaucuucaggaacugaagcacaaauga

SEQ ID NO: 14210 - RNA, 4302 nt, Artificial Sequence
  derived and/or modified CDS sequence (opt5) from NORV(0234)__EU004188.1__GP
augaucugguucauucugcuccuggccaucgcucccagcuuuggcaccccuauugccacaagaugcuuccacgggggacagcuuaucgcggaggcuaagucccaaacgucuauuagcgaauuuugucugaaagacgauguguccaugaucaagucugaggucaccuacacaaagaacgacaccggcaucuucgggcauagcaagguuuaucgguccuggacaauuaaagauuggaagcucugcaauccggugcccaccgugggaggcucuaucaacgucauugaagugacagccgaccugagccuuuccaccaaggccuacguuuguagccgcgauugcacgaucaccauugacaaagagggggcucagaucguguuucagacagauaagcugaaucacuucgaagucucuggaaccacacucuccagcggcugguuuaaaaccaaggccucugugacgcuggacagaacaugugagcauauuaaaguuaccugcggcaagaagacacugcaguuccacgcuuguuuuaaacaucacauguccugcauccgguucuuucacaacaccauccucccugggagcaugguggccucuaugugucaaaauauugagcugaucauuauccuuggacugacccucauuaucuucauccugauggcgauucuuacaaagacguauaucugcuaccugcucaugcccauuuuuaugccuaucgccuaugcuuacggcugggccuauaacaaauccuguaagaaaugccauugcugugggcuggcuuaccaccccuucaccaauugcggaagccauugugucugcggccugaaguucgaagccuccgaucgcaugcggauucacagagagucugggcucugucagggauacaaaagccugcgcguggcgagacuucugugcaaguccaagggcagcucucucgugaucuccauccugcuuagcaugcugauucucucuuuugucacaccuaucgaaggcacccugacaaacuauccggagagccggcgcuacacccuggaggaaauugccgacguuguggaggggaucauugcugaacaggaucucaaagaguauaucguguucuacacgucccuguuuggaucucuuauucugcuccuggccuucauccuuagcgucacacugaccaaggugcucgaccugcuggcuaaaaccaauguuaucuauugugaagagugcuccauguaccaccccagaaagggcauuaaauauaacggggauuuuacaaauaaguguggauucugcaccugugacgagcaggaagacguggagggcgucaucauucauaaggugagcaaaaagugcacauaccgguaccaaguuaaaugggccaagaucauuaugaucaucguggucauucuccugauggcccagaacacgauccuuauuguggcugcggaaaccgauugcuggaccaaaaagucucuggagcucgacuguaucgggccucugcugaauauuggauccugcagcggcaaggaagcccgcacauaugagacagaggucaaaaagcucgugucucaguccaaaguuacccacaucgaugcugaacauaucagcauucuuggcgccacgaucgacuccgccauuaagucuaucagagcucagaaaaccuacgccacaaugcaucugcuggagaccguguuucucaugaagaacugugauuauuacacagucuucgaacacaauagcggguauucccaagcgaaguggcggcugauugcuaaaaccaaccacuuugacaucugcucucgccacagcgcccaucacuucuguagaugcaucaacgaugagacgaagugucagaauggaaacugggacuuugccggcgaaaugaauaacacauacuccaccaaaaaggauuucuaucggcaugaccuugaucuguuuuacacaauuuucgagaaugcuuuccccgggagcaccgagucucucuuuuaccaucugcugcagaccaaaaacacaacgggagccuccagaauccuugaaaagcucagcaccaaauucggcaauaacaauauguuuguggggauuuggaaguucggccaauaucugcugacacucccuuacguuaacgagaccgaacugucucccucccgccagagcacaauccuuaccaauucuaacagccugucccggagcacgggaagacaggagucucucuccagcgcuauuccgggcccuaauacaaaggagugcuccaacgcccgcgacgugggguguaucucuccccgguuuggcauuccuaucggaaaucugaccgcgugcggggaaagccccuccuauaaaaucuacaagacccccgagaaacuguauaagucuaacaacaaaggagaaauuugguguagcgacgauguccacugccuuaagaauuucgagccugccacagaagagaucgugaacagaauuaagcagaugaccugcuuucucacagacguguccacgaaaaccgauaucuucucuauugcuacaagcaccugucgcaugguugacaagggcgucugcacagugaaugaugccaaauggaacauccugaagugugacuccgggcuguuuuacuucaccgaucaacgggagggccaggacacgggaaaugauuuuggcgaauauugcaucagccacucuuguaacaccgagagauucccgauuaaucccgacauccucaaagauugcacaugggaauaccacucccgcaagagcaaguacauuucuaccaucucccuggagagccuugacgaauuucggagagcuaugucugauaaacugucccauacacucaugauuuauaacuucaagccuaccgccaaucugccccacaucaaaccuacauacaaguucaucaccgcgaacgggauugagaauagcgacggacuggacuccgccuauaucgugagcucuauucccgcucuuggcgggaugagcgucggauacaacgugcagacgaaagauaauuuuccgcuccuggacaucauuguuuucaucaaguccgccgugauucgcacaaccuauaaccauaucuacgauaccggcccuacaaucgggauuaauacccagcacgacgagcacuguacgggcgcuugccccacacaaaucccucauaaggauaacuggcugaccuuuucucaggaacggacaagcagauggggaugugaggaauuuggcugccucgccauuaacaccgggugugucuuuggauccugccaggacaucauucaccccgagacaaaaguguaucggaaggccauggaagaggagguuauccugaccgugugcgucacguucccuggcaauaccuacuguacagaaaucaacgcuauugagcccaaaaucaccgaugaaauugagcuucaguuuaagacaguggacaccaaaacgcugccgaauauccucgcgguucaaaaccauaagcuguacucugggcagauuaaugaucugggcagcuucucccagggaugcgggaacgugcagaaaacaaaucaaucuauccuuggcaccggaacagccaaguuugacuaugucugucacggcgcuagccgcaaggauaucauugugagacggugcuacaacaauaaccaugacuccuguaaacugcucaaggaggaaaccagccugaucuucgccgauaaucacgagacccucguggucgccaacacaaaacaccugauuggggaacuucaguuuaagaucaugcugggagacauuagauauaaaucuuucgcugaguccccugaacucgagaucgacgccaagugcguuggcugucccagcugcuucgagucuuacuccuguaauuuucagauuaucacgaacaucgauaccgugugcagcguguccgggcccuguacacuguuccauaaucgccugauuaucaccgcgacaaagcaaucuuauggaauuaaaaugagcugcccuaccaagccggaaggcacggagacauuugaaaucugcaacaaacaguacaagauuuucuuuaccaccaucgacaaaaacgauaagaucgagauuaauacaggcgaccagaccuccuauaucuacgaaaaggauaaccgguguaaaacauggcuuugcagaguccgcgacgaggggauuagcgugcuguucgagccccucagagcuuucuucggaucuuacuuuuccaucauuuucuaugccguugugggcaucaucauucuguuucucgccgucuacaucuuccugccuaugauuuuuaaacuucgggauaugcugaaaaagaaugaauaucucuaccugcaggagagcaaacacaaguga

SEQ ID NO: 14211 - RNA, 4305 nt, Artificial Sequence
  derived and/or modified CDS sequence (opt5) from PLAV(75V3066)__KX100122.1__GP
augcuguuccuccugauccuugccuuucugggcuucagcaccuccaaccccauugcuacaagaugcuuucacgggggacagcucaucgccgagucuaagagcgcgacguccauuucugaguucugucugaaagacgaugugagcaugcuuaaguccgaagucguuuacaucaaaaaugacaccggccuguuugggcauaacaagguguuccggucuuggacaauuaaagauuggaagcucugcaauccuaucccgaccgcuggaggcacaaucaacgugauugaagucaauaaggaccugagccugaugaccaaaacauauaucuguucccgcgauugcaccauuacgaucgacaaggaggaagcccaaauuaucuuucagaccgauaaacucaaccacuucgaggugagcgggacaacccugucuuccggaugguuuaagagcaaagccucuguuacacuugacagaaccugugagcaugugaaggucacgugcggcaagaaaucccugcaguuccacgcuuguuuuaagcaucacaugagcugcgugcgguucuuucacaauacaauucuccccggcaacaugaucaccucuaugugucagaauaucgaacugauuaucauucuugggcugacacucgccaucuucauucugaugguuaugcugaccaaaaccuacaucugcuaucuccugaugccuaucuucaugcccauugcuuaccuuuauggaugggccuacaacaaguccuguaaaaagugcaauugcuguggccuggcguaucauccuuuuacaaacugcgggagccacugugugugcggacucaaauucgaggccuccgaucgcaugagaauccaucgggaaucuggccugugucaaggguacaagagccuucgcauugcuagacugcucugcaaguccaaaggaagcucucuggucaucuccggccugcucagcaugcugauucuuucuuuugugacgcccaucgagggcaccaucacaagcuacccugagucccggaaguauacccuggaagagauuacagacguggucgaagggcucguuucugagcagaauaucaaagaauacauuguguucuauaccagccuguuuggaucccuuauccugcuccuggccuucauuaugagcaucacgcugucuaagauuacauccauccucgcuaaacgcaacgugaucuacugugaggagugcagcauguaucacucuaagagaggcauuaaguacaauggggauuuuaccaacaaauguggauucugcaccuguaacgaacaggaggacacagaaggccuggucauccacaagguguccaaacggugcaccuauaaguaccagcuuaaaugggccaagguucugaugauuacacucgugcugcugcuuaucgcgcaaaauacgauucucaucgucgccgcugagaccgauugcuggacaaagaaaagccuggacaucgacuguauugggccgaugcuggauaucggauccugcaccaacaagaauacacgcucuuacgacgccgaagcucagaaacucgugagccaguccaagauuucucagcuggaugccgaccaaguuagccuucugggcaacuccaucgauagcgccauuaaagcuaucagagcgcagaagaccuaucccacgaugcaucuccuggagaccaucuuucugaugaagaauugugacuacuauacaaacuucaaucacaacucuggcuacucccaggccaaauggcggcuuauugcuaagaccgggcauuuugauaucugcagccgccacucuacacaucacuucuguagaugcauuaaugacggaaccaaaugucaaaacggcgauugggacuuugccggggagaugaaugaaacguauaacuccaagaaugauuucuacagccacgaccucaaccuguucuauacaaucuuugagaaugccuucccuggaaccacagaaucucuguuuuaccagcucauucagaaaaagaacaccaccggcgcuagcaaagugcuggggaaacuuaucacaaaguacggcaacaauaacauguucgucggaguguggaaguuuggccaguaucugcucacgcugcccuacaucaauaacaccgagcugucccaaaaucggagacuuacaauucucgccacccaggaaauccugagccgcucucauuccgggcggcaggagagcauguccaacgcgauucagggaucuaucacaaaggagugccacaaugcuaaaggcgucggguguauuagcccuagauucggaauccccauuggcaaccugaccgccugcggggacuccccgaauuauaagaucuacaaaacgccugaaaagcucuauaagucuaacaauaaaggcgaggugugguguagcaacgauguucauugccugaaugacuuugaacccgccgaugaggaggugaucaacaagauuaaaaagcugacaugcuuccugaccgacgucuccguggaaguugauaucuuuucuguggcugccagcaccuguaaaauggcugacaagggagucugcacagugaauggcgccaaguggaacauuaucaaaugugauuccgggcucuacuauuucaccgaccaccgcgagggacaagauacaggcaacgacuuuggggaauacugcauuagccacucuuguaauacggagcgguucccuaucaaccccgauacccugaaggacugcacaugggaauuucauuccagaaaaagcaaguacaucucuaccauuucccuggagagccuugaggaguuccgccgggcgauggccgaaaaacucucucacacacugaccaucuauaauuucaagcccacggcuaaccugccucauauuagaccgaccuacaaguuuaucacagccaauggaguggaaaacuccgauggcauugagagcgcuuauauccucuccagcauccccgcccuugggggcauuucuguuggauacaauguccagaccaaagacaacuucccucuucuggacaucauuguguuuaucaagagcgcggugauucgcacaaccuauaaucacaucuacgauacaggccccaccauugggaucaacacgcagcaugacgaacacuguacaggaccuugccccgccgucgugccgcacaaagagaauuggaugaccuucucccaggagcggaccucuagauggggcugugaagaguuugggugccucgcuaucaacacaggauguguuuucggcagcugccaagauauuauccauccugaaaccaagguguaucgcaaagccgucgaggaagaggugguucugacggugugcauuaauuuucccgggaacuccuacuguacagagaucaaugcuauugaaccuaagaucaccgacgagaucgaacugcaguucaaaacagucgauaccaagacacuucccaaccugcucgccgugcagaaccacaagcuguacucuggccagauuaaugaccucggcagcuuuucccaaggaugcgggaacguucagaaaaccaaucauucuauccugggaaugggcacggugaaguucgauuaugucugucacggggccagccggaaagacgugaccgugagacggugcuacaacaauaacuuugauuccuguaaacuucugaaggaggagacaagccucauuuucgcugacaaucaugaaacccuggaggucgcgcacacaaagcaccugaucggagaacuucaguucaagauuaugcugggcgauauccgcuauaaaucuuuugccgaguccccugaacucgagaucgacgcuaagugcguuggcugucccagcugcuucgagucuuacuccuguaacuuucaaauugugaccaauaucgauacggugugcagcgucgaagggccguguacacuguuccauaacagaauuaucauuuccgccaauaaacagucuuauggacucaagaugagcugccagaccaaaccuaaccagaaugaggaauuuaucauuugcaaccggaaguacuccgugcuguucacaaccaucgacaagaaugacaaaaucgagguuaacaccggcgaucaaacaagcuauauuuacgaaaaggacucuagauguaaaacguggcuuugccgcgugcgggaugaggggaucuccguccuguuugagccccucaaggccuucuuuggaagcuacuucucuauuaucuuuuaugugguugugggcauuaucguccuguuccugaucguguacauuuuucuucccauguucuucaaacugaaggacguucucaagagaaaugaauaucuguaccuccaggagcugaaacacaaguga

SEQ ID NO: 14212 - RNA, 4305 nt, Artificial Sequence
  derived and/or modified CDS sequence (opt5) from PLAV(75V5758)__KX100128.1__GP
auggagcugcucaucauuauccugcuucugggcagcgccgcuuccucucccgugagcaccagaugcuuccacgggggacagcucauugccgaaucccggucugcgacaagcaucuccgaguuuugucugaaggacgaugucucuaugauuaaaagcgaaguuacguacaccaagaacgacacaggcaucuaugggcauaauaaaguguuccgcuccuggaccaucaaggauuggaaacuuugcaacccuauuccgacagcuggaggcagcaucaaugugauugaggucaacucugaccugucccucgccaccaaggccuacguguguagcagagauugcacaaucaccauugacaaggaagaugcucaaaucauuuuucagacggacaaacugaaucacuucgagguuucugggaccacacuguccagcggaugguuuaagaccaaagccucugugacacucgaucggaccugugagcauaucaaggucacgugcggcaaaaagucccugcaguuccacgcuuguuuuaagcaucacaugagcugcauccgcuucuuucaccauacaauucuucccggcaccaugguguccucuaugugucagaacaucgaacugauuaucauuaucgggcucacacuggccaucuucauucuuaugguuauccugaccaaaaccuauauuugcuaccuccugaugccuguguuuaugcccaucgcguauauuuacggaugggccuauaauaagagcuguaaaaagugcaacugcuguggccuggcuuaccacccuuucacaaauugcgggucccauugugucugcggacucaaauuugaggccagcgacagaaugcggauccaccgcgaaucuggccugugucaaggguacaagucccuuagaaucgcucggaugcugugcaaaagcaagggaucuagccucgugauuuccggccugcuuucuaugcugcuccugagcuucaucacgcccauugagggcacccugacaaacuauccuaaugagaagcaguacacccucgaagagaucgccgauguggucgaagggauuaugacagagcagcaccugaaagaauauguuguguucuacaccucccuuuuuggaggccugauccuccugcuuacgcugauucucagcaucacaaucaacaaggugaccgaccugcuggcgucuaccaaugucauuuauugugaggagugcuccauguaccauagcaaaaaggggaucaaauauaacggagauuucacaaauaaguguggcuuuugcaccuguucugaacaggaggacguggaagggguugugauucacaaggucucccgcaaaugcacauacaaguaccaacucaaaugggugagaguuaucaugauuauccuggcccuucugcucacgauccagaacaccgugcugauugucgcugccgagguggacugcuggacaaagaaaagcaucgaaauugauuguaucggaccgcugcuuaacauuggcuccugcaccgacaagucuggcaagacauaugagaccgaggucaauaaacucgugcggcagagcaagguuacgcaggcugaugccgaacaaaucuccgugcuggggaacacccuggacucugccaucaaagcuauucgcagccagaagacauacgagaccaugcauuuccucgaaacagucuuucugaugaaaaauugugauuauuacuccagcuucgagcacaacucuggauauucccagaccaaguggagacuuaucgcgaagacgagccauuuugacauuugcucucggcacuccgcccaccauuucugucgcugcgugaaugaaggcacaaaaugucaaaacggggauugggacuuugcuggagagaugaauaacaccuacaauagcaagaacgauuucuaucugcacgaccucgaucuguuuuacacacuguucgagaaugccuuucccggcaccaccgaaucucuuuucuaccagcuccugcagaaaaagaacacaacgggggccagcaaacugcucggcaagcugaucaccaaauauggaaauaacaauauguucguuggcauuuggaaguuugggcaguaccuucugaagcucccuuauaucaacgacacagagcuguccgcugacagaaaaagcaccaucaugaagucucaacaggugcugucccggagccagacaggaagacaggaaucccuuucuagcgccacccccggcacggcgacaaaagagugcuccaacgcuaaggauauuggguguaucucuccucgcuucggcauucccaucggaaaucucaccgccugcggggacagcccgaacuacaaaauuuauaagaccccugagaagaucuacaaauccaauaacaagggcgaagucugguguucugaugacgugcauugccuggccgauuuugagcccgcugaagaggaagugguuaaucggauuaaacaaaugacaugcuuccugaccgacgucacaacgaagaccgauguguuuagcaucgccguguccacauguaaaauggucgacaagggagugugcaccguuaacgaugcuaaguggaauauccucaaauguaacagcggccuguauuacuucacagaccacagagaugggcaggacaccggaaaugauuuuggcgaguacugcauuucucacuccuguaacacggagcgcuucccuaucaaucccgacgugcuuaaggacugcauuugggaauaucauagccggaaaucuaaguacaucuccaccauuagccuggagucucucgaugaauuuagacgcgccauguccgacaaacugagccacacacugaugaucuauaacuucaagcccaccgcgaaucuuccucauaucaagccggccuacaaauuuauuacagcuaacgggaucgaaaauuccgauggaauugacagcgccuauauccucucuagcauucccgcucugggcgggauguccgucggcuacaacgugcagaccaaggauaacuucccucugcucgacaucaucguuuuuauuaaaucugccaucauuaagacaaccuauaaucacaucuacgauacgggacccacaauuggcaucaacacccagcaugacgagcacuguaccgggccuugccccacacugauuccgcacaaagagaauuggcuuaccuucagccaagagcggacguccagauggggaugugaagaguucggcugccuggcgaucaacacaggguguguguuuggaucuugccaggauaucauucauccugaagccaaggucuaccgcaaagcuaucgaggaagaggugguucucaccgugugcauuacauuccccggcaauaccuauuguacagagaucaacgccauugaaccuaagaucaccgacgagaucgaacugcaguuuaagacggucgauaccaaaacacugcccaaucuucugauggugcacaaccauaagcucuacagcgggcagauuaaugaccugggcuccuucucucaaggaugcggcaacgugcagaaaaccaaucagagcgucaucggggcuggaacaguuaaguuugauuaugugugucacggcgccucccggaaagacgugauugucagacgcugcuacaacaauaacuaugagagcuguaagcuccugaaggaggaaaccucucuuaucuucgccgacaaucaugagacgcuggaaguggcuaacacaaaacaccucauuggggagcugcaauuuaagaucaugcugggagauauccgguacaaauccuucgcggaaagcccugagcuugagguugacgccaagugcgugggcugucccucuugcuuugaauccuauagcuguaacuuccagauugucaccaauaucgauacagugugcuccguuaacggcccguguacccuguuucacaauagacucauuaucucugcuaccaaacagagcuacgggcugaagauguccugcagccggaagccugagcccacagaagaguuccagauuugcaaccgcaaauacucuguccucuucacgaccaucgacaagaaugauaaaauugaaaucaacacaggagaccaaaccuccuauaucuacgagaaggauaauagauguaaaacauggcugugccgggugagagacgagggcauuagcgugaucuuugaaccccuuaaggccuucuuugggucuuauuucagcauuaucuuuuacguuauugugggaaucaucguccuguuccucauuguguauaucuuucugccuauguucuuuaagcugcgcgauauucuuaaacggaacgaguaccuguaucuccaggaacugaagcauaaauga

SEQ ID NO: 14213 - RNA, 4317 nt, Artificial Sequence
  derived and/or modified CDS sequence (opt5) from POTV(89-3380)__EU004189.1__GP
auggagcccccuaugaagcuguuccucauccuggccaccgcuguggccgcggucuacagccuuccggcuuccagaugcuuuucugacggcauuaucauuaaagaaaagcaggauagcaaagccguuuccgaguucugucugaaggacgaugugucuaugaucaaaagccacguggucuauuccaagaacgaaucugggauuuuugccaauagccaaauccuccggaaguggaucauuaaagacuggaagcugugcagcccccuuccuacagcuggaggccagaucaacgugauugagaucaaucaugaucugacgcucagcaccaaaacauacguuuguaccacagacugcaccauugggaucgauaaggaaaacgcccagauuacauuccagaccaauaaacugaacuauuuugaggugucuggaacgaccaucuccagcggcugguucaagucuaagacauccgucagccuggaccaaaccugugagcaccucaaagugucuugcgggaagaaauccaugcaguuucaugcuuguuucaagcagcacaugagcugcauccgcuaccugcauaaaacagcccuucccggauauauggcggccuccauuuguucuaauaucgaacugauuaucaugaccacgcucacacuggcuauuuuuauccuucugugcaucauuaccaagacauacaucuguuaucuccugaugccucuguucaugcccauugccuacaucuacggcuggcucuauaacaaaagcugcaagaagugcaauuguugcggccuguccuaccacccuuuuaccaacugugggagcuauugcguuuguggagcuaaauucgagaccucugauagaaugcggauucaccgcgaauccggccuuugccagggguacaagagccugagaguggcccggaaacucuguaagucuaaaggaagcucccuggucaucucugugacacuuagcguguuuaucuucuccuucauuacgccgaucggcggggucauuaucaaugacaagcugagcgaggagaaguauucuauuaaccaaaugauggaugcgaucguugaccucgaaaauuuuucccauaacgugagcggaacccaacaggugauuucugucaucuuccugcugaucuccugccucuuucugcuucugacauaccgccucaauaaaauuauccagcaccuggccagaagcggccuucuguucugugaggaaugcuccauguaucauucuaagaaagauauuaaguacaacggcgacuuuaccaacaaauguggguucugcacaugcggacaacccgaggacccugaaggccucaaucugcacauccugagccagaacuguaccuacaagcagcaauuuaagugggugaaaauuaucaucuccauucuccugucucuuaucauuaucgagagcuccaugauucuggcugccgcugagacggauugcuucagcgaaaagcagaucucugaguuuugucucgggccccugcuguccaucagcucuugcgaagacaaaaauucccggacauucaagggagaggcccagaaacuuguugcccucaagaagauuaccagcgaugaagcuaugcugaucgagucuaugggcgcgaaaguggaggacgcccugaagaugauucaggcucagaaaagcccugauuccauguauaccauggaauacgucuuucucaacacauauugugacuacuauagccuguucgagcacaauucuggguacucccagaucaaguggcgcuauauucuuaaaacccaucaguuugaugccugcgccagacacagcaacaaucauuucugucggugcauguccgacggaaugcacugucccucucuggauugggacaucgcugaugaacucaacaauacauacaucacgaagccgaacuucuuuaaacaugacuacaaucugcugcuugacgugauuaccgccgcguucccuggcacaggcgcuguuuuugugaucgaugccugcaagaaggccaacgcuaccgccauuaaaacauucagcaauaacaucauugcucgcuuucccuauaauaaccuccugaagggggucaugaaauuccugcaguacaucuccaagcacccuucuuuuaaaaaguaucaacccgacaccagacacuacgaucucauucccguggccccuacggcgcggggacgcagccugggcagauccaacucuuauagcgacgcccaggucgggccgcccaccaaggauugucagaaacuuaaggaggugggaugccuguccccuaaauucggccucccccuggaaagcaucaucucuugcggguccagcccuaauuacaagcuguauaaaaagccccagaaguacuacaaaucuaacaauaaggagaacacaugguguuccaaagacguucauugccuucacgauuuugagccgauuaccgaagacgugcucgagaaggucaaagugaugacauguugggaaaucgagccuggcaccauugaggauaucuucacgauugcuagcgaaacaugcaagaucaaugaccggggaguuugugaggugaacgccgcuaaguggaaaaucgucaagugcgaaaccggccuguauuacuauacagaucauagagagggggacgauaccggaucugaccugggccacuacugucucacccacaaaugcgccgggggacgcuaucccauuaauccugaaauccugcaaaacuguauuugggaguuucauucccagaagucccaguacaucaaucagguggaccuugagcaaauugaagaguauaaaaaggcgcugacagaaaaacucacgcacacccugaaccauuacaauuuccugcccacaaagaaccuuccucacaucucccccaauuacaaguaugugacccucaacggccaggagacaagcgaugggaucgaaaauucuuacauuguuagcgagaucccggccauugcuggcaccuccaucggacugaaaguccagacgaagaacaacggcaauauuuuugaccugaucauuuaugugaaacgggccgauaucaucgcuucuuacaaccauauuuaugacacagggccuaccaucggacacaauguggagcacgaagaacucugcaccggccaauguccccagcauauucccgccaaggccaacuggcugacauucagccaggaaagaaccucccgcugggggugcgaggaguucggaugccuugcuaucaauacaggcugugucuacgggucuugccaggauauuaucaaaccuguggcgaagguuuauagaaagagcacggaggagaaaguggaacuggagcucuguaucguccugccggaccggaacuuuugcaccacacugaaugcccuugaacccaagauuaccgaggagaucgaacugcaauucaaaacaauugaucaggugucccucccuaacaucguucugcuccgcgaccacaagcuguuuaaaggccagauuaaugaucuuggaaccuucggccagaacugugggaaugugcaaaagacgaaccagucuauccugggagcuggcaccguccgguuugacuaccucugccauagcgccuccagaaaggauaucauuauccgccgguguuacaauaacaauuaugacagcugcaaccaucugcagcuggccgagucucuuauuuuccuggauaaccacgaaacacucgaggugagaaaacccaaucacauccuggggacccucuccaugaagcugaugcuuggagacuuucaguacaaaacauucgcuaaggacauugaacuggauuuuaccggccgcuguguugggugcaucggcuguuucgagggauuugugugcgagaugcacauuacaaccacggucgaagccacaugcaaccucgaggcgagcugucaauucuuccauaaucagcugcacaucaaaccugacgugcugaaguauuacaccaagaugaccugccagacagaugaauauauccccucuaaaauuaagaucuguaacaaagaguacaagauuaccaucggcaaagugcggaagaaugacaagauugaaaucgauaacuccgaccaaacgagcuauaucaaagagaaggaugagagaugcaaaacauggcuuugucggguccgcgacgaagggauuuccguuaucuuugagccucugcucaauauuuucggaaacuacggcagaaucgcuguggccgugauuucugccauccuggcucucaucguccugguguacauucuuaugcccaucugcaugaagauucgggauauccugaaaaccaaugaaaaggaguuucugauugaaagcaaauauaaguga

SEQ ID NO: 14214 - RNA, 4311 nt, Artificial Sequence
  derived and/or modified CDS sequence (opt5) from TENV(TSV-FE3-66FB)__FJ943508.1__GP
auggagaucuucuuuauugcccugcucgcuaucgccaacagcgucaauuccacaccccuggcgaccagaugcuuccacggcgggcagcuuauugcugaaucuaagagcgccacgucccugucugaguuuugucucaaagacgaugugagcaugaucaaguccgaaauuuacuauguuaaaaacgagaccggaaucuucucucauaauaaggugcugcggagcuggacaaucaaagacuggaaguuuugcaacccugugccgaccgccggcggguccauuaaugucaucgaagugaacagcgauaugucucuugcuacaaagaccuacguuuguucccgcgacugcacaauuaccaucgauagagaggaggcccaaauuaucuuccagacggaaaaacugaaucacuuugaggugagcggaaccacacucucuuccggcugguucaagagcaaggcuucugucacccuggaccggacaugugaacaucugaaggugaccugcgggaaaaagucccuccaguuucacgccuguuucaagcaucacaugagcugcauucgcuuuuuccacaacacgaugcugcccggaagaaucguuaauuccaugugucagaacaucgagcuuauuaucauucugggccucacaaucgugauuuuuauccugauggucauccuuaccaaaacauauauuugcuacauccugaugccucucuucaugcccauugcguauaucuacggcugggccuauaauaagucuuguaaaaagugcaacugcugugggcuggcuuaccauccuuucaccaauugcggaagccacugugugugcggccugaaauuugaggccuccgaucggaugcgcauucauagagaaagcgggcucugucaaggauacaagucucugcggaucgcucgccuucugugcaaauccaagggcagcucucucgugaucagcauucugcuuuccaugcugcuccugucuuucgucacccccaucgagggggcccugacaaacuauccucagagcaagcucuacucccuggaagagauugcggacguuguggaaggacuuaucacggagcacaaugugaaagaguauauugucuuuuacaccagccuguucggcggccucauccugcuucuggccuuuauucucucuaucaugcugacaaaggugaccuccaugcuggcuagaacaaacguuaucuauugugaagagugcagcauguaccacucuaaaaccgggauuaaguauaacggagauuucacgaauaaauguggcuuuugcacaugugacgaacaggaggaugccgaagggaucauuauccauaagguguccaagaaaugcaccuacaaguaccagcucaaaugggcucggauuaucaugaucauucugaucguccuucugaccacacaaaacaccauucucaucguggccgccgagguugacugcugggagcgcgcuacacugagccaggaauguauuggaccgcugcagaagaucgaggauugccagaauaaagaagagaagacguauauguccgaagcgaacaaacuugugucucaaagcaaaaucacccaggccgacgcugaccaggucuccgugcucggcgauacaauugacucugccaucaaggccauuagaagccaaaagaccuaccagacaaugcaucugcuggagaccgucuuccucaugaagaauugugauuauuacuccacguuugagcacaacagcggguauucucaggcuaaauggcggcugauggccaagaccaaucacuucgacaucugcucccgccauagcaaccaccacuuuuguagaugcgugacagaaggaaccaagugucagaauggcgauugggacuucgcgggcgagaugaacucuacauacaauaccaaauccgauuuuuaucaacaugaccuuaaccuguucuucagccucuacgaaucugcuuuucccgggacggccgagagccuguucuaccagcugauuuccgagaagaauacaaccggagccagccagcuucucggccagaucaucaaaaaguuugcuaacaauaacaugcugauugggguuuggaaauucggacaauaucugcucacacugccuuacgugaacaccaccaaacuuucuaaaucccgggaagagacaauccugacgaaucaccagagacucguccgcagcuauaccggccggcagcaguccauggccaacgcugaagugggggagucuacaaagaauugccugaacgccaagaauguuggcuguauuagccccagauuuggagugccuaucggcaaccugaccgucugcggggaauccacaaauuacaaaguguauaagacccccgcgaaaauuuacaagucuaacaaucgcccgaaaacgugguguagcgaggaugugcauugccuuuccaacuucgagccugccucugcugaaguugucaauaagaucaagcggaugacaugcuuucucaccgacgugaccacaaacguggaugucuucagcauugccaucuccaccuguaaaauggcugacaagggagugugcacaguuaaugacgccagauggagcauccugaaaugugauucuggccugcucuauuuuacggaccaccgcgaggggcaagauaccggaaacgacuucggcgaauacugcauuucccacaauuguaacacagagcgguaccccaucaacccugauauuaucaaggacugcauuugggaauaucauagcagaaaaucuaaguacaucuccgcgaucaaucuggagagccuugaggaauuucgccgggccaugucugagaagcugucccacacccucgugauuuauaacuucaaacccacagcuaaucugccccauaucaagccuagcuacaaauccauuaccgucaacgggaucgaaaauagcgauggcauugagucugccuauauccugagcaacaucccggcuauuggaggcauguccgugggguacaauguucuuacgaaggacggauuuccccuccuggauaucauuaucuucauuaaaucugccgugaucaagaccacauauaaccacauuuacgacaccggcccuacaaucgggaucaauacccugcaugaugaaaaguguacaggacccugcccuagcauuaucccccacaaagagaacuggcucaccuucucccaggagagaacgucucgcuggggcugugaagaguuugggugccuggccauuaauacaggcugugucuucggaagcugccaggacaucauucggccggaaaccaagaucuacagaaaagcuguggaggaggaaguuauccuuaacgcgugcauuaauuuuccuggcaacaccuauuguacagagaucaaugccauugaacccaagaucaccgaugagauugaacugcaguucaaaacgguggacacaaagacccucccuaaccugcuggcuguccaaaaccacaaacuuuacuccgggcagaucaaugacaucggaacauuuucucagggcugcgggaacgugcaaaagaccaaucagacaaugcugggaaccggcacggugcgguucgauuaugucugucauggggccagccgcaaggacauuaucguuagacggugcuacaacaauaacuaugaguccuguaaacuccugaaggaggagaaaagccucauuuuugccgauaaucacgaaacccuggaaguggcuaacacaagacaucuucugggcgagcuccaguucaagaucaugcugggagacauucgcuacaaagccuuugcggaaaagcccgagcuggagaucgaugcuaagugcgugggcuguccuucuugcuucgaauccuauagcuguaauuuucagauugucucuaacguggacaccguuugcuacaucgaggggcccuguacacuuuuccacaaucggaucauuaucaaaaccaugaagcaagccuacggaauuaaaauguccugcaagacgaaaccggccccuagcgaagaguucaagaucugcggcagaacauauaacguggcuuuuaauaccgucgaaaagaacgauaaaauugagaucaauacaggggaccagaccuccuacaucucugagaaggaugaccgcuguaaaaccuggcugugcagagugcgggaugaaggaauuagcguuaucuucgagccccucaagaaccuguuuggcaauuauuucaacauugccuuuuacaucauuaucggccucaucgcgcuguuccuuacaauuuauaucuuucugcccauguucuuuaaacuccgcgacgugcugaagagaaacgaauaccuguaucuucaggagcugaagcauaaauga

SEQ ID NO: 14215 - RNA, 4311 nt, Artificial Sequence
  derived and/or modified CDS sequence (opt5) from TENV(TSV-FL06)__FJ943506.1__GP
auggagaucuucuuuauugcccugcucgcuaucgccagcuccgugaacucuacaccccuggcgaccagaugcuuccacggcgggcagcuuauugcugaaagcaaguccgccacgucucugagcgaguuuugucucaaagacgaugucuccaugaucaagucugaaauuuacuauguuaaaaaugagaccggaaucuucagcuacaacaaggugcugcgguccuggacaaucaaagacuggaaguuuugcaauccugugccgaccgccggcgggagcauuaacgucaucgaaguuaauucugauaugucccuugcuacaaagaccuauguguguagccgcgacugcacaauuaccaucgauagagaggaggcccaaauuaucuuccagacggaaaaacugaaccauuuugaggugucuggaaccacacucuccagcggcugguucaagucuaaggcuuccgucacccuggaccggacaugugaacaccugaaggugaccugcgggaaaaagagccuccaguuucaugccuguuucaagcaccauauguccugcauucgcuuuuuccacaauacgaugcugcccggaagaaucguuaacucuaugugucagaauaucgagcuuauuaucauucugggccucacaaucgugauuuuuauccugauggucauccuuaccaaaacauacauuugcuauauccugaugccucucuucaugcccguggcguacauuuauggcugggccuacaacaagagcuguaaaaagugcaauugcugugggcuggcuuaccacccuuucaccaacugcggaucccauugugugugcggccugaaauuugaggccagcgaucggaugcgcauccacagagaaucugggcucugucaaggauauaagucccugcggauugcucgccuucugugcaaaagcaagggcucuagccucgucaucuccauccugcuuucuaugcugcuccugagcuucguuacccccauugagggggcccugacaaauuacccucaguccaagcucuauagccuggaagagaucgcggacgugguggaaggacuuauuacggagcauaacgucaaagaguacaucguguuuuauaccucucuguucggcggccucauucugcuucuggccuuuauccucuccauuaugcugacaaagguuaccagcaugcuggcuagaacaaaugugaucuacugugaagagugcucuauguaucacuccaaaaccgggaucaaguacaacggagauuucacgaacaaauguggcuuuugcacaugugacgaacaggaggaugccgaagggauuaucauucacaaggucagcaagaaaugcaccuacaaguaucagcucaaaugggcucggaucauuaugaucauccugauugugcuucugaccacacaaaauaccauccucauuguugccgccgagguggacugcugggagcgcgcuacacugucccaugaauguaucggaccgcugcagaagauugaggauugccagaacaaagaagagaagacguacaugucugaagcgaauaagcuggucagccaguccaaaaucacccaagccgacgcugaccaggugucuguccucggcgauacaaucgacagcgccauuaaggccaucagaucccagaaaaccuaucaaacaaugcaccuucuggagaccguguuccucaugaagaacugugauuacuauagcacguuugagcauaauucuggguacucccaggcuaaauggcggcugauggccaagaccaaccacuucgacauuugcagccgccauucuaaucaccacuuuuguagaugcguuacagaaggaaccaagugucagaacggcgauugggacuucgcgggcgagaugaacuccacauauaauaccaaaagcgauuuuuaccagcaugaccuuaaucuguucuucucucucuacgaaagcgcuuuucccgggacggccgagucccuguucuaucaacugaucagcgagaagaacacaaccggagccucucagcuucucggccagauuaucaaaaaguuugcuaauaacaauaugcugaucgggguguggaaauucggacaguaccugcucacacugccuuaugucaacaccaccaaacuuuccaaaagccgggaagagacaacgcugaccaaccaccaaagacucgugcgcuccuacacaggccggcagcagucuauggccaaugcugaaguuggggagagcaccaagaacugccugaaugccaagaacgugggcuguauuucccccagauuuggagucccuaucggcaaucugacagugugcggggaaucuaccaacuauaaaguguacaagacgcccgcgaaaauuuauaagagcaauaaccgcccgaaaacaugguguuccgaggauguucauugccuuucuaauuucgagccugccagcgcugaagucgugaacaagaucaagcggaugaccugcuuucucaccgacgugacaaccaaugucgauguguucuccauugccaucagcacauguaaaauggcugacaagggaguuugcacggugaacgacgccagauggucuauucugaaaugugauuccggccugcucuacuuuaccgaccaccgcgaggggcaggauacaggaaaugacuucggcgaauacugcaucagccacaacuguaauaccgagcgguaucccaucaacccugauauuaucaaggacugcauuugggaauacuauucuagaaaauccaaguacaucagcgcgauuaaccuggagucucuugaggaauuucgccgggccauguccgagaagcugagccauacacucgucaucuauaauuucaaacccaccgcuaaccugccccacaucaagccuuccuacaaaagcauuacggugaaugggaucgaaaacucugauggcauugagagcgccuauauccuguccaauauuccggcuaucggaggcaugucuguuggguacaacgugcuuaccaaggacggauuuccccuccuggauaucauuaucuucauuaaaagcgccgucaucaagacaaccuacaaucauauuuaugacacaggcccuaccaucgggauuaacacacugcacgaugaaaaguguaccggacccugcccuuccaucaucccccauaaagagaauuggcucacguucucucaagagagaacaagccgcuggggcugugaagaguuugggugccuggccauuaacaccggcuguguguucggauccugccaggacaucauucggccggaaaccaagaucuacagaaaagcuguugaggaggaagugauucuuaaugcgugcaucaacuuuccuggcaauacauauuguaccgagaucaacgccuucgaacccaagauuacggaugagaucgaacugcaguuuaaaacagucgacaccaagacacucccuaaucugcuggcugugcagaaccacaaacuuuacucugggcaaauuaacgacaucggaaccuucagccagggcugcgggaaugugcagaagacaaaccaaaccaugcugggaacgggcaccguccgguuugauuauguuugucacggggccucccgcaaggacauuaucgugagacggugcuacaauaacaauuaugagagcuguaaacuccugaaggaggaaaaaucucucaucuucgccgauaaccaugagacacuggaaguggcuaauaccagacaccuucugggcgagcuccaguuucgcauuaugcugggagacauccgguacaaggccuucgcggaaaaacccgagcuggagauugaugcuaagugcgucggcuguccuuccugcuuugaaagcuacucuuguaacuuccagaucguguccaauguugacacagugugcuauauugaggggcccuguacccuuuuccauaacagagucaucauuaagacgaugaaacaggccuacggaaucaagaugagcugcaaaacaaagccggccccuuccgaagaguuuaaaaucugcggccgcaccuauaauguggcuuucaacacaguugaaaagaaugauaagauugagaucaacaccggggaccaaaccucuuacauuagcgagaaagaugacagauguaagacauggcugugccgggugcgcgaugaaggaaucuccgucauuuuugagccccucaaaaaucuguucggcaacuauuuuaauaucgccuucuacaucauuaucggccucauugcgcuguuucuuacgaucuauauuuuccugcccauguuuuucaagcucagagacgugcugaaacggaacgaauaccuguaccuucaggagcugaagcacaaguga

SEQ ID NO: 14216 - RNA, 4305 nt, Artificial Sequence
  derived and/or modified CDS sequence (opt5) from TLAV(61D240)__KX100119.1__GP
augcuguuccuccugauccuugccuuucugggcuucagcaccuccaaccccauugcuacaagaugcuuucacgggggacagcucaucgccgagucuaagagcgcgacguccauuucugaguucugucugaaagacgaugugagcaugcuuaaguccgaagucguuuacaccaaaaaugacacaggccuguuugggcauaacaagguguuccggucuuggaccaucaaagauuggaagcucugcaauccuauuccgacagcuggaggcaccaucaacgugaucgaagucaauaaggaccugagccugaugacaaaaaccuauauuuguucccgcgauugcacgaucaccauugacaaggaggaagcccaaaucauuuuucagacagauaaacucaaccacuucgaggugagcgggaccacacuuaauucuggaugguuuaaguccaaagccagcguuacccuugacagaacgugugagcaugugaaggucacaugcggcaagaaaucucugcaguuccacgcuuguuuuaagcaucacauguccugcgugcgguucuuucacaacaccauccuccccggcaauaugauuacaagcaugugucagaacaucgaacugaucauuauccuugggcugacccucgccauuuucauccugaugguuaugcugaccaaaacauacauuugcuaucuccugaugccuaucuucaugcccaucgcuuaccuuuauggaugggccuacaauaagucuuguaaaaagugcaacugcuguggccuggcguaucauccuuuuacgaauugcgggucccacugugugugcggacucaaauucgaggccagcgaucgcaugcggauucauagagaauccggccugugucaaggguacaagucucuucgcaucgcuagacugcucugcaagagcaaaggauccagccuggucauuucuggccugcucuccaugcugauccuuagcuuugugacccccauugagggcacaaucaccucuuacccugagagccggaaguauacacuggaagagaucaccgacguggucgaagggcucguuuccgagcagaacauuaaagaauacaucguguucuauacgucucuguuuggaagccuuauucugcuccuggccuucaucauguccauuacacugagcaagaucaccucuauucucgcucgcagaaaugugaucuacugugaggagugcuccauguaucacagcaaacggggcaucaaguacaacggggauuuuaccaacaaguguggauucugcacauguaaugaacaggaggacgccgaaggccuggucauucacaaagugucuaagcgcugcaccuauaaauaccagcuuaagugggcgaaaguucugauggugacacucguccugcugcuuaucgcccaaaacacgauucucaucguggcugccgggaccgauugcuggacaaagaagucccuggacauugacuguaucggaccgaugcuggauaucggcagcugcaccaauaaaaacacaagaaauuacgacaccgaggcucagaagcucguuucccagucuaaagugagccagcuggaugccgaccaagccucccuucugggcaacucuauugauagcgcuaucaaggcgauucgggcccagaaaacguaucccaccaugcaucuccuggaaacaaucuuucugaugaagaauugugacuacuauaccuccuucaaccacaauagcggguacucucaggcuaaguggcgccuuauugccaaaacaggacauuuugauaucugcuccagacacagcacccaucacuucugucggugcaucaacgacggcacgaagugucaaaauggggauugggacuuugccggagagaugaacgagacauauaauucuaaaaacgauuucuacucccacgaccucaaucuguucuauaccauuuuugaaaacgcuuucccuggcacaaccgagagccuguuuuaccagcucauccagaagaaaaacaccacaggggccucuaagauucugggcaaacuuaucacgaaguacggaaauaagaacauguucgucggcguguggaaauuugggcaguaucugcucacccugcccuacauuaauaacacagaacugagccaaaauagacgccagaccauccuugcgacacaggagucccucagccggucucauuccggaagacaggaaagcauguccucugcuauccaaggcagcgucaccaaggagugccacaacgccaaagacgugggguguauuuccccucgcuucggaauccccauuggcaaucugacggccugcggggauucuccgaacuauaagaucuacaaaacaccugagaagcuguauaagagcaauaacaaaggcgaaguuugguguuccaaugacgugcauugccucaacgauuuugagcccgcugacgaagaggucgugaauaagguuaaaaagcugaccugcuuccuuaccgaugugucugucaaaacagacauuuuuagcguggccgcuuccaccuguaagauggccgauaagggagugugcacaguuaacgacgcgaaauggaauaucauuaagugugauagcggccuguacuauuucacggaccaccgggaggggcaggauaccggaaacgacuuuggcgaauacugcaucucucacuccuguaacacagagagauucccuaucaaucccgauauucucaaagacugcaccugggaauuucauagccgcaagucuaaauacaucuccacaauuagccuggagucucuggaagaguuccggagagccaugaccgagaagcugucccacacgcucaccaucuauaacuucaagcccacagcuaaucugccucauauucgcccgaccuacaaauuuaucacagccaacggggucgaaaauagcgacggaaucgaguccgcuuauauucugagcucuauccccgcccucggcgggauuagcgugggcuacaacgugcagaccaaggauaauuucccucugcuugacaucauugucuuuaucaaauccgcggugauccggacaaccuauaaccacauuuacgauacgggacccacaaucggcauuaauacccagcaugacgaacacuguaccgggccuugccccgccguugugccgcacaaggagaacuggaucacauucucucaagaaagaaccagccgcuggggaugugaggaguuuggcugccuggcuauuaauacggggugugucuucggauccugccaggauaucauucauccugaaacaaaaguguaucggaaggccguugaggaagaggugauccucaccgucugcaucaacuuucccggcaauaacuacuguacagaaauuaaugcuaucgagccuaaaauuaccgacgagaucgaacugcaguucaagacaguggauaccaagacgcugcccaaccuucuggccguucagaaccacaaacucuacucugggcaaauuaaugaccugggcagcuuuucccagggaugcggcaacgugcagaagaccaaucauucuauccucgggaugggaacagccaaauucgauuaugucugucacggcgcuagcagaaaggacgugaucgugcggcgcugcuacaacaauaacuuugauuccuguaaacugcuuaaggaggaaaccagccugauuuucgcggacaaucaugagacacucgaggucgcccacaccaagcaccugaucggggaacugcaauucaaaauuaugcuuggagauaucagauauaagucuuuugcugaguccccugaacuggagauugacgccaaaugcguuggcugucccagcugcuucgaaucuuacuccuguaacuuucagaucgugacgaauaucgacacagugugcagcgucgagggcccguguacccucuuccauaaccggauuaucauuuccgccaauaagcagucuuaugggcugaaaaugagcugccagacaaagccuaaccaaaaugaggaauuuaucauuugcaacagaaaguacuccguucucuucaccaccaucgauaaaaaugacaagauugaggugaacacaggagaucagacgagcuauaucuacgaaaaagacucucgcuguaagaccuggcugugccgggugagagaugagggcaucuccguccuuuuugaaccccugaaggcuuucuuugggagcuacuucucuauuaucuuuuaugugguugugggaauuaucguccucuuccugauuaucuacaucuuucugcccauguucuucaaacuuaaggacgugcugaaacgcaaugaguaucucuaccugcaggagcucaagcacaaauga

SEQ ID NO: 14217 - RNA, 4305 nt, Artificial Sequence
  derived and/or modified CDS sequence (opt5) from NRIV(9800535)__AY593725.1__GP
augcugcuccugcuugugcugcucauccccugcuacgucagcgccuccccuguugugaccagauguuuccacggcgggcagcugauugcugagaagaaaucucaaacagccgugagcgaauuuugccuuaaggacgaugucuccacgaucaaaucugagauuaccuaugaaaagaacaauacaggacuguucgcgcauagcaaagugcuccggaacuggaucauuaaggacuggaagaauuguaacccgguucccaccgcuggcggguccaucaaugugaucgaggucaacacagaucugucucugaccacaaaaaccuacgugugcagccgcgacuguacgauuaccguugauaaggaagacgcccagaucauuuuucagacagagaaacucaaucacuucgagguguccggaaccacacugagcucuggcugguuuaagaccaaagccuccgucacgcuugauagaacaugcgaacauaucaaggugaccugugggaagaaaacacugcaguuccacgcuugcuuuaagcaucacaugagcuguauucgguucuuucacggaaccauccucccuggcaccauggccacaucuauuugccaaaacaucgagcugaucauuaucauuucccuuacgcugaucauuuucauccucaugaucauucugaccaaaacauauaucuguuaccugcucaugccccuguuuaugccuauugcuuauuucuacggcuggagcuauaauaagucuugcaaaaagugcuccuguugcgggcuugccuaccaucccuuuaccaacuguggaagccacugcguguguggccugaaauucgaagcguccgaccgcaugagaauccaucgggagucugggcucugccagggauacaagagccugcgcgucgccagacuucuguguaaguccaaaggcagcucucucguuauuuccauccugcugagcaugcucauccugucuuucgugacaccuauugaggggacccuuacgaauuauccggaaagccggaaguacgaucuggaggaaaucgcugacgugcucgagggauuuauugucgaaaaaggcaucaaggaguaugugguuuucuacacauccauuuuuggcgcccugcuucugcucaucgcucuggugauuaccaucacccugaacaaagucacagaguaucucaccaauaucaacgugcuguacugcuaugaauguucuauguaccacagcaagaagaauauuaaauacaucggggauuucacaaacaagugcggauuuuguacgugcggcgagcuugaagaccaggaggggcugaaaauucacaagguuucccgcaaaugcaucuauaaguaccagcucaccuggagcaagauuaucaugacaauccuggugugucugcuuauugcccaaaacaccauccucauugucgcggccucugaugacugcuggaccaaaaagucccuggaaauggaguguaucggaccccugcaacagguggacacaugcgaugacaaagcuagcagaucuuauuccggcgaggcccggaagcucguccgcgcuagcaaaauuuccgaucuggacgccgcccagguggggcuucugggaucuacgaucgaaagcgcuaucgcguccauuagaaagcagcggaccuacccuacaaugcaucuccuggagucuguuuuccugggcaagcacugugauuauuacaaaaccuuugaacauaauagcggcuauucccaggccaaguggcgccuuacagcuaaaacccaccauuucgacaucugcagcagacacucuacgcaccauuuuugucggugcauuuccgaugggacaaagugucagaacggagaccucgauuucgccggcgagaugaauagcaccuaccaaucuaaaaaggacuuuuucgaacacgauuuuaaacuguucugcacacugguggagaacgccuuccccgggaccaccgagucccucuuuuacgaaaugcugagcaagaagaauacaacgggaaucaaacagcuucuggacaagcucaccagaaaauucggcaacaauaacauguuugucgggauuuggaaguucggccaguaucugaugucucugccuuacaucaaugagacaagccuuacccccgcucagaucuccaaaauucucgaagugacagaccaacaucaccgcagcaucucuggacggcaggagucccuggccagcgcgaccccgggcuccaagucuaaggagugugggcacgcuaaaaagguuagcugcauuuccccuagauuuucugugcccauggaaggacugauggccugcggcgauagcccuaacuauaaaaucuacaagacgcccacaaaacucuauaaguccaauaacaagggggaggucugguguucuggagacgugcauugcagccaggaacugucccccgccagccaggagucuguggaucgcauuaaacaaaucaccuguuuccuuaccgaaccugagguuuccgacgaugucuuuagcauugcuaucucuacaugcaaggugcaggacaaaggcguguguaccgucaaugaggaucgguggaacgugaucaagugcgacuccgggcugauuuacuauacagaucagagagacggccaggauacgggaaaugacuucggcgaauacugucucagccacucuugccgcaucgagcgguuuccgauuaaccccgccaucauuagagauugucugugggaauaccauucccgcaaaagcaaguauaucaccucccuggaccuugagaaccucgaagaguucaagcgggcuaucagcgagaaacugucucacacacugauuguuuacaauuuuaagccuaccgccaaccucccccauaucaaaccuguguauaaguacauuacaguccaagggguggaaaauagcgacggaguugauuccgcguauaucgccgcuucuaugcccgcccugagcggcaccuccauuggguacaacaucaugucuagagacaauuucccgcuuuuugauaucauuaucuucauuaaaagcgcuaucauuaaggccacguauaaccacaucuacgacaccggaccuacaauuggcaucaaugugaugcacgaugagcauugcaccgggcagugucccacagacaucccucacaaagaaaacuggauuaccuucgcgcaggagcgcacaucccgguggggcugcgaagaguuuggaugccuggccgucaauaccggcuguguguucgggucuugccaggauaucauuagacccgagacgaagguuuaccggaaggcuguggaagagagcguccuccugacaguguguaucaccuauccuggaaaaaccuuuugcacagaaauuaacgccaucgagcccaagaucaccgacgagcuggaacuucaauucaaaacgguggauacaaagacccugccgaauauucucgcuguccagaaccauaaacuguacuccggccagaucaaugaccucgggagcuuuucucaaggauguggcaacauucagcgcacaaauuccagcaucauugggaccggcacagccaaguucgauuauguuugccacggagccucuagaaaggacaucaucgugcggagauguuacaacaacaauuaugaguccugcaaacugcuuaaggaagaacagagccugauguuugcugauaaccaugaaaccauugacguggcgaauguccgccaccuccugggcgaccugcaguucaaacuuaugcugggggaucuccgguacaaguccuuugccgagaacccugaccuggagaucgaagcuaaaugugugggaugccccucuuguuucacgagcuauuccugcagcuuuaagauugccucuaauaucgauaccguuugcuccauugagggccccuguacaaccuuccacaacagacucaugaucacaagcaccaagcaagacuacgggauuaaaaugucuugcaagacgaaaccuaaggaaacagaggaguuccagaucuguaaaaagaccuacacagugcuguuuaccaccgucgagaagaaugauaaaaucgagauuagcacaggagaccagacguccuucauccaggaacgcgaugacagaugcaagaccuggcuuugucgggugcgcgaugagggcauuucuguuaucuuugaaccgauuagagccuucuuuggcagcuauuucuccaucgcuuuuuacguggucaucucuauuaucgugcuguuccucgccauuuauaucuuucugcccaugguuuucaaacugcgggacgugcuuaagcgcaacgaguaccuguaucuccaagaaauuaaacauaaguga

SEQ ID NO: 14218 - RNA, 4305 nt, Artificial Sequence
  derived and/or modified CDS sequence (opt5) from NRIV(GSA/TS7/5170/WT)__KM514677.1__GP
augcugcuccugcuugugcugcucauccccugcuacgucagcgccuccccuguugugaccagauguuuccacggcgggcagcugauugcugagaagaaaucucaaacagccgugagcgaauuuugccuuaaggacgaugucuccacgaucaaaucugagauuaccuaugaacggaacaauacaggacuguucgcgcauagcaaggugcuccgcaacuggaucauuaaagacuggaagaauuguaacccgguucccaccgcuggcggguccaucaaugugaucgaggucaacacagaucugucucugaccacaaagaccuacgugugcagcagagacuguacgauuaccguugauaaagaagacgcccagaucauuuuucagacagagaagcucaaucacuucgagguguccggaaccacacugagcucuggcugguuuaaaaccaaggccuccgucacgcuugaucggacaugcgaacauaucaaagugaccugugggaagaagacacugcaguuccacgcuugcuuuaaacaucacaugagcuguauucgcuucuuucacggaaccauccucccuggcaccauggccacaucuauuugccaaaacaucgagcugaucauuaucauuucccuuacgcugaucauuuucauccucauggugauccugaccaagacauauauuuguuaccugcucaugccccuguuuaugccuaucgcuuauuucuacggcuggagcuauaauaaaucuugcaagaaaugcuccuguugcgggcuugccuaccaucccuuuaccaacuguggaagccacugcgucuguggccugaaguucgaagcguccgacagaaugcggauucaucgcgagucugggcucugccagggauacaaaagccugagaguugcccggcuucuguguaaguccaagggcagcucucucgugaucuccauucugcugagcaugcucauccugucuuucgugacaccuaucgaggggacccuuacgaauuauccggaaagccgcaaauacgaucuggaggaaauugcugacguccucgagggauuuaucguggaaaagggcauuaaagaguauguuguguucuacacauccaucuuuggcgcccugcuucugcucauggcucuggucauuaccaucacccugaacaaggugacagaguaucucaccaauauuaacguucuguacugccacgaauguucuauguaucacagcaaaaagaauaucaaguacaucggggauuucacaaacaaaugcggauuuuguacgugcggcgagcuugaagaccaggaggggcugaagauucauaaaguguccagaaagugcaucuaccgguaucagcucaccuggagcaaaauuaucaugacaauucuggucugucugcuuaucgcccaaaacaccauccucauuguggcggccucugaugacugcuggacaaagaagucccuggaaauggaguguaucggaccccugcagcaggucgauaccugcgacgacaaagcuagccgcucuuacuccggcgaggccaagaaacucgugagagcuagcaagauuuccgaucuggacgccgcccagguugggcuucugggaucuacgaucgaaagcgcuauugcguccauccggaaacaacgcaccuauccuacaaugcaccuccuggagucuguguuccugggcaagcauugugauuacuauaagaccuuugaacacaauagcggcuacucccaggccaaauggagacuuacagcuaagacccaucacuucgacaucugcagccggcacucuacgcaucacuuuuguagaugcauuuccgaugggacaaaaugucagaacggagacugggauuucgccagcgagaugaauagcaccuaucaauccaagaaagacuuuuucgaacaugauuuuaaacucuucugcacacuggucgagaacgccuuccccggcaccaccgagagccuguuuuacgaaaugcucucuaaaaagaauacaacggggaucaagaaccugcuugacaaacugacccgcaaguucggaaauaacaauauguuugugggcauuuggaaauucgggcaguaccucaucagccugccuuauguuaacgagacaucccugacccccgcucaggugagcaagauucuugaagucacagaccagcaccaccggucuaucuccggcagacaagagagccucgccuccgcgaccucuggaagcaaauccaaggaguguggccaugcuaagaaagugucuugcaucagcccgcgcuuuuccgugccuauggaagggcugauggccugcggagauucucccaauuacaagauuuauaaaacgccugccaagcuguacaaaagcaacaauaagggcgagguuugguguuccggggacguccacugcagccaggaacucucucccgcuucccaggagagcguggaucggaucaagcagauuacauguuuccugaccgaacccgaggugucugacgaugucuuuuccaucgccauuucuaccugcaaagugcaagacaagggaguuuguacagugaacgaggauagauggaaugucaucaaaugcgacucuggccuuauuuauuacaccgaucagcgcgacgggcaggauacaggcaacgacuucggagaauauugucugucccauagcugccggaucgagagauuuccuaucaacccgacgauuaucuccgauugucucugggaauaccacagccgcaagucuaaauacauuaccagccuggaccuggagaaucuugaagaguucaagcgggcuaucuccgagaagcucucucauacacugauuguguauaacuuuaaacccaccgccaaucugccucacaucaagcccguuuacaaauauaucacagugcagggcgucgaaaacagcgacgggguggauuccgcguacauuucugccagcaugccugcucucuccggaaccucuaucggcuauaauauuaugagcagagacaacuucccccuguuugauaucauuaucuucaucaaguccgccauuaucaaagcuacguacaaucacauuuaugacaccgggccgacaaucggaauuaacguuaugcaugaugagcacugcaccggccaauguccuacagacaucccccauaaggaaaauuggauuaccuucgcccaggagcgcacaagccggugggggugcgaagaguuuggcugccuugcggugaacaccggaugugucuucggcucuugccaggauaucaucagaccugagacgaaaguguaccggaaggccguggaagaguccguccugcucacaguuuguauuaccuaccccgggaagaccuuuugcacagaaaucaaugcuauugagccuaaaaucaccgacgagcuggaacugcaguucaagacgguggauacaaaaacccuucccaacauucuggccgugcaaaaucacaagcucuauagcggacagaucaacgaccugggcucuuuuucccagggguguggaaauauccaaaagacaaacagcuccauuaucggcaccgggacagcuaaguucgauuacgucugccauggcgccucucgcaaggacauuaucgugagacgguguuauaacaauaacuacgagagcugcaaacuccugaaggaagaacagucccuuauguuugccgauaaucacgaaaccauugacguugcuaacgugagacaucugcucggagaccugcaguucaaacugaugcuuggcgaucugcgcuauaagagcuuugcggagaauccggaccucgagaucgaagccaaaugugucgggugcccuucuuguuucacguccuacagcugcucuuuuaagaucgcuagcaacauugauaccgugugcuccaucgagggacccuguacaaccuuccacaaucggcugaugauuacaucuaccaagcaggacuauggcaucaaaaugagcugcaagacgaaacccaaggaaacagaggaguuccaaauuuguaaaaagaccuacacaguucucuuuaccaccguggagaagaacgauaaaaucgagauuuccacaggggaccagacgucuuucauccaggaaagagaugaccgcugcaagaccuggcuguguagaguccgggaugagggaaucagcgugauuuuugaaccuauccgcgccuucuuuggcuccuacuucagcauugccuuuuauguuguggucaucauuaucgugcuuuuccuggcuaucuacauuuuucucccgaugguguucaaacugagagacguccugaagcggaaugaguaucuuuaccugcaggaaaucaaacacaaguga

SEQ ID NO: 14219 - RNA, 4305 nt, Artificial Sequence
  derived and/or modified CDS sequence (opt5) from NRIV(TND/S1/19801/WT)__KM514679.1__GP
augcugcuccugcuugugcugcucauccccugcuacgucagcgccuccccuguugugaccagauguuuccacggcgggcagcugauugcugagaagaaaucucaaacagccgugagcgaauuuugccuuaaggacgaugucuccacgaucaaaucugagauuaccuaugaacggaacaauacaggacuguucgcgcauagcaaggugcuccgcaacuggaucauuaaagacuggaagaauuguaacccgguucccaccgcuggcggguccaucaaugugaucgaggucaacacagaucugucucugaccacaaagaccuacgugugcagcagagacuguacgauuaccguugauaaagaagacgcccagaucauuuuucagacagagaagcucaaucacuucgagguguccggaaccacacugagcucuggcugguuuaaaaccaaggccuccgucacgcuugaucggacaugcgaacauaucaaagugaccugugggaagaagacacugcaguuccacgcuugcuuuaaacaucacaugagcuguauucgcuucuuucacggaaccauccucccuggcaccauggccacaucuauuugccaaaacaucgagcugaucauuaucauuucccuuacgcugaucauuuucauccucauggugauccugaccaagacauauauuuguuaccugcucaugccccuguuuaugccuaucgcuuauuucuacggcuggagcuauaauaaaucuugcaagaaaugcuccuguugcgggcuugccuaccaucccuuuaccaacuguggaagccacugcgucuguggccugaaguucgaagcguccgacagaaugcggauucaucgcgagucugggcucugccagggauacaaaagccugagaguugcccggcuucuguguaaguccaagggcagcucucucgugaucuccauucugcugagcaugcucauccugucuuucgugacaccuaucgaggggacccuuacgaauuauccggaaagccgcaaauacgaucuggaggaaauugcugacguccucgagggauuuaucguggaaaagggcauuaaagaguauguuguguucuacacauccaucuuuggcgcccugcuucugcucauggcucuggucauuaccaucacccugaacaaggugacagaguaucucaccaauauuaacguucuguacugccacgaauguucuauguaucacagcaaaaagaauaucaaguacaucggggauuucacaaacaaaugcggauuuuguacgugcggcgagcuugaagaccaggaggggcugaagauucauaaaguguccagaaagugcaucuaccgguaucagcucaccuggagcaaaauuaucaugacaauucuggucugucugcuuaucgcccaaaacaccauccucauuguggcggccucugaugacugcuggacaaagaagucccuggaaauggaguguaucggaccccugcagcaggucgauaccugcgacgacaaagcuagccgcucuuacuccggcgaggccaagaaacucgugagagcuagcaagauuuccgaucuggacgccgcccagguugggcuucugggaucuacgaucgaaagcgcuauugcguccauccggaaacaacgcaccuauccuacaaugcaccuccuggagucuguguuccugggcaagcauugugauuacuauaagaccuuugaacacaauagcggcuacucccaggccaaauggagacuuacagcuaagacccaucacuucgacaucugcagccggcacucuacgcaucacuuuuguagaugcauuuccgaugggacaaaaugucagaacggagacugggauuucgccagcgagaugaauagcaccuaucaauccaagaaagacuuuuucgaacaugauuuuaaacucuucugcacacuggucgagaacgccuuccccggcaccaccgagagccuguuuuacgaaaugcucucuaaaaagaauacaacggggaucaagaaccugcuugacaaacugacccgcaaguucggaaauaacaauauguuugugggcauuuggaaauucgggcaguaccucaucagccugccuuauguuaacgagacaucccugacccccgcucaggugagcaagauucuugaagucacagaccagcaccaccggucuaucuccggcagacaagagagccucgccuccgcgaccucuggaagcaaauccaaggaguguggccaugcuaagaaagugucuugcaucagcccgcgcuuuuccgugccuauggaagggcugauggccugcggagauucucccaauuacaagauuuauaaaacgccugccaagcuguacaaaagcaacaauaagggcgagguuugguguuccggggacguccacugcagccaggaacucucucccgcuucccaggagagcguggaucggaucaagcagauuacauguuuccugaccgaacccgaggugucugacgaugucuuuuccaucgccauuucuaccugcaaagugcaagacaagggaguuuguacagugaacgaggauagauggaaugucaucaaaugcgacucuggccuuauuuauuacaccgaucagcgcgacgggcaggauacagcuaacgacuucggcgaauauugucugucccauagcugccggaucgagagauuuccuaucaacccgacgauuaucuccgauugucucugggaauaccacagccgcaagucuaaauacauuaccagccuggaccuggagaaucuugaagaguucaagcgggccaucuccgagaagcucucucauacacugauuguguauaacuuuaaacccaccgcgaaucugccucacaucaagcccguuuacaaauauaucacagugcagggagucgaaaacagcgacggcguggauuccgccuacauuucugcuagcaugccugcccucuccgggaccucuaucggauauaauauuaugagcagagacaacuucccccuguuugauaucauuaucuucaucaaguccgcuauuaucaaagccacguacaaucacauuuaugacaccggcccgacaaucgggauuaacguuaugcaugaugagcacugcaccggacaauguccuacagacaucccccauaaggaaaauuggauuaccuucgcgcaggagcgcacaagccgguggggcugcgaagaguuugggugccuugccgugaacaccggcugugucuucggaucuugccaggauaucaucagaccugagacgaaaguguaccggaaggcuguggaagaguccguccugcucacaguuuguauuaccuaccccggcaagaccuuuugcacagaaaucaaugccauugagccuaaaaucaccgacgagcuggaacugcaguucaagacgguggauacaaaaacccuucccaacauucuggcugugcaaaaucacaagcucuauagcgggcagaucaacgaccugggaucuuuuucccagggcugugggaauauccaaaagacaaacagcuccauuaucggaaccggcacagccaaguucgauuacgucugccauggggccucucgcaaggacauuaucgugagacgguguuauaacaauaacuacgagagcugcaaacuccugaaggaagaacagucccuuauguuugcugauaaucacgaaaccauugacguugcgaacgugagacaucugcucggcgaccugcaguucaaacugaugcuuggagaucugcgcuauaagagcuuugccgagaauccggaccucgagaucgaagcuaaaugugucggcugcccuucuuguuucacguccuacagcugcucuuuuaagaucgccagcaacauugauaccgugugcuccaucgaggggcccuguacaaccuuccacaaucggcugaugauuacaucuaccaagcaggacuauggaaucaaaaugagcugcaagacgaaacccaaggaaacagaggaguuccaaauuuguaaaaagaccuacacaguucucuuuaccaccguggagaagaacgauaaaaucgagauuuccacaggcgaccagacgucuuucauccaggaaagagaugaccgcugcaagaccuggcuguguagaguccgggaugaggggaucagcgugauuuuugaaccuauccgcgccuucuuuggauccuacuucagcauugcuuuuuauguuguggucaucauuaucgugcuuuuccuggccaucuacauuuuucucccgaugguguucaaacugagagacguccugaagcggaaugaguaucuuuaccugcaggaaaucaaacacaaguga

SEQ ID NO: 14220 - RNA, 4305 nt, Artificial Sequence
  derived and/or modified CDS sequence (opt5) from NRIV(9800521)__JX857326.1__GP
augcugcuccugcuugugcugcucauccccugcuacgucagcgccuccccuguugugaccagauguuuccacggcgggcagcugauugcugagaagaaaucucaaacagccgugagcgaauuuugccuuaaggacgaugucuccacgaucaaaucugagauuaccuaugaaaagaacaauacaggacuguucgcgcauagcaaagugcuccggaacuggaucauuaaggacuggaagaauuguaacccgguucccaccgcuggcggguccaucaaugugaucgaggucaacacagaucugucucugaccacaaaaaccuacgugugcagccgcgacuguacgauuaccguugauaaggaagacgcccagaucauuuuucagacagagaaacucaaucacuucgagguguccggaaccacacugagcucuggcugguuuaagaccaaagccuccgucacgcuugauagaacaugcgaacauaucaaggugaccugugggaagaaaacacugcaguuccacgcuugcuuuaagcaucacaugagcuguauucgguucuuucacggaaccauccucccuggcaccauggccacaucuauuugccaaaacaucgagcugaucauuaucauuucccuuacgcugaucauuuucauccucaugaucauucugaccaaaacauauaucuguuaccugcucaugccccuguuuaugccuauugcuuauuucuacggcuggagcuauaauaagucuugcaaaaagugcuccuguugcgggcuugccuaccaucccuuuaccaacuguggaagccacugcguguguggccugaaauucgaagcguccgaccgcaugagaauccaucgggagucugggcucugccagggauacaagagccugcgcgucgccagacuucuguguaaguccaaaggcagcucucucguuauuuccauccugcugagcaugcucauccugucuuucgugacaccuauugaggggacccuuacgaauuauccggaaagccggaaguacgaucuggaggaaaucgcugacgugcucgagggauuuauugucgaaaaaggcaucaaggaguaugugguuuucuacacauccauuuuuggcgcccugcuucugcucauggcucuggugaucaccauuacccugaacaaagucacagaguaucucaccaauaucaacgugcuguacugccacgaauguucuauguaucacagcaagaagaauaucaaauacauuggggauuucacaaacaagugcggauuuuguacgugcggcgagcuugaagaccaggaggggcugaaaauccauaagguuucccgcaaaugcauuuacaaguaucagcucaccuggagcaagaucauuaugacaauccuggugugucugcuuaucgcccaaaacaccauucucaucgucgcggccucugaugacugcuggaccaaaaagucccuggaaauggaguguauuggaccccugcaacagguggacacaugcgaugacaaagcuagcagaucuuacuccggcgaggcccggaagcucguccgcgcuagcaaaaucuccgaucuggacgccgcccagguggggcuucugggaucuacgauugaaagcgcuaucgcguccaucagaaagcagcggaccuauccuacaaugcaccuccuggagucuguuuuccugggcaagcauugugauuacuauaaaaccuuugaacacaauagcggcuacucccaggccaaguggcgccuuacagcuaaaacccaucacuucgacauuugcagcagacacucuacgcaucacuuuugucggugcaucuccgaugggacaaagugucagaacggagacugggauuucgccggcgagaugaauagcaccuaucaaucuaaaaaggacuuuuucgaacaugauuuuaaacucuucugcacacugguggagaacgccuuccccgggaccaccgagucccuguuuuacgaaaugcucagcaagaagaauacaacgggaauuaaacagcugcuugacaagcugaccagaaaauucggcaacaauaacauguuugucgggaucuggaaguucggccaguaccucaugucucugccuuaugugaaugaggcuagccugacacccgcccagauuuccaaaauccuugaaguuaccgaccaacaccaccgcagcaucucuggacggcaggagucccucgcgagcgcuacaccgggcuccaagucuaaggagugugggcaugccaaaaaggugagcugcauuuccccuagauuuucuguccccauggaaggacugauggccugcggcgauagcccuaacuacaaaaucuauaagacccccacgaaacuguacaaguccaauaacaagggggaggugugguguucuggagacgugcacugcagccaggaacucucccccgcuagccaggagucuguugaucgcauuaaacaaaucacauguuuccugaccgaaccugaggucuccgacgauguguuuagcauugccaucucuaccugcaaggugcaggacaaaggcgucuguacagugaaugaggaucgguggaacguuauuaagugcgacuccgggcuuaucuauuacaccgaucagagagacggccaggauacaggaaaugacuucggcgaauauugucugagccauucuugccgcaucgagcgguuuccgauuaaccccgcuaucauuagagauugucucugggaauaccacucccgcaaaagcaaguacaucacgucccuggaccuggagaaccuugaagaguucaagcgggccauuagcgagaaacucucucauacccugaucguguauaauuuuaagccuacagcgaaccugccccacaucaaaccugucuacaaguauauuaccgugcaagggguugaaaauagcgacggaguggauuccgccuacaucgcugccucuaugcccgcucucagcggcacauccauuggguauaacaucaugucuagagacaauuucccgcuguuugauauuaucaucuucauuaaaagcgccaucauuaaggcgaccuacaaccacaucuaugacacgggaccuaccauuggcaucaaugucaugcaugaugagcacugcacagggcagugucccaccgacauuccucauaaagaaaacuggaucacauucgcccaggagcgcaccucccgguggggcugcgaagaguuuggaugccuugcugugaauacaggcuguguuuucgggucuugccaggauaucauuagacccgagaccaagguguaccggaaggccgucgaagagagcgugcugcucacgguguguaucacauacccuggaaaaaccuuuugcaccgaaauuaacgcuaucgagcccaagauuacagacgagcuggaacugcaauucaaaaccgucgauacgaagacacuuccgaauauccuggccguucagaaccacaaacucuauuccggccagaucaaugaccuggggagcuuuucucaaggauguggcaacauucagcgcaccaauuccagcaucauugggacaggcaccgccaaguucgauuacgugugccauggagcuucuagaaaggacaucauugugcggagauguuauaacaacaauuacgaguccugcaaacuccugaaggaagaacagagccuuauguuugcggauaaccacgaaacaaucgacgucgccaaugugcgccaucugcucggcgaccugcaguucaaacugaugcuuggggaucugcgguauaaguccuuugcugagaacccugaccucgagaucgaagccaaauguguuggaugccccucuuguuucaccagcuacuccugcagcuuuaagauugccacgaauaucgauaccgugugcucuauugagggccccuguacaaccuuccacaacagacugaugaucacauccaccaagcaagacuaugggauuaaaaugagcugcaagacgaaaccuaaggaaacagaggaguuccagaucuguaaaaagaccuacacaguccucuuuaccaccguggagaagaaugauaaaauugagaucucuacaggagaccagacgagcuucauccaggaacgcgaugacagaugcaagaccuggcugugucggguucgcgaugagggcauuuccgugaucuuugaaccgauuagagcuuucuuuggcucuuacuucagcaucgccuuuuaugucgugauuuccaucaucguucuuuuccuggcgauuuacaucuuucuccccaugguguucaaacugcgggacguccugaagcgcaacgaguaucuuuaccugcaagaaauuaaacacaaguga

SEQ ID NO: 14221 - RNA, 4305 nt, Artificial Sequence
  derived and/or modified CDS sequence (opt5) from NRIV(Adrar)__KJ716849.1__GP
augcugcuccugcuugugcugcucauccccugcuacgucagcgccuccccuguugugaccagauguuuccacggcgggcagcugauugcugagaagaaaucucaaacagccgugagcgaauuuugccuuaaggacgaugucuccacgaucaaaucugagauuaccuaugaaaagaacaauacaggacuguucgcgcauagcaaagugcuccggaacuggaucauuaaggacuggaagaauuguaacccgguucccaccgcuggcggguccaucaaugugaucgaggucaacacagaucugucucugaccacaaaaaccuacgugugcagccgcgacuguacgauuaccguugauaaggaagacgcccagaucauuuuucagacagagaaacucaaucacuucgagguguccggaaccacacugagcucuggcugguuuaagaccaaagccuccgucacgcuugauagaacaugcgaacauaucaaggugaccugugggaagaaaacacugcaguuccacgcuugcuuuaagcaucacaugagcuguauucgguucuuucacggaaccauccucccuggcaccauggccacaucuauuugccaaaacaucgagcugaucauuaucauuucccuuacgcugaucauuuucauccucauggugauccugaccaaaacauauauuuguuaccugcucaugccccuguuuaugccuaucgcuuauuucuacggcuggagcuauaauaagucuugcaaaaagugcuccuguugcgggcuugccuaccaucccuuuaccaacuguggaagccacugcgucuguggccugaaauucgaagcguccgaccgcaugcggauucauagagagucugggcucugccagggauacaagagccugcgcguugccagacuucuguguaaguccaaaggcagcucucucgugaucuccauucugcugagcaugcucauccugucuuucgugacaccuaucgaggggacccuuacgaauuauccggaaagccggaaguacgaucuggaggaaauugcugacguccucgagggauuuaucguggaaaaaggcauuaaggaguauguuguguucuacacauccaucuuuggcgcccugcuucugcucauggcucuggucauuaccaucacccugaacaaagugacagaguaucucaccaauauuaacguucuguacugccacgaauguucuauguaucacagcaagaagaauaucaaauacaucggggauuucacaaacaagugcggauuuuguacgugcggcgagcuugaagaccaggaggggcugaaaauucauaaggugucccgcaaaugcaucuacaaguaucagcucaccuggagcaagauuaucaugacaauucuggucugucugcuuaucgcccaaaacaccauccucauuguggcggccucugaugacugcuggacaaagaagucccuggaaauggaguguaucggaccccugcagcaggucgauaccugcgacgacaaagcuagcagaucuuacuccggcgaggccaagaaacucgugcgggcuagcaagauuuccgaucuggacgccgcccagguugggcuucugggaucuacgaucgaaagcgcuauugcguccauccgcaagcaaagaaccuauccuacaaugcaccuccuggagucuguguuccugggcaaacauugugauuacuauaagaccuuugaacacaauagcggcuacucccaggccaaauggcggcuuacagcuaagacccaucacuucgacaucugcagccgccacucuacgcaucacuuuuguagaugcauuuccgaugggacaaaaugucagaacggagacugggauuucgccggcgagaugaauagcaccuaucaaucuaagaaagacuuuuucgaacaugauuuuaaacucuucugcacacuggucgagaacgccuuccccgggaccaccgagucccuguuuuacgaaaugcucagcaagaaaaauacaacgggaaucaagaaacugcuugacaagcugacccggaaauucggcaacaauaacauguuuguggggauuuggaaguucggccaguaccucaucucucugccuuauguuaaugagacaagccugacccccgcucagguguccaagauucuugaagucacagaccagcaccacagaagcaucucuggacgccaagagucccucgccagcgcgaccccgggcuccaaaucuaaggagugugggcaugcuaaaaaggugagcugcaucuccccucgguuuucugugcccauggaaggacugauggccugcggcgauagcccuaacuacaaaauuuauaagacgcccgccaagcuguacaaauccaauaacaagggggagguuugguguucuggagacguccacugcagccaggaacucucccccgcuagccaggagucuguggauagaaucaaacagauuacauguuuccugaccgaaccugagguguccgacgaugucuuuagcaucgccauuucuaccugcaaggugcaagacaaaggcguuuguacagugaaugaggaucgcuggaacgucaucaagugcgacuccgggcuuauuuauuacaccgaucagcgggaaggccaggacacaggaaaugauuucggcgaguauugucugagccauucuugcagaaucgaacgcuuuccgaucaaccccgcuauuaucuccgacugucucugggaguaccacagccggaaguccaaauacauuacgagccuggaucuggaaaaccuugaggaguucaagagagccaucucugaaaaacucagccauacccugauuguguauaauuuuaagccuacagcgaaccugccccacaucaaaccuaucuacaaguauauuaccguucaggggguggaaaauuccgacggagucgacucugccuacaucgcugccagcaugcccgcucucuccggcacaucuauuggguauaacaucaugagccgcgauaauuucccgcuguuugacauuaucaucuucauuaaauccgccaucauuaaggcgaccuacaaccacaucuaugauacgggaccuaccauuggcaucaaugugaugcaugacgagcacugcacagggcaaugucccaccgauauuccucauaaggagaacuggaucacauucgcccaggaacggaccucuagauggggcugcgaggaguuuggaugccuugcuguuaauacaggcuguguguucgggagcugccaggacaucauucgcuccgaaaccaaagucuaccggaaggccguggaggaaagcgugcugcucacggucuguaucacauaccccggaaaaaccuuuugcaccgagauuaacgcuaucgagccuaagauuacagaugaacuggagcugcaguucaaaaccguugacacgaagacacuucccaauauccuggccgugcaaaaccacaagcucuauucuggccagaucaaugaucugggguccuuuagccagggauguggcaacauucaaaagaccaaucucucuaucauugggacaggcaccgccaaguucgacuacgugugccauggagcuuccagaaaagauaucauuguccggcgcuguuauaacaacaauuacgaaagcugcaagcugcuuaaagaggaacagucccugauguuugcggacaaccacgagacaaucgauguggccaauguuagacaccuccugggcgaccugcaguucaaacuuaugcugggggaccuccgguauaagucuuuugcugagaacccggaucuggaaaucgaggccaaaugugugggaugcccuagcuguuucaccuccuacagcugcucuuuuaagauugccuccaauaucgacacggucugcagcauugaaggccccuguaccacauuccauaacagacucaugaucaccucuacaaaacaggauuaugggauuaagaugagcugcaaaaccaagcccaaggagacggaagaguuccaaaucuguaaaaagacauacaccgugcuguuuacaaccguugagaaaaaugacaagauugaaaucuccaccggagaucagacaucuuucauccaggagaaagacgaucgcugcaagacguggcuuugucgggugagagacgaaggcauuagcgucaucuuugagccuauucgcgcuuucuuuggcuccuacuucucuaucgccuuuuaugugguuauuagcaucaucgugcuguuccucgcgauuuacaucuuucugccgauggucuucaagcugagagaugugcuuaaacggaacgaauaucuguaccuccaggagauuaagcacaaauga

SEQ ID NO: 14222 - RNA, 4305 nt, Artificial Sequence
  derived and/or modified CDS sequence (opt5) from NRIV(DakArD28542)__JX857317.1__GP
augcugcuccugcuugugcugcucauccccugcuacgucagcgccuccccuguugugaccagauguuuccacggcgggcagcugauugcugagaagaaaucucaaacagccgugagcgaauuuugccuuaaggacgaugucuccacgaucaaaucugagauuaccuaugaaaagaacaauacaggacuguucgcgcauagcaaagugcuccggaacuggaucauuaaggacuggaagaauuguaacccgguucccaccgcuggcggguccaucaaugugaucgaggucaacacagaucugucucugaccacaaaaaccuacgugugcagccgcgacuguacgauuaccguugauaaggaagacgcccagaucauuuuucagacagagaaacucaaucacuucgagguguccggaaccacacugagcucuggcugguuuaagaccaaagccuccgucacgcuugauagaacaugcgaacauaucaaggugaccugugggaagaaaacacugcaguuccacgcuugcuuuaagcaucacaugagcuguauucgguucuuucacggaaccauccucccuggcaccauggccacaucuauuugccaaaacaucgagcugaucauuaucauuucccuuacgcugaucauuuucauccucauggugauccugaccaaaacauauauuuguuaccugcucaugccccuguuuaugccuaucgcuuauuucuacggcuggagcuauaauaagucuugcaaaaagugcuccuguugcgggcuugccuaccaucccuuuaccaacuguggaagccacugcgucuguggccugaaauucgaagcguccgaccgcaugcggauucauagagagucugggcucugccagggauacaagagccugcgcguugccagacuucuguguaaguccaaaggcagcucucucaucauuuccauccugcugagcaugcucauccugucuuucgugacaccuauugaggggacccuuacgaauuauccggaaagccggaaguacgaucuggaggaaaucgcugacgugcucgagggauuuauugucgaaaaaggcaucaaggaguaugugguuuucuacacauccauuuuuggcgcccuguuccuucugauggcucucgugaucaccauuacccugaacaaagucacagaguaucugaccaauaucaacgugcucuacugccacgaauguucuauguaucacagcaagaagaauaucaaauacauuggggauuuuacaaacaagugcggauucuguacgugcggcgagcuggaagaccaggaggggcuuaaaauccauaagguuucccgcaaaugcauuuacaaguaucagcugaccuggagcaagaucauuaugacaauccucgugugucugcugaucgcccaaaacaccauucuuaucgucgcggccucugaugacugcuggacaaagaagucccucgaaauggaguguauuggaccccugcaacagguggauaccugcgacgacaaagcuagcagaucuuacuccggcgaggccaagaaacugguccgggcuagcaagaucuccgaucucgacgccgcccagguggggcugcuuggaccuacgauugaaucugcuaucgcgagcauccgcaagcaaagaaccuauuccacaaugcaucugcucgagucuguuuuucugggcaaacacugugauuacuauaagaccuucgaacacaauagcggcuacucccaggccaaauggcggcugacagcuaagacccaucacuuugacauuugcagccgccacucuacgcaucacuucuguagaugcaucuccgaugggacaaaaugucagaacggagacugggauuuugccggcgagaugaauagcaccuaucaaucuaagaaagacuucuuugaacaugaucuuaaacucuucugcacacugguggagaacgccuuccccgggaccaccgagucccuguuuuacgaaaugcucagcaagaaaaauacaacgggagucaagaaacugcuugacaagcugacccggaaauucggcaacaauaacauguuuguggggauuuggaaguucggccaguaccucaugucucugccuuauguuaaugagacaagccugacccccgcucagguggccaagauccuugaagucacagaccagcaccacagauccauuagcggacgccaagagucucucgcguccgcuaccccgggcagcaaauccaaggaguguucucaugccaaaaaggugagcugcaucuccccucgguuuucugugcccauggaagggcugauggccugcggagauagcccuaacuacaaaaucuauaagacgcccgcuaagcuguacaaauccaauaacaagggcgagguuugguguucuggggacguccacugcagccaggaacucucccccgccagccaggagucuguggauagaauuaaacagaucacauguuuccugaccgaaccugagguguccgacgaugucuuuagcauugcuaucucuaccugcaaggugcaagacaaaggaguuuguacagugaaugaggaucgcuggaacgucauuaagugcgacuccggccuuaucuauuacaccgaucagcgggacgggcaggauacaggcaaugacuucggagaauauugucugagccauucuugcagaauugagcgcuuuccgaucaaccccgccaucauuuccgauugucucugggaauaccacagccggaaguccaaauacaucacgagccuggaccuggagaaccuugaagaguucaagagagcgauuucugagaaacucagccauacccugaucguguauaauuuuaagccuacagccaaccugccccacauuaaaccuguuuacaaguauaucaccgugcagggcgucgaaaauuccgacgggguggauucugcuuacaucgccgcuagcaugcccgcccucuccggaacaucuauuggcuauaacaucaugagccgcgacaauuucccgcuguuugauauuaucauuuucaucaaauccgcgaucauuaaggccaccuacaaccacaucuaugacacggggccuaccauuggaaucaauguuaugcaugaugagcacugcacaggccaaugucccaccgacauuccucauaaggaaaacuggaucacauucgcucaggagcggaccucuagaugggggugcgaagaguuuggcugccuugccgugaauacaggaugugucuucggcagcugccaggauauuauccgccccgagaccaaaguguaccggaaggcuguggaagaguccguccugcucacgguuuguaucacauacccugggaaaaccuuuugcaccgaaauuaacgccaucgagcccaagauuacagacgagcuggaacugcaguucaaaaccguggauacgaagacacuuccgaauauccuggccgugcaaaaccacaagcucuauagcggacagauuaaugaccugggcucuuuuucccagggguguggaaacauccagaaaaccaauagcucuaucauuggcacagggaccgcuaaguucgauuacgucugccauggcgcguccagaaaagacaucauugugcggcgcuguuauaacaacaauuacgagagcugcaagcuccugaaagaagaacagucccuuauguuugccgauaaccacgaaacaaucgacguugcuaaugugagacaucugcucggagaccugcaguucaagcugaugcuuggcgaucugcgguauaagucuuuugccgagaacccugaccucgagauugaagccaaaugugucgggugccccagcuguuucaccuccuacagcugcucuuuuaagaucgcuuccaauaucgauacggugugcagcauugagggacccuguaccacauuccacaacagacugaugaucaccucuacaaaacaggacuauggcauuaagaugagcugcaaaaccaagccuaaggaaacggaggaguuccaaaucuguaaaaagacauacaccguucucuuuacaaccguggagaaaaaugauaagauugagaucuccaccggggaccagacaucuuucauucaggaacgcgaugaccggugcaaaacguggcuguguagaguccgcgaugagggaaucagcgugaucuuugaaccgauuagagccuucuuuggcuccuacuucucuaucgcguuuuauguuguggucagcauuaucgugcuuuuccuggcuauuuacaucuuucuccccaugguguucaagcugcgggacguccugaagcgcaacgaguaucuuuaccugcaggaaaucaaacacaaguga

SEQ ID NO: 14223 - RNA, 4305 nt, Artificial Sequence
  derived and/or modified CDS sequence (opt5) from NRIV(SUD-HKV141)__JX857323.1__GP
augcugcuccugcuugugcugcucauccccugcuacgucagcgccuccccuguugugaccagauguuuccacggcgggcagcugauugcugagaagaaaucucaaacagccgugagcgaauuuugccuuaaggacgaugucuccacgaucaaaucugagauuaccuaugaaaagaacaauacaggacuguucgcgcauagcaaagugcuccggaacuggaucauuaaggacuggaagaauuguaacccgguucccaccgcuggcggguccaucaaugugaucgaggucaacacagaucugucucugaccacaaaaaccuacgugugcagccgcgacuguacgauuaccguugauaaggaagacgcccagaucauuuuucagacagagaaacucaaucacuucgagguguccggaaccacacugagcucuggcugguuuaagaccaaagccuccgucacgcuugauagaacaugcgaacauaucaaggugaccugugggaagaaaacacugcaguuccacgcuugcuuuaagcaucacaugagcuguauucgguucuuucacggaaccauccucccuggcaccauggccacaucuauuugccaaaacaucgagcugaucauuaucauuucccuuacgcugaucauuuucauccucauggugauccugaccaaaacauauauuuguuaccugcucaugccccuguuuaugccuaucgcuuauuucuacggcuggagcuauaauaagucuugcaaaaagugcuccuguugcgggcuugccuaccaucccuuuaccaacuguggaagccacugcgucuguggccugaaauucgaagcguccgaccgcaugcggauucauagagagucugggcucugccagggauacaagagccugcgcguugccagacuucuguguaaguccaaaggcagcucucucaucauuuccauccugcugagcaugcucauccugucuuucgugacaccuauugaggggacccuuacgaauuauccggaaagccggaaguacgaucuggaggaaaucgcugacgugcucgagggauuuauugucgaaaaaggcaucaaggaguaugugguuuucuacacauccauuuuuggcgcccuguuccuucugauggcucucgugaucaccauuacccugaacaaagucacagaguaucugaccaauaucaacgugcucuacugccacgaauguucuauguaucacagcaagaagaauaucaaauacauuggggauuuuacaaacaagugcggauucuguacgugcggcgagcuggaagaccaggaggggcuuaaaauccauaagguuucccgcaaaugcauuuacaaguaucagcugaccuggagcaagaucauuaugacaauccucgugugucugcugaucgcccaaaacaccauucuuaucgucgcggccucugaugacugcuggaccaaaaagucccucgaaauggaguguauuggaccccugcaacagguggacacaugcgaugacaaagcuagcagaucuuacuccggcgaggccaagaaacugguccgggcuagcaagaucuccgaucucgacgccgcccagguggggcugcuuggaccuacgauugaaucugcuaucgcgagcauccgcaagcaaagaaccuauuccacaaugcaccuccucgagucuguuuuucugggcaaacauugugauuacuauaagaccuucgaacacaauagcggcuacucccaggccaaauggcggcugacagcuaagacccaucacuuugacauuugcagccgccacucuacgcaucacuucuguagaugcaucuccgaugggacaaaaugucagaacggagacugggauuuugccggcgagaugaauagcaccuaucaaucuaagaaagacuucuuugaacaugaucuuaagcuguucugcacacugguggagaacgccuuccccgggaccaccgagucccuguuuuacgaaaugcucagcaagaaaaauacaacgggagucaagaaacugcuugacaagcugacccggaaauucggcaacaauaacauguuuguggggauuuggaaguucggccaguaccucaugucucugccuuauguuaaugagacaagccugacccccgcucagguggccaagauccuugaagucacagaccagcaccacagauccauuagcggacgccaagagucucucgcguccgcuaccccgggcagcaaauccaaggagugugggcaugccaaaaaggugucuugcaucagcccucgguuuuccgugcccauggaaggacugauggccugcggcgauucuccuaacuacaaaaucuauaagacgcccgcuaagcuguacaaaagcaauaacaagggggagguuugguguuccggagacguccacugcucucaggaacucacacccgccagccaggaguccguggauagaauuaaacagaucaccuguuuccugaccgaaccugaggugagcgacgaugucuuuucuauugcuaucuccacaugcaaggugcaagacaaaggcguuuguaccgugaaugaggaucgcuggaacgucauuaagugcgacagcgggcuuaucuauuacacagaucagcgggacggccaggauacgggaaaugacuucggcgaauauugucugucucauuccugcagaauugagcgcuuuccgaucaaccccgccaucauuagcgauugucucugggaauaccacucucggaaguccaaauacaucaccagccuggaccuggagaaccuugaagaguucaagagagcgauuuccgagaaacucagccauacacugaucguguauaauuuuaagccuaccgccaaccugccccacauuaaaccuguuuacaaguauaucacagugcagggggucgaaaauucugacggaguggauagcgcuuacaucgccgcuuccaugcccgcccucucuggcaccagcauuggguauaacaucaugucccgcgacaauuucccgcuguuugauauuaucauuuucaucaaaucugcgaucauuaaggccacguacaaccacaucuaugacaccggaccuacaauuggcaucaauguuaugcaugaugagcacugcaccgggcaaugucccacagacauuccucauaaggaaaacuggaucaccuucgcucaggagcggacaagcagauggggcugcgaagaguuuggaugccuugccgugaauaccggcugugucuucggguccugccaggauauuauccgccccgagacgaaaguguaccggaaggcuguggaagagucuguccugcucacaguuuguaucaccuacccuggaaaaaccuuuugcacagaaauuaacgccaucgagcccaagauuaccgacgagcuggaacugcaguucaaaacgguggauacaaagacccuuccgaauauccuggccgugcaaaaccacaagcucuauagcggccagauuaaugaccugggguccuuuagccagggauguggcaacauccagaaaacaaauucuuccaucauugggaccggcacagcuaaguucgauuacgucugccauggagcgagcagaaaagacaucauugugcggcgcuguuauaacaacaauuacgagucuugcaagcuccugaaagaagaacagucccuuauguuugccgauaaccacgaaaccaucgacguugcuaaugugagacaucugcucggcgaccugcaguucaagcugaugcuuggggaucugcgguauaagagcuuugccgagaacccugaccucgagauugaagccaaaugugucggaugccccuccuguuucacgucuuacagcugcuccuuuaagaucgugagcaauaucgauaccguuugcucuauugagggccccuguacaaccuuccacaacagacugaugaucacauccaccaaacaggacuaugggauuaagaugagcugcaaaacgaagccuaaggaaacagaggaguuccaaaucuguaaaaagaccuacacagugcucuuuaccaccgucgagaaaaaugauaagauugagaucucuacaggagaccagacgagcuucauucaggaacgcgaugaccggugcaaaaccuggcuguguagagugcgcgaugagggcaucuccguuaucuuugaaccgauuagagcuuucuuuggcucuuacuucagcaucgccuuuuauguggucguguccauuaucgugcuuuuccuggcgauuuacaucuuucuccccauggucuucaagcugcgggacguucugaagcgcaacgaguaucuuuaccugcaggaaaucaaacacaaguga

SEQ ID NO: 14224 - RNA, 4305 nt, Artificial Sequence
  derived and/or modified CDS sequence (opt5) from NRIV(SUD-HKV66)__JX857320.1__GP
augcugcuccugcuugugcugcucauccccugcuacgucagcgccuccccuguugugaccagauguuuccacggcgggcagcugauugcugagaagaaaucucaaacagccgugagcgaauuuugccuuaaggacgaugucuccacgaucaaaucugagauuaccuaugaaaagaacaauacaggacuguucgcgcauagcaaagugcuccggaacuggaucauuaaggacuggaagaauuguaacccgguucccaccgcuggcggguccaucaaugugaucgaggucaacacagaucugucucugaccacaaaaaccuacgugugcagccgcgacuguacgauuaccguugauaaggaagacgcccagaucauuuuucagacagagaaacucaaucacuucgagguguccggaaccacacugagcucuggcugguuuaagaccaaagccuccgucacgcuugauagaacaugcgaacauaucaaggugaccugugggaagaaaacacugcaguuccacgcuugcuuuaagcaucacaugagcuguauucgguucuuucacggaaccauccucccuggcaccauggccacaucuauuugccaaaacaucgagcugaucauuaucauuucccuuacgcugaucauuuucauccucauggugauccugaccaaaacauauauuuguuaccugcucaugccccuguuuaugccuaucgcuuauuucuacggcuggagcuauaauaagucuugcaaaaagugcuccuguugcgggcuugccuaccaucccuuuaccaacuguggaagccacugcgucuguggccugaaauucgaagcguccgaccgcaugcggauucauagagagucugggcucugccagggauacaagagccugcgcguugccagacuucuguguaaguccaaaggcagcucucucaucauuuccauccugcuggcuaugcucauccugagcuucgugacaccuauugaggggacccuuacgaauuauccggaaucucggaaguacgaucuggaggaaaucgccgacgugcucgagggauuuauugucgaaaaaggcaucaaggaguaugugguuuucuacacaagcauuuuuggcgcucuguuccuucugauggcccucgugaucaccauuacccugaacaaagucacagaguaucugaccaauaucaacgugcucuacugccacgaauguuccauguaucacucuaagaagaauaucaaauacauuggggauuuuacaaacaagugcggauucuguacgugcggcgagcuggaagaccaggaggggcuuaaaauccauaagguuagccgcaaaugcauuuacaaguaucagcugaccugguccaagaucauuaugacaauccucgugugucugcugaucgcgcaaaacaccauucuuaucgucgccgcuagcgaugacugcuggacaaagaagucucucgaaauggaguguauuggaccccugcaacagguggauaccugcgacgacaaagccuccagaagcuacucuggcgaggcuaagaaacugguccgggccuccaagaucagcgaucucgacgccgcucaggugcgccugcuugggccuacgauugaauccgcgaucgccucuaucagaaagcaacggaccuauagcacaaugcaucugcucgaguccguuuuucugggaaaacacugugauuacuauaagaccuucgaacacaauucuggcuacagccaggcuaaauggcgccugacagccaagacccaucacuuugacauuugcuccagacacagcacgcaucacuucugucggugcaucucugaugccacaaaaugucagaacggcgacugggauuuugcuggggagaugaauagcaccuaucaaagcaagaaagacuucuuugaacaugaucuuaaacucuucugcacacugguggagaacgccuuccccggaaccaccgagucucuguuuuacgaaaugcucuccaagaaaaauacaacgggcgucaagaaacugcuugacaagcugaccagaaaauucgggaacaauaacauguuugugggaauuuggaaguucggccaguaccucaugagccugccuuauguuaaugagacaucucugacccccgcucagguggcgaagauccuugaagucacagaccagcaccaccgcagcauuuccgggcggcaagagagccucgccucugccaccccgggcuccaaaagcaaggaguguggacaugcuaaaaagguguccugcaucucuccuagauuuagcgugcccauggaaggccugauggccugcggggauuccccuaacuacaaaaucuauaagacgcccgcuaagcuguacaaaucuaauaacaagggagagguuugguguagcggcgacguccacugcucccaggaacucacacccgccucucaggagagcguggaucgcauuaaacagaucaccuguuuccugaccgaaccugagguguccgacgaugucuuuagcauugcgaucucuacaugcaaggugcaagacaaagggguuuguaccgugaaugaggaucgguggaacgucauuaagugcgacuccggacuuaucuauuacacagaucagagagacggccaggauacggggaaugacuucggcgaauauugucugagccauucuugccgcauugagcgguuuccgaucaaccccgccaucauuuccgauugucucugggaauaccacagcagaaagucuaaauacaucaccucccuggaccuggagaaccuugaagaguucaagcgcgcuauuagcgagaaacucucccauacacugaucguguauaauuuuaagccuaccgccaaccugccccacauuaaaccuguuuacaaguauaucacagugcagggagucgaaaauagcgacggcguggauucugcuuacaucgccgcgagcaugcccgcccucuccgggaccucuauuggauauaacaucaugagccgggacaauuucccgcuguuugauauuaucauuuucaucaaauccgcuaucauuaaggccacguacaaccacaucuaugacaccggcccuacaauugggaucaauguuaugcaugaugagcacugcaccggacaaugucccacagacauuccucauaaggaaaacuggaucaccuucgcucaggagagaacaucucgcuggggcugcgaagaguuugggugccuugccgugaauaccggcugugucuucggaagcugccaggauauuauccggcccgagacgaaaguguacagaaaggccguggaagaguccguccugcucacaguuuguaucaccuacccuggcaaaaccuuuugcacagaaauuaacgcuaucgagcccaagauuaccgacgagcuggaacugcaguucaaaacgguggauacaaagacccuuccgaauauccuggcggugcaaaaccacaagcucuauucugggcagauuaaugaccugggauccuuuucccagggcugugggaacauccagaaaacaaauagcucuaucauuggaaccggcacagccaaguucgauuacgucugccauggggcuucccggaaagacaucauugugcgcagauguuauaacaacaauuacgagagcugcaagcuccugaaagaagaacagucucuuauguuugccgauaaccacgaaaccaucgacguugccaaugugcggcaucugcucggcgaccugcaguucaagcugaugcuuggagaucugagauauaaguccuuugcugagaacccugaccucgagauugaagccaaaugugucggcugccccagcuguuucacguccuacucuugcagcuuuaagaucgcguccaauaucgauaccgugugcagcauugaggggcccuguacaaccuuccacaaccgccugaugaucacaucuaccaaacaggacuauggaauuaagauguccugcaaaacgaagccuaaggaaacagaggaguuccaaaucuguaaaaagaccuacacaguucucuuuaccaccguggagaaaaaugauaagauugagaucagcacaggcgaccagacgucuuucauucaggaacgggaugacagaugcaaaaccuggcugugucgcgucagagaugaggggaucagcgugaucuuugaaccgauucgggcuuucuuuggauccuacuucucuaucgccuuuuauguuguggucagcauuaucgugcuuuuccuggccauuuacaucuuucuccccaugguguucaagcugcgcgacguccugaagagaaacgaguaucuuuaccugcaggaaaucaaacacaaguga

SEQ ID NO: 14225 - RNA, 4344 nt, Artificial Sequence
  derived and/or modified CDS sequence (opt5) from BWAV(M459)__NC_034490.1__GP
auggccauguucgagcugaucgugcuccuggcuuuuagcuacgucaccggcguuccccaggaacuuacaagaugcuucaccgggggauccguggugcggcaacacuggucuaagaacgccauuagcgagcugugucucaaagacgaugucuccaucauuaagucugaaaucgaguauaaaaagaaugaaacgggcacauuugcgcugagcaaaauuuaccgcaaguggaucaccacagacugggagaagugccagccucagaaauccaccgggggacauaucucugugcuugagguuagacacgaucugacacucgcuagcgccaccuauauuuguggcaacccgugcacgaucaauguggaccgggaaauggcccagguccaucugcaaaccgagggggugaaccacuucgaaauuuccggaacaaccaucaagagcggcugguuuaaaacaaccacguacauuacacuggaucagaccugugagcaucucaagguuucuugcggcaaacaguccgugcaguuccacgcuuguuuuaagcaacacauggccugcguccgcuuccugcauagaacaauccuucccgggaauauggcuaacagcauuugucagaauaucgagaucauuauccugcucgcccugacccuuucuauuuuuauccugcucugcauucugaccaagacauauaucuguuacauccugcucccuauuuucauccccauuuccuauaucuacggauacuuuuauaaccggagcugcaaaaagugcucucaguguggccugguguaccacccuuucacggaaugcgggcgcaauugugugugcggagcgagauaugacaccuccgagcggaugaaacuucaucgccugagcggccucugucccggguacaagucccugaaagccgcuagaguccuuugcaagucuaaaggaagcgccuccauucugagcauccucaucucucugcugauucucacauuuguuaccccuaucaacggccugaugcuuaaggauacagacauuaccaaucugaagaucgauacgcucccggacgauaugcuggaacuuauucacaacguggacuaucugaaacucauccuggagauuaauaucacaaucuucggcuucauucugaucauuauccucuuuaugcugcuuauguucuaccgguaucagcacauuuuuaucuccaucuacgugauugauuguaaggaaugcaacauguaccauagcaaaucugggcugcgcuauaauggagacuucaccaacaaguguaugaccugcacauguggcgaggucgacgauauggaggggcucaacaaacacaagaagagauacaauugccugaucaaauauaagaccacaauucugcaacacuuuuuccuuagcauccucgugugccugauucugaaagaauccguucucuuugcugccgcgcagucugaggaaaucaucaagugucuggagcaggaaagccuuacguccaaaugcaccggaccccugcucaagacaccucaauguaccgagcagcagaagaaccugcuguucauugagaucgccaaacagauggaaaaggacaauauuaucacaagccuugauaacgcucucauugccaaacugcccaaugagaucgcuggcucuauggccauccuggacaccaagaaauacuaucaugaacaaauuacgcucgaguacgccauccuguccaaguauugcgauuacuacaagaaauaugaagggaacaccggauacagccagacaaccuggcggacauaucuucgcucucaggaccuggagauuugucucauccugccuuaccaguuuuucugcagauguuuuaaguccggcaccggcugcauugauacgaaaauggagaucaagagcacaauggacaccuauuacuccucucaucaaacaaaauucgauagcgaccugaauuauaugcuucacgugauucaccucgcuuuucggggguccgcgaccucuuacaucgccaagugucugaucgaaaagaacuacaccgagacaauuagcuaucugacgaagauccaggaaaaguaccccaauaaccagcuccugaaagucgcuauuuucuucaccaaucaucuucugaaccagucccucguggagaauuuugagguuagcacagaauggucuagauauaagcacuccaccgcccaaccggagcaugaauggaaaaagggaagcgagcugaaaaugcuggauccuaacaaacuuaagacaggccccgccauccagaccugccuccacauuaaagaccugcacuguaucucuccucgcucccgggcucccacgagcgggaucauuacaugcggacugaaugaccaggccugcguguacagaaagcccgauaaaaagaucuaugcgucucauaugacccagcacggcuucugugucauggacgggcauugccucaaaccuuuugaaccgauuagcggcgagaugcugcaaaucauuaagaaguccaaauguuggaccgaggauaucgaagaccuuaucacagagggacaggauaagggccgcauuagcugccagcccaucgacguggggaacuguaacgucucuggaaaucuguggaccauuacacucugcuccgauaaaaaguucuacuauacggacaacaaacacgugcaugauaauagcaaggacaucggcuacuacuguauggaagagaacugcaagauuccucgguuucccauccacccugauuucguuaaagacugugaaugggaucugaaucacauuaagaucgaccaucugaaacaaaucaacauugaggacaucaauuccuauaagaaaauucuuaccgagaagcugacaaccgcucucaacucuuuuaaauacaaggggaaugaaaaccugccccacagcaucccgaaguauaaauacauuacaauccagggaacccagacgaucgauggcauugagaaugccuucaucgaaguggagauuccugcccucuccgggucugcuaccggcuuuaagaucagcuccagagacggaauugaacuguucgaugccauccuuuaugucaaacaggcuucuuuuagcuccguguacaagaaacuguauguuacaggccccaccaucgggauuaacacaaagcaugacgagcgcugcaccggagccuguccuaugacacucccccacagcuacggcuggcugaccuucucuaaggagcggacgucccaaugggggugcgaagaguacggaugccuggcgaucagcgauggcuguguguuugggucuugccaggacauuaucaaagaugaccuuacaauuuauagaaaggaaaccgaggagcugucccucgccgaaaucuguauuaccuucaugcauaauacauucugcaccagcaucgauucuacgacaccuaccaucacagacauucuggaggcucaguuuaaaaccgucgaauccuucaagcuccccaacacagugggccugaaaaugcacaaacuuuacaucggaaccauuaaugauaucggcguguauaagaaggccugugggaacguucagaaguacaacaauacgauucugggaagcggcuccccgaaauuugacuaugucugccaccucgcuaagcgcaaagaugugauccugcggaaguguuucgacaacgacuacaauagcugcaagcugcuuaaaguggccaacgaucugagaaucgaggaagacggggagaagcucaaagucauuaauuauaagaaagugaugggaacccugaaguuuaaggcgaucuucggcgauauuaaauacaagucuuuuacacaagacguugauaucgacgccgaggcuaccuguguggggugccucaacuguuucgaaaauauuaacugcgagaucaaaguccagagcccucuggaaacaaccugcgagguggaauccucuugugaucuuuuuacgacacgcauccuguuccaucaggacauucacaaguacgcccugaaacucaucugcagcaaggaggcuuccucuaaauuuuggauucgguucuguaauaaggagaucaagagcuccauuucucugaucaacgccgcccccauucuugaacuggcucccaucgaucagaccagcuauguuaaagaggaagacgagagaugcggcacauggaugugucggguggcgcaagaaggaaucggcgucauuuucgagccuuuuaagaaucucuucggguccuaccugggaaucuuuuauauuaucauuaucgugaucauucuccugguucuuuucguguacaucuuucugccgaugauucugaaacucaaggagauccugcagaaaaacgaagucgccuaucagcgcgauaugaagauuagauga

SEQ ID NO: 14226 - RNA, 4344 nt, Artificial Sequence
  derived and/or modified CDS sequence (opt5) from BWAV(UgAr1888)__KJ867186.1__GP
auggccaucuucaagcugauugugcuccuggcuuuuagcuacgccaccggcgucccccaggagcuuuccagaugcuucacagggggaucuguugugcggcaacacuggagcaaaaacgcgaucuccgaacugugucucaaggacgaugugucuauuaucaaaagcgagauugaauauaagaaaaaugagacgggcaccuuugcucugaacaagaucuaccgcaaguggaucacaaccgacugggaaaaaugccagccucagaaguccacagggggacauauuucuguccuugaggugagacacgaucugacccucgccagcgccacauauaucuguggcaauccgugcaccauuaacguugaccgggagauggcucaggugcaucugcaaacggaaggggucaaucacuucgagaucuccggaaccacaauuaaaagcggcugguuuaagaccacaaccuacaucacgcuggaucagacaugugaacaucucaaagugucuugcggcaagcaguccguucaguuccacgccuguuuuaagcaacacauggcuugcgugcgcuuccugcauagaaccauucuucccgggaacauggccaauagcaucugucagaacaucgagauuaucauucugcucgcgcugacacuuucuaucuuuauucugcucugcauccugaccaaaaccuauaucuguuacauucugcucccuaucuucauucccaucuccuauauuuacggauacuuuuauaaucggagcugcaagaaaugcucucaguguggccuggucuaccacccuuucacagagugcgggcgcaacugugugugcggagccagauaugacacguccgaacggaugaagcuccaucgccugagcggccucugucccggguacaaaucccugaagaccgcuagagugcuuugcaaaucuaagggaagcgccuccauccugagcauccucauuucucugcugauccucacauuugucaccccuauuaauggccugaugcuuaaggauacagacaucaccaaccugaaaauugauacgcucccggacgauaugcuggagcuuauccacaauguugacuaucugaagcucauucuggaaaucaacaucaugauuuucggcuucauccugauuaucauucucuuuaugcugcuuauguucuaccgguaucagcacaucuuuaucuccauuuacgugaucgauuguaaagagugcgacauguaccauagcaagucugggcugcgcuauaauggagacuucacaaacaaauguaugaccugcaccuguggcgaaguggaugacauggaggggcucaacaagcacaagaaaagauacaauugccugauuaaguauaaaacaaccauccugcaacauuuuagccuuuccaugcucgucugccugauucugaaggagucugugcuuuucgcugccgcgcagcccgaagagaucaucaaaugucuggaacaggagagccuuacauccgaaugcacgggaccucugcucaagacaccccaauguaccgagcagcagaagaaccugcuguuuauggagauugccaaacagauggaaaaggauaauguuaucaccagccuugacaacgcucucauugccaaacugccuaaugagaucgcuggcucuauggccauucuggauacaaagaaauacuaucacgaacaaaucacccucgaguacgccauccuguccaaguauugcgacuacuacaagaaauaugaagggaacacgggauacagccagaccacauggcggaccuaucuucgcucucaggaucuggagauuugucucauccugcccuaccaguucuuuugcagauguuucaaguccggcacaggcugcauugacaccaaaaucgaguuuaagagcacgauggauacauauuacuccucucaucaaaccaaauucgacagcgaucugaauuauaugcuucacgugauucaccucgcuuuucggggguccgcgacaucuuacaucgccaagugucugauugaaaagaacuacaccgagaccaucagcuaucugacaaagauccaggaaaaguacccgaauaaccagcuccugaaagucgcuauuuucuucacgaaucaucuucugaaccagucccucguggagaauuuugagguuagcaccgaauggucuagauauaagcacuccgccacacaaccugagcaugaauggaaaaagggaagcgagcugaaaauccuggacucuaacaaacuuaagaccggccccgccauucagacaugccuccacaucaaagaccugcacuguauuuccccucgcagccgggcucccaccucugggaucaucacgugcggacugaaugaucaggccugcguguacagaaagcccaacaaagaaauuuaugcgagccauaugacacagcacggcuucuguaucauggacgggcauugccucaagccuuuugagccgauuuccggcgagaugcugcaaaucauuaaaaagagcaaguguuggaccgaagauaucgaggaccuuaucaccgaaggacaggauaaaggccgcauuucuugccagcccaucgacgucgggaacuguaauguguccggaaaccuguggacaauuacccucugcagcgauaagaaauucuacuauacagacaauaagcacguccaugauuccucuaaagacgugggcuacuacuguauggaggaaaacugcaagaucccucgguuucccauucacccugauuucguuaaggacugugagugggaucugaaucacauggagaucgaccaucugaaacaaauuaacaucgaagacaucaauagcuauaagaaaauucuuacggagaagcugaucaccgcucucaacuccuuuaaauacaaggggaaugaaaaccugccccacucuauuccgaaauaugaguacaucacaauucagggaacccagacaaucgauggcaucgaaaaugccuucauugagguggagaucccugcccucagcggguccgcuaccggcuuuaagauuucuagcagagacggaaucgaacuguucgaugccauucuuuaugucaagcaggcuuccuuuagcucuguguacaaaaagcuguauguuacgggccccaccaucgggaucaacacaaaacaugacgagcgcugcaccggagccuguccugugacacucccccacuccuacggcuggcugaccuucagcaaggaacggacaucucaaugggggugcgaggaguacggaugccuggcgauuuccgauggcugugucuuugggagcugccaggacaucauuaaagaugaccuuaccguguauagaaaggaaacggaggaacugucucucgccgagaucuguauuacauucaugcauaauaccuucugcaccuccaucgauagcacaaccccuacgauuacagacauccuggaagcucaguuuaagaccguggaguccuucaaacuccccaacacaguuggccugaagaugcacaaacuuuacaucggaaccauuaaugauaucggcgucuauaagaaagccugugggaacgugcagaaguacaacaauacaauucugggaagcggcucuccgaaguuugacuaugugugccaccucgcuaaacgcaaggaugucauccugcggaaauguuucgacaacgacuacaauagcugcaagcugcuuaaaguggccaacgaucugagaauugaggaagacggggagaagcucaagguuaucaauuauaaaaaggugaugggaacccugaaauuuaaggcgaucuucggcgaugucaaauacaaguccuuuacgcaagacguggauauugacgccgaagcuaccuguguugggugccucaacuguuucgagaauaucaacugcgaaauuaaggugcagucuccucuggagacaaccugcgaggucgaaagcuccugugaucuuuuuacaacccgcauccuguuccaucaggacauucacaaauacgcccugaagcucaucugcucuaaagaggcuacgagcaaguuuuggauccgguucuguaaaaaggaaauuaaauccucuaucagccugauuaaugccgcccccauccuugagcuggcucccauugaucagacauccuaugugaaggaagaggacgagagaugcggcaccuggaugugucggguugcgcaagaaggaaucggcgugauuuucgagccuuuuaagaaccucuucgggagcuaccugggaaucuuuuauaucauuaucauugucaucauucuccuggugcuuuucguguacaucuuucugccgaugauccugaaacucaaggaaauucugcagaaaaaugaggucgccuaucagcgcgauaugaagguuagauga

SEQ ID NO: 14227 - RNA, 4332 nt, Artificial Sequence
  derived and/or modified CDS sequence (opt5) from BWAV/PGAV(SAAr1)__KJ867177.1__GP
augaucugcauuuguaucuucguggccauuuuucccgcuaucuacgccauuccugacagcuauuccagaugcuucaccggcgggacagucguuaaggagauguggucuaaagaugcggugacggaacuguguaucaaggacgaugugagcaucgucaaaaccgagacauccuacaagaaaaacggaaccggcacauuugcucucaauaaggugacccggaaguggcugaugacagacugggaaaaaugcaagccgcagaaaucuagcuccgggcacauuaacguuaucgaggugcgcgaugaccuuacccuggccacgucuaccuauauuuguagcuccagcugcacaaucaaugucgauagagaaaccgcccaaauucagcucaacacagacucuaucaaucauuucgagauugcuggaaccacgaucaagacaggcugguuuaaauccaccacacugguggcccuugaucagaccugugagcaccugaagguuagcugcgggaagcagucugugcaauuccaugcuuguuuuaaccagcacauguccugcguccgguuccuccaucgcaccauccugcccggaaauauggccaaaagcauuugucagaacaucgaaauuaucauucuggugggccucaucauccugauuuuucuucugcucugcauccugacaaagacguacauuugcuauauccuucugccuauuuucaucccccucucuuacgcguauggcuacuuuuacaauaaagccuguaagaaaugcucccagugugggcugguguaucacccuuucaccgagugcggaagcaacugugucugcggcgcuagauacgacacauccgaacggaugaagcugcaccgcaucucugggcucugucccggauauaaaagccugagaaccgcccggguucuuugcaaguccaagggcagcgcuucuauucuguccauccucauuagcauccugauucuuauguuugugacaccuaucaauggguacaugauuaccaacgaguucgaugagggaaaacugacgguggacucucucccggaugacaugcugagcaugaucucccgccugucugcccuccaauucaucuuuacacugaauauugcguguagcguccuugugacccugcugaccugccucuuccuuaucaucuuuuauagauuccagcaucgguuucuguccaaguacgccauuaacuguacagaaugcgacauguaucaccagaaaaagggccucauuuacaauggcgauuucaccaacaaaugcaugacauguacgugcggggagguuaacgacauggaaggacugaauaagcauaagaaacgcuacaacugucugaucaaguauaaagcugccugguuucucaaucugaccaucacaauuaucugccuuaugcugauuaaggauggcagcaugauggcugccgccgagaccaacaucgaaacauguauggcuaaacccucucucaccacggacugcaccgggccuuuccugaagauuacaaagugugaugagucccagaaagcgcugcccuuucaagagaucgccaagcagcuugugaaaagcaauguccucacccugcuggacaagcacaucguggaaaaacucccuaacgagauugcuggaucucuguccauccuugauaagaagcagcacuaccaugaacaacuggccguugaguauggcauucucagcaaauacugcgacuauuacgaacuguauaaguccaauucuggguacagccaguccacauggggaaccuaccugagaucucacgauuucgagaucugucuucuccugcccuaucaguacgugugccgguguuuuaaaagcggcacgggcugcacagacaccaaguucgaguuugaacagaaaaugaacgagacauauaauuccaagaacgauauguacaauagcgacuucacccuggcccucaccguccugcaucuugcuaugcgcgggacagccucuacguauauuaucgacaacgugcugcagaaaaauuacuccaacgucaucgaauaucucaauaccacaaagaacaacuucaagagcaaucaaguguuuggaguucugguggauuucaccauuuaccugcuuagacacgcgucuuacgcuaaauauaaccucccgcagucccugaagaaauuucggagcgucucuagcgaccugacaaccaucuccggcagaagcucugggcagaauauuguguccgaucuccaucaaggagacguuaucaagacgugccugaacauuaaacagcuuaauuguaucagcccuaagucccgcacaaccaccacaaaccugauuaccugcggcucuagccagaucuccguguacaaucucccccgggggcagcuguaugagucugucacaacggaacacggcaccugugccggagauggccacugccugacagacuucaugccuaucaacagcgauuuucuugccacccucaagaaauccaaguguuggacaaccgacauucccaauaucauuaaacugguggagucugaugggaagaucagcugccaacccauugacgugggauccuguaacguuagcggcaauaucuggacgaucaccaaaugcucugauaacaaguacuauuacacagacaauaagcauguccacgaugacgagaaagacauugggcauuauuguauggaagagaccugcaaguucgugagauuuccuaucaacgauaaauucguguccaauugugaaugggaccugaaccacauugagaucaacaagcucaaucaggucgagcuggauaacauuaaugcuuacaaaaaggugcuuacagaaaagcugaccagcucucucuccguuuuuaaauacaagcugacacagaaccugccgcacgugauccccaaauucaaguauaucaccauucagggaacgcaaacagucgacggcaucgagaauagcuuuauugaaguggagaucccugcccuuucuggggcugccuccggcuucaaaauuaugaccaaggaaaacaaugagcuguuugaugcgauccucuacguuaaacaggccagcuucuccagcauuuauaagaagaucuacaccacaggacccaccaucggcauuaacacgaaacaugacgagaagugcacaggggcuugcccugugaaucugccccacucuaccggauggcucacauucgccaaagaacgcaccagcacauggggcugugaggaauaugggugccuggcuaucaacgauggaugugucuuuggcuccugccaggacauuaucaaggaugagauguacauuuucaaaaaggaaaccgaggagguggcccuuguugaaaucuguaucucuuuuaaucauaagacguucugcaccgacguggauagcacaaccccgauuaucacagacacccuggaggcgcaauuuaaaacggucgaauccuauaagcucccuaaccacguggcccugaaacagcauaagcuguacguggggcagauuaaugauuucggcgucuacaaaaaggcuuguggaaacguucagaagaucaauaacacaauuuauggcgaggggacaccccgguuugacuaccuuugccaccuggccaaaagaaaggacgugcucgugcgcaaauguuucgauaacgacuauaauucuugcagccugcucaccaucgcugaugaccugcggcuugaagaggauggagagaagcugaaagucaucaacuacagaaaggugcucggcuccaugaaguuuaaagcccuguucggggacauucgcuauaagucuuuuaccgaagauaucgagcuggacguugaagccagcugugcuggaugcauuaauugcuucgauaacauccacugugagauuaaacuuaccaauggccuggacacauccugcagcuucgagucuuccugugaugcguuuaacagccggauccucuucaauucuaaccaacauguguacuccacgaagcugauuugcaccaaagaacagacaaaggccuuugagaucaagaucugugggaaaaccauuaaggcugaccucgucgugacagaagccaaaccuauccuggagcuuacccccauugaccagacgagcuauaucaaggaagaggauacaagaugcggcaccugguucugucgccugaccaaagagggauuuuccguucugcucgaaccuuucaagaaucuguuuggcucuuaccuugggauugccuacacaaucaucauugcucugcucugccuguucguguuuaucuauauuauccuccccaugauuaugaaacugaaggagguccuuaagcagaacgaaaucgccuaccaaaaagagcagaagaaacgguga

SEQ ID NO: 14228 - RNA, 4332 nt, Artificial Sequence
  derived and/or modified CDS sequence (opt5) from BWAV/PGAV(191B-07)__KJ867180.1__GP
augaucuacauuuauaucuucguggccauuuuucccgcuaucuacgccauuccugacagcuauuccagaugcuucaccggcgggacagucguuaaggagauguggucuaaagaugcggugacggaacuguguaucaaggacgaugugagcaucgucaaaaccgagacauccuacaagaaaaacggaaccggcacauuugcucucaauaaggugacccggaaguggcugaugacagacugggaaaaaugcaagccgcagaaaucuagcuccgggcacauuaacguuaucgaggugcgcgaugaccuuacccuggccacgucuaccuauauuuguagcuccagcugcacaaucaaugucgauagagaaaccgcccaaauucagcucaacacagacucuaucaaucauuucgagauugcuggaaccacgaucaagacaggcugguuuaaauccaccacacugguggcccuugaucagaccugugagcaccugaagguuagcugcgggaagcagucugugcaauuccaugcuuguuuuaaccagcacauguccugcguccgguuccuccaucgcaccauccugcccggaaauauggccaaaagcauuugucagaacaucgaaauuaucauucuggugggccucacaauccugaucuuucuucugcucugcauucugacgaagaccuacaucuguuauauucuucugccuaucuucauuccccucucuuacgcguacggcuauuuuuacaauaaagccugcaagaaaugcucccagugugggcugguguaucacccuuucacagagugcggaagcaacugugucugcggcgcuagauacgacaccuccgaacggaugaagcugcaccgcaucucugggcucugucccggauauaaaagccugagaacagcccggguucuuugcaaguccaagggcagcgcuucuauccuguccauucucaucagcauucugauccuuauguuugugaccccuauuaauggguacaugaucacgaacgaguucgaugagggaaaacugacaguggacucucucccggaugacaugcugagcaugauuucccgccugucugcccuccaauucaucuuuacccugaauaucgcguguagcguccuugugacccugcucacaugccuguuccuuauuaucuuuuauagauuccagcaucgguuucuguccaaguacgccauuaacuguaccgaaugcgacauguaccaccagaaaaagggccucaucuauaauggcgauuucacaaacaaauguaugacguguaccugcggggagguugacgauauggaaggacugaacaagcauaagaaacgcuacaauugccugauuaaguauaaagcugccugguuucucaaccugacaaucaccaucauuugccuuaugcugaucaaggacggcagcaugauggcugccgccgagucuaauauugaaacauguauggcuaaacccucccucaccacggauugcaccgggccuuuccugaagaucacaaagugugacgagagccagaaagcgcugcccuuucaagagauugccaagcagcuugugaaaucuaacguccucacccugcuggauaagcacaucguggaaaaacucccuaaugagaucgcuggaucccugagcauucuugacaagaagcagcacuaccaugaacaacuggccguugaguauggcauccucuccaaauacugcgauuauuacgaacuguacaagucuaacagcggguauucccagucuacauggagaaccuaccugcggagccacgacuucgagauuugucuucuccugcccuaucaguacgugugccgcuguuuuaaauccggaacgggcugcacagauaccaaguucgaguuugaacagaaaaugaaugagacauauaacagcaagaaugacauguacaacucugacuucacccuggcccucaccguccugcaucuugcuaugagaggcacagccuccacguauaucauugauaaugugcugcagaaaaacuacagcaaugucaucgaauaccucaacaccacaaagaauaacuucaagucuaaccaaguguuugggguucugguggacuucaccaucuaucugcuucggcacgcguccuacgcuaaauauaaucucccgcagagccugaagaaauuuagaucugucagcuccgaucugacaaccauuagcggacggucuuccggccagaacaucgugagcgaccuccaucaaggggauguuauuaagacgugucugaauaucaaacagcuuaacugcauuuccccucgcucuagaacaaccaccacaaaucugauuaccugcggaacaagccagaucuccguguacaaccucccccgcggccagcuguaugagucugucacgaccgaacacgggacaugugccgacgauggccacugccugaccgacuucaugccuaucaauagcgauuuucuugccacacucaagaaguccaaauguuggaccacggacauccccaacauuaucaagcugguggagucugauggaaaaauuagcugccaacccaucgacgugggcuccuguaauguuagcgggaacauuuggaccaucacaaagugcucugauaauaaauacuauuacaccgacaacaagcauguccacgacgaugcuaaggacaucggacauuacuguauggaggaaacaugcaaauucgugcgguuuccuauuaaugauaaguucguguccaacugugagugggaccugaaucacaucgaaauuaacaaacucaaccaggucgagcuggauaauaucaacgccuauaagaaagugcuuaccgagaagcugacaagcucucucuccguuuuuaaguacaaacugacccagaaucugccgcacgugauucccaaguucaaauauaucacgauccagggcacacaaaccgucgacgggauugaaaacagcuuuaucgagguggaaauuccugcucuuucuggagccgcguccggcuucaagaucaugaccaaagagaauaacgaacuguuugaugccauucucuacguuaagcaggcuagcuucuccagcaucuauaaaaagauuuacacaaccgggcccacgaucggcaucaauacaaagcaugacgagaaaugcaccggagccuguccugugaaccugccccacaauacaggcuggcucaccuucgcuaaggagagaacaucuaccugggggugcgaagaguauggaugccuggccauuaacgauggcugugucuuugggagcugccaggacaucauuaaagaugaaauguacaucuucaagaaagagacggaagagguggcgcuuguugagauuuguaucuccuuuaaucauaagaccuucugcacagacguggauucuaccacaccgaucauuaccgacacgcuggaagcccaauuuaagacagucgagagcuacaaacucccuaaccacguggcucugaagcagcauaaacuguaugugggacagaucaaugacuucggcgucuacaagaaagccugugggaacguucagaagauuaauaacaccaucuauggcgaaggaacaccccgcuuugauuaccuuugccaccuggcuaagcggaaagacgugcucgugagaaaguguuucgauaacgacuauaauuccugcucucugcucaccauugccgaugaccugcgccuugaggaagauagcgagaaacugaaggucaucaacuaccggaaagugcucggcuccaugaaguuuaaggcccuguucggggacaucagauauaaaucuuuuaccgaggauauugaacuggacguugaggcuagcugugcgggaugcaucaauuguuucgauaacauucacugcgaaaucaaacuuacaaauggccuggacacguccugcagcuucgagucuuccugugacgccuuuaacagccgcauucucuucaauucuaaccaacauguguacuccaccaaacugaucugcacaaaggagcagaccaaggcuuuugaaauuaagaucugugggaagacaaucaaagccgaucucgucgugaccgaggccaagccuauucuggaacuuacgcccaucgaccagacaagcuacauuaaagaggaagauacccggugcggaaccugguucuguagacugacaaaggagggcuuuuccguucugcucgagccuuucaaaaaucuguuugggucuuaucuuggcaucgcuuacaccgugauuaucgcccugcucugccuguucgucuuuaucuauauuauccuccccaugauuaugaagcugaaagaagugcuuaagcagaacgagaucgcguaccaaaaggaacagaaaaagcgguga

SEQ ID NO: 14229 - RNA, 4326 nt, Artificial Sequence
  derived and/or modified CDS sequence (opt5) from CEV(283)__KX817313.1__GP
augaucuucaugcugauucucuuugccguggcugccgcgagccccgucuaccagagaugcuuccaagacggcgcuaucguuaagcagaacccuuccaaagaggccgugaccgaagugugucugaaggaugacgucucuaugauuaaaacagaggcccgguauacgaagaauagcaccgggguguuuuccaacaauguugcuauccgcaaauggcuugugucugauuggcacgacugcagaccgcggaaggucgugggaggccauauuaacguuaucgaagugggggaugaccugacacuccacaccgagagcuacgucuguuccgccgauugcacaaucggaguggacaaggaaaccgcucaggugcgccugcagacagauaccacgaaucauuucgagauugccggcaccacagucaaaucugggugguuuaagagcaccacauauaucucccuugaccaaaccugugagcaccugaaaguuagcugcggacccaagucuauucaguuccaugcguguuuuaaccagcacauguccugcgugagauuccuccaccggacgauccugccuggcagcauugccaauucuaucugucagaacguggaaauuaucauccuggucacacucgcucugcuuauuuuuauccugcucuccauuaucagcaaaaccuacauuugcuaucugcuuaugcccaucuucaucccuauugccuacaucuauggccugauuuacaauaagucuuguaagaaaugcaagcucugcgggcugguguaccaucccuuuacagaguguggaacccacugcguuuguggcgcucgcuaugauaccuccgacagaaugaaacugcaucgggccagcgggcucugcccuggauacaagucccugcgcgcggccagagugauguguaaaucuaagggcccggcuagcauccuuuccauuaucacagccguccugauccucacguucgugacccccauuaacgcuaugaugguuggggaaagcaaagagacauuugagcuggaagaacuuccugaugacaugcuggaaauggccaauaaccucaauaccuauuacaugcugugcguggccaacuaugcugucacauggucucugcucaucguggcgcugauuaucggacuucuguucaagaaguaccaacaccgguuccucgacauuuaugccauguacugugaggaaugcgauauguaccacgaccgcuccggcaucaaauggaauggcgauuuuaccaacaagugugggcauugcacguguggacaguaugaggacgcuagcggccugcuuguccacagaaaaacauacaacugccugauucaguauaagucuaaauggaucaugaauuuccucgugaccuacguuauccuggugcugcucaaggauagcgucgugauuguucaggccaaggggguggacuuuuccgagugcaucgaagccgagaaaguccgguggaacuguaccggacccuucgugaaucugggcaacugcgaaaagaaacaaaagaaagagccuuauucuaauauugcugcccagcuuaaggggcugggagcgaucagcauucucgaugugcccaucaucgcuuccauuccggaagacaucgccggcgcccugcgcuacauugaggaucagagaagcuaucauucucaacugacaguugaguacgcuaugcuuacccgguacugugacuauuacacacaguuuuccgauaacagcggcuauucucagacgaccuggagagucuaccuccgcucccacgacuucgaagccugcgugcuguauccuaaucagcauuuuugucggugcgugaagcacggggacaaauguagcuccucuaacugggauuucgcuagcgagaugaagaauuacuauuccggaaaacaaucuaaguuugacaaagaucugaaccucgcccugacaagccuucaccaugcguucagaggcaccuccagcucuuacaucgccgggcugcucuccagcaaggcuaaugacgaacugguccaguacacaucuaagauucgcgagaaauuucccggaaacgcccugcuuaaggcugugaucgauuauaucgccuacaugaaaggccucaccgaaauguccaauuucaagaaagacgaguuuugggaugagcugguuuaugugccugaccccacgaagcccccuaaacugagccggucuagcgggaccgucuacgauuucaaguccgcgacaagcaaccucggcgaaaagaauugcaaagacgugaagggaguugugugucugucuccgagauccggcgucaccuaugauagcauuaucgccugcggggagggauccucucccaacauuuaccgcaucccuaaaacaggcguguaucagagcaacuccgaacccucuaauuacuguguuagcgacucccacugccuugaggauuucgaggugauuaaccaggaggagcuggacgcuaucaagaaaucucggugcugggaagucgacuaccucuaugccaauccuagcaagcaauccgaugggaucagaagcugucgcaugcgggacgcuggacauugcaacgugaccacgaauagauggcccauuauccagugugaugacaacaaguacuauuacucugagcugcagcgcgauuaugacaaagaacaggauauuggccacuuuugccuguccccgcgguguacaaccgugagauucccuauccaccccaagcaugucagcaauugcgacuggcaaguuucucacuccacaguggauaaaguggacguccauaaccuugaggauauugagcaguaccggaaggccaucacccagaaacuccagaauagccugucuauuuuuaaguaugcccgcaccaagaaccugccucacaucaaacccaucuacaaguacauuacaaucgaagggacggagaccgcugaaggcauugaguccgcguauaucgaaagcgagauuccugcccucgcuggaacauccaucggcuucaaaaucaauaccaaggaggggaaacaucugcuugacgugauugccuacguuaagcaagccagcuauucuagccuguacaacaagauguaugugacaggacccaccgucggcaucaauacgaaacacgaugaacucuguacagggccgugcccugugaacguuccccacuccgacggauggcugaccuuugcuagagagcggaccucuagcuggggcugugaagaguucgggugccuggccauuuccgacggcuguguguuuggaucuugccaggaucuuaucaaggaggaacucgcggucuacagaaaagagacagaagaggcuaccaauguggaacugugccugacauucagcgacaagacguauuguaccgagcucaaccccauuacaccuaucaucaccaaccuguuugagguucaguucaaaacaguggaaaccuacucccuuccgcgcgucguggccgugcaaaaucaugagauucggaucggccagauuaacgaucuggggaucuacucuaagggaugcggcaauguccagaaaguuaacaauacgauuuaugggaacggagugcccaaguuugacuaccucugucaccuggccagcagaaaggaagugaucguccgcaaaugcuucgauaaugacuuucaggcuuguaaguuccugcaauccccucccagcuauagacuugaggaagaugacggcucuauuaccgugaucgauuacaaaaagauccuggggacaauuaaaaugaaggccauccucggcgacguuaaguauaaaaccuucgcggagaacauugauaucacagcugagggagugugcaccggcugugucaauugcuuugaaaacauucauugugagcugacaauccacaccacgaucgaagccuccugcccugugacaagccccuguacccucuuccaugaccggauucugaucaccccugacgagcacaaguacgccaugaaaguuauuugcacagaaaagcagaccgggacgcuucccuuuaaaaucugcaauucuaagguggaugcuacacugacccucgucgaggccaagccgauucuggagcuggcuuccguggaccagacagccuauauccgcgaaaaagaugagagauguaagaccuggaugugccggguccgcgacgaaggaauccaggugauucuugagccuuucaaaaaccuguuuggcagcuacaucgggauuuucuacacauccauccucauuguuaucaccauuuuuaucaucauuuaugugauccugcccauuuguuucaagcucaaagauacgcugcaaaagcacgaagacgcguacaagagagagaugaaaauccgguga

SEQ ID NO: 14230 - RNA, 4326 nt, Artificial Sequence
  derived and/or modified CDS sequence (opt5) from CEV(BFS283)__AF123483.1__GP
augaucuucauucugauccucuuugccguggcugccgcgagccccgucuaccagagaugcuuccaagacggcgcuauuguuaagcagaacccuuccaaagaggccgugaccgaagugugucugaaggaugacgucucuaugaucaaaacagaggcccgguauacgaagaauagcaccgggguguuuuccaacaauguugcuauucgcaaauggcuugugucugauuggcacgacugcagaccgcggaaggucgugggaggccauaucaacguuaucgaagugggggaugaccugacacuccacaccgagagcuacgucuguuccgccgauugcacaauuggaguggacaaggaaaccgcucaggugcgccugcagacagauaccacgaaucauuucgagaucgccggcaccacagucaaaucugggugguuuaagagcaccacauauauuucccuugaccaaaccugugagcaccugaaaguuagcugcggacccaagucuauccaguuccaugcguguuuuaaccagcacauguccugcgugagauuccuccaccggacgauucugccuggcagcaucgccaauucuauuugucagaacguggaaaucaucauucuggucacacucgcucugcuuaucuuuauucugcucuccaucauuagcaaaaccuacaucugcuaucugcuuaugcccaucuucauuccuaucgccuacauuuauggccugaucuacaauaagucuuguaagaaaugcaagcucugcgggcugguguaccaucccauuacagaguguggaacccacugcguuuguggcgcucgcuaugauaccuccgacagaaugaaacugcaucgggccagcgggcucugcccuggauacaagucccugcgcgcggccagagugauguguaaaucuaagggcccggcuagcauccuuuccaucauuacagccguccugauccucacguuugugacccccauuaacgcuaugaugguugggggaagcaaagaaacauucgagcuggaggaacuuccugaugacaugcuggagauggccaauaaccucaauaccuauuacaugcugugcgugacaaacuaugccgucaccuggucucugcucaucauugcucuggcgaucggccuucuguuuaagcgguaccaacaccgcuuccucgacauuuaugccauguacugugaagagugcgauauguaccacgacagauccggcaucaaguggaauggggauuucacgaacaaauguggacagugcacauguggccaguaugaagacgcuagcgggcugcuugugcaucggaagaccuacaacugccugauccaguauaaaucuaaguggauuaugaauuuucucaucaccuacgucauucuggugcugcucaaagauagcguugugaucguccaagccaagggaacagacuucuccgagugcauugaugccgacaagaucaaauggaacuguaccggccccuuugugaaucuggggaacugcgagaagaaacagaagaaagaaccuuauucuaauaucgcugcccagcuuaagggacugagcgcgauuuccauccucgauguucccauuaucgcuagcauuccggaggacaucgccggcgcccugcgcuacaucgaagaucaaagaucuuaucacucccagcugacaguggaguacgcuaugcuuacgcgguacugugacuauuacacccaguucagcgacaacucuggcuauucccagacaaccuggagagucuaccuccgcagccauguguuugaagccugcauucuguauccuaaucaacacuucugucggugcgugaagcauggggauaaauguuccucuagcaacugggacuuugcuuccgagaugaagaauuacuauucuggaaaacagaacaaguucaauaaagaucugaaccucgcccugacaagccuucaccacgcguuuagaggcaccuccagcucuuacaucgccgggcugcucuccacgaaggcuaaugacgagcugguucaguacaccagcaagauucgcgaaaaauuccccggaaacgcccugcuuaaggcuaucauugauuauaucgccuacaugaaaggccucacagagaugucuaauuuuaagaaagacgaauuuugggaugagcuggucuaugugccugaccccaccaagcccccuaaacugucccgggggagcgaaacaguguacgauuuuaagucugcgaccagcaaccucggcgagaagaacugcaaagacgucaagggagugguuugucuguccccgagaagcggcgugacguaugauucuaucauugccugcggggagggauccagccccaauaucuacaaaauuccuaagacaggcgucuaucaguccaacucugaacccagcaauuacuguguguccgacucucauugccuugaggauuucgaaguuaucagccaagaggagcuggacgcuauuaaaaagucccgcugcugggaaguggacuaccucuaugccaacccucccaagcagucugaugggguccggagcuguagaaugaaagacgcuggacacugcaaugugaccacaaaccgcuggccgaucauucagugugaugacaauaaguacuauuacuccgagcugcagcgggauuaugacaaagaacaagauaucggccauuucugccugagcccuagaugugccaccguucgcuuucccauccacccuaagcacauuucuaacugcgacuggcaggucucccauagcaccguggauaaagugaaugugcacaaccuugaggacaucgaacaguaccggaaggccauuacacagaagcuccaaaauucucuguccaucuucaaauaugcuagaacgaagaaccugccccauauuaaaccuaucuacaaguacaucaccauugaggggacagagaccgcggaaggcaucgagagcgccuauauugaaucugagauccccgcucucgccggaacauccauuggcuuuaaaaucaauaccaaggaagggaagcaucugcuugaugucaucgccuacguuaaacaggcuagcuauuccagccuguacaacaagauguaugugacgggaccgacagugggcauuaauaccaaacacgacgagcucuguaccgggccuugccccgucaacgugccccacucugauggauggcugacauucgcccgggagcgcaccagcuccuggggcugugaagaguuugggugccuggcgaucucugacggcuguguuuucggaagcugccaggaccuuauuaaggaggaacucacaguguacagaaaagaaacggaggaggcuaccaacgucgaacugugccugacauuugccgauaagaccuauuguacagagcucaauccugugaccccgaucauuacgaaccuguucgaaguucaauuuaaaaccguggagacauacucccuuccccgggucguggccguucagaaucacgagaucagaauuggccagaucaacgaccuggggguguacucuaagggaugcggcaauguccagaaggugaacaauaccaucuaugggaacggagugccuaaauucgauuaccucugucaucuggcuagccgcaaggaagucauuguucggaaaugcuuugacaaugauuuccaagccuguaaguuucugcagucucccccuuccuauagacuugaggaagacgauggcagcaucacagugauugacuacaaaaagauccuggggaccauuaagaugaaagcgauccucggcgaugugaaguauaaaacauucgcugagaacaucgacauuaccgccgaaggagucugcacgggcuguaucaauugcuucgagaacauucacugugagcugacaauccauaccaccauugaagccuccugccccgugacaagcccuuguacccucuuucacgaucgcauccugaucacgcccgacgagcauaaguacgcuauuaaaguuaucugcacagaaaagcagaccgggacacuuccguucaagauuugcaauucuaaaaucgacgccacccugacacucguggaggcuaagccuauucuggaacuggcccccgucgaucagaccgcguauaucagagagaaagacgagcgguguaagacguggauguaccgcgugagagaugaaggcauucaaguuauccuugagccuuuuaaaaaccuguucggauccuacaucgggauuuucuauaccagcauccucguggucauugccauguucaucauuguguacgucauccugcccaucugcuuuaagcucaaggacacacugcagcggcacgaagaugcuuauaaacgcgagaugaagauuagauga

SEQ ID NO: 14231 - RNA, 4329 nt, Artificial Sequence
  derived and/or modified CDS sequence (opt5) from CHATV(Mohko ILO8-3)__KF719222.1__GP
augaugaucuucauucugauccucuuugccgugagcgcugccucccccgucuaccagagaugcuuccaagacggcgcgauuguuaagcagaacccuucuaaagaggcugugaccgaagugugucugaaggaugacgucagcaugaucaaaacagaggcccgguaugugaagaaugccacggggauuuacuccaacaauguugcuauccgcaaauggcuugugucugauuggcacgacugcagaccgcggaaggucagcggaggccauaucaacgugauugaaguuggggaugaccugucccuccacaccgagucuuauguguguagcgccgauugcacaaucggagucgacaaggaaaccgcucaggugcgccugcagacagauaccacaaaucauuuugagauugccggcaccacggugaaauccgggugguucaagagcaccacauacaucacccuugaccaaacaugugagcaccugaaagucucuugcggacccaaguccguucaguuucaugcguguuucaaccagcacaugagcugcgugagauuucuccaccggaccauucugccuggcucuaucgccaauuccauuugucagaacaucgaaaucauuauccuggugacgcucacacugcuuauuuucguccugcucagcauccugucuaaaaccuauauuugcuaccuucugaugcccaucuuuaucccuauugcuuauaucuacggcauuaucuacaauaaguccuguaagaaaugcaagcucugcgggcugguguaucaucccuucacagaguguggaacccacugcguuuguggcgcccgcuacgauaccagcgacagaaugaaacugcaucgguccucugggcucugcccuggauauaagagccugcgcgcugccagagugauguguaaauccaagggcccggcgagcauucuuucuaucaucacagccauucugguccucacguuugugacccccaucaacuccaugguuauuggggaaagcaaagagguguucgagcuggaggaacuuccugaugacaugcuggaaauggcucucaagaucaaucuguacuauuuugucugcgugauuaacuacgccgucacauggucucuggugaucguugcucuccugauugcccuuaucuucaagaaauaucaacaccgguuccugaaucucuacgccauguacugugaggaaugcgacauguaucacgaucgcaucggacugaagagaaacggcgacuuuaccaauaaaugucggcagugcacauguggccaguacgaggaugcuaccgggcuuaugacgcaucgcaagacauauaacugccuggugcaguacaaaagcaaguggauucucaacuuccugaucaccuauaugauucugacccucaucaaggacuccgcgauuaucguccaagccgcuggaacagauuuuucugccugccuggaggcccagagcguggacuggaauuguaccggccccuuccuuaaccuggggaauugccagaaacaacagaagaaagaauccuacgcuaacaucgccacacagcucaagggacugcaggcgauuagcguucuggaugugccuaugaucgcuaauauucccgaggacaucgccggcgcccuuagauauauugaagagaaagauacguuucacguccaacucaccgcugaauacgccaugcugacacgguacugugacuauuacacccaguucgcugauaacucuggguauucccagacaaccuggagaguguaccugcgcagccaugacuuugacgccugcauccucuauccgaaucagcacuucugucggugcgugaagcauggagauaaguguucuuccagcaacugggacuuugcgaaugagaugaaaaacuacuauuccggcaagcaaaauaaauucgauaaggaccugaaccuugcccugauggcuguucaccacgccuuuagaggcacgucuagcgcuuacaucgccaccaugcucuccaaaaagucuaauaacgaucuggucacauacaccaauaagauuaaagagaaguucccugggaacgcgcugcuuaaagccaucauggacuauauuagcuacaugaagggacucuccgaaaugacaaacuuuaaauaugaugaguucugggacgaucugcugcauaagcccagcccuaccaaugcuccuccccucucucgcgacuccgaacccagcuacaacuucaaaucugugaucuccagccggucugucaagagcugcaagaaugugaaaaacgugguuugucuguccccgagaagcggcgugucuuaugauuccauucuugccugcggggagcccaauggaccuagcgucuacaagaaacccuccgacggcguguuucagucuaacagcgauaagacgauguauugucuggcugacucccacugccucgaagacuucgagguugugucucaggaggaacuggaugccaucaaaaagagcaagugcugggucacagaguacccuaaugugaaacuguccaaacuuucugacgggaucaccagcugucgcaugaaggauuccggcaagugcaacguugccgcuaaucgguggcccauuauccagugugaaaacgacaaauuuuacuauagcgagcuccaaaaugauuacgacaagacacaggauauuggacauuucugccugucuccgggcuguuccaccaucagauuuccuauuaaccagaagcacaucagcaauugcaacuggcaagugucucgcuccagcauugcgaaaaucgacguccacgauaucgaggacauugaucaguaucggaaggccaucacccagaaacugcagacagggcucucucuguucaaguacgcuaaaacgaagaaucuuccccauauuaagccuaucuauaaauacauuaccaucgaaggaacagagaccgccgaaggcaucgaguccgccuauauugaaagcgagauccccgcucuggccgggacauccauuggauuuaagaucaacagcaaagagggcaagcaccuccuggacauugugggguacgugaaaucugcgagcuacuccucugucuauaccaagcuguacagcacgggcccuacauccggaaucaacaccaaacaugaugaacuuuguaccggccccugcccgguuaauaucaaccaccaaacaggguggcucaccuucgcuaaggagagaacaucuagcuggggaugugaagaguuuggcugccuggccauuuccgacggguguguguucggaucuugccaggacaucgugcgcgaugaacugagcgucuaucggaaggagacggaggaagugaccgacguugagcucugccugacauuuuccgauaaaaccuacuguacaaaucuuaacccuauuacccccaucauuacggaccuguucgaagugcaguuuaagaccgucgagacauauagccuccccagaaucguggccauucagaaucaugaaguuaaaaucggccaaaucaacgaucuggggguguacucuaagggcugcggaaauguccagaaagugaacggcaccguuuaugggaauggagugccuaaguucgacuaccugugucaccuugcuucccggaaggaggucauugugcgcaaaugcuucgauaacgacuaccaggccuguaaguuucugcagacaccggcgagcuauagacucgaggaaucuuccggcaccgugacagucaucgauuacaaaaagauucuggggaccaucaaaaugaaggcuauucucggagacguuaaguauaaaacguucgccgauaauguggacaugacagccgagggcagcugcgcuggguguaucaacugcuuugaaaauauccacugugagcugacccuucauaccacaauugacgccuccugccccgugaccucuccuuguacggucuuccacgaucggauccugauuacacccaacgagcauaaguacgcuaugaaagugaucugcaccgaaaagccuggcaauacacucaccauuaaaaucugcggaacaaagaucgacgccagccuggcgcugauugaugccaagcccauccuugagcuggcuccuguugaccaaaccgccuauauuagagaaaaagaugagcgcuguaagacguggaugugccgggugagagacgaaggccuccaggucauccuggagcccuuuaaaaaccucuucggguccuacauuggaaucuuuuauaccuucauuaucuguaucauugugcugcuuaucguuauuuacaucgugcugccgauuugcuuuaagcuccgcgauacacugagacagcacgaggacgcuuacaaacgggaaaugaagauccgcuga

SEQ ID NO: 14232 - RNA, 4329 nt, Artificial Sequence
  derived and/or modified CDS sequence (opt5) from CHATV(Mohko M07-1)__KF719225.1__GP
augaugaucuucauucugauccucuuugccgugagcgcugccucccccgucuaccagagaugcuuccaagacggcgcgauuguuaagcagaacccuucuaaagaggcugugaccgaagugugucugaaggaugacgucagcaugaucaaaacagaggcccgguaugugaagaaugccacggggauuuacuccaacaauguugcuauccgcaaauggcuugugucugauuggcacgacugcagaccgcggaaggucagcggaggccauaucaacgugauugaaguuggggaugaccugucccuccacaccgagucuuauguguguagcgccgauugcacaaucggagucgacaaggaaaccgcucaggugcgccugcagacagauaccacaaaucauuuugagauugccggcaccacggugaaauccgggugguucaagagcaccacauacaucacccuugaccaaacaugugagcaccugaaagucucuugcggacccaaguccguucaguuucaugcguguuucaaccagcacaugagcugcgugagauuucuccaccggaccauucugccuggcucuaucgccaauuccauuugucagaacaucgaaaucauuauccuggugacgcucacacugcuuauuuucguccugcucagcauccugucuaaaaccuauauuugcuaccuucugaugcccaucuuuaucccuauugcuuauauguacggcaucauuuacaauaaguccuguaagaaaugcaagcucugcgggcugguguaucaucccuucacagaguguggaacccacugcguuuguggcgcccgcuacgauaccagcgacagaaugaaacugcaucgguccucugggcucugcccuggauauaagagccugcgcgcugccagagugauguguaaauccaagggcccggcgagcauccuuucuauuaucacagccauccugguccucacguuugugacccccauuaacuccaugguuaucggggaaagcaaagagguguucgagcuggaggaacuuccugaugacaugcuggaaauggcucucaagauuaaucuguacuauuuugucugcgugaucaacuacgccgucacauggucucugauuaucguggcucuccugauugcccuuaucuucaagaaauaucaacaccgguuccugaaucucuacgccauguacugugaggaaugcgacauguaucacgaucgcaucggacugaagagaaacggcgacuuuaccaauaaaugucggcagugcacauguggccaguacgaggaugcuaccgggcuuaugacgcaucgcaagacauauaacugccugguucaguacaaaagcaaguggauucucaacuuccugaucaccuauauggugcugacccucauuaaggacuccgcgaucauuguccaagccgcuggaacagauuuuucugccugccuggaggcccagagcguggacuggaauuguaccggccccuuccuuaaccuggggaauugccagaaacaacagaagaaagaauccuacgcuaacaucgccacacagcucaagggacugcaggcgaucagcguucuggaugugccuaugauugcuaauauccccgaggacauugccggcgcccuuagauauaucgaagagaaagauacguuucacguccaacucaccgcugaauacgccaugcugacacgguacugugacuauuacacccaguucgcugauaacucuggguauucccagacaaccuggagaguguaccugcgcagccaugacuuugacgccugcauucucuauccgaaucagcacuucugucggugcgugaagcauggagauaagugugggucuuccaacagagacuuugcgaaugagaugaaaaacuacuauagcggcaagcaaaauaaauucgauaaggaccugaaccuugcccugauggcuguucaccacgccuuucgcggcacguccucugcuuacaucgccaccaugcucagcaaaaaguccaauaacgaucuggucacauacaccaauaagaucaaagagaaguucccuggaaacgcgcugcuuaaagccauuauggacuauaucucuuacaugaagggccucagcgaaaugacaaacuuuaaauaugaugaguucugggacgaucugcugcauaagcccuccccuaccaaugcuccuccccucagccgggacucugaacccuccuacaacuucaaaagcgugauuucuuccagaagcgugaagucuugcaagaaugucaaaaacgugguuugucugagcccgcgcuccggggugagcuaugauucuauccuugccugcggagagcccaauggcccuuccgucuacaagaaacccagcgacgggauuuuucaguccaacucugauaagacgauguauugucuggcugacagccacugccucgaagacuucgaggugguuucccaggaggaacuggaugccaucaaaaagucuaagugcugggugacagaguacccuaaugucaaacugagcaaacuuuccgacggcaucaccucuugucggaugaaggauagcggaaagugcaacguggccgcuaauagauggcccauuauccagugugaaaacgacaaauuuuacuauuccgagcuccaaaaugauuacgacaagacacaggauauuggccauuucugccugagcccgggguguucuaccauccgcuuuccuauuaaccagaagcacaucuccaauugcaacuggcagguuagccggucuuccauugcgaaaaucgacgugcacgauaucgaggacauugaucaauauagaaaggccaucacccagaaacugcagacaggacucagccuguucaaguacgcuaaaacgaagaaucuuccccauauuaagccuaucuauaaauacauuaccaucgaaggcacagagaccgccgaagggaucgagucugccuauauugaauccgagauccccgcucuggccggaacaagcauuggcuuuaagaucaacuccaaagaggggaagcaccuccuggacauugucggcuacgugaaaagcgcgucuuacagcuccguguauaccaagcuguacucuacgggaccuacaagcggcaucaacaccaaacaugaugaacuuuguaccgggcccugcccggucaauaucaaccaccaaacaggauggcucaccuucgcuaaggagcgcacauccucuuggggcugugaagaguuugggugccuggccauuagcgacggauguguuuucggcuccugccaggacaucgugcgggaugaacugucuguguauagaaaggagacggaggaagucaccgacguggagcucugccugacauuuagcgauaaaaccuacuguacaaaucuuaacccuauuacccccaucauuacggaccuguucgaaguucaguuuaagaccguggagacauauucccucccccggaucgucgccauucagaaucaugaagugaaaaucgggcaaaucaacgaucugggcguuuacagcaagggaugcggcaaugugcagaaagucaacgggaccguguauggaaauggcguuccuaaguucgacuaccugugucaccuugcuucucgcaaggaggugauugucagaaaaugcuucgauaacgacuaccaggccuguaaguuucugcagacaccggcguccuaucggcucgaggaaaauagcgggaccgugacagugaucgauuacaaaaagauucugggaaccaucaaaaugaaggcuauucucggcgacgucaaguauaaaacguucgccgauaacguugacaugacagccgaggggucuugcgcuggcuguaucaauugcuuugaaaacauccacugugagcugacccuucauaccacaauugacgccuccugccccgugaccagcccuuguacgguguuccacgauagaauccugauuacacccaaugagcauaaguacgcuaugaaagucaucugcaccgaaaagccuggaaacacacucaccauuaaaaucugcggcacaaagaucgacgccucccuggcgcugauugaugccaagcccauccuugagcuggcuccuguggaccaaaccgccuauauucgcgaaaaagaugagcgguguaagacguggaugugcagaguucgcgacgaagggcuccaggugauccuggagcccuuuaaaaaccucuucggaucuuacauuggcaucuuuuauaccuucauuaucuguaugaucguccugcuuauugugaucuacauuguucugccgaucugcuuuaagcucagagauacacugcggcagcacgaggacgcuuacaaacgcgaaaugaagauuagauga

SEQ ID NO: 14233 - RNA, 4329 nt, Artificial Sequence
  derived and/or modified CDS sequence (opt5) from CHATV(Mohko M07-2-83)__KF719228.1__GP
augaugaucuucauucugauccucuuugccgugagcgcugccucccccgucuaccagagaugcuuccaagacggcgcgauuguuaagcagaacccuucuaaagaggcugugaccgaagugugucugaaggaugacgucagcaugaucaaaacagaggcccgguaugugaagaaugccacggggauuuacuccaacaauguugcuauccgcaaauggcuugugucugauuggcacgacugcagaccgcggaaggucagcggaggccauaucaacgugauugaaguuggggaugaccugucccuccacaccgagucuuauguguguagcgccgauugcacaaucggagucgacaaggaaaccgcucaggugcgccugcagacagauaccacaaaucauuuugagauugccggcaccacggugaaauccgggugguucaagagcaccacauacaucacccuugaccaaacaugugagcaccugaaagucucuugcggacccaaguccguucaguuucaugcguguuucaaccagcacaugagcugcgugagauuucuccaccggaccauucugccuggcucuaucgccaauuccauuugucagaacaucgaaaucauuauccuggugacgcucacacugcuuauuuucguccugcucagcauccugucuaaaaccuauauuugcuaccuucugaugcccaucuuuaucccuauugcuuauauguacggcaucauuuacaauaaguccuguaagaaaugcaagcucugcgggcugguguaucaucccuucacagaguguggaacccacugcguuuguggcgcccgcuacgauaccagcgacagaaugaaacugcaucgguccucugggcucugcccuggauauaagagccugcgcgcugccagagugauguguaaauccaagggcccggcgagcauccuuucuauuaucacagccauccugguccucacguuugugacccccauuaacuccaugguuaucggggaaagcaaagagguguucgagcuggaggaacuuccugaugacaugcuggaaauggcucucaagauuaaucuguacuauuuugucugcgugaucaacuacgccgucacauggucucugauuaucguggcucuccugauugcccuuaucuucaagaaauaucaacaccgguuccugaaucucuacgccauguacugugaggaaugcgacauguaucacgaucgcaucggacugaagagaaacggcgacuuuaccaauaaaugucggcagugcacauguggccaguacgaggaugcuaccgggcuuaugacgcaucgcaagacauauaacugccugguucaguacaaaagcaaguggauucucaacuuccugaucaccuauauggugcugacccucauuaaggacuccgcgaucauuguccaagccgcuggaacagauuuuucugccugccuggaggcccagagcguggacuggaauuguaccggccccuuccuuaaccuggggaauugccagaaacaacagaagaaagaauccuacgcuaacaucgccacacagcucaagggacugcaggcgaucagcguucuggaugugccuaugauugcuaauauccccgaggacauugccggcgcccuuagauauaucgaagagaaagauacguuucacguccaacucaccgcugaauacgccaugcugacacgguacugugacuauuacacccaguucgcugauaacucuggguauucccagacaaccuggagaguguaccugcgcagccaugacuuugacgccugcauucucuauccgaaucagcacuucugucggugcgugaagcauggagauaagugugggucuuccaacugggacuuugcgaaugagaugaaaaacuacuauagcggcaagcaaaauaaauucgauaaggaccugaaccuugcccugauggcuguucaccacgccuuuagaggcacguccucugcuuacaucgccaccaugcucagcaaaaaguccaauaacgaucuggucacauacaccaauaagaucaaagagaaguucccuggaaacgcgcugcuuaaagccauuauggacuauaucucuuacaugaagggccucagcgaaaugacaaacuuuaaauaugaugaguucugggacgaucugcugcauaagcccuccccuaccaaugcuccuccccucagccgcgacucugaacccuccuacaacuucaaaagcgugauuucuucccggagcgugaagucuugcaagaaugucaaaaacgugguuugucugagcccgagauccggggugagcuaugauucuauccuugccugcggagagcccaauggcccuuccgucuacaagaaacccagcgacgggauuuuucaguccaacucugauaagacgauguauugucuggcugacagccacugccucgaagacuucgaggugguuucccaggaggaacuggaugccaucaaaaagucuaagugcugggugacagaguacccuaaugucaaacugagcaaacuuuccgacggcaucaccucuugucgcaugaaggauagcggaaagugcaacguggccgcuaaucgguggcccauuauccagugugaaaacgacaaauuuuacuauuccgagcuccaaaaugauuacgacaagacacaggauauuggccauuucugccugagcccgggguguucuaccaucagauuuccuauuaaccagaagcacaucuccaauugcaacuggcagguuagccggucuuccauugcgaaaaucgacgugcacgauaucgaggacauugaucaauaucgcaaggccaucacccagaaacugcagacaggacucagccuguucaaguacgcuaaaacgaagaaucuuccccauauuaagccuaucuauaaauacauuaccaucgaaggcacagagaccgccgaagggaucgagucugccuauauugaauccgagauccccgcucuggccggaacaagcauuggcuuuaagaucaacuccaaagaggggaagcaccuccuggacauugucggcuacgugaaaagcgcgucuuacagcuccguguauaccaagcuguacucuacgggaccuacaagcggcaucaacaccaaacaugaugaacuuuguaccgggcccugcccggucaauaucaaccaccaaacaggauggcucaccuucgcuaaggagagaacauccucuuggggcugugaagaguuugggugccuggccauuagcgacggauguguuuucggcuccugccaggacaucgugcgcgaugaacugucuguguaucggaaggagacggaggaagucaccgacguggagcucugccugacauuuagcgauaaaaccuacuguacaaaucuuaacccuauuacccccaucauuacggaccuguucgaaguucaguuuaagaccguggagacauauucccuccccagaaucgucgccauucagaaucaugaagugaaaaucgggcaaaucaacgaucugggcguuuacagcaagggaugcggcaaugugcagaaagucaacgggaccguguauggaaauggcguuccuaaguucgacuaccugugucaccuugcuucucggaaggaggugauuguccgcaaaugcuucgauaacgacuaccaggccuguaaguuucugcagacaccggcguccuauagacucgaggaaaauagcgggaccgugacagugaucgauuacaaaaagauucugggaaccaucaaaaugaaggcuauucucggcgacgucaaguauaaaacguucgccgauaacguugacaugacagccgaggggucuugcgcuggcuguaucaauugcuuugaaaacauccacugugagcugacccuucauaccacaauugacgccuccugccccgugaccagcccuuguacgguguuccacgaucggauccugauuacacccaaugagcauaaguacgcuaugaaagucaucugcaccgaaaagccuggaaacacacucaccauuaaaaucugcggcacaaagaucgacgccucccuggcgcugauugaugccaagcccauccuugagcuggcuccuguggaccaaaccgccuauauuagagaaaaagaugagcgcuguaagacguggaugugccggguuagagacgaagggcuccaggugauccuggagcccuuuaaaaaccucuucggaucuuacauuggcaucuuuuauaccuucauuaucuguaugaucguccugcuuauugugaucuacauuguucugccgaucugcuuuaagcuccgcgauacacugagacagcacgaggacgcuuacaaacgggaaaugaagauucgcuga

SEQ ID NO: 14234 - RNA, 4326 nt, Artificial Sequence
  derived and/or modified CDS sequence (opt5) from CHATV(LEIV-15854)__HQ734820.1__GP
augaucuucauucugauccucuuugccgugagcgcugccucccccgucuaccagagaugcuuccaagacggcgcgauuguuaagcagaacccuucuaaagaggcugugaccgaagugugucugaaggaugacgucagcaugaucaaaacagaggcccgguaugugaagaaugccacggggauuuacuccaacaauguugcuauccgcaaauggcuugugucugauuggcacgacugcagaccgcggaaggucagcggaggccauaucaacgugauugaaguuggggaugaccugucccuccacaccgagucuuauguguguagcgccgauugcacaaucggagucgacaaggaaaccgcucaggugcgccugcagacagauaccacaaaucauuuugagauugccggcaccacggugaaauccgggugguucaagagcaccacauacaucacccuugaccaaacaugugagcaccugaaagucucuugcggacccaaguccguucaguuucaugcguguuucaaccagcacaugagcugcgugagauuucuccaccggaccauucugccuggcucuaucgccaauuccauuugucagaacaucgaaaucauuauccuggugacgcucacacugcuuauuuucguccugcucagcauccugucuaaaaccuauauuugcuaccuucugaugcccaucuuuaucccuauugcuuauguguacggcaucauuuacaauaaguccuguaagaaaugcaagcucugcgggcugguuuaucaucccuucacagaguguggaacccacugcguguguggcgcccgcuacgauaccagcgacagaaugaaacugcaucgguccucugggcucugcccuggauauaagagccugcgcgcugccagagucauguguaaauccaagggcccggcgagcauccuuucuauuaucacagccauccuggugcucacguuuguuacccccauuaacuccauggugaucggggaaagcaaagaggucuucgagcuggaggaacuuccugaugacaugcuggaaauggcucucaagauuaaucuguacuauuuugugugcgucaugaacuacgccgugacauggucucugguuaucguggcucuccugauugcccuuaucuucaagaaauaucaacaccgguuccugaaucucuacgccauguacugugaggaaugcgacauguaucacgaucgcauuggacugaagagaaacggcgacuuuaccaauaaaugucggcagugcacauguggccaguacgaggaugcuaccgggcuuaugacgcaucgcaagacauauaacugccugguccaguacaaaagcaaguggauccucaacuuccugaucaccuauauggugcugacccucauuaaggacuccgcgaucauuguucaagccgcuggaacagauuuuucugccugccuggaggcccagagcguggacuggaauuguaccggccccuuccuuaaccuggggaauugccagaaacaacagaagaaagaauccuacgcuaacaucgccacacagcucaagggacugcaggcgauuagcguccuggaugugccuaugaucgcuaauauccccgaggacauugccggcgcccuuagauauaucgaagagaaagauacguuucacgugcaacucaccgcugaauacgccaugcugacacgguacugugacuauuacacccaguucgcugauaacucuggguauucccagacaaccuggagaguuuaccugcgcagccaugacuuugacgccugcauucucuauccgaaucagcacuucugucggugcgucaagcauggagauaaguguucuuccagcaacugggacuuugcgaaugagaugaaaaacuacuauuccggcaagcaaaauaaauucgauaaggaccugaaccuugcccugauggcugugcaccacgccuuuagaggcacgucuagcgcuuacaucgccaccaugcucuccaaaaagcugaauaacgaucugauuacauacaccaauaagaucaaagagaaguucccugggaacgcgcuucucaaagccaucauggacuauauuucuuacaugaagggacugagcgaaaugacaaacuuuaaauaugaugaguucugggacgaucugcuccauaagcccuccccuaccaaugcuccuccccugagccgcgacucugaacccuccuacaacuucaaaagcgugaucucuucccggagcgucaagucuugcaagaaugugaaaaacguugugugucuuagcccgagauccggcgccagcuaugauucuauucuggcuugcggggagcccaauggaccuuccgucuacaagaaacccagcgacggcguguuucaguccaacucugauaagacgauguauugucucgccgacagccacugccuggaagacuucgagguugugucccaggaggaacuggaugccaucaaaaagucuaagugcugggucacagaguacccuaaugugaaacuuagcaagcucuccgacgggauuaccucuugucgcaugaaagauagcggcaagugcaacguugcugcgaaucgguggcccaucauccagugugaaaacgacaaauuuuacuauuccgagcugcaaaaugauuacgacaagacacaggauauuggacauuucugccugagcccgggcuguucuaccaucagauuuccuauuaaccagaagcacaucuccaauugcaacuggcaagugagccggucuuccauugccaaaaucgacguccacgauauugaggacaucgaucaguaucgcaaggcuaucacccagaaacuccagacagggcugagccuuuucaaguacgccaaaacgaagaaucugccccauauuaagccuaucuauaaauacauuaccaucgaaggaacagagaccgccgaaggcauugagucugcuuauaucgaauccgagauccccgcccucgcggggacaagcauuggauuuaagaucaacuccaaagagggcaagcaccuucuggacauugugggguacgugaaaagcgcuucuuacagcuccgucuauaccaagcuguacucuacgggcccuacaagcggaaucaacaccaaacaugaugaacucuguaccggccccugcccgguuaauauuaaccaccaaacaggguggcugaccuucgccaaggagagaacauccucuuggggaugugaagaguuuggcugccuggccaucagcgacggguguguguucggauccugccaggacaucgugcgcgaugaacucucugucuaucggaaggagacggaggaagugaccgacguugagcugugccuuacauuuagcgauaaaaccuacuguacaaaucugaacccuauuacccccaucauuacggaccucuucgaagugcaguuuaagaccgucgagacauauucccugcccagaaucguggcuguucagaaucaugaagugaaaauuggccaaaucaacgaucuggggauuuacagcaagggcugcggaaauguccagaaagugaacggcaccguuuaugggaauggagugccuaaguucgacuaccuuugucaccuggccucucggaaggaggucaucgugcgcaaaugcuucgauaacgacuaccaggcguguaaguuucuccagacaccggcuuccuauagacuggaggaaaauagcggcaccgugacagucaucgauuacaaaaagauucucgggaccaucaaaaugaaggccauucugggagacguuaaguauaaaacguucgccgauaacguggacaugacagcugagggcucuugcgccggguguaucaauugcuuugaaaacauucacugugagcuuacccugcauaccacaaucgacgcuuccugccccgugaccagcccuuguacggucuuccacgaucggauccucauuacacccaaugagcauaaguacgccaugaaagugaucugcaccgaaaagccuggcaacacacugaccauuaaaaucugcuccacaaagauugacgcgucucuggcccuuaucgaugcuaagcccauccuggagcucgccccuguugaccaaaccgcuuauauuagagaaaaagaugagcgcuguaagacguggaugugccgggugagagacgaaggacugcaggucauccucgagcccuuuaaaaaccuguucggcagcuacauugggaucuuuuauaccuucauuaucugugugauuguucuucugaucgugaucuacauuguccucccgaucugcuuuaagcugcgcgauacacugagacagcacgaggacgccuacaaacgggaaaugaagauucgcuga

SEQ ID NO: 14235 - RNA, 4326 nt, Artificial Sequence
  derived and/or modified CDS sequence (opt5) from CHATV(LEIV-17756)__EU621834.1__GP
augaucuucauucugauccucuuugccgugagcaccgcuucccccgucuaccagagaugcuuccaagacggcgccauuguuaagcagaacccuucuaaagaggcggugacagaagugugucugaaggaugacgucagcaugaucaaaacggaggcucgguauauucgcaaugccaccgggacauuuuccaacaauguggccaucagaaaguggaucguuucugauuggcacgacugccggccgaaaaaggugagcggaggccauauuaacgucaucgaagugggggaugaccuuucccugcacaccgagucuuacguuuguagcgcugauugcacaauuggaguggacaaggaaaccgcccagguccgccuccagacagauaccacgaaucauuucgagaucgcuggcaccacagugaaauccgggugguuuaagagcaccacauauauuacccuggaccaaacgugugagcaccuuaaagugucuugcggacccaaguccguccaguuccaugccuguuuuaaccagcacaugagcugcguuagauuccugcaccggacaauccucccuggcucuauugcgaauagcaucugucagaacaucgaaauuaucauucuggugacccugacacuccugaucuuugugcuucugagcauucucucuaaaaccuacaucugcuaucugcuuaugcccaucuucauuccuaucgccuacauuuauggcaucauuuacaauaaguccuguaagaaaugcaagcugugcgggcucgucuaccaucccuuuaccgaguguggaacacacugcguguguggcgcucgcuaugauacgagcgacagaaugaaacugcaucgguccucugggcugugcccuggauacaagagccuccgcgccgcuagaguuauguguaaauccaagggcccggccagcauccugucuaucauuaccgcgauccuugugcugacauucgucacccccauuaacuccauggugguuggggaaagcaaagagguguuugagcucgaagaacugccugaugacaugcuugaaauggcccugaagaucaauuucuauuacuucgucugcgugaugaacuaugcugucacauggggacucauugugguugcccugcugaucggccucauuuuuaagaaauaccaacaccgguuccugaaucuuuaugcuauguacugugaggaaugcgacauguaccacgaucgcaccggccugaagagaaacggggacuuuacgaauaaaugucggcagugcacauguggacaguaugaggaugccaccggccucaugacccaucgcaagacauacaacugccuggugcaguauaaaucuaaguggauccuuaacuuccugaucaccuacaugguccucacacugauuaaggacagcgccaucgugguucaagcuacggggaccgauuuuuccucuugccuggagacacagagcgugaauuggaacuguaccggacccuuccucaaucugggcaacugccagaaacaacagaagaaagaauccuaugcgaauauugccacacagcuuaaggggcugcaggcuaucagcguccucgacaugccuaugauugccucuauccccgaggauaucgccggagcucugagauacauugaggagcgggaaaccuuucacgugcaacugacggccgaguaugcgaugcuuaccagauacugugacuacuauacacaguucgcugauaacuccggcuacagccagaccacauggcgcguguaucuccggucucaugacuuugaugccugcauccuguacccgaaucagcacuucuguagaugcguuaaacauggcgacaaguguuccagcuccaacugggacuuugccaaugagaugaagaacuauuacucugggaaacaaaauaaguucgauaaagaccugaaccucgcucugaugaccaugcaccacgccuuucgcggaacgagcuccgcuuauauugccgcgcuucugucuaagcggagcaaugaugaccucgucgccuacacaaacaaaaucaaggaaaaguucccuggcaaugcucugcugaaagccgugauggauuacauuuccuauaugaagucccuuucugagauguccaacuucaaauacgacgaauuuugggaugaccuccugcauaagcccaacccuaccaaagcucccagccugucuagaggggaugagcccgccuauaauuucaagcucgcgaucuccagccgcucuaugaaaagcugcaagaacgugaaguccgucgugugucugagcccucggucuggaguuuccuacgacagcauccuugccugcggcgaaccgaaugcucccuccgugcacagaaaaccuucugauggggucuuucagagcaacuccgacaagacaauguauugucuggccgauucucauugccucgaggacuucgaggugguuagccaggaggaacuggacgcuauuaaaaaguccgaaugcugggugaccgaguaccccaaugucaaacugucuaaacuuagcgauggcaucaaguccugucgcaugaaggacagcggaaagugcaacguggccaccaaucgguggccuauuauccagugugagaacgauaaauuuuauuacucugaacuccaaaaugacuacgauaagacacaggacauuggccacuucugccugucccccggguguagcacgaucagauuuccgaucaaccagaaacacauuucuaauugcaacuggcagguuucccgcagcucuaucgccaagauugaugugcauaauaucgaggacauugaacaauaucggaaggcuaucacccagaaacugcagacaucccucagccuguucaaguacgcgagaaccaaaaaccuuccucacauuaagcccaucuauaaauacaucacaauugagggaaccgaaacggccgagggcaucgaguccgcuuauauugaaagcgagaucccugcccuggccgggacaucuauuggauuuaagaucaauagcaaggaaggcaaacaucuccuggaugucaucggguacgugaaguccgcuucuuauagcuccguguacaccaaacuguacucuaccggccccacaagcggaauuaacaccaagcacgacgagcuuuguacaggcccuugccccgccaacaucaaacaucaaacgggguggcucaccuucgcgcgggaacgcacauccucuuggggaugugaggaguuuggcugccuggcuauuagcgaugggugugucuucggauccugccaggacaucguuagagaugaacugagcguguaucggaaggagaccgaagaggugacagacgucgaacucugccugaccuuuucugacaaaacguacuguaccaaucuuaacccgauuacaccuaucaucaccgaucuguucgaggugcaguucaagacaguugagaccuauucccuccccagaauuguggccauccagaaucacgaaauuaagaucggccaaauuaacgaccugggggucuacagcaaaggcugcggaaaugugcagaagguuaacggcacaguguaugggaauggaguccccaaauuugauuaccugugucaccuugccucucgcaaggaggugaucguucggaaaugcuucgacaacgauuaucaggcuuguaaguuucugcagaccccugccuccuacagacucgaagagaauagcggcacggugacagucauugacuacaagaaaauccuggggaccaucaagaugaaagcgauucucggagaugugaaguauaaaaccuucgcugacaacguggauaucacagccgagggcuccugcaccggguguauuaauugcuuugaaaacauccauugugagcugacgauucacacaaccaucgacgccucuugcccggucacaagccccuguaccguuuuccaugaucgcauccuugugacaccuaaugaacacaaguacgcuaugaaggugauuugcaccgagaaacccggcuccacgcuggccaucaagauuugcaacaccaaaaucgacgcuagccucgcccugauugacgcgaagccuauccuggaacuugcccccgucgaucaaacagcuuauaucagagagaaagacgagcgguguaagaccuggaugugccgcgugagagaugaaggacugcagguuauucucgagccuuuuaagaaucuguucggcucuuacaucgggaucuuuuauacauucgugauuuccauuaucgcccuccugauugucaucuacaucauucuucccaucuguuuuaaacugcgggacacccuccgcaagcaugaagaugcuuauaaaagagagaugaagauucgguga

SEQ ID NO: 14236 - RNA, 4326 nt, Artificial Sequence
  derived and/or modified CDS sequence (opt5) from CHATV(LEIV-18733)__HQ734821.1__GP
augaucuucauucuggugcuccuggccgucagcaccgcuucccccguuuaccagagaugcuuucaagacggcgccaucgugaagcagaacccuucuaaagaggcggugacagaagucugucuuaaggaugacgugagcaugauuaaaacggaggcucgguauaugaagaaugccaccgggacauucuccaacaauguugccauccgcaaauggcuggugucugauuggcacgacugcagaccgaagaaggucagcggaggccauauuaacgugaucgaaguuggggaugaccucucccugcacaccgagucuuacguguguagcgcugauugcacaaucggagucgacaaagaaaccgcccaggugcggcuucagacagauaccacgaaucauuuugagauugcuggcaccacagugaaguccgggugguucaaaagcaccacauauaucacccuggaccaaacgugugagcaccucaaggucucuugcggacccaaauccguucaguuucaugccuguuucaaccagcacaugagcugcgugcgcuuucugcacagaacagugcugccuggcucuauugcuaauuccaucugucagaacauugaaaucauuauccucgucacccugacacuucugaucuucgugcuccugagcauucuuucuaagaccuacaucugcuaucugcucaugcccauuuuuaucccuauugccuacguuuauggcaucaucuacaauaaguccuguaaaaagugcaaacugugcgggcugguguaccaucccuucaccgaguguggaacacacugcgucuguggcgcucgguaugauacgagcgaccgcaugaagcuccauagauccucugggcugugcccuggauacaaaagccuucgggccgcucgcgugauguguaaguccaaaggcccggccagcauucugucuaucauuaccgcgauccucguucugacauuugugacccccauuaacuccauggucaucggggaaagcaaggagguguucgagcuugaagaacugccugaugacaugcucgaaauggcccugaagaucaauuuuuauuacuucgucugcgugauuaacuaugcuguuacauggggacugaucguggucgcccuccugauuggccuuguguucaaaaaguaccaacacagauuucugaaucucuaugcuauguacugugaggaaugcgacauguaccacgaucggaccggccugaaacgcaacggggacuucacgaauaaguguagacagugcacauguggacaguaugaggaugccaccggccuuaucacccaucggaaaacauacaacugccugguuaaguauaagucuaaauggauucucaacuuucugaucaccuacauggugcugacacucauuaaggacagcgccaucgucgugcaggcugcggggacggauuucuccgccugccuggaggcucaaucuguggacuggaauuguaccggacccuuucuuaaccugggcaauugccagaaacagcaaaagaaagaaagcuaugccaacaucgccacacagcucaaggggcugcaggcuauuuccguucuggauaugccuaugaucgccagcauucccgaggacaucgcgggagcgcuucgcuacauugaagagaaggaaaccuuccacguccagcucacagccgaguaugccaugcugaccagauacugugauuacuauacgcaauuugcugacaauucuggcuacucccagaccacauggcggguguaucugagaagccaugauuucgacgccugcauccucuacccgaaccagcacuuuugucgcugcgugaaacauggcgacaaguguucuuccagcaauugggauuucgcuaacgagaugaaaaauuauuacuccgggaagcagucuaaauuugacaaggaucugaaccuugcccugaugaccguccaccacgcguuccggggaacaagcuccgccuauaucgcuaccaugcucucuaagaaaagcaauaacgaccugguggccuacacgaauaagauuaaagaaaaguuuccuggcaacgcucugcuuaaagccguuauggauuacaucuccuauaugaaaagccucucugagaugacaaauuucaaguacgacgaguucugggaugaccugcuguauagacccaacccuaccaaggcgcccucccucagccgcgagucugaaacauccuacaacuuuaagcuggugauuagccccaaaucuaugaaaagcugcaagaaugucaaguccgugguuugucuuagcccucggucuggggccuccuaugauagcauccuggcuugcggagagccgaacggccccuccguguacagaaaaccuucugggggcgucuuccaaagcaauuccgacaagaccauguauugucucgccgauucucauugccuggaggacuuugaagugauuggacaggaggaacuggaugcuaucaagaaaagcguuugcugggccguggaguaccccgacgucacccuuuccaagcucucugacggcgugaaaagcugucgcaugaaggauuccgggaaaugcaacguggccgcuaaucgguggccuaucauucagugugagaacgacaaguucuacuauagcgaacugcagaaugauuacgacaagacacaagauaucggacacuuuugccugucucccggcuguuccacggucagauucccgauuaaccagaaacauaucagcaauugcaacuggcagguuucucgcuccagcauugcgaagaucgacgugcacgauaucgaggacauugaucaguaucggaaagccaucacccaaaagcuccagacaucucugucccuuuuuaaauacgcuaagaccaagaaucugccucacauuaaacccaucuauaaguacauuacaaucgaagggaccgagacggccgaaggaauugagagcgccuauaucgaguccgaaaucccugcucucgccggcacaagcgugggguucaaaauuaacucuaaggagggcaaacaucugcuggacaucauuggauacgucaagagcgcguccuacucuagcguguauaccaaacuuuacuccaccggccccacaucugggaucaauaccaagcacgaugaacucuguacaggaccuugccccgcuaacauuaaucaucagaacggcuggcugacguuugccaaggagagaaccagcuccugggggugugaagaguucggaugccuggccaucucugacggcuguguuuuugggagcugccaagauaucgugcgcgacgagcucuccgucuaucggaaagaaacagaggaagugaccgacguugagcugugccuuacauucagcgauaagaccuacuguacgaaccugaauccgauuaccccuaucauuacagaccucuuugaagugcaguucaaaaccgucgagacauauucucugcccagaaucguggcuauucagaaccacgagaucaagaucggccagauuaaugaucugggaguuuacuccaaaggcugcgggaacgugcaaaaggucaauggaaccguguauggcaacggggugcccaaguucgacuaccuuugucaucuggccagccggaaagaagucaucguucgcaagugcuuugauaaugacuaccaggcguguaaauuccuccagaccccugcuucuuauagacuggaggaaaacuccggaacaauuacggugaucgauuacaagaaaauucucggcacaaucaagaugaaggccauucugggggacgugaaauauaagaccuuugccgauaaugucgacaucaccguggagggcagcugcgcuggauguaucaacugcuucgagaauauucacugugaacuuacaauccacaccacgauugaggccuccugcccgguuacaucucccuguaccguguuucaugaucggauccugauuacaccuaacgaacacaaauacgcuaugaaggucgugugcaccgagaaacccggcaauacacucacccugaagguuugcaacacgaagguggacgccagccuggcgcuuaucgacgccaaaccuauccuggaacucgcucccgucgaucagaccgccuauauuagagagaaggacgagcgcuguaaaacauggaugugccgggugagagaugaagggcugcaagucauccucgagccuuucaagaaucuguuuggauccuacauuggcaucuucuauaccauuaucaucagcauuaucgugcuucugauuguuaucuacauuauccuccccguguguuuuaaacugcgcgacacacugagacagcaugaagaugcuuacaagcgggagaugaagguccgcuga

SEQ ID NO: 14237 - RNA, 4326 nt, Artificial Sequence
  derived and/or modified CDS sequence (opt5) from CHATV(LEIV-22712)__HQ734822.1__GP
augaucuucauucugauccucuuugccgugagcgcugccucccccgucuaccagagaugcuuccaagacggcgcgauuguuaagcagaacccuucuaaagaggcugugaccgaagugugucugaaggaugacgucagcaugaucaaaacagaggcccgguauacgaagaaugccaccgggacauuuuccaacaauguggcuauucgcaaauggcuuguuucugauuggcacgacugcagaccgaagaaggugagcggaggccauaucaacgucaucgaagugggggaugaccugucccuccacaccgagucuuacguuuguagcgccgauugcacaauuggaguggacaaagaaaccgcucagauccggcugcagacagauaccacgaaucauuucgagauugccggcaccacagucaaguccgggugguuuaaaagcaccacauauaucacccuugaccaaacgugugagcaccugaaggugucuugcggacccaaauccgugcaguuccaugcguguuuuaaccagcacaugagcugcguccgcuuccuccacagaacaguucugccuggcucuauugccaauuccaucugucagaacauugaaaucaucauucuggugacccucacacugcuuaucuuugugcugcucagcauucugucuaagaccuacaucugcuaucuucugaugcccauuuucaucccuaucgcuuacgucuauggcauuaucuacaauaaguccuguaaaaagugcaaacucugcgggcugguguaccaucccuuuaccgaguguggaacacacugcguuuguggcgcccgguaugauacgagcgaccgcaugaagcugcauagauccucugggcucugcccuggauacaaaagccugcgggcugcccgcgugauguguaaguccaaaggcccggcgagcguccuuucuauuaucaccgccauucuggugcucacauucguuacccccaucaacuccaugguggucggggaaagcaaggagguguuugagcuggaagaacuuccugaugacaugcuggaaauggcucucaagaucaauuucuauuacuucauuugcgucaugaacuaugccgugacauggggacugaucguugugggccugcucauuggccuggucuuuaaaaaguaccaacacagauuccuuaaucuguaugcuauguacugugaggaaugcgacauguaccacgaucggaccgggcucaaacgcaacggagacuuuacgaauaaguguagacagugcacauguggccaguaugaggaugccaccgggcugaucacccaucggaaaacauacaacugccuugugcaguauaagucuaaguggauucugaacuuccucaucgccuacaugacccugacacugauuaaagacagcgcuaucaucguucaagcgacgggaaccgauuuuauuuccugccucgagacacagucugugaauuggaacuguaccggccccuuccugaaucuugggaacugccagaagcaacagaaaaaggaaccuuaugccaauaucgcuacacagcugaaaggacuccaggccauuagcguccuggacauccccaugauugccaacaucccggaggauaucgcuggcgcccugcgcuacauugaagagaaggaaaccuuucacgugcaacuuacggcggaguaugcuaugcucaccagauacugugacuacuauacacaguucgccgauaauuccggcuacagccagaccacauggcggguguaucugagaucucaugacuuugaugccugcauccuguacccuaaccagcacuucugucgcugcguuaagcauggggacaaauguuccagcucuaauugggacuuugcuaacgagaugaagaauuauuacuccggaaaacaaagcaaguucgauaaagaccucaaccuggcccuuaugaccaugcaccacgcuuuucggggcacguccucugccuauauugcgacacugcucagcaagaagcugaaugaugaccuggccgcuuacaccaacaaaaucaaggaaaaauuccccgggaaugcccuucucaaggcuaugauggauuacauuuccuauaugaaaucucugagcgagauggccaacuucaaguacgacgaauuuugggaugaccugcuccauaaaccugaucccacaaaggcgccccugcuuuccagaggaagcgagccugucuauaacuucaagcugguggugucuucccgcagcgucaaaucuugcaagaaugugaaauccguugugugucucagcccgcggucuggcgucagcuacgacuccgugcuggccugcggggaacccaacggcccuagcguuuauagaaagcccucugauggaguguuucaguccaauagcgacaaaaccaucuacugucuggcugauucccacugccuugaggacuucgaggucaucucucaggaggagcucgacgccauuaaaaagagcgaaugcugggugaucgaguauccuaacguuaagcugaccaagcccuccgauggcauuaaaucuugucgcaugaaggacagcgggaaaugcaauguggcuacaaaccgguggccgaucauucagugugagaauaacaauuuuuacuacuccgaacugcaaaacgauuaugacaagacgcaggauaucggacauuucugccucucuccuggcuguagcaccaucagauaccccauuaaucagaagcacaucuccaacugcaauuggcaggucagccacucuuccauugccaaaaucgacgugcauaacauugaggauaucgaacaauaucgcaaggccauuacacagaaacugcagaccagccuuucucuguuuaaguacgcuaaaacaaagaaucucccucacaucaagcccaucuauaaauacauuaccaucgaggggacggaaacagcggagggaauugaguccgccuauaucgaaagcgagauuccugcucuggccggcaccucuaucggguucaagaucaacuccaaagaaggcaagcaucugcuugacgugauuggauacgucaaaagcgccuccuacagcucuguuuauagcaagcucuacuccaccggccccacaucugggaucaacaccaaacacgaugagcuguguacaggaccgugcccugaaaauauuaagcaucaaacgggcuggcugaccuuugcucgggagagaacaagcuccugggggugugaggaguucggaugccucgccaucucugacggcuguguguuugggagcugccaggauauugugaaggacgagcuguccgucuaucgcaaagaaaccgaggaagugacagauguugagcuuugccugaccuucucugacaagacguacuguaccaaccucaaucccaucacacccaucauuaccaaccuguuugaggugcaguucaaaacagucgaaaccuauagccugccucggaucguggcgauucagaaucacgagaucaagauuggccaaaucaacgaccuuggaguuuacuccaaaggcugcgggaaugugcagaaggucaacggaacaguguauggcaaugggguuccgaaguucgauuaccugugucaccucgcuagcagaaaagaagugauuguccggaagugcuuugacaacgauuaccaggccuguaaauuccugcagacccccgccucuuaucgccucgaggaaaauuccggagcuaucacggugaucgacuacaagaaaauucugggcacaaucaagaugaaggccauucuuggggaugugaaauauaagaccuuugcggacaacgucgauaucaccgcugaaggcagcugcacaggauguauuaauugcuucgagaacauccauugugaacugaccauccacacgacaauugaggccucuugcccuguuaccucccccuguacaguguuucaugacagaauccucgugaccccuaaugaacacaaauacgccaugaaggucgugugcacagagaaacccggcagcacccugguuauuaaggugugcaacacgaagaucgaugcuucccuggcccuuauugacgcuaaaccuauccuggagcucgcccccgucgaucaaaccgcguauauccgggaaaaggacgagagauguaaaacauggaugugccgcgugcgggacgaagggcugcagguuauucucgagccguucaagaaccuguuuggaucuuacaucggcauuuucuauaccuuuaucauuagcaucauugugcuucugaucgucaucuacauuauccucccuauuuguuucaaacugagagauacacugcgcaagcaugaagacgccuacaagagagagaugaaaauccgguga

SEQ ID NO: 14238 - RNA, 4332 nt, Artificial Sequence
  derived and/or modified CDS sequence (opt5) from INKV(KN3641)__U88059.1__GP
auggaggugcugaaccucaucuggcugcuuacccugugcagcgccucccccgucuuccagagauguuuucaagacggcgcuauuguuaagcagaauccuucuaaagaagccgugacagaggugugccucaaggaugacgucagcaugaucaaaacggaagcgaaguacauuaaaaacaccacagggaccuucgcuaauaacaucgccaugcggaaguggcugguggccgauuggcacgacugucgcccgcagaaguccucuggaggccauauuaauguuaucgaggugggggaugaccuuagccugcacacagaauccuauaucugcucugcugauugugucauuaccguggacaaagagacagcccagaucagacuccaaaccgauaacacgaaucauuuugagguugcuggaaccacagugaaguccggcugguucaaauccaccacauacauuacccuggaccagacgugcgaacaccugaaggucagcugugggcccaaaucuauccaguuucaugccugcuucaaccagcacauguccugugugcgguuucuccaccgcacaauucugccuggaagcaucgccaauucuauuugccaaaacaucgagaucauuauccuugugacccugucccucgucauuuucaucuuucugacaauuguuagcaagaccuauguguguuaccuucugaugcccaucuucaucccuauugcguauaucuacggcuggauuuauaauaagucuugcaaaaagugcagacucuguggccugguguaccaucccuuuaccgaaugcgggacacacugugucugcggagcucgguacgagacguccgaucgcaugaaacugcauagagccagcggccucuguccuggguauaagaaccugcgggcugcccgcgugaugugcaaauccaagggaccggcgucuguucuuagcaucaugaccgccgugcugauucucacauucgucacccccaucuccgcuauggugaucggcgagagcucugaaguuuacacacugggggaccuuccugaugacaugguggagauggccgaaagagucaauauuuauuaccagaucauuaucauuaacuauuccaucaccuggguguuucugcuccugggacugauuaucgcuuacuucuuccggaaauaucagcaccgcuuucucagcuucuacgccauguacuguaaggagugcgacauguaucacgaaagagccggccugacguacuggggcgauuuuacaaauaagugucggcagugcaccugugggcaauucgaggacgucaccggacuuauggugcauaaaaagucuuauaacugcaucauuaaauacaaggcuaaauggauccgcgauaugcugauuacauaucuccugaucaugcuuauuaaggacagccugcucuuuguuggcgcgaccgggacagauuucgccgcuugcaucgacgagaagacggugaccuggaacagaacaggacccuuucugaaucugggccggugugauaaaucccagaagaaaaccggguacacagacaucgccgaucagcucaagggacugggcgccauuucuguccuugacaucccuaugauuaaaaagaugcccgaugaaaucagcggcucccugaagugcauugacgaccucgagacccaccaugaacaacugacggcugaguaugccuuccugaccagauacugugauuacuauacacaguacaccgacaacagcggguauucucagacaguguggcgcaccuaccuucggucccacgauuuuggagcgugcguuguguauccgaaucagcauuucuguagaugcgucaaacacggcgacaaguguaacagcgcuaaaugggauuuugccaaugaaaugaagacguucuacacagggcaaaaagccaaguuuaacaaggaccucaaucuggcucugcucgugcugcacaaagccuuccgcggaaccggcacaucuuauaucgcugaguccauggcccggaaggauaacagaagcaugacccauuucgcgcuugagaucaaaaagaaauuuccuaccaaugcccugcucacagcucugauugacuacaucuccuaccugcagucucccgccgaaaugagcacguucgagcuugaugaagacugggaggauuuuaaguauaaaccugaacccaccgagagcccccagcuccgcucucaccggacagaccaguacaacuucaagaaugcugauagcaacuccaaugugaagguuugcaaaaacauucaaaaggucagcuguaucucuccuagaucccgcgccaaauuugagaauauuaucgcgugcggggaacaugccaacccgagcguguauaccaugcccaacgugucuaucuaccaguccaauagcgagcggucucacuauuguauugcugacagccacugccuggaagaguacgaggucguggaaacagagcugcucaacgcccugaagaaauccaagugcugggcuagagaaauggacgauaucguucuucauaaacagguggacggccugcgcagcugucggaugaaggauaccggaaauugcaacguccaggagaaugacuggacgauugugcucugugaaaacggcaauuauuacuacucugaggcccacagagauuaugacaaggaucaagacguugggcauuucugccuguccccucgguguagcacaauccgcuaccccauuuccaaaagacacaucaagaacugcgauuggcagauuucucauagcaccaucgacaaaaucuccgugcaggagcuggccgauauugaacaguauaagaaggcuaucucucaaaaacuucagaccagccucuccauuuuuaaguacgucaaaacaaagaaucugccucacaucaaacccgcguauaaguacauuaccguggagggaguugaaacaguggagggcaucgaaaacgccuucaucgagucugagauuccggcucuggccgggacggccaucggauuuaagauuaauagccgggaaggcaacuaucucauggacgucaucggguacgugaaauccggcagcuacucugcuaccuauacaaagcuguacauuaccggaccuacaaucggcgugaauaccaaacacgaugagaaguguacggggcccugcccugccaucauugaccauaaagaaggauggcuuaccuucgcgaagggcagaacauccaccugggggugugaggaauuuggaugccuggcugucagcgacggcuguguuuucgggucuugccaggauaucauuaaagacgagcucgccgugcaccgcaagacaaccgaggaacccacaaccguggagcugugccugacguuuuccgauaagacauauuguaccaaccuuaaugccaucaccccuauuaucacagacaaauucgaaguccaauucaagaccguggagagcuacacgcucccccggauuaucgcuaucaaaaaccaugagauuaagguuggccagaucaacgaucugggaguguauucuaaaggcugcgggaauguccagaagauuaacggaacaaauuacggcaacgggcugccgaaguuugacuaucucugucaccuggccggaagaaaagaagugaucauucgcaagugcuucgauaaugacuaccaggcguguaaauuucuucaauccccucccagcuacagacuggaggaacaucagggcaccguuacagugaucgauuauaagaaaauccucgggaccauuaagauggaggcuauccugggcgacgucaaguaccggaacuaucaguccaauauugaaaucaacgccaaaggaacaugcgccggcuguauuaauugcuucgagaacauccacugugaguuuaccauccacacgaccguggaagcuagcugccccauuguuacagauugggugucuuuccaugaccgcauccugauuaccccugacgagcacaaguacgcccuuaaagucgugugucaggaaaagccgaaacugagccucaaguuuaagaucugcaauacaaacauugaugcuuccaugaccguggucgacucuaaacccauccuggagcucgccccuguugaucaaacgacauauauuagagaacgggacgagcgcugcaagaccuggauguguagagugcgggaugagggguuccaggugauccuggaacccuuuaaaaaucuuuucggaagcuacaucggcaucuuuuauacagggauucugugcauugucugucuccugaucgugauuuacaucauccugccuauuugcuucaaacuucgcgacacccugagacagcucgaggaugcguacaagaaggaaguuaagauccgguga

SEQ ID NO: 14239 - RNA, 4332 nt, Artificial Sequence
  derived and/or modified CDS sequence (opt5) from INKV(SWAR83-161)__U88060.1__GP
auggaggugcugaaccucaucuggcugcuuacccugugcagcgccucccccgucuuccagagauguuuucaagacggcgcuauuguuaagcagaauccuucuaaagaagccgugacagaggugugccucaaggaugacgucagcaugaucaaaacggaagcgaaguacauuaaaaacgcuaccgggacauucgccaauaacaucgccaugcggaaguggcugguggcugauuggcacgacugucgcccgcagaaguccucuggaggccauauuaauguuaucgaggugggggaugaccuuagccugcacaccgaauccuauaucugcucugccgauugugucauuacaguggacaaagagaccgcucagaucagacuccaaacagauaacaccaaucauuuugagguugccggaacgaccgucaagagcggcugguucaaauccacaaccuacauuacacuggaccagaccugcgaacaccugaaggugagcugugggcccaaaucuauccaguuucaugcgugcuucaaccagcacauguccugugugcgguuucuccaccgcacgauucugccuggaagcaucgccaauucuauuugccaaaacaucgagaucauuauccuugugacacugucccucgcuauuuucaucuuucugaccauugucagcaagacauauguuuguuaccuucugaugcccaucuucaucccuauugccuauaucuacggcuggauuuauaauaagucuugcaaaaagugcaaacucuguggccugguguaccaucccuuuaccgaaugcgggacccacugugugugcggagcuagauacgagacauccgaucggaugaagcugcaucgcgccagcggccucuguccuggguauaaaaaccugagagcggcccgggucaugugcaaguccaaaggaccggcuucugugcuuagcaucaugacggccauucugauccucaccuucguuacacccaucuccgcuauggugauuggcgagagcucugaagucuacacccuggacgagcuuccugaugacauggugcagauggccgaacgcguuaauaucuauuaccagauuaucauuaucaacuauuccauuacaugggccuuucuccuguucgggcuggugcuggcuuacuucuuuaagaaguaucagcacagauuccucagcuuuuacgcgauguacuguaaagagugcgacauguaucacgaacgggccggacugaccuacuggggcgauuucacgaauaagugucgccaaugcacauguggccaguuugaggacgucaccgggcuuauggugcauaaaaagucuuauaacugcaucaucaaauacaaggcuaaguggauuagagauauccugauuaccuaucucaucauuaugcugaucaaagacagccuucuguucgucggagccacaggcaccgauuuugccgcuugcaucgacgagaagacagugacguggaacuguaccgggcccuuccucaaucugggaaaaugcgauaagucccagaaaaagauuggcuacgccgacaucgcggaucaacugaaggggcucggagcuauuucuguucuggacaucccuaugauuaaacggaugcccgaugaaaucagcggcucccuuaaguauaucgacggccuggagacauaccacgaacagcucaccgccgaguacgccuuucugacacgcuauugugacuacuauacccaguacacggauaacagcggguauucucagaccguguggagaacauaccugcggucccaugacuucggagcuugcgucguguauccgaaucaacacuuuuguagaugcguuaaacauggcgauaaguguaacagcgccaaaugggacuucgcuaaugaaaugaagaccuuuuacacagggcagaaggccaaauucaacaaggaucuuaaucucgcgcugcuggugcuccacaaagccuuccgcggaaccggcacgucuuacauugcugaguccauggcccggaaggacaacagaagcaugacacacuuugcucuggagaucaaaaagaaauucccuaccaaugcccuucugacagcgcucauugauuauaucuccuaccugcagucucuggccgaaaugagcaccuuugagcuugacgaagauugggaggacuucaaguauaagcccgaaccuaccgaggcuccccagcuccgcucccaucggacagaucaauacaacuuuaaaaaugccgacucuaacagcaaugucaaggugugcaaaaacauucagaagguguccuguaucagccccagaucucgcgcuaaauucgagaauaucauugccugcggggaacacgccaacccuuccguuuauaugaugccgaacgucagcaucuaccagucuaauuccgagcggagccauuauuguauugcugauucucacugccuggaagaguacgaggugguggaaagcgagcugcucaacgcgcugaagaaguccaaaugcugggccaaggaaauggacgacaucguccuucacaaacagagcgauggccugagaucuugucgcaugaaggacacgggaaauugcaacgugcaagagaaugauuggaccauuguucucugugaaaacggcaauuacuauuacuccgaggcucaucgggacuaugauaaagaccaggauguggggcacuuuugccugagccccagauguuccacaauccgcuacccuauuaacaagcggcauaucagaaauugcgacuggcagaucucucacagcaccauugauaagaucuccguccaggagcuggccgacauugaacaauauaaaaaggccaucucucagaaacuucagacaagccucuccauuuucaaguacgugaaaaccaagaaccugccccauaucaagccugcuuauaaauacaucacgguugagggaauugaaacaguggagggcaucgaaaaugccuuuauugagucugagauccccgcgcuggcugggaccgccauuggauucaagaucaacagccgggaaggcaauuaccucauggaugucaucggguaugugaaauccgccagcuacucugcuaccuauacaaagcuguacaccacaggcccgacgauuggaguuaacaccaaacacgacgagaaguguacaggcccuugucccccuaucauugaucacaaagaaggguggcuuaccuuugccaaggagcgcacauccaccuggggaugcgaagaguucggcugccuggcggugagcgacgggugugucuuuggaucuugccaagacaucauuaaggaugagcucgcuguguauagaaaaacgaccgaagaacugacaaccguggaacugugccuuacauucuccgacaagaccuacuguacaaaucucaacgccaucacccccauuaucacggauaaauucgagguccaguuuaagacaguugagagcuauacccugccucggaucauugccaucaaaaaccaugaaauuaaggugggccagaucaaugaccuggggguguacucuaagggcugcggaaacguccagaaaauuaauggcaccaacuacgggaauggagugcccaaguucgauuaucucugucaccuggcuuccagaaaagagguuaucauccgcaagugcuuugacaacgauuaccaagccuguaaauuccuucagagcccgccuuccuaucggcuggaggagcaucagggcacagugaccgucauugacuacaagaagauccucgggauuaucaaaaugaaggcuauucugggagaugugaaauauaagaauuaccagagcaacaucgaaaucaaugccgagggcacgugcgcgggguguauuaacugcuuugagaauauccacugugaguucacaauucauaccacaguugaagccucuugccccaucgugaccgacugugucagcuuucacgaucgcauucugaucacacccgacgaacacaaauaugcucuuaaggugguuugccaagagaagccuaaacugucccucaaguucaaaauuugcaacaccaauaucgacgccucuaugacgaucguggauagcaagccgauucuggaacucgcucccgucgaccagaccacauacaucagagagaaagaugagagauguaagaccuggaugugccgggugcgcgacgaaggcuuucaggugauucuggagccuuucaagaaccuuuuuggauccuacaucggcauuuucuauacagggauccuguguaucauuugccuccugaucgucauuuacaucauucugcccaucuguuucaaacuuagagauacccugcggcagcaugaagacgccuauaagaaagagaugaagauccgcuga

SEQ ID NO: 14240 - RNA, 4332 nt, Artificial Sequence
  derived and/or modified CDS sequence (opt5) from INKV(Lovanger)__KU681435.1__GP
auggaggugcugaaccucaucuggcugcuuacccugugcagcgccucccccgucuuccagagauguuuucaagacggcgcuauuguuaagcagaauccuucuaaagaagccgugacagaggugugccucaaggaugacgucagcaugaucaaaacggaagcgaaguacauuaaaaacgcuaccgggacauucgccaauaacaucgccaugcggaaguggcugguggcugauuggcacgacugucgcccgcagaaguccucuggaggccauauuaauguuaucgaggugggggaugaccuuagccugcacaccgaauccuauaucugcucugccgauugugucauuacaguggacaaagagaccgcucagaucagacuccaaacagauaacaccaaucauuuugagguugccggaacgaccgucaagagcggcugguucaaauccacaaccuacauuacacuggaccagaccugcgaacaccugaaggugagcugugggcccaaaucuauccaguuucaugcgugcuucaaccagcacauguccugugugcgguuucuccaccgcacgauucugccuggaagcaucgccaauucuauuugccaaaacaucgagaucauuauccuugugacacugucccucgcuauuuucaucuuucugaccauugucagcaagacauauguuuguuaccuucugaugcccaucuucaucccuauugccuauaucuacggcuggauuuauaauaagucuugcaaaaagugcaaacucuguggccugguguaccaucccuuuaccgaaugcgggacccacugugugugcggagcuagauacgagacauccgaucggaugaagcugcaucgcgccagcggccucuguccuggguauaaaucccugagagcggcccgggucaugugcaagucucgcggaccggcuagcgugcuuuccaucaugacggccauucugauccucaccuucguuacacccaucagcgcuauggugauuggcgagucuuccgaagucuacacccuggacgagcuuccugaugacauggugcagauggccgaaagaguuaacaucuauuaccagauuaucauuaucaauuauagcauuacaugggccuuucuucucuucgggcuggugcuggcuuacuucuuuaaaaaguaucagcaccgguuccucucuuuuuacgcgauguacuguaaggagugcgacauguaucacgaacgcgccggacugaccuacuggggcgauuucacgaacaaauguagacaaugcacauguggccaguuugaggacgucaccgggcuuauggugcauaagaaaagcuauaauugcaucaucaaguacaaagcuaaguggauucgggauauccugauuaccuaucucaucauuaugcugaucaaggacucccuucuguucgucggagccacaggcaccgauuuugccgcuugcaucgacgagaaaacagugacguggaacuguaccgggcccuuccucaaccugggacgcugcgauaagucucagaaaaagauuggcuacgccgacaucgcggaucaacugaaagggcucggagcuauuagcguucuggacaucccuaugauuaagagaaugcccgaugaaaucuccggcagccuuaaguauaucgacggccuggagacauaccacgaacagcucaccgccgaguacgccuuucugacacgguauugugacuacuauacccaguacacggauaauucuggguauucccagaccguguggagaacauaccugcgcagccaugacuucggagcuugcgucguguauccgaaccaacacuuuugucggugcguuaaacauggcgauaaguguaauucugccaaaugggacuucgcuaacgaaaugaagaccuuuuacacagggcagaaagccaaguucaauaaggaucuuaaccucgcgcugcuggugcuccacaaagccuucagaggaaccggcacguccuacauugcugagagcauggcccgcaaggacaaucgguccaugacacacuuugcucuggagaucaaaaagaaauucccuaccaacgcccuucugacagcgcucauugauuauaucucuuaccugcagagccuggccgaaauguccaccuuugagcuugacgaagauugggaggacuucaaguauaaacccgaaccuaccgaggcuccccagcucagaucucaucgcacagaucaauacaauuuuaagaacgccgacagcaauuccaacgucaaggugugcaaaaauauucagaaggugagcuguaucucuccccgguccagagcuaaauucgagaacaucauugccugcggggaacacgccaauccuagcguuuauaugaugccgaacgucucuaucuaccaguccaacagcgagcgcucucauuauuguauugcugauagccacugccuggaagaguacgaggugguggaauccgagcugcucaaugcgcugaagaaaagcaagugcugggccaaggaaauggacgacaucguccuucacaaacaggcugauggccugcggucuuguagaaugaaggacacgggaaacugcaaugugcaagagaacgauuggaccauuguucucugugaaaauggcaacuacuauuacuccgaggcccaucgcgacuaugauaaagaccaggauguggggcacuuuugccugagcccccgguguuccacaaucagauacccuauuaauaagcggcauauccgcaacugcgacuggcagaucucucacagcaccauugauaaaaucuccguccaggagcuggccgacauugaacaauauaagaaggcuaucucucagaaacuucagacaagccucuccauuuucaaguacgugaaaaccaagaaucugccccauaucaaaccugccuauaaguacaucacgguugagggaguggaaacagucgagggcauugaaaacgcguuuaucgagucugagauucccgcucuggccgggaccgccaucggauucaagauuaauagcagagaaggcaacuaccucauggaugugaucggguauguuaaauccgcuagcuacucugccaccuauacaaagcuguacaccacaggcccgacgaucggagugaauaccaaacacgacgagaaguguacaggcccuugucccccuauuaucgaucacaaagaaggguggcuuaccuuugcgaaggagcggacauccaccuggggaugcgaagaguucggcugccuggcugucagcgacggguguguguuuggaucuugccaagacauuaucaaagaugagcucguggucuauagaaagacgaccgaagaacugacaaccguugaacugugccuuacauucuccgacaagaccuacuguacaaaccucaaugccauuacccccaucauuacggauaaauucgaggugcaguuuaagacaguggagagcuauacccugccucgcaucaucgccauuaaaaaccaugaaaucaaggucggccagauuaacgaccuggggguguacucuaaaggcugcggaaauguucagaagaucaacggcaccaauuacgggaacggauggcccaaguucgauuaucucugucaccuggcuucccggaaagaggugauuaucagaaagugcuuugacaaugauuacaaagccuguaaguuccuucaaagcccgccuuccuaucgccuggaggagcaucagggcacagucaccgugaucgacuacaaaaagauucucgggacgaucaagaugaaagcuauucugggagauguuaaguauaaaaacuaccagagcaauaucgaaauuaacgccgagggcacaugcgcgggguguaucaauugcuuugagaacauccacugugaguucaccauucauacaaccguggaagccucuugccccaucgucacagacugugugagcuuucacgaucggauucugaucacccccgacgaacacaaguaugcucuuaaaguugugugccaggagaagccuaagcugucccucaaauucaagauuugcaauacgaacaucgacgccucuaugaccauugucgauagcaaaccgauccuggaacucgcucccguggaccaaacaaccuacaucagagagaaggaugagcgcuguaaaacauggaugugcagagugcgggacgaaggcuuucaggucauucuggagccuuucaagaaucuuuuuggauccuacaucggcauuuucuauaccgggauccuguguauuaucugccuccugaucauuaucuacauuauccugcccauuuguuucaagcugcgcgauacgcugagacagcaugaagacgccuauaaaaaggagaugaaaauccgguga

SEQ ID NO: 14241 - RNA, 4332 nt, Artificial Sequence
  derived and/or modified CDS sequence (opt5) from INKV(Lovanger)__KX554936.1__GP
auggaggugcugaaccucaucuggcugcuuacccugugcagcgccucccccgucuuccagagauguuuucaagacggagcuauuguuaagcagaauccuucuaaagaagccgugacagaggugugccucaaggaugacgucagcaugaucaaaacggaagcgaaguacauuaaaaacgcuaccgggacauucgccaauaacaucgccaugcggaaguggcugguggcugauuggcacgacugucgcccgcagaaguccucuggaggccauauuaauguuaucgaggugggggaugaccuuagccugcacaccgaauccuauaucugcucugccgauugugucauuacaguggacaaagagaccgcucagaucagacuccaaacagauaacaccaaucauuuugagguugccggaacgaccgucaagagcggcugguucaaauccacaaccuacauuacacuggaccagaccugcgaacaccugaaggugagcugugggcccaaaucuauccaguuucaugcgugcuucaaccagcacauguccugugugcgguuucuccaccgcacgauucugccuggaagcaucgccaauucuauuugccaaaacaucgagaucauuauccuugugacacugucccucgcuauuuucaucuuucugaccauugucagcaagacauauguuuguuaccuucugaugcccaucuucaucccuauugccuauaucuacggcuggauuuauaauaagucuugcaaaaagugcaaacucuguggccugguguaccaucccuuuaccgaaugcgggacccacugugugugcggagcuagauacgagacauccgaucggaugaagcugcaucgcgccagcggccucuguccuggguauaaaucccugagagcggcccgggucaugugcaagucucgcggaccggcuagcgugcuuuccaucaugacggccauucugauccucaccuucguuacacccaucagcgcuauggugauuggcgagucuuccgaagucuacacccuggacgagcuuccugaugacauggugcagauggccgaaagaguuaacaucuauuaccagauuaucauuaucaauuaugggauuacaugggccuuucuucucuucggacuggugcuggcuuacuucuuuaaaaaguaucagcaccgguuccucagcuuuuacgcgauguacuguaaggagugcgacauguaucacgaacgcgccggccugaccuacuggggcgauuucacgaacaaauguagacaaugcacaugugggcaguuugaggacgucaccggacuuauggugcauaagaaaucuuauaauugcaucaucaaguacaaagcuaaguggauucgggauauccugauuaccuaucucaucauuaugcugaucaaggacagccuucuguucgucggcgccacagggaccgauuuugccgcuugcaucgacgagaaaacagugacguggaacuguaccggacccuuccucaaccugggccgcugcgauaagucccagaaaaagauuggguacgccgacaucgcggaucaacugaaaggacucggcgcuauuucuguucuggacaucccuaugauuaagagaauccccgaugaaaucagcggcucccuuaaguauauugacgggcuggagacauaccacgaacagcucaccgccgaguacgccuuucugacacgguauugugacuacuauacccaguacacggauaauagcggauauucucagaccguguggagaacauaccugcgcucccaugacuucggcgcuugcgucguguauccgaaccaacacuuuugucggugcguuaaacauggggauaaguguaauagcgccaaaugggacuucgcuaacgaaaugaagaccuuuuacacaggacagaaagccaaguucaauaaggaucuuaaccucgcgcugcuggugcuccacaaagccuucagaggcaccgggacgucuuacaucgcugaguccauggcccgcaaggacaaucggagcaugacacacuuugcucuggagauuaaaaagaaauucccuaccaacgcccuucugacagcgcucaucgauuauauuuccuaccugcagucucuggccgaaaugagcaccuuugagcuugacgaagauugggaggacuucaaguauaaacccgaaccuaccgaggcuccccagcucagaucccaucgcacagaucaauacaaucugaagaacgccgacucuaauagcaacgucaaggugugcaaaaauauccagaagguguccuguaucagcccccggucuagagcuaaauuugagaacauuaucgccugcggcgaacacgccaauccuuccguuuauaugaugccgaacgucagcauuuaccagucuaacuccgagcgcagccauuauuguaucgcugauucucacugccuggaagaguacgaggugguggaaagcgagcuccugaaugcgcuuaagaaauccaagugcugggccaaggaaauggacgacauuguccugcacaaacaggcugauggacuccggagcuguagaaugaaggacacgggcaacugcaaugugcaagagaacgauuggaccaucguucugugugaaaaugggaacuacuauuacucugaggcccaucgcgacuaugauaaagaccaggaugugggacacuucugccugagcccccgguguuccacaauuagauacccuaucaauaagcggcauauccgcaacugcgacuggcagauuucccacucuaccaucgauaaaauuagcguccaggagcuugccgacaucgaacaauauaagaaggcuauuucccagaaacuccagacaucucugagcaucuuuaaguacgugaaaaccaagaaucugccccauaucaaaccugccuauaaguacauuacgguugagggcguggaaacagucgaggggaucgaaaacgcguucauugaguccgagauccccgcucucgccggaaccgccauuggcuuuaagaucaauucuagagaagggaacuaccugauggaugugaucggcuauguuaaaagcgcuuccuacagcgccaccuauacaaagcuguacaccacaggaccgacgauuggcgugaauaccaaacacgacgagaaguguacagggccuugucccccuaucauugaucacaaagaaggauggcugaccuucgcgaaggagcggacaucuaccuggggcugcgaagaguuugggugccucgcugucuccgacggauguguguucggcagcugccaagacaucauuaaagaugagcuggccguguauagaaagacgaccgaggaacugacaaccgucgaacuuugccucacauuuucugacaagaccuacuguacaaaccugaaugccaucacccccauuaucacggauaaauucgagguucaguucaagacaguggaguccuauacccugccucgcaucauugcuaucaaaaaccaugaaauuaagguggggcagaucaacgaccucggcgucuacagcaaaggaugcggcaaugugcagaagauuaacgggaccaauuacggaaacggccugcccaaguuugauuaucuuugucaccuggccucucggaaagagguuaucaucagaaagugcuucgacaaugauuaccaggcuuguaaauuucuccaauccccgccuagcuaucgccuggaggaacaucaggggacagugaccgucauugacuacaagaaaauccugggaacgauuaagaugaaggccauccuuggcgaugugaaauauaagaacuaccaguccaauauugaaaucaacgcggaggggacaugcgccggcuguaucaauugcuucgagaacauucacugugaauuuaccauccauacaaccguugaggcuagcugccccauugugacagacugugucucuuuccacgauagaauccugauuacccccgacgaacacaaauaugcccucaaggugguuugccaagagaaaccuaagcugagccucaaguuuaaaaucugcaauacgaacauugacgcuuccaugaccaucguggauucuaagccgauccuggaacuugcccccgucgaccagacaaccuacauucgggagaaagaugagcgcuguaagacauggaugugcagagugcgggacgaaggauuccaggugauccuggagccuuuuaaaaaucucuucggcagcuacauugggaucuuuuauaccggcauucuguguaucaucugccugcuuauugucaucuacauuauccugcccauuuguuucaagcuccgcgauacgcugagacagcaugaagacgccuauaagaaagagaugaagauccgguga

SEQ ID NO: 14242 - RNA, 4335 nt, Artificial Sequence
  derived and/or modified CDS sequence (opt5) from JSV__AF123487.1__GP
auggaggugcugaaccucaucuggcugcuugcccugugcagcgcuucccccgucuuccagagauguuuucaagacggagccauuguuaagcagaauccuucuaaagaagcggugaccgaggugugccucaaggaugacgucagcaugaucaaaacagaagcuaaguacgugaaaaacacgaccgggacauucgccaauaacauugccaugcggaaguggcugguugcugauuggcacgacugucgcccgcagaaguccucuggaggccauaucaaugugauugaggucggggaugaccuuagccugcacaccgaauccuauaucugcucugccgauugugugaucacaguugacaaagagaccgcucagauuagacuccaaacagauaacaccaaucauuuugagguggccggaacgaccgucaagagcggcugguucaaauccacaaccuacaucacacuggaccagaccugcgaacaccugaaggugagcugugggcccaaaucuauucaguuucaugcgugcuucaaccagcacauguccugugugcgguuucuccaccgcacgauccugccuggaagcauugccaauucuaucugccaaaacauugagaucaucauucuugucacacugucccucguuaucuucauuuuucugagcaucgugucuaagaccuauguguguuaccuucugaugcccauuuucaucccuaucgcuuuuauuuauggcuggaucuacaauaaguccugcaaaaagugcaaacucuguggccuggucuaucaucccuucacagaaugcgggacccacugugugugcggagccagauacgagaccagcgaucggaugaagcugcaucgcgcuuccggccucuguccuggguacaaaucucugagagccgcgcggguuaugugcaagagcaaaggaccggccuccauucuuagcaucaugacagcuauucugauccucacguuugugacccccaucucugccauggucauuggcgaguccagcgaaguguauacacuggacgaucuuccugacgacaugguucagauggcugagcgcgugaacaucuacuaucagauuaucauuaucaauuacggggucaccugggccuuccugcuccugggacugauucucgccuauuucuuuaagaaguaccagcacaaauuccuggauuuuuaugcuauguacugugaagagugcgacauguaccacgaaaagucuggccuuacacauuggggcgauuucaccaacaaauguagacaaugcacgugugggcaguuugaggacguggcgggacugaugauccaccggaaaagcuauaauugccucgucaaauacaaggcccgcuggaucagagauauucugaucauguaucuugcuaugauucugaucaaggacucccuccuguucgugggcgccucugggacagauuuugccgcuugcauugacgagaaaguugugaccuggaacuguaccggacccuuccugaaccucggccggugcgauaagagccagaaaaagacaaauuacgaagggaucgccaaccaacugaaaggacuuggcgucaucuccgugcuggacauuccuaugaucaagaauaugcccgaugagauuagcggcucucucaaguauaucgacucccuggaaaccuaccaugagcagcugacagcggaauaugcuuuucuuacgcgcuacugugacuacuauacccaguacacagauaacagcggguauucuagaaccguuuggcggacauaccucagaucccacgacuucggagccugcguggucuauccgaaucaucaccugugucgcugcgugaaauacggcgauaaguguaacagcgccaaaugggacuuugcuaaugagaugaagaccuucuauacggggcagaaagugaaguuuaacaaggaucugaaucucgcccugcuuguucugcacaaggcuuuccggggaaccggcacagccuacgucgcggaggccauggcuagaaaggacaacggguccauggcccauuucgcucucgaaauucgcaaaaaguuuccuaccaaugcccugcuggcggcccuuaucgauuacaucguguaucuccaaucucuggcugagauugccacauucgaacuggacgaggauugggaagacuuuaaauacaagcccgagccuaccgagagcacgccccaggcucggucccacagaaacgaucaguauaauuucaaaaacgccgaaucuaauagcaacacaaaggugugcaagaacguccagaaagugcucuguaucagcccccgcuccaaggccaaauuugagaauauuaucgcuugcggcgaacaugcgaacccuucuguuuacaugaugccgaauguguccauuuaucaaagcaacucugagcggucccacuacuguaucgccgacagccacugccuggagaaguaugaagucguggagaccgaacuucugaaugcucucaaaaagucuaagugcugggccaaagagauggaugacaucguucugcauaagcagagcgacggacugagauccugucgcauuaaagauacaggcaacugcaaugugcaggaaaacgacuggaccaucguccuuugugagaaugggaacuacuacuauagcgaggugcacaaggauuacgacaaagaucaggacguuggacauuucugccucucuccccgguguaccacaauuagauauccuaucucccgccggcacauuagaaagugcgaauggcaaaucagccauuccacgauugauaagaucucugugcaggagcuggccgacaucgaacaguacaaaaaggcuauuagccagaaacugcaaaccucccucucuaucuuuaaguauguccggaccaaaaaucugccccacauuaagccugccuacaaguauaucacaguggagggcguggaaacaauugaggggaucgagaacgcguucaucgaaagcgagauucccgcucuugccggaaccgccaucggcuuuaaaauuaauucccgcgaagggaacuaccugauggaugucaucggcuacguuaagucugcuagcuauuccgccguguacacgaaacucuauacaaccggaccgaccauuggcaucaauacaaagcacgacgagaaauguaccgggccuugccccgcggugaucgaucauaaggacggauggcugacauucagcaaagaaagaacgucuaccuggggcugugaggaguuugggugccuggcugucuccgauggauguguguucggcagcugccaggacauuaucaaggacgaacuugccguuuaccggaagacaaccgaggaacucacaaccguggagcugugccugacguuuucugauaaaaccuauuguacaaaccucaacgccauuaccccuaucauuacagacaaguucgagguccaguucaaaaccguggaauccuacacacugcccagaguuaucgcuauuaagaaucacgagaucaaaguggggcaaaucaacgaucuuggcgucuauagcaagggaugcggcaaugugcagaagguuaacgggaccaauuacggaaacggcucuccucgcuuugacuaccugugucaucucgccucccggaaagaagugauucugagaaagugcuucgauaaugacuaucaggcuuguaaauuucugcagagccccuccagcuaccgccuugaggaacaccaagggacggucacagugaucgauuauaagaaaauucugggaaccaucaagaugaaggccauucucggcgacgugaucuacaucaacuaucagaauaacauugagaucaaugcggaggggaccugcgccggcuguauugauugcuucgaaaacauccauugugaguuuacaauucacaccacggucgaggcuucuugcccgaucacaaccgaauguguuagcuuccacgacagaauccugauuacaccugaugaacauaaauacgcccucaagaucgugugccacgacaaacccaaggugucccugaaauuuaagauuugcaauaccaacgucgacgcugccaugacaaucguggauucuaagcccauucuugagcuggccccuguugaccagaccacguauauccgggagaaagaugaacgcuguaagaccuggaugugcagagugcgggacgagggauuccaggucauucucgaaccguuuaaaaaucuguucggcagcuacaucgggaucuuuuacacaggcauucuguccaucauuugucuucugaucgugguuuauauuauccuccccaucugcuucaagcugcgcgauacccucagacaacaugaggacgcuuaccggaaagaaaugaagauucgcuga

SEQ ID NO: 14243 - RNA, 4335 nt, Artificial Sequence
  derived and/or modified CDS sequence (opt5) from JSV(BFS 4474)__KX817319.1__GP
auggaggugcugaaccucaucuggcugcuugcccugugcagcgcuucccccgucuuccagagauguuuucaagacggcgccauuguuaagcagaauccuucuaaagaagcggugaccgaggugugccucaaggaugacgucagcaugaucaaaacagaagcuaaguacgugaaaaacacgaccgggacauucgccaauaacauugccaugcggaaguggcugguugcugauuggcacgacugucgcccgcagaaguccucuggaggccauaucaaugugauugaggucggggaugaccuuagccugcacaccgaauccuauaucugcucugccgauugugugaucacaguugacaaagagaccgcucagauuagacuccaaacagauaacaccaaucauuuugagguggccggaacgaccgucaagagcggcugguucaaauccacaaccuacaucacacuggaccagaccugcgaacaccugaaggugagcugugggcccaaaucuauucaguuucaugcgugcuucaaccagcacauguccugugugcgguuucuccaccgcacgauccugccuggaagcauugccaauucuaucugccaaaacauugagaucaucauucuugucacacugucccucguuaucuucauuuuucugagcaucgugucuaagaccuauguguguuaccuucugaugcccauuuucaucccuaucgcuuuuauuuauggcuggaucuacaauaaguccugcaaaaagugcaaacucuguggccuggucuaucaucccuucacagaaugcgggacccacugugugugcggagccagauacgagaccagcgaucggaugaagcugcaucgcgcuuccggccucuguccuggguacaaaucucugagagccgcgcggguuaugugcaagagcaaaggaccggccuccauucuuagcaucaugacagcuauucugauccucacguuugugacccccaucucugccauggucauuggcgaguccagcgaaguguauacacuggacgaucuuccugacgacaugguucagauggcugagcgcgugaacaucuacuaucagauuaucauuaucaauuacggggucaccugggccuuccugcuccugggacugauucucgccuauuucuuuaagaaguaccagcacaaauuccuggauuuuuaugcuauguacugugaagagugcgacauguaccacgaaaagucuggccuuacacauuggggcgauuucaccaacaaauguagacaaugcacgugugggcaguuugaggacguggcgggacugaugauccaccggaagucuuauaauugccucgucaaauacaaggcccgcuggaucagagauauucugaucauguaucuugcuaugauucugaucaaggacucccuccuguucgugggcgccucugggacagauuuugccgcuugcauugacgagaaaguugugaccuggaacuguaccggacccuuccugaaccucggccggugcgauaagagccagaaaaagacaaauuacgaagggaucgccaaccaacugaaaggacuuggcgucaucuccgugcuggacauuccuaugaucaagaauaugcccgaugagauuagcggcucucucaaguauaucgacucccuggaaaccuaccaugagcagcugacagcggaauaugcuuuucuuacgcgcuacugugacuacuauacccaguacacagauaacagcggguauucuaaaaccguuuggagaacauaccuccggucccacgacuucggagccugcguggucuauccgaaucagcauuuuuguagaugcgugaaguacggcgauaaauguaacagcgccaagugggacuucgcuaaugagaugaaaaccuuuuauacggggcaaaaggugaaguucaacaaagaucugaaucuggcccuccugguucuucacaaggcuuuccgcggaaccggcacagccuacgucgcggaggccauggcucggaaagacaacggguccauggcccacuuugcucuggaaauuagaaagaaauucccuaccaaugcccuccuggcggcccugaucgauuacaucguguaucuucagucucucgcugagauugccacauuugaacuggacgaggauugggaagacuucaaguacaaacccgagccuaccgagagcacgccccaggcucgcucccaucggaacgaucaguauaauuuuaagaacgccgaaucuaauagcaacacaaaggugugcaaaaacguccaaaaggugcuguguaucucccccagaagcaaagccaaguucgagaauauuaucgcuugcggcgaacacgcgaacccuucuguuuacaugaugccgaauguguccauuuaucagagcaacucugagcgcucccauuacuguaucgccgacagccacugccucgagaaauaugaagucguggagaccgaacugcuuaaugcucugaagaagucuaaaugcugggccaaggagauggaugacaucguucuccacaaacagagcgacggacugcgguccuguagaauuaaggauacaggcaacugcaaugugcaggaaaacgacuggaccaucguccugugugagaaugggaacuacuacuauagcgaggugcauaaagauuacgacaaggaucaagacguuggacacuuuugccuuucuccccgcuguaccacaauucgguauccuaucuccagacgccauauucggaagugcgaauggcagaucagccacuccacgauugauaaaaucucugugcaggagcucgccgacaucgaacaguacaagaaagcuauuagccaaaagcugcagaccucccugucuaucuucaaauaugucagaacaaagaaucucccccauauuaagccugccuacaaauauaucaccguggagggcguggaaacaauugaggggaucgagaacgcguuuaucgaaagcgagauucccgcucuggccggaaccgccaucggcuucaagauuaauucccgggaagggaacuaccuuauggaugucaucggcuacguuaaaucugcuagcuauuccgccguguacacgaagcuguauacaaccggaccgaccauuggcaucaauacaaaacacgacgagaaguguaccgggccuugccccgcggugaucgaucacaaagacggauggcucacauuuagcaaggaacgcacgucuaccuggggcugugaggaguucgggugccuggcugucuccgauggauguguguuuggcagcugccaggacauuaucaaggacgaacuggccguuuacagaaaaacaaccgaggaacuuacaaccguggagcucugccugacguucucugauaagaccuauuguacaaaccugaacgccauuaccccuaucauuacagacaaauucgagguccaauuuaagaccguggaauccuacacacucccccggguuaucgcuauuaaaaaucaugagaucaagguggggcagaucaacgaucugggcgucuauagcaagggaugcggcaaugugcagaaaguuaacgggaccaauuacggaaacggcucuccuagauucgacuaccuuugucaccuggccucccgcaaggaagugauucuccggaaaugcuuugauaaugacuaucaggcuuguaaguuccugcaaagccccuccagcuacagacuggaggaacaucaggggacggucacagugaucgauuauaaaaagauucuuggaaccaucaagaugaaagccauucugggcgacgugaaguacaaaaacuaucagaauaacaucgagaucaaugcggaggggaccugcgccggcuguauugauugcuuugaaaacauccacugugaguucacaauucauaccacggucgaagcuagcugcccgaucacaaccgaguguguuagcuuucacgaccgcauucucaucacaccugaugaacacaaguacgcccugaaaaucgugugccaugacaagcccaaggugucccucaaauucaagauuugcaauaccaacgucgacgcugccaugacaaucguggauucuaaacccauucuggagcuugccccuguugaccagaccacguauaucagagagaaggaugaacgguguaaaaccuggaugugccgcgugagagacgagggauuucaagucauucuggaaccguucaagaaucucuuuggcagcuacaucgggauuuucuacacaggaauccuguccaucauuugucugcuuaucgugguuuauauuauccugcccauuugcuucaagcuccgggauacccugcgccagcacgaggacgcuuacagaaaagaaaugaagauccgguga

SEQ ID NO: 14244 - RNA, 4323 nt, Artificial Sequence
  derived and/or modified CDS sequence (opt5) from LUMV__AF123484.1__GP
augauccuggugcuuuucuuugucgcccugagcgcugccggccccguuuaccagagaugcuuccaagacggggcgauugugaagcaguccccuucuaaacaggcugugaccgaggucugucuuaaggaugacgugagcaugaucaaaacagaagcccgguauuuuaagaacacgaccggaauuuacgccaauaacguugcuauccgcaaauggcugguggccgauuggcacgacugcagaccgaagaaggucuccggcgggcauauuaaugugaucgagguuggagaugaccucacacugcacaccgaagcguauguguguaacgccgauugcaucauuggcgucgacaaagagacagcucaggugcggcuucaaaccgauacaaccaaucauuucgaaaucgccgggacgaccgugaagucuggaugguuuaaaagcacaaccuacauuacacugggccagaccugugagcaccucaaggucuccugcggccccaaaucuauccaguuccaugcuuguuuuaaccagcacaugagcugcguucgcuuccugcacagaacgauucugccuggguccaucgccaauagcgugugucaaaacauugagaucaucauucucacagugcugacccuucugaucuuuacacuccugucuauucuuuccaagaccuauaucugcuacauucugaugcccaucuucaucccucucgcuuauauuuacggacugaucuacaauaagagcuguaaaaagugcaaacugugcggccucgucuaucaucccuuuaccgaaugugggacacacugcguguguggagcccgguacgacacgucugaucgcaugaagcugcauagagcguccggccuuugcccuggguauaaaagccugcgggccgcucgcguuauguguaagucuaaaggaccggccuccgugcucagcauuaucaccgcuguccugauucuuacauucaucacccccaucaacgccaugauugccggcgagacacaggaaaccuuuaagcuggaggaccucccugaugacaugcuguccauggcuaugaagaucaauauguacuauauuaugugcaugcugaacuacguggcgacguggucuuucaucuucugugcccucauuaucgcucugauuuuuaaaaaguaucagcacaaauuccuuagcuacuacgccauguauugccaggagugugacauguaccacgauagauccggccugaaguauaaugggggauuuacaaacaaaugccggcaauguaccugcggccaguacgaagacgccaccgggcucauggcucaucgcaagacauauaauugccugauccaguacaagagcaaauggcuuguuaacuuccugaucaccuauauuauccucaugcugauuaaggauucugugcugaucguccacgccgagggaacagacuuugaaaaauguuccagcgauauuaacaucguguggaauugcacgggccccuuccucucucuggggaacugugagaagaaacaaaagaaggaaagcuacaaugacaucgcggcucagcuuaaaggacuggaugccauuuccguccucgacaucccuaugauuucuaagauccccgaggauauugccggcgcucugagauuuaucgaggaacagaacagcuaccaugugcagcugaccguugaguaugccaugcuuacacgguacugcgacuauuacacccaauucuccgauaauagcggcuauucucagacaaccuggcgcacguaccucagaucccacgacuuugaggcuuguauccuguauccgaaccagcauuucugccggugugugaaacacggggacaagugcagcagaucuaauugggauuuugccaacgaaaugaaaaauuacuacuccggaaagcagagcaaguauaacaaagaccugaaucucgcgcugauguccuuccaccaugccuuucgcggcaccucuagcuucuacacagcuaagcuccugcgggaaaagaagaccgaggagcucaaaaacuauauugauaagaucagaacagaauacccugggaaugcccugcugaaagcugucauugacuauaucaaguacaugaugggacuuaccgagguguccaacuucaagcacgaugaaaugugggacgauuuuauuuucgagaaucccucuacgcgcagcucccucagccggaacucugaauccagcuaugacuuuaaaacaaacaucaauucugauccuaccaacacauguaagaauaucaaagccguuaccugccugucccccaagagcggcgugucuuucgacagcgucauugcguguggggaguccaaccaacccagcaucuaccagaaaccuagaaaacagguguaccagucuaauuccgagcaaacccauuuuugccugcucgauacacacugccuggaaggcuaugagacggugggagaagagguucuuagcgccauuaagaaauccaaguguugggagaccgacuucacagaauacauccaguuuaaacagucugauggcguccgcagcugccggaugaaggacuccggggaguguaccgugacaaccaacaaauggccgauuauccugugcgaaaauaacagauauuacuauucugagcuccacaaggacuacgauaaggaccaggauauuggacauuucugucugagcccccgcugcaauacgauccgguauccuaucaaccaaaaucacauuuccaacuguacauggcaagugagacauaauaacaucgacaaaauugaaguccacgagcuggaggaucuugaacaguaccgcaaggcuaucacccagaaacuccagaccucucugacacuguuuaaguacagccggaccaaaaaucucccccauauuaagccuaucuauaaguacaucacaauugagggcacggaaaccgccgaggggaucgaauccgcuuauauugagagcgagauccccgcccuggccggaacaucuauuggcuucaaaaucaccuccaagagcgggaaacaccuucuggacgugaucucuuacguuaaguccgcuagcuauucugcgguguacacaaaacucuauaccacgggcccgaccauuggagucaacacaaagcacgaugaacugugcaccggcuccuguccugugaacguuccccauaauacaggguggcugaccuuugccagagagcggacaagcuccuggggaugcgaagaguucggcugucuugcuaucagcgacgggugcguguuuggaucuugccaggauauuaucaaagacgaacucaccgucuaccgcgaggagacggaagagacaaccaacguggaacugugucugaccuucgccgauaagacauacugcaccaaucucaacgccauuacgccuaucauuacagaccaguucgagguucaauuuaagaccguggaggcuuauagccugcccagaaucaucgccguccggaaucacgaaauuauggugggccagaucaacgauauugggguguacuccaaaggcuguggaaauguccagaagaucaacaauacaaacuauggcaaugggguuccuaaauucgacuaccuuugccaucuggcgucuagaaaggaggugauuauccgcaaauguuuugacaacgauuaucaggcuugcaaguuccuccaaacccccgccagcuaccggcuggaagaggaaggaggcuccgugacagucaucgacuauaagaaaauucuggggaccaucaagaugaaagccauucuuggagaugugaaguacaaaacguuugcugacaauguugauaucaccguggagggcgccuguacagggugcauuaacuguuucgacaauauccacugcgagcugaccauccauucuacagucgaagcgagcuguccgauuaccuccucuugcacgguguuucacgauagaauccucauuacaccuaacgagcacaaguacgcuaucaagguuauuugcaacggcaaacccggaaucagccugcccuucaagauuuguaauaccaaaguggacgccgccaugacacucaccgaugcuaagcagauccuggaacuugccccugucgaccagaccacauauaucaaagagaaggaugaacgcugcaagacguggauguguagagugcgggacgagggccugcagguuauuuuugagccguucaaaaaccucuuuggguccuacaucggaauuuucuauaccuucgugaucuuucuggucgugauuuucaucgugaucuacauuguccugcccaucugcuuuaaacuucgcgacacacugagacaacaugaagaugcuuauaagcgggagaugaagauucgcuga

SEQ ID NO: 14245 - RNA, 4323 nt, Artificial Sequence
  derived and/or modified CDS sequence (opt5) from LUMV(SAAr 1881)__KX817325.1__GP
augauccuggugcuuuucuuugucgcccugagcgcugccggccccguuuaccagagaugcuuccaagacggggcgauugugaagcaguccccuucuaaacaggcugugaccgaggucugucuuaaggaugacgugagcaugaucaaaacagaagcccgguauuuuaagaacacgaccggaauuuacgccaauaacguugcuauccgcaaauggcugguggccgauuggcacgacugcagaccgaagaaggucuccggcgggcauauuaaugugaucgagguuggagaugaccucacacugcacaccgaagcguauguguguaacgccgauugcaucauuggcgucgacaaagagacagcucaggugcggcuucaaaccgauacaaccaaucauuucgaaaucgccgggacgaccgugaagucuggaugguuuaaaagcacaaccuacauuacacuggaccagaccugugagcaccucaaggucuccugcggccccaaaucuauccaguuccaugcuuguuuuaaccagcacaugagcugcguucgcuuccugcacagaacgauucugccuggcuccaucgccaauagcgugugucaaaacauugagaucaucauucucacagugcugacccuucugaucuuuacacuccugucuauucuuuccaagaccuauaucugcuacauucugaugcccaucuucaucccucucgcuuauauuuacgggcugaucuacaauaagagcuguaaaaagugcaaacugugcggacucgucuaucaucccuuuaccgaauguggcacacacugcguguguggggcccgguacgauacgucugaccgcaugaagcugcauagagcguccggacuuugcccuggcuauaaaagccugcgggccgcucgcguuauguguaagucuaaagggccggccuccgugcucagcauuaucaccgcuguccugauucuuacauucaucacccccaucaacgccaugauugccggagagacacaggaaaccuuuaagcuggaggaucucccugacgacaugcuguccauggcuaugaagaucaauauguacuauauuaugugcaugcugaacuacguggcgacguggucuuucaucuucugugcccucauuaucgcucugauuuuuaaaaaguaucagcacaaauuccuuagcuacuacgccauguauugccaggagugugauauguaccacgacagauccggccugaaguauaauggcggguuuacaaacaaaugccggcaauguaccugcggacaguacgaagaugccaccggccucauggcucaucgcaagacauauaauugccugauccaguacaagagcaaauggcuuguuaacuuccugaucaccuauauuauccucaugcugauuaaggacucugugcugaucguccacgccgaggggacagauuuugaaaaauguuccagcgacauuaacaucguguggaauugcacgggacccuuccucucucugggcaacugugagaagaaacaaaagaaggaaagcuacaaugauaucgcggcucagcuuaaagggcuggacgccauuuccguccucgauaucccuaugauuucuaagauccccgaggacauugccggagcucugagauuuaucgaggaacagaacagcuaccaugugcagcugaccguugaguaugccaugcuuacacgguacugcgauuauuacacccaauucuccgacaauagcggcuauucucagacaaccuggcgcacguaccucagaucccacgacuuugaggcuuguauccuguauccgaaccagcauuucugccggugugugaaacacggcgauaagugcagcagaucuaauugggacuuugccaacgaaaugaaaaauuacuacuccgggaagcagagcaaguauaacaaagaucugaaucucgcgcugauguccuuccaccaugccuuucgcggaaccucuagcuucuacacagcuaagcuccugcgggaaaagaagaccgaggagcucaaaaacuauauugacaagaucagaacaaaauacccuggcaaugcccugcugaaggcugucauugauuauaucaaguacaugauggggcuuaccgaaguguccaacuucaaacacgacgagaugugggaugacuuuauuuucgaaaaucccucuacgcgcagcucccucagccggaacucugaguccagcuaugauuuuaagacaaacaucaauucugacccuaccaacacauguaaaaauaucaaggccguuaccugccugucccccaaaagcggagugucuuucgauagcgucauugcguguggcgaauccaaccaacccagcaucuaccagaagccuagaaaacagguguaccagucuaauuccgagcaaacccauuuuugccugcucgacacacacugccuggagggguaugaaacggugggcgaggaaguucuuagcgccauuaaaaaguccaaauguugggagaccgauuucacagaguacauccaguuuaagcagucugacggaguccgcagcugccggaugaaagacuccggcgaauguaccgugacaaccaacaaguggccgauuauccugugcgagaauaacagauauuacuauucugaacuccacaaggauuacgacaaagaucaggacauugggcauuucugucugagcccccgcugcaauacgauccgguauccuaucaaccaaaaucacauuuccaacuguacauggcaagugagacauaauaacaucgauaagauugagguccacgaacuggaggaccuugagcaguaccgcaaagcuaucacccagaagcuccagaccucucugacacuguuuaaauacagccggaccaagaaucucccccauauuaagccuaucuauaaauacaucacaauugaaggaacggagaccgccgaaggcaucgaguccgcuuauauugaaagcgagauccccgcccuggccgggacaucuauuggauucaagaucaccuccaaaagcggcaagcaccuucuggaugugaucucuuacguuaaauccgcuagcuauucugcgguguacacaaagcucuauaccacggggccgaccauuggcgucaacacaaaacacgacgagcugugcaccggauccuguccugugaacguuccccauaauacaggcuggcugaccuuugccagagaacggacaagcuccugggggugcgaggaguucggaugucuugcuaucagcgauggcugcguguuugggucuugccaggacauuaucaaggaugaacucaccgucuaccgcaaggaaacggaggagacaaccaacguggaacugugucugaccuucgccgacaaaacauacugcaccaaucucaacgccauuacgccuaucauuacagaucaguucgagguucaauuuaagaccguggaggcuuauagccugcccagaaucaucgccguccggaaucacgaaauuauggugggacagaucaacgacauuggcguguacuccaaaggguguggcaauguccagaagaucaacaauacaaacuauggaaauggcguuccuaaauucgacuaccuuugccaucuggcgucuagaaaggaggugauuauccgcaaguguuuugauaacgacuaucaggcuugcaaauuccuccaaacccccgccagcuaccggcuggaagaggaagggggauccgugacagucaucgauuauaagaaaauucugggcaccaucaagaugaaagccauucuuggggacgugaaguacaagacguuugcugauaauguugacaucaccguggagggagccuguacaggcugcauuaacuguuucgauaauauccacugcgaacugaccauccauucuacagucgaggcgagcuguccgauuaccuccucuugcacgguguuucacgacagaauccucauuacaccuaacgagcacaaauacgcuaucaagguuauuugcaacgggaaacccggcaucagccugcccuucaagauuuguaauaccaaaguggaugccgccaugacacucaccgacgcuaagcagauccuggaacuugccccugucgaucagaccacauauaucaaggagaaagacgaacgcugcaagacguggauguguagagugcgggacgagggacugcagguuauuuuugaaccguucaaaaaccucuuuggcuccuacaucgggauuuucuauaccuucgugaucuuucuggucgugauuuucaucgugaucuacauuguccugcccaucugcuuuaaacuucgcgauacacugagacaacaugaggacgcuuauaagcgggagaugaagauucgcuga

SEQ ID NO: 14246 - RNA, 4329 nt, Artificial Sequence
  derived and/or modified CDS sequence (opt5) from MELV__U88057.1__GP
augaucgcccugauuuuccucaucgcuauugccgcggcuagccccguguaccagagaugcuuucaagacggcgggaucgucaagcagaacccuuccaaagaugccguuaccgaggugugucugaaggacgaugugucuaugauuaaaacagaagccaaguauaugaaaaaugacacgggaaccuucagcaacaaugucgcuaugcggaaguggcuuguggccgauuggcacgacugccgcccgcagaaguccucuggcgggcauaucaacguuaucgaggugggagaugaccugagccuccacacagaggcuuacauuuguuccgccgauugcaugaucucugucgacaaagagaccgcgcagauuagacugcaaacagauagcaccacacauuuugaaaucgccggcaccacggugaaguccgggugguucaaaagcaccacauauauuacccuugaccagacaugugagcaccugaagguuucuugcggacccaaauccauccaguuucaugcuuguuucaaucagcacaugagcugcgugcgguuucuccaccgcaccauucugccuggcucuaucgccaacuccaucugucaaaauauugagaucauuauccuggucacgcucacacugcuuauuuucaucuuucugagcauccucucuaagaccuacauuugcuauauccugaugcccauguucauuccuguggcuuacaucuauggcuggauuuacaacaaguccuguaaaaagugcaaacuuugcgggcugguguaccaucccuuuacagaauguggaacccacugcgucuguggcgccagauaugagaccagcgaucggaugaagcuccaucgcuccucugggcugugcccuggauacaaaagccugagagcggcccggguuauguguaaguccaaaggcccggcuagcauccucucugugcugacagccgugcuuauccugacguucgucacccccaugaaugcucucacacugggguccagcgaagagaacuauaaacuugagaaucugccugacgacaugcucgauauggccgaacgcauugacaucuacuaucugucuauuauccugaacuacagcauuaccuggggacucgugauccugcuuggccugacauuuauucucuucagacgguuccagcaccgcuuucugaauugcuaugccauguacuguuccgagugcgauauguaccacgacaagaacggccuuguuagaaauggggauuucaccaacaagugucggcagugcacguguggacaguaugaagacgcugcgggccugaucauccaucaaaagucuuacaacugccucauuaaauauaaggccaaauggauccgcaauauucugcugacauacaucauucucauccugaucaaggauagcgugcuucugaccuccgcugaggggcccgacuuuagcgucugcauugaacagaaggccaucucuuggaacuguaccggaccuuuccucaaucugggcagaugcgagaaaacacagaagaaagccuccuaugcuaccauugccacacaacugcggagcaucgaugcgauuucugugcuugacauccccaugaucgcuaagauuccggaggauaucuccggggcccucaaauacauugaaagccugaagacguaucacgagcagcugaccgccgaauacgcuaugcucacaagauacugugacuauuacacccaguuuuccgacaacucuggauauagccagacauccuggcgcaaguuccugcggucucaugauuuugagagcugcaucauuuacccuaaucaacacuucuguagaugcguuaaacaggacgaaaaguguuccagcgccaaaugggauuuugcuucugagaugaagggcuucuaucuuaacaaacaggccaaguuuaauaaggaccugaaccucgcgcuguccaccuuccauaaagccuuucgcggcacgcccaucagcuacgugaccgagcugaucucuaagaauaaaaacuccagccuucucauguaugucucugaaauuaagcggaaauucccugggaaugcucugcugguggcccuccuggauuucaucauguaccuucagagccuguccgagauuagcggauuugaacucggcgacgagugggaagauuucaaguacgaccccgagcccacagagccugcucugaugccgagaucucaccgcuccgaucaauauaacuuuaaaaaugccgcgagcgucuccaagaccaagacaugcgaaaacaucaaacgggugcugugucuuucucccagaagccgcgccaccuucgacgauguuguggcuugcggggaguuugccaauccuuccgucuacaugcuccccaacauuacgaucuaucagucuaacauugaacggagccacuacuguaucgcugacucccauugccuggaggaguucgaacuggugaagccugagcuccugacagcccuuaaaaagucuaccugcugggccggagaaaucgaugacauuguucugcacaaacagagcgacggccucagauccugucgcaucaaggauacagggaccugcgacgugcugggcaaugaguggaccauuguccugugugaaaacaauaacuuuuauuacagcgaggugcaucgggauuaugacaaggaucaggacaucggacacuucugccuuucucccagauguaauauuauccgguacccgaucaacccucgccacauuagaacaugcaaauggcaaaucucccauagcacgauugauaagaucaccgugcacgagcucgcugacauugaacaguacaaaaaggcgaucacacagaaacugcaaaauucucuguccaucuuuaaguauaagcggaccaaaaaccucccccauauuaagccuaucuacaaauauauugccaucgagggcacagaaaccguugaggggauugaaaaugcuuacaucgagagcgagauucccgcccuggccggaacggcuaucggcuucaagaucaacucuaaagaugggaaucaccuuauggacgucauuggauaugugaaguccgccagcuacuccagcacauauaccaagcuguacaccacaggcccuaccaucgggauuaacacaaaacaugaugaaaaguguacgggcucuugccccacccaggugaaacacaagacaggauggcucaccuuugcgaaagagagaacaagcaccuggggcugugaagaguucgggugccuggcuaucuccgacggaugugucuuuggcucuugccaggauauuaucaaggacgaacugacgguguaccgcaaaaccacagacgagguuaccgagcuugaacugugccucacauucgccgauaagaccuauuguacaaaucugaacgccgugaccccgaucauuacggacaaguucgagguccaguuuaaaacaguggaaagcuacucccucccucggaucauugcuguuaagaaucacgagaucaaaguggggcaaauuaacgauaucggagucuauucuaagggcugcgggaacgugcagaaaguuaauggcaccagcuacggaaacggcgugcccaaguucgacuaucugugucaucuugccuccagaaaggaggucaccauccgcaaaugcuuugauaaugacuaccaggcguguaaguuccugcagacacccucuagcuauagacucgaagaacaccaagggaccgugacgauuaucgauuacaaaaagauucugggauccaucaaaaugaaggcuauucugggcgacgugaaguacaaaaacuaugccagcaauaucgauauuaacgccgaagggucuugcgcuggauguaucaauugcuuugagaacauccauugugaguucacaauucacuccaccgucgaaacaagcugccagaucgagucugacuguaccuccuuucaugaucggguucuuauuacaccuaaugaacacaaguacgcccugaaacucaucugccacgacaagccggcuagcucccugaaauucaagauuugcaacaccaagguggaggccgcgaugacgcucguggacgcccgccccaucaucgaacuggcuccugucgaucagaccgccuauauuagagagaaagacgaacgguguaagacauggaugugccgcgugagagaugagggcauccagguuauuuuugagcccuucaaaaaucuuuuugggucuuacaucggcauuuucuaugcuaucgugaucuguauuaucguccuguuccucauuguguacaucguucugccuauuugcuuuaagcugaaagacacccuuaagcaacaugaagaugccuauaagcgggagaugaaaauccgcuga

SEQ ID NO: 14247 - RNA, 4326 nt, Artificial Sequence
  derived and/or modified CDS sequence (opt5) from SAV__AF123486.1__GP
augaucccccuccuguuccuggugacccuugucagcgccggcccuguuuuucagagaugcuuccaagacggggcuauugugaagcagaacccguccaaagaggccgugacagaagucuguaucaaggaugacgugucuaugauuaaaacggaggcgcgguacguucgcaauagcuccggaguguuuucuaacaaugucgcucugagaaaguggcucgugagcgauuggcacgacugcaaacccaagaagguuuccggcgggcauaucaacgugauugaagucggaaaugaucugacccuucacacagagucuuauguguguagcgccgacugcaccaucggcaucgauaaagaaacagcccagauucggcugcagaccgacacaaccaaccauuucgagguggcugggacgaccgucaaguccggaugguuuaaaagcacaaccuacaucacacucgaucaaaccugugagcaccugaagguuucuugcggcccuaaauccauucaguuccaugccuguuuuaaucagcacaugagcugcgugcgcuuccugcacagaacgauccuccccggcucuauggcuaacuccauuugucagaauaucgaaauuaucauccugacaacccuugcccugcucauuuuucugcuucugacaauccucagcaagaccuauauuugcuaccugcugaugccuaucuucauucccaucgcgcaucucuaugggcugaucuacaacaagucuuguaaaaagugccaacuuugcggacugguguaucacccuuuuaccgaguguggcacacauugcgucuguggggcccgguacgaaacguccgaccgcaugaaacuccacagagcuagcggacugugcccgggcuacaagucccuucgggccgcucgcgugauguguaaaucuaaggggcccgccagcaaucuguccauuaucaccgcgguucucacacugaccuucgugacaccuauuaacggacugaccaucggcgauagcaaagagguccucaaucccgacgagcugccugaugacaugcuugaaauggcccagaagcugaacauguaucagcucauuugcaucaucaauuacacggcuacauggucuauuaucauuaucggccuggccguguuuuauauuuucaagaaauaccagcacagauucuauaacuacuaugcuauguacugucaagagugcgacauguaccaugaacgguccgggcuuaaguggaacggagauuuuaccaauaaaugucgccagugcaccuguggcgaguaugaagacgccgccgggcugaucagccacagaaagucuuacaacugccuccugcaguauaaaguuaagugggugaugaauuuccugacaauuuacgucgcucucaucauccugaaggauagcacccuuauugugcaagcggccggaacagacuuuuccgauugcaucgagacggaggaacugaacuggaauuguaccggccccuuccucaaccuggggaauugcgagaaaaagcagaaaaaggaaucuuauagcaacauugcugagcagcugaaaggacuucaggccaucuccguccucgacauuccgcugaucgcccggaucccugaagauauuagcggcggccugcgcuacaucgagucuauuagaacacaucacgcucaacucaccgccgaguaugcgaugcugacacgguacugugacuaccauaaacuuuuuggggauaauuccggauauagccagaccacguggagaauguaccugcgcucucacgacuucggcgcuugcauccucuaucccaaccagcacuuuugucggugcgugaagcauggggaaaaauguuccagcuccucuugggauuucgccagcgagaugaagaauuacuauuccggaaaacagggcaaguuuaacaaagaccugaaucuggcccuucaaucuauucaccaugcuuucagagggaccagcuccagcuacaucgccacaauccucucugaaaagcgcaacgaccagcugguugaguauauggaaaagcugcgggagaaauuuauuggcaaugcucuccugagagccgugcuugauuucaucaccuacaugaagucccugacagagaugaccaacuuuaaacacgacgaguucugggaugaguucguccaccucccugcgcccacgaaggcccccagcaugcgccggucuggaaacgaaaauuacgacuuuaaagcuccuacauccccggccggcaccaagagcugcaaaaacauuaagaaugugguuugucugucucccagaagcggggcuuccuaugagggaaucguggccugcggcgagccuagcgcgccccagauuuucaagaugccuucugaauccaucuaccauaacaaugccgaucagagcauguauuguaucgcugacacacacugccugcaagauuacucccccgucgaggacgaagaacuuaacgccauuaaaaagucuaaaugcugggaaaccgaguuuaccaaugcugugccguucaagcagagcgaugggauccgcuccugucggaugagagacucuggaaacugcaaugugacaacgaaccucuggccuguuaugcagugugaugacggcaaauuuuauuacagcgagcaucagaaggauuaugacaaggaccaagauauugggcacuucugccugucuccccgcuguaauaugguccgguuuccuaucuccgaaaagaacauucuggccugcgacuggaucgugagccaucccaauauugauaagaucgacgugcacucccucgaggaucuggaacaguacaaaaaggccaucacccagaaacuucaaacaagccugucuauuuucaaguacgcuaagaccaugaaccucccucacgucaaacccaucuauaaguacauuuccaucgagggcacagaaaccgcggagggaguggagaaugccuuuauugaaagcgagaucccggcucuggccggcacgucuaucggguucaaaguuaacuccaaggacggaaaacauauuauggauaucauuggcuaugugaagacagccagcuacucuuccgucuauaccaagcuguacaccacaagcccuaccacaggggugaacacgaaacacgacgaacuuuguaccggacccugccccaagcagaucgagcauaaaaauggcuggauuacauuuuccaaggaaagaaccagcucuugggggugugaggaguucggcugccucgcuaucagcgauggauguguuuuuggcuccugccaggacaucauuaaagaugaaaugucuguguaucggaaggagacagaagagaccacgaucgucgagcugugccugaccuucagcgacaaaacauacuguguggaacucaacccuguuaccccgauuaucacagaucuguucgaggugcaguuuaagaccgucgaauccuacacacuuccccgcauuguggccgugaagaaucacgaggucaugguugggcaaaucaacgaccugggaguguauucuaaaggcugcgggaaugugcagaaggucaacggaaccguguacggcaaugggguuccuaaauucgacuaucucugucaucuggcgagcagaaaggaagugauuauccggaaaugcuuugauaacgacuaccaggcuuguaaguuccugcagucccccucuagcuauagacuugaggaggaugccuccacggucagcaucauugacuacaagaaaauccugggcacaauuaagaugaaagccauccucggagaugugcgcuauaagaccuuuucugaauccauugacaucagcgcugaggggaccugcacaggcuguguuaauugcuucgaaaacauccacugugaguuuaccauucacucuacgguggaagccuccugcccugucgugagcacauguacccuguuccaugaucggauccucauuggacccgacaaucacaaauacgcgaugaagguuaucugcacagaggcuccuaagaccucccugucuuuuaaaauuugcaacacaaagguggaugccgccaucaccaucgucgacagcaaacccauuguggagcuugcuccgguggaucaaacggccuacaucagagaaaaggacgaccgcuguaaaaccuggaugugcagaguccgggaugagggcaugcagguucuguccgaaccuuucaagaaucucuuugggagcuauauuggaaucuucuacacaggccuggcugugcugauuaucgcccuuauugcgguguauaucgucaugcccaucuguuucaaggugaaagacauucugaagaaacaugaugacgccuaccgcagagagcucaagauccgguga

SEQ ID NO: 14248 - RNA, 4326 nt, Artificial Sequence
  derived and/or modified CDS sequence (opt5) from SAV(20230)__KX817331.1__GP
augaucccccuucucuuccuggugacccuugucagcgccggcccuguuuuucagagaugcuuccaagacggggcuauugugaagcagaacccguccaaagaggccgugacagaagucuguaucaaggaugacgugucuaugauuaaaacggaggcgcgguacguucgcaauagcuccggaguguuuucuaacaaugucgcucugagaaaguggcucgugagcgauuggcacgacugcaaacccaagaagguuuccggcgggcauaucaacgugauugaagucggaaaugaucugacccuucacacagagucuuauguguguagcgccgacugcaccaucggcaucgauaaagaaacagcccagauucggcugcagaccgacacaaccaaccauuucgagguggcugggacgaccgucaaguccggaugguuuaaaagcacaaccuacaucacacucgaucaaaccugugagcaccugaagguuucuugcggcccuaaauccauucaguuccaugccuguuuuaaucagcacaugagcugcgugcgcuuccugcacagaacgauccuccccggcucuauggcuaacuccauuugucagaauaucgaaauuaucauccugacaacccuugcccugcucauuuuucugcuucugacaauccucagcaagaccuauauuugcuaccugcugaugccuaucuucauucccaucgcguaucucuacgggcugaucuauaacaagucuuguaaaaagugccaacuuugcggacugguguaccauccuuuuaccgaguguggcacacacugcgucuguggggcccgguacgaaacguccgaccgcaugaaacuccauagagcuagcggacugugcccgggcuauaagucccuucgggccgcucgcgugauguguaaaucuaaggggcccgccagcauucuguccaucauuaccgcgguucucauccugacauucgugaccccuauuaauggacugacaaucggcgauagcaaagaggucuuuaaccucgacgagcugcccgaugacaugcuugaaauggcccagaagcugaauauguaccagcucaucugcauuaucaacuauaccgcuacguggucuauuaucauuaucggccuggccguguucuacauuuucaagaaauaucagcacagauuuuacaauuauuacgcuauguacugucaagagugcgacauguaucacgaacgguccgggcuuaaguggaacggagauuucacaaacaaaugucgccagugcaccuguggcgaguacgaagacgccgccgggcugaucagccauaagaaaucuuauaauugccuccugcaguacaagguuaagugggugaugaacuuucugaccaucuaugucgcucucauuauccugaaagauagcacacuuauugugcaagcggccggaaccgacuucuccgauugcaucgagacagaggaacugaauuggaacuguacgggcccuuuucucaaucuggggaacugcgagaagaaacagaagaaagaaucuuacagcaauauugcugagcagcugaagggacuucaggccaucuccguccucgacaucccccugauugccagaaucccggaagauauuagcggcggccugcgguauaucgagucuauucgcacccaccaugcucaacucacagccgaguacgcgaugcugaccagauacugugacuauuacaagcuguucggggauaacuccggauauagccagacaaccuggcggauguaccugagaucucacgacuuugaggcuugcauccucuauccuaaucgccauuucugucggugcgugaaacacggcgaaaaguguuccagcuccucuugggauuuugccagcgaaaugaaaaacuacuauuccgggaagcagggaaaauucaauaaggaccugaaccuggcccuucagucuauccaccaugcuuuuagaggcacgagcuccagcuacauugccaccauccucucugagaagcgcaaugaccaacugguugaauacaugaaaaagcugcgggagaaauucauugggaacgcucuccugagagccgugcuugauuuuaucacauauaugaagucccugaccgagaugacaaauuucaaacacgacgaguucugggaugaauuuguccaucuccccgcgccuaccaaggcccccagcaugcgccggucuggcaacgaaaacuacgacuucaaagcucccacguccccugccggaacaaagagcugcaagaauauuaaaaacgugguuugucugucuccgagaagcggcgcuuccuaugaggggaucguggccugcggagagcccagcgcgccucagaucuuuaagaugcccucugaauccauuuaccacaauaacgccgaucagagcauguauuguaucgcugacacccacugccugcaggauuacuccccugucgaggacgaggaacuuaaugccauuaaaaagucuaaaugcugggaaacagaguucaccaacgcugugcccuuuaagcaaagcgauggcauccgcuccugucggaugagagacucugggaauugcaacgugaccacaaaucucuggccgguuaugcagugugaugacggaaaguucuauuacagcgagcaucagaaagauuacgacaaggaccaggauauuggccacuuuugccuguccccucgcuguaacaugguccgguuccccaucucugaaaagaauauucuggccugcgacuggaucgugagccauccuaacaucgauaagauugacgugcacucccucgaggaucuggaacaauauaaaaaggccaucacgcagaaacuucagaccagccugucuauuuuuaaauacgcuaagacaaugaaucucccccauaucaaaccuauuuauaaguacaucuccaucgaggggaccgaaacagcggagggcgucgagaacgccuucauugaaagcgagauccccgcucuggccggaaccucuauuggcuuuaaaguuaauuccaaggacgggaagcacaucauggauauuaucggauaugugaaaacggccagcuacucuuccguguauacaaagcuguacaccaccggcccgacaaccggggucaacacaaaacacgacgaacuuuguacgggaccuugccccaagcaaaucgagcauaaaaacggcuggauuaccuucagcaaggaaagaacauccagcugggggugugaggaguuuggcugccucgcuaucucugauggauguguguucggcagcugccaggacauuaucaaagaugaaauguccguuuaccggaaggagaccgaagagacaaccauuguggagcugugccugacguucucugacaagaccuauugugucgaacucaaucccgugacaccuaucauuaccgaucuguuugagguucaguucaaaacaguggaaagcuacacccuuccgcgcaucgucgccgugaagaaccacgaggugauggucgggcagaucaaugaccugggaguuuauuccaaaggcugcgggaacgugcaaaaggugaauggaacagucuacggcaacggggugcccaaauuugacuaucucugucaucuggcgucuagaaaggaaguuauuauccggaagugcuucgauaaugacuaccaggcuuguaaauuucugcagagcccuuccucuuauagacuugaggaggaugccagcaccguguccauuaucgacuacaagaaaauucugggcacgaucaagaugaaagccauccucggagauguccgcuacaagacauucagcgaaucuauugacaucuccgcugaggggaccugcaccggcugugugaacugcuuugaaaauauucacugugaguucacaauccauagcaccguugaagccucuugccccguggucuccacguguacacuguuucacgaucggauucucaucggaccugacaaccacaaguaugcgaugaaagugaucugcaccgaggcucccaagacaagccuguccuucaaaauuugcaauaccaagguugaugccgccaucacaauuguggacucuaaaccuaucgucgagcuugcucccguggaucagaccgccuacauuagagaaaaggacgaccgcuguaagacguggaugugcagagugcgggaugagggcaugcaaguccugcucgaaccguuuaaaaaccuguucgggagcuauaucggaauuuucuacaccggccuggcuguucuuaucaucgcccugauugcgguguauaucgugaugccuauuuguuuuaaggucaaagacauccucaagaaacaugaugacgccuaccgcagagagcugaagauucgguga

SEQ ID NO: 14249 - RNA, 4329 nt, Artificial Sequence
  derived and/or modified CDS sequence (opt5) from SDNV__AF123490.1__GP
augaucugcauucugcuccugaucgcccuugcuagcgccucccccguguaccagagauguuuccaagacggcgcgauugucaagcaguauccugcuaaagaugccguuaccgaggugugccugaaggacgaugugucuaugaucaaaacacaggccaacuacaugaagaauacgaccgggacauuuagcaacaaugucgcuaugcggaaauggcucguggccgacuggcacgauugucgcccgcagaaguccucuggaggccauauuaacguuaucgaagugggggacgaucugagccuucacaccgaggcuuauaucugcuccgccgacugugucauuucuaucgauaaggaaacagcgcaaauuagacugcagaccgacagcacaaaucauuucgagguguccggaaccacgguuaaaagcggcugguuuaagucuaccacauacaucacccucgaucagacaugcgaacaccugaaaguguccugugggcccaagagcauucaguuccaugccugcuuuaaccaacacaugucuuguguccgguuccugcaccgcaccauccucccuggauccauggcuaauagcauuugccagaacaucgagaucauuauccuggugacgcuuacacugaugauuuuuauccuccugaccauuaucucuaaaacauauaucuguuacauucuuaugcccaucuucauuccuaucgccuauauuuacggcuggaucuacaauaaguccugcaagaaaugcaagcuguguggccucguguaucaucccuuuaccgagugcgggacccacugugucugcggagcuagauacgaaacaagcgaccggaugaaacugcaucgcuccucuggccuguguccuggguauaagagccucagagccgcgcggguuaugugcaaaucccgcggaccggccagcauccugucuauucuuacggcugugcugauccucaccuucgugacacccauguccgcccuggucauuggcagcucugaggaacuuuacaagcuggaugagcucccugacgacaugaucgauauggcugagaaagugaaccuguauuaccugguuauugugcucaauuauagcgccaccugggggcugcuucugcucaugggaauccuggcccuucuguuuaagaaguaccagcacauuuuccucaacuacuaugcuauguacuguacagaaugcgacauguaucacgauaaaaaggagcugaccuacaauggcgacucccccacgaacgcguggcaguguacaugcggccaauaugaagaugccaccgggcugaucguccaucagaaaucuuacaauugucucgugaaguauaaaguuaaguggaucaagaacauucugaucauguacauugugcuuacccugaucaaagacagcguccucauugcuuccgccgagggaccugauuuugccacaugcaucgaagagaagaccaucacauggaacugcacgggccccuuccugaaucuggggagaugugacaaaacccagaagaaaacagauuacgcuaccauugccagccaacuuaagggaaucgacgcgauuucuauccucgaugugccgaugauuuccaagaucccugaggacaucagcggcgcucugaaauauauugaaucucugaagacauaccacgagcagcucaccgccgaauaugccauguucacgcgguacugcgacuauuacacccaguuuuccgauaacagcggguauucccagacaaccuggcgcacauaccugagaucucaugacuucgaggucuguaucgcuuaccccaaucaacacuuuugccggugugugaaaaacggagaaaagugcagcuccgcccagugggauuucgcuaccgagauuaaaggcuauuacacgggccgccagaauaaguuuaacaaggaccuuaaucuggcccucaugacauuccauaccgcguuuagagggacagccaccucuuauguuaccgagcugaucagcaaaggaaagaacuccagccugcuuauguacgcuucugccauuaaauccaaguucaauggcaacgcucuccugaaagcccugcucgauuuuaugauguaucugcagagccuuggggaaaucucuggauucaagcugacagacgagugggaagauuuuaaauacgaggaagaaccuacggagcaaacccucaugccccggggccacagagggggccaguauaauuucaagaacgcggccuccaauggaaagacaaaaguguguaagaacgucaaaaaggugcugugccugagcccccgcucucgggcuaccuuugacgauguuaucgccuguggcgaacacgcuaauccuagcguguacaugauuccgaacacaaccaucuaccaguccaacacggagagaagccauuauugcauugccgacucucacugucuugaagaguacgagcucgucaaacccgaacugcugacagcccucaagaagucccgcugcugggcuggggauaucgacaccauugugcugcauaaacagagcgauggacuucgguccugcagaaucaaggacaccggcucuuguaaugugauggggaacgacuggacaauuguucugugcgaggauaauaaauauuacuauagcgaaguccaccaagacuacgauaaggaccaggaugugggacacuucugucucuccccucgcugcaacaccauccgguaucccaucucuccuagacauauuaauagcuguaaauggcagaucucccacucuacaauuggcaagaucagcgugcaugagcuggcggacauugaacaguacaagaaagccaucucccaaaagcugcagacgagccuuucuaucuucaaauacgcuaagaccaaaaaccucccccacauuaagccggucuauaaguacaucgccauugaggggacagagaccguggaaggcguugagaaugccuuuaucgaauccgagauuccugcucuggccggaacagcgaucggcuucaaaaucaacagcaaggaaggguaucaucugauggauauuaucggauacgugaaaucugcuuccuauagcucuaccuacacgaagcucuauaccacaggccccaccauugggaucaauacaaaacacgacgagaagugcaccggauccuguccuggcacaauucaccauaaaaccggguggcugacguuuagcaaggagcgcacauccaccuggggcugcgaagaguucggaugucuugccgucagcgauggcugcguguacgggucuugucaggacaucauuaaggaugaacugaccguuuaccggaaaaucagcgacgaggugacagaagucgagcucugccugaccuuuuccgauaagacguauugcacaaaccugaaugccgugacccccaucauuacagacaaauucgagguucaauuuaagaccguggaaucuuacagccuuccuagaaucgucggagugcgcaaccacaaaauucagaucggccagauuaaugacaucgggguguauuccaagggauguggcaacguccagaagguuaaugggacaaacuacggcaacggagugcccaaauucgauuaucugugccaucucgcuucucggaaggaggugaucauuagaaaauguuuugacaaugauuaccaagccugcaaguuccugcagaccccggcgagcuaucggcucgaggagcaccagggcacggucaccaucauuaacuacaaaaagauccugggguccauuaagaugaaaccuuacugggugaugcuucgcuauaagaauuacgcuaacucucuggacaucaaugccgagggaacauguagcggcugcguuggguguuuugaaaacauccauugcgaguucaccauucacacaaccaucgaagccuccugucagauugagagcgauugcacgacauuucacgacagaauccucgugacccccaaugaacauaaauaugcucugaaggucauuugucacgauaaacccaagacaaucuucaacuucaagauuugcaauaccgagaucgaggccgcuaucgccauuguggacgcgaaaccuaucauugaacuggccccgguugaucaaaccgcuuacauccgggagaaggacgaaagaugcaaaacauggaugugucgcgugcgggaugagggcauucagguccuucuggaacccuuuaagaaccucuucggaucuuauaucggcaucuuuuacacgauucugaucgugauuuucauccucguuauuaucaucuauauuauccugccuauuugcuuuaaacuucaggacacccugaagcagcaugaggacgccuacaagagagagaugaaaauccgcuga

SEQ ID NO: 14250 - RNA, 4329 nt, Artificial Sequence
  derived and/or modified CDS sequence (opt5) from SDNV(BeAr103645)__KX817334.1__GP
augaucugcauucugcuccugaucgcccuugcuagcgccucccccguguaccagagauguuuccaagacggcgcgauugucaagcaguauccugcuaaagaugccguuaccgaggugugccugaaggacgaugugucuaugaucaaaacacaggccaacuacaugaagaauacgaccgggacauuuagcaacaaugucgcuaugcggaaauggcucguggccgacuggcacgauugucgcccgcagaaguccucuggaggccauauuaacguuaucgaagugggggacgaucugagccuucacaccgaggcuuauaucugcuccgccgacugugucauuucuaucgauaaggaaacagcgcaaauuagacugcagaccgacagcacaaaucauuucgagguguccggaaccacgguuaaaagcggcugguuuaagucuaccacauacaucacccucgaucagacaugcgaacaccugaaaguguccugugggcccaagagcauucaguuccaugccugcuuuaaccaacacaugucuuguguccgguuccugcaccgcaccauccucccuggauccauggcuaauagcauuugccagaacaucgagaucauuauccuggugacgcuuacacugaugauuuuuauccuccugaccauuaucucuaaaacauauaucuguuacauucuuaugcccaucuucauuccuaucgccuauauuuacggcuggaucuacaauaaguccugcaagaaaugcaagcuguguggccucguguaucaucccuuuaccgagugcgggacccacugugucugcggagcuagauacgaaacaagcgaccggaugaaacugcaucgcuccucuggccuguguccuggguauaagagccucagagccgcgcggguuaugugcaaaucccgcggaccggccagcauccugucuauucuuacggcugugcugauccucaccuucgugacacccauguccgcccuggucauuggcagcucugaggaacuuuacaagcuggaugagcucccugacgacaugaucgauauggcugagaaagugaaccuguauuaccugguuauugugcucaauuauagcgccaccugggggcugcuucugcucaugggaauccuggcccuucuguuuaagaaguaccagcacauuuuccucaacuacuaugcuauguacuguacagaaugcgacauguaucacgauaaaaaggagcugaccuacaauggcgacuuuacgaacaaauguagacagugcacauguggccaauaugaagaugcgaccgggcugaucguccaucagaaguccuacaauugccucgugaaauauaagguuaaguggaucaaaaacauucugaucauguacauuauccuuacccugauuaaggacucugugcucaucgccagcgcugagggacccgauuucgccacaugcaucgaagagaaaaccauuacauggaacuguacgggcccuuuccugaaucuggggcggugcgacaagacccagaaaaagacagauuacgccaccaucgcuucccaacuuaagggaauugacgccaucagcauucucgauguccccaugaucucuaaaaucccggaggacauuuccggcgcgcugaaguauaucgaaagccugaaaacauaccacgagcagcucaccgcugaauaugccauguuuacgcgcuacugugacuauuacacccaguucucugauaacuccggguauagccagacaaccuggagaacauaccugcggucccaugacuuugaggugugcauugccuacccuaaucaacacuucugucgcugcgucaagaacggagaaaaauguucuagcgcucagugggauuuugccaccgagaucaagggcuauuacacgggcaagcagaauaaauucaacaaggaccuuaaucuggcucucaugacauuucauaccgccuucagagggacagcgaccuccuaugugaccgagcugauuucuaaaggaaagaacagcucccugcuuauguacgccagcgcuaucaaaucuaaguuuaauggcaacgcccuccugaaagcucugcucgauuucaugauguaucugcagucccuuggggaaaucagcggauuuaagcugacagacgagugggaagauuucaaguacgaggaagaacccacggagcaaacccucaugccucggggccacagagggggccaguauaauuuuaaaaacgccgcgucuaauuccaagacaaaaguuugcaagaacgugaaaaagguccugugucugagcccccgcucucgggccaccuucgacgaugugauugcuugcggagaacacgccaaucccagcguuuacaugaucccuaacacaaccauuuaccaguccaacacggagagaagccauuauuguaucgcugacucucacugccuugaagaguacgagcucgugaagccggaacugcugacagcccucaaaaagucccgcugcugggccggcgauauugacaccaucguccugcauaaacagagcgaugggcuucgguccuguagaauuaaggacaccggaucuugcaaugugaugggcaacgacuggacaaucgugcugugugaggauaauaaauauuacuauagcgaaguucaccaagacuacgauaaggaccaggaugucgggcacuucugccucucuccccgcuguaacaccauccgguauccuauuucccccagacauaucaauagcugcaaguggcagauuucccacucuacaaucggaaaaauuagcgugcaugagcuggcugacaucgaacaguacaagaaagcgaucucccaaaagcugcagacgagccuuucuauuuuuaaauacgccaagaccaagaaccucccucacaucaaacccguguauaaguacauugcuaucgagggcacagagaccgucgaagggguggagaaugccuucauugaauccgagaucccggcccuggcuggcacagccaucggauuuaaaauuaacagcaaggaaggcaaucaucugauggauaucauuggguauguuaaaucugcguccuacagcucuaccuauacgaagcucuacaccacaggaccuaccaucggcauuaacacaaaacacgacgagaaguguaccggguccugccccggaacaauccaccauaagaccggcuggcugacguucagcaaagagcgcacauccaccugggggugugaagaguuuggcugccuugcugugagcgauggaugugucuauggcucuugccaggacauuaucaaggaugaacugaccguguaccggaaaaucagcgacgagguuacagaaguggagcucugccugaccuucuccgauaagacguacuguacaaaucugaacgccgucaccccuauuaucacagacaaauuugaggugcaauucaagaccguugaaucuuauagccuucccagaauuguggggguccgcaaucacaagauccagauuggacagaucaacgacaucggcguguacuccaaagggugcggaaaugugcagaaggucaacggcacaaacuaugggaauggcguuccuaaauuugauuaccugugucaucucgccucucggaaggaggugauuaucagaaaaugcuucgacaacgauuaucaggcuuguaaguuucugcaaacccccgccagcuaccggcucgaggagcaccagggaacggugaccauuaucgacuauaagaaaauucugggcuccaucaagaugaaagcgauccuuggggauguccgcuacaagaauuacgcuaacucucuggacauuaaugccgagggaacaugcgccggcuguguggggugcuucgaaaacauccauugugaguuuaccauucacacaaccaucgaagcuagcugccagauugaguccgauuguacgacauuccacgacagaauccucguuaccccgaaugaacauaaauaugcccugaaggugauuugccacgauaagccuaaaacaauccugaacuucaagaucugcaauaccaaaauugaggcugccaucaccauugucgacgcgaagcccaucauugagcuugcccccguggaucaaacagcuuacauccgggaaaaagacgagagauguaagacguggaugugccgcguucgggacgaaggaauccaggugcugcucgagccuuuuaagaaccuguucggcagcuauauuggcaucuuuuacaccauucucaucgucauuuucauccuggugaucauuaucuauauuauccuuccgauuuguuuuaaacugcaggauacacucaagcagcaugaagacgccuacaaaagagagaugaagauccgcuga

SEQ ID NO: 14251 - RNA, 4326 nt, Artificial Sequence
  derived and/or modified CDS sequence (opt5) from SSHV__EU262553.1__GP
augaucugcauucugauccucuucgccgugaccgcugccagccccgucuaccagagauguuuucaagacggcgcgauuguuaagcagaacccuuccaaagaggcugugacagaagugugccugaaggaugacgucucuaugaucaaaacggaggcccgguauauuaagaaugccaccgggguguucagcaacaauguugcuauccgcaaauggcuuguguccgauuggcacgacuguagaccgaagaagaucacaggaggccauauuaacgucaucgaagugggggaugaccugucucuccacaccgagagcuacguuugcuccgccgauuguacaauuggaguggacaaagaaaccgcucagguccggcugcagacagauaccacgaaucauuuugagaucgccggcaccacagugaagucugggugguucaaaagcaccacauauauuacccuugaccaaacgugcgagcaccugaagguguccuguggacccaaaagcauccaguuucaugcgugcuucaaccagcacaugucuuguguccgcuuucuccacagaacaauucugccuggcuccaucgccaauagcaucugccagaacauugaaaucauuauccugguuacccucacacugcuuauuuucauccugcucucugugcuguccaagaccuacaucuguuaucuucugaugcccguguuuauuccuaucgcuuacgccuauggcauuaucuacaauaagagcugcaaaaagugcaaacucugugggcuggucuaccaucccuucaccgagugcggaacacacugugugugcggcgcucgguaugauacgucugaccgcaugaagcugcauagagccuccgggcucuguccuggauacaaaagccugcgggcggcccgcguuaugugcaaguccaaaggcccggcuucuauucuuagcgugaucaccgccauccugauucucacauuugucacccccaucaacuccauggugguuggggaaagcaaggagguguucgagcuggaacaacuuccugaugacaugcuggacauggcucucagaauuaauuuuuauuacuucgucuguaucaugaacuaugccgugacauggggacugauuaucauuggccugcucaucggccugcuuuucaagaaauaccagcaccgguuuucuaaucuguaugccauguacugcgaggaaugugauauguaccacgaccgcuccgggcucaagagaaacggagauuucaccaauaaaugccggcaguguacgugcggccaguaugaggacgcuacagggcugaugacccaucgcaagaccuacaacugccuugucagauauaaagcgaagugggugaugaacuuucugaucgccuacaugcuccugacacugauuaaggauagcgcuaucguugugcaagccgccggaaccgacuucacaacgugucucgaaaccgagaauauuaacuggaauugcacaggccccuuucugaaccuugggaauugucagaaacagcaaaagaaagagccuuaugcuaacaucgccacccagcugaagggacuccaggcgauuucuguccuggauaugcccaugaucgcuagcaucccggaagacauugccggcgcccugcgguacaucgaggaaaaagagacauuccacgugcagcuuaccgcugaauaugccaugcucuccagauacugcgauuacuaugcucaauuuucugacaauagcggcuacucccagacgaccuggcgcguuuaucugcggagccaugauuucgacgccuguauucuguacccuaaccagcacuuuugcagaugugugaagcauggggacaagugcagcuccagcaaucgcgauuucgcgaacgagaugaaaaauuauuacucuggaaagcagaacaaauuugacaaggaucucaaucuggcccuuauggcucugcaccacgccuuccggggcacauccagcgcuuauaucgccaccaugcucuccaaaaagucuaacgacgaucugauugcguacacaaauaagaucaaagagaaguuucccgggaacgcccugcuuaaagcuaucgucgacuacauugccuauaugaagucucucuccgaaaugucuagcuucaaauacgaugaguucugggacgaucugcuguauaaguccgcuccuaccaaagcccccagccucucuagaggauccgaacccagcuacaacuuuaagcugguggugucuucccgcagcaucaagucuuguaaaaauguuaagagcgucgugugccuuuccccucggagcggcgugucuuaugacuccauuaucgccuguggggauccgaacggccccagcgucuacagaaaaccuuccgacggaguguuccaaucuaaugcugaucagagcacguauugccuggcggacucccauugccucgaggacuuugaaguugugucucaggaggagcuggaugccauuaagaaaagcaaguguugggaagcugaguaccccgacgucaagcuguccaaacuuacagauggcgugaagucuugccgcaugaaagacagcgggaacuguaauguugccgccaaccgguggccuaucauccagugcgaaaaugauaaguucuacuauuccgagcuccaaaaagacuacgauaagacccaggacauuggacacuuuugucugagccccggcugcucuacagugagauucccgaucaacccuaagcauauuuccaauuguaacuggcaggucagccggucuuccaucgcuaaaauugaugugcacaauaucgaggacauugaucaguaucgcaaggccaucacccaaaaacugcagaccagccucucucuguuuaaguacgcgaaaacaaagaaccuuccccacaucaagccuauuuauaaauacaucacgauugaagggaccgagacagcugaaggaaucgaguccgccuauauugaaagcgagauccccgcccuggcuggcaccuccaucggguucaagauuacaagcaaagagggcaagcaucuccuggacguuaucggauacgugaaaucugccagcuacuccucuauuuauaccaagcuguacacgacaggcccuaccagcgggaucaauaccaaacacgaugaacuuugcacaggacccuguccggcgaagauuaaccaucagaccggcuggcucacauuugcuaaggagagaacguccucuugggggugcgaagaguucggaugucuggccaucagcgacggcugcgucuuuggguccugccaagacaucauucgggaugaacugaccguguaucgcaaagagacagacgaggugaccgaugucgaacucugucugacauucucugacaagaccuacugcacgaaucuuaacccuaucacccccauuaucacagaucuguuugagguucaguucaaaaccguggaaacauauagccuccccagaauuguggccauccagaaccacgagauuaagaucggccaggucaaugaccugggaguguacuccaaaggcugugggaacguucaaaaggugaauggaaccgucuauggcaacggggugccuaaguucgauuaccugugccaucuugcuagccggaaagaaguuaucgugagaaaguguuuugacaaugauuaccaggccugcaaauuccugcagucuccggcuuccuaucgccucgaggaggacagcggaacagucaccgugauugauuacaagaaaauccugggcacgauuaagaugaaggccauccucggggacguuaaauauaagacauuugcggacaacguggauaugaccgccgaaggcucuuguaccggaugcauuaauuguuucgagaacauccacugcgaacugacacuucacaccacgaucgaggcuuccugucccauugucagcacaugcaccguguuucaugaccggauccuggugacaccuaaugagcacaaauacgcccucaaggucguuugcaccgaaaaacccggcaacacacugaccauuagaaucuguaauacgaagguggaggcuucccuggcccuuguggaugccaagccuauucuggaacucgcucccgucgaccagaccgcguauauccgcgagaaagaugaaagaugcaagacauggaugugucgggugcgcgacgaggggcugcaaguuauccucgagccuuucaaaaaccuguuuggaucuuacauuggcaucuucuauaccuuuauuaucagcauuaucgcccuucugauuaucaucuacauugugcuccccaucugcuucaagcugagagauacacugcggaaacaugaagacgcuuacaagcgcgagaugaagauuagauga

SEQ ID NO: 14252 - RNA, 4326 nt, Artificial Sequence
  derived and/or modified CDS sequence (opt5) from SSHV__K02539.1__GP
augaucugcauucugauccucuucgccgugaccgcugccagccccgucuaccagagauguuuucaagacggcgcgauuguuaagcagaacccuuccaaagaggcugugacagaagugugccugaaggaugacgucucuaugaucaaaacggaggcccgguauauuaagaaugccaccgggguguucagcaacaauguugcuauccgcaaauggcuuguguccgauuggcacgacuguagaccgaagaagaucacaggaggccauauuaacgucaucgaagugggggaugaccugucucuccacaccgagagcuacguuugcuccgccgauuguacaauuggaguggacaaagaaaccgcucagguccggcugcagacagauaccacgaaucauuuugagaucgccggcaccauugugaagucugggugguucaaaagcacaaccuauaucacacuugaccaaaccugcgagcaccugaagguguccuguggacccaaaagcauucaguuucaugcgugcuucaaccagcacaugucuuguguccgcuuucuccacagaacgauccugccuggcuccaucgccaauagcauuugccagaacaucgaaauuaucauucugguuacacucacccugcuuaucuucauccugcucucugugcuguccaagacauacauuuguuaucuucugaugcccguguuuaucccuauugcuuacgccuauggcaucauuuacaauaagagcugcaaaaagugcaaacucugugggcuggucuaccaucccuucaccgagugcggaacccacugugugugcggcgcucgguaugauacaucugaccgcaugaagcugcauagagccuccgggcucuguccuggauacaaaagccugcgggcggcccgcguuaugugcaaguccaaaggcccggcuucuauccuuagcgugaucacggccauucugauccucaccuuugucacacccauuaacuccauggugguuggggaaagcaaggagguguucgagcuggaacaacuuccugaugacaugcuggacauggcucucagaaucaauuuuuauuacuucgucuguauuaugaacuaugccgugaccuggggacugaucauuaucggccugcucaucggccugcuuuucaagaaauaccagcaccgguuuucuaaucuguaugccauguacugcgaggaaugugauauguaccacgaccgcuccgggcucaagagaaacggagauuucacaaauaaaugccggcaguguaccugcggccaguaugaggacgcuacggggcugaugacacaucgcaagaccuacaacugccuugucagauauaaagcgaagugggugaugaacuuucugauugccuacaugcuccugacccugaucaaggauagcgcuauuguugugcaagccgccggaacagacuucaccacaugucucgaaacggagaauaucaacuggaauugcaccggccccuuucugaaccuugggaauugucagaaacagcaaaagaaagagccuuaugcuaacauugccacacagcugaagggacuccaggcgaucucuguccuggauaugcccaugaucgcuagcauuccggaagacaucgccggcgcccugcgguacauugaggaaaaagagaccuuccacgugcagcuuacagcugaauaugccaugcucuccagauacugcgauuacuaugcucaauuuucugacaauagcggcuacucccagaccacguggcgcguuuaucugcggagccaugauuucgacgccuguauccuguacccuaaccagcacuuuugcagaugugugaagcgcggggacaagugcagcuccagcaauggagauuucgcgaacgagaugaaaaauuauuacucuggcaagcagaacaaauuugacaaggaucucaaucuggcccuuauggcucugcaucacgccuuccgggggaccuccagcgcuuauauugccacaaugcucuccaaaaagucuaacgacgaucugaucgcguacaccaauaagaucaaagagaaguuucccggaaacgcccugcuuaaagcuauugucgacuacaucgccuauaugaagucucucuccgaaaugucuagcuucaaauacgaugaguucugggacgaucugcuguauaaguccgcuccuacaaaagcccccagccucucuagaggcuccgaacccagcuacaacuuuaagcugguggugucuucccgcagcauuaagucuuguaaaaauguuaagagcgucgugugccuuuccccucggagcggggugucuuaugacuccaucauugccuguggcgauccgaacggacccagcgucuacagaaaaccuuccgacggcguguuccaaucuaaugcugaucagagcaccuauugccuggcggacucccacugccucgaggacuuugaaguugugucucaggaggagcuggaugccaucaagaaaagcaaguguugggaagcugaguaccccgacgucaagcuguccaaacuuacggauggggugaagucuugccgcaugaaagacagcggaaacuguaauguugccgccaaccgguggccuaucauucagugcgaaaaugauaaguucuacuauuccgagcuccaaaaagacuacgauaagacacaggacaucggccauuuuugucugagccccgggugcucuaccgugagauucccgauuaacccuaagcacaucuccaauuguaacuggcaggucagccggucuuccauugcuaaaaucgaugugcauaauauugaggacaucgaucaguaucgcaaggccaucacacaaaaacugcagaccagccucucucuguuuaaguacgcgaaaaccaagaaccuuccccacauuaagccuaucuauaaauacauuacaaucgaaggaacggagaccgcugaaggcauugaguccgccuauaucgaaagcgagauccccgcccuggcugggacauccauuggcuucaagaucaccagcaaagagggaaagcaccuccuggacguuauuggcuacgugaaaucugccagcugcuccucuaucuacacaaagcuguauaccacggggccuacaagcggaauuaauaccaaacaugaugaacuuuguaccggccccugcccggcgaagaucaaccaccagacaggguggcucaccuuugcuaaggagagaacauccucuuggggaugugaagaguucggcugccuggccaucagcgacgggugcgucuuuggcuccugucaagacauuauccgggaugaacugacgguguaccgcaaagagaccgacgaggugacagaugucgaacucugccugaccuucucugacaagacauauuguaccaaucuuaacccuauuacgcccaucauuaccgaucuguuugagguucaguucaaaacaguggaaaccuacagccuccccagaaucguggccauucagaaccaugagaucaagaucggacaggucaaugaccugggcguguauuccaaagggugcggaaacguucaaaaggugaauggcacagucuacgggaacggagugccuaaguucgauuaucugugucaccuugcuagccggaaagaaguuauugugagaaagugcuuugacaaugauuaccaggccuguaaauuccugcagucuccggcuuccuaccgccucgaggaggacagcggcaccgucacagugaucgauuauaagaaaauucuggggaccaucaagaugaaggccauucucggcgacguuaaauacaagacguuugcggacaacguggauaugacagccgaaggaucuugcaccggcuguaucaauugcuucgagaacauccauugugaacugacccuucacacaaccauugaggcuuccugccccaucgucagcacgugcacaguguuucacgaccggauucuggugaccccuaaugagcauaaauaugcccucaaggucguuuguacagaaaaacccgggaacacccugacaaucagaauuugcaauaccaagguggaggcuucccuggcccuuguggaugccaagccuauccuggaacucgcucccgucgaccagacggcguacauccgcgagaaagaugaaagauguaagaccuggaugugccgggugcgcgacgagggacugcaaguuauucucgagccuuucaaaaaccuguuuggcucuuauaucgggauuuucuacacauuuaucauuagcaucauugcccuucugaucaucauuuauaucgugcuccccauuuguuucaagcugagagauacccugcggaaacacgaagacgcuuacaagcgcgagaugaagaucagauga

SEQ ID NO: 14253 - RNA, 4335 nt, Artificial Sequence
  derived and/or modified CDS sequence (opt5) from SORV__AF123488.1__GP
auggaggugcugagccucaucuggcugcuuacccugugcuccgccucucccgucuuccagagauguuuucaagacggcgcuauuguuaagcagaacccuagcaaagaagccgugacagaggugugccucaaggaugacgucuccaugaucaaaacggaaaccaaguacgugaaaaauacaaccgggacauucgcgaacaauauugcuaugcggaaguggcugguugccgauuggcacgacugucgcccgcagaagucuagcggaggccauaucaacgugauugaggucggggaugaccuuucccugcacaccgaaucuuauaucugcagcgccgauugugugaucacaguugacaaagagaccgcucagauuagacuccaaacggauaauaccaaccauuuugagguggccggaacaaccgucaaguccggcugguucaaaagcacaaccuacaucacgcuggaccagacaugcgaacaccugaaggugucuugugggcccaaauccauucaguuucaugcuugcuucaaucagcacaugagcugugugcgguuucuccaccgcaccauccugccuggaucuauugccaacuccaucugccaaaauauugagaucaucauucuugucacacugagccucguuaucuucauuuuucugaccaucgugucuaagaccuauauuuguuaccuucugaugcccaucuucaucccuauugcguuuaucuauggcuggauuuacaacaaguccugcaaaaagugcaaacucuguggccugguguaucaucccuucacagaaugcgggacgcacugugucugcggagccagauacgagaccagcgaucggaugaagcugcaucgcgcuuccggccucuguccuggguacaaaucucugagagccgcucgggugaugugcaagagcaaaggaccggccuccauccuuagcauucugacagcgauccucauccugaccuuuguuacacccauuucugccaugguggucggcgaguccaaugaaaucuauacccuugacgaucugccugacgacauggugcagauggcugagcgcauuaacaucuacuaucagauucucaucauuaauuacgggguuacgugggccuuccugcugcucggacuggugcuugcuuauuucuuuaagaaguaccagcacaaauuccuggauuauuacgccauguacugugaagagugcgacauguaucacgaaaagagcggcaugacauacuggggcgauuuuaccaacaaauguagacaaugcaccugugggcaguucgaggacgccacaggacucaugguccauaagaaaucuuauaauugccuggugaaguacaaggcuaaauggauccggaacauccuuauugcguaucugaugaucaugcucgucaaggauagccugcuguuugugggcgccacccgcgcugacuucgccuccugcguugaugagaaaacagugacguggaacuguaccgggcccuuucucaaucugggaagaugcgacaagacacagaaaaagaccggcuacaaggauauugccaaccaacuuaaagggcugggagucaucucuauucucgacaucccuaugaucgaaaagaugcccgaugagauuagcggcucccugaaauauaucgacagccuggaaacauaccacgagcagcuuaccgcugaauacgccuuccucacgcgguauugugacuacuauacccaguacacagauaauucuggcuauucccagaccguguggcgcacauaccugagaagccaugacuuuggggcgugcguuguguauccgaaccaacacuucugucggugcgucaaguacgaugacaaauguaauucugcuaagugggauuuugccaacgagaugaagaccuucuacacgggaagaaaagugaaguuuaauaaagaccugaaccucgcccugcuugugcugcauaaggcuuuccgcggcacagggaccgccuauauugcugaggccauggcgcggaaagauaauggauccauggcccacuucgcucucgaaaucagaaagaaauuuccuacaaacgcccugcuggcugcccuuauugacuacaucguuuaucuccagagccuggcggagaucuccaccuucgaacuggaggaagauugggaggacuuuaaguacaagcccgagccuaccgaaucuacacuccagccccgcagccaccgguccgaucaguauaauuucaaaaacgccgacucuaauagcaacgucaaggugugcaaaaaugugaagaaaguccugugugugucccccagaagccgcgcuaaguuugagaacauuaucgccugcggcgaacaugcuaacccuucuguuuacaugaugccgaauauuuccaucuaucaaagcaacucugagcggucccacuacuguauugccgauagccauugccuugaggaauacgagaucgugaauacggaacugcucaccgcccugaagaaaucuagaugcugggcuaaggagauggacgacgucgugcugcacaaacagagcgaugggcuucgcuccugucggaucaaggacacaggcagcugcaacguucucggaaaugauuggaccauugugcugugugaaaacggcaauuauuacuauucugagauccacaaagacuacgauaaggaccaggaugucgggcauuucugccugucccccagauguagcacaauucgcuauccuaucaaccggagacacauucggaagugcgacuggcagaucucccauucuaccauugauaaaaucagcgugcaagagcucgcggacaucgaacaguacaagaaagccauuucccagaagcugcagacgucucuuagcaucuuuaaauauguuaagacaaagaaucugccccacauuaaaccugcuuacaaguacaucaccguggagggaaccgaaacaauugagggcaucgaaaacgccuucaucgaguccgagauucccgcccucgcugggaccgccaucggauuuaaaauuaauucucgcgaaggcaacuaucugauggaugucaucggguacgucaagagcgcguccuauagcgcuacauacacgaaacuguauaccacaggcccgaccauuggaaucaauacaagacaugacgagaaguguaccggcccuugccccgugacgaucgaucacaaagacggguggcuuaccuucucuaaggaacggacauccaccuggggaugugaggaauuuggcugccucgccgugagcgacggguguguuuucggaucuugccaagauauuaucaaggacgagcuggccguguacagaaaaacaaccgaggaacugacaaccguggagcucugccugacguuuuccgauaagacauauuguaccaaccuuaaugcuauuaccccuaucauuacagacaaauucgaaguccaguucaagaccguggagagcuacacgcugccccgcaucauugccguuaaaaaccacgagaucaaggugggccagaucaacgaucucggggucuacucuaagggcugcggaaaugugcaaaaaguuaacggcacaaauuaugggaacggagugccuaaguuugacuaccugugucaucuggcgucccggaaagaagucauucuuagaaagugcuucgauaaugacuaucaggcuuguaaauuucugcagagccccgccuccuaccgccucgaggaacaccagggcaccgugacaguuaucgauuauaagaagauucuggggagcaucaaaaugaaggccauucucggagacgugaaauacaagaacuaucaaucuaauaucgagaucaacgcugaagggaccugcgccggcugugucaauugcuucgagaacauucauugugaguuuacaauccacaccacgguggaaaccagcugcccgauugugacagauugugucuccuuccaugacagaauccugauuaccccugacgagcacaaauacgcucuuaagaucguuugccaggauaagcccaaagugucucugaaguuuaaaaucugcaauacaaacauugacgccagcaugaccaucguggauuccaagcccauucucgaacuggcgccugucgaccagacggccuacaucaaagagaaggaugaacgguguaagacauggaugugccgcgugagagacgagggcuuccagguuauucuggagccguuuaaaaaucuuuucggaucuuauaucggcaucuuuuacaccgggauucugagcgugaucugucuccugauugucaucuauauugugcuccccaucugcuucaagcugcgggauacacuuaaacaacacgaagacgcuuacaagaaagagaugaagauucgcuga

SEQ ID NO: 14254 - RNA, 4335 nt, Artificial Sequence
  derived and/or modified CDS sequence (opt5) from SORV(SORV-252)__JN815081.1__GP
auggaggugcugagccucaucuggcugcuugccgucugcuccgcuaaccccguuuuccagagauguuuucaagacggcgccauugugaagcagaauccuucuaaagaagcggugaccgaggucugccugaaggaugacgugagcaugaucaaaacagaagcuaaguacguuaaaaacacgaccgggacauucuccaauaacguggccaugcggaaguggcucgucgccgauuggcacgacugucgcccgcagaagucuagcggaggccauauuaaugugaucgagguuggggaugaccugucccuucacaccgaaucuuauauuugcagcgcugauugugugaucacagucgacaaagagaccgcccagaucagacugcaaacagauuccaccaaccauuuugagguggcuggaacgaccgucaagagcggcugguucaaaucuacaaccuacauuacacucgaccagaccugcgaacaccugaagguguccugugggcccaaaagcauccaguuucaugccugcuucaaucagcacaugucuuguguucgguuucugcaccgcacgauucucccuggauccaucgcgaacagcauuugccaaaauaucgagauuaucauccuggugacacuuucucugauuaucuucauuuuucucaccaucguguccaagacauauauuuguuaccugcuuaugcccaucuucaucccuauugccuuuaucuauggcuggauuuacaacaagagcugcaaaaagugcaaacuguguggccucgucuaucaucccuucaccgaaugcgggacccacugugugugcggagcuagauacgagacauccgaucggaugaagcugcaucgcgccucuggccuguguccuggguacaaaagccucagagcugcccggguuaugugcaaguccaaaggaccggcgagcauccugucuauucuuacggccgugcugauccucaccuuugucacacccaucuccgcuauuaucauugacgagagcaaggaaaucuauacccuggaugaccuuccugacgauauggugcagauggccgagcgcauuaauaucuacuaucagauucugcucaucaacuacggcguuacaugggcuuuccugcugcucgggcugauccuugccuauuucuuuaagaaauaccagcacaaguuccuggacuauuacgccauguacugugaagagugcgauauguaucacgaaaaaucuggaaugaccuacuggggcgacuuuacgaauaaguguagacaaugcacauguggccaguaugaggaugcugcggggcucauggugcauaaaaagagcuacaacugccugauuaaguauaaagccaaguggaucaaaaauauucuuauccuguaccucauuaugauccuggucaaggacucccugcucuuugugggagcuaccggcaccgauuuugccgccugcaucgacgagaaaucugucacauggaacuguaccgggcccuuccugaaccuuggacggugcgauaagccucagaagaaagcuagcuuuaaggacauugccaaucaacugaaaggccucggggugaucuccguucuggauauucccaugaucgaaaagaugccggacgacauuagcggaucucugaaauauaucgauucccuucgcacauaccacgagcagcucacggcggaauacgcuuuccugaccagauauugugacuacuaugcccaguacacagauaacagcggcuauucucagaccguguggcggacauaccugcgcucccaugacuuuggcgccugcgucguguauccuaaucaacacuucuguagaugcguuaaguacggggauaaguguaacagcgcuaaaugggacuuugccaaugagaugaaguccuucuacaccggacagaaagcuaaguuuaacaaagaucucaaucuggcccuucuggugcuccauaaggcguuccggggcacggggaccgccuauaucgcugaaacacuggccagaaaagacaacggaucuaugguccacuucgcucuggagauucgcaagaaguuucccaccaaugcccuucucgcggcccugaucgauuacauuguguaucugcagagccucgcugagaucuccacauucgaaccugaggaagacugggaggauucuaaauaccagcccgaacccaccgagagcgugcugcaaccucgggcccacagauccgaccaguauaacuuuaagaaugcugauagcaacucuaauguuaaagucugcaagaacauuaaaaaggugcuuuguaucuccccgcgcagccgggccaaguucgagaauaucauugccugcggcgaacaugcuaaccccucuguguacaugaugccuaacacguccaucuaucagagcaauucugagagaagccacuacuguauugcggacucccauugccuggaagaguacgagaucgucaacacagaacuccugaccgccuuuaaaaagagccgcugcugggcuaaagagauugacgauaucgugcugcacaagcagucugacgggcuucgguccuguagaauuaaagauacaggcagcugcaauguucucggaaacgacuggaccaucgugcugugugaaaauggcaacuauuacuauuccgagguccacaaggauuacgacaaggaucaagacguggggcauuucugccugucuccccgcuguaauaccauccgguauccuauuagcagacgccacaucggagaaugcaacuggcagauuacacauuccacgaucgauaaaauuucuguucaggagcucgccgacaucgagcaguacaagaaagccaucagccaaaagcugcagaccucccuuucuauuuuuaaauaugugaagacaaagaaucugccccacaucaaaccggcuuaccgguacauuaccgucggcgggacagaaaccaucgagggaguggaaaacgccuucauugagagcgaaaucccugcgcucgcuggcacggccaucggguuuaagauuaauuccagagagggcaacuaucugauggauguuaucggauacgugaaaagcgccucuuauuccgcuacauacaccaagcuguauaccacaggccccaccauugggaucaauacaaaacaugacgagaaguguacgggaagcugcccugucaccauuaaccacaaagauggcuggcuuacauucucuaaggaacggaccuccacaugggggugugaggaauuuggaugccucgccgugagcgacggcuguguguucgggucuugccaggacaucauuaaggaugagcuggcggucuaccgcaaaaccacggaggaacugaccacaguugagcucugccugaccuuuuccgacaagacauauuguaccgaucuuaaugcuaucacacccaucauuaccgacaaauucgaagugcaauucaagacgguggagagcuacacacugccuagaaucauugccgucaaaaaccacgaaauccggaccggccagauuaacgaucucggaguguacuccaagggcugcgggaauguucagaaggugaacggaaccagcuauggcaaugggguccccaaauuugacuaccugugucaucuggccucuagaaaggaggugauccuucgcaaaugcuucgauaacgacuaucaggcuuguaaguuucugcaaagcccggccuccuaccggcucgaggaacaccagggaacaguuaccgugaucgauuauaaaaagauucugggcucuaucaagaugaaagcuaugcucggggacgucaaguacaaaaauuaucagagcaacauugagaucaaugccgaaggcacgugcgcgggauguauugauugcuucgagaacauccauugugaauuuacaauccacaccacaguggaggccuccugcccuauuaccacagacuguguuucuuuccaugacagaauccugauuacccccgaggaacacaaguacgcucuuaaaaucgugugccaggauaagcccaaggucagccugaaauuuaagauuugcaauacgaacguggaggccuccaugaccaucauugacucuaaaccuauccucgaacuggcuccgguggaucaaacaaccuacaucaaggagaaagacgaacgcuguaagacauggaugugcagaguccgggaugagggcuuccagguuauucuggagcccuuuaagaaucuuuucgggagcuauaucggaauuuucuacaccggcgugcuguccaucauuugucuccugaucgugaucuauauuauccucccuauuugcuacaaacugcgcgacacgcuuaagcagcacgaagaugccuauaaaaaggagaugaaaaucagauga

SEQ ID NO: 14255 - RNA, 4335 nt, Artificial Sequence
  derived and/or modified CDS sequence (opt5) from SORV(NJO-94F)__KX817337.1__GP
auggaggugcugagccucaucuggcugcuuacccugugcuccgccucucccgucuuccagagauguuuucaagacggcgcuauuguuaagcagaacccuagcaaagaagccgugacagaggugugccucaaggaugacgucuccaugaucaaaacggaaaccaaguacgugaaaaauacaaccgggacauucgcgaacaauauugcuaugcggaaguggcugguugccgauuggcacgacugucgcccgcagaagucuagcggaggccauaucaacgugauugaggucggggaugaccuuucccugcacaccgaaucuuauaucugcagcgccgauugugugaucacaguugacaaagagaccgcucagauuagacuccaaacggauaauaccaaccauuuugagguggccggaacaaccgucaaguccggcugguucaaaagcacaaccuacaucacgcuggaccagacaugcgaacaccugaaggugucuugugggcccaaauccauucaguuucaugcuugcuucaaucagcacaugagcugugugcgguuucuccaccgcaccauccugccuggaucuauugccaacuccaucugccaaaauauugagaucaucauucuugucacacugagccucguuaucuucauuuuucugaccaucgugucuaagaccuauauuuguuaccuucugaugcccaucuucaucccuauugcguuuaucuauggcuggauuuacaacaaguccugcaaaaagugcaaacucuguggccugguguaucaucccuucacagaaugcgggacgcacugugucugcggagccagauacgagaccagcgaucggaugaagcugcaucgcgcuuccggccucuguccuggguacaaaucucugagagccgcucgggugaugugcaagagcaaaggaccggccuccauccuuagcauucugacagcgauccucauccugaccuuuguuacacccauuucugccaugguggucggcgaguccaaugaaaucuauacccuugacgaucugccugacgacauggugcagauggcugagcgcauuaacaucuacuaucagauucucaucauuaauuacgggguuacgugggccuuccugcugcucggacuggugcuugcuuauuucuuuaagaaguaccagcacaaauuccuggauuauuacgccauguacugugaagagugcgacauguaucacgaaaagagcggcaugacauacuggggcgauuuuaccaacaaauguagacaaugcaccugugggcaguucgaggacgccacaggacucaugguccauaagaaaucuuauaauugccuggugaaguacaaggcuaaauggauccggaacauccuuauugcguaucugaugaucaugcucgucaaggauagccugcuguuugugggcgccacccgcgcugacuucgccuccugcguugaugagaaaacagugacguggaacuguaccgggcccuuucucaaucugggaagaugcgacaagacacagaaaaagaccggcuacaaggauauugccaaccaacuuaaagggcugggagucaucucuauucucgacaucccuaugaucgaaaagaugcccgaugagauuagcggcucccugaaauauaucgacagccuggaaacauaccacgagcagcuuaccgcugaauacgccuuccucacgcgguauugugacuacuauacccaguacacagauaauucuggcuauucccagaccguguggcgcacauaccugagaagccaugacuuuggggcgugcguuguguauccgaaccaacacuucugucggugcgucaaguacggagauaaauguaauucugcuaagugggacuuugccaacgagaugaagaccuucuacacgggcagaaaagugaaguuuaauaaagaucugaaccucgcccugcuugugcugcauaaggcuuuccgcgggacaggaaccgccuauauugcugaggccauggcgcggaaagacaauggcuccauggcccacuucgcucucgaaaucagaaagaaauuuccuacaaacgcccugcuggcugcccuuauugauuacaucguuuaucuccagagccuggcggagaucuccaccuucgaacuggaggaagacugggaggauuuuaaguacaagcccgagccuaccgaaucuacacuccagccccgcagccaccgguccgaccaguauaauuucaaaaacgccgauucuaauagcaacgucaaggugugcaaaaaugugaagaaaguccugugugugucccccagaagccgcgcuaaguuugagaacauuaucgccugcggggaacaugcuaacccuucuguuuacaugaugccgaauauuuccaucuaucaaagcaacucugagcggucccacuacuguauugccgacagccauugccuugaggaauacgagaucgugaauacggaacugcucaccgcccugaagaaaucuagaugcugggcuaaggagauggaugacgucgugcugcacaaacagagcgacggccuucgcuccugucggaucaaggauacaggaagcugcaacguucucggcaaugacuggaccauugugcugugugaaaacgggaauuauuacuauucugagauccacaaagauuacgacaaggaucaggacgucggacauuucugccugucccccagauguagcacaauucgcuauccuaucaaccggagacacauucggaagugcgauuggcagaucucccauucuaccauugacaaaaucagcgugcaagagcucgcggauaucgaacaguacaagaaagccauuucccagaagcugcagacgucucuuagcaucuuuaaauauguuaagacaaagaaucugccccacauuaaaccugcuuacaaguacaucaccguggagggcaccgaaacaauugaggggaucgaaaacgccuucaucgaguccgagauucccgcccucgcuggaaccgccaucggcuuuaaaauuaauucucgcgaagggaacuaucugauggacgucaucggcuacgucaagagcgcguccuauagcgcuacauacacgaaacuguauaccacaggaccgaccauuggcaucaauacaagacaugaugagaaguguaccgggccuugccccgugacgaucgaccacaaagauggauggcuuaccuucucuaaggaacggacauccaccuggggcugugaggaauuugggugccucgccgugagcgacggauguguuuucggcucuugccaagacauuaucaaggaugagcuggccguguacagaaaaacaaccgaggaacugacaaccguggagcucugccugacguuuuccgacaagacauauuguaccaaccuuaaugcuauuaccccuaucauuacagauaaauucgaaguccaguucaagaccguggagagcuacacgcugccccgcaucauugccguuaaaaaccacgagaucaagguggggcagaucaacgaccucggcgucuacucuaagggaugcggcaaugugcaaaaaguuaacgggacaaauuauggaaacggcgugccuaaguuugauuaccugugucaucuggcgucccggaaagaagucauucuuagaaagugcuucgacaaugauuaucaggcuuguaaauuucugcagagccccgccuccuaccgccucgaggaacaccaggggaccgugacaguuaucgacuauaagaagauucugggaagcaucaaaaugaaggccauucucggcgaugugaaauacaagaacuaucaaucuaauaucgagaucaacgcugaagggaccugcgccggcugugucaauugcuucgagaacauucauugugaguuuacaauccacaccacgguggaaaccagcugcccgauugugacagacugugucuccuuccaugauagaauccugauuaccccugacgagcacaaauacgcucuuaagaucguuugccaggacaagcccaaagugucucugaaguuuaaaaucugcaauacaaacauugaugccagcaugaccaucguggacuccaagcccauucucgaacuggcgccugucgaucagacggccuacaucaaagagaaggacgaacgguguaagacauggaugugccgcgugagagaugagggauuccagguuauucuggagccguuuaaaaaucuuuucggcucuuauaucgggauuuucuacaccggaauccugagcgugaucugucuccugauugucaucuauauugugcuccccaucugcuuuaagcugcgggacacacuuaaacaacacgaagaugcuuacaagaaagagaugaagauucgcuga

SEQ ID NO: 14256 - RNA, 4323 nt, Artificial Sequence
  derived and/or modified CDS sequence (opt5) from TAHV__AF123485.1__GP
augauguucgugcuguuuuucaucgcccucagcgcugccucccccgucuaccagagaugcuuucaagacggcgcgauuguuaagcagaacccuucuaaacaggcugugaccgaggugugucugaaggaugacgucagcaugaucaaaacagaagcccgguauuuccgcaaugccacggggaccuacgcuaacaauguggccauuagaaaguggcuuguuuccgauuggcacgacugccggccgaaaaaggugucuggaggccauaucaacgucauugaggugggggaugaccugacacuccacaccgaggcuuauguuuguaaugccgauugcacaaucggaguggacaaggagaccgcgcagguccgccugcaaacagauaccacgaaccauuuugaaaucgccggcaccacagugaaaagcgggugguucaaguccaccacauacauuacccuugaccagacgugugagcaccugaaagugucuugcggacccaagagcauccaguuucaugcuuguuucaaucagcacauguccugcgucagauuucuccaccggacaauucugccuggcagcaucgccucuuccauuugucaaaacguugagaucauuauccugaccgugcucacacugcuuaucuucauucugcucagcauccugucuaaaaccuauauuugcuacauccuuaugcccauuuuuaucccucuggcuuauaucuacggcgugauuuacaauaaguccuguaagaaaugcaagcucugcgggcuggucuaucaucccuucaccgaauguggaacacacugcguguguggcgcccgcuacgagacgagcgauagaaugaaacugcaucgggcgucugggcucugcccuggauauaagucccugcgcgccgcuagaguuauguguaaaagcaagggcccggccuccauccuuucuauuaucaccgcugugcugauucucacauuugucacccccaucaacgccaugguggccggggacacacaggaaaccuucaaacuggaggaucuuccugacgacaugcugagcauggcuaugaagguuaauauguacuauaucaugugcaugauuaacuacgcggugacgugguccuucauccucugugcccugcugauugcucuccuguuuaagaaauaucagcaccgguuccuuaauuuuuacgccauguacugccacgagugugauauguaucaugaccgcagcggacugaaguacaacggcgauuucacaaauaaaugcagacaguguaccugcggccaauaugaagacgccgcugggcuccugacccaccggaagacauacaacugccuuguccaguauaaaucuaaguggcugaccaacuuucucaucguguacauuauccugaugcugauuaaggauuccguccucaucgugcaugccgacggaacagauuucgagaaauguagcggcgaaguugacaucacguggaauugcaccgggcccuuucugaaccuuggaaauugugagaagaaacagaagaaagaaucuuauaacaauauugcgacacaacugaagggccucgaugcuaucagcgugcuggacauuccuaugaucuccaagauucccgaggauaucgccggggcccugcgcuucaucgaggaacagagaucuuaccacguccagcuuaccgcugaguacgccaugcucacacgguauugcgacuacuauacccaguuuacggacaacagcggauacucccaaaccacauggagaguguaucugcgcagccaugauuucaaggcuuguauucuguacccgaaucagcacuuuugccgguguguuaagcacggcgacaaauguucuuccagcaacugggauuucgccaaugaaaugaagaacuauuacucuggcaaacaguccaaguuugacaaggaucucaaucuggcgcuuaugagccugcaucacgccuucagagggaccuccucuuucuacaucgcuaaacuccugaaggagaaaaagaacgaagaccuggugacauaugccgagaaaauuaagggaaaauacccuggcaaugcccuucucaaggcuaucauugauuauaucaaguacauggaggaccugaccgaaaugaacaauuuuaaacaugaugagaugugggacgauuucaucuuugaagugcccccuacgaaaagccccuccauucgccggcuggagucuagcuaugacuucaaaacaaacgucaacuccaaucccagccacaucugcaagaacauuaaaaccgugguuugccucucuccuaaguccggggucagcuacgauucuaucauugcguguggagaaccgucccagcccagcaucuauagaaagccugacucucaaguguuucagagcaaugccgaccagacacacuucugccuguccgauacccauugccuugagaacuacgagaccgugggcgaagagaucauugacgcuaucaaaaagagcaaauguugggaaacagaguuuacggaguacauucaguucaagcaaucugaugggguccgcuccugccggaugaaagacagcggcgaauguaccgugacaaccaauagauggcccaucauucugugcgauaacgacaaguuuuauuacuccgagcuccagaaggauuaugacaaagaucaggacaucggacacuucugucugucuccucgcugcaauacaauucggcaucccaucaacagaaagcacaucagcaauuguaccuggcagguuucccauaacaauauugauaaaaucgaagugcacgagcuggaagaccuugagcaauacaagaaagccauuacgcagaagcuccagacaucucugacccuguuuaaguauagcaaaaccaagaaccucccgcacaucaaaccuauguacaaguauauuacaaucgagggcaccgaaacagcugaggggcuggaauccgccuacaucgagucugaaauucccgcccuugcuggaacgagcaucggcuucaaaauuaccuccaagagcgggaaacaucugcucgaugucaucggauacgugaagucugcguccuauagcgccguuuacacaaagcuguauaccacaggcccuaccauuggggugaauacgaaacacgacgagcugugcaccggccccuguccugucaacgugccccauggaacaggcuggcuuaccuuugcuaaggagcgcacaucuuccugggggugcgaagaguucggaugucucgccaucagcgacggcugcguuuucgggucuugccaagauaucauuaaagacgaaaucaccguguaccggaaggagacagaagagaccacggaugucgagcugugucugacauuugccgacaaaaccuauugcaccaaucucaacgcuauuacaccgaucauuaccgaucaguucgaagugcaguuuaagacgguggaggccuacucccugccuagaaucauugcgguccggaaccacgaaaucaugguuggacagaucaaugacauuggcguguauagcaagggguguggcaacgugcaaaaagucaauaacacaaauuacggaaacggcgugcccaaguucgauuaccuuugccaucuggcuucccgcaaagagguuaucgugagaaaguguuuugacaaugauuaucaggccugcaaauuccuccagacccccgccagcuaccggcuggaggaagaagggggaucugucacagugauugacuauaagaagauccugggcaccauuaaaaugaaggcuauccuuggggauguuaaauacaagacauuugccgacaacguggaccugaccgucgaaggaguguguacgggcugcaucaauuguuucgagaacauucacugcgaacucaccauccacagcacaguugaggcguccuguccuguggucucuagcugcaccguguuucaugaucgcauucugaucacaccgaaugagcacaaauaugcuauuaaggugaucugcaacgaaaagcccgggccuacccuccccuucaaaaucuguuccgccaagacggacgccgcuaugacacuggccgaugcuaaaccuauucuugagcuggcccccgucgaccagaccacauacaucaaggaaaaagaugagagaugcaagaccuggaugugucggguuagagacgaaggcuuucaagugauuuucgagccuuucaagaaucucuuuggaucuuauaucggcauuuucuacaccuuuaucauuagccugauggcgaucuucaucgugauuuacaucguccugcccauuugcuuuaaacuucgcgauacacugagacagcaugaggacgccuauaagcgggaaaugaaaauccgcuga

SEQ ID NO: 14257 - RNA, 4323 nt, Artificial Sequence
  derived and/or modified CDS sequence (opt5) from TAHV__AF229129.1__GP
augauguucgugcuguuuuucaucgcccucagcgcugccucccccgucuaccagagaugcuuucaagacggcgcgauuguuaagcagaacccuucuaaacaggcugugaccgaggugugucugaaggaugacgucagcaugaucaaaacagaagcccgguauuuccgcaaugccacggggaccuacgcuaacaauguggccauuagaaaguggcuuguuuccgauuggcacgacugccggccgaaaaaggugucuggaggccauaucaacgucauugaggugggggaugaccugacacuccacaccgaggcuuauguuuguaaugccgauugcacaaucggaguggacaaggaaaccgcgcagguccgccugcaaacagauaccacgaaccauuuugaaaucgccggcaccacagugaaaagcgggugguucaaguccaccacauacauuacccuugaccagacgugugagcaccugaaagugucuugcggacccaagagcauccaguuucaugcuuguuucaaucagcacauguccugcgucagauuucuccaccggacaauucugccuggcagcaucgccucuuccauuugucaaaacguugagaucauuauccugaccgugcucacacugcuuaucuucauucugcucagcauccugucuaaaaccuauauuugcuacauccuuaugcccauuuuuaucccucuggcuuauaucuacggcgugauuuacaauaaguccuguaagaaaugcaagcucugcgggcuggucuaucaucccuucaccgaauguggaacacacugcguguguggcgcccgcuacgagacgagcgauagaaugaaacugcaucgggcgucugggcucugcccuggauauaagucccugcgcgccgcuagaguuauguguaaaagcaagggcccggccuccauccuuucuauuaucaccgcugugcugauucucacauuugucacccccaucaacgccaugguggccggggacacacaggaaaccuucaaacuggaggaucuuccugacgacaugcugagcauggcuaugaagguuaauauguacuauaucaugugcaugauuaacuacgcggugacgugguccuucauccucugugcccugcugauugcucuccuguuuaagaaauaucagcaccgguuccuuaauuuuuacgccauguacugccacgagugugauauguaucaugaccgcagcggacugaaguacaacggcgauuucacaaauaaaugcagacaguguaccugcggccaauauggggacgccgcuggacuccugacccaccggaagacauacaacugccuuguccaguauaaaucuaaguggcugaccaacuuucucaucggcuacauuauccugaugcugauuaaggauuccgugcuccugguccaugccgacgggacagauuucgaaaaauguagcggagaggcggacaucacguggaauugcaccggccccuuucuuucucuggggaacugugaaaagaaacagaagaaagagagcuauaauaacaucgcuacacaacucaagggacuggaugccauuuccgugcuggacaucccuaugauuucuaagauccccgaagauauugccggcgcccuucgcuucaucgaggagcagagaagcuaccacguucagcucaccgcugaauacgcuaugcugacacgguauugcgacuacuauacccaguuuacggacaauuccggcuacagccaaaccacauggagaguguaucugcgcucucaugauuucgaggccuguauccucuacccgaaccggcacuuuugcagaugugucaaacacggggacaagugcuccagcucuaauugggauuucgcgaacgaaaugaaaaauuauuacuccggaaagcagagcaaauuuaacaaggaccugaaucuugcccugaugucccuccaucacgcuuuccgcggcaccucuagcuucuacauugccaagcugcugaaagagaagaaaaacgaagaucuugugacauaugcugagaagaucaaagggaaguacccuggaaaugcccuccugaaagcgauuaucgacuauauuaaguacaugaagggccugaccgagaugaacaauuuuaaacaugaugaaaugugggacgauuucaucuuugagguucccccuacgaagucccccucugugcggagacucgaaagcuccuaugacuucaaaacaaacgucaacagcaaucccucucacaucuguaagaacauuaaaaccguggugugccuguccccuaagagcgggguuucuuacgauuccaucauugccuguggcgagccgagccagcccucuaucuaucgcaagccugacagccaggucuuucaauccaaugcugaucagacacacuucugccuuagcgacacccauugccuggaaaacuacgagaccgugggagaggaaauuaucgacgccaucaaaaagucuaaauguugggagacagaauuuacggaguacacccagcucaagcaguccgauggcgugcggagcugcagaaugaaagacuccggggaguguacagucaccacaaaucgcuggcccauuauccugugcgauaacgacaaguucuauuacucugaacugcaaaaggauuaugacaaagaucaggacauuggacacuuuugucuuagcccucggugcaauaccaucagacaucccauuaaccgcaagcacaucuccaauuguacguggcaagugaaccauaauaacauugauaaaaucgagguucacgaacucgaggaccuggaacaguacaagaaagcuaucacacaaaagcugcagaccucucucacccuguucaaguauagcaaaacaaagaaucuuccgcacauuaaaccuauguacaaguauaucaccauugagggcacagagacggccgaagggaucgaguccgccuacauugaaucugagauccccgcucuggcgggaaccagcaucggcuuuaaaauuacauccaagagcgggaaacaucuccuggaugugaucggcuacgucaagucugccuccuauagcgcuguguacaccaagcuguauacaaccggaccuacgauuggcguuaacaccaaacacgacgaacuuugcacagggcccuguccugugaaugucccccauggaaccggcuggcucacauucgccaaggagcggaccucuuccugggggugcgaggaauuuggaugucuggccaucagcgauggcugcguguucgggucuugccaggacauuaucaaagacgagaucacaguuuacagaaaggaaaccgaggaaacgacagauguggagcugugucucaccuucgcugacaaaaccuauugcacaaaccugaacgccauuaccccgaucauuacggaucaauuugagguccaguucaagacaguggaagcguacucccuuccucggaucauugcugugcgcaaucacgagaucauggucggccagauuaacgacaucggaguuuauagcaagggcugugggaaugugcagaaagugaacaauaccaacuacggaaauggcgcccccaaguuugauuaccugugccaucucgccuccagaaaagaagucaucgugcggaaguguuucgacaacgauuaucaggcuugcaaauuucugcagacacccgccagcuacagacuggaggaggaagggggaucuguuaccgugauugacuauaagaagauccuuggcacaauuaaaaugaaggcgauccugggggaugucaaauacaagaccuucgcugacaauguggaucucacgguugagggcguguguaccggaugcgucaacuguuuugaaaauauucacugcgagagcacaauccacuccaccguggaagccucuuguccuguuaucagcuccugcacaguguuccaugaccgcauucugaucaccccgaacgagcacaaauaugccauuaaggucaucugcaaugagaagcccggcccuacgcuccccuuuaaaauuuguucugcuaagacagacgccgcuaugacccuggccgaugcgaaaccuauccuugaacuggcccccguggaccagacaaccuacaucaaggagaaaguggaacggugcaagaccuggauguguagaguccgcgaugagggguuccagguuauuuuugaaccuuucaagaaccucuucggaagcuauaucggcaucuuuuacacauucauuauuucccugauggcuaucuuuauugugaucuacaucgugcugcccauuugcuucaaacuuagagacacgcugcggcaacaugaggaugccuauaagcgcgagaugaaaaucagauga

SEQ ID NO: 14258 - RNA, 4323 nt, Artificial Sequence
  derived and/or modified CDS sequence (opt5) from TAHV(22595-6)__HM036218.1__GP
augauguucgugcuguuuuucaucgcccucagcgcugccucccccgucuaccagagaugcuuucaagacggcgcgauuguuaagcagaacccuucuaaacaggcugugaccgaggugugucugaaggaugacgucagcaugaucaaaacagaagcccgguauuuccgcaaugccacggggaccuacgcuaacaauguggccauuagaaaguggcuuguuuccgauuggcacgacugccggccgaaaaaggugucuggaggccauaucaacgucauugaggugggggaugaccugacacuccacaccgaggcuuauguuuguaaugccgauugcacaaucggaguggacaaggaaaccgcgcagguccgccugcaaacagauaccacgaaccauuuugaaaucgccggcaccacagugaaaagcgggugguucaaguccaccacauacauuacccuugaccagacgugugagcaccugaaagugucuugcggacccaagagcauccaguuucaugcuuguuucaaucagcacauguccugcgucagauuucuccaccggacaauucugccuggcagcaucgccucuuccauuugucaaaacguugagaucauuauccugaccgugcucacacugcuuaucuucauucugcucagcauccugucuaaaaccuauauuugcuacauccuuaugcccauuuuuaucccucuggcuuauaucuacggcgugauuuacaauaaguccuguaagaaaugcaagcucugcgggcuggucuaucaucccuucaccgaauguggaacacacugcguguguggcgcccgcuacgagacgagcgauagaaugaaacugcaucgggcgucugggcucugcccuggauauaagucccugcgcgccgcuagaguuauguguaaaagcaagggcccggccuccauccuuucuauuaucaccgcugugcugauucucacauuugucacccccaucaacgccaugguggccggggacacacaggaaaccuucaaacuggaggaucuuccugacgacaugcugagcauggcuaugaagguuaauauguacuauaucaugugcaugauuaacuacgcggugacgugguccuucauccucugugcccugcugauugcucuccuguuuaagaaauaucagcaccgguuccuuaauuuuuacgccauguacugccacgagugugauauguaucaugaccgcagcggacugaaguacaacggcgauuucacaaauaaaugcagacaguguaccugcggccaauaugaagacgccgcugggcuccugacccaccggaagacauacaacugccuuguccaguauaaaucuaaguggcugaccaacuuucucaucguguacauuauccugaugcugauuaaggauuccguccucaucgugcaugccgacggaacagauuucgagaaauguagcggcgaagcggacaucacguggaauugcaccgggcccuuucugaaccuuggaaauugugagaagaaacagaagaaagaaucuuauaacaauauugcuacacaacugaagggccucgaugccaucagcguucuggacauuccuaugaucuccaagauucccgaggauaucgccggggcucugcgcuucaucgaggaacagagaucuuaccacgugcagcuuaccgccgaguacgcuaugcucacacgguauugcgacuacuauacccaguuuacggacaacagcggauacucccaaaccacacugagagucuaucugcgcagccaugauuucaaagccuguauucucuacccgaaucagcacuuuugccggugugugaagcacggcgacaaaugcagcuccagcaacugggauuucgcgaaugaaaugaagaacuauuacucuggcaaacaguccaaguuugacaaggaucugaaucuugcccugaugagccuccaucacgcuuucagagggaccuccucuuucuacaucgccaaacugcugaaggagaaaaagaacgaagaccuuguuacauaugcugagaaaauuaagggaaaauacccuggcaaugcccuccugaaggcgaucauugauuauaucaaguacauggaggaccugaccgaaaugaacaauuuuaaacaugaugagaugugggacgauuucaucuuugaagugcccccuacgaagucucccuccauucgccggcucgagucuagcuaugacuucaaaacaaacgucaacuccaaucccagccacaucuguaagaacauuaaaaccguggugugccugucuccuaaguccgggguuagcuacgauucuaucauugccuguggagaaccgucccagcccagcaucuauagaaagccugacucucaagucuuucagagcaaugcugaccagacacacuucugccuuuccgauacccauugccuggagaacuacgagaccgugggcgaagagaucauugacgccaucaaaaagagcgaauguugggagacagaguuuacggaauacauucaguucaaacaaucugauggggugcgcuccugccggaugaaggacagcggcgaguguaccgucacaaccaauagauggcccaucauucucugcgauaacgacaaauuuuauuacuccgaacugcagaaggauuaugacaaggaucaggacaucggacacuucugucugucuccucgcugcaauacaauucggcaucccaucaacagaaaacacaucagcaauuguaccuggcaagugucccauaacaauauugauaagaucgagguucacgaacuugaggaccucgagcaguacaaaaaggcuauuacgcagaaacugcagacaucucugacccucuuuaaguauagcaagaccaaaaaccugccgcacaucaagccuauguacaaauauauuacaaucgaaggcaccgagacagccgaagggaucgaguccgccuacauugaaucugagauccccgcucuugcgggaacgagcauuggcuucaagaucaccuccaaaagcgggaagcaucugcucgaugugauuggauacgucaaaucugccuccuauagcgcuguguacacaaagcuguauaccacaggcccuaccaucgggguuaauacgaagcacgacgagcugugcaccggccccuguccugugaacgucccccauggaacaggcuggcuuaccuuugccaaagaacgcacaucuuccugggggugcgaggaguucggaugucucgccaucagcgacggcugcguguucgggucuugccaagauauuaucaaggacgaaauuaccguuuaccggaaagaaacagaggagaccacggauguggaacugugucugacauuugcugacaagaccuauugcaccaaucucaacgccaucacaccgauuaucaccgaucaguucgagguccaguuuaaaacgguggaagcguacucccugccuagaauuaucgcugugcggaaccacgagaucauggucggacagauuaaugacaucggcguuuauagcaagggguguggcaacgugcaaaaggugaauaacacaaauuacggaaacggcguccccaaauucgauuaccuuugccaucuggccucccgcaaggaggugauuguuagaaaauguuuugacaaugauuaucaggccugcaaguuccuccagacccccgcuagcuaccggcuggaagaggaagggggaucugugacagucaucgacuauaaaaagauucugggcaccaucaagaugaaagccauccuuggggaugugaaguacaaaacauuugcggacaacguugaccugaccguggagggagucuguacgggcugcauuaauuguuucgaaaacauccacugcgagcucaccauucacagcacaguggaggcuuccuguccuguugugucuagcugcaccgucuuucaugauagaauccugauuacaccgaaugaacacaaguaugccaucaaagugaucugcaacgagaagcccgggccuacccuccccuucaagauuuguuccgccaaaacggacgcugccaugacacuggcugaugccaagccuauccuugaacuggcgcccguggaccagaccacauacauuaaagagaaggaugaacgcugcaaaaccuggaugugucgggucagagacgagggcuuucaaguuaucuucgagccuuucaagaaucucuuuggaucuuauauuggcaucuucuacaccuuuauuaucagccugauggccaucuucauugugaucuacauugugcugcccaucugcuuuaaacuucgcgauacacugagacagcaugaagacgcuuauaagcgggagaugaagauucgcuga

SEQ ID NO: 14259 - RNA, 4323 nt, Artificial Sequence
  derived and/or modified CDS sequence (opt5) from TAHV(92' Bardos)__HM036209.1__GP
augauguucgugcuguuuuucaucgcccucagcgcugccucccccgucuaccagagaugcuuucaagacggcgcgauuguuaagcagaacccuucuaaacaggcugugaccgaggugugucugaaggaugacgucagcaugaucaaaacagaagcccgguauuuccgcaaugccacggggaccuacgcuaacaauguggccauuagaaaguggcuuguuuccgauuggcacgacugccggccgaaaaaggugucuggaggccauaucaacgucauugaggugggggaugaccugacacuccacaccgaggcuuauguuuguaaugccgauugcacaaucggaguggacaaggagaccgcgcagguccgccugcaaacagauaccacgaaccauuuugaaaucgccggcaccacagugaaaagcgggugguucaaguccaccacauacauuacccuugaccagacgugugagcaccugaaagugucuugcggacccaagagcauccaguuucaugcuuguuucaaucagcacauguccugcgucagauuucuccaccggacaauucugccuggcagcaucgccucuuccauuugucaaaacguugagaucauuauccugaccgugcucacacugcuuaucuucauucugcucagcauccugucuaaaaccuauauuugcuacauccuuaugcccauuuuuaucccucuggcuuauaucuacggcgugauuuacaauaaguccuguaagaaaugcaagcucugcgggcuggucuaucaucccuucaccgaauguggaacacacugcguguguggcgcccgcuacgagacgagcgauagaaugaaacugcaucgggcgucugggcucugcccuggauauaagucccugcgcgccgcuagaguuauguguaaaagcaagggcccggccuccauccuuucuauuaucaccgcugugcugauucucacauuugucacccccaucaacgccaugguggccggggacacacaggaaaccuucaaacuggaggaucuuccugacaauaugcugagcauggcuaugaagguuaacauguacuauaucaugugcaugauuaauuacgcggugacgugguccuucauccucugugcccugcugauugcucuccuguuuaagaaauaucagcaccgguuccuuaacuuuuacgccauguacugccacgagugugacauguaucaugaucgcagcggacugaaguacaaugaagacuucacaaacaaaugcagacaguguaccugcggccaauaugaggaugccgcuggccuccugacccaccggaagacauacaacugccuuguccaguauaaaucuaaguggcugaccaauuuucucaucguguacauuauccugaugcugauuaaggacuccguccucaucgugcaugccgaugggacagacuucgaaaaauguagcggagaggcggauaucacguggaacugcaccggccccuuucugaaucuugggaacugugaaaagaaacagaagaaagagucuuauaauaacauugcuacacaacugaagggacucgacgccaucagcguucuggauauuuccaugaucucuaagauuccugaggacaucgccggcgcucugcgcuucaucgaagaacagagaagcuaccacgugcagcuuaccgccgaauacgcuaugcucacacgguauugcgauuacuauacccaguuuacggacaauuccggguacagccaaaccacauggagagucuaucugcgcucucaugacuucgaggccuguauucuguaccccaaccagcacuuuugccggugugugaaacacggagauaagugcuccagcucuaauugggacuucgcgaacgaaaugaaaaauuuuuauuccggcaagcagagcaaauucgauaaggaccucaaccuggcccuuaugucccugcaucacgcuuucagaggcaccucuagcuuuuacaucgccaagcuccugaaagagaagaaaaaugaggaucugguuacauacgcugaaaagauuaaagggaaguauccgggaaacgcccuucucaaagcgaucauugacuacaucaaguauauggaggaucugaccgaaaugaauaacuucaaguacgacgagaugugggaugacuuuaucuucgaagugccucccacgaaauccccuucuauucgccggcuggagagcuccuaugauuuuaagacaaacgucaauagcaaccccucucauaucuguaaaaauauuaagaccguggugugccucucccccaaaagcggcguuucuuacgacuccaucauugccuguggggagccuagccagccgucuaucuauagaaagcccgauagccaagucuuccaguccaacgcugaccagacacacuuuugccugagcgacacccacugccuugaaaauuacgagaccgugggagaagagaucauugaugccaucaagaaaucuaaguguugggagacagaguucacggaauacauucaguuuaaacaauccgacggcgugcgcagcugccggaugaaggauuccggggaauguaccgucacaaccaacagauggccuaucauucugugcgacaaugauaaauucuauuacucugagcuccagaaggacuaugauaaggaccaggauaucggccauuuuugucugagcccccgcugcaacacaauucggcacccuaucaauagaaaacauaucuccaacuguaccuggcaagugucucacaauaacauugacaagaucgaaguucaugagcuggaggaucuugaacaguacaaaaaggcuauuacgcagaaacuccagacaagccugacccuguucaaguauuccaagaccaaaaaucucccccacaucaagccgauguacaaauauauuacaaucgagggaaccgaaacagccgagggcaucgaaucugccuacauugagagcgagaucccugcucuggcggggacguccauuggauuuaagaucaccagcaaaucuggcaagcaccuucuggacgugauuggguacgucaaauccgccagcuauucugcuguguacacaaagcucuauaccacaggacccaccaucggcguuaacacgaagcaugaugaacugugcaccgggccuugucccgugaaugucccucacggcacaggauggcugaccuucgccaaagagcgcacauccagcuggggcugcgaagaguucgggugucuugccaucucugacggaugcguguuuggcuccugccaagacauuaucaaggaugaaauuaccguuuaccggaaagagacagaggaaaccacggacguggagcucugucugacauucgcugauaagaccuauugcaccaaccugaacgccaucacacccauuaucaccgaccaguuugaaguccaguucaaaacgguggaggcguacagccucccgagaauuaucgcugugcggaaucaugagaucauggucgggcagauuaacgauaucggaguuuauuccaagggcugugggaaugugcaaaaggugaacaauacaaacuacggcaauggagucccuaaauuugacuaccugugccaccuugccagccgcaaggaagugauuguuagaaaauguuucgauaacgacuaucaggccugcaaguuucugcagacccccgcuucuuaccggcucgaggaagagggcgggagcgugacagucaucgauuauaaaaagauucugggaaccaucaagaugaaagccauccugggcgacgugaaguacaaaacauucgcggauaauguugaccuuaccguggaaggggucuguacgggaugcauuaacuguuuugagaauauccauugcgagcugaccauucacuccacaguggaggcuucuugucccguugugagcuccugcaccgucuuccacgacagaauccucauuacaccuaacgaacauaaguaugccaucaaagugaucugcaaugaaaagccgggccccacccugccuuuuaagauuuguucugccaaaacggaugcugccaugacacucgcugacgccaagcccauccuggagcuugcgccuguggaucagaccacauacauuaaagaaaaggacgagcgcugcaaaaccuggaugugucgggucagagaugagggguuccaaguuaucuucgaacccuuuaagaaccuguucggcagcuauauuggaaucuuuuacaccuucauuaucucccucauggccaucuuuauugugaucuacauugugcugccuaucugcuucaagcugcgcgacacacuuagacagcacgaggaugcuuauaaacgggaaaugaagauucgcuga

SEQ ID NO: 14260 - RNA, 4323 nt, Artificial Sequence
  derived and/or modified CDS sequence (opt5) from TAHV(92' Bardos)__HM036212.1__GP
augauguucgugcuguuuuucaucgcccucagcgcugccucccccgucuaccagagaugcuuucaagacggcgcgauuguuaagcagaacccuucuaaacaggcugugaccgaggugugucugaaggaugacgucagcaugaucaaaacagaagcccgguauuuccgcaaugccacggggaccuacgcuaacaauguggccauuagaaaguggcuuguuuccgauuggcacgacugccggccgaaaaaggugucuggaggccauaucaacgucauugaggugggggaugaccugacacuccacaccgaggcuuauguuuguaaugccgauugcacaaucggaguggacaaggagaccgcgcagguccgccugcaaacagauaccacgaaccauuuugaaaucgccggcaccacagugaaaagcgggugguucaaguccaccacauacauuacccuugaccagacgugugagcaccugaaagugucuugcggacccaagagcauccaguuucaugcuuguuucaaucagcacauguccugcgucagauuucuccaccggacaauucugccuggcagcaucgccucuuccauuugucaaaacguugagaucauuauccugaccgugcucacacugcuuaucuucauucugcucagcauccugucuaaaaccuauauuugcuacauccuuaugcccauuuuuaucccucuggcuuauaucuacggcgugauuuacaauaaguccuguaagaaaugcaagcucugcgggcuggucuaucaucccuucaccgaauguggaacacacugcguguguggcgcccgcuacgagacgagcgauagaaugaaacugcaucgggcgucugggcucugcccuggauauaagucccugcgcgccgcuagaguuauguguaaaagcaagggcccggccuccauccuuucuauuaucaccgcugugcugauucucacauuugucacccccaucaacgccaugguggccggggacacacaggaaaccaucaaacuggaggaucuuccugacgacaugcugagcacggcuaugaagguuaauauguacuauauuaugugcaugaucaacuacgcggugacaugguccuucauucucugugcccugcugaucgcucuccuguucaagaaauaucagcaccgguuucuuaauuucuacgccauguacugccacgagugugauauguaucaugaccgcagcggacugaaguacaacgaagauuuuaccaauaaaugcagacaguguaccugcggccaauaugaggacgccgcuggccuccugacacaccggaagaccuacaacugccuuguccaguauaaaucuaaguggcugacaaacuuccucauuguguacaucauucugaugcugaucaaggauuccguccucaucgugcaugccgacgggacggauuuugaaaaauguagcggagaggcggacauuaccuggaauugcacaggccccuuccugaaccuugggaauugugaaaagaaacagaagaaagagucuuauaacaauaucgcuacccaacugaagggacucgaugccauuagcguucuggacaucuccaugauuucuaagaucccugaggauaucgccggcgcucugcgcuuuauugaagaacagagaagcuaccacgugcagcuuacagccgaauacgcuaugcucacccgguauugcgacuacuauacgcaguucaccgacaacuccggguacagccaaacaaccuggagagucuaucugcgcucucaugauuuuaaagccuguauccuguaccccaaucagcacuucugccggugugugaagcacggagacaaaugcuccagcucuaacugggauuccgcgaaugagaugaagaacuuuuauagcggcaaucaguccaaauucgacaaggaucucaaccuggcccuuaugucucugcaucacgcuuuuagaggcacaagcuccuucuacauugccaagcuccugaaagaaaagaaaaaugaggaccugguuaccuacgcugagaagaucaaagggaaguauccgggaaacgcccuucucaaagcgauuaucgauuacaucaaguauauggaagaccugacggagaugaauaacuucaaguacgaugaaaugugggacgauuuuauuuucgaggugccucccacaaaaucuccuagcauccgccggcuggaauccagcuaugacuuuaagaccaacgucaauucuaaccccucccauauuuguaaaaauaucaagacaguggugugccucagccccaaaucuggcguuuccuacgauagcauuaucgccuguggggagccuucucagccgagcaucuauagaaagcccgacucccaagucuuccagagcaacgcugaccagacccacuuuugccugucugauacccacugccuugagaauuacgaaacagugggagaggaaauuaucgacgccauuaagaaauccaaguguugggagacggaguucaccgaauacauccaguuuaaacaaagcgauggcgugcgcuccugccggaugaaggacucuggggaguguacagucaccacaaacagauggccuauuauccugugcgauaaugacaaauucuauuacagcgaacuccagaaggauuaugacaaggaucaggacauuggccauuuuugucugucccccagaugcaacaccauccggcacccuaucaauagaaaacauauuucuaacuguacguggcaagugagccacaauaacaucgauaagauugagguucaugaacuggaggaccuugagcaguacaaaaaggcuaucacacagaaacuccagaccucccugacccuguucaaguauucuaagaccaaaaaucucccccacauuaagccgauguacaaauauaucacaaucgaaggaacagagacggccgaaggcauugagagcgccuacaucgaauccgagauuccugcucuggcggggaccagcaucggauuuaagauuacaucuaaauccggcaagcaccuucuggaugugaucggguacgucaaaagcgccucuuauuccgcuguguacaccaagcucuauacaaccggacccacgaucggcguuaacaccaagcaugacgagcugugcacagggccuugucccgugaaugucccucacggcaccggauggcugacauucgccaaagaacgcaccagcucuuggggcugcgaggaauuugggugucuugccauuuccgacggaugcguguucggcagcugccaagauaucauuaaggacgagaucacaguuuaccggaaagaaaccgaggagacgacagauguggaacucugucugaccuucgcugacaagaccuauugcacaaaccugaacgccauuacccccaucauuacggaucaguuugagguccaguucaaaacaguggaagcguacucccucccgagaaucaucgcugugcggaaucaugagauuauggucgggcagaucaacgacauuggaguuuauagcaagggcugugggaaugugcaaaaggugaacaauaccaacuacggcaauggagucccuaaauuugauuaccugugccaccuugccucucgcaaggaggugaucguuagaaaauguuucgacaacgauuaucaggccugcaaguuucugcagacacccgcuagcuaccggcucgaagaggaaggcggguccgugaccgucauugacuauaaaaagauccugggaacaaucaagaugaaagccauucugggcgaugugaaguacaaaaccuucgcggacaauguugaccuuacgguggagggggucuguaccggaugcaucaacuguuuugaaaauauucauugcgagcugacaauccacucuaccguggaggcuagcugucccguuguguccucuugcacagucuuccacgaucgcauucucaucaccccuaacgaacauaaguaugccaucaaagugauuugcaaugagaagccgggccccacgcugccuuuuaagaucuguagcgccaaaacagacgcugccaugacccucgcugaugccaagcccauucuggaacuugcgccuguggaccagacaaccuacaucaaagagaaggaugaacgcugcaaaaccuggaugugucgggucagagacgagggguuccaaguuauuuuugagcccuucaagaaccuguucggcuccuauaucggaaucuuuuacacauucauuaucucucucauggccauuuuuaucgugauuuacaucgugcugccuauuugcuucaagcugcgcgauacgcuuagacagcacgaagacgcuuauaaacgggagaugaagauccgcuga

SEQ ID NO: 14261 - RNA, 4323 nt, Artificial Sequence
  derived and/or modified CDS sequence (opt5) from TAHV(Souche D C14019-29)__HM036215.1__GP
augauguucgugcuguuuuucaucgcccucagcgcugccucccccgucuaccagagaugcuuucaagacggcgcgauuguuaagcagaacccuucuaaacaggcugugaccgaggugugucugaaggaugacgucagcaugaucaaaacagaagcccgguauuucaagaaugccacggggaccuacgcuaacaauguggccauucgcaaauggcuuguuuccgauuggcacgacugcagaccgaagaaggugucuggaggccauaucaacgucauugaggugggggaugaccugacacuccacaccgaggcuuauguuuguaaugccgauugcacaaucggaguggacaaagaaaccgcgcagguccggcugcaaacagauaccacgaaccauuuugaaaucgccggcaccacagucaagagcgggugguucaaauccaccacauacauuacccuugaccagacgugugagcaccugaaggugucuugcggacccaaaagcauccaguuucaugcuuguuucaaucagcacauguccugcgugcgcuuucuccacagaacaauucugccuggcagcaucgccucuuccauuugucaaaacguugagaucauuauccugaccgugcucacacugcuuaucuucauucugcucagcauccugucuaagaccuauauuugcuacauccuuaugcccauuuuuaucccucuggcuuauaucuacggcgugauuuacaauaaguccuguaaaaagugcaaacucugcgggcuggucuaucaucccuucaccgaauguggaacacacugcguguguggcgcccgguacgagacgagcgaucgcaugaagcugcauagagcgucugggcucugcccuggauauaaaucccugcgggccgcucgcguuauguguaagagcaaaggcccggccuccauccuuucuauuaucaccgcugugcugauucucacauuugucacccccaucaacgccaugguggccggggacacacaggaaaccuucaagcuggaggaucuuccugacgacaugcugagcauggcuaugaagguuaauauguacuauaucaugugcaugauuaacuacgcggugacgugguccuucauccucugugcccugcugauugcucuccuguuuaaaaaguaucagcacagauuccuuaauuuuuacgccauguacugccacgagugugauauguaucaugaccggagcggacugaaauacaacggcgauuucacaaauaagugccgccaguguaccugcggccaauaugaagacgccgcugggcuccugacccacagaaaaacauacaacugccuuguccaguauaagucuaaguggcugaccaacuuucucaucguguacauuauccugaugcugauugaggauuccguccucaucgugcaugccgacggaacagauuucgaaaaauguagcggcgaggcggacaucacguggaauugcaccgggcccuuucugaaccuuggaaauugugaaaagaaacagaagaaagagucuuauaacaauauugcuacacaacugaagggccucgaugccaucagcguucuggacauuccuaugaucuccaagauucccgaggauaucgccggggcucugcgguucaucgaggaacagcgcucuuaccacgugcagcuuaccgccgaauacgcuaugcucacaagauauugcgacuacuauacccaguuuacggacaacagcggauacucccaaaccacauggcgggucuaucugagaagccaugauuucgaggccuguauucuguacccgaaucgccacuuuugccggugugugaaacacggcgacaaguguucuuccagcaacugggauuucgcgaaugaaaugaaaaacuauuacucuggcaagcaguccaaauuuaauaaggaccucaaccuggcccuuaugagccugcaucacgcuuucagagggaccuccucuuucuacaucgccaagcuccugaaagagaagaaaaaugaggaucugguuacauaugcugaaaagauuaaaggaaaguacccuggcaacgcccuucucaaagcgaucauugacuauaucaaguacaugaaggaucugaccgagaugaauaacuuuaaacaugacgaaaugugggaggauuucaucuuugaagugcccccuacaaagagccccuccguccgccggcuggagucuagcuaugacuucaaaacgaacguuaauuccaaccccagccacauuugcaagaauaucaaaaccguggugugccucucuccuaaguccggggucagcuacgauucuauuaucgccuguggagagccgucccagcccagcauuuauagaaagccugacucucagguguuucaaagcaacgcugaucagacacacuucugccuguccgacacccauugccuugaaaauuacgagaccgugggcgaagagaucaucgacgccauuaaaaagagcaaauguugggagacagaauuuacggaguacauccaguucaagcagucugaugggguccgcuccugccggaugaaagacagcggcgaauguaccguggcuacaaacagauggcccauuauccugugcgauaauaacaaguuuuauuacuccgagcuccaagaagacuaugauaaggaccaggauauuggacacuucugucugucuccucgcugcaauaccauccggcaucccauuaacagaaaacacaucagcaauuguacauggcagguuucccauaacaauaucgacaagauugaggugcacgagcuggaagaucuugagcaguacaaaaaggccaucacccaaaaacuccagacgucucugacacuguuuaaguauagcaagaccaaaaaccucccgcacauuaagccuauguacaaauauaucaccauugaaggcacagagaccgccgaagggaucgaguccgcuuacaucgagucugaaauucccgcgcuggccggaacaagcaucggcuucaagauuacguccaaaagcgggaagcaucuucuggacgucaucggauacgugaaaucugcuuccuauagcgccguuuacaccaagcucuauacaaccggcccuacaauuggggugaauaccaagcacgaugagcugugcacgggccccuguccugucaacgugccccauggaaccggcuggcugacauuugccaaagaacgcaccucuuccugggggugcgaggaguucggaugucuugcuaucagcgacggcugcguuuucgggucuugccaggauaucauuaaggacgaaaucacaguguaccggaaagagaccgaagagacaaccgacgucgaacucugucugacguuugccgauaagacauauugcaccaaccugaaugcgauuaccccgaucauuacagaccaauucgaggugcaguuuaaaaccguggaggcuuacucccucccuagaaucauugccguccggaaccacgaaaucaugguuggacagaucaaugauauuggcguguauagcaagggguguggcaacgugcagaaggucaauaacacgaauuacggaaacggcgugcccaaauucgacuaccugugccaucuugccucccgcaaggagguuaucgugagaaaauguuuugauaaugacuaucaggcuugcaaguuccugcaaacacccgccagcuaccggcucgaagaggaagggggaucugucaccgugauugauuauaaaaagauccugggcacaauuaagaugaaagcgauccugggggacguuaaguacaaaaccuuugcugauaacguggaccuuacagucgagggaguguguaccggcugcaucaauuguuucgagaacauucacugcgaacugacgauccacagcaccguugaggccuccuguccuguggucucuagcugcacaguguuucaugaucgcauucucaucaccccgaaugaacacaaguaugccauuaaagugaucugcaacgagaagcccgggccuauccugcccuucaagauuuguuccgcuaaaacagacgccgcuaugacccucgccgacgcgaagccuauccuggaacuugcccccgucgaucagacgacauacauuaaagagaaggacgagagaugcaaaaccuggaugugucggguuagagaugaaggcuuucaggugaucuucgagccuuucaagaaucuguuuggaucuuauauuggcaucuucuacacauuuauuaucagccucauggcuaucuucauugugaucuacauuguccugcccaucugcuuuaagauucgcgacacccugagacaacaugaagaugccuauaaacgggagaugaagauccgcuga

SEQ ID NO: 14262 - RNA, 4323 nt, Artificial Sequence
  derived and/or modified CDS sequence (opt5) from TAHV(1014)__GQ386833.1__GP
augauguucgugcuguuuuucaucgcccucagcgcugccucccccgucuaccagagaugcuuucaagacggcgcgauuguuaagcagaacccuucuaaacaggcugugaccgaggugugucugaaggaugacgucagcaugaucaaaacagaagcccgguauuuccgcaaugccacggggaccuacgcuaacaauguggccauuagaaaguggcuuguuuccgauuggcacgacugccggccgaaaaaggugucuggaggccauaucaacgucauugaggugggggaugaccugacacuccacaccgaggcuuauguuuguaaugccgauugcacaaucggaguggacaaggaaaccgcgcagguccgccugcaaacagauaccacgaaccauuuugaaaucgccggcaccacagugaaaagcgggugguucaaguccaccacauacauuacccuugaccagacgugugagcaccugaaagugucuugcggacccaagagcauccaguuucaugcuuguuucaaucagcacauguccugcgucagauuucuccaccggacaauucugccuggcagcaucgccucuuccauuugucaaaacguugagaucauuauccugaccgugcucacacugcuuaucuucauucugcucagcauccugucuaaaaccuauauuugcuacauccuuaugcccauuuuuaucccucuggcuuauaucuacggcgugauuuacaauaaguccuguaagaaaugcaagcucugcgggcuggucuaucaucccuucaccgaauguggaacacacugcguguguggcgcccgcuacgagacgagcgauagaaugaaacugcaucgggcgucugggcucugcccuggauauaagucccugcgcgccgcuagaguuauguguaaaagcaagggcccggccuccauccuuucuauuaucaccgcugugcugauucucacauuugucacccccaucaacgccaugguggccggggacacacaggaaaccuucaaacuggaggaucuuccugacgacaugcugagcauggcuaugaagguuaauauguacuauaucaugugcaugauuaacuacgcggugacgugguccuucauccucugugcccugcugauugcucuccuguuuaagaaauaucagcaccgguuccuuaauuuuuacgccauguacugccacgagugugauauguaucaugaccgcagcggacugaaguacaacggcgauuucacaaauaaaugcagacaguguaccugcggcaaguaugaagacgccgcugggcuccugacccaccggaaaacauacaacugccuuguccaauauaagucuaaguggcugaccaacuuucucaucguguacauuauccugaugcugauuaaagauuccguccucaucgugcaugccgacggaacagauuucgagaaguguagcggcgaagcggacaucacguggaauugcaccgggcccuuucugaaccuuggaaauugugagaaaaagcagaaaaaggaaucuuauaacaauauugcuacacagcugaagggccucgaugccaucagcguucuggacauuccuaugaucuccaaaauucccgaggauaucgccggggcucugcgcuucaucgaggaacaaagaucuuaccacgugcagcuuaccgccgaguacgcuaugcucacacgguauugcgacuacuauacccaguuuacggacaacagcggauacucccagaccacauggagagucuaucugcgcagccaugauuucgaagccuguauucuguacccgaaucaacacuuuugccggugugugaagcacggcgacaaauguucuuccagcaacugggauuucgcgaaugagaugaagaacuauuacucuggcaaacaguccaaguuugacaaggaucucaaucuggcccuuaugagccugcaucacgcuuucagagggaccuccucuuucuacaucgccaaacuccugcgcgaaaagaaaaacgaggaccugguuacauauguggagaagauuaaaggaaaguacccuggcaaugcccuucucaaagcuaucauugauuauaucaaguacaugaaggggcugaccgaaaugaacaauagcaaacaugacgagaugugggaugacuuuaucuucgaagugcccccuacgaagucccccucugugcggagacuggagagcuccuaugauuuuaaaacaaacgugaacagcaaucccucucacauuugcaagaacaucaaaaccguugucugccucuccccuaagagcggagugucuuacgacuccauuaucgcguguggcgaaccgagccagcccucuauuuaucgcaagccugauagccagguguuccaauccaaugccgaccagacacacuuuugccugagcgacacccauugccuugagaacuucgagaccgucggggaagagaucaucgaugcuauuaaaaagucuaaauguugggaaacagaguuuacggaguacauccaguucaagcaguccgacggcgugcggagcugcagaaugaaagauuccggagaauguaccguuacaaccaaucgcuggcccauuauccugugcgacaacgauaaguuuuacuauucugagcuccaaaaggacuacgauaaaggccaggacauugggcacuucugucugagcccucggugcaauacaaucagacaucccauuaaccgcaagcacaucuccaauuguaccuggcaggucaaccauaauaacaucgauaaaauugaaguccacgagcuggaagaccuugagcaguauaagaaagccaucacgcaaaagcuccagacaucucugacccuguuuaaguacagcaaaaccaagaaucucccgcacauuaaaccuauguauaaguacaucacaauugagggaaccgaaacagcugagggcaucgaauccgccuauaucgagucugaaauucccgcccuggcugggacgagcaucggauucaaaauuaccuccaagagcggcaaacaucuucuggaugugaucggguacguuaagucugcguccuacagcgccguguauacaaagcucuacaccacaggcccuaccauuggagucaacacgaaacacgacgagcugugcaccggccccuguccugugaauguuccccaugggacaggauggcugaccuuugcuaaggagcggacaucuuccuggggcugcgaagaguucgggugucuugccaucagcgauggaugcguguucggcucuugccaggacaucauuaaagacgaaaucaccgucuauagaaaggagacagaagagaccacggauguggagcucugucugacauuugccgacaaaaccuacugcaccaaccugaacgcuauuacaccgaucauuaccgaucaauucgaagugcaguuuaagacggucgaggccuauucccucccucggaucauugcgguucgcaaucacgaaaucaugguggggcagaucaacgacauuggcguguacagcaagggauguggcaauguccagaaagugaacaauacaaacuaugggaauggaguucccaaguucgauuaccugugccaucuugcuuccagaaaagaggugaucguccggaaguguauugacaacgauuaccaagccugcaaauuucugcagacccccgccagcuauagacucgaggaagagggcgggucugugacaguuaucgacuacaagaagauucugggaaccaucaaaaugaaggcuauccugggcgaugugaaauauaagacauucgccgacaaugucgaucuuaccguggaagggguuuguacgggcugcauuaacuguuuugagaauauccacugcgaacugaccauucacagcacaguggaggcguccuguccugucgugucuagcugcaccguguuccaugaccgcauccucauuacaccgaacgagcacaaauacgcuaucaaggucaucugcaaugaaaagcccggaccuacccugcccuuuaaaauuuguuccgccaagacggacgccgcuaugacacucgccgaugcuaaaccuauccuggagcuugcccccguugaccagaccacauauauuaaggaaaaagaugagcggugcaagaccuggauguguagagugcgcgacgaaggcuuccaggugaucuuugagccuuucaagaaccuguucgggucuuacauuggaaucuuuuauaccuucauuaucagccucauggcgaucuuuauugucaucuacauugugcugcccaucugcuucaaacugagagauacacuucggcaacaugaggacgccuacaagcgcgaaaugaaaauuagauga

SEQ ID NO: 14263 - RNA, 4323 nt, Artificial Sequence
  derived and/or modified CDS sequence (opt5) from TAHV(105)__GQ386829.1__GP
augauguucgugcuguuuuucaucgcccucagcgcugccucccccgucuaccagagaugcuuucaagacggcgcgauuguuaagcagaacccuucuaaacaggcugugaccgaggugugucugaaggaugacgucagcaugaucaaaacagaagcccgguauuuccgcaaugccacggggaccuacgcuaacaauguggccauuagaaaguggcuuguuuccgauuggcacgacugccggccgaaaaaggugucuggaggccauaucaacgucauugaggugggggaugaccugacacuccacaccgaggcuuauguuuguaaugccgauugcacaaucggaguggacaaggagaccgcgcagguccgccugcaaacagauaccacgaaccauuuugaaaucgccggcaccacagugaaaagcgggugguucaaguccaccacauacauuacccuugaccagacgugugagcaccugaaagugucuugcggacccaagagcauccaguuucaugcuuguuucaaucagcacauguccugcgucagauuucuccaccggacaauucugccuggcagcaucgccucuuccauuugucaaaacguugagaucauuauccugaccgugcucacacugcuuaucuucauucugcucagcauccugucuaaaaccuauauuugcuacauccuuaugcccauuuuuaucccucuggcuuauaucuacggcgugauuuacaauaaguccuguaagaaaugcaagcucugcgggcuggucuaucaucccuucaccgaauguggaacacacugcguguguggcgcccgcuacgagacgagcgauagaaugaaacugcaucgggcgucugggcucugcccuggauauaagucccugcgcgccgcuagaguuauguguaaaagcaagggcccggccuccauccuuucuauuaucaccgcugugcugauucucacauuugucacccccaucaacgccaugguggccggggacacacaggaaaccuucaaacuggaggaucuuccugacgacaugcugagcauggcuaugaagguuaauauguacuauaucaugugcaugauuaacuacgcggugacgugguccuucauccucugugcccugcugauugcucuccuguuuaagaaauaucagcaccgguuccuuaauuuuuacgccauguacugccacgagugugauauguaucaugaccgcagcggacugaaguacaacggcgauuucacaaauaaaugcagacaguguaccugcggccaauaugaagacgccgcugggcuccugacccaccggaagacauacaacugccuuguccaguauaaaucuaaguggcugaccaacuuucucaucguguacauuauccugaugcugauuaaggauuccguccucaucgugcaugccgacggaacagauuucgagaaauguagcggcgaagcggacaucacguggaauugcaccgggcccuuucugaaccuuggaaauugugagaagaaacagaagaaagaaucuuauaacaauauugcuacacaacugaagggccucgaugccaucagcguucuggacauuccuaugaucuccaagauucccgaggauaucgccggggcucugcgcuucaucgaggaacagagaucuuaccacgugcagcuuaccgccgaguacgcuaugcucacacgguauugcgacuacuauacccaguuuacggacaacagcggauacucccaaaccacauggagagucuaucugcgcagccaugauuucgaagccuguauucuguacccgaaucagcacuuuugccggugugugaaacacggcgacaagugcagcuccagcaacugggauuucgcgaaugagaugaaaaacuauuacucuggcaagcaguccaaauuugacaaggaucucaaucuggcccuuaugagccugcaucacgcuuucagagggaccuccucuuucuacaucgccaagcuccugaaagaaaagaaaaacgaggaccugguuacauaugcugagaagauuaaaggaaaguacccuggcaaugcccuucucaaagcgaucauugauuauaucaaguacaugaaggaccugaccgaaaugaacaauuuuaaacaugaugagaugugggacgauuucaucuuugaagugcccccuacgaagucucccuccguccgccggcuggagucuagcuaugacuucaaaacaaacgugaacuccaaucccagccacauuuguaagaacaucaaaaccgugguuugccucucuccuaaguccggggucagcuacgauucuauuaucgccuguggagaaccgucccagcccagcauuuauagaaagccugacucucaaguguuucagagcaaugcugaccagacacacuucugccuguccgauacccauugccuugagaacuacgagaccgugggcgaagagaucaucgacgccauuaaaaagagcaaauguugggaaacagaguuuacggaguacauccaguucaagcaaucugaugggguccgcuccugccggaugaaagacagcggcgaauguaccgugacaaccaauagauggcccauuauccugugcgauaacgacaaguuuuauuacuccgagcuccagaaggauuaugacaaagaucaggacauuggacacuucugucugucuccucgcugcaauacaauccggcaucccauuaacagaaagcacaucagcaauuguaccuggcagguuucccauaacaauaucgauaaaauugaagugcacgagcuggaagaccuugagcaauacaagaaagcuaucacgcagaagcuccagacaucucugacccuguuuaaguauagcaaaaccaagaaccucccgcacauuaaaccuauguacaaguauaucacaauugagggcaccgaaacagccgaggggaucgaauccgccuacaucgagucugaaauucccgcucuggcgggaacgagcaucggcuucaaaauuaccuccaagagcgggaaacaucuucuggaugucaucggauacgugaagucugccuccuauagcgcuguuuacacaaagcucuauaccacaggcccuaccauuggggugaauacgaaacacgacgagcugugcaccggccccuguccugucaacgugccccauggaacaggcuggcugaccuuugccaaggagcgcacaucuuccugggggugcgaagaguucggaugucuugccaucagcgacggcugcguuuucgggucuugccaagauaucauuaaagacgaaaucaccguguaccggaaggagacagaagagaccacggaugucgagcucugucugacauuugcugacaaaaccuauugcaccaaucugaacgccauuacaccgaucauuaccgaucaguucgaagugcaguuuaagacgguggaggcguacucccucccuagaaucauugcuguccggaaccacgaaaucaugguuggacagaucaaugacauuggcguguauagcaagggguguggcaacgugcaaaaagucaauaacacaaauuacggaaacggcgugcccaaguucgauuaccugugccaucuugccucccgcaaagagguuaucgugagaaaguguuuugacaaugauuaucaggccugcaaauuccugcagacccccgcuagcuaccggcucgaggaagaagggggaucugucacagugauugacuauaagaagauccugggcaccauuaaaaugaaggccauccugggggauguuaaauacaagacauuugcggacaacguggaccuuaccgucgaaggaguguguacgggcugcaucaauuguuucgagaacauucacugcgaacugaccauccacagcacaguugaggcuuccuguccuguggucucuagcugcaccguguuucaugaucgcauucucaucacaccgaaugagcacaaauaugccauuaaggugaucugcaacgaaaagcccgggccuacccugcccuucaaaaucuguuccgccaagacggacgcugccaugacacucgcugaugccaaaccuauucuggagcuugcgcccgucgaccagaccacauacaucaaggaaaaagaugagagaugcaagaccuggaugugucggguuagagacgaaggcuuucaagugauuuucgagccuuucaagaaucuguuuggaucuuauaucggcauuuucuacaccuuuaucauuagccucauggccaucuucaucgugauuuacaucguccugcccauuugcuuuaaacugcgcgauacacuuagacagcaugaggacgcuuauaagcgggaaaugaaaauccgcuga

SEQ ID NO: 14264 - RNA, 4323 nt, Artificial Sequence
  derived and/or modified CDS sequence (opt5) from TAHV(106)__GQ386830.1__GP
augauguucgugcuguuuuucaucgcccucagcgcugccucccccgucuaccagagaugcuuucaagacggcgcgauuguuaagcagaacccuucuaaacaggcugugaccgaggugugucugaaggaugacgucagcaugaucaaaacagaagcccgguauuuccgcaaugccacggggaccuacgcuaacaauguggccauuagaaaguggcuuguuuccgauuggcacgacugccggccgaaaaaggugucuggaggccauaucaacgucauugaggugggggaugaccugacacuccacaccgaggcuuauguuuguaaugccgauugcacaaucggaguggacaaggagaccgcgcagguccgccugcaaacagauaccacgaaccauuuugaaaucgccggcaccacagugaaaagcgggugguucaaguccaccacauacauuacccuugaccagacgugugagcaccugaaagugucuugcggacccaagagcauccaguuucaugcuuguuucaaucagcacauguccugcgucagauuucuccaccggacaauucugccuggcagcaucgccucuuccauuugucaaaacguugagaucauuauccugaccgugcucacacugcuuaucuucauucugcucagcauccugucuaaaaccuauauuugcuacauccuuaugcccauuuuuaucccucuggcuuauaucuacggcgugauuuacaauaaguccuguaagaaaugcaagcucugcgggcuggucuaucaucccuucaccgaauguggaacacacugcguguguggcgcccgcuacgagacgagcgauagaaugaaacugcaucgggcgucugggcucugcccuggauauaagucccugcgcgccgcuagaguuauguguaaaagcaagggcccggccuccauccuuucuauuaucaccgcugugcugauucucacauuugucacccccaucaacgccaugguggccggggacacacaggaaaccuucaaacuggaggaucuuccugacgacaugcugagcauggcuaugaagguuaauauguacuauaucaugugcaugauuaacuacgcggugacgugguccuucauccucugugcccugcugauugcucuccuguuuaagaaauaucagcaccgguuccuuaauuuuuacgccauguacugccacgagugugauauguaucaugaccgcagcggacugaaguacaacggcgauuucacaaauaaaugcagacaguguaccugcggccaauaugaagacgccgcugggcuccugacccaccggaagacauacaacugccuuguccaguauaaaucuaaguggcugaccaacuuucucaucguguacauuauccugaugcugauuaaggauuccguccucaucgugcaugccgacggaacagauuucgagaaauguagcggcgaagcggacaucacguggaauugcaccgggcccuuucugaaccuuggaaauugugagaagaaacagaagaaagaaucuuauaacaauauugcuacacaacugaagggccucgaugccaucagcguucuggacauuccuaugaucuccaagauucccgaggauaucgccggggcucugcgcuucaucgaggaacagagaucuuaccacgugcagcuuaccgccgaguacgcuaugcucacacgguauugcgacuacuauacccaguuuacggacaacagcggauacucccaaaccacauggagagucuaucugcgcagccaugauuucgaagccuguauucuguacccgaaucagcacuuuugccggugugugaaacacggcgacaaguguucuuccagcaacugggauuucgcgaaugagaugaaaaacuauuacucuggcaagcaguccaaauuugacaaggaucucaaucuggcccuuaugagccugcaucacgcuuucagagggaccuccucuuucuacaucgccaagcuccugaaagaaaagaaaaacgaggaccugguuacauaugcugagaagauuaaaggaaaguacccuggcaaugcccuucucaaagcgaucauugauuauaucaaguacaugaaggggcugaccgaaaugaacaauuuuaaacaugacgagaugugggaugacuucaucagcgaagugcccccuacgaagucccccucuguccgccggcuggagagcuccuaugauuuuaaaacaaacgugaacagcaaucccucucacauuugcaagaacaucaaaaccgugguuugccucuccccuaagagcggagucucuuacgacuccauuaucgccuguggcgaaccgagccagcccucuauuuauagaaagccugauagccaaguguuccaguccaaugcugaccagacacacuuuugccugagcgacacccauugccuugagaacuacgagaccgugggggaagagaucaucgaugccauuaaaaagucuaaauguugggaaacagaguucacggaguacauccaguuuaagcaauccgacggcguccgcagcugccggaugaaagauuccggagaauguaccgugacaaccaauagauggcccauuauccugugcgacaacgauaaguucuauuacucugagcuccagaaggacuaugauaaagaccaggauauuggccacuuuugucugagcccucgcugcaauacaauccggcaucccauuaacagaaagcacaucuccaauuguaccuggcagguuucucauaacaauaucgacaaaauugaagugcacgagcuggaagaucuugagcaauacaagaaagcuaucacgcagaagcuccagacaagccugacccuguucaaguauuccaaaaccaagaaccucccgcacauuaaaccuauguacaaguauaucacaauugaggggaccgaaacagccgagggaaucgaaucugccuacaucgagagcgaaauucccgcucuggcgggcacguccaucggguuuaaaauuaccagcaagucuggaaaacaucuucuggacgucaucggcuacgugaaguccgccagcuauucugcuguuuacacaaagcucuauaccacagggccuaccauugaugugaauacgaaacacgacgagcugugcaccggccccuguccugucaacgugccccauggaacaggcuggcugaccuucgccaaggagcgcacauccagcugggggugcgaagaguuuggaugucuugccaucucugacggcugcguuuucggguccugccaagauaucauuaaagacgaaaucaccguguaccggaaggagacagaagagaccacggaugucgagcucugucugacauucgcugacaaaaccuauugcaccaaucugaacgccauuacaccgaucauuaccgaucaguuugaagugcaguucaagacgguggaggcguacagccucccuagaaucauugcuguccggaaccacgaaaucaugguuggacagaucaaugacauuggcguguauuccaagggguguggcaacgugcaaaaagucaauaacacaaauuacggaaacggcgugcccaaguuugauuaccugugccaucuugccagccgcaaagagguuaucgugagaaaguguuucgacaaugauuaucaggccugcaaauuucugcagacccccgcuucuuaccggcucgaggaagaagggggaagcgucacagugauugacuauaagaagauccugggcaccauuaaaaugaaggccauccugggggauguuaaauacaagacauucgcggacaacguggaccuuaccgucgaaggaguguguacgggcugcaucaauuguuuugagaacauucacugcgaacugaccauccacuccacaguugaggcuucuuguccuguggucagcuccugcaccguguuccaugaucgcauucucaucacaccgaaugagcacaaauaugccauuaaggugaucugcaacgaaaagcccgggccuacccugcccuuuaaaaucuguucugccaagacggacgcugccaugacacucgcugaugccaaaccuauucuggagcuugcgcccgucgaccagaccacauacaucaaggaaaaagaugagagaugcaagaccuggaugugucggguuagagacgaaggcuuccaagugauuuuugagccuuucaagaaucuguucggaagcuauaucggcaucuuuuacaccuucauuauuucccucauggccaucuuuaucgugauuuacaucguccugcccauuugcuucaaacugcgcgauacacuuagacagcaugaggacgcuuauaagcgggaaaugaaaauccgcuga

SEQ ID NO: 14265 - RNA, 4323 nt, Artificial Sequence
  derived and/or modified CDS sequence (opt5) from TAHV(181)__GQ386831.1__GP
augauguucgugcuguuuuucaucgcccucagcgcugccucccccgucuaccagagaugcuuucaagacggcgcgauuguuaagcagaacccuucuaaacaggcugugaccgaggugugucugaaggaugacgucagcaugaucaaaacagaagcccgguauuuccgcaaugccacggggaccuacgcuaacaauguggccauuagaaaguggcuuguuuccgauuggcacgacugccggccgaaaaaggugucuggaggccauaucaacgucauugaggugggggaugaccugacacuccacaccgaggcuuauguuuguaaugccgauugcacaaucggaguggacaaggaaaccgcgcagguccgccugcaaacagauaccacgaaccauuuugaaaucgccggcaccacagugaaaagcgggugguucaaguccaccacauacauuacccuugaccagacgugugagcaccugaaagugucuugcggacccaagagcauccaguuucaugcuuguuucaaucagcacauguccugcgucagauuucuccaccggacaauucugccuggcagcaucgccucuuccauuugucaaaacguugagaucauuauccugaccgugcucacacugcuuaucuucauucugcucagcauccugucuaaaaccuauauuugcuacauccuuaugcccauuuuuaucccucuggcuuauaucuacggcgugauuuacaauaaguccuguaagaaaugcaagcucugcgggcuggucuaucaucccuucaccgaauguggaacacacugcguguguggcgcccgcuacgagacgagcgauagaaugaaacugcaucgggcgucugggcucugcccuggauauaagucccugcgcgccgcuagaguuauguguaaaagcaagggcccggccuccauccuuucuauuaucaccgcugugcugauucucacauuugucacccccaucaacgccaugguggccggggacacacaggaaaccuucaaacuggaggaucuuccugacgacaugcugagcauggcuaugaagguuaauauguacuauaucaugugcaugauuaacuacgcggugacgugguccuucauccucugugcccugcugauugcucuccuguuuaagaaauaucagcaccgguuccuuaauuuuuacgccauguacugccacgagugugauauguaucaugaccgcagcggacugaaguacaacggcgauuucacaaauaaaugcagacaguguaccugcggccaauauggggacgccgcuggacuccugacccaccggaagacauacaacugccuuguccaguauaaaucuaaguggcugaccaacuuucucaucggcuacauuauccugaugcugauuaaggauuccgugcucaucguccaugccgacgggacagauuucgaaaaauguagcggagaggcggacaucacguggaauugcaccggccccuuucugaaccuugggaauugugaaaagaaacagaagaaagagucuuauaacaauauugcuacacaacugaagggacucgaugccaucagcgugcuggacauuccuaugaucuccaagauucccgaagauaucgccggcgcucugcgcuucaucgaggagcagagaucuuaccacguucagcuuaccgccgaauacgcuaugcucacacgguauugcgacuacuauacccaguuuacggacaacagcggcuacucccaaaccacauggagaguguaucugcgcagccaugauuucgaggccuguauucuguacccgaaucggcacuuuugcagaugugucaaacacggggacaagugcagcuccagcaacugggauuucgcgaaugaaaugaaaaacuauuacucuggaaagcaguccaaauuugacaaggaucucaaucuggcccuuaugagccugcaucacgcuuuccgcggcaccuccucuuucuacaucgccaagcuccugaaagagaagaaaaacgaagaccuggugacauaugcugagaagauuaaagggaaguacccuggaaaugcccuucucaaagcgaucauugauuauaucaaguacaugaagggccugaccgagaugaacaauuuuaaacaugacgaaaugugggaugacuucaucuuugagguucccccuacgaagucucccuccgugcggagacuggaaucuagcuaugauuucaaaacaaacgucaacuccaaucccagccacauuuguaagaacaucaaaaccguggugugccucucuccuaaguccgggguuagcuacgacucuauuaucgccuguggcgagccgucccagcccagcauuuaucgcaagccugauucucaggucuuucaaagcaaugcugaccagacacacuucugccuguccgacacccauugccuugaaaacuacgagaccgugggagaggaaaucaucgaugccauuaaaaagagcaaauguugggagacagaauuuacggaguacauccaguucaagcagucugacggcgugcgguccugcagaaugaaagauagcggggaguguaccgucacaaccaaucgcuggcccauuauccugugcgacaacgauaaguuuuauuacuccgaacuccaaaaggacuaugauaaagaccaggauauuggacacuucugucugucuccucggugcaauacaaucagacaucccauuaaccgcaagcacaucagcaauuguaccuggcaagugaaccauaauaacaucgacaaaauugagguucacgaacuggaggaucuugaacaguacaagaaagcuaucacgcagaagcuccagacaucccugacccuguuuaaguauucuaaaaccaagaaucucccgcacauuaaaccuauguacaaguauaucacaauugagggcaccgagacagccgaagggaucgagagcgccuacaucgaauccgagauucccgcucuggcgggaacgucuaucggcuucaaaauuaccagcaaguccgggaaacaucuucuggacgugaucggcuacgucaagagcgccucuuauuccgcuguguacacaaagcucuauaccacaggaccuaccauuggcguuaacacgaaacacgaugaacugugcaccgggcccuguccugugaaugucccccauggaacaggcuggcugaccuuugccaaggagcggacaagcucuugggggugcgaggaguucggaugucuugccaucuccgacggcugcguguucgggagcugccaggacaucauuaaagaugaaaucaccguuuacagaaaggaaacagaggaaaccacggacguggagcucugucugacauuugcugauaaaaccuauugcaccaaccugaacgccauuacaccgaucauuaccgaccaauucgagguccaguuuaagacgguggaagcguacucucucccucggaucauugcugugcgcaaucacgagaucauggucggccagaucaacgauauuggaguuuauuccaagggcugugggaaugugcagaaagugaacaauacaaacuacggaaauggcguccccaaguucgacuaccugugccaucuugccagcagaaaagaagugaucguucggaaguguuuugauaacgacuaucaagccugcaaauuccugcagacccccgcuuccuacagacucgaggaggaagggggaagcgugacagucauugauuauaagaagauccugggcaccauuaaaaugaaggccauccugggggacgugaaauacaagacauuugcggauaauguugaccuuaccguggagggcgucuguacgggaugcaucaacuguuucgaaaauauucacugcgagcugaccauccacucuacaguggaagcuagcuguccuguuguguccucuugcaccgucuuucaugaccgcauucucaucacaccgaacgagcacaaauaugccauuaaggugaucugcaaugagaagcccggcccuacccugcccuucaaaaucuguagcgccaagacggaugcugccaugacacucgcugacgccaaaccuauucuggaacuugcgcccguggaucagaccacauacaucaaggagaaagacgaacggugcaagaccuggauguguagaguccgcgaugagggguuucagguuauuuucgaaccuuucaagaaccuguuuggauccuauaucggcauuuucuacaccuuuaucauuucucucauggccaucuucaucgugauuuacaucgugcugcccauuugcuuuaaacugagagacacacuucggcaacaugaggaugcuuauaagcgcgagaugaaaaucagauga

SEQ ID NO: 14266 - RNA, 4323 nt, Artificial Sequence
  derived and/or modified CDS sequence (opt5) from TAHV(236)__GQ386832.1__GP
augauguucgugcuguuuuucaucgcccucagcgcugccucccccgucuaccagagaugcuuucaagacggcgcgauuguuaagcagaacccuucuaaacaggcugugaccgaggugugucugaaggaugacgucagcaugaucaaaacagaagcccgguauuuccgcaaugccacggggaccuacgcuaacaauguggccauuagaaaguggcuuguuuccgauuggcacgacugccggccgaaaaaggugucuggaggccauaucaacgucauugaggugggggaugaccugacacuccacaccgaggcuuauguuuguaaugccgauugcacaaucggaguggacaaggaaaccgcgcagguccgccugcaaacagauaccacgaaccauuuugaaaucgccggcaccacagugaaaagcgggugguucaaguccaccacauacauuacccuugaccagacgugugagcaccugaaagugucuugcggacccaagagcauccaguuucaugcuuguuucaaucagcacauguccugcgucagauuucuccaccggacaauucugccuggcagcaucgccucuuccauuugucaaaacguugagaucauuauccugaccgugcucacacugcuuaucuucauucugcucagcauccugucuaaaaccuauauuugcuacauccuuaugcccauuuuuaucccucuggcuuauaucuacggcgugauuuacaauaaguccuguaagaaaugcaagcucugcgggcuggucuaucaucccuucaccgaauguggaacacacugcguguguggcgcccgcuacgagacgagcgauagaaugaaacugcaucgggcgucugggcucugcccuggauauaagucccugcgcgccgcuagaguuauguguaaaagcaagggcccggccuccauccuuucuauuaucaccgcugugcugauucucacauuugucacccccaucaacgccaugguggccggggacacacaggaaaccuucaaacuggaggaucuuccugacgacaugcugagcauggcuaugaagguuaauauguacuauaucaugugcaugauuaacuacgcgaucacgugguccuucauucucugugcccugcugaucgcucuccuguuuaagaaauaucagcaccgguuccuuaauuuuuacgccauguacugccacgagugugauauguaucaugaccgcagcggacugaaguacaacggcgauuucacaaauaaaugcagacaguguaccugcggccaauaugaagacgccgcugggcuccugacccaccggaagacauacaacugccuugugcaguauaaaucuaaguggcugaccaacuuucucauugucuacaucauucugaugcugaucaaggauuccgugcucaucguccaugccgacggaacagauuucgagaaauguagcggcgaagcggacauuacguggaauugcaccgggcccuuucugaaccuuggaaauugugagaagaaacagaagaaagaaucuuauaacaauaucgcuacacaacugaagggccucgaugccauuagcgugcuggacaugccuaugaucuccaagauucccgaggauaucgccggggcucugcgcuucaucgaggaacagagaucuuaccacguucagcuuaccgccgaguacgcuaugcucacacgguauugcgacuacuauacccaguuuacggacaacagcggauacucccaaaccacauggagaguguaucugcgcagccaugauuucgaagccuguauucuguacccgaaucagcacuuuugccggugugucaaacacggcgacaagugcagcuccagcaacugggauuucgcgaaugagaugaaaaacuauuacucuggcaagcaguccaaauuugacaaggaucucaaucuggcccuuaugagccugcaucacgcuuucagagggaccuccucuuucuacaucgccaagcuccugaaagaaaagaaaaacgaggaccuggugacauaugcugagaagauuaaaggaaaguacccuggcaaugcccuucucaaagcgaucauugauuauaucaaguacaugaaggaccugaccgaaaugaacaauuuuaaacaugaugagaugugggacgauuucaucuuugaaguucccccuacgaagucucccuccgugcgccggcuggagucuagcuaugacuucaaaacaaacgucaacuccaaucccagccacauuuguaagaacaucaaaaccgugauuugccucucuccuaaguccggggugagcuacgauucuaucauugccuguggagaaccgucccagcccagcaucuauagaaagccugacucucaaguuuuucagagcaaugcugaccagacacacuucugccuguccgauacccauugccuugagaacuacgagaccgucggcgaagagaucauugacgccaucaaaaagagcaaauguugggaaacagagcugacggaguacauucaguuuaagcaaucugauggggugcgcuccugccggaugaaagacagcggcgaauguaccgugacaaccaauagauggcccaucauucucugcgauaacgacaaguucuauuacuccgagcugcagaaggauuaugacaaagaucaggacaucggacacuuuugucugucuccucgcugcaauacaauucggcaucccaucaacagaaagcacaucagcaauuguaccuggcaggucucccauaacaauauugauaaaaucgaagugcacgagcuugaagaccucgagcaauacaagaaagcuauuacgcagaagcugcagacaucucugacccucuucaaguauagcaaaaccaagaaccugccgcacaucaaaccuauguacaaguauauuacaaucgagggcaccgaaacagccgaggggaucgaauccgccuacauugagucugaaauccccgcucuugcgggaacgagcauuggcuuuaaaaucaccuccaagagcgggaaacaucugcucgauguuauuggauacgugaagucugccuccuauagcgcugucuacacaaagcuguauaccacaggcccuaccaucggggugaauacgaaacacgacgagcugugcaccggccccuguccuguuaacgugccccauggaacaggcuggcuuaccuucgccaaggagcgcacaucuuccugggggugcgaagaguuuggaugucucgccaucagcgacggcugcgucuucgggucuugccaagauauuaucaaagacgaaauuaccguguaccggaaggagacagaagagaccacggauguugagcugugucugacauucgcugacaaaaccuauugcaccaaucucaacgccaucacaccgauuaucaccgaucaguuugaagugcaguucaagacggucgaggcguacucccugccuagaauuaucgcugugcggaaccacgaaaucauggugggacagauuaaugacaucggcgucuauagcaagggguguggcaacguucaaaaagugaauaacacaaauuacggaaacggcgugcccaaguuugauuaccuuugccaucuggccucccgcaaagaggucauugugagaaaguguuucgacaaugauuaucaggccugcaaauuucuccagacccccgcuagcuaccggcuggaggaagaggggucuagcguuacagugaucgacuauaagaagauucugggaaccaucaaaaugaaggccauccuuggcgaugucaaauacaagacauucgcggacaacguggaccugaccguugaagggguguguacgggaugcauuaauuguuuugagaacauccacugcgaacucaccauucacuccacagucgaggcuucuuguccugugguuagcuccugcaccguguuccaugauagaauccugauuacaccgaaugagcacaaauaugccaucaaggucaucugcaacgaaaagcccggcccuacccuccccuuuaaaauuuguucugccaagacggacgcugccaugacacuggcugaugccaaaccuauccuugagcuggcgcccguggaccagaccacauacauuaaggaaaaagaugagcgcugcaagaccuggaugugucgggugagagacgaaggguuccaagucaucuuugagccuuucaagaaucucuucggcagcuauauuggaaucuuuuacaccuucauuaucucccugauggccaucuuuauuguuaucuacauugugcugcccaucugcuucaaacuucgcgaugcucugagacagcaugaggacgccuauaagcgggaaaugaaaauucgcuga

SEQ ID NO: 14267 - RNA, 4323 nt, Artificial Sequence
  derived and/or modified CDS sequence (opt5) from TAHV(29)__GQ386823.1__GP
augauguucgugcuguuuuucaucgcccucagcgcugccucccccgucuaccagagaugcuuucaagacggcgcgauuguuaagcagaacccuucuaaacaggcugugaccgaggugugucugaaggaugacgucagcaugaucaaaacagaagcccgguauuuccgcaaugccacggggaccuacgcuaacaauguggccauuagaaaguggcuuguuuccgauuggcacgacugccggccgaaaaaggugucuggaggccauaucaacgucauugaggugggggaugaccugacacuccacaccgaggcuuauguuuguaaugccgauugcacaaucggaguggacaaggagaccgcgcagguccgccugcaaacagauaccacgaaccauuuugaaaucgccggcaccacagugaaaagcgggugguucaaguccaccacauacauuacccuugaccagacgugugagcaccugaaagugucuugcggacccaagagcauccaguuucaugcuuguuucaaucagcacauguccugcgucagauuucuccaccggacaauucugccuggcagcaucgccucuuccauuugucaaaacguugagaucauuauccugaccgugcucacacugcuuaucuucauucugcucagcauccugucuaaaaccuauauuugcuacauccuuaugcccauuuuuaucccucuggcuuauaucuacggcgugauuuacaauaaguccuguaagaaaugcaagcucugcgggcuggucuaucaucccuucaccgaauguggaacacacugcguguguggcgcccgcuacgagacgagcgauagaaugaaacugcaucgggcgucugggcucugcccuggauauaagucccugcgcgccgcuagaguuauguguaaaagcaagggcccggccuccauccuuucuauuaucaccgcugugcugauucucacauuugucacccccaucaacgccaugguggccggggacacacaggaaaccuucaaacuggaggaucuuccugacgacaugcugagcauggcuaugaagguuaauauguacuauaucaugugcaugauuaacuacgcggugacgugguccuucauccucugugcccugcugauugcucuccuguuuaagaaauaucagcaccgguuccuuaauuuuuacgccauguacugccacgagugugauauguaucaugaccgcagcggacugaaguacaacggcgauuucacaaauaaaugcagacaguguaccugcggccaauaugaagacgccgcugggcuccugacccaccggaagacauacaacugccuuguccaguauaaaucuaaguggcugaccaacuuucucaucguguacauuauccugaugcugauuaaggauuccguccucaucgugcaugccgacggaacagauuucgagaaauguagcggcgaagcggacaucacguggaauugcaccgggcccuuucugaaccuuggaaauugugagaagaaacagaagaaagaaucuuaugauaacauugcuacacaacugaagggccucgacgccaucagcguucuggauauuccuaugaucuccaagauucccgaggacaucgccggggcucugcgcuucaucgaggaacagagaucuuaccacgugcagcuuaccgccgaguacgcuaugcucacacgguauugcgacuacuauacccaguuuacggauaauagcggauacucccaaaccacauggagagucuaucugcgcagccaugacuucgaagccuguauucuguacccgaaccagcacuuuugccggugugugaaacacggcgauaagugcagcuccagcaauugggacuucgcgaacgagaugaaaaauuauuacucuggcaagcaguccaaauuugauaaggaccucaaccuggcccuuaugagccugcaucacgcuuucagagggaccuccucuuucuacaucgccaagcuccugaaagaaaagaaaaaugaggaucugguuacauaugcugagaagauuaaaggaaaguacccuggcaacgcccuucucaaagcgaucauugacuauaucaaguacaugaaggaucugaccgaaaugaauaacuuuaaacaugacgagaugugggaugacuucaucuuugaagugcccccuacgaagucucccuccguccgccggcuggagucuagcuaugauuucaaaacaaaugugaacuccaaccccagccacauuuguaagaauaucaaaaccgugguuugccucucuccuaaguccggggucagcuacgacucuauuaucgccuguggagaaccgucccagcccagcauuuauagaaagccugacucucaaguguuucagagcaacgcugaucagacacacuucugccuguccgacacccauugccuugagaauuacgagaccgugggcgaagagaucaucgaugccauuaaaaagagcaaauguugggaaacagaguuuacggaguacauccaguucaagcaaucugacgggguccgcuccugccggaugaaagauagcggcgaauguaccgugacaaccaacagauggcccauuauccugugcgacaaugauaaguuuuauuacuccgagcuccagaaggacuaugauaaagaccaggauauuggacacuucugucugucuccucgcugcaacacaauccggcaucccauuaauagaaagcacaucagcaacuguaccuggcagguuucccauaauaacaucgacaaaauugaagugcacgagcuggaagaucuugagcaauacaagaaagcuaucacgcagaagcuccagacaucucugacccuguuuaaguauagcaaaaccaagaaucucccgcacauuaaaccuauguacaaguauaucacaauugagggcaccgaaacagccgaggggaucgaauccgccuacaucgagucugaaauucccgcucuggcgggaacgagcaucggcuucaaaauuaccuccaagagcgggaaacaucuucuggacgucaucggauacgugaagucugccuccuauagcgcuguuuacacaaagcucuauaccacaggcccuaccauuggggugaacacgaaacacgacgagcugugcaccggccccuguccugucaauaugccccauggaacaggcuggcugaccuuugccaaggagcgcacaucuuccugggggugcgaagaguucggaugucuugccaucagcgauggcugcguguucgggucuugccaagacaucauuaaagaugaaaucaccguuuaccggaaggagacagaagagaccacggacguggagcucugucugacauuugcugauaaaaccuauugcaccaaccugaaugccauuacaccgaucauuaccgaccaguucgaaguccaguuuaagacgguggaggcguacucccucccuagaaucauugcugugcggaaccacgaaaucauggucggacagaucaacgauauuggcguuuauagcaagggguguggcaaugugcaaaaagugaacaauacaaacuacggaaauggcguccccaaguucgacuaccugugccaucuugccucccgcaaagaggugaucguuagaaaguguuuugauaacgacuaucaggccugcaaauuccugcagacccccgcuagcuaccggcucgaggaagaagggggaucugugacagucauugauuauaagaagauccugggcaccauuaaaaugaaggccauccugggggacgugaaauacaagacauuugcggacaauguugaucuuaccguggaaggagucuguacgggcugcaucaacuguuucgagaauauucacugcgaacugaccauccacagcacaguggaggcuuccuguccuguugugucuagcugcaccgucuuucaugaccgcauucucaucacaccgaacgagcacaaauaugccauuaaggugaucugcaaugaaaagcccgggccuacccugcccuucaaaaucuguuccgccaagacggauguggcuaugacacucgccgacgcuaaaccuauucuggagcuugcccccgucgaucagaccacauacaucaaggaaaaagacgagagaugcaagaccuggaugugucggguuaaggaugaaggcuuucaagugauuuucgagccuuucaaaaaccuguuuggaucuuauaucggcauuuucuacaccuuuaucauuagccucauggcgaucuucaucgugauuuacaucguccugcccauuugcuuuaagcugagagacacacuucgccagcaugaggaugccuauaaaagagaaaugaagauccgguga

SEQ ID NO: 14268 - RNA, 4323 nt, Artificial Sequence
  derived and/or modified CDS sequence (opt5) from TAHV(4019)__GQ386834.1__GP
augauguucgugcuguuuuucaucgcccucagcgcugccucccccgucuaccagagaugcuuucaagacggcgcgauuguuaagcagaacccuucuaaacaggcugugaccgaggugugucugaaggaugacgucagcaugaucaaaacagaagcccgguauuuccgcaaugccacggggaccuacgcuaacaauguggccauuagaaaguggcuuguuuccgauuggcacgacugccggccgaaaaaggugucuggaggccauaucaacgucauugaggugggggaugaccugacacuccacaccgaggcuuauguuuguaaugccgauugcacaaucggaguggacaaggaaaccgcgcagguccgccugcaaacagauaccacgaaccauuuugaaaucgccggcaccacagugaaaagcgggugguucaaguccaccacauacauuacccuugaccagacgugugagcaccugaaagugucuugcggacccaagagcauccaguuucaugcuuguuucaaucagcacauguccugcgucagauuucuccaccggacaauucugccuggcagcaucgccucuuccauuugucaaaacguugagaucauuauccugaccgugcucacacugcuuaucuucauucugcucagcauccugucuaaaaccuauauuugcuacauccuuaugcccauuuuuaucccucuggcuuauaucuacggcgugauuuacaauaaguccuguaagaaaugcaagcucugcgggcuggucuaucaucccuucaccgaauguggaacacacugcguguguggcgcccgcuacgagacgagcgauagaaugaaacugcaucgggcgucugggcucugcccuggauauaagucccugcgcgccgcuagaguuauguguaaaagcaagggcccggccuccauccuuucuauuaucaccgcugugcugauucucacauuugucacccccaucaacgccaugguggccggggacacacaggaaaccuucaaacuggaggaucuuccugacgacaugcugagcauggcuaugaagguuaauauguacuauaucaugugcaugauuaacuacgcggugacgugguccuucauccucugugcccugcugauugcucuccuguuuaagaaauaucagcaccgguuccuuaauuuuuacgccauguacugccacgagugugauauguaucaugaccgcagcggacugaaguacaacggcgauuucacaaauaaaugcagacaguguaccugcggccaauaugaagacgccgcugggcuccugacccaccggaagacauacaacugccuuguccaguauaaaucuaaguggcugaccaacuuucucaucguguacauuauccugaugcugauuaaggauuccguccucaucgugcaugccgacggaacagauuucgagaaauguagcggcgaagcggacaucacguggaauugcaccgggcccuuucugaaccuuggaaauugugagaagaaacagaagaaagaaucuuauaacaauauugcuacacaacugaagggccucgaugccaucagcguucuggacauuccuaugaucuccaagauucccgaggauaucgccggggcucugcgcuucaucgaggaacagagaucuuaccacgugcagcuuaccgccgaguacgcuaugcucacacgguauugcgacuacuauacccaguuuacggacaacagcggauacucccaaaccacauggagagucuaucugcgcagccaugauuucgaagccuguauucuguacccgaaucggcacuuuugcagaugugugaaacacggcgacaagugcagcuccagcaacugggauuucgcgaaugagaugaaaaacuauuacucuggcaagcaguccaaauuugacaaggaucucaaucuggcccuuaugagccugcaucacgcuuuccgcgggaccuccucuuucuacaucgccaagcuccugaaagaaaagaaaaacgaggaccugguuacauaugcugagaagauuaaaggaaaguacccuggcaaugcccuucucaaagcgaucauugauuauaucaaguacaugaaggaccugaccgaaaugaacaauuuuaaacaugaugagaugugggacgauagcaucuucgaagugcccccuacgaagucccccucuguccggagacuggagagcuccuaugacuuuaaaacaaacgugaacagcaaucccucucacauuuguaagaacaucaaaaccgugguuugccucuccccuaagagcggggucucuuacgauuccauuaucgccuguggagaaccgagccagcccucuauuuaucgcaagccugacagccagguguuccaauccaaugcugaccagacacacuuuugccugagcgauacccauugccuugagaacuacgaggccgugggcgaagagaucaucgacgcuauuaaaaagucuaaauguugggaaaccgaguucacagaguacauccaguuuaagcaguccgaugggguccggagcugcagaaugaaagacuccggcgaauguacggugaccacaaaucgcuggcccauuauccugugcgauaacgacaaguucuauuacucugagcuccaaaaggauuaugacaaagaucaggacauuggacacuuuugucugagcccucggugcaauaccaucagacaucccauuaaccgcaagcacaucuccaauuguacauggcagguuucucauaacaauaucgauaaaauugaagugcacgagcuggaagaccuugagcaguacaagaaagccaucacccaaaagcuccagacgagccugacacuguucaaguauuccaaaaccaagaaccucccgcacauuaaaccuauguacaaguauaucaccauugagggcacagaaaccgccgaggggaucgaaucugcuuacaucgagagcgaaauucccgcgcuggccggaacauccaucggcuuuaaaauuacgagcaagucugggaaacaucuucuggaugucaucuccuacgugaagucugcuucuuauuccgccguuuacaccaagcucuauacaaccggaccuacaauuggcgugaauaccaaacacgacgagcugugcacggggcccuguccugucaacgugccccauggcaccggauggaucacauucgccaaggagcggaccagcucuuggggcugcgaagaguuugggugucuggcuaucuccgacggaugcguuuucggcagcugccaggauauuaucaaagacgaaauuacaguguacagaaaggagaccgaagagacaaccgaugucgagcuuugucucacguucgccgacaaaacauauugcaccaaucugaacgcgaucaccccgauuaucacagaucaauuugaagugcaguucaagaccguggaggcuuacucccugccucggauuaucgccguccgcaaccacgaaaucaugguugggcagauuaaugacaucggaguguauagcaagggcugugggaacgugcagaaagucaauaacacgaauuacggcaacggagugcccaaguuugauuaccucugccaucuggccucuagaaaagagguuauugugcggaaguguuucgacaaugauuaucaggcuugcaaauuucuucaaacacccgccagcuacagacuggaggaagagggcggguccgucaccgugaucgacuauaagaagauucucggaacaaucaaaaugaaggcgauccugggcgauguuaaauacaagaccuucgcugacaacguggaccugacagucgaagggguguguaccggaugcauuaauuguuuugagaacauccacugcgaacuuacgauucacucuaccguugaggccagcuguccuguggucuccucuugcacaguguuccaugaucgcauccugauuaccccgaaugagcacaaauaugccaucaaggugaucugcaacgaaaagcccggcccuacacuccccuuuaaaauuuguagcgcuaagaccgacgccgcuaugacgcuggccgaugcgaaaccuauccucgagcuggcccccgucgaccagacaaccuacauuaaggaaaaagaugagcggugcaagacauggauguguagaguucgcgacgaaggguuccaggugaucuuugagccuuucaagaaucuuuucggcuccuauauuggaaucuuuuacaccuucauuaucucucugauggcuaucuuuauugugaucuacauuguccuccccaucugcuucaaacugagagauacccugcggcaacaugaggacgccuauaagcgcgaaaugaaaauuagauga

SEQ ID NO: 14269 - RNA, 4323 nt, Artificial Sequence
  derived and/or modified CDS sequence (opt5) from TAHV(4020)__GQ386835.1__GP
augauguucgugcuguuuuucaucgcccucagcgcugccucccccgucuaccagagaugcuuucaagacggcgcgauuguuaagcagaacccuucuaaacaggcugugaccgaggugugucugaaggaugacgucagcaugaucaaaacagaagcccgguauuuccgcaaugccacggggaccuacgcuaacaauguggccauuagaaaguggcuuguuuccgauuggcacgacugccggccgaaaaaggugucuggaggccauaucaacgucauugaggugggggaugaccugacacuccacaccgaggcuuauguuuguaaugccgauugcacaaucggaguggacaaggaaaccgcgcagguccgccugcaaacagauaccacgaaccauuuugaaaucgccggcaccacagugaaaagcgggugguucaaguccaccacauacauuacccuugaccagacgugugagcaccugaaagugucuugcggacccaagagcauccaguuucaugcuuguuucaaucagcacauguccugcgucagauuucuccaccggacaauucugccuggcagcaucgccucuuccauuugucaaaacguugagaucauuauccugaccgugcucacacugcuuaucuucauucugcucagcauccugucuaaaaccuauauuugcuacauccuuaugcccauuuuuaucccucuggcuuauaucuacggcgugauuuacaauaaguccuguaagaaaugcaagcucugcgggcuggucuaucaucccuucaccgaauguggaacacacugcguguguggcgcccgcuacgagacgagcgauagaaugaaacugcaucgggcgucugggcucugcccuggauauaagucccugcgcgccgcuagaguuauguguaaaagcaagggcccggccuccauccuuucuauuaucaccgcugugcugauucucacauuugucacccccaucaacgccaugguggccggggacacacaggaaaccuucaaacuggaggaucuuccugacgacaugcugagcauggcuaugaagguuaauauguacuauaucaugugcaugauuaacuacgcggugacgugguccuucauccucugugcccugcugauugcucuccuguuuaagaaauaucagcaccgguuccuuaauuuuuacgccauguacugccacgagugugauauguaucaugaccgcagcggacugaaguacaacggcgauuucacaaauaaaugcagacaguguaccugcggccaauaugaagacgccgcugggcuccugacccaccggaagacauacaacugccuuguccaguauaaaucuaaguggcugaccaacuuucucaucguguacauuauccugaugcugauuaaggauuccguccucaucgugcaugccgacggaacagauuucgagaaauguagcggcgaagcggacaucacguggaauugcaccgggcccuuucugaaccuuggaaauugugagaagaaacagaagaaagaaucuuauaacaauauugcuacacaacugaagggccucgaugccaucagcguucuggacauuccuaugaucuccaagauucccgaggauaucgccggggcucugcgcuucaucgaggaacagagaucuuaccacgugcagcuuaccgccgaguacgcuaugcucacacgguauugcgacuacuauacccaguuuacggacaacagcggauacucccaaaccacauggagagucuaucugcgcagccaugauuucgaagccuguauucuguacccgaaucagcacuuuugccggugugugaaacacggcgacaaguguucuuccagcaacugggauuucgcgaaugagaugaaaaacuauuacucuggcaagcaguccaaauuugacaaggaucucaaucuggcccuuaugagccugcaucacgcuuucagagggaccuccucuuucuacaucgccaagcuccugaaagaaaagaaaaacgaggaccugguuacauaugcugagaagauuaaaggaaaguacagcggcaaugcccuucucaaagcgaucauugauuauaucaaguacaugaaggggcugaccgaaaugaacaauuuuaaacaugacgagaugugggaugacuucaucuuugaagugccucccccuaagucccccucuguccgccggcuggagagcuccuaugauuucaaaacgaacgugaacagcaaucccucucacauuugcaagaacaucaaaacagugguuugccucuccccuaagagcggagucucuuacgacuccauuaucgccuguggcgaaccgagccagcccucuauuuauagaaagccugauagccaaguguuucaguccaaugcugaccagacccacuucugccugagcgacacacauugccuugagaacuacgagaccgugggggaagagaucaucgaugccauuaaaaagucuaaauguugggaaaccgaguuuacagaguacauccaguucaagcaauccgacggcguccgcagcugccggaugaaagauuccggagaauguacggugaccacaaauagauggcccauuauccugugcgacaacgauaaguuuuauuacucugagcuccagaaggacuaugauaaagaccaggauauuggccacuucugucugagcccucgcugcaauaccauccggcaucccauuaacagaaagcacaucuccaauuguacauggcagguuucucauaacaauaucgacaaaauugaagugcacgagcuggaagaucuugagcaauacaagaaagcuaucacccagaagcuccagacgagccugacacuguuuaaguauuccaaaaccaagaaccucccgcacauuaaaccuauguacaaguauaucaccauugaggggacagaaaccgccgagggaaucgaaucugccuacaucgagagcgaaauucccgcucuggcgggcacauccaucggguucaaaauuacgagcaagucuggaaaacaucuucuggacgucaucggcuacgugaaguccgccagcuauucugcuguuuacaccaagcucuauacaaccgggccuacaauuggcgugaauaccaaacacgaugagcugugcacgggacccuguccugucaacgugccccauggcaccggguggcugacauuugccaaggagcgcaccuccagcuggggaugcgaagaguucggcugucuugccaucucugacgggugcguuuucggauccugccaagacaucauuaaagaugaaaucacaguguaccggaaggagaccgaagagacaaccgacgucgagcucugucugacguuugcugauaaaacauauugcaccaaucugaacgccauuaccccgaucauuacagaccaguucgaagugcaguuuaagaccguggaggcguacagccucccuagaaucauugcuguccggaaccacgaaaucaugguuggccagaucaaugauauugggguguauuccaagggcuguggaaacgugcaaaaagucaauaacacgaauuacggcaacggggugcccaaguucgacuaccugugccaucuugccagccgcaaagagguuaucgugagaaaguguuuugauaaugacuaucaggccugcaaauuccugcagacacccgcuucuuaccggcucgaggaagagggaggcagcgucaccgugauugauuauaagaagauccuggggacaauuaaaaugaaggccauccugggagacguuaaauacaagaccuuugcggauaacguggaccuuacagucgaaggcguguguaccgggugcaucaauuguuucgagaacauucacugcgaacugacgauccacuccaccguugaggcuucuuguccuguggucagcuccugcacaguguuucaugaccgcauucucaucaccccgaaugagcacaaauaugccauuaaggugaucugcaacgaaaagcccggcccuacacugcccuucaaaaucuguucugccaagaccgaugcugccaugacgcucgcugacgccaaaccuauucuggagcuugcgcccgucgaucagacaaccuacaucaaggaaaaagacgagagaugcaagacauggaugugucggguuagagaugaaggauuucaagugauuuucgagccuuucaagaaucuguuuggcagcuauaucgggauuuucuacaccuuuaucauuucccucauggccaucuucaucgugauuuacaucguccugcccauuugcuuuaaacugcgcgacacccuuagacagcaugaggaugcuuauaagcgggaaaugaaaauccgcuga

SEQ ID NO: 14270 - RNA, 4323 nt, Artificial Sequence
  derived and/or modified CDS sequence (opt5) from TAHV(4030)__GQ386836.1__GP
augauguucgugcuguuuuucaucgcccucagcgcugccucccccgucuaccagagaugcuuucaagacggcgcgauuguuaagcagaacccuucuaaacaggcugugaccgaggugugucugaaggaugacgucagcaugaucaaaacagaagcccgguauuuccgcaaugccacggggaccuacgcuaacaauguggccauuagaaaguggcuuguuuccgauuggcacgacugccggccgaaaaaggugucuggaggccauaucaacgucauugaggugggggaugaccugacacuccacaccgaggcuuauguuuguaaugccgauugcacaaucggaguggacaaggagaccgcgcagguccgccugcaaacagauaccacgaaccauuuugaaaucgccggcaccacagugaaaagcgggugguucaaguccaccacauacauuacccuugaccagacgugugagcaccugaaagugucuugcggacccaagagcauccaguuucaugcuuguuucaaucagcacauguccugcgucagauuucuccaccggacaauucugccuggcagcaucgccucuuccauuugucaaaacguugagaucauuauccugaccgugcucacacugcuuaucuucauucugcucagcauccugucuaaaaccuauauuugcuacauccuuaugcccauuuuuaucccucuggcuuauaucuacggcgugauuuacaauaaguccuguaagaaaugcaagcucugcgggcuggucuaucaucccuucaccgaauguggaacacacugcguguguggcgcccgcuacgagacgagcgauagaaugaaacugcaucgggcgucugggcucugcccuggauauaagucccugcgcgccgcuagaguuauguguaaaagcaagggcccggccuccauccuuucuauuaucaccgcugugcugauucucacauuugucacccccaucaacgccaugguggccggggacacacaggaaaccuucaaacuggaggaucuuccugacgacaugcugagcauggcuaugaagguuaauauguacuauaucaugugcaugauuaacuacgcggugacgugguccuucauccucugugcccugcugauugcucuccuguuuaagaaauaucagcaccgguuccuuaauuuuuacgccauguacugcaacgagugugauauguaucacgaccgcagcggacugaaguacaauggcgauuucacaaacaaaugcagacaguguaccugcggccaauaugaagacgccgcugggcuccugacccaucggaagacauacaacugccuuguccaguauaaaucuaaguggcugaccaauuuucucaucguguacauuauccugaugcugauuaaggauuccguccucaucgugcacgccgacggaacagauuucgagaaauguagcggcgaagcggacaucacguggaacugcaccgggcccuuucugaaucuuggaaacugugagaagaaacagaagaaagaaucuuauaauaacauugcuacacaacugaagggccucgaugccaucagcguucuggacauuccuaugaucuccaagauucccgaggauaucgccggggcucugcgcuucaucgaggaacagagaucuuaccaugugcagcuuaccgccgaguacgcuaugcucacacgguauugcgacuacuauacccaguuuacggacaauagcggauacucccaaaccacauggagagucuaucugcgcagccacgauuucgaagccuguauucuguacccgaaccagcauuuuugccggugugugaaacacggcgacaagugcagcuccagcaauugggauuucgcgaacgagaugaaaaauuauuacucuggcaagcaguccaaauuugacaaggaucucaaccuggcccuuaugagccugcaccaugcuuucagagggaccuccucuuucuacaucgccaagcuccugaaagaaaagaaaaaugaggaccugauuacauaugcugagaagaucaaaggaaaguacccuggcaacgcccuucucaaagcgauuaucgauuauaucaaguacaugaaggaccugaccgaaaugaauaacuuuaaacacgaugagaugugggacgauuucauuuuugaaguucccccuacgaagucucccuccgugcgccggcuggagucuagcuaugacuucaaaacaaacgucaauuccaaccccagccauaucuguaagaauauuaaaaccguggugugccucucuccuaaguccgggguuagcuacgauucuaucauugccuguggagaaccgucccagcccagcaucuauagaaagccugacucucaagucuuucagagcaacgcugaccagacacacuucugccuguccgauacccacugccuugagaauuacgagaccgugggcgaagagaucauugacgccaucaaaaagagcaaauguugggaaacagaguuuacggaguacauucaguucaagcaaucugauggggugcgcuccugccggaugaaagacagcggcgaauguaccgucacaaccaacagauggcccaucauucugugcgauaaugacaaguuuuauuacuccgagcuccagaaggauuaugacaaagaucaggacaucggacauuucugucugucuccucgcugcaacacaauucggcaccccaucaauagaaagcauaucagcaacuguaccuggcaagugucccacaauaacauugauaaaaucgaaguucaugagcuggaagaccuugagcaguacaagaaagcuauuacgcagaagcuccagacaucucugacccuguuuaaguauagcaaaaccaagaaucucccgcacaucaaaccuauguacaaguauauuacaaucgagggcaccgaaacagccgaggggaucgaauccgccuacauugagucugaaauccccgcucuggcgggaacgagcauuggcuucaaaaucaccuccaagagcgggaaacaccuucuggaugugauuggauacgucaagucugccuccuauagcgcuguguacacaaagcucuauaccacaggcccuaccaucgggguuaacacgaaacaugacgagcugugcaccggccccuguccugugaaugucccccacggaacaggcuggcugaccuuugccaaggagcgcacaucuuccugggggugcgaagaguucggaugucuugccaucagcgacggcugcguguucgggucuugccaagauauuaucaaagacgaaauuaucguuuaccggaaggagaccgaagagacaaccgauguggagcucugucugacguuugcugacaaaacauauugcaccaaccugaacgccauuaccccgaucauuacagaucaguucgaaguccaguuuaagaccguggaggcguacucccucccuagaaucaucgcugugcggaaucaugaaauuauggucggacagaucaacgacauuggcguuuauagcaagggguguggcaaugugcaaaaagugaacaauacgaacuacggaaauggcguccccaaguucgauuaccugugccaccuugccucccgcaaagaggugaucguuagaaaguguuuugacaacgauuaucaggccugcaaauuccugcagacacccgcuagcuaccggcucgaggaagaagggggaucugugaccgucauugacuauaagaagauccugggcacaaucaaaaugaaggccauucugggggaugugaaauacaagaccuuugcggacaauguugaccuuacaguggaaggagucuguaccggcugcgugaacuguuucgagaauauccauugcgaacugacgauucacagcaccguugaggcuuccuguucuguggucagcuccugcacaguguuucacgauagaauccucauuaccccuaacgagcauaaauaugccaucaaggugaucugcaaugaaaagccggggcccacacugccuuucaaaauuuguucugccaagaccgacgcugccaugacgcucgcugaugccaaacccauccuggagcuugcgccugucgaccagacaaccuacauuaaggaaaaagaugagcgcugcaagacauggaugugucggguuagagacgaaggcuuucaagugaucuucgagcccuucaagaaccuguuuggaagcuauauuggcaucuucuacaccuuuauuaucucccucauggccaucuucauugugaucuacauuguccugccuaucugcuuuaaacugcgcgauacccuuagacagcacgaggacgcuuauaagcgggaaaugaaaauucgcuga

SEQ ID NO: 14271 - RNA, 4323 nt, Artificial Sequence
  derived and/or modified CDS sequence (opt5) from TAHV(4033)__GQ386837.1__GP
augauguucgugcuguuuuucaucgcccucagcgcugccucccccgucuaccagagaugcuuucaagacggcgcgauuguuaagcagaacccuucuaaacaggcugugaccgaggugugucugaaggaugacgucagcaugaucaaaacagaagcccgguauuuccgcaaugccacggggaccuacgcuaacaauguggccauuagaaaguggcuuguuuccgauuggcacgacugccggccgaaaaaggugucuggaggccauaucaacgucauugaggugggggaugaccugacacuccacaccgaggcuuauguuuguaaugccgauugcacaaucggaguggacaaggaaaccgcgcagguccgccugcaaacagauaccacgaaccauuuugaaaucgccggcaccacagugaaaagcgggugguucaaguccaccacauacauuacccuugaccagacgugugagcaccugaaagugucuugcggacccaagagcauccaguuucaugcuuguuucaaucagcacauguccugcgucagauuucuccaccggacaauucugccuggcagcaucgccucuuccauuugucaaaacguugagaucauuauccugaccgugcucacacugcuuaucuucauucugcucagcauccugucuaaaaccuauauuugcuacauccuuaugcccauuuuuaucccucuggcuuauaucuacggcgugauuuacaauaaguccuguaagaaaugcaagcucugcgggcuggucuaucaucccuucaccgaauguggaacacacugcguguguggcgcccgcuacgagacgagcgauagaaugaaacugcaucgggcgucugggcucugcccuggauauaagucccugcgcgccgcuagaguuauguguaaaagcaagggcccggccuccauccuuucuauuaucaccgcugugcugauucucacauuugucacccccaucaacgccaugguggccggggacacacaggaaaccuucaaacuggaggaucuuccugacgacaugcugagcauggcuaugaagguuaauauguacuauaucaugugcaugauuaacuacgcggugacgugguccuucauccucugugcccugcugauugcucuccuguuuaagaaauaucagcacggauuccuuaauuuuuacgccauguacugccacgagugugauauguaucaugaccggagcggccugaaguacaacggcgauuucacaaauaaaugccgccaguguaccugcgggcaauaugaagacgccgcuggacuccugacccacagaaagacauacaacugccuuguccaguauaaaucuaaguggcugaccaacuuucucaucguguacauuauccugaugcugauuaaggauuccguccucaucgugcaugccgacggcacagauuucgagaaauguagcggggaagcggacaucacguggaauugcaccggacccuuucugucucuuggcaacugugagaagaaacagaagaaagaaagcuauaauaacauugcuacacaacugaaggggcucgaugccaucuccguucuggacauuccuaugaucucuaagauucccgaggauaucgccggagcucugcgguucaucgaggaacagcgcagcuaccacgugcagcuuaccgccgaguacgcuaugcucacaagauauugcgacuacuauacccaguuuacggacaauuccggcuacagccaaaccacauggcgggucuaucugagaucucaugauuucgaagccuguauucuguacccgaaccagcacuuuugccgcugugugaaacacggcgacaagugcuccagcucuaauugggauuucgcgaacgagaugaaaaauuauuacuccgggaagcagagcaaauuugacaaggaucucaaccuggcccuuaugucccugcaucacgcuuuccggggaaccucuagcuucuacaucgccaagcuccugaaagaaaagaaaaaugaggaccugguuacauaugcugagaagauuaaaggcaaguacccugggaacgcccuucucaaagcgaucauugauuauaucaaguacaugaaggaccugaccgaaaugaauaacuuuaaacaugaugagaugugggacgauuucaucuuugaagugcccccuacgaagucccccucugucagacgccuggagagcuccuaugacuucaaaacaaaugugaacagcaaccccucucacauuuguaagaauaucaaaaccgugguuugccucuccccuaagagcggagucucuuacgauuccauuaucgccuguggcgaaccgagccagcccucuauuuaucggaagccugacagccaaguguuucaguccaacgcugaccagacacacuucugccugagcgauacccauugccuugagaauuacgagaccgugggggaagagaucaucgacgccauuaaaaagucuaaauguugggaaacagaguuuacggaguacauccaguucaagcaauccgauggcgucagaagcugccgcaugaaagacuccggagaauguaccgugacaaccaaccgguggcccauuauccugugcgauaaugacaaguuuuauuacucugagcuccagaaggauuaugacaaagaucaggacauuggccacuucugucugagcccuagaugcaacacaauccgccaucccauuaaucggaagcacaucuccaacuguaccuggcagguuucucauaauaacaucgauaaaauugaagugcacgagcuggaagaccuugagcaauacaagaaagcuaucacgcagaagcuccagacaagccugacccuguuuaaguauuccaaaaccaagaaucucccgcacauuaaaccuauguacaaguauaucacaauugaggggaccgaaacagccgagggaaucgaaucugccuacaucgagagcgaaauucccgcucuggcgggcacguccaucggguucaaaauuaccagcaagucuggaaaacaucuucuggaugucaucggcuacgugaaguccgccagcuauucugcuguuuacacaaagcucuauaccacagggccuaccauuggcgugaacacgaaacacgacgagcugugcaccggacccuguccugucaaugugccccauggcacaggguggcugaccuuugccaaggagagaacauccagcuggggaugcgaagaguucggcugucuugccaucucugacgggugcguuuucggauccugccaagauaucauuaaagacgaaaucaccguguaccgcaaggagacagaagagaccacggaugucgagcucugucugacauuugcugacaaaaccuauugcaccaaccugaaugccauuacaccgaucauuaccgaucaguucgaagugcaguuuaagacgguggaggcguacagccucccucggaucauugcugucagaaaccacgaaaucaugguuggccagaucaacgacauugggguguauuccaagggcuguggaaaugugcaaaaagucaacaauacaaacuacggcaauggggugcccaaguucgauuaccugugccaucuugccagccggaaagagguuaucgugcgcaaguguuuugacaacgauuaucaggccugcaaauuccugcagacccccgcuucuuacagacucgaggaagagggaggcagcgucacagugauugacuauaagaagauccuggggaccauuaaaaugaaggccauccugggagauguuaaauacaagacauuugcggacaauguggaccuuaccgucgaaggcguguguacggggugcaucaacuguuucgagaauauucacugcgaacugaccauccacuccacaguugaggcuucuuguccuguggucagcuccugcaccguguuucaugaucggauucucaucacaccgaacgagcacaaauaugccauuaaggugaucugcaaugaaaagcccggcccuacccugcccuucaaaaucuguucugccaagacggacgcugccaugacacucgcugaugccaaaccuauucuggagcuugcgcccgucgaccagaccacauacaucaaggaaaaagaugagagaugcaagaccuggaugugucgcguucgggacgaaggauuucaagugauuuucgagccuuucaagaaccuguuuggcagcuauaucgggauuuucuacaccuuuaucauuucccucauggccaucuucaucgugauuuacaucguccugcccauuugcuuuaaacugagagauacacuucgccagcaugaggacgcuuauaagagagaaaugaaaauccgguga

SEQ ID NO: 14272 - RNA, 4323 nt, Artificial Sequence
  derived and/or modified CDS sequence (opt5) from TAHV(4034)__GQ386838.1__GP
augauguucgugcuguuuuucaucgcccucagcgcugccucccccgucuaccagagaugcuuucaagacggcgcgauuguuaagcagaacccuucuaaacaggcugugaccgaggugugucugaaggaugacgucagcaugaucaaaacagaagcccgguauuuccgcaaugccacggggaccuacgcuaacaauguggccauuagaaaguggcuuguuuccgauuggcacgacugccggccgaaaaaggugucuggaggccauaucaacgucauugaggugggggaugaccugacacuccacaccgaggcuuauguuuguaaugccgauugcacaaucggaguggacaaggagaccgcgcagguccgccugcaaacagauaccacgaaccauuuugaaaucgccggcaccacagugaaaagcgggugguucaaguccaccacauacauuacccuugaccagacgugugagcaccugaaagugucuugcggacccaagagcauccaguuucaugcuuguuucaaucagcacauguccugcgucagauuucuccaccggacaauucugccuggcagcaucgccucuuccauuugucaaaacguugagaucauuauccugaccgugcucacacugcuuaucuucauucugcucagcauccugucuaaaaccuauauuugcuacacccuuaugcccaucuuuauuccucuggcuuauaucuacggcgugaucuacaauaaguccuguaagaaaugcaagcucugcgggcuggucuaucaucccuucacagaauguggaacgcacugcguguguggcgcccgcuacgagaccagcgauagaaugaaacugcaucgggcgucugggcucugcccuggauauaagucccugcgcgccgcuagaguuauguguaaaagcaagggcccggccuccauucuuucuaucauuacagcugugcugauccucaccuuugucacacccauuaacgccaugguggccggggacacccaggaaacguucaaacuggaggaucuuccugacgacaugcugagcauggcuaugaagguuaauauguacuauaucaugugcaugaucaacuacgcggugacaugguccuucauucucugugcccugcugaucgcucuccuguuuaagaaauaucagcaccgguuccuuaauuuuuacgccauguacugccacgagugugauauguaucaugaccgcagcggacugaaguacaacggcgauuucaccaauaaaugcagacaguguaccugcggccaauaugaagacgccgcugggcuccugacacaccggaagaccuacaacugccuuguccaguauaaaucuaaguggcugacaaacuuucucauuguguacaucauucugaugcugaucaaggauuccauucucaucguccaugccgacggaacggauuucgagaaauguagcggcgaagcggacaucaccuggaauugcacagggcccuuucugaaccuuggaaauugugagaagaaacagaagaaagaaucuuauaacaauauugcuacccaacugaagggccucgaugccaucagcgugcuggacauuccuaugaucuccaagauucccgaggauaucgccggggcucugcgcuucaucgaggaacagagaucuuaccacguucagcuuacagccgaguacgcuaugcucacccggugcugugacuauuacacgcaguuuaccgacaacagcggauauucccaaacaaccuggagaguguaccugcgcagccaugauuucgaagccugcauucuguauccgaaucagcacuuuugucggugcgucaaacacggcaacaaguguucuuccagcaauugggacuucgcgaacgagaugaaaaauuacuauucuggcaagcaguccaaauuugauaaggaccucaaccuggcccuuaugagccugcaucacgcuuucagagggacauccucuuucuacaucgccaagcuccugaaagaaaagaaaaaugaggaucuggugaccuacgcugagaagauuaaaggaaaguauccuggcaacgcccuucucaaagcgaucauugacuacaucaaguauaugaaggaucugacggaaaugaauaacuuuaaacaugacgagaugugggaugacuucaucuuugaaguucccccuacaaagagccccuccgugcgccggcuggagucuagcuacgauuucaaaaccaacgucaauuccaaccccagccacauuugcaagaauaucaaaacaguggugugucucucuccuaaguccgggguuagcuaugacucuauuaucgccugcggagaaccgucccagcccagcauuuacagaaagccugauucucaagucuuucagagcaacaccgaccagacccacuucugccuguccgacacacauugucuugagaauuaugaggcugugggcgaagagaucaucgaugccauuaaaaagagcaaaugcugggaaacggaguuuaccgaguacauccaguucaagcaaucugacggggugcgcuccugucggaugaaagauagcggcgaaugcacagucaccacaaacagauggcccauuauccugugugacaaugauaaguuuuacuauuccgagcuccagaaggacuacgauaaagaccaggauauuggacacuucugccugucuccucgcuguaacaccauccggcaucccauuaauagaaagcacaucagcaacugcacguggcaagugaaucauaacaauaucgacaaaauugaaguucacgagcuggaagaucuugagcaguauaagaaagcuaucacacagaagcuccagaccucccugacccuguuuaaguacucuaaaacaaagaaccucccgcacauuaaaccuauguauaaguacaucaccauugagggcacagaaacggccgaggggaucgaaagcgccuauaucgaguccgaaauucccgcucuggcgggaaccucuaucggcuucaaaauuacaagcaaguccgggaaacaucuucuggacgugaucggauacgucaagagcgccucuuacuccgcuguguauaccaagcucuacacaaccggcccuacgauugggguuaauaccaaacacgaugagcuguguacaggccccugcccugugaacgucccccauggaaccggcuggcugacauuugccaaggagcgcaccagcucuugggggugugaagaguucggaugccuugccaucuccgacggcugcguguucgggagcugucaagacaucauuaaagaugaaaucacaguuuaucggaaggagaccgaagagacgacagacguggagcucugccugaccuuugcugauaaaaccuacuguacaaaccugaaugccauuaccccgaucauuacggaccaguucgaaguccaguuuaagacaguggaggcguauucucucccuagaaucauugcugugcggaaccacgaaaucauggucggacagaucaaugauauuggcguuuacuccaaggggugcggcaacgugcaaaaagugaauaacaccaauuauggaaacggcguccccaaguucgacuaccugugucaucuugccagccgcaaagaggugaucguuagaaagugcuuugauaaugacuaccaggccuguaaauuccugcagauucccgcuuccuaucggcucgaggaagaagggggaagcgugacagucaucgauuacaagaagauucugggcaccaucaaaaugaaggccauccugggggacgugaaauauaagacauuugcggauaacguugaccuuaccguggaaggagucugcacgggcuguauuaauugcuucgagaacauccacugugaacugaccauucacucuacaguggaggcuagcugcccuguuguguccucuugcaccgucuuucaugacagaauccucauuacaccgaaugagcacaaauacgccaucaaggugaucuguaacgaaaagcccgggccuacccugcccuucaaaauuugcagcgccaagacggaugcugccaugacacucgcugacgccaaaccuauccuggagcuugcgcccguggaucagaccacauauauuaaggaaaaagacgagcgcuguaagaccuggaugugccgggucagagaugaaggcuuucaaguuaucuucgagccuuucaagaaucuguuuggauccuacauuggcaucuucuauaccuuuauuaucucucucauggccaucuucauugugaucuacauugugcugcccaucuguuuuaaacugcgcgacacacuuagacagcaugaggaugcuuacaagcgggaaaugaaaauucgcuga

SEQ ID NO: 14273 - RNA, 4323 nt, Artificial Sequence
  derived and/or modified CDS sequence (opt5) from TAHV(4057)__GQ386839.1__GP
augauguucgugcuguuuuucaucgcccucagcgcugccucccccgucuaccagagaugcuuucaagacggcgcgauuguuaagcagaacccuucuaaacaggcugugaccgaggugugucugaaggaugacgucagcaugaucaaaacagaagcccgguauuuccgcaaugccacggggaccuacgcuaacaauguggccauuagaaaguggcuuguuuccgauuggcacgacugccggccgaaaaaggugucuggaggccauaucaacgucauugaggugggggaugaccugacacuccacaccgaggcuuauguuuguaaugccgauugcacaaucggaguggacaaggaaaccgcgcagguccgccugcaaacagauaccacgaaccauuuugaaaucgccggcaccacagugaaaagcgggugguucaaguccaccacauacauuacccuugaccagacgugugagcaccugaaaggaucuugcggccccaagagcauccaguuucaugcuuguuucaaucagcacauguccugcgugagauuucuccaccggacaauucugccuggcagcaucgccucuuccauuugucaaaacgucgagaucauuauccugaccguucucacacugcuuaucuucauucugcucagcauccugucuaaaaccuauauuugcuacauccuuaugcccauuuuuaucccucuggcuuauaucuacggggugauuuacaauaaguccuguaagaaaugcaagcucugcggacugguguaucaucccuucaccgaauguggcacacacugcgucuguggggcccgcuacgagacgagcgauagaaugaaacugcaucgggcgucuggacucugcccuggcuauaagucccugcgcgccgcuagagugauguguaaaagcaaggggccggccuccauccuuucuauuaucaccgcuguucugauucucacauuugugacccccaucaacgccauggucgccggagacacacaggaaaccuucaaacuggaggaucuuccugacgacaugcugagcauggcuaugaaggugaauauguacuauaucaugugcauuaucaacuacgcgguuacgugguccuucauucucugugcccugcugaucgcucuccuguuuaagaaauaucagcaccgguuccuuaauuuuuacgccauguacugccacgagugugauauguaucaugaccgcagcggccugaaguacaacggcgauuucacaaauaaaugcagacaguguaccugcgggcaauaugaagacgccgcuggacuccugacccaccggaagacauacaacugccuugugcaguauaaaucuaaguggcugaccaacuuucucauugucuacaucauucugaugcugaucaaggauuccgugcucaucguccaugccgacggcacagauuucgagaaauguagcggggaagcggacauuacguggaauugcaccggacccuuucugaaccuuggcaauugugagaagaaacagaagaaagaaucuuauaacaauaucgcuacacaacugaaggggcucgaugccauuagcgugcuggacaucccuaugauuuccaagauccccgaggauaucgccggagcucugcgcuucauugaggaacagagaucuuaccacguucagcuuaccgccgaguacgcuaugcucacacgguauugcgacuacuauacccaguuuacggacaacagcggcuacucccaaaccacauggagaguguaucugcgcagccaugauuucgaagccuguauccuguacccgaaucagcacuuuugccggugugucaaacacggcgacaaguguucuuccagcaacugggauuucgcgaaugagaugaaaaacuauuacucugggaagcaguccaaauuugacaaggaucucaaucuggcccuuaugagccugcaucacgcuuucagaggaaccuccucuuucuacauugccaagcuccugaaagaaaagaaaaacggcgaccuggugacauaugcugagaagaucaaagggaaguacccuggaaaugcccuucucaaagcgauuaucgauuauaucaaguacaugaaggaccugaccgagaugaacaauuuuaaacaugaugaaaugugggacgauuucauuuuugagguucccccuacgaagucucccuccgugcgccggcuggaaucuagcuaugacuucaaaacaaacgucaacuccaaucccagccacaucugcaagaacauuaaaaccguggugugccucucuccuaaguccggcguuagcuacgauucuaucauugccuguggggagccgucccagcccagcaucuauagaaagccugacucucaagucuuucagagcaaugcugaccagacacacuucugccuguccgauacccauugccuugaaaacuacgagaccgugggcgaggaaaucauugacgccaucaaaaagagcaaauguugggagacagaauuuacggaguacauucaguucaagcaaucugauggagugcgcuccugccggaugaaagacagcggcgaguguaccgucacaaccaauaaguggcccaucauucugugcgauaacgacaaguuuuauuacuccgaacuccagaaagauuaugacaaggaucaggacaucgggcacuucugucugucuccuagaugcaauacaauucgccaucccaucaaccggaaacacaucagcaauuguaccuggcaagugucccauaacaauauugauaagaucgagguucacgaacuggaggaccuugaacaguacaaaaaggcuauuacgcagaagcuccagacaucucugacccuguuuaaauauagcaagaccaaaaaccucccgcacaucaagccuauguacaaauauauuacaaucgagggaaccgagacagccgaaggcaucgaguccgccuacauugaaucugagauccccgcucuggcggggacgagcauuggauucaagaucaccuccaaaagcggcagacaucuucuggaugugauuggguacgucaagucugccuccuauagcgcuguguacacaaagcucuauaccacaggcccuaccaucggaguuaauacgaaacacgacgaacugugcaccggccccuguccugugaacgucccccaugggacaggauggcugaccuuugccaaggagcgcacaucuuccuggggcugcgaggaguucgggugucuugccaucagcgacggaugcguguucggcucuugccaagauauuaucaaagacgaaauuaccguuuaccggaaggaaacagaggaaaccacggauguggagcucugucugacauuugcugacaaaaccuauugcaccaaucugaacgccaucacaccgauuaucaccgaucaguucgagguccaguuuaagacgguggaagcguacucccucccuagaauuaucgcugugcggaaccacgagaucauggucgggcagauuaaugacaucggcguuuauagcaagggauguggcaacgugcaaaaagugaauaacacaaauuacgggaacggaguccccaaguucgauuaccugugccaucuugccucccgcaaagaagugauuguuagaaaguguuuugacaaugauuaucaggccugcaaauuccugcagacccccgcuagcuaccggcucgaggaggaaggcgggucugugacagucaucgacuauaagaagauucugggaaccaucaaaaugaaggccauccugggcgaugugaaauacaagacauuugcggacaacguugaccuuaccguggagggggucuguacgggcugcgugaauuguuucgaaaacauucacugcgagagcaccauccacuccacaguugaagcuagcuguccuguggucagcuccugcaccguguuucaugaucgcauucugaucacaccgaaugagcacaaauaugccauuaaggugaucugcaacgagaagcccggaccuacccuccccuucaaaaucuguucugccaagacggacgcugccaugacacuggcugaugccaaaccuauucucgaacuggcgcccgucgaccagaccacauacaucaaggagaaagaugaaagaugcaagaccuggaugugucggguuagagacgagggcuuucaagugauuuucgaaccuuucaagaaucuuuuugggagcuauaucggaauuuucuacaccuuuaucauuucccugauggccaucuucaucgugauuuacaucguccuccccauuugcuuuaaacugcgcgauacacugagacagcaugaggacgcuuauaagcgggagaugaaaauccgcuga

SEQ ID NO: 14274 - RNA, 4323 nt, Artificial Sequence
  derived and/or modified CDS sequence (opt5) from TAHV(4060)__GQ386840.1__GP
augauguucgugcuguuuuucaucgcccucagcgcugccucccccgucuaccagagaugcuuucaagacggcgcgauuguuaagcagaacccuucuaaacaggcugugaccgaggugugucugaaggaugacgucagcaugaucaaaacagaagcccgguauuuccgcaaugccacggggaccuacgcuaacaauguggccauuagaaaguggcuuguuuccgauuggcacgacugccggccgaaaaaggugucuggaggccauaucaacgucauugaggugggggaugaccugacacuccacaccgaggcuuauguuuguaaugccgauugcacaaucggaguggacaaggagaccgcgcagguccgccugcaaacagauaccacgaaccauuuugaaaucgccggcaccacagugaaaagcgggugguucaaguccaccacauacauuacccuugaccagacgugugagcaccugaaagugucuugcggacccaagagcauccaguuucaugcuuguuucaaucagcacauguccugcgucagauuucuccaccggacaauucugccuggcagcaucgccucuuccauuugucaaaacguugagaucauuauccugaccgugcucacacugcuuaucuucauucugcucagcauccugucuaaaaccuauauuugcuacauccuuaugcccauuuuuaucccucuggcuuauaucuacggcgugauuuacaauaaguccuguaagaaaugcaagcucugcgggcuggucuaucaucccuucaccgaauguggaacacacugcguguguggcgcccgcuacgagacgagcgauagaaugaaacugcaucgggcgucugggcucugcccuggauauaagucccugcgcgccgcuagaguuauguguaaaagcaagggcccggccuccauccuuucuauuaucaccgcuauucugauccucacauuugugacccccaucaacgccauggucgccggggacacacaggaaaccuucaaacuggaggaucuuccugacgacaugcugagcauggcuaugaaggugaauauguacuauauuaugugcaugaucaacuacgcgguuacgugguccuucauucucugugcccugcugaucgcucuccuguuuaagaaauaucagcaccgguuccuuaauuuuuacgccauguacugccacgagugugauauguaucaugaccgcagcggacugaaguacaacggcgauuucacaaauaaaugcagacaguguaccugcggccaauaugaagacgccgcugggcuccagacccaccggaagacauacaacugccuggugcaguauaaaucuaaguggcuuaccaacuuucugauugucuacaucauucucaugcugaucaaggauuccgugcugaucguccaugccgacggaacagauuucgagaaauguagcggcgaagcggacauuacguggaauugcaccgggcccuuucucaaccugggaaauugugagaagaaacaaaagaaagaaucuuauaacaauaucgcuacacagcuuaagggccuggaugccauuagcgugcucgacaucccuaugauuuccaagauccccgaggauaucgccggggcucugcgcuucauugaggaacagagaucuuaccacguucagcugaccgccgaguacgcuaugcuuacacgguauugcgacuacuauacccaauuuacggacaacagcggauacucccagaccacauggagaguguaucuccgcagccaugauuucgaagccuguauccuguacccgaaucagcacuuuugccggugugucaaacacggcgacaagugcagcuccagcaacugggauuucgcgaaugagaugaaaaacuauuacucuggcaagcaguccaaauuugacaaggaucugaaucucgcccugaugagccuucaucacgcuuucagagggaccuccucuuucuacauugccaagcugcucaaagaaaagaaaaacgaggaccuggugacauaugcugagaagaucaaaggaaaguacccuggcaaugcccugcuuaaagcgauuaucgauuauaucaaguacaugaaggaccucaccgaaaugaacaauuuuaaacaugaugagaugugggacgauuucauuuuugaaguucccccuacgaagucucccuccgugcgccggcuggagucuagcuaugacuucaaaacaaacgucaacuccaaucccagccacaucuguaagaacauuaaaaccguggugugccugucuccuaaguccgggguuagcuacgauucuaucauugccuguggagaaccgucccaacccagcaucuauagaaagccugacucucaggucuuucagagcaaugcugaccagacacacuucugccucuccgauacccauugccuggagaacuacgagaccgugggcgaagagaucauugacgccaucaaaaagagcaaauguugggaaacagaguuuacggaguacacccaauucaagcagucugauggggugcgcuccugccggaugaaagacagcggcgaauguacagucaccacaaauagauggcccauuauccuuugcgauaacgacaaguuuuauuacuccgagcugcagaaggauuaugacaaagaucaggacauuggacacuucugucucucuccucgcugcaauaccauccggcaucccauuaacagaaagcacaucagcaauuguacguggcaagugucccauaacaauaucgauaaaauugaaguucacgagcuggaagaccuggagcaguacaagaaagcuaucacacagaaacuucaaaccucucucacccuguuuaaguauagcaagacaaagaaccugccgcacauuaaaccuauguacaaguauaucaccauugagggcacagaaacggccgaggggaucgaauccgccuacaucgagucugaaauucccgcucucgcgggaaccagcaucggcuucaaaauuacauccaagagcgggaaacaucugcuugaugugaucggauacgucaagucugccuccuauagcgcuguguacaccaagcuguauacaaccggcccuacgauugggguuaauaccaaacacgacgagcucugcacaggccccuguccugugaacgucccccauggaaccggcuggcugacauuugccaaggagcgcaccucuuccugggggugcgaagaguucggaugucuggccaucagcgacggcugcguguucgggucuugccaggauaucauuaaagacgaaaucacaguuuaccggaaggagaccgaagagacgacagauguggagcuuugucucaccuuugcugacaaaaccuauugcacaaaucugaacgccauuaccccgaucauuacggaucaguucgaaguccaguuuaagacaguggaggcguacucccugccuagaaucauugcugugcggaaccacgaaaucauggucggacaaaucaaugacauuggcguuuauagcaagggguguggcaacgugcagaaagugaauaacaccaauuacggaaacggcguccccaaguucgauuaccucugccaucuggccucccgcaaagaggugaucguuagaaaguguuuugacaaugauuaucaggccugcaaauuccuucagacacccgcuagcuaccggcuggaggaagaagggggaucugugaccgucauugacuauaagaagauccucggcacaauuaaaaugaaggccauccugggggaugugaaauacaagaccuuugcggacaacguugaccugacgguggaaggagucuguaccggcugcaucaauuguuucgagaacauucacugcgaacuuacaauccacagcaccguggaggcuuccuguccuguugugucuagcugcacagucuuucaugaucgcauucugaucaccccgaaugagcacaaauaugccauuaaggugaucugcaacgaaaagcccgggccuacgcuccccuucaaaaucuguuccgccaagacagacgcugccaugacccuggcugaugccaaaccuauucucgagcuggcgcccguggaccaaacaaccuacaucaaggaaaaagaugagagaugcaagaccuggaugugucgggucagagacgaaggcuuucagguuauuuucgagccuuucaagaaucuuuuuggaucuuauaucggcauuuucuacacauuuaucauuagccugaucgccaucuucauugugaucuacauugugcuccccaucugcuuuaaacugcgcgauacgcugagacagcaugaggacgcuuauaagcgggaaaugaaaauucgcuga

SEQ ID NO: 14275 - RNA, 4323 nt, Artificial Sequence
  derived and/or modified CDS sequence (opt5) from TAHV(5060)__GQ386841.1__GP
augauguucgugcuguuuuucaucgcccucagcgcugccucccccgucuaccagagaugcuuucaagacggcgcgauuguuaagcagaacccuucuaaacaggcugugaccgaggugugucugaaggaugacgucagcaugaucaaaacagaagcccgguauuuccgcaaugccacggggaccuacgcuaacaauguggccauuagaaaguggcuuguuuccgauuggcacgacugccggccgaaaaaggugucuggaggccauaucaacgucauugaggugggggaugaccugacacuccacaccgaggcuuauguuuguaaugccgauugcacaaucggaguggacaaggaaaccgcgcagguccgccugcaaacagauaccacgaaccauuuugaaaucgccggcaccacagugaaaagcgggugguucaaguccaccacauacauuacccuugaccagacgugugagcaccugaaagugucuugcggacccaagagcauccaguuucaugcuuguuucaaucagcacauguccugcgucagauuucuccaccggacaauucugccuggcagcaucgccucuuccauuugucaaaacguugagaucauuauccugaccgugcucacacugcuuaucuucauucugcucagcauccugucuaaaaccuauauuugcuacauccuuaugcccauuuuuaucccucuggcuuauaucuacggcgugauuuacaauaaguccuguaagaaaugcaagcucugcgggcuggucuaucaucccuucaccgaauguggaacacacugcguguguggcgcccgcuacgagacgagcgauagaaugaaacugcaucgggcgucugggcucugcccuggauauaagucccugcgcgccgcuagaguuauguguaaaagcaagggcccggccuccauccuuucuauuaucaccgcugugcugauucucacauuugucacccccaucaacgccaugguggccggggacacacaggaaaccuucaaacuggaggaucuuccugacgacaugcugagcauggcuaugaagguuaauauguacuauaucaugugcauuaucaacuacgcggugacgugguccuucauucucugugcccugcugaucgcucuccuguuuaagaaauaucagcaccgguuccuuaauuuuuacgccauguacugccacgagugugauauguaucaugaccgcagcggacugaaguacaacggcgauuucacaaauaaaugcagacaguguaccugcggccaauaugaagacgccgcugggcuccugacccaccggaagacauacaacugccuuguccaguauaaaucuaaguggcugaccaacuuucucauuguguacaucauucugaugcugaucaaggauuccguccucaucgugcaugccgacggaacagauuucgagaaauguagcggcgaagcggacauuacguggaauugcaccgggcccuuucugaaccuuggaaauugugagaagaaacagaagaaagaaucuuauaacaauaucgcuacacaacugaagggccucgaugccauuagcguucuggacaucccuaugauuuccaagauccccgaggauaucgccggggcucugcgcuucauugaggaacagagaucuuaccacgugcagcuuaccgccgaguacgcuaugcucacacgguauugcgacuacuauacccaguuuacggacaacagcggauacucccaaaccacauggagagucuaucugcgcagccaugauuucgaagccuguauccuguacccgaaucagcacuuuugccggugugugaaacacggcgacaagugcagcuccagcaacugggauuucgcgaaugagaugaaaaacuauuacucuggcaagcaguccaaauuugacaaggaucucaaucuggcccuuaugagccugcaucacgcuuucagagggaccuccucuuucuacauugccaagcuccugaaagaaaagaaaaacggagaccugguuacauaugcugagaagaucaaaggcaaguacccugggaaugcccuucucaaagcgauuaucgauuauaucaaguacaugaaggaccugaccgagaugaacaauuuuaaacaugaugaaaugugggacgauuucauuuuugaggugagccccacgaaguccccuucuguccgccggcuggaaagcuccuaugacuucaaaacaaacgugaacagcaaucccucucacaucuguaagaacauuaaaaccgugguuugccucucccccaagagcggagucucuuacgauuccaucauugccuguggcgagccuagccagccgucuaucuauagaaagcccgacagccaaguguuucaguccaaugcugaccagacacacuucugccugagcgauacccauugccuugaaaacuacgagaccgugggggaggaaaucauugacgccaucaaaaagucuaaauguugggagacagaauuuacggaguacauucaguucaagcaauccgauggcguccgcagcugccggaugaaagacuccggagaguguaccgugacaaccaauaaguggccuaucauucugugcgauaacgacaaguuuuauuacucugaacuccagaaagauuaugacaaggaucaggacaucggccacuucugucugagccccagaugcaauacaauucgccauccuaucaaccggaaacacaucuccaauuguaccuggcagguuucucauagcaacauugauaagaucgaggugcacgaacuggaggaccuugaacaauacaaaaaggcuauuacgcagaagcuccagacaucccugacccuguuuaaauauucuaagaccaaaaaucucccccacaucaagccgauuuacaaauauaucacaaucgaggggaccgagacagccgaaggaauugagagcgccuacaucgaauccgagauuccugcucuggcgggcacgagcaucggguucaagauuaccucuaaauccggaaagcaucuucuggaugucaucggcuacgugaagucugccucuuauuccgcuguuuacacaaaacucuauaccacagggcccaccaucggcgugaacacgaagcacgacgaacugugcaccggaccuugucccgucaaugugccucauggcacaggguggcugaccuuugccaaagagagaacaagcucuuggggaugcgaggaguucggcugucuugccauuuccgacgggugcguuuucggaagcugccaagauaucauuaaggacgaaaucaccguguaccgcaaagaaacagaggaaaccacggaugucgagcucugucugacauuugcugacaagaccuauugcaccaaccugaaugccauuacacccaucauuaccgaucaguucgaggugcaguuuaagacgguggaagcguacucccucccgcggaucaucgcugucagaaaccacgagauuaugguuggccagaucaacgacauugggguguauagcaaaggcuguggaaaugugcaaaaggucaacaauacaaacuacggcaauggggugccuaaauucgauuaccugugccaucuugccucucggaaggaaguuaucgugcgcaaauguuuugacaacgauuaucaggccugcaaguuccugcagacccccgcuagcuacagacucgaggaggaaggaggcuccgucacagugauugacuauaagaaaauccuggggaccaucaagaugaaagccauucugggagauguuaaguacaaaacauuugcggacaauguggaccuuaccgucgagggcguguguacggggugcaucaacuguuucgaaaauauucacugcgagcugaccauccacucuacaguugaagcuagcugucccguggucuccucuugcaccguguuucaugaucggauucucaucacaccuaacgagcacaaguaugccaucaaggugauuugcaaugagaaaccgggccccacccugccuuucaagaucuguagcgccaaaacggacgcugccaugacacucgcugaugccaagcccauucuggaacuugcgccugucgaccagaccacauacaucaaagagaaggaugaaagaugcaagaccuggaugugucgcguucgggacgagggauuucaagugauuuucgaacccuucaaaaaccuguuuggcuccuauaucgggauuuucuacaccuuuaucaucucucucauggccauuuucaucgugauuuacaucguccugccuauuugcuuuaagcugagagauacacuucgccagcaugaggacgcuuauaaaagagagaugaagauccgguga

SEQ ID NO: 14276 - RNA, 4323 nt, Artificial Sequence
  derived and/or modified CDS sequence (opt5) from TAHV(76)__GQ386824.1__GP
augauguucgugcuguuuuucaucgcccucagcgcugccucccccgucuaccagagaugcuuucaagacggcgcgauuguuaagcagaacccuucuaaacaggcugugaccgaggugugucugaaggaugacgucagcaugaucaaaacagaagcccgguauuuccgcaaugccacggggaccuacgcuaacaauguggccauuagaaaguggcuuguuuccgauuggcacgacugccggccgaaaaaggugucuggaggccauaucaacgucauugaggugggggaugaccugacacuccacaccgaggcuuauguuuguaaugccgauugcacaaucggaguggacaaggaaaccgcgcagguccgccugcaaacagauaccacgaaccauuuugaaaucgccggcaccacagugaaaagcgggugguucaaguccaccacauacauuacccuugaccagacgugugagcaccugaaagugucuugcggacccaagagcauccaguuucaugcuuguuucaaucagcacauguccugcgucagauuucuccaccggacaauucugccuggcagcaucgccucuuccauuugucaaaacguugagaucauuauccugaccgugcucacacugcuuaucuucauucugcucagcauccugucuaaaaccuauauuugcuacauccuuaugcccauuuuuaucccucuggcuuauaucuacggcgugauuuacaauaaguccuguaagaaaugcaagcucugcgggcuggucuaucaucccuucaccgaauguggaacacacugcguguguggcgcccgcuacgagacgagcgauagaaugaaacugcaucgggcgucugggcucugcccuggauauaagucccugcgcgccgcuagaguuauguguaaaagcaagggcccggccuccauccuuucuauuaucaccgcugugcugauucucacauuugucacccccaucaacgccaugguggccggggacacacaggaaaccuucaaacuggaggaucuuccugacgacaugcugagcauggcuaugaagguuaauauguacuauaucaugugcaugauuaacuacgcggugacgugguccuucauccucugugcccugcugauugcucuccuguuuaagaaauaucagcaccgguuccuuaauuuuuacgccauguacugccacgagugugauauguaucaugaccgcagcggacugaaguacaacggcgauuucacaaauaaaugcagacaguguaccugcggccaauauggggacgccgcuggacuccugacccaccggaagacauacaacugccuuguccaguauaaaucuaaguggcugaccaacuuucucaucguguacauuauccugaugcugauuaaggauuccguccucaucgugcaugccgacggcacagauuucgaaaaauguagcggggaggcggacaucacguggaauugcaccggacccuuucugaaccuuggcaauugugaaaagaaacagaagaaagagucuuauaacaauauugcuacacaacugaaggggcucgaugccaucagcguucuggacauuccuaugaucuccaagauucccgaagauaucgccggagcucugcgcuucaucgaggagcagagaucuuaccacgugcagcuuaccgccgaauacgcuaugcucacacgguauugcgacuacuauacccaguuuacggacaacagcggcuacucccaaaccacauggagagucuaucugcgcagccaugauuucgaggccuguauucuguacccgaaucagcacuuuugccggugugugaaacacggcgacaagugcagcuccagcaacugggauuucgcgaaugaaaugaaaaacuauuacucugggaagcaguccaaauuugacaaggaucucaaucuggcccuuaugagccugcaucacgcuuucagaggaaccuccucuuucuacaucgccaagcuccugaaagagaagaaaaacgaagaccugguuacauaugcugagaagauuaaaggcaaguacccugggaaugcccuucucaaagcgaucauugauuauaucaaguacaugaaggaccugaccgagaugaacaauuuuaaacaugaugaaaugugggacgauuucaucuuugaggugcccccuacgaagucucccuccguccgccggcuggaaucuagcuaugacuucaaaacaaacgugaacuccaaucccagccacauuuguaagaacaucaaaaccgugguuugccucucuccuaaguccggagucagcuacgauucuauuaucgccuguggcgagccgucccagcccagcauuuauagaaagccugacucucaaguguuucagagcaaugcugaccagacacacuucugccuguccgauacccauugccuugaaaacuacgaggccgugggggaggaaaucaucgacgcuauuaaaaagagcaaauguugggagaccgaauuuacagaguacauccaguucaagcaaucugauggcguccgcuccugccggaugaaagacagcggagaguguacggugaccacaaauagauggcccauuauccugugcgauaacgacaaguuuuauuacuccgaacuccagaaggauuaugacaaagaucaggacauuggccacuucugucugucuccucgcugcaauaccauccggcaucccauuaacagaaagcacaucagcaauuguacauggcagguuucccauaacaauaucgauaaaauugaggugcacgaacuggaggaccuugaacaauacaagaaagccaucacccagaagcuccagacgucucugacacuguuuaaguauagcaaaaccaagaaccucccgcacauuaaaccuauguacaaguauaucaccauugaggggacagagaccgccgaaggaaucgaguccgcuuacaucgaaucugagauucccgcgcuggccggcacaagcaucggguucaaaauuacguccaagagcggaaaacaucuucuggaugucaucucuuacgugaaguccgcuagcuauucugccguuuacaccaagcucuauacaaccggcccuacaauuggggugaauaccaaacacgacgaacugugcacgggccccuguccugucaacgugccccauggaaccggcuggaucacauuugccaaggagcgcaccuccagcugggggugcgaggaguucggaugucuggcuaucucugacggcugcguuuucggguccugccaagauauuaucaaagacgaaauuacaguguaccggaaggaaaccgaggaaacaaccgaugucgagcuuugucucacguuugccgacaaaacauauugcaccaaucugaacgcgaucaccccgauuaucacagaucaguucgaggugcaguuuaagaccguggaggcuuacagccugccuagaauuaucgccguccggaaccacgaaaucaugguuggacagauuaaugacaucggcguguauuccaagggguguggcaacgugcaaaaagucaauaacacgaauuacggaaacggcgugcccaaguucgauuaccucugccaucuggccagccgcaaagaaguuauugugagaaaguguuuugacaaugauuaucaggcuugcaaauuccuucagacacccgccucuuaccggcuggaggaggaagggggaagcgucaccgugaucgacuauaagaagauucucggcacaaucaaaaugaaggcgauccugggggauguuaaauacaagaccuuugcugacaacguggaccugacagucgagggaguguguaccggcugcauuaauuguuucgaaaacauccacugcgagcuuacgauucacuccaccguugaagccucuuguccuguggucagcuccugcacaguguuucaugauagaauccugauuaccccgaaugagcacaaauaugccaucaaggugaucugcaacgagaagcccgggccuacacuccccuucaaaauuuguucugcuaagaccgacgccgcuaugacgcuggccgaugcgaaaccuauccucgaacuggcccccgucgaccagacaaccuacauuaaggagaaagaugaacgcugcaagacauggaugugucggguuagagacgagggcuuucaagugaucuucgaaccuuucaagaaucuuuuuggaagcuauauuggcaucuucuacaccuuuauuaucucccugauggcuaucuucauugugaucuacauuguccuccccaucugcuuuaaacugcgcgauacccugagacagcaugaggacgccuauaagcgggagaugaaaauucgcuga

SEQ ID NO: 14277 - RNA, 4323 nt, Artificial Sequence
  derived and/or modified CDS sequence (opt5) from TAHV(83)__GQ386825.1__GP
augauguucgugcuguuuuucaucgcccucagcgcugccucccccgucuaccagagaugcuuucaagacggcgcgauuguuaagcagaacccuucuaaacaggcugugaccgaggugugucugaaggaugacgucagcaugaucaaaacagaagcccgguauuuccgcaaugccacggggaccuacgcuaacaauguggccauuagaaaguggcuuguuuccgauuggcacgacugccggccgaaaaaggugucuggaggccauaucaacgucauugaggugggggaugaccugacacuccacaccgaggcuuauguuuguaaugccgauugcacaaucggaguggacaaggaaaccgcgcagguccgccugcaaacagauaccacgaaccauuuugaaaucgccggcaccacagugaaaagcgggugguucaaguccaccacauacauuacccuugaccagacgugugagcaccugaaagugucuugcggacccaagagcauccaguuucaugcuuguuucaaucagcacauguccugcgucagauuucuccaccggacaauucugccuggcagcaucgccucuuccauuugucaaaacguugagaucauuauccugaccgugcucacacugcuuaucuucauucugcucagcauccugucuaaaaccuauauuugcuacauccuuaugcccauuuuuaucccucuggcuuauaucuacggcgugauuuacaauaaguccuguaagaaaugcaagcucugcgggcuggucuaucaucccuucaccgaauguggaacacacugcguguguggcgcccgcuacgagacgagcgauagaaugaaacugcaucgggcgucugggcucugcccuggauauaagucccugcgcgccgcuagaguuauguguaaaagcaagggcccggccuccauccuuucuauuaucaccgcugugcugauucucacauuugucacccccaucaacgccaugguggccggggacacacaggaaaccuucaaacuggaggaucuuccugacgacaugcugagcauggcuaugaagguuaauauguacuauaucaugugcaugauuaacuacgcggugacgugguccuucauccucugugcccugcugauugcucuccuguuuaagaaauaucagcaccgguuccuuaauuuuuacgccauguacugccacgagugugauauguaucaugaccgcagcggacugaaguacaacggcgauuucacaaauaaaugcagacaguguaccugcggccaauaugaagacgccgcugggcuccugacccaccggaagacauacaacugccuuguccaguauaaaucuaaguggcugaccaacuuucucaucguguacauuauccugaugcugauuaaggauuccguccucaucgugcaugccgacggaacagauuucgagaaauguagcggcgaagcggacaucacguggaauugcaccgggcccuuucugaaccuuggaaauugugagaagaaacagaagaaagaaucuuauaacaauauugcuacacaacugaagggccucgaugccaucagcguucuggacauuccuaugaucuccaagauucccgaggauaucgccggggcucugcgcuucaucgaggaacagagaucuuaccacgugcagcuuaccgccgaguacgcuaugcucacacgguauugcgacuacuauacccaguuuacggacaacagcggauacucccaaaccacauggagagucuaucugcgcagccaugauuucgaaguguguauucuguacccgaaucagcacuuuugccgguguguuaaacacggcgacaagugcagcuccagcaacugggauuucgccaaugagaugaaaaacuauuacucuggcaagcaguccaaauuugacaaggaucucaaucuggcgcuuaugagccugcaucacgccuucagagggaccuccucuuucuacaucgcuaagcuccugaaagaaaagaaaaacgaggaccuggugacauaugccgagaagauuaaaggaaaguacccuggcaaugcccuucucaaagcuaucauugauuauaucaaguacaugaaggggcugaccgaaaugaacaauuuuaaacaugacgaggucugggaugacuucaucuuugaagugcccccuacgaagucucccuccgugcgccggcuggagucuagcuaugauuucaaaacaaacguuaacuccaaucccagccacauuuguaagaacaucaaaaccgucgugugccucucuccuaaguccggagugagcuacgacucuauuaucgcguguggcgaaccgucccagcccagcauuuauagaaagccugauucucaagucuuucagagcaaugccgaccagacacacuucugccuguccgacacccauugccuugagaacuacgagaccgugggggaagagaucaucgaugcuauuaaaaagagcaaauguugggaaacagaguuuacggaguacauccaguucaagcaaucugacggcguucgcuccugccggaugaaagauagcggagaauguaccgugacaaccaauagauggcccauuauccugugcgacaacgauaaguuuuauuacuccgagcuccagaaggacuaugauaaagaccaggauauuggccacuucugucugucuccucgcugcaauacaauccggcaucccauuaacagaaagcacaucagcaauuguaccuggcaggucucccauaacaauaucgacaaaauugaagugcacgagcuggaagaucuugagcaauacaagaaagccaucacgcagaagcuccagacaucucugacccuguuuaaguauagcaaaaccaagaaccucccgcacauuaaaccuauguacaaguauaucacaauugaggggaccgaaacagcugagggaaucgaauccgccuacaucgagucugaaauucccgcccuggcuggcacgagcaucggguucaaaauuaccuccaagagcggaaaacaucuucuggacguuaucggcuacgugaagucugcguccuauagcgccgucuacacaaagcucuauaccacagggccuaccauuggcgugaauacgaaacacgaugagcugugcaccggacccuguccuguuaacgugccccauggcacaggguggcugaccuuugcuaaggagcgcacaucuuccuggggaugcgaagaguucggcugucuugccaucagcgacgggugcgucuucggaucuugccaagacaucauuaaagaugaaaucaccguguaccggaaggagacagaagagaccacggacguggagcucugucugacauuugccgauaaaaccuauugcaccaaucugaacgcuauuacaccgaucauuaccgaccaguucgaaguccaguuuaagacgguugaggccuacucccucccuagaaucauugcggugcggaaccacgaaaucauggugggccagaucaaugauauuggggucuauagcaagggcuguggaaacgugcaaaaaguuaauaacacaaauuacggcaacggggugcccaaguucgacuaccugugccaucuugcuucccgcaaagaggucaucgugagaaaguguuuugauaaugacuaucaggccugcaaauuccugcagacccccgccagcuaccggcucgaggaagagggaggcucuguuacagugauugauuauaagaagauccuggggaccauuaaaaugaaggcuauccugggagacgucaaauacaagacauuugccgauaacguggaccuuaccguugaaggcguguguacggggugcaucaauuguuucgagaacauucacugcgaacugaccauccacagcacagucgaggcguccuguccuguggugucuagcugcaccgucuuucaugaccgcauucucaucacaccgaaugagcacaaauaugcuauuaagguuaucugcaacgaaaagcccggcccuacccugcccuucaaaaucuguuccgccaagacggaugccgcuaugacacucgccgacgcuaaaccuauucuggagcuugcccccguggaucagaccacauacaucaaggaaaaagacgagagaugcaagaccuggaugugucgggugagagaugaaggauuucaagucauuuucgagccuuucaagaaucuguuuggcucuuauaucgggauuuucuacaccuuuaucauuagccucauggcgaucuucaucgugauuuacaucguucugcccauuugcuuuaaacugcgcgacacacuuagacagcaugaggaugccuauaagcgggaaaugaaaauccgcuga

SEQ ID NO: 14278 - RNA, 4323 nt, Artificial Sequence
  derived and/or modified CDS sequence (opt5) from TAHV(89)__GQ386826.1__GP
augauguucgugcuguuuuucaucgcccucagcgcugccucccccgucuaccagagaugcuuucaagacggcgcgauuguuaagcagaacccuucuaaacaggcugugaccgaggugugucugaaggaugacgucagcaugaucaaaacagaagcccgguauuuccgcaaugccacggggaccuacgcuaacaauguggccauuagaaaguggcuuguuuccgauuggcacgacugccggccgaaaaaggugucuggaggccauaucaacgucauugaggugggggaugaccugacacuccacaccgaggcuuauguuuguaaugccgauugcacaaucggaguggacaaggaaaccgcgcagguccgccugcaaacagauaccacgaaccauuuugaaaucgccggcaccacagugaaaagcgggugguucaaguccaccacauacauuacccuugaccagacgugugagcaccugaaagugucuugcggacccaagagcauccaguuucaugcuuguuucaaucagcacauguccugcgucagauuucuccaccggacaauucugccuggcagcaucgccucuuccauuugucaaaacguugagaucauuauccugaccgugcucacacugcuuaucuucauucugcucagcauccugucuaaaaccuauauuugcuacauccuuaugcccauuuuuaucccucuggcuuauaucuacggcgugauuuacaauaaguccuguaagaaaugcaagcucugcgggcuggucuaucaucccuucaccgaauguggaacacacugcguguguggcgcccgcuacgagacgagcgauagaaugaaacugcaucgggcgucugggcucugcccuggauauaagucccugcgcgccgcuagaguuauguguaaaagcaagggcccggccuccauccuuucuauuaucaccgcugugcugauucucacauuugucacccccaucaacgccaugguggccggggacacacaggaaaccuucaaacuggaggaucuuccugacgacaugcugagcauggcuaugaagguuaauauguacuauaucaugugcaugauuaacuacgcggugacgugguccuucauccucugugcccugcugauugcucuccuguuuaagaaauaucagcaccgguuccuuaauuuuuacgccauguacugccacgagugugauauguaucaugaccgcagcggacugaaguacaacggcgauuucacaaauaaaugcagacaguguaccugcggccaauaugaagacgccgcugggcuccugacccaccggaagacauacaacugccuuguccaguauaaaucuaaguggcugaccaacuuucucaucggauacauuauccugaugcugauuaaggauuccgugcucaucguccaugccgacggcacagauuucgagaaauguagcggggaagcggacaucacguggaauugcaccggacccuuucugaaccuuggcaauugugagaagaaacagaagaaagaaucuuauaacaauauugcuacacaacugaaggggcucgaugccaucagcgugcuggacauuccuaugaucuccaagauucccgaggauaucgccggagcucugcgcuucaucgaggaacagagaucuuaccacguucagcuuaccgccgaguacgcuaugcucacacgguauugcgacuacuauacccaguuuacggacaacagcggcuacucccaaaccacauggagaguguaucugcgcagccaugauuucgaagccuguauucuguacccgaaucagcacuuuugccggugugucaaacacggcgacaagugcagcuccagcaacugggauuucgcgaaugagaugaaaaacuauuacucugggaagcaguccaaauuugacaaggaucucaaucuggcccuuaugagccugcaucacgcuuucagaggaaccuccucuuucuacaucgccaagcuccugaaagaaaagaaaaacgaggaccuggugacauaugcugagaagauuaaaggcaaguacccugggaaugcccuucucaaagcgaucauugauuauaucaaguacaugaagggacugaccgaaaugaacaauuuuaaacaugacgagaugugggaugacuucaucuuuggcguucccccuacgaagucucccuccgugcgccggcuggaaucuagcuaugauuucaaaacaaacgucaacuccaaucccagccacauuuguaagaacaucaaaaccguggugugccucucuccuaaguccgggguuagcuacgacucuauuaucgccuguggcgagccgucccagcccagcauuuauagaaagccugauucucaagucuuucagagcaaugcugaccagacacacuucugccuguccgacacccauugccuugaaaacuacgagaccgugggagaggaaaucaucgaugccauuaaaaagagcaaauguugggagacagaauuuacggaguacauccaguucaagcaaucugacggcgugcgcuccugccggaugaaagauagcggggaguguaccgucacaaccaauagauggcccauuauccugugcgacaacgauaaguuuuauuacuccgaacuccagaaggacuaugauaaagaccaggauauuggacacuucugucugucuccucgcugcaauacaauccggcaucccauuaacagaaagcacaucagcaauuguaccuggcaagugaaccauaauaacaucgacaaaauugagguucacgaacuggaggaucuugaacaguacaagaaagcuaucacgcagaagcuccagacaucccugacccuguuuaaguauucuaaaaccaagaaucucccgcacauuaaaccuauguacaaguauaucacaauugagggcaccgagacagccgaagggaucgagagcgccuacaucgaauccgagauucccgcucuggcgggaacgucuaucggcuucaaaauuaccagcaaguccgggaaacaucuucuggacgugaucggcuacgucaagagcgccucuuauuccgcuguguacacaaagcucuauaccacaggaccuaccauuggcguuaacacgaaacacgaugaacugugcaccgggcccuguccugugaaugucccccauagcacaggauggcugaccuuugccaaggagcgcacaucuuccuggggcugcgaggaguucgggugucuugccaucagcgacggaugcguguucggcucuugccaagacaucauuaaagaugaaaucaccguuuaccggaaggaaacagaggaaaccacggacguggagcucugucugacauuugcugauaaaaccuauugcaccaaccugaacgccgucacaccgauuaucaccgaccaguucgaggugcaguuuaagacgguggaagcguacucccucccuagaauuaucgcuguccggaaucacgagauuaugguugggcagaucaacgauaucggcguguauagcaagggauguggcaaugugcaaaaagucaacaauacaaacuacgggaauggagugcccaaguucgacuaccugugccaucuugccucccgcaaagaaguuauugugagaaaguguuuugauaacgacuaucaggccugcaaauuccugcagacccccgcuagcuaccggcucgaggaggaaggcgggucugucacagugaucgauuauaagaagauucugggaaccaucaaaaugaaggccauucugggcgacguuaaauacaagacauuugcggauaaugcugaccuuaccguggagggggucuguacgggcugcaucaacuguuucgaaaauauccacugcgagcugaccauucacagcacaguggaagccuccuguccuguugugucuagcugcaccgucuuucaugacagaauccucauuacaccgaacgagcacaaauaugccaucaaggugauuugcaaugagaagcccggaccuacccugcccuucaaaaucuguuccgcuaagacggaugccgcuaugacacucgccgacgcgaaaccuauccuggaacuugcccccguggaucagaccacauacauuaaggagaaaggcgaacgcugcaagaccuggaugugucgggucagagacgagggguuucaaguuaucuucgaaccuuucaagaaccuguuuggaucuuauauuggcaucuucuacaccuuuauuaucagccucauggcuauuuucaucgugaucuacauugugcugcccaucugcuuuaaacugcgcgauacacuuagacagcaugaggacgccuauaagcgggagaugaaaauucgcuga

SEQ ID NO: 14279 - RNA, 4323 nt, Artificial Sequence
  derived and/or modified CDS sequence (opt5) from TAHV(90)__GQ386827.1__GP
augauguucgugcuguuuuucaucgcccucagcgcugccucccccgucuaccagagaugcuuucaagacggcgcgauuguuaagcagaacccuucuaaacaggcugugaccgaggugugucugaaggaugacgucagcaugaucaaaacagaagcccgguauuuccgcaaugccacggggaccuacgcuaacaauguggccauuagaaaguggcuuguuuccgauuggcacgacugccggccgaaaaagguggcuggaggccauaucaacgucauugaggugggggaugaccugacacuccacaccgaagccuauguuuguaaugcggauugcacaaucggaguggacaaggagaccgcccagguccgccugcaaacagauaccacgaaccauuuugaaaucgcuggcaccacagugaaaucugggugguucaagagcaccacauacauuacccuugaccagacgugugagcaccugaaaguguccugcggacccaagucuauccaguuucaugccuguuucaaucagcacaugagcugcgucagauuucuccaccggacaauucugccuggcuccaucgcuagcucuauuugucaaaacguugagaucauuauccugaccgugcucacacugcuuaucuucauucugcucuccauccugagcaaaaccuauauuugcuacauccuuaugcccauuuuuaucccucuggccuauaucuacggcgugauuuacaauaagucuuguaagaaaugcaagcucugcgggcuggucuaucaucccuucaccgaauguggaacacacugcguguguggcgcgcgcuacgagacguccgauagaaugaaacugcaucgggccagcgggcucugcccuggauauaagucucugcgcgcugccagaguuauguguaaauccaagggcccggcuagcauccuuuccauuaucaccgccgugcugauucucacauuugucacccccaucaacgccaugguggcuggggacacacaggaaaccuucaaacuggaggaucuuccugacgacaugcugucuauggcgaugaagguuaauauguacuauaucaugugcaugauuaacuacgccgugacguggagcuucauccucugugcucugcugauugcccuccuguuuaagaaauaucagcaccgguuccuuaauuuuuacgccauguacugccacgagugugauauguaucaugaccgcuccggacugaaguacaacggcgauuucacaaauaaaugcagacaguguaccugcggccaauaugaagacgcugccgggcuccugacccaccggaagacauacaacugccuuguccaguauaaaagcaaguggcugaccaacuuucucaucggauacauuauccugaugcugauuaaggauucugugcucaucguccaugcggacggcacagauuucgagaaauguuccggggaagcugacaucacguggaauugcaccggacccuuucugaaccuuggcaauugugagaagaaacagaagaaagaaagcuauaacaauauugccacacaacugaaggggcucgaugccaucucugugcuggacauuccuaugaucagcaagauucccgaggauaucgcuggagcccugcgcuucaucgaggaacagagauccuaccacguucagcuuaccgcugaguacgccaugcucacacgguauugcgacuacuauacccaguuuacggacaacucuggcuacagccaaaccacauggagaguguaucugcgcucccaugauuucgaagcguguauucuguacccgaaucagcacuuuugccggugugucaaacacggcgacaagugcucuagcuccaacugggauuucgccaaugagaugaaaaacuauuacagcgggaagcagucuaaauuugacaaggaucucaaucuggcucuuaugucccugcaucacgccuucagaggaaccagcuccuucuacaucgcuaagcuccugaaagaaaagaaaaacgaggaccuggugacauaugccgagaagauuaaaggcaaguacccugggaaugcgcuucucaaagccaucauugauuauaucaaguacaugaagggacugaccgaaaugaacaauuuuaaacaugacgagaugugggaugacuucaucuuugaaguucccccuacgaagucucccagcgugcgccggcuggaguccucuuaugauuucaaaacagacgucaacagcaaccccucccacauuuguaagaauaucaaaaccguggugugccucagcccuaagucuggcguuuccuacgauagcauuaucgcuuguggggaaccgucucagcccuccauuuauagaaagccugacagccaagucuuucagucuaacgccgaccagacacacuucugccugagcgauacccauugccuugagaauuacgagaccgugggcgaagagaucaucgacgcuauuaaaaaguccaaauguugggaaacagaguuuacggaguacauccaguucaagcaaagcgauggagugcgcucuugccggaugaaagacuccggcgaauguaccgucacaaccaacagauggcccauuauccugugcgauaauaacaaguuuuauuacagcgagcuccagaaggacuaugauaaagaccaggauauugggcacuucugucuguccccucgcugcaauacaauccggcaucccauuaacagaaagcacaucucuaauuguaccuggcaagugaaccauaauaacaucgacaaaauugaaguucacgagcuggaagaucuugagcaguacaagaaagccaucacgcagaagcuccagacaagccugacccuguuuaaguauuccaaaaccaagaaucucccgcacauuaaaccuauguacaaguauaucacaauugagggaaccgaaacagccgagggcaucgaaucugcuuacaucgagagcgaaauucccgcgcuggccgggacguccaucggauucaaaauuaccucuaagagcggcaaacaucuucuggacgugaucggguacgucaaguccgcuagcuauucugccguguacacaaagcucuauaccacaggcccuaccauuggaguuaacacgaaacacgaugagcugugcaccggccccuguccugugaaugucccccaugggacaggauggcugaccuuugccaaggagcgcacauccagcuggggcugcgaagaguucgggugucuugcuaucucugacggaugcguguucggcuccugccaagacaucauuaaagaugaaaucaccguuuaccggaaggagacagaagagaccacggacguggagcucugucugacauuugccgauaaaaccuauugcaccaaccugaacgcggucacaccgauuaucaccgaccaguucgaagugcaguuuaagacgguggaggcuuacagccucccuagaauuaucgccguccggaaucacgaaauuaugguugggcagaucaacgauaucggcguguauucuaagggauguggcaaugugcaaaaagucaacaauacaaacuacgggaauggagugcccaaguucgacuaccugugccaucuugccucccgcaaagagguuauugugagaaaguguuuugauaacgacuaucaggcuugcaaauuccugcagacccccgccagcuaccggcucgaggaagagggcggguccgucacagugaucgauuauaagaagauucugggaaccaucaaaaugaaggcgauucugggcgacguuaaauacaagacauuugcugauaauguggaccuuaccgucgaagggguguguacgggcugcaucaacuguuucgagaauauccacugcgaacugaccauucacagcacaguugaggccucuuguccuguggucagcuccugcaccgccuuucaugacagaauccucauuacaccgaacgagcacaaauaugcuaucaaggugauuugcaaugaaaagcccggaccuacccugcccuucaaaaucuguucugccaagacggaugcugccaugacacucgcggacgccaaaccuauccuggagcuugcucccguggaucagaccacauacauuaaggaaaaagacgagcgcugcaagaccuggaugugucgggucagagaugaaggcuuucaaguuaucuucgagccuuucaagaaccuguuugggagcuauauuggaaucuucuacaccuuuauuaucucccucauggccauuuucaucgugaucuacauugugcugcccaucugcuuuaaacugcgcgacacacuuagacagcaugaggaugcuuauaagcgggaaaugaaaauucgcuga

SEQ ID NO: 14280 - RNA, 4323 nt, Artificial Sequence
  derived and/or modified CDS sequence (opt5) from TAHV(94)__GQ386828.1__GP
augauguucgugcuguuuuucaucgcccucagcgcugccucccccgucuaccagagaugcuuucaagacggcgcgauuguuaagcagaacccuucuaaacaggcugugaccgaggugugucugaaggaugacgucagcaugaucaaaacagaagcccgguauuuccgcaaugccacggggaccuacgcuaacaauguggccauuagaaaguggcuuguuuccgauuggcacgacugccggccgaaaaaggugucuggaggccauaucaacgucauugaggugggggaugaccugacacuccacaccgaggcuuauguuuguaaugccgauugcacaaucggaguggacaaggaaaccgcgcagguccgccugcaaacagauaccacgaaccauuuugaaaucgccggcaccacagugaaaagcgggugguucaaguccaccacauacauuacccuugaccagacgugugagcaccugaaagugucuugcggacccaagagcauccaguuucaugcuuguuucaaucagcacauguccugcgucagauuucuccaccggacaauucugccuggcagcaucgccucuuccauuugucaaaacguugagaucauuauccugaccgugcucacacugcuuaucuucauucugcucagcauccugucuaaaaccuauauuugcuacauccuuaugcccauuuuuaucccucuggcuuauaucuacggcgugauuuacaauaaguccuguaagaaaugcaagcucugcgggcuggucuaucaucccuucaccgaauguggaacacacugcguguguggcgcccgcuacgagacgagcgauagaaugaaacugcaucgggcgucugggcucugcccuggauauaagucccugcgcgccgcuagaguuauguguaaaagcaagggcccggccuccauccuuucuauuaucaccgcugugcugauucucacauuugucacccccaucaacgccaugguggccggggacacacaggaaaccuucaaacuggaggaucuuccugacgacaugcugagcauggcuaugaagguuaauauguacuauaucaugugcaugauuaacuacgcggugacgugguccuucauccucugugcccugcugauugcucuccuguuuaagaaauaucagcaccgguuccuuaauuuuuacgccauguacugccacgagugugauauguaucaugaccgcagcggacugaaguacaacggcgauuucacaaauaaaugcagacaguguaccugcggccaauaugaagacgccgcugcccuccugacccaccggaagacauacaacugccuuguccaguauaaaucuaaguggcugaccaacuuucucaucguguacauuauccugaugcugauuaaggauuccguccucaucgugcaugcggacgggacagauuucgagaaauguagcggagaagcugacaucacguggaauugcaccggccccuuucugaaccuugggaauugugagaagaaacagaagaaagaaucuuauaacaauauugccacacaacugaagggacucgaugccaucagcguucuggacauuccuaugaucuccaagauucccgaggauaucgcuggcgcccugcgcuucaucgaggaacagagaucuuaccacgugcagcuuaccgcugaguacgccaugcucacacgguauugcgacuacuauacccaguuuacggacaacagcggguacucccaaaccacauggagagucuaucugcgcagccaugauuucgaaguguguauucuguacccgaaucagcacuuuugccgguguguuaaacacggagacaagugcagcuccagcaacugggauuucgcgaaugagaugaaaaacuauuacucuggcaagcaguccaaauuugacaaggaucucaaucuggcccuuaugagccugcaucacgcuuucagaggcaccuccucuuucuacaucgccaagcuccugaaagaaaagaaaaacgaggaccuggugacauaugcugagaagauuaaagggaaguacccuggaaaugcccuucucaaagcgaucauugauuaugucaaguacaugaaggaccugaccgaaaugaacaauuuuaaacaugaugagaugugggacgauuucaucuuugaagugcccccuacgaagucucccuccgugcgccggcuggagucuagcuaugacuucaaaacaaacguuaacuccaaucccagccacaucuguaagaacauuaaaaccgucgugugccucucuccuaaguccggcgugagcuacgauucuaucauugccuguggggaaccgucccagcccagcaucuauagaaagccugacucucaagucuuucagagcaaugcugaccagacacacuucugccuguccgauacccauugccuugagaacuacgagaccgugggagaagagauuaucgacgccaucaaaaagagcaaauguugggaaacagaguuuacggaguacauucaguucaagcaaucugauggcguucgcuccugccggaugaaagacagcggggaauguaccgugacaaccaauagauggcccaucauucugugcgauaacgacaaguuuuauuacuccgagcuccagaaggauuaugacaaagaucaggacaucggccacuucugucugucuccucgcugcaauacaauucggcaucccaucaacagaaagcacauuagcaauuguaccuggcaggucucccauaacaauaucgauaaaaucgaagugcacgagcuggaagaccuugagcaauacaagaaagcuauuacgcagaagcuccagacaucucugacccuguuuaaguauagcaaaaccaagaaccucccgcacaucaaaccuauguacaaguauauuacaaucgagggaaccgaaacagccgagggcauugaauccgccuacaucgagucugaaauccccgcucuggcggggacgagcauuggauucaaaaucaccuccaagagcggcaaacaucuucuggauguuauuggguacgugaagucugccuccuauagcgcugucuacacaaagcucuauaccacaggaccuaccaucggcgugaauacgaaacacgacgagcugugcaccgggcccuguccuguuaacgugccccauggcacaggauggcugaccuuugccaaggagcgcacaucuuccuggggcugcgaagaguucgggugucuugccauuagcgacggaugcgucuucggcucuugccaagauaucaucaaagacgaaauuaccguguaccggaaggagacagaagagaccacggauguggagcucugucugacauuugcugacaaaaccuauugcaccaaucugaacgccaucacaccgauuaucaccgaucaguucgaaguccaguuuaagacgguugaggcguacucccucccuagaauuaucgcugugcggaaccacgaaauuaugguggggcagaucaaugacaucggagucuauagcaagggcugugggaacgugcaaaaaguuaauaacacaaauuacggcaacggagugcccaaguucgauuaccugugccaucuugccucccgcaaagaggucauugugagaaaguguuuugacaaugauuaucaggccugcaaauuccugcagacccccgcuagcuaccggcucgaggaagagggcgggucuguuacagugaucgacuauaagaagauucugggaaccaucaaaaugaaggccauucugggcgaugucaaauacaagacauuugcggacaacguggaccuuaccguugaagggguguguacgggaugcgucaauuguuucgagaacauccacugcgaaagcaccauccacuccacaguggaggcuucuuguccugugauuagcuccugcaccgucuuucaugauagaauccugauuacaccgaaugagcacaaauaugccaucaagguuauuugcaacgaaaagcccggcccuacccuccccuucaaaaucuguucugccaagacggacgcugccaugacacuggcugaugccaaaccuauccucgagcuggcgcccguggaccagaccacauacauuaaggaaaaagaugagcgcugcaagaccuggaugugucgggugagagacgaaggguuucaagucaucuucgagccuuucaagaaucuuuuuggcagcuauauuggaaucuucuacaccuuuauuaucucccugauggccauuuucaucgugaucuacauuguucuccccaucugcuuuaaacugcgcgauacacugagacagcaugaggacgcuuauaagcgggaaaugaaaauucgcuga

SEQ ID NO: 14281 - RNA, 4323 nt, Artificial Sequence
  derived and/or modified CDS sequence (opt5) from TAHV(XJ0625)__EU622819.2__GP
augauguucgugcuguuuuucaucgcccucagcaccgcuucccccgucuaccagagaugcuuucaagacggcgccauuguuaagcagaacccuucuaaacaggcggugacagaggugugucugaaggaugacgucagcaugaucaaaacggaagcucgguauuucaagaaugccaccgggacauacgccaacaauguggcuauucgcaaauggcuuguuuccgauuggcacgacugcagaccgaagaagguggccggaggccauaucaacgucauugaggugggggaugaccugacccuccacacagaggcuuauguuuguaaugccgauugcaccaucggaguggacaaagaaacagcgcagguccggcugcaaaccgauacgaccaaccauuuugaaaucgccggcacaaccgugaagucugggugguucaaaagcacaaccuacauuacgcuugaccagacaugugagcaccugaagguguccugcggacccaaaucuguccaguuucaugcuuguuucaaucagcacaugagcugcguucgcuuucuccacagaaccauccugccuggcuccauugccagcucuaucugucaaaacguggagauuaucauucugacagugcucacccugcuuaucuucauccugcucuccauucugagcaagaccuauaucugcuaccuucugaugcccauuuuuaucccucucgcuuaugucuacggcgugauuuacaauaagucuuguaaaaagugcaaacugugcgggcugguuuaucaucccuucacagaauguggaacgcacugcguguguggcgcccgguacgagaccuccgaucgcaugaagcuccauagagcgagcgggcugugcccuggauauaaaucucuucgggccgcucgcgucauguguaaguccaaaggcccggccagcauccuguccgugaucacagcuguucucauucugaccuuugugacacccaucaacgccauggucgccggggacacccaggaaacguucaaacuugaggaucugccugacgacaugcucucuauggcuaugaagauucagauguacuauaucaugugcauugugaauuacaucgucacauggagcuucaucgugugugcgcugauuaucgcccugauuuuuaaaaaguaucagcacagauuccucaacuuuuacgcuauguacugccacgagugugauauguaucaugaccgguccggacugaaauacaauggcgauuucaccaacaagugccgccaauguaccugcggccaguaugaagacgccgccgggcuucugacacacagaaaaaccuacaauugccucguucaguauaagagcaaguggcuggugaacuuucuuaucauuuacauccugcucaugcuggucaaagauucugugcugauuguucaagcugagggaacagacuucgaaaaguguuccggcgagaucaacaucacguggaauugcaccgggcccuuucucaaccugggaaauugugaaaagaagcagaaaaaggagccuuauagcaacauugccacacagcuuaagggccuggaugcgaucucuauucucgacauccccaugauuagccggaucccggaggauaucgcuggggcccugcgcuucauugaggaacaaaauuccuaccaugugcagcugaccgccgaauacgcuaugcuuacaagauauugcgacuacuauacccaguuuucugauaacagcggauacucccagaaaacguggcgggucuaucucagaagccacgacuucgaggccuguauccuguacccuaaucagcauuuuugccgcugugugaagcacggcgacaaauguucuuccagcaacugggauuucgcuucugaaaugaagaauuauuacaccggcaaacaacugaaguuuaacaaggaccucaaucuggcccuuauguccuuccaccaugcguuccgggggacaagcuccuuuuacguggccaaacugcucagagagaagaacaaugaggaacugguuaacuauaccgagaaaauuaaggauaaauaccccggaaaugcucugcuuaaggccaucauugacuauaucaaauacaugaagaaccucucugaaaugacaaacuucaagcacgaugagaugugggacgauuuugucuucaauagcccucccaccaaaucccccucugugcgccggagcgacuccgcuuaugauuuuaagaacaauaucaacagcaauccuucucauauuugccagaacaucaaaacggugauuugccugucccccaagagcggcgucucuuacgacuccaucauugccuguggggaacccagccagccuacaaucuauaaaaagcccgagucuagaguguuccagagcaaugcggaucaaacccacuuuugccuggccgacacacacugccucgagaacuacgaaaccguuggagaggaaauccuggaugcuauuaagaaauccaaguguugggagaccgacuucacagaguacauccaguuuaaacagagcgacggcgugcgcucuugccggaugaaggauuccggggaauguacggucaccacacauagauggccuauuauccuuugcgacaauaacaaauucuauuacagcgagcugcagaaggauuaugacaaggaucaagacauuggccacuuuugucucuccccgcgcugcaauaccauccggcauccgauuaaccagaaacacaucucuaauuguacauggcaagugagccauaacaauaucgaaaagauugagguucacgaacuggagaaccuggagcaguacaaaaaggccaucacccagaaacuucagacgucccucacacuguucaaguauucuaagaccaaaaaccugccucacauuaagcccauguacaaauauaucaccauugaaggaacagagaccgcugaaggcaucgagagcgccuacaucgaauccgagauuccugcccucgcugggacaucuaucggauuuaagauuacgagcaaauccggcaagcaucugcuugaugugaucggguacgucaaaagcgcgucuuauuccgccguguacaccaagcuguauacaaccggacccacaauuggcguuaauaccaagcacgacgagcucugcacggggccuugucccgugaacgucccgcauggcaccggauggcugacauucgcuaaagaaagaaccagcucuuggggcugcgaggaguucgggugucuggccaucuccgauggaugcguguuuggcagcugccaggacaucauuaaggaagaacuugccguguaccgcaaagagacagaggaaaccacagaugucgagcucugucugaccuucgcugacaagacguauugcacaaaucugaacgccaucaccccuauuaucaccgaucaauuugaaguucaguucaaaacaguggagucuuacucccucccccggauuaucgcggugagaaaucacgagauuauggucgggcagaucaacgacaucggaguguauagcaagggcugugggaauguucagaaggugaacaauaccaacuacggcaauggaguccccaaauuugacuaccugugccaucuugcuucccggaaggaagugauuguucgcaaauguuucgauaacgacuaucaagccugcaaguuucugcagacgccugccagcuacagacucgaggaagagggcgggucugugacagucaucgauuauaaaaagauucugggaaccaucaagaugaaagcuauucugggcgacgugaaguacaaaacauucgccgauaauguugaccuuaccguggaaggggucuguacaggaugcaucaacuguuuugagaauauccacugcgagcugaccauucacagcacgguggaagcguccuguccggugaccucuagcugcacagucuuccaugaucggauccucauuacccccaacgagcacaaguaugcuaucaaaguuauuugcgccgaaaagccuggccccucccugcaguuuaagaucuguaacgccaaaacagacgcugccaugacccucgcugaugccaagccuauccuggagcuugcgcccguggaccagacgacauacauuaaagaaaaggaugugagaugcaaaaccuggaugugucgcguccgggacgaggggcugcaagugaucuucgagccuuucaagaaucucuuuggcucuuauauuggaaucuucuacacauuucugauuacccugaucgccguuuucguggucauuuacaucgugcuucccaucugcuuuaagcugagagacacccuccgccagcaugaagaugcuuauaaaagagagaugaagauucgguga

SEQ ID NO: 14282 - RNA, 4323 nt, Artificial Sequence
  derived and/or modified CDS sequence (opt5) from TAHV(XJ0708)__HM243138.1__GP
augauccuggugcucgucuucguugcccugagcgcugccucccccguguaccagagaugcuuucaagacggcgcgauugugaagcagucuccuagcaaacaggcugucaccgaggugugucuuaaggaugacguuuccaugaucaaaacagaagcccgguauuucaagaacgccacggggaccuacgcuaauaacguggccauucgcaaauggcuggucucugauuggcacgacugcagaccgaagaagaucagcggaggccauauuaaugugaucgagguuggggaugaccucacacugcacaccgaagcguauguguguaacgccgauugcaucauuggagucgacaaagagacagcucaggugcggcuucaaaccgauacaaccaaucauuuugaaaucgccggcacgaccgugaaguccgggugguucaaaucuacaaccuacauuacacuggaccagaccugugagcaccucaaggucagcugcggacccaaauccauccaguuucaugcuuguuucaaccagcacaugagcugcguucgcuuucugcacagaacgauucugccuggcucuaucgccuccagcauuugucaaaauguggagaucaucauucucacagugcugacccuucugaucuucauucuccugucuauccuuuccaagacauauauuugcuacauccugaugcccaucuuuauuccucucgcuuaugucuacggcgugaucuacaacaagagcuguaaaaagugcaaacugugcgggcugguuuaucaucccuucaccgaauguggaacccacugcguguguggcgcccgguacgagacaucugaucgcaugaagcuccauagagcguccgggcugugcccuggauauaaaagccuucgggccgcucgcgucauguguaaguccaaaggcccggccucuauucugagcaucauuacggcugugcucauccugaccuuuguuacacccaucaaugccaugauugccggggaaacccaggagacauucaaacuugaggaccugccugaugacaugcucuccauggcuaugaagcugaacauguacuaucugaugugcaucgugaauuacauugucaccuggagcuuuaucauuugugcgcucaucauugcccugaucuucaaaaaguaucagcacagauuccuuaacuuuuacgcuauguacugccacgaaugugacauguaucaugaucggucuggacugaaauacaauggcgacuucacgaacaagugccgccaguguacaugcggccaauaugaggaugccgccgggcuccugacccacagaaaaaccuacaauugccuugugcaguauaaguccaaguggcuggucaacuuucucaucguguacauucugcugaugcucguuaaagacagcauccugauugugcaggcugaaggaacagauuucgacaaguguucuggcgaggccgggaucauuuggaacugcaccggacccuuucuuaaucugggcaacugugaaaagaagcagaaaaaggagagcuauaauaacaucgcgacacaacucaaggggcugaaugcuaucuccguccuggauauuccuaugaucucucggauucccgaggacaucgccggagcccuucgcuucauugaagaucagaacagcuaccaugugcagcucacggcugaguacgccaugcugaccagauauugcgacuacuauacacaauuuuccgauaauagcggcuacucucagaccacauggcggguuuaucugagaucccacaacuucgaggcuuguauccucuacagcaaucagcauuuuugccgcugugugaaacacggcgacaaguguucuuccagcaacugggacuucgccaaugagaugaaaaacuauuacuccgggaagcagucuaaauuuaauaaggaucugaaccuugcgcugaugagccuccaccaugccuuccggggaaccuccucuuuuuacaucgcuaagcugcugagagaaaagaagaaugaggagcuuauuaacuaugucgaagagaucaaaaagaaauacccgggcaacgcccuccugaaggcugugauugacuauaucaaauacaugaagaaucugacggaaauggccagcuucaagcacgaugagaugugggacgaguucguguaugaauccccucccacccgcagcccuucugcgcggagauccgagagcgaauacgauuuuaaaacaaacguuaauucuaagcccacccaugucugcaaaaacauuaagacaguggugugccucucccccaaaagcggggucucuuaugacagcaucaucgccuguggagagccuggccaaccguccguguaccgcaagcccgaacagcagguuuuccagagcaaugcugaucaaacccacuuuugccugcuugacacgcacugccuggagaacuacacaaccgugaaugaugagauucucgacgccaucaagaaaucucgguguugggaaacagaguucaccgaauauauucaguuuaagcagggggauggcgucagauccugccgcaugaaagacagcggagagugugcuguggccgccaaccgguggccuaucauucugugcgauaauaacaaguucuacuauuccgaacugcagaaagacuacgacaaggaucaagacaucggccauuuuugucuuucucccagaugcaauaccauucgccacccuaucaaccagaagcauaucagcaauuguacauggcagguuucccacaacaauauugagaaaaucgaggugcaugaacucgagaaccuggaacaauauaagaaagcuauuacgcagaagcugcagaccucucucacacuguucaaauacagcaagaccaagaaccuuccccacaucaaaccgauguauaaguacauuacaaucgaggggaccgaaacggcggagggaaucgaguccgccuacauugaaucugagaucccugcucuggccggcacaagcauuggguuuaaaaucaccuccaagagcggaaaacaccuccuggaugucauuggcuaugugaagucugccuccuacagcucuguuuauacccggcuguacacaaccgggcccacaaucggcaucaauacgagacaugacgaacuuugcaccggaccuugucccgugaacgucccucacaauacaggcuggcucaccuucgcuaaagagcggacauccagcugggggugcgaagaguuuggaugucuggccauuucugauggcugcguguucggguccugccaggacaucauuaaggaggaacugaccguguaucgcaaggagacggaagagaccacagaugucgagcucugucugaccuuugcggacaaaacauacugcaccaaccuuaaugcuaucacacccauuaucaccgaucaauucgaaguucaguucaagacgguggaggccuauagccugccgagaauuaucgccgugcggaaccaugaaauccucgucggacagauuaaugaccugggcguguacuccaaaggguguggcaacguucagaaggugaauaaaacaaacuacggaaauggcgucccuaaguuugauuaucugugccaccuugcuagcagaaaggaggugaucguucgcaaauguuucgacaacgauuaccaagccugcaaguuucugcagacccccgcgucuuaucggcucgaagaggaagggggaaccgugacagucauugacuacaaaaagauccugggcaccauuaaaaugaaggcuauccucggggacgugaaguauaaaacguucgccgauaauguugaccugacaaucgaaggaguguguaccggcugcauuaacuguuuugagaauauccauugcgaacuuacaauucacagcaccgucgaggccuccugucccaucauuucuagcugcacaguguuccacgauagaauccugaucaccccuaacgaacauaaguacgcuauuaaagugaucugcaacgagaagccgggguccucucucagcuuucgcgucuguaauacgaaaaccgacgccgcuaugacacugaccgaugccaagcccauucuggagcuugcgccuguugaccagacagccuauaucaaggaaaaagaugagagaugcaagaccuggaugugucgggugcgcgacgaaggccuccaggugauuuucgagcccuuuaaaaaccuguucggauccuacaucggcaucuuuuacacguucauucugucucucaucgcuauuuucaucauuaucuauauuguccugccuaucugcuuuaaacuuagagauacacugcggcaacacgaagacgccuacaaacgcgagaugaagaucagauga

SEQ ID NO: 14283 - RNA, 4323 nt, Artificial Sequence
  derived and/or modified CDS sequence (opt5) from TAHV(XJ0710)__HM243141.1__GP
augauguucgugcuguuuuucaucgcccucagcgcugccucccccgucuaccagagaugcuuucaagacggcgcgauuguuaagcagaacccuucuaaacaggcugugaccgaggugugucugaaggaugacgucagcaugaucaaaacagaagcccgguauuucaagaaugccacggggaccuacgcuaacaauguggccauucgcaaauggcuuguuuccgauuggcacgacugcagaccgaagaagguggcuggaggccauaucaacgucauugaggugggggaugaccugacacuccacaccgaagccuauguuuguaaugcggauugcacaaucggaguggacaaagagaccgcccagguccggcugcaaacagauaccacgaaccauuuugaaaucgcuggcaccacagugaagucugggugguucaaaagcaccacauacauuacccuugaccagacgugugagcaccugaagguguccugcggacccaaaucuguccaguuucaugccuguuucaaucagcacaugagcugcguucgcuuucuccacagaacaauccugccuggcuccauugcuagcucuaucugucaaaacguggagauuaucauucugaccgugcucacacugcuuaucuucauccugcucuccauucugagcaagaccuauaucugcuaccuucugaugcccauuuuuaucccucucgccuaugucuacggcgugauuuacaauaagucuuguaaaaagugcaaacugugcgggcugguuuaucaucccuucaccgaauguggaacacacugcguguguggcgcgcgguacgagacguccgaucgcaugaagcuccauagagccagcgggcugugcccuggauauaaaucucuucgggcugcccgcgucauguguaaguccaaaggcccggcuagcauccuguccaucauuaccgccgugcucauccugacauuuguuacccccauuaacgccaugguggcuggggacacacaggaaaccuucaaacuugaggaucugccugacgacaugcucucuauggcgaugaagauccagauguacuauauuaugugcaucgucaauuacaucgugacguggagcuucauugucugugcccugaucauugcucugaucuuuaaaaaguaucagcacagauuccucaacuuuuacgccauguacugccacgagugugauauguaucaugaccgguccggacugaaauacaauggcgauuucacaaacaagugccgccaauguaccugcggccaguaugaagacgccgcugggcuucugacccacagaaaaacauacaauugccucgugcaguauaagagcaaguggcugguuaacuuucuuauuaucuacauucugcucaugcuggugaaagauucuguccugaucgugcaagccgagggaaucgacuucgaaaaguguuccggcgagauuaacaucaccuggaauugcacagggcccuuucucaaccugggaaauugugaaaagaagcagaaaaaggagccuuauagcaacauugcgacgcagcuuaagggccuggaugcuaucucuauucucgacauccccaugaucagccggauuccggaggauaucgccggggcccugcgcuucauugaggaacaaaauuccuaccauguucagcugaccgcugaauacgccaugcuuacaagauauugcgacuacuauacccaguuuucugauaacagcggauacucccagacaaccuggcggguguaucucagaagccacgacuucgaggcuuguauccuguacccuaaucagcauuuuugccgcugugucaaacacggcgacaaguguucuuccagcaacugggauuucgccucuaaaaugaagaauuauuacacgggcaaacaacugaaguuuaacaaggaccucaaucuggcgcuuauguccuuccaccaugccuuccgggggaccagcuccuuuuacguggcuaaacugcucagagaaaagaacaaugaugagcuggugaacuauacagagaaaauuaagaauaaauaccccggaaacgcccugcuuaaggcuaucaucgacuauauuaaauacaugaagucucucagcgaaaugaccaacuucaagcacgaugagaugugggacgauuuuguuuucaauuccccucccacaaaaucucccagcguccgccgguccgacagcgccuaugauuuuaagaacaauaucaacucuaauccuucccauauuugcaaaaacaucaagaccguggugugccugagcccgaaaucuggcgucuccuacgacagcauuaucgcguguggggaacccucucagccuacgaucuauaagaagcccgagagcagaguguuccaguccaaugccgaucagacacacuuuugccuggcugacacccacugccucgaaaacuacgagacaguuggagaggaaauucuggaugccaucaaaaagagcaaauguugggagaccgacuucaccgaauacauucaauuuaagcagucugacggcgugcgcuccugccggaugaaagauagcggggaguguacagucacgaccaauagauggccuaucauucuuugcgacaacaauaaguucuauuacuccgagcugcagaaggauuaugacaaagaucaggacaucggccauuuuugucucucuccccgcugcaacacaauucggcacccgaucaaucaaaagcauaucagcaacuguaccuggcaagugucccacaauaacauugaaaagaucgagguucaugaacuggagaaccuggaacaguacaagaaagcuauuacacagaaacuucagaccucucucacgcuguucaaguauagcaaaacaaagaaucugccucacaucaaacccauguacaaguauauuaccaucgagggaaccgagacagccgaaggcaucgaguccgccuacauugaaucugagaucccugcucucgcggggaccagcauuggauuuaaaaucacauccaagagcggcaaacaucugcuugaugugauuggguacgucaagucugccuccuauagcgcuguguacacgaagcuguauaccacaggacccaccaucggcguuaacacaaaacacgacgaacucugcaccgggccuugucccgugaaugucccgcacggcacgggauggcugaccuucgccaaggagagaacaucuuccuggggcugcgaggaguucgggugucuggccaucagcgauggaugcguguuuggcucuugccaggacauuaucaaagaagaacuugcuguguaccgcaaggagaccgaagaggccacagaugucgagcucugucugaccuucgcggacaaaacauauugcaccaaccugaaugcuauuacgccuaucauuacagaucaguuugaaguucaauucaagaccguggaguccuacagccucccccggaucauugccgugagaaaccaugaaaucauggucgggcagaucaaugacauuggaguguauuccaagggcugugggaacguucagaaagugaauaacaccaauuacggcaacggaguccccaaguuugacuaccugugccaccuugccagccggaaagaggugaucguucgcaaguguuucgauaaugacuaucaggcuugcaaauuucugcaaaccccugccucuuacagacucgaggaagagggcgggagcgugacagucauugauuauaagaagauccugggaacgauuaaaaugaaggcgauccugggcgacgugaaauacaagacauucgcugauaacguugaccuuaccguggaaggggucuguacaggaugcaucaauuguuuugagaacauucauugcgaacugaccauccacuccacaguggaggccucuuguccggugaccagcuccugcacggucuuccacgaucggauucucaucacccccaacgagcauaaauaugccauuaagguuaucugcgcugaaaagccuggccccucucugcaguuuaaaaucuguaaugccaagacagacgcugccaugacccucgcggaugccaaaccuauucuggagcuugcucccguggaccagacaaccuacaucaaggaaaaagaugagagaugcaagacguggaugugucgcgugcgggacgaagggcugcaggucauuuucgagccuuucaagaaccucuuuggcagcuauaucggaauuuucuacacauuucugaucacccugauugccguguucaucguuaucuacauugugcuucccaucugcuuuaaacugagagacacacuccgccaacacgaggaugcuuauaagagagaaaugaaaauucgguga

SEQ ID NO: 14284 - RNA, 4326 nt, Artificial Sequence
  derived and/or modified CDS sequence (opt5) from TVTV__AF123491.1__GP
augaucguguucgcccugcucaccauugucgcugccagccccguuuacaagagaugcuuucaggacggcgcgaucgugcggcaagaguauuccaaaaacgcugugacagaagucugucugaaggaugacgugucuaugauuaaaacggaggccgaauacuucaagaauagcaccgggguguuuuccaaaaacaucgccuaucgcaaguggcuugugucugauuggaaugagugcagaccucaaaagagcgcuaacggacacauuaaugucaucgaagugcagccggaccugucccuccagacaaacucuuacguuugugccgcuaccugcgugaucagcauugauaaagagacagcccaaguccggcugcagaccgacacaaccaaucauuucgagaucuccggcacgaccguuaagagcgggugguuuaaaucuacaaccuaucuuacacuggaucagaccugugaacaccucaagauuuccugcggaagcaaaucugugcagcugcaugcguguuucaaccaacacauguccugcguccgcuuucugcauagaacgauccuccccggcaagcaccgcaagagcauuugucagaauaucgagauuaucauccugacaucucuuucccuguucauuuuucucuuccugaccaucauuagcaaaacauacaucugcuauguucuuauuccuaucuuuauccccauugccuacguguacggguucaucuauaacaaguccuguaaaaagugcaaacugugcggacucguguaccacccuuuuaccgaauguggcucucauugcgucuguggcgcuaaguaugacaccagcgaucggaugaaaaugcacagauccagcgggcugugccccggauacaagucucugcgggccgcucgcuccauguguaagagcaaaggcccugccccgauucucucucugcuuagcgcggugcugauccucacauucguuacgcccauuaccgccaucucccugaaggacgaggagaaagaaacauauaaacuuccugagcugcccgaugacaaagugaaucucgaaaccaagaucgaucuguacuuccagaugugccugauuaacuaugcuacaaccugggcccucaucuuuuguguccugauuacggcuugccuuuucaagaaacugcagcauaaguuucucgacuacuacgccguguauugucacgagugcgacauguaccacgaaaagacaucucugaaguauaauggggauuucagcaacaaauguagacaauguaccugcgagcaguacgaggacgccaccggacuucugacacaucggaaguccuauaaucgccucguucaguacaaggcuaaauggacccugaacuuucugaucacauaugcgauucucgugaucauuaaggauagcgucaugaucgugggcgccucuaacacggacgucaaagauugccuggaccaagaagagaucaccuggaauugcacagggccuuuccuuaacaugggaagauguacccggccccagaagaaagaaaauuacggcaacauugcuacacagcugaagggccucgaugugcuguccgcccuggacaugccggccguugggaagaucccugaggauauugcuggagcccuuagcuacaucgaaucuaaaaagaccuaucacgagcagcucacgcuggaguuugcgaugcugacccgcuacugcgacuucuauaaacaauacgcugauaauuccggcuauagccagacaaccuggagagccuacauucggucccaugacuuugggguguguaucauguaucccaaccagcacuucugcagaugugucaagaugggagaaaaaugcacaucuagcaauugggacuuugccaaccagauggcuaauuacuacaacggcaagcaaaaucgcuucaacaaagaucucaaucuggcccuuuauaccaugcaucacgcuuuucggggguccacgucuuaccugaucagcaaggugcuccacgagaagaaauaugaccagcugacaaaccugcuuacccagcucaagacaaaauacccuggaaaugcccugcugaaggcgcucauuggcuaucagaucuaccugaaaucccuuagcgaaaugucuuccuucacccccgaugagcugugggacgaucuccaauauguucccgccccuaccuucaagccgaaccugggcagaagcggggacaacgaauacaaguuugauaaaucucgcauuguggacccccagacaacguguaccucccugaagggagucaauugccuuagcccucggucuagagcuagcguguccgauaucauugccuguggccaggcuacacagcccgcccucuucuacgugccuaacgacaaaauccaucaaagcaauaccgaucagaaccaguauugcaucggggacucucacugccugacaaaguuuacccccauuacggaggagcugcucgcggccguuaaaaaguccaagugucaggcuuucgaucuggacaauaucgucaaaacaagcaccuccaccggagugcgcucuugccuugugaagaaauuuggcaacuguaauacaaccaaccaggucuggccgauuacaaucugcagcgacgaucaguacuauuacacggacaccaagcaguccuaugauucuuaccaagacauugggcauuucugucugagcccucggugcuccacaaucagauaucccgugaauccuaaacaccucucugccuguaccuggacagaagaguacacccccguugauaagaucagcgugacgaacauugaagagaucgagcaguacaagaaagcucugcugcagaaacuucagaccggccucaauauuuuuaaguaucgcaagacauccaaccugccucacaucaaaagcauguacaaguauauuaccguccaaggaacaggcaccgccgaagggguggagaaugccuacaucgaaucugagaugcccgcucuggcgggauccagcucuggcuucaaaguucucuccaaggaagggaaccaucuguuugacguggucgccuauauuaagagcgcuucuuacuccagcguguauaauaaacuuuacuccacaggaccgacccugggcaucaacguuaagcacgaugagaaaugcacggggccuugucccgccaacaucccccauaagacaggcuggcucaccuucgcccgggagagaaccagcacauggggacgcgaagaguacggcugccuggcuauuucugacggguguguguuuggaagcugccaggauaucauuaaaccugaaaugaccgucuaucggaagcagacggacgagaucgugacaguggaacugugccuuaccuucgucgauaagacauacuguaccgagcugaaugccguuacaccgauuaucuccgaccucuuugaggugcaguucaaaaccguggaaucuuauagccugcccaagaucgucgcgauuaaaaaccaccaaaucuucgugggccagauuaauguuaucgggacgaacuccaagggaugcggcaaugugcaggucuuuaacgggaccaauuacggcucuggaacaccuagauucgauuaucucugucaucuggcuagccggcgcgaggugauuaugagaaaaugcuuugacaacgacuaccaagccuguaaguuccuucagcagcccuccucuuuucggcuggaagaggaaggcgagaccguuacaaucaucgauuauaagaaaauucucgggaccaucaagaugaaagccauuuucggagacgugaaguacagaacguuuagcgagaaagucgauaucaaugcugaaggcgugugcgccggguguauuaacugcuucgagcgcaucaauugugaauuuacaauucacuccaccguugagacaagcugcccucugguggcggacugucagcuguuccacgaucggcuucugaucacccccaacgagcauaaguacgcuaucaaggccauuugcaaagacaagccuucuaauacccucagauuuuccaucugcaacacaaaagucgaagccacggugaccauuaucgaugcuaagcccauucuggagcucgccccgguggaccaaacagcuuauaucaaagaaaaggaugagcgcuguaagaccuggcugugcagagucaaagacgaaggaguugccgugcuucuggagccuuucaagaaucucuucggcagcuacaucgggaucuuuuauggcauuauucuggugguccuggcgauccuuguguguauuuacaucguucugcccgugugcuucaaaaucaaggauacacucaaaaagcacgaggacgccuauaaacgggaaaugaagauucgcuga

SEQ ID NO: 14285 - RNA, 4335 nt, Artificial Sequence
  derived and/or modified CDS sequence (opt5) from TVTV(AR42)__KX891322.1__GP
augagaaacaugaucguguucgcccugcucaccauugucgcugccagccccguuuacaagcggugcuuucaggacggcgcgaucgugcgccaagaguauuccaaaaaugcugugacagaagucugucugaaggaugacgugucuaugauuaaaacggaggccgaauacuucaagaacagcaccgggguguuuuccaaaaauaucgccuauagaaaguggcuugugucugauuggaacgagugccggccucaaaagagcgcuaauggacacauuaacgucaucgaagugcagccggaccugucccuccagacaaauucuuacguuugugccgcuaccugcgugaucagcauugauaaagagacagcccaaguccgccugcagaccgacacaaccaaccauuucgagaucuccggcacgaccguuaagagcgggugguuuaaaucuacaaccuaucuuacacuggaucagaccugugaacaccucaagauuuccugcggaagcaaaucugugcagcugcaugcguguuucaaucaacacauguccugcgucagauuucugcaucggacgauccuccccggcaacauugccaauagcaucugucagaacauugagaucaucauucugacaucucuuucccuguucaucuuucucuuccugaccauuaucagcaagacauacauuugcuauguucuuaucccuaucuuuauucccaucgcuuacguguacggguucauuuauaauaaguccuguaaaaagugcaaacugugcggacucguguaccacccuuuuaccgaauguggcucucacugcgucuguggcgccaaguaugacaccagcgaucgcaugaaaaugcauagauccagcgggcugugccccggauacaagucucugcgggcugcccgcuccauguguaaaagcaagggcccugcgucuauccucagccugcuuuccgccgugcugauucucacauucguuacgccgaucaccgcuaucucucugaaggacgaggagaaagaaacauauaaacuuagcgagcugcccgaugacauggugaaccucgaaaauaaaauugaucuguacuuccagaugugccugaucaacuaugccaccacaugggcucucaucuuuugugcccugauuaccgccugccuuuucaagaaacugcagcacaaguuucucgacuacuacgcugucuauugucaugagugcgacauguaccacgaaagacgggggcugaaguauaacggagauuucuccaauaaaugucgccaaugcacgugcggccaguacgaggacgcgacagggcuucugacccacagaaagagcuauaacugucucgugcaguacaaagccaaguggaugcugaauuuucugauuaccuaugcuauccucguuauuaucaaagauucugugaugaucgucggagccuccgacacagaugugaaggacugccuggaucaagaggaaauuaccuggaacuguacaggcccuuuccuuaauaugggcagcugcacgcggccccagaagaaagagaacuacgggaauaucgccacccagcugaagggacucgacguccugucugcucuggauaugccugccgugggcaaaauucccgaagacaucgcgggggcucuuuccuacauugagagcaagaaaacauaucaugaacagcucacccuggaguuugccaugcugacacgcuacugugauuucuauaagcaauacgccgacaacuccggauauucucagaccacguggagagcuuacauccggagccacgacuuuggcguuugcaucauguauccgaaucagcauuucuguagaugcgugaagaugggggagaaauguaccuccucuaacugggauuuugccaaucagauggcuaacuacuacaauggaaagcaaaaccgcuucaauaaagaccucaaccuggcccuuuauacaaugcaccaugcguuucggggcagcaccuccuaccugauuagcaagguccuccacgaaaagaaguaugaucagcugacaaaccugcuuacccagcucaaaacgaaguacccuggcaaugcccugcugaaggcucucaucgacuaucagauuuaccugaaaucucuuuccgagaugagcucuuucacacccgaugaacugugggacgaucuccaauaugugccugcccccaccuucaagcccaaccuggggagauccgaggacaaugaauacaaauuugauaagagccgcaucguugacccucagacaaccugcaccucucugaaaggagugaacugucuuagcccgcgguccagagcuagcgucucugauauuaucgccugcggccaggcgacacagcccgcccucuucuacgugccuaaugacaagauccaccaauccaacacggaucagaaucaguauugcauuggggacagccauugucugaccaaguuuacacccaucaccgaggagcugcucgcugccgugaaaaaguccaaaugccaggcuuucgaccuggaugacauuguuaagacaucuccuagcaccggaguccgcuccugucuugugaaaaaguuuggcaacugcaauacgacaaaccagguguggcccaucaccauuuguucugaugaccaguacuauuacaccgauacaaagcagagcuaugacuccaaucaagauaucgggcacuucugccugucuccgcgguguagcaccaucagauacccugucaaccccaaacaucucuccgccugcacauggacggaagaguauaccccuguggacaagauuagcguuacaaauaucgaagagauugagcaguacaaaaaggcccugcugcagaaacuucagaccggccucaacaucuuuaaguacaagaaaacaucuaaucugccccacauuaagccuauguauaaauacaucaccgugcaaggaacggaaaccgcugagggcgucgaaaacgcguauauugaguccgaaaugcccgcccuggcugggucuagcuccggauucaaggugcucagcaaagagggcaaccaccuguuugauguuguggccuacaucaagucugccuccuauagcuccgucuacaauaaacuuuauagcacagggccgacccugggaaucaacgugaagcaugacgagaaguguacaggcccuugccccgcuaauauuccccacaaaaccggguggcucacauucgcccgcgaacggaccucuacguggggcugugaggaauacggaugccuggcgaucagcgauggcugcguuuuuggguccugucaggacauuaucaagccugagaugacaguguacagaaaacagaccgaugaaauugucaccguggagcugugccuuacauucguggacaagaccuauuguacggagcugaacgcugucacaccgaucaucucugaccucuuugaaguucaguucaaaaccguggagagcuacucccugcccaagauuguggccaucaagaaucaucaaauuuucgucggacagaucaacgauauuggcacauauucuaaagggugcggaaaugugcagguuuuuaacggcaccaauuacgggagcggcacaccucgcuucgacuaucucugucaccuggccucccggaaggaagugaucaugagaaaaugcuuugauaacgacuaccaggcuuguaaguuccuucaacagcccucuagcuuucggcuggaggaagagggagagaccgucacgaucauugauuauaaaaagauccucggcaccauuaagaugaaagccaucuucggggacgugaaguacaaaacauuuuccgaaaagguugauauuaaugcggagggagugugcgcuggcuguaucaacugcuucgaaagcauuaauugugaguuuaccauccauucuacagucgagaccuccugcccucugguggccgacugccagcuguuccacgaucgccuucugaucacgcccaacgaacacaaauacgccauuaaggcuaucuguaaggacaaaccuagcaauacacucagauuuucuauuugcaacaccaagguugaggccacagugaccaucauugaugcuaaacccauccuggaacucgccccggucgaccaaaccgcguauaucaaggagaaagacgaacgguguaagacauggcugugcagagugaaggaugaggggguggccguccuucuggagccuuucaaaaaccucuucggauccuacauuggcaucuuuuaugggauuauccugguugugcuggcuauucuuguguguaucuacaucguccugcccgugugcuucaagauucgcgacacgcucaaaaagcaugaagaugccuauaaacgggagaugaagaucagauga

SEQ ID NO: 14286 - RNA, 4335 nt, Artificial Sequence
  derived and/or modified CDS sequence (opt5) from TVTV(Eklund)__KR149248.1__GP
augagaaacaugaucguguucgcccugcucaccauugucgcugccagccccguuuacaagcggugcuuucaggacggcgcgaucgugcgccaagaguauuccaaaaaugcugugacagaagucugucugaaggaugacgugucuaugauuaaaacggaggccgaauacuucaagaacagcaccgggguguuuuccaaaaauaucgccuauagaaaguggcuugugucugauuggaacgagugccggccucaaaagagcgcuaauggacacauuaacgucaucgaagugcagccggaccugucccuccagacaaauucuuacguuugugccgcuaccugcgugaucagcauugauaaagagacagcccaaguccgccugcagaccgacacaaccaaccauuucgagaucuccggcacgaccguuaagagcgggugguuuaaaucuacaaccuaucuuacacuggaucagaccugugaacaccucaagauuuccugcggaagcaaaucugugcagcugcaugcguguuucaaucaacacauguccugcgucagauuucugcaucggacgauccuccccggcaacauugccaauagcaucugucagaacauugagaucaucauucugacaucucuuucccuguucaucuuucucuuccugaccauuaucagcaagacauacauuugcuauguucuuaucccuaucuuuauucccaucgcuuacguguacggguucauuuauaauaaguccuguaaaaagugcaaacugugcggacucguguaccacccuuuuaccgaauguggcucucacugcgucuguggcgccaaguaugacaccagcgaucgcaugaaaaugcauagauccagcgggcugugccccggauacaagucucugcgggcugcccgcuccauguguaaaagcaagggcccugcgucuauccucagccugcuuuccgccgugcugauucucacauucguuacgccgaucaccgcuaucucucugaaggacgaggagaaagaaacauauaaacuuagcgagcugcccgaugacauggugaaccucgaaaccaaaauugaucuguacuuccagaugugccugaucaauuaugccacaaccugggcucucaucuuuugugcccugauuacggccugccuuuucaagaaacugcagcacaaguuucucgacuacuacgcugucuauugucaugagugcgacauguaccacgaaagacgggggcugaaguauaacggagauuucuccaacaaaugucgccaaugcacaugcggccaguacgaggacgcgaccgggcuucugacccacagaaagagcuauaauugucucgugcaguacaaagccaaguggaugcugaacuuucugauuacauaugcuauccucguuauuaucaaagauucugugaugaucgucggagccuccaauaccgacgugaaggauugccuggaccaagaggaaauuacauggaacuguacgggcccuuuccuuaauaugggccggugcacccgcccccagaagaaagagaacuacgggaauaucgccacacagcugaagggacucgauguccugagcgcucuggacaugccugccgugggcaaaauucccgaagauaucgcgggggcucuuucuuacauugaguccaagaaaaccuaucaugaacagcucacacuggaguuugccaugcugaccagauacugugacuucuauaagcaauacgccgauaacagcggauauucccagacgaccuggcgggcuuacaucagaucucacgacuuuggcguuugcaucauguauccgaaucagcauuucugucgcugcgugaagaugggggagaaauguacaagcuccaacugggacuuugccaaucagauggcuaacuacuacaauggaaagcaaaaccgguucaauaaagaucucaaccuggcccuuuauaccaugcaccaugcguuuagaggcucuacaagcuaccugauuuccaagguccuccacgaaaagaaguaugaccagcugaccaaccugcuuacgcagcucaaaacaaaguacccuggcaaugcccugcugaaggcucucaucgauuaucagauuuaccugaaaagccuuucugagauguccagcuucacccccgacgaacugugggaugaccuccaauaugugccugcccccacauucaagcccaaccuggggcgcucugaggauaaugaauacaaauuugacaagucccggaucguugauccucagacaaccugcaccagccugaaaggagugaacugucuuucuccgagaagccgcgcuuccgucagcgacauuaucgccugcggccaggcgacgcagcccgcccucuucuacgugccuaaugauaagauccaccaaucuaacaccgaccagaaucaguauugcauuggggauucccauugucugacaaaguuuacccccaucacagaggagcugcucgcugccgugaaaaagagcaaaugccaggcuuucgaccuggacaacauuguuaagaccuccccuucuacgggaguccggagcugucuugugaaaaaguuuggcaauugcaacacaaccaaucagguguggcccaucaccauuuguuccgaugaccaguacuauuacacagauaccaagcagucuuaugacagcuaccaagauaucgggcacuucugccuguccccgagauguucuacaauccgcuauccugucaaccccaaacaucucagcgccugcacguggaccgaagaguacacaccuguggacaagauuuccguuaccaauaucgaagagauugagcaguacaaaaaggcccugcugcagaaacuucagacaggccucaacaucuuuaaguaucggaagaccagcaaucugccccacauuaaaccuauguacaaguauaucacggugcaaggaaccgaaacagcugagggcgucgaaaacgcguacauugagucugaaaugcccgcccuggcuggguccagcucuggauucaaagugcucuccaaggagggcaaccaccuguuugauguuguggccuauaucaaaagcgccucuuacuccagcgucuauaauaaacuuuacuccaccgggccgacacugggaaucaacgugaagcaugacgagaaguguaccggcccuugccccgcuaauauuccccacaagacaggguggcucaccuucgccagagaacgcacgagcacauggggcugugaggaauacggaugccuggcgaucucugauggcugcguuuuugggagcugucaggacauuaucaaaccugagaugaccguguaucggaagcagaccgaugaaauugucacaguggagcugugccuuaccuucguggacaaaacguacuguacagagcugaacgcugucaccccgaucaucuccgaucucuuugaaguucaguucaagacaguggagucuuauagccugcccaaaauuguggccaucaagaaucaucaaauuuucgucggacagaucaacgacauuggcaccuacuccaaggggugcggaaaugugcagguuuuuaacggcacaaauuaugggucuggcaccccuagauucgacuaccucugucaccuggccagccggaaagaagugaucaugcgcaagugcuuugauaacgacuaucaggcuuguaaauuccuucaacagcccuccucuuuuagacuggaggaagagggagagacggucaccaucauugauuacaagaaaauccucggcacaauuaagaugaaggccaucuucggggacgugaaauacaagaccuuuagcgaaaaaguugauauuaaugcggagggagugugcgcuggcuguaucaacugcuucgaauccauuaauugugaguuuacaauccauagcaccgucgagacgucuugcccucugguggccgacugccagcuguuccacgaucggcuucugaucacacccaacgaacacaaguaugccauuaaagcuaucuguaaggacaagccuuccaauacccucagauuuagcauuugcaacacaaaaguugaggccaccgugaccaucauugaugcuaagcccauccuggaacucgccccggucgaccaaacagcguacaucaaagagaaggaugaacgcuguaaaacguggcugugccgggugaaggacgaggggguggccguccuucuggagccuuucaagaaccucuucggaucuuauauuggcaucuuuuacgggauuauccugguugugcuggcuauucuuguguguaucuauaucguccugcccgugugcuucaaaauuaaggacacccucaaaaagcaugaagaugccuacaaaagagagaugaagauccgcuga

SEQ ID NO: 14287 - RNA, 4335 nt, Artificial Sequence
  derived and/or modified CDS sequence (opt5) from JCV(3324-04)__HM007357.1__GP
auggaggugcugaaccucaucuggcugcuuacccugugccucgccagccccgucuuccagagauguuuucaagacggcgcuauuguuaagcagaauccuuccaaagaagccgugacagaggugugccugaaggaugacgucucuaugaucaaaacggaagcgaaguacgugaaaaacaccacagggaccuucgcuaauaacauugccaugcggaaguggcuuguugccgauuggcacgacugucgcccgcagaaaagcuccggaggccauaucaaugugauugaggucggggaugaccugucucuccacacagaaagcuauaucugcuccgcugauugugugaucaccguugacaaagagacagcccagauuagacugcaaaccgauaacacgaaucauuuugagguggcuggaaccacagucaagucuggcugguucaaaagcaccacauacaucacccuggaccagacgugcgaacaccucaagguguccugugggcccaaaagcauucaguuucaugccugcuucaaccagcacaugucuugugugcgguuucugcaccgcacaauccuuccuggauccauugcgaauagcaucugccaaaacauugagaucaucauucuggucacccucucucugguuaucuucauuuuucuuacaaucguguccaagaccuauauuuguuaccugcucaugcccaucuucaucccuauugccuuuaucuauggcuggauuuacaauaagagcugcaaaaagugcaaacuguguggccugguguaucaucccuucaccgaaugcgggacacacugugucugcggagcuagauacgagacgucugaucggaugaagcuccaucgcgccuccggccuguguccuggguacaaaagccuuagagcugcccgggugaugugcaaguccaaaggaccggcgucuguucugagcaucaugaccgccgugcucauucugacauuugucacccccaucuccgcuauggugaucggcgagagcucugaaauuuauacacuugaggaccugccugaugacaugguucagauggccgaacgcaucaacauuuacuaucagaucauuaucauuaauuacgggaucaccugggcuuuccuccugcugggacuccugcuugccuauuucuuuagaaaguaccagcaccgguuccuggacuuuuaugccauguacugugaggaaugcgauauguaccacgagaaggcuggccucacgcauuggggcgacuucacaaacaaaugucgccaaugcaccugugggcaguaugaggauaucaccggacugauggugcacaagaaauccuacaauugccuugucaaguauaaagcgaaguggauuagagacauccugauuacauaccucgugaucauucuggucaaggauagccugcucuuugugggcgccaccgggacagacuucgcuacgugcaucgaugaaaagaccguuacauggaacuguaccggacccuuucugaaccuuggccggugcgacaagucucagaaaaagacaaauuaugccgauaucgccaaccaacugaaagggcucggagugauuagcguccuggacaucccuaugauuaagaagaugcccgaugagaucuccggcucucugaaauacauugacaaucuugaaaccuaucaugagcagcucacggcugaauacgccuuccugacccgcuacugugacuauuacacacaguauaccgauaacagcggcuacucccagacaguguggagaaccuaucugcggagccacgacuuuggggcgugcguuguguacccgaaucaacauuucuguagaugcgucaaguauggagauaaauguaacucugcuaagugggacuuugccaaugagaugaaaacguucuacacaggccagaaggccaaguuuaacaaagaucucaaucuggcccuucuggugcuccacaaggcuuuccgcgggaccggaacagcuuacaucgccgaggcgauggcccggaaagacaacggcuccauggcucacuucgcccuggaagugagaaagaaauuuccuaccaaugcucugcuugccgcgcucaucgauuauauuguuuaccugcagagccuggccgagaucucuaccuucgaacucgacgaggauugggaagacuuuaaguauaaacccgagccuacagaguccacgauucaggcucgcagccaucgggaugaccaauacaacuucaagaaugccgcuuccgggucuaacgucaaggugugcaaaaauauccagaaggugcuguguauuagccccagaucccgcgccaaauuugaaaacaucaucgccugcggcgagcacgcuaaccccucugucuauaugaugccuaaugugagcauuuaccaguccagcucugaacggucccauuauuguaucgcggauagccacugccuugaggaguacgaaguuguggagaccgaacugcucaacgcccugaagaaaucuaagugcugggucaaggagauggacgacgugauucugcacaaacaguccgauggacuuagaagcugucgcaugaaggacacaggcaauugcaacguucaagaaaaugauuggaacaucgugcucugugagaaugggaacuacuauuacucugagauucauaaagacuaugauaaggaccaggaugucggacacuucugccugagcccgcgguguaauaccaucagauaccccauuuccaaacgccauauccggagcugcaacuggcagaucucucacuccacaauugacaagaucgcugugcaggaacuggccgauauugagcaauauaagaaagccaucagccagaagcuccagaccucccugucuauuuuuaaauacaucaagacgaaaaaucuuccucauaucaagcccgcuuauaaguacauuacaguugaaggcguggagaccgucgaagggaucgagaacgccuucauugagagcgaaaucccugcgcuggcuggaaccgccauuggcuuuaaaaucaauuccagagaggggaacuaccucauggacgugaucggcuaugugaagucugccagcuacuccgcuacauauaccaaacuguacacaacgggacccaccauuggcaucaauacacggcacgaugaaaaguguaccgggccgugcccugccgucauugaccacaaagauggauggcugacauucucuaaggagcgcaccagcacguggggcugugaagaguuugggugccuugcgguuuccgacggauguguguucggcagcugccaagacaucauuaaagaugagcucgcuguguauagaaagaccacagaagaacugaccacagucgaacugugccucaccuuuucugacaagacauacuguaccaaccugaacgccaucacgcccauuaucacagauaaauucgaggugcaguucaagaccguugaggccuauacccuuccucggaucauugcugugaaaaaucaugaaaucaaggucgggcagauuaacgaccugggcguguacuccaaaggaugcggcaauguucagaaggugaacgggacaaauuacggaaacggcgcccccagauuugauuaucucugucaccuggcuagccgcaaggaggucauccugcggaaaugcuucgacaaugauuaccaagccuguaaguuucuucagucuccuuccagcuauagacuggaggagcaucaggggaccgugacgguuauugacuacaaaaagauccucggaacaaucaaaaugaaggcgauucugggcgaugugaaguauaaaaacuuccagucuaauaucgaaauuaacgccgaggggaccugcgcuggcuguaucaauugcuuugagaacauucacugugaguucacaauccauaccacagucgaaaccuccugccccaucgugacggacugugugagcuuucacgaucgcauucucaucaccccggacgaacacaaguacgcccugaaagucguuugccaagacaagccuaaagugucccuuaaguucaagauuugcaauacaaacaucgaugcuagcaugaccauuguggacucuaaacccauccuggagcucgcccccgucgaucagacagccuauauuagagaaaaggacgagcgguguaaaaccuggaugugccgcgugagagaugagggauuucagguuauccuggaaccuuucaagaaucuguuuggcagcuacaucgggauuuucuacacgggaauccuuuccauuaucugucugcucauugugaucuauaucauucugccgaucugcuucaaacuccgggacacacugcgccagcaugaggaugcuuacaagaaggaaaugaaaauuagauga

SEQ ID NO: 14288 - RNA, 4335 nt, Artificial Sequence
  derived and/or modified CDS sequence (opt5) from JCV(61V2235)__U88058.1__GP
auggaggugcugaaccucaucuggcugcuugcccugugcagcgcuucccccgucuuccagagauguuuucaagacggcgccauuguuaagcagaauccuucuaaagaagcggugaccgaggugugccucaaggaugacgucagcaugaucaaaacagaagcuaaguacgugaaaaacacgaccgggacauucgccaauaacauugccaugcggaaguggcugguugcugauuggcacgacugucgcccgcagaaguccucuggaggccauaucaaugugauugaggucggggaugaccuuagccugcacaccgaauccuauaucugcucugccgauugugugaucacaguugacaaagagaccgcucagauuagacuccaaacagauaacaccaaucauuuugagguggccggaacgaccgucaagagcggcugguucaaauccacaaccuacaucacacuggaccagaccugcgaacaccugaaggugagcugugggcccaaaucuauucaguuucaugcgugcuucaaccagcacauguccugugugcgguuucuccaccgcacgauccugccuggaagcauugccaauucuaucugccaaaacauugagaucaucauucuugucacacugucccucguuaucuucauuuuucugagcaucgugucuaagaccuauguguguuaccuucugaugcccauuuucacaccuaucgcuuuuaucuauggcugggucuacaauaaguccugcaaaaagugcaaacucuguggccugguguaucaucccuucaccgaaugcgggacccacuguguuugcggagccagauacgagaacagcgaucggaugaagcugcaucgcgcuuccggccucuguccuggguacaaaucucugagagccgcgcgggugaugugcaagagcaaaggaccggccuccauucuuagcaucaugacagcuauucugauccucacguuugucacccccauuucugccauggugaucggcgaguccagcgaacuguauacacuugacgaucugccuaaugacaugguucagauggcugagcgcgugaacaucuacuaucagauuaccaucauuaauuacggggucacaugggccuucuucugucucggacugauccuggccuacuuuuucaagaaguaucagcacaaauuucucgacuucuaugcuauguacugcgaagagugugauauguaccacgaaaagucuggccugacccauuggggcgacuuuacgaacaaaugcagacaauguacaugcgggcaguucgaggauguggcgggacuuaugauucacaagaaaagcuauaacugccuggucaaguacaaggccaaauggauccgggacauucucaucaucuaucuggcuaugauucuuaucaaggauucccugcucuuugugggcgccucugggaccgacuucgccgcuuguauugaugagaaaguugugaccuggaauugcacaggacccuuucugaaccugggccgcugugacaagagccagaaaaaggccuccuacgcggggaucgcugaucaacucaagggacugggcgucauuagcgugcuugacaucccuaugaucaaaaauaugcccgaugaaauuucuggcucccugaaguauaucgacagccucgagaccuaccaugaacagcugacagccgaguaugccuuccugacgagauacugcgacuacuauacccaguacacagauaaaucuggguauucccagaccguuuggcggacauaccuucgcagccacgacuuuggagcuuguguggucuauccgaaccaacauuucugcagaugugugaaguacggcgauaaaugcaauuccgccaagugggacuuugcuaacgaaaugaagaccuucuauacggggcagaaagugaaguucaauaaagaucucaaccuggcccugcucguucugcacaaggcguuucggggaaccggcacagccuacgucgcugaggccauggcuagagaggacaaugggucuauggcccacuucgcgcuugaaauucgcaaaaaguuuccuaccaacgcccugcucgcugcccugaucgauuacauuguguaucugcagagccuuggcgagaucgcuacauucgaacucgacgaggauugggaagacuuuaaauacaagcccgagccuaccgaguccacgccccaggugcggucucauagaaaugaucaauauaacuucaagaaugccgaaagcaacuccgacacaaaagucuguaagaaugugcagaaaguucugugcaucagcccccgcucuaaggccaaauuugagaacauuaucgcuuguggagaacacgcgaacccuuccguguacaugaugccgaaugucagcauuuaucagucuaacuccgagcggagccauuacugcaucgccggcucucacugccuggagaaguaugaagugguugagaccgaacuccugaaugcucuuaagaaaagcaaguguugggccaaagagauggaugacauuauccugcacaagcaguccgacgggcucagaagcugccgcaucaaagauacaggaaacuguaaugugcaagaaaacgacuggaccauuguccugugcgagaauggcaacuacuacuauucugaggugcauaaggauuacgacaaggaucaggacguugggcacuucugucugucccccagaugcaccacaaucagauauccuauuagcaaacgccauaucaagaaaugugaauggcagauuucccacucuacgaucgauaagauuagcgugcaggagcuugccgacaucgaacaauacaaaaaggcuaucucccagaagcuccagaccucucugagcauuuuuaaauauguccggacaaagaaucugccccauaucaaaccugccuacaaguauauuaccguggagggaguggaaacaaucgagggcauugagaacgcguucaucgaauccgagauccccgcucucgccgggaccgccauuggcuuuaaaaucaauucuagagaaggaaacuaccugauggaugucauuggcuacguuaagagcgcuuccuauagcgccguguacacgaaacuuuauacaaccgggccgaccaucggaauuaauacaaagcacgacgagaagugcaccggcccuugucccgcgaucaucgaucacaaagacggguggcugacauucucuaaggaacgcacguccaccuggggaugcgaggaguuuggcugucucgcugugagcgaugggugcgucuucggcucuugccaagacauuaucaaagacgaacuggccguguaccggaagacaaccgaggaacugacaaccguugagcuuugucucacguucuccgauaaaaccuauugcacaaaccugaaugccauuaccccuaucauuacagacaaguuugaggugcaguucaagaccgucgaaagcuacacacugcccagagugaucgcuauuaaaaaccaugagaucaagguuggacagaucaacgaucucggcguguauucuaaaggguguggaaauguccagaaggugaacggcaccaauuacgggaacggauccccucgguuugacuaccugugccaccuugccagccgcaaagaaguuauucugagaaaguguuucgauaaugacuaucaggcuugcaaguuucuccaaucccccagcucuuaccggcuggaggaacaucagggcacggugacagucaucgauuauaaaaagauucuggggaccaucaaaaugaaggccauucuuggcgacgugaaauacaagaacuaucagaauaacaucgagaucagcgcggagggaaccugugccggcugcauugauuguuucgaaaauauccacugcgaguuuacaauucauaccacgguggaggcuuccuguccgaucacaaccgaaugcgucucuuuccacgaccggauucugaucacaccugaugaacacaaguacgcccucaaaaucguuugccaugacaagcccaaagugagccugaaguuuaaaauuuguaacacccacguggacgcugccaugacaaucgucgauuccaagcccauucucgagcuggccccuguggaccaaaccacguauauccgcgagaaggaugaacggugcaaaaccuggauguguagaguucgcgacgagggguuccaggugauucuugaaccguuuaagaaucuguucggaucuuacaucggcauuuucuacacagggauccucagcaucauuugccugcugaucgucguguauauuauccuucccauuuguuuuaaacugagagauacccuccggcagcaugaggacgcuuacaagaaagaaaugaagauccgcuga

SEQ ID NO: 14289 - RNA, 4335 nt, Artificial Sequence
  derived and/or modified CDS sequence (opt5) from JCV(61V2235)__HM007351.1__GP
auggaggugcugaaccucaucuggcugcuugcccugugcagcgcuucccccgucuuccagagauguuuucaagacggcgccauuguuaagcagaauccuucuaaagaagcggugaccgaggugugccucaaggaugacgucagcaugaucaaaacagaagcuaaguacgugaaaaacacgaccgggacauucgccaauaacauugccaugcggaaguggcugguugcugauuggcacgacugucgcccgcagaaguccucuggaggccauaucaaugugauugaggucggggaugaccuuagccugcacaccgaauccuauaucugcucugccgauugugugaucacaguugacaaagagaccgcucagauuagacuccaaacagauaacaccaaucauuuugagguggccggaacgaccgucaagagcggcugguucaaauccacaaccuacaucacacuggaccagaccugcgaacaccugaaggugagcugugggcccaaaucuauucaguuucaugcgugcuucaaccagcacauguccugugugcgguuucuccaccgcacgauccugccuggaagcauugccaauucuaucugccaaaacauugagaucaucauucuugucacacugucccucguuaucuucauuuuucugagcaucgugucuaagaccuauguguguuaccuucugaugcccauuuucaucccuaucgcuuuuauuuauggcugggucuacaauaaguccugcaaaaagugcaaacucuguggccugguguaucaucccuucacagaaugcgggacccacuguguuugcggagccagauacgagaccagcgaucggaugaagcugcaucgcgcuuccggccucuguccuggguacaaaucucugagagccgcgcgggugaugugcaagagcaaaggaccggccuccauccuuagcauuaugacagcuauccugauucucacguuugucacccccaucucugccauggugaucggcgaguccagcgaaguuuauacacuggacgaucuuccuaacgacauggugcagauggcugagcgcgucaauauuuacuaucagaucauuaucauuaacuacggggugaccugggccuuccugcuccugggacugauccucgccuauuucuuuaagaaguaccagcacaaauuccuggacuuuuaugcuauguacugugaagagugcgauauguaccacgaaaagucuggccuuacacauuggggcgacuucaccaauaaauguagacaaugcacgugugggcaguuugaggaugucgcgggacugaugauucacaagaaaagcuauaacugccucgugaaguacaaggccaaauggauccgggacauccugauuaucuaucuugcuaugauucugaucaaggauucccuccuguucguuggcgccucugggacagacuuugccgcuugcauugaugagaaaguggucaccuggaacuguaccggacccuuccugaaucucggccgcugcgacaagagccagaaaaaggccuccuacgcggggaucgcugaucaacugaagggacuuggcgugaucagcguucuggacauuccuaugaucaaaaacaugcccgaugaaauuucuggcucccucaaguauaucgacagccuggagacauaccaugaacagcugaccgccgaguaugccuuucuuacaagauacugugacuacuauacgcaguacaccgauaauucuggguauucccagacaguguggcggaccuaccuccgcagccacgacuucggagcuugcgucguguauccgaaccaacauuuuuguagaugcgugaaauacggcgauaaguguaauuccgccaaaugggacuucgcuaacgaaaugaagacauuuuauaccgggcagaagguuaaauucaauaaggaucugaaccuggcccuccugguccuucacaaagcguuccggggaacgggcaccgccuacguggcugaggccauggcuagaaaggacaaugggucuauggcccacuuugcgcuggagauucgcaaaaaguucccuacaaacgcccuccuggcugcccugaucgauuacaucguguaucuucagagccucggcgaaauugcuaccuuugagcuggacgaagauugggaggacuucaaauacaagcccgaaccuacagaguccacgccccagguccggucucauagaaaugaucaauauaacuuuaagaaugccgagagcaacuccgacaccaaagugugcaagaauguucagaaagugcuguguaucagcccccgcucuaaggccaaauucgaaaacauuaucgcuugcggagagcacgcgaacccuuccgucuacaugaugccgaaugugagcauuuaucagucuaacuccgaacggagccauuacuguaucgccgauucucacugccucgagaaguaugagguuguggaaacagagcugcuuaaugcucugaagaaaagcaagugcugggccaaagaaauggacgacaucauucuccacaagcaguccgauggccugagaagcugucgcaucaaagacaccgggaacugcaauguccaagagaacgauuggacaauugugcugugugaaaauggaaacuacuacuauucugagguucauaaggacuacgauaaggaccaggaugugggccacuuuugccuuagcccccgguguaccaccaucagauauccuauuagcaaacgccauaucaagaaaugcgaguggcagauuucccacucuacaaucgacaagaucagcguccaggaacucgccgauauugagcaauacaaaaaggcuaucucccagaagcugcagacgucucugagcauuuucaaauaugugcggaccaagaaucucccccauaucaaaccugccuacaaguauauuacaguggaaggggucgagaccaucgaaggaaucgagaacgcguuuauugaguccgaaauccccgcucuggccggcacagccauuggguucaaaaucaauucuagagagggcaacuaccuuauggacguuauuggauacgugaaguccgcuuccuauagcgccguguacaccaaacuguauacgacaggcccgaccaucgggaucaauaccaagcacgaugaaaaguguacaggaccuugccccgcgauuaucgaccacaaagauggcuggcucaccuuuucuaaggagcgcacauccacgugggggugugaagaguucggaugccuggcugucagcgacggcuguguguuugggucuugccaagacauuaucaaagaugagcuggccguuuaccggaagaccacagaagaacuuaccacaguggaacucugccugaccuucuccgacaaaacguauuguaccaaccugaaugccauuacaccuaucauuaccgauaaguucgagguccaguuuaagacaguggagagcuacacccuccccagaguuaucgcuaucaaaaaccaugaaauuaaggugggccagaucaacgaccugggagucuauucuaaaggcugcgggaaugugcagaagguuaacggaacaaauuacggcaacggguccccucgguucgauuaccuuugucaccuggccagccgcaaagaggugauucucagaaagugcuuugacaaugauuaucaggcuuguaaguuccugcaaucccccagcucuuaccggcuggaggagcaucagggaaccgucacggugaucgacuauaaaaagauucuuggcacaaucaaaaugaaggccauccugggggaugugaaauacaagaacuaucagaauaacauugaaaucaaugcggagggaaccugcgccggcuguauugacugcuuugagaacauccacugugaguucaccauucauacaaccgucgaagcuagcugcccgaucacgacagaauguguuuccuuucacgauagaauccucauuaccccugacgagcacaaguacgcccugaaaaucgugugccaugacaagcccaaagugucucucaaguucaaaauuugcaauacaaacgucgaugcugccaugaccaucguggacagcaagcccauucuggaacuugccccuguugaucaaacaaccuauauccgcgagaaggacgagcgguguaaaacguggaugugcagagugcgcgaugaaggcuuucaggucauucuggagccguucaagaaucucuuuggguccuacaucggaaucuucuacaccggcauucugucuaucauuugucugcuuaucgugguuuauauuauccugcccaucugcuucaaacucagagacacacugcggcagcacgaagaugcuuacaagaaagagaugaagauucgcuga

SEQ ID NO: 14290 - RNA, 4335 nt, Artificial Sequence
  derived and/or modified CDS sequence (opt5) from JCV(61V2235)__KX817316.1__GP
auggaggugcugaaccucaucuggcugcuugcccugugcagcgcuucccccgucuuccagagauguuuucaagacggcgccauuguuaagcagaauccuucuaaagaagcggugaccgaggugugccucaaggaugacgucagcaugaucaaaacagaagcuaaguacgugaaaaacacgaccgggacauucgccaauaacauugccaugcggaaguggcugguugcugauuggcacgacugucgcccgcagaaguccucuggaggccauaucaaugugauugaggucggggaugaccuuagccugcacaccgaauccuauaucugcucugccgauugugugaucacaguugacaaagagaccgcucagauuagacuccaaacagauaacaccaaucauuuugagguggccggaacgaccgucaagagcggcugguucaaauccacaaccuacaucacacuggaccagaccugcgaacaccugaaggugagcugugggcccaaaucuauucaguuucaugcgugcuucaaccagcacauguccugugugcgguuucuccaccgcacgauccugccuggaagcauugccaauucuaucugccaaaacauugagaucaucauucuugucacacugucccucguuaucuucauuuuucugagcaucgugucuaagaccuauguguguuaccuucugaugcccauuuucaucccuaucgcuuuuauuuauggcugggucuacaauaaguccugcaaaaagugcaaacucuguggccugguguaucaucccuucacagaaugcgggacccacuguguuugcggagccagauacgagaccagcgaucggaugaagcugcaucgcgcuuccggccucuguccuggguacaaaucucugagagccgcgcgggugaugugcaagagcaaaggaccggccuccauccuuagcauuaugacagcuauccugauucucacguuugucacccccaucucugccauggugaucggcgaguccagcgaaguuuauacacuggacgaucuuccuaacgacauggugcagauggcugagcgcgucaauauuuacuaucagaucauuaucauuaacuacggggugaccugggccuuccugcuccugggacugauccucgccuauuucuuuaagaaguaccagcacaaauuccuggacuuuuaugcuauguacugugaagagugcgauauguaccacgaaaagucuggccuuacacauuggggcgacuucaccaauaaauguagacaaugcacgugugggcaguuugaggaugucgcgggacugaugauucacaagaaaagcuauaacugccucgugaaguacaaggccaaauggauccgggacauccugauuaucuaucuugcuaugauucugaucaaggauucccuccuguucguuggcgccucugggacagacuuugccgcuugcauugaugagaaaguggucaccuggaacuguaccggacccuuccugaaucucggccgcugcgacaagagccauaaaaaggccuccuacgcggggaucgcugaucagcugaagggacuuggcgugaucagcguucuggacauuccuaugaucaaaaacaugcccgaugaaauuucuggcucccucaaguauaucgacagccuggagacauaccacgaacaacugaccgccgaguaugccuuucuuacaagauacugugacuacuauacgcaguacaccgauaauucuggguauucccagacaguguggcggaccuaccuccgcagccaugacuucggagcuugcgucguguauccgaaccagcacuuuuguagaugcgugaaauacggcgauaaguguaauuccgccaaaugggacuucgcuaacgaaaugaagacauuuuauaccgggcaaaagguuaaauucaauaaggaucugaaccuggcccuccugguccuucacaaagcguuccggggaacgggcaccgccuacguggcugaggccauggcuagaaaggacaaugggucuauggcccauuuugcgcuggagauucgcaaaaaguucccuacaaacgcccuccuggcugcccugaucgauuacaucguguaucuucagagccucggcgaaauugcuaccuuugagcuggacgaagauugggagggauucaaauacaagcccgaaccuacagaguccacgccccagguccggucucacagaaaugaccaguauaacuuuaagaaugccgagagcaacuccgauaccaaagugugcaagaauguucaaaaagugcuguguaucagcccccgcucuaaggccaaauucaagaacauuaucgcuugcggcgaacaugcgaacccuuccgucuacaugaugccgaaugugagcauuuaucagucuaacuccgagcggagccacuacuguaucgccgacucucacugccucgaaaaguaugagguuguggagacagaacugcuuaaugcucugaaaaagagcaaaugcugggccaaggagauggaugacaucauucuccauaaacaguccgacgggcugagaagcugucgcaucaaggauaccggaaacugcaauguccaggaaaacgacuggacaauugugcugugugagaauggcaacuacuacuauucugaaguucacaaggauuacgacaaagaucaagacguggggcauuuuugccuuagcccccgguguaccaccaucagauauccuauuuccaagcgccacaucaaaaagugcgaguggcagauuucccauucuacaaucgauaaaaucagcguccaggagcucgccgacauugaacaguacaagaaggcuaucucccaaaaacugcagacgucucugagcauuuucaaguaugugcggaccaaaaaucucccccacaucaagccugccuacaaauauauuacaguggagggagucgaaaccaucgagggcaucgaaaacgcguuuauugaguccgagauccccgcucuggccgggacagccauuggcuucaagaucaauucuagagaaggaaacuaccuuauggauguuauuggcuacgugaaaagcgcuuccuauagcgccguguacaccaagcuguauacgacagggccgaccaucggaaucaauaccaagcacgacgagaaauguacaggcccuugccccgcgauuaucgaucauaaggacggguggcucaccuuuucuaaagaacgcacauccacguggggaugugaggaguucggcugccuggcugucagcgauggguguguguuuggcucuugccaggacauuaucaaggacgaacuggccguuuaccggaaaaccacagaggaacuuaccacaguggagcucugccugaccuucuccgauaagacguauuguaccaaccugaaugccauuacaccuaucauuaccgacaaguucgaaguccaauuuaaaacaguggagagcuacacccuccccagaguuaucgcuaucaagaaccacgagauuaaagugggacagaucaacgaucugggcgucuauucuaaggggugcggaaaugugcagaaaguuaacggcacaaauuacgggaacggauccccucgguucgacuaccuuugucaucuggccagccgcaaggaagugauucucagaaagugcuuugauaaugacuaucaggcuuguaaauuccugcaaucccccagcucuuaccggcuggaggaacaccagggcaccgucacggugaucgauuauaagaaaauucuugggacaaucaagaugaaagccauccugggcgacgugaaguacaagaacuaucagaauaacauugagaucaaugcggaaggaaccugcgccggcuguauugauugcuuugagaacauccauugugaguucaccauucacacaaccgucgaagcuagcugcccgaucacgacagaguguguuuccuuucacgacagaauccucauuaccccugaugaacauaaauacgcccugaagaucgugugccacgacaaacccaaggugucucucaaauucaagauuugcaauacaaacgucgacgcugccaugaccaucguggauagcaagcccauucuggagcuugccccuguugaccagacaaccuauauccgcgaaaaagaugagcgguguaagacguggaugugcagagugcgcgacgagggguuucaagucauucuggaaccguucaaaaaucucuuuggauccuacaucggcaucuucuacaccgggauucugucuaucauuugucugcuuaucgugguuuauauuauccugcccaucugcuucaagcucagagauacacugcggcagcaugaggacgcuuacaaaaaggaaaugaaaauucgcuga

SEQ ID NO: 14291 - RNA, 4335 nt, Artificial Sequence
  derived and/or modified CDS sequence (opt5) from JCV(3573-03)__HM007354.1__GP
auggaggugcugagccucaucuggcugcuuacccugugcuccgccucucccgucuuccagagauguuuucaagacggcgcuauuguuaagcagaacccuagcaaagaagccgugacagaggugugccucaaggaugacgucuccaugaucaaaacggaagcgaaguacgugaaaaauaccacagggaccuucgcuaacaauauugccaugcggaaguggcugguugccgauuggcacgacugucgcccgcagaagucuagcggaggccauaucaacgugauugaggucggggaugaccuuucccugcacacagaaucuuauaucugcagcgcugauugugugaucaccguugacaaagagacagcccagauuagacuccaaaccgauaauacgaaccauuuugagguggcuggaaccacagucaaguccggcugguucaaaagcaccacauacaucacccuggaccagacgugcgaacaccugaaggugucuugugggcccaaauccauucaguuucaugccugcuucaaucagcacaugagcugugugcgguuucuccaccgcacaauccugccuucuuccauugcgaacagcaucugccaaaauauugagaucaucauucuugucacccugucucucacaaucuucauuuuucugaccaucguuuccaagaccuauauuuguuaccuucugaugcccguguucaucccuaucgccuuuguguauggauggauuuacaacaagagcugcaaaaagugcaaacucuguggccuggucuaucaucccuucacagaaugcggcacgcacugugugugcggggcuagauacgagaccuccgaucggaugaagcugcaucgcgccucuggacucuguccuggcuacaaaagccugagagcugcccggguuaugugcaaguccaaagggccggcgagcauccuuucuauuaugacagccgugcugauccucaccuuugucacacccauuuccgcuaugaugaucggagagagcucugaaguguauacccuggacgaucuuccugacgacaugguucagauggccgagcgcgugaauaucuacuaucagauuaucauuaucaacuacggcgucacgugggcuuuccugcuccuggggcuggugcucgccuauuucuuuaagaaguaccagcacaaauuccuggauuuuuaugccauguacuguaaugaaugcgacauguaccacgagaaggcuggacuuacacauuggggcgauuucaccaacagaugucggcaaugcaccuguggccaguaugaagacgucacagggcugauugugcacaaaaagagcuacaauugccucguuaaauauaaggcgaaguggauccgcgauauucugaucaccuaccuuaucauuauccuggugaaagacucccuccuguuugucggagccacaggcacggauuucgcugccugcauugacgagaagaccgugacauggaacuguaccgggcccuuucugaaccucggaagaugcgauaaaucucagaagaaaacaagcuauaaugacaucgccaaccaacugaagggccuugggguuauuuccgugcuggauaucccuaugaucaagcggaugcccgacgagauuagcggaucucucaaauacaucgacaaucuggaaaccuaucaugagcagcugacggcugaauacgccuuccuuacccgcuacugugauuauuacacacaguauaccgacaacuccggcuacagccagacagucuggagaaccuaucuccggucucacgauuuuggcgcgugcgugguguacccgaaucaacauuucuguagaugcguuaaguauggggacaaauguaacuccgcuaagugggauuuugccaaugagaugaaaacguucuacacaggacagaagauuaaguuuaacaaagaccugaaucuggcccuccugguccuucacaaggcuuuccgcggcaccgggacagccuacaucgcugaagccauggcgcggaaagauaacggaagcauggcccacuucgcucuggaggugagaaagaaauuuccuaccaaugcccuccuggcugcccugauugacuauaucguguaccuucagucccucgcggagaucucuaccuucgaacuggaugaggacugggaagauuuuaaguauaaacccgagccuacagaaagccccucccaggcccgcucucaucggagcgaccaauacaacuucaagaaugcugaguccaacagcaaugucaaggugugcaaaaacauucagaagguucuguguaucucucccagaucccgcgccaaauuugagaacauuaucgcuugcggcgaacacgccaauccuagcguguauaugaugccgaacgucucuauuuaccaguccaauagcgagcggucucauuauuguaucgccgauagccacugccucgaagacuacgagaucguggagacggaacugcuuuccgcucugaagaaaagcaagugcugggcgaaggagauggacgauauuguucuccacaaacagucugacgggcugagauccugucgcaugaaggauaccggcaacugcgacgugcaagaaaaugauuggacaaucguccugugugagaacggaaauuacuauuacagcgaaauucauaaagacuaugauaaggaccaggaugugggccacuucugccuuucuccccgguguuccaccaucagauacccuauuaacaaacgccauaucaagcggugcaauuggcagauuagccacuccacaaucgacaagaucucuguucaggagcucgccgauauugagcaauauaaaaaggcuaucagccagaaacugcagaccucccugucuauuuuuaaguacgugaaaacgaagaaccucccccauaucaagccugccuauaaauacauuacagucgaagggaucgagaccguggaaggaaucgagaaugccuucauugaaagcgagauccccgcucuggccggcaccgcgauuggguuuaagaucaacuccagagagggaaauuaccuuauggacgugauuggcuaugucaaaagcgcuucuuacuccgccacauauaccaagcuguacacaacggggccgaccaucggcaucaacacacggcacgaugaaaaauguaccggaccuugccccgccguuauugaccacaaggacggcuggcucacauucagcaaagagcgcaccucuacgugggggugugaagaguuuggaugccuggcuguguccgauggcuguguguucgggagcugccaagacaucauuaaggaugaacuggccgucuauagaaagaccacagaggagcuuaccacaguggaacucugccugaccuuuucugacaaaacauacuguaccaaucugaacgcgaucacgccuauuaucacagauaaguucgagguucaguucaaaaccguggaauccuauacccucccccgggucauugcugugaagaaccaugagaucaaaguuggacagaucaaugaccugggcguguacagcaaggggugcggcaacguccagaaggugaauggaacaaacuacggcaaugggaugccuaaauuugauuaucuuugucaccuggccuccagaaaggagguuauucuccgcaaaugcuucgacaacgauuaccaagccuguaaguuucugcagagccccucuagcuaucggcuggaggaacaucagggaaccgugacgaucauugacuacaaaaagauccuuggcacaauuaagaugaaagcuauccugggggaugucaaguauaaaaauuaccaguccaacaucgaaauuaaugccgagggaaccugcgcuggcuguaucaacugcuucgaaaauauucacugugaguuuacaauccauaccacaguggaggccucuugcccgauugugaccgacugugucagcuuccacgacagaauccucaucacgccugaugaacacaaguaugcgcugaaaguugugugccaagacaagcccaaggugucccucaaauuuaagauuugcaacaccaauaucgaugccucuaugacaauugucgacagcaaacccauccuggagcuugcuccuguggaucagaccgccuacauuaaggaaaaagacgagcgcuguaagacauggaugugcagaguucgggaugaaggguuccaggugauccuggagccguuuaagaaccucuucggcuccuacauuggaaucuuuuauaccggcauccugucugucauuugucugcuuaucgugauuuacaucauucugcccaucugcuucaaacuccgcgacacgcugagacagcaugaggaugcuuauaagaaagaaaugaagauccgguga

SEQ ID NO: 14292 - RNA, 4335 nt, Artificial Sequence
  derived and/or modified CDS sequence (opt5) from KEYV(KEYV/Ochlerotatus atlanticus/USA/KEYVLK01/2005)__KT630289.1__GP
augaugaucuggauucugcucaccguggucacaguuacgaucgccaaccccguguaccagagaugcuuccaagacggcgcuauugugaagcagaauccuagcaaagaggccgucaccgaagugugucugaaggaugacguuuccaugaucaaaacagaggcgaaguaugugaaaaaccuuaccgggacauuuucuaauaacgucgcuaugcggaaguggcugguggccgauuggcacgacugccgcccgcagaagagagccggaggccauauuaauguuaucgaagugggggaugaccucagccugcacaccgaguccuacaucuguucugcugauugcgucauuagcguggacaaagaaacagcccagauccggcuucaaaccgauacgaccaaccauuucgagguggcuggaacaaccgucaaguccggcugguuuaaaucuacaaccuauauuacgcuggaccagacaugugagcaccucaagguuagcugcgggcccaaauccauccaguuccaugccuguuuuaaucagcacaugagcugcgugcgcuuccugcacagaaccauucugccuggaucuaucgcgaacuccauuugucaaaauaucgaaaucauuauccucgugacacugacccuucugauuuuuauccuccugagcauucuuucuaagaccuacaucugcuauauccugaugcccauuuucaucccuauugccuacaucuauggcugggucuacaacaaguccuguaaaaagugcaaacucugcggccugguguaccaucccuuuacagagugugggacgcacugcguuuguggagcucgguaugaaaccagcgaucgcaugaagcugcauagagccucuggccucugcccuggguacaaaucccugcgggcugcccgcgugauguguaagagcaaaggaccggcguccauucuuucuauccugacagccguccucauccugaccuucauuacacccaugaaugcuauggugcuuggcagcuccgaggagguuuauaagcuggaagaccucccugaugacaugcugaacauggccgagaagaucgacauuuacuaucugagcaucgugcucaauuacucuaccacgugggggcugcuuauucugcuccugaucgucuccugccuuuuuaaaaaguaucagcacguguuccugaacuacuacgcuauguauugucacgaaugcgauauguaccaugagaaaaagaaucucgucuauaacggagacuuuagcaacaaauguagacagugcacauguggccaguacgaagaugccaccggccugauugugcaccaaaagucuuauaauugccugaucaaguacaaagccaagugguucaucaacauucucaucauuuauaccauccugguucuucugaaagacagcgugcucauggcugcggccgaggggcccgauuucaauacaugcauugagcagcgguccaucucucugaacuguaccggaccuuuuaucaaucugggcgggugcgaaaagccccagaaacgcgcuagcuaccaauccauugccgagcagcuuaaggccaucaacgcuauuagcauccucgacaugccgaugauuucuaagaucccugaugacaucuccggagcccugagacauauugaaaaucugaaaacauaccacgagcagcucacggcggaguucgcuaugcugacccgguauugugauuacuauacacaguuuagcgacaacucuggcuacucccaaaccagcuggcgcacauaucuuagaucccaugauuucgaggucugcaucgccuaccccaaucagcacuuuugucggugcgugaagaacggggagaaauguaccucugccaauugggacuucgcuaacgaaaugaagaauuauuacacgggaaaacagauuagauuugacaaggaucugaaccucgcccugaccacacugcacaccgcuuuccgcggcacaagcaccuacuauauguccgacauccuugccgagacgaaggccaauucucuccgggauuacgcgcuggcucugaaaagcaaguauccuggcaacgcccuccugaaagcuauucuugacuuuaucauguaccugcagucccucaacgaagccacaaaguucaaacugagcucugauugggaggacuuuaaguauaauuccgaacuggaggcgagagcccuuaugccccgcgcucggagcucuggggauuacaacuucuccaaugccgagagcaccaacaaaguuaagaucugcaagaauauucaaagagugaugugucucucuccccgcagcaaagcuacagucgaagacaucauugccugcggagagcaugaacacccuuccguguauauggugccgaacaccaccaucuaccagagcaauauugagcggucucauuacuguaucgccgauucccacugccuggaggaauaugagcugguucagaacgaacuccugacagcucuuaagaaaagcacgugcuggaccggcgagcuggaaaaugucauuccccacaagcaguccgacgggaucagaucuugucgcacaaagaacaccggacggugcaaugugaagggcgaggauuggacagugauccucugugagaacgacaaguacuauuacagcgaacugaauaaagauuaugacaaggaccaagauauugggcaugucugccuguccccuagauguaacucuauccgcuaccccauuagcccucggcacaucaccaauugcaaaugggagaaccccgcgggcacgauuuccagaaucgaaacacauucucuugccgacaucgagcaguauaagaaagcuauuagccagaagcuccagaacucccugaccaucuuuaaguacgagaaaaccaagaaucugccgcacauuaaaccuaucuacaaguauauuacaaucgaaggaaccgagacaguggaaggcguugagaacgccuucaucgaagccgagauucccgcucucgccgggacgagcaucggauucaaagucaauucucgggauggcgaccaucugauggauauuaucgcguacauuaagguggcuuccuauagcucuaccuacacaaaacuuuauaccacagggccuaccaucggaauuaacacgaaacacgacgaaaaguguaccggcaauugccccgcccgccuggagcacaaagugggguggcucacauuugccaaggagagaaccuccacauggggcugugaagaguucggaugccuggcuguuagcgauggcuguguguuugggucuugccaagacaucaucaaagaagaacuguccgucuaccggaaggauaccgaggaagugagcaacguugagcuuugccugacauucgccgacaaaaccuauuguacgucccucaaugcgauuacaccuaucauuaccgaaaaguuugaggugcaguucaagaccgucgaaagcuacucucugcccagaaucgugggcauucgcaaccaugagauccggaucggacagauuaaugaucucgggagcuacuccaaaggaugcggcaacgugcaaagagucaaugggacaaacuauggcucuggacagccgaaguuugacuaccugugucaccuugcuagccgcaaagagguuaucgugagaaagugcuucgauaaugacuaucaggccuguaaauuucugcagaccccuuccucuuaccggcucgaggaacaugaaggcacggugacaauuaucgacuauaagaagauucuggggaccaucaaaaugaaggccauccugggagauguccgcuacaaaaacuaugcuagcgccauugacaucaaugcugagggcgugugcgccggguguauuaacugcuucgaaaacauccacugugaguuuacaauucauaccacaaucgaggcguccugccccauugaaucugauuguguuagcuuccacgacagaauccuugugacccccaaugagcacaaguacgcccugaaacucaucugcgaagauaagccuggauccacgcugaaguuuaaaauuugcaacaccaagaucgacgcugccaugacacucgucgaugcuaaaccgauucuggagcuugcccccguggaccaaaccgccuacauccgggaaaaggaugagcgcuguaaaacauggaugugcagaguucgggacgagggcauuaaggugcugcucgaaccuuucaagaaucuguucgggagcuauaucggcaucgucuacucuauuauccugauuaucauugcugcgaucaucauuaucuauauuauccuucccauuuguuuuaaacugcgcgauacccucaagaaacaugaggacgccuacagaaaggaaaugaaaauccgguga

SEQ ID NO: 14293 - RNA, 4332 nt, Artificial Sequence
  derived and/or modified CDS sequence (opt5) from KEYV(KEYV/Ochlerotatus atlanticus/USA/KEYVLK01/2005)__KT630289.1__GP
augaucuggauucugcucaccguggucacaguuacgaucgccaaccccguguaccagagaugcuuccaagacggcgcuauugugaagcagaauccuagcaaagaggccgucaccgaagugugucugaaggaugacguuuccaugaucaaaacagaggcgaaguaugugaaaaaccuuaccgggacauuuucuaauaacgucgcuaugcggaaguggcugguggccgauuggcacgacugccgcccgcagaagagagccggaggccauauuaauguuaucgaagugggggaugaccucagccugcacaccgaguccuacaucuguucugcugauugcgucauuagcguggacaaagaaacagcccagauccggcuucaaaccgauacgaccaaccauuucgagguggcuggaacaaccgucaaguccggcugguuuaaaucuacaaccuauauuacgcuggaccagacaugugagcaccucaagguuagcugcgggcccaaauccauccaguuccaugccuguuuuaaucagcacaugagcugcgugcgcuuccugcacagaaccauucugccuggaucuaucgcgaacuccauuugucaaaauaucgaaaucauuauccucgugacacugacccuucugauuuuuauccuccugagcauucuuucuaagaccuacaucugcuauauccugaugcccauuuucaucccuauugccuacaucuauggcugggucuacaacaaguccuguaaaaagugcaaacucugcggccugguguaccaucccuuuacagagugugggacgcacugcguuuguggagcucgguaugaaaccagcgaucgcaugaagcugcauagagccucuggccucugcccuggguacaaaucccugcgggcugcccgcgugauguguaagagcaaaggaccggcguccauucuuucuauccugacagccguccucauccugaccuucauuacacccaugaaugcuauggugcuuggcagcuccgaggagguuuauaagcuggaagaccucccugaugacaugcugaacauggccgagaagaucgacauuuacuaucugagcaucgugcucaauuacucuaccacgugggggcugcuuauucugcuccugaucgucuccugccuuuuuaaaaaguaucagcacguguuccugaacuacuacgcuauguauugucacgaaugcgauauguaccaugagaaaaagaaucucgucuauaacggagacuuuagcaacaaauguagacagugcacauguggccaguacgaagaugccaccggccugauugugcaccaaaagucuuauaauugccugaucaaguacaaagccaagugguucaucaacauucucaucauuuauaccauccugguucuucugaaagacagcgugcucauggcugcggccgaggggcccgauuucaauacaugcauugagcagcgguccaucucucugaacuguaccggaccuuuuaucaaucugggcgggugcgaaaagccccagaaacgcgcuagcuaccaauccauugccgagcagcuuaaggccaucaacgcuauuagcauccucgacaugccgaugauuucuaagaucccugaugacaucuccggagcccugagacauauugaaaaucugaaaacauaccacgagcagcucacggcggaguucgcuaugcugacccgguauugugauuacuauacacaguuuagcgacaacucuggcuacucccaaaccagcuggcgcacauaucuuagaucccaugauuucgaggucugcaucgccuaccccaaucagcacuuuugucggugcgugaagaacggggagaaauguaccucugccaauugggacuucgcuaacgaaaugaagaauuauuacacgggaaaacagauuagauuugacaaggaucugaaccucgcccugaccacacugcacaccgcuuuccgcggcacaagcaccuacuauauguccgacauccuugccgagacgaaggccaauucucuccgggauuacgcgcuggcucugaaaagcaaguauccuggcaacgcccuccugaaagcuauucuugacuuuaucauguaccugcagucccucaacgaagccacaaaguucaaacugagcucugauugggaggacuuuaaguauaauuccgaacuggaggcgagagcccuuaugccccgcgcucggagcucuggggauuacaacuucuccaaugccgagagcaccaacaaaguuaagaucugcaagaauauucaaagagugaugugucucucuccccgcagcaaagcuacagucgaagacaucauugccugcggagagcaugaacacccuuccguguauauggugccgaacaccaccaucuaccagagcaauauugagcggucucauuacuguaucgccgauucccacugccuggaggaauaugagcugguucagaacgaacuccugacagcucuuaagaaaagcacgugcuggaccggcgagcuggaaaaugucauuccccacaagcaguccgacgggaucagaucuugucgcacaaagaacaccggacggugcaaugugaagggcgaggauuggacagugauccucugugagaacgacaaguacuauuacagcgaacugaauaaagauuaugacaaggaccaagauauugggcaugucugccuguccccuagauguaacucuauccgcuaccccauuagcccucggcacaucaccaauugcaaaugggagaaccccgcgggcacgauuuccagaaucgaaacacauucucuugccgacaucgagcaguauaagaaagcuauuagccagaagcuccagaacucccugaccaucuuuaaguacgagaaaaccaagaaucugccgcacauuaaaccuaucuacaaguauauuacaaucgaaggaaccgagacaguggaaggcguugagaacgccuucaucgaagccgagauucccgcucucgccgggacgagcaucggauucaaagucaauucucgggauggcgaccaucugauggauauuaucgcguacauuaagguggcuuccuauagcucuaccuacacaaaacuuuauaccacagggccuaccaucggaauuaacacgaaacacgacgaaaaguguaccggcaauugccccgcccgccuggagcacaaagugggguggcucacauuugccaaggagagaaccuccacauggggcugugaagaguucggaugccuggcuguuagcgauggcuguguguuugggucuugccaagacaucaucaaagaagaacuguccgucuaccggaaggauaccgaggaagugagcaacguugagcuuugccugacauucgccgacaaaaccuauuguacgucccucaaugcgauuacaccuaucauuaccgaaaaguuugaggugcaguucaagaccgucgaaagcuacucucugcccagaaucgugggcauucgcaaccaugagauccggaucggacagauuaaugaucucgggagcuacuccaaaggaugcggcaacgugcaaagagucaaugggacaaacuauggcucuggacagccgaaguuugacuaccugugucaccuugcuagccgcaaagagguuaucgugagaaagugcuucgauaaugacuaucaggccuguaaauuucugcagaccccuuccucuuaccggcucgaggaacaugaaggcacggugacaauuaucgacuauaagaagauucuggggaccaucaaaaugaaggccauccugggagauguccgcuacaaaaacuaugcuagcgccauugacaucaaugcugagggcgugugcgccggguguauuaacugcuucgaaaacauccacugugaguuuacaauucauaccacaaucgaggcguccugccccauugaaucugauuguguuagcuuccacgacagaauccuugugacccccaaugagcacaaguacgcccugaaacucaucugcgaagauaagccuggauccacgcugaaguuuaaaauuugcaacaccaagaucgacgcugccaugacacucgucgaugcuaaaccgauucuggagcuugcccccguggaccaaaccgccuacauccgggaaaaggaugagcgcuguaaaacauggaugugcagaguucgggacgagggcauuaaggugcugcucgaaccuuucaagaaucuguucgggagcuauaucggcaucgucuacucuauuauccugauuaucauugcugcgaucaucauuaucuauauuauccuucccauuuguuuuaaacugcgcgauacccucaagaaacaugaggacgccuacagaaaggaaaugaaaauccgguga

SEQ ID NO: 14294 - RNA, 4332 nt, Artificial Sequence
  derived and/or modified CDS sequence (opt5) from KEYV(KEYV/Ochlerotatus atlanticus/USA/KEYVLK02/2005)__KT630292.1__GP
augaucuggauucugcucaccguggucacagccacgaucgcuaaccccguuuaccagagaugcuuccaagacggcgccauugugaagcagaauccuagcaaagaggcggugaccgaagucugucugaaggaugacguguccaugaucaaaacagaggcuaaguauguuaaaaaccuuaccgggacauuuucuaauaacguggccaugcggaaguggcuggucgccgauuggcacgacugccgcccgcagaagagagcuggaggccauauuaaugugaucgaaguuggggaugaccucagccugcacaccgaguccuacaucuguucugccgauugcgugauuagcgucgacaaagaaacagcucagauccggcuucaaaccgauacgaccaaccauuucgagguggccggaacaaccgugaaguccggcugguuuaaaucuacaaccuauauuacgcuggaccagacaugugagcaccucaaggucagcugcgggcccaaauccauccaguuccaugcguguuuuaaucagcacaugagcugcguucgcuuccugcacagaaccauucugccuggaucuaucgccaacuccauuugucaaaauaucgaaaucauuauccucgugacacugacccuucugauuuuuauccuccugagcauucuuucuaagaccuacaucugcuauauccugaugcccauuuucaucccuauugcuuacaucuauggcuggguguacaacaaguccuguaaaaagugcaaacucugcggccuggucuaccaucccuuuacagagugugggacgcacugcguguguggagcccgguaugaaaccagcgaucgcaugaagcugcauagagcuucuggccucugcccuggguacaaaucccugcgggccgcgcgcguuauguguaagagcaaaggaccggccuccauucuuucuauccugacagcugugcucauccugaccuucauuacacccaugaaugccaugguccuuggcagcuccgaggagguguauaagcuggaagaccucccugaugacaugcugaacauggcugagaagaucgacauuuacuaucugagcaucguucucaauuacucuaccacgugggggcugcuuauucugcuccugaucguguccugccuuuuuaaaaaguaucagcacgucuuccugaacuacuacgccauguauugucacgaaugcgauauguaccaugagaaaaagaaucucguguauaacggagacuuuagcaacaaauguagacagugcacauguggccaguacgaagaugccaccggccugauuguccaccaaaagucuuauaauugccugaucaaguacaaagcuaagugguucaucaacauucucaucauuuauaccauccuggugcuucugaaagacagcguucucauggcggccgcugaggggcccgauuucaauacaugcauugagcagcgguccaucucucugaacuguaccggaccuuuuaucaaucugggcgggugcgaaaagccccagaaacgcgccagcuaccaauccauugccgagcagcuuaaggcuaucaacgccauuagcauccucgacaugccgaugauuucuaagaucccugaugacaucuccggagcgcugagacauauugaaaaucugaaaacauaccacgagcagcucacggcugaguucgccaugcugacccgguauugugauuacuauacacaguuuagcgacaacucuggcuacucccaaaccagcuggcgcacauaucuuagaucccaugauuucgaggugugcaucgccuaccccaaucagcacuuuugucggugcgucaagaacggggagaaauguaccucugcuaauugggacuucgccaacgaaaugaagaauuauuacacgggaaaacagauuagauuugacaaggaucugaaccucgcucugaccacacugcacaccgccuuccgcggcacaagcaccuacuauauguccgacauccuugcggagacgaaggccaauucucuccgggauuacgcucuggcccugaaaagcaaguauccuggcaacgcucuccugaaagccauucuugacuuuaucauguaccugcagucccucaacgaagcgacaaaguucaaacugagcucugauugggaggacuuuaaguauaauuccgaacccgaggccagagcucugaugccccgcgcccggagcucuggggauuacaacuucuccaaugcugagagcaccaacaaagccaaggugugcaagaauauccaaagaguuaugugucuuucuccucgcagcaaagccacaguggaagacauuaucgcuugcggagagcaugaacacccguccgucuauauggugcccaacaccaccguguaccagagcaauauugagcggucucauuacuguaucgcggauucccacugccucgaggaauaugagcugguucagaacgaacugcucacagcccugaagaaaagcacgugcuggaccggcgagcuugaaaaugucauuccucacaagcaguccgacgggacaagaucuugucgcaccaaaaacacaggacggugcaaugugaagggcgaggauuggaccgugauccugugugagaacgacaaguacuauuacagcgaacucaauaaagauuaugacaaggaccaagauauugggcaugucugccugucccccagauguaacucuauccgcuacccuaucagcccccggcacauuacgaauugcaaaugggagaacccggcuggcacaaucuccagaauugaaacccauucucuggccgacaucgagcaguauaagaaagccauuagccagaaacuucagaacucccucaccaucuuuaaguacgaaaagacaaagaaucugccucacaucaaacccauuuacaaguauaucaccauugagggaacagagacgguggaaggcguugagaacgcuuucaucgaagccgagauuccugcgcuggcugggaccagcaucggauucaaagucaauucucgggauggcgaccaucucauggauaucauugccuacaucaagguggccuccuauagcucuacauacaccaagcuguauacaaccgggcccacgauuggaaucaacaccaaacacgacgaaaaguguacaggcaauugcccugcucgccuugagcacaaagugggguggcugaccuuugccaaggagagaacauccaccuggggcugugaagaguucggaugccucgcgguuagcgauggcuguguguuugggucuugccaagacauuaucaaagaagaacuguccgucuaccggaaggauacagaggaagugaccaacguugagcugugccuuacguucgcugacaaaacauauuguaccagccugaaugccauuacccccaucaucacagaaaaguuugaggugcaguucaagaccgucgaauccuacagccucccgagaauugugggaauccgcaaccaugagauucggaucggccagauuaaugaucuggggucuuacagcaaaggaugcggcaacgugcaaagagucaaugacacgaacuauggguccggccagccuaaguuugauuaccucugucaccuggccucucgcaaagagguuaucgugagaaagugcuucgacaaugacuaucaggcuuguaaauuucuucagacacccagcuccuaccggcuggaggaacaugaaggaaccgugacaaucauugauuauaagaagauccucggcaccauuaaaaugaaggccauccugggggacguccgcuacaaaaacuaugcuucugccauugauaucaaugcggagggagugugcgccggcuguaucaacugcuucgaaaacauucacugugaguuuacaauccauaccacgauugaggcuagcugccccaucgaauccgacuguguuucuuuccacgauagaaugcuggugaccccuaaugagcacaaguacgcccuuaaacugauuugcgaagacaagccggggagcacacucaaguuuaaaaucugcaacaccaagauugaugcugccaugacacuggucgacgccaaacccauccucgagcuggcuccuguggaucaaaccgcguacauccgggaaaaggacgagcgcuguaaaacguggaugugcagaguucgggaugagggaauuaaggugcuucuggaacccuucaagaaucucuucggcuccuauaucgggauugucuacagcaucauucugaucaucauugccgcuaucauuaucauuuaugugauccugccuaucuguuuuaaacuucgcgacacacugaagaaacaugaggacgccuacagaaaggaaaugaaaauucgguga

SEQ ID NO: 14295 - RNA, 4332 nt, Artificial Sequence
  derived and/or modified CDS sequence (opt5) from KEYV(C14031-33)__AF123489.1__GP
augaucuggauucugcucaccguggucacaguuacgaucgccaaccccguguaccagagaugcuuccaagacggcgcuauugugaagcagaauccuagcaaagaggccgucaccgaagugugucugaaggaugacguuuccaugaucaaaacagaggcgaaguaugugaaaaaccuuaccgggacauuuucuaauaacgucgcuaugcggaaguggcugguggccgauuggcacgacugccgcccgcagaagagagccggaggccauauuaauguuaucgaagugggggaugaccucagccugcacaccgaguccuacaucuguucugcugauugcgucauuagcguggacaaagaaacagcccagauccggcuucaaaccgauacgaccaaccauuucgagguggcuggaacaaccgucaaguccggcugguuuaaaucuacaaccuauauuacgcuggaccagacaugugagcgccucaagguuagcugcgggcccaaauccauccaguuccacgccuguuuuaaucagcauaugagcugcgugagauuccugcaccggaccauucugcucggaucuaucgcgaacuccauuugucaaaauaucgaaaucauuauccuggugacacuuacccugcucauuuuuauccugcuuagcauucugucuaagaccuacaucugcuauauccucaugccuauuuccauccccauugccuacaucuauggcugggucuacaacaagagcuguaaaaagugcaaacugugcggccugguguaccacccuuucacagagugugggacgcauugcguuuguggagcucgcuaugaaaccucugauagaaugaagcuccaccgggccuccggccugugccccggguacaaaagccuucgcgcugccagagugauguguaaguccaaaggaccugcgucuauucugagcauccucacagccguccugauccuuaccuuuauuacaccgaugaaugcuauggugcugggcuccagcgaggagguuuauaagcucgaagaccugcccgaugacaugcugaacauggccgagaagaucgacauuuacuaucucucuaucgugcugaauuacuccaccacgugggggcuucugauucuccugcuuaucgucagcugccuguucaaaaaguaucaucucguguuucugaacuacuacgcucuguauugucacgaaugcgauauguaccacgagaaaaagaaucucgucuauaacggagacuucucuaacaaaugucugcagugcacauguggccaguacgaagaugccaccggccuuauugugcaucagaaaagcuauaauugccugaucaacuacaaggccaaaugguuuaucaauauucucaucauuuauaccauccugguucugcuuaaggacuccgugcucauggcugcggccgagcggccugauuucaacacaugcauugagcaacgcucuaucagccugaauuguaccgggcccuucaucaaccugggaggcugcaaaaagccucagaaaagagcuuccuaccagagcauugccgaacaacucaaggccaucaaugcuauuucuauccuggacaugcccaugauuuccaagaucccggaugacaucagcggggcccuucggcacauugagaaccugaaaacauaccaugaacagcucacggcggaguuugcuaugcugacccgcuauugugauuacuauacacaguucucugacaauuccggauacagccagaccuccuggagaacauaucugcggucucacgauuuugaagucugcaucgccuacccuaaccaacauuucuguagaugcgugaagaauggcgagaaauguaccagcgccaacugggacuuugcuaaugagaugaagaacuauuacacggggaaacagauucgcuucgacaaggaucuuaaucucgcccugaccacacugcacaccgcuuuucggggaacauccaccuacuauaugucugacauccucgccgaaacgaaggcgaacagccugagagauuacgcccuugcucugaaauccaaguaucccggcaacgcccuccugaaagcuauucuggacuucaucauguaccuucagccucucaaugaggccacaaaguuuaaacugagcucugauugggaagacuucaaguauaacuccgagcccgaagcgcgcgcccugaugccccgggcuagaagcucuggcgauuacaauuuuuccaacgccgagagcaccaauaaaguuaaggugugcaagaacauccagcgcgucaugugucucucuccucggagcaaagcuacaguggaggacauuaucgccugcggggaacacgagcauccguccguguauaugguucccaauaccaccauuuaccaaagcaacaucgaaagaucucacuacuguauugccgauucccauugccuggaggaguaugaacuuguccagaaugagcugcucacagcucugaagaaaagcacgugcuggaccggagaacuggagaacgugaucccucacaagcaguccgacggcauucgcucuugucggacaaagaauaccgggagaugcaacgugaagggagaagauuggacagucauccuuugugagaaugacaaguacuauuacagcgagcucaacaaagauuaugacaaggaccaggauaucggccacgugugccugucuccccgcuguaauuccauucgguacccuaucagccccagacauauuaccaacugcaaaugggaaaacccggcggggacgaucucccggauugagacacacucucuggccgacaucgaacaauauaagaaagcuaucagccagaagcuccaaaauucccugaccauuuucaaguacgagaaaaccaagaaccuuccucauaucaaacccauuuacaaguauaucacaauugaaggcaccgagacaguugagggaguggaaaaugccuuuaucgaggccgaaaucccugcucuggccggcacgagcauuggguucaaagucaacucucgcgauggagaccaccucauggauaucauugcguacaucaagguggcuuccuauagcucuaccuacacaaagcuguauaccacaggccccaccauugggaucaauacgaaacaugacgagaaguguaccggaaacugcccugccagacuggaacacaaaguuggcuggcuuacauucgccaaggagcggaccuccacaugggggugugaggaauuuggcugccuggcugugagcgauggaugugucuucggcucuugccaggacauuaucaaagaggaacucuccguguacagaaaggauaccgaggagguuacaaauguggaacugugccucaccuuugccgacaaaacguauuguacaagccugaacgcgaucacccccauuaucaccgagaaguucgaaguccaguuuaagacaguggaguccuacagccuuccgcgcauuguggggauccggaaucacgaaauuagaaucggacagaucaacgaucugggcucuuacagcaaagggugcggaaauguccagcgcguuaacggcaccaauuauggguccggccaaccuaaguucgacuaccucugucaucuggcuucuagaaaagaggugauugugcggaagugcuuugauaacgacuaucaggccuguaaauuccugcagacgcccagcuccuaccgccuugaggaacacgagggaacagucaccaucauugacuauaagaagauccugggcacaauuaaaaugaaggccauccucggggaugugagauacaaaaauuaugcuucugccaucgacauuaacgcugaaggaguuugcgccggcuguaucaacugcuuugagaauauucauugugaguucaccauccacacaaccauugaagcgagcugccccaucgaguccgauugugugucuuuucaugaccggaugcuggucacgccuaacgaacacaaguacgcccucaaacugauuugcgaggauaagccggggagcgcucuuaaguucaaaaucugcaauaccaagaucgacgccgcuaugacacugguggaugccaaacccauucucgaacuggccccuguugaccagaccgcuuacauccgcgagaaggaugaaagauguaaaacauggaugugccgggugcgcgacgagggaauuaagguccugcuugagcccuuuaagaaccuguucggcuccuauaucgggauuguguacagcaucauccucauuaucauugcggccaucauuaucaucuauauuauccugccuauuuguuucaaacucagagauacccugaagaaacacgaagacgcuuaccggaaggagaugaaaauccgcuga

SEQ ID NO: 14296 - RNA, 4326 nt, Artificial Sequence
  derived and/or modified CDS sequence (opt5) from LACV(Human/78)__NC_004109.1__GP
augaucugcauucuggugcucaucaccgucgccgcugccagccccguuuaccagagauguuuccaagacggcgcgauugugaagcagaacccuuccaaagaggcugugacagaagucugccugaaggaugacgugucuaugaucaaaacggaggcccgguauguucgcaaugccaccgggguguuuagcaacaaugucgcuauuagaaaguggcuuguguccgauuggcacgacugucggccgaaaaagaucguuggaggccauaucaacgugauugaagucggggaugaccugucucuccacacagagagcuacgugugcuccgccgauuguaccaucggaguggacaaggaaacagcucagguccgccugcagaccgauacaaccaaucauuucgagauugccggcacgaccguuaaaucugggugguuuaagagcacaaccuauaucacacuugaccaaaccugcgagcaccugaaaguguccuguggacccaagagcgugcaguuccaugcgugcuuuaaccagcacaugucuugugucagauuccuccaccggacgauucugccuggcuccaucgccaauagcauuugccagaacaucgaaaucauuauccuggugacacucacccugcuuauuuuuauccugcucucuauucuguccaaaacauacaucuguuaucuucugaugcccaucuucauuccuaucgcuuacauuuauggcaucauuuacaauaagagcugcaagaaaugcaagcucugugggcugguuuaccaucccuuuaccgagugcggaacccacugugugugcggcgcccgcuaugauacaucugacagaaugaaacugcaucgggcuuccgggcucuguccuggauacaagagccugcgcgccgcgagagucaugugcaaauccaagggcccggccucuauccuuagcaucauuacggcugugcugguucucaccuucgugacacccaucaacuccaugguccugggggaaagcaaagagaccuuugagcuugaagaucugccugacgacaugcucgagauggccucucggauuaauuccuauuaccugacauguauccugaacuaugcugugagcuggggacucgucauuaucggccugcuuauuggccuccuguucaagaaguaccaacaccgcuuucugaauguguaugccauguacugcgaagagugugauauguaccacgacaaaucugggcuuaagagacauggagauuucaccaacaaaugccggcaguguacgugcggccaguaugaagacgccgcugggcugauggcgcaccgcaagacauacaauugccucguucaguauaaagccaaguggaugaugaacuuccugaucaucuacauuuuucugauccucauuaaggauagcgcuaucgugguccaagccgccggaaccgacuucaccacaugucuggagaccgaguccauuaacuggaauugcacaggccccuuucuuaaccuggggaauugucagaaacagcaaaagaaagaaccuuauacgaacaucgcuacccagcucaagggacugaaagccaucucugugcuggauguucccauuaucacaggcauuccggacgauaucgcgggcgcucuuagauacauugaggaaaaggaggacuuccaugugcagcucaccaucgaauaugccaugcugagcaaguacugcgauuacuauacacaguuuuccgacaauagcggguacucucaaaccacguggcgggucuaucugagaucccacgacuucgaggccuguauccucuacccuaaccagcauuuuugccgcugugugaaaaauggagagaagugcucuagcuccaacugggauuucgcuaaugaaaugaaagacuauuacagcggcaagcagaccaaauuugauaaggaccugaaccuugcccugacagcucuccaccacgccuuccgggggaccuccucugcguauauugccacaaugcugagcaagaaauccaaugaugaccugaucgcuuacaccaacaagauuaaaacgaaguuucccggaaaugcccuucucaaagcuaucauugauuacaucgccuauaugaagucucugccuggcauggcgaacuucaaauacgacgaguuuugggaugaacugcucuauaagcccaaucccgccaaggcuagcaaccuggccagagggaaagaguccagcuacaacuucaaacuugcuaucucuuccaaaagcauuaagacauguaaaaaugugaaggacguugccugccugucuccucgcuccggcgccaucuaugcuagcauuaucgcguguggagaaccgaacggccccucugucuaccggaagccuagcgggggaguguuccaguccagcaccgauagaucuauuuauugccuccuggacucccauugccuggaggaguuugaagccaucggccaagaggaacuugaugcugugaaaaagagcaaauguugggagauugaguaccccgacgucaagcucauccaggaaggggacggaacaaaauccugccgcaugaaggauucuggcaauuguaacguggccaccaaucgguggccuguuauccagugcgagaacgacaaguucuacuauagcgaacugcagaaagauuacgacaaggcccaagauauugggcacuauugucugucccccggcugcaccacagugagauacccgaucaauccuaaacauauuucuaacuguaauuggcaggucagccgcuccucuaucgcuaagauugacgugcacaacaucgaggauaucgaacaguauaaaaaggccauuacgcagaagcuccaaaccagccugucccuuuuuaaauacgcgaagacaaagaaucugccccacaucaagccuauuuauaaauacaucaccauugagggaacagagaccgcugaaggcaucgagagcgccuacaucgaaucugagguucccgcccucgcugggacguccauuggauucaagaucaacagcaaagaaggcaagcaucugcuggacgugauugccuaugucaagucugcguccuacagcucuguguauacaaaacuuuacuccaccgggccuaccagcggaaucaauacaaagcacgaugagcucugcaccggccccuguccggcuaacauuaaucaucagguuggguggcugacauuugcccgggagagaacguccagcuggggcugcgaagaguucggaugucuggccgugucugacggcugcgucuuugggagcugccaggauaucauuaaagaggaacucuccguguaucgcaaggaaaccgaggaggugacagacgucgaacugugucuuaccuucucugauaaaacauacugcaccaaccugaacccuguuacgcccaucaucaccgaccucuuugaggugcaauucaagacaguggaaaccuauagccugccccggauugucgcugugcagaaucacgagaucaagauuggacagaucaacgaccugggcguuuacuccaaaggguguggaaaugugcagaaggucaacggcacaauuuacgggaauggcgugccuagauuugauuaucuuugccaucuggccucucggaaagagguuaucgugcgcaaguguuucgacaacgauuaccaggcuugcaaauuucuccaaagcccggccuccuauagacuggaagaggacucuggaaccgucacaaucauugauuacaagaagauccucggcaccauuaaaaugaaggcgauccugggggacgugaaauauaagacguucgccgauagcguugacauuacagcugaaggauccuguaccggcugcaucaauuguuucgagaacauccacugcgaacuuacccugcacacaaccauugaggccagcugucccaucaaaucuuccugcacgguguuucaugaucggauucucgucacaccuaaugagcacaaguacgcucugaagauggugugcaccgaaaaacccgggaacacacugaccaucaagguguguaauacaaaagucgaggccagcauggcccuuguugacgcuaagccuauuaucgaacuggcgcccguggaucagaccgccuauauuagagagaaagacgaacgcugcaagacguggaugugucgggugagagacgagggacuccaggucauccuggagccuuucaagaaccucuuuggcucuuacaucggcauuuucuacaccuuuaucauuuccaucgugguucugcuugugauuaucuauguccugcuccccaucugcuucaaacugcgcgauacacugagaaagcaugaagacgcuuacaaacgggagaugaagauucgcuga

SEQ ID NO: 14297 - RNA, 4326 nt, Artificial Sequence
  derived and/or modified CDS sequence (opt5) from LACV__KP271111.1__GP
augauccggauucuggugcucaucgccgucaccgcugccagccccguuuaccagagaugcuuccaagacggcgcgauugugaagcagaacccuuccaaagaggcugugacagaagucugucugaaggaugacgugucuaugaucaaaacggaggcccgcuauguuagaaaugccaccgggguguuuagcaacaaugucgcuauucggaaguggcuuguguccgauuggcacgacugccgcccgaaaaagaucaucggaggccauauuaacguuaucgaagugggggaugaccugucucuccacacagagagcuacgucuguuccgccgauugcucuauuggaguggacaaggaaaccgcucaggugagacugcagacagauaccacaaaucauuucgagaucgccggcaccacggucaaaagcgggugguuuaaguccaccacauauauuacccuugaccaaacaugugagcaccugaaaguuagcugcggacccaagucugugcaguuccaugcguguuuuaaccagcacauguccugcgugcgguuccuccaccgcaccauccugccuggcagcauugccaauucuaucugucagaacaucgaaauuaucauucuggucacgcucacacugcuuaucuuuauucugcucuccauccugagcaaaaccuacaucugcuaucuucugaugcccauuuucaucccuauugcuuacauguauggcaucauuuacaauaagucuuguaagaaaugcaagcucugcgggcugguguaccaucccuuuacagaguguggaacccacugcguuuguggcgccagauaugauaccuccgaccggaugaaacugcaucgcgcuagcgggcucugcccuggauacaagucccugagagccgcgcgggugauguguaaaucuaagggcccggccagcauccuuuccaucauuacagcuguccuggugcucacguucguuacccccaucaacagcauggugcugggggaaucuaaagagacauuugagcuugaagaacugccugaugacaugcucgaaauggccucccgcauuaauagcuauuacuuuaccugcauccugaacuaugcugucucuuggggacuggugauuaucggccuccugacaggccuucuguuuaagaaguaccaacacagauuccucaaugucuaugccauguacugugaggaaugcgacauguaccacgauaaaagcgggcugaagcggcauggagacuucaccaacaaaugucgccagugcacguguggccaguaugaggaugccgcugggcuuauggcgcacagaaagacauacaauugccuggugcaguauaaagccaaguggaugaugaacuuucucauuaucuacaucuuccugauucugaucaaggacuccgcuauuguugugcaagccgccggaaccgauuuuaccacaugccucgagaccgaaucuaucaacuggaauuguacaggccccuuccugaaccuugggaauugccagaaacagcaaaagaaagagccuuauacgaacauugcuacccagcugaagggacucaaagccaucagcguccuggacauccccauuaucacaggcauuccggaugacaucgcgggcgcucugcgguacauugaagagagagaagauuuucaugugcagcuuaccaucgaguaugccaugcucuccaaguacugugacuacuauacacaguucagcgauaauucuggguacucccaaaccacguggcgcguuuaucugcggagccacgacuuugaggccugcauccuguacccuaaccagcauuucuguagaugcgugaagaauggagaaaaauguucuuccagcaacugggacuuugcuaaugagaugaaggauuauuacuccggcaaacagaccaaguucgacaaagaucucaaccuggcccuuacagcucugcaccacgccuuucgcgggaccucuagcgcguauauugccacaaugcucuccaagaagucuaaugacgaucugaucgcuuacaccaacaaaauuaaggccaaauuccccggaaaugcucugcuuaaggccaucauugacuacaucgcguauaugaaaagccucccuggcauggccaacuuuaaguacgaugaguucugggacgagcugcuguauaaacccaaucccgcuaaggccuccaaccucgcucgggggaaggaaagcucuuacaacuucaaacuggccaucuccagcaagucuauuaaaacgugcaagaaugucaaagauguggccugucuuuccccuagaagcggcgcuaucuaugcgucuauuaucgccugcggagagccgaacggccccagcguguaccgcaagccuuccgggggaguuuuucagagcucuacagaccgguccauuuauugucugcucgauagccauugccuggaggaguucgaggcuaucaaucaagaagaacuggacgccgucaagaaauccaagugcugggagauugaauacucugaugugaaaccccuucaggagggcgacgggaccaagagcuguagaaugaaagacuccggaaacugcaauguggccacaaaccgcuggccugucauccagugugaaaaugauaaguuuuacuauucugagcuccagaaggacuacgauaaaacccaagacaucggccacuauugccugagccccggguguaccacagugcgguacccgauuaacccuaagcauaucuccaauugcaacuggcagguuucuagaagcuccauugcuaaaaucgaugugcacaauauugaagacaucgagcaguauaagaaagccaucacgcagaagcugcaaaccagccucucucuguucaaguacgcgaaaacaaagaaccuuccccacauuaaaccuaucuauaaguacauuaccaucgagggcacagaaaccgcugagggaauugaauccgccuacaucgagagcgaaguccccgcccuggcuggcacgucuaucggguuuaaaauuaauuccaaggagggaaaacaucuccuggaugugaucgccuauguuaagagcgcgucuuacuccagcguguaugcuaagcuguacuccacaggcccuaccagcgggauuaacaccaaacacgacgagcuuuguacaggacccugcccggccaauaucaaccaucaggucggcuggcucaccuucgccaaggaacgcacaucuagcugggggugugaggaauuuggcugccuggcuguguccgauggauguguuuucggcucuugccaggacauuaucaaagaggaacugagcguguaucggaaggagacggaggaagucaccgauguggagcucugccugacauuuuccgacaaaaccuacuguacaaaccuuaauccugugacccccauuaucacggaucuguucgaaguccaauuuaagaccguugagacauauucucuccccagaaucguggccgugcagaaccacgagauuaagaucgggcagauuaaugaccugggagucuacagcaaaggcugcgggaacgugcagaagaucaauggaaccguuuacggcaacggggugccucgguucgacuaucugugucaucuugcuucccgcaaagaagucauugugagaaagugcuuugauaaugacuaccaagccuguaaauuccugcagucuccggcgagcuaucggcucgaggaagauuccggcacaguuaccaucaucgacuacaagaagauucugggaacaaucaaaaugaaggccauucucggcgaugugaaauauaagaccuucgcugacagcgucgauaucacggccgaggggucuugcacaggauguauuaacugcuuugaaaauauccacugugagcugacccuucacaccacaaucgaggcuuccugccccauuaaaagcucuuguaccguguuccaugacagaauccugguuacgccuaacgaacacaaguacgcccucaagauggugugcacagagaaacccggcaauacccugacaauuaaggucugcaacaccaaaaucgaagccuccauggcucugguggaugcgaagccuauuaucgagcuugcccccguggaccagacagcuuauauucgcgaaaaagaugagcgguguaagaccuggaugugcagaguccgcgacgaggggcugcagguuauccucgaaccuuuuaagaaucuguucggaagcuacaucggcauuuucuacacguucaucauuuccaucguggcccuccuggugauugucuaugugcuucugcccaucuguuuuaaacucagagacacccugcggaagcaugaggaugccuacaaacgcgaaaugaagaucagauga

SEQ ID NO: 14298 - RNA, 4326 nt, Artificial Sequence
  derived and/or modified CDS sequence (opt5) from LACV__M87664.1__GP
augaucugcauucuggugcucaucaccgucgccacagcuagccccguucugcagagauguuuccaagacggcgccauugugaagcagaacccuuccaaagaggcguuuacggaagugugccuuaaggaugacgucucuaugaucaaaaccgaggcucgguacgugcgcaaugccacagggguuuucagcaacaauguggccauuagaaaguggcuggucuccgcuuggcacgauugucggccgaaaaagaucgugggaggccauaucaacguuauugaagugggggacgaucucucucugcacaccgagagcuaugucugcuccgccgacuguacaaucggaguggauaaggaaaccgcucaggugcgccuucagacagacaccacgaaucauuuugagauugccggcaccacagucaaaucugggugguucagaagcaccacauacaucacccuggaucaaacgugcgagcaccucaagguuuccuguggacccaaaagcgugcaguuucaugcgugcuucaaccagcacaugucuugugugcgguuucugcaccgcacaauucugccuagauccaucgccaauagcauuugccagaacaucgaaaucauuauccucgucacccugacacuucugauuuucauccuccugucuauucuuuccaagaccuauaucuguuaccugcucaugcccaucuuuauuccuaucgcuuauauuuacggcaccaucuauaauaaaagcugcaagaagugcaaacuguguggccuggcccaucaccccuucacagagugcgggacgcauugugugugcggagcucgguacgacaccucugaucgcaugaagcuccacagagccuccggccuguguccuggguacaaaagccuucgggcggcccgcguuaugugcaaguccaaaggaccggcuucuauucugagcaucaucacagccgugcucguccugaccuuugugacacccauuaacuccaugguucuuggcgaaagcaaggagaccuucgagcuggaagaccucccugaugacaugcuggagauggcuucuagaaucaauuccuauuaccccacguguauucugaacuaugccgugagcugggggcucgucaucauuggacugcuuaucggccugcucuuuaaaaaguaccaacaccgguuccugaauguguaugccauguacugcgaagagugugacauguaucaugauaagucuggcgucaaacgccacggggacuucacaaacaagugcagacaguguaccugcggacaguacgaagaugcugcgggccuuauggcccaucggaaaaccuacaauugccuggugcaguauaaggcuaaauggaugaugaacuuucucauuaucuacaucuuccugauucugaucaaggacagcgccauuguugugcaagccgcugggacagauuuuaccacaugucucgagacggaguccaucaacuggaauugcaccggaccuuuccugaaccuuggcaauugucagaagcagcagaaaaaggaacccuauacaaacauugccacccagcugaaagggcucaaggcgaucucuguccuggacaucccgauuaucacaggcauuccugaugacaucgcuggagcccugagauacauugaggaaaaagaggauuuucacgugcagcuuaccaucgaauaugccaugcucagcaaguacugcgacuauuacacgcaguucuccgauaauagcggcuacucucaaaccacauggcgcguuuaucugcggucccaugacuuugaggcuuguauccuguaccccaaccagcacuucugcagaugugugaagaauggggagaaaugcuccucuuccaaccgcgacuuugccaaugaaaugaaggauuauuacagcggaaaacagaccaaguucgacaaagaucucaaccuggcucuuacagcccugcacucccaggucaugcauuguucuagcgcguauauugccaccaugcucuccaagaagucuaaugacgaucugaucgcuuacacgaacaaaauuaagacaaaauuuccuggcaaugcccugcuuaaggcuaucauugacuauaucgccuacaugaaaagccuccccgggauggcgaacuucaaguacgaugaguuuugggacgaacugcuguauaaacccaauccugccaaggcuuccaaccucgcccggggaaaggagagcucuuacaacuucaaacuggcuaucuccagcaagucuauuaaaaccugcaagaaugugaaagauguggccugucuuuccccgagaagcggcgccaucuaugcuucuauuaucgcgugcggggaacccaacggcccuagcguuuaccgcaagcccuccggaggcgucuuccaaagcucuacagaccgguccauuuauugccugcucgauagccacugucuggaggaguuugaagccaucucccaggaggaacuggacgcugugaagaaaucuaagugcugggagauugaguacccugaugugaaacuuauccaggaaggggacggaaccaagagcuguagaaugaaagacuccggcaauugcaacgucgccaccaaucgcuggcccgugacacagugugagaacgauaaguucuauuacucugaccuccaaaaggauuacgacaaaacgcaggauaucgggcauuauugccugagcccgggauguaccacaguucgguacccuauuaaucccaagcacaucuccaacugcaauuggcaagugucuagaagcuccauugccgaaaucgacguccacaacauugaggauaucgaacaguauaaaaaggcuaucacccaaaaacugcagacaagccucucucuguuuaaguacgccaagaccaaaaaucuuccucauauuaagcccaucuauaaauacauuacgaugaagggcacagagaccgcggaggggaucgaauccgcuuauauugagagcgaagugccugcccuggccggcaccucuaucggauucaaaaucaacuccaaggagggcaaacaccuccuggacguuauugcuuacgucaagagcgccucuuacuccagcguguauacaaagcuguacuccaccgggcccacaagcggaaucaauacgaaacaugaugaacuuuguaccggcccgugcccugcgaacauuaaucaccaggugggguggcucacauuugcucgcgagcggaccucuagcuggggaugugaggaguucggcugccuggccguuuccgacgggugcguguuuggcucuugucaagauaucauuaaggaagaacugagcgucuauagaaaagagacagaagaggugaccaacguggagcucugccugacguucuccgacaagaccuacuguacaaaccuuaaucccgucacccccaucauuacagaucuguuugaaguucaguucaaaaccguggagacauauucucucccucggaucguggccguccagaaccaugaaaucaagauuggacagaucaaugaccugggcguguacagcaaggggugcggaaacguucaaaaagugaauggcaccauuuaugggaacggagucccgcgcuuugacuaccugugucaccuugcuuccagaaaggaggugaucguucggaaaugcuucgauaaugacuaccaggccuguaaguuucugcagucucccgcuagcuauagacucgaggaagauuccggcacggugacaauuaucgacuacaaaaagauccuggggaccauuaagaugaaagccauccucggcgaugucaaguauaaaaccuucgcggacagcguggauauuacagccgagggaucuugcaccggcuguaucaacugcuucgaaaauauucacugugagcugacgcuucauacaaccaucgaagcuagcugcccuaucaagagcucuugcacaguuuuucacgaccgcauucuggugacccccaacgagcauaaauacgcccucaagauggucuguacagagaagccugggaauacccugacgaucaaagugugcaacaccaagauugaggcuuccauggcccugguggaugccaaacccaucauugaacuugcuccugucgaccagacagcguauauccgggaaaaggaugagagauguaaaaccuggaugugccgcguuagagacgaaggacugcaagugauucucgagcccuucaagaaucuguuuggcagcuacaucgggaucuucuauacauuuauuaucuccauuguggcccuccuggucaucauuuacgugcuucugccgaucuguuucaagcuccgggacacccugcgcaaacacgaggaugcuuacaagagagaaaugaaaauccgguga

SEQ ID NO: 14299 - RNA, 4326 nt, Artificial Sequence
  derived and/or modified CDS sequence (opt5) from LACV__KP271105.1__GP
augauccggauucuggugcucaucgccgucaccgcugccagccccguuuaccagagaugcuuccaagacggcgcgauugugaagcagaacccuuccaaagaggcugugacagaagucugucugaaggaugacgugucuaugaucaaaacggaggcccgcuauguuagaaaugccaccgggguguuuagcaacaaugucgcuauucggaaguggcuuguguccgauuggcacgacugccgcccgaaaaagaucaucggaggccauauuaacguuaucgaagugggggaugaccugucucuccacacagagagcuacgucuguuccgccgauugcucuauuggaguggacaaggaaaccgcucaggugagacugcagacagauaccacaaaucauuucgagaucgccggcaccacggucaaaagcgggugguuuaaguccaccacauauauuacccuugaccaaacaugugagcaccugaaaguuagcugcggacccaagucugugcaguuccaugcguguuuuaaccagcacauguccugcgugcgguuccuccaccgcaccauccugccuggcagcauugccaauucuaucugucagaacaucgaaauuaucauucuggucacgcucacacugcuuaucuuuauucugcucuccauccugagcaaaaccuacaucugcuaucuucugaugcccauuuucaucccuauugcuuacauguauggcaucauuuacaauaagucuuguaagaaaugcaagcucugcgggcugguguaccaucccuuuacagaguguggaacccacugcguuuguggcgccagauaugauaccuccgaccggaugaaacugcaucgcgcuagcgggcucugcccuggauacaagucccugagagccgcgcgggugauguguaaaucuaagggcccggccagcauccuuuccaucauuacagcuguccuggugcucacguucguuacccccaucaacagcauggugcugggggaaucuaaagagacauuugagcuugaagaacugccugaugacaugcucgaaauggccucccgcauuaauagcuauuacuucacaugcauccugaacuaugcugucucuuggggacuggugauuaucggccuccugacaggccuucuguuuaagaaguaccaacacagauuccucaaugucuaugccauguacugugaggaaugcgacauguaccacgauaaaagcgggcugaagcggcauggagacuucaccaacaaaugucgccagugcacguguggccaguaugaggaugccgcugggcuuauggcgcacagaaagacauacaauugccuggugcaguauaaagccaaguggaugaugaacuuucucauuaucuacaucuuccugauucugaucaaggacuccgcuauuguugugcaagccgccggaaccgauuuuaccacaugccucgagaccgaaucuaucaacuggaauuguacaggccccuuccugaaccuugggaauugccagaaacagcaaaagaaagagccuuauacgaacauugcuacccagcugaagggacucaaagccaucagcguccuggacauccccauuaucacaggcauuccggaugacaucgcgggcgcucugcgguacauugaagagagagaagauuuucaugugcagcuuaccaucgaguaugccaugcucuccaaguacugugacuacuauacacaguucagcgauaauucuggguacucccaaaccacguggcgcguuuaucugcggagccacgacuuugaggccugcauccuguacccuaaccagcauuucuguagaugcgugaagaauggagaaaaauguucuuccagcaacugggacuuugcuaaugagaugaaggauuauuacuccggcaaacagaccaaguucgacaaagaucucaaccuggcccuuacagcucugcaccacgccuuucgcgggaccucuagcgcguauauugccacaaugcucuccaagaagucuaaugacgaucugaucgcuuacaccaacaaaauuaaggccaaauuccccggaaaugcucugcuuaaggccaucauugacuacaucgcguauaugaaaagccucccuggcauggccaacuuuaaguacgaugaguucugggacgagcugcuguauaaacccaaucccgcuaaggccuccaaccucgcucgggggaaggaaagcucuuacaacuucaaacuggccaucuccagcaagucuauuaaaacgugcaagaaugucaaagauguggccugucuuuccccuagaagcggcgcuaucuaugcgucuauuaucgccugcggagagccgagcggccccuccguguaccgcaagccuagcgggggaguuuuucagucuuccacagaccggagcauuuauugucugcucgauucccauugccuggaggaguucgaggcuaucaaccaagaagaacuggacgccgucaagaaaucuaagugcugggagauugaauacagcgaugugaaaccccuucaggagggcgacgggaccaaguccuguaaaaugaaggacucuggaaauugcaacguggccacaaauagauggccugucauccagugugaaaacgauaaguuuuacuauagcgagcuccagaaagacuacgauaagacccaagacaucggccacuauugccugucccccggguguaccacagugcgcuacccgauuaauccuaaacauaucucuaacugcaauuggcagguuagccgguccagcauugcuaagaucgaugugcacaacauugaagacaucgagcaguauaaaaaggccaucacgcagaagcugcaaaccucucucucccuguucaaauacgcgaagaccaaaaaucuuccccacauuaagccuaucuauaaauacauuaccaucgagggcacagaaaccgcugagggaauugaaagcgccuacaucgagucugaaguccccgcccuggcuggcacguccaucggguuuaagauuaacagcaaagagggaaagcaucuccuggaugugaucgccuauguuaagucugcguccuacagcuccguguaugcuaaacuguacagcacaggcccuaccucugggauuaauaccaagcacgacgagcuuuguacaggacccugcccggccaacaucaaucaucaggucggcuggcucaccuucgccaaagaaagaacaagcuccugggggugugaggaauuuggcugccuggcugugucugauggauguguuuucggcagcugccaggacauuaucaaggaggaacuguccguguaucgcaaagagacggaggaagucaccgauguggagcucugccugacauuuucugacaagaccuacuguacaaaccuuaacccugugacccccauuaucacggaucuguucgaaguccaauuuaagaccguugagacauauagccucccccggaucguggccgugcagaaucacgagauuaaaaucgggcagauuaacgaccugggagucuacuccaagggcugcgggaaugugcagaaaguuaacggaaccguguacggcaauggggucccuagauucgacuaucugugucaucuugcuucucggaaggaagugaucguucgcaaaugcuuugauaacgacuaccaagccuguaaguuccugcagagcccggcguccuauagacucgaggaagauagcggcacagugaccauuaucgacuacaagaaaauccugggaacaauuaagaugaaagccauccucggcgaugucaaguauaaaaccuucgcugacucuguggauauuacggccgagggguccugcacaggauguaucaauugcuuugaaaacauucacugugagcugacccuucacaccacaaucgaggcuagcugccccaucaagucuuccuguaccguuuuccaugaccggauucuggugacgccuaaugaacacaaguacgcccucaaaauggucugcacagagaagcccggcaacacccugacaaucaaagugugcaauaccaagauugaagccagcauggcucugguggaugcgaaaccuaucauugagcuugcccccgucgaccagacagcuuauaucagagaaaaggaugagcgcuguaagaccuggaugugccggguuagagacgaggggcuccaggugauucuggaaccuuuuaaaaaccuguucggauccuacaucggcaucuuuuacacguucauuaucucuauuguggcccuccuggucaucguguauguucuucugcccauuuguuuuaagcuccgcgacacccugagaaaacaugaggaugccuacaagcgggaaaugaaaauccgcuga

SEQ ID NO: 14300 - RNA, 4326 nt, Artificial Sequence
  derived and/or modified CDS sequence (opt5) from LACV(74-32813)__D10370.1__GP
augaucagaaugcuggugcucauugucguuaccgccgcuagccccguguaccagcggugcuuccaagacggcgccaucgugaagcagaacccuuccaaagaggcggucacagaagugugucugaaggaugacguuucuaugauuaaaacggaggcucgcuaugugaagaaugccaccggggucuuuagcaacaauguggccaucagaaaauggcuuguuuccgauuggcacgacugccggccgaagaagauugugggaggccauaucaacgucaucgaagugggggaugaccugucucuccacacagagagcuacguguguuccgcugauugcaccauuggagucgacaaagaaacagcccagguucgccugcagaccgauacaaccaaucauuucgagaucgcuggcacgaccgugaagucugggugguuuaaaagcacaaccuauauuacacuugaccaaaccugugagcaccugaagguguccugcgcccccaaaagcguccaguuccaugcguguuuuaaccagcacaugucuugcgugagauuccuccaccggacgauccugccuggauccauugccaauagcaucugucagaacauugaaaucaucauucugguuacacucacccugcuuaucuuuauucugcucucuauccuguccaagacauacauuugcuaucuucugaugcccaucuucaucccuauugcuuacauguauggcgugaucuacaauaagagcuguaaaaagugcaaacucugcggccuggucuaccaucccuuuaccgagugugggacccacugcguguguggagcccgcuaugauacaucugacagaaugaagcugcaucgggcuuccggccucugcccuggguacaaaagccugcgcgccgcgagaguuauguguaaguccaaaggaccggccucuauucuuagcaucauuacggcugugcugguccucaccuucgugacacccaucaacuccaugguccugggcgaaagcaaggagaccuuugagcuugaagaacugccugaugacaugcucgaaauggcccugcggaucaauucuuauuacuucacaugcauucugaacuaugcuguguccugggggcucaucauugccggacugcuuguuggccugaucuuuaagaaauaccaacaccgcuuccucaauauuuaugccauguacugugaggaaugcaacauguaccacgacaagagcggccugaaaagacauggggauuucaccaauaagugucggcagugcacguguggacaguaugaggacgcuacaggccuuaucacccaccgcaaaaccuacaacugccuggugcaguauaaggcgaaguggaugaugaacuuucucauuaucuacaucuuccugauucugaucaaagauucugccauugucgggcaagcuacaggaaccgacuuuacaacgugccucgagaccgaaagcaucaauuggaacuguacaggccccuuccugaaucuugggaacugccagaagcagcagaaaaaggagccuuauaccaauauugccacacaacugaaaggacucaaggccaucuccgugcuggauauccccauuaucaccucuauuccggacgauaucgcuggcgcccugagauacauugaagagaaggaagacuuucauguucagcuuacgaccgaguaugcgaugcucagcaaauacugugauuacuauacacaguucuccgacaacagcggcuacucucaaaccacauggcggguguaucugagaucccacgauuuugaggcuugcauccuguacccuaaucagcauuucuguaagugcgucaaaaacggggaaaaguguucuagcuccaauugggacuuugccaacggaaugaaaaauuauuacagcggcaagcaggccaaguucgacaaagaucucaaccuggcucuuaccgcccugcaccacgcuuuucgcgggacguccucugccuauaucgcggccaugcucagcaagaaauccaaugacgaucugauugcuuacacaaacaagaucaaagccaaguuccccggaaaugcucugcuuaaagccauuaucgacuacauugcguauaugaagggccucccugagauggccaacuuuaaguacgaugaguucugggacgagcugcuguauaaacccaaccccgcuaaggccucuaaucucgcucgggggaaagaaagcuccuacaacuucaagcuggccaucagcucuaaauccaucaagaccugcaagaaugugaaagauguggccugucuuagcccuagaucuggcgcuauuuauuccagcaucauugcgugcggagagccgaacggccccucuguuuaccgcaagccuagcgggggagucuuucaguccagcacagaccggucuaucuauugucugcucgauucccauugccuggaggaguucgaggccauuagccaagaagaacuggacgcugugaaaaaguccaaaugcugggagaucgaauaccccgaugugagaccucuucaggagucugacggcgccaagagcugucgcaugaaggauuccgggaauugcaacgucgccaccaaucgguggcccgugaugcagugugaaaacgacaaauuuuacuauucugagcuccagaaggacuacgauaaaacccaagacauuggacacuauugccugagcccgggcuguacaacgaucagauacccuaucaaucccaagcauauuuccaacugcaauuggcagguuucucgcagcuccaucgcuaaaauugaugugcacaacgucgaagacaucgagcaguauaagaaggccauuacccagaaacugcaaacaagccucucucuguucaaguacgcgaaaaccaagaaucuuccucacauccggcccaucuauaaauacauuacaaugaaggagaccgaaacggcugaggggaucgaauccgccuacauugagagcgaagugccugcccuggcuggcacaucuguuggauuuaaaaucaacuccaaggagggcaagcaucuccuggaugugauugccuaugucaaaagcgcgucuuacuccagcguguaugcuaagcuguacuccaccgggcccaccagcggaaucaauacaaaacacgacgagcuuuguaccggcccgugcccugccaacaucaaccaucagguuggguggcucacauucgccagagaacgcacgucuagcuggggaugugaggaauuuggcugccuggcuguguccgaugggugugucuucggcucuugccaggacauuaucaaggaggaacugagcguguaucggaaagagaccgaggaagugacaaaugucgagcucugccugaccuuuuccgauaagacauacuguaccaaccuuaaucccguuacgcccauuaucaccgaccuguucgaagugcaauuuaagacaguggagaccuauucucucccuagaauugucgccgugcagaaccacgagaucaaaauuggacagaucaaugaucugggcguuuacagcaaggggugcggaaacgugcagaaagucaauggcacaguguacgggaacggaguuccgcgguucgacuaucugugucaucuugcuucccgcaaggaagugaucgucagaaaaugcuuugauaaugacuaccaagccuguaaguuccugcagucucccgcgagcuaucggcucgaggaagacuccggcaccgugacaauuaucgauuacaagaaaauucuggggaccaucaagaugaaagccauucucggcgacguuaaguauaaaacguucgcugauagcguggacaucacagccgagggaucuugcgcuggcuguaucaacugcuuucagaauauucacugugaacugacccuucacaccacaaucgaggccuccugcccuauuaagagcucuuguaccgucuuccaugauagaauccuggugacgcccaacgagcacaaguacgcccucaaaauugugugcacagaaaagccugggaauacccugacaaucaaagucugcaacacccgcaucgaggcuuccauggcgcugguugacgccaagcccauuaucgaacuugcuccuguggaucagacagccuauauucgggagaaagacgaaagauguaagaccuggaugugccgcgugagagaugagggacugcaagucauccucgagcccuuuaagaaucuguucggcagcuacauugggaucuuuuacacguucauuaucuccaucauugcccuccuggugaucauuuauguucuucugccgaucuguuuuaaacuccgggacacccugcgcaagcaugaugacgcuuacaaaagagaaaugaagauucgguga

SEQ ID NO: 14301 - RNA, 4326 nt, Artificial Sequence
  derived and/or modified CDS sequence (opt5) from LACV(Craig County/VA/2009)__KP226848.1__GP
augauccggauucuggugcucaucgccgucaccgcugccagccccguuuaccagagaugcuuccaagacggcgcgauugugaagcagaacccuuccaaagaggcugugacagaagucugucugaaggaugacgugucuaugaucaaaacggaggcccgcuauguuagaaaugccaccgggguguuuagcaacaaugucgcuauucggaaguggcuuguguccgauuggcacgacugccgcccgaaaaagaucaucggaggccauauuaacguuaucgaagugggggaugaccugucucuccacacagagagcuacgucuguuccgccgauugcaccauuggaguggacaaggaaacagcucaggugagacugcagaccgauacaaccaaucauuucgagaucgccggcacgaccgucaaaucugggugguuuaagagcacaaccuauauuacacuugaccaaaccugugagcaccugaaaguuuccugcggacccaagagcgugcaguuccaugcguguuuuaaccagcacaugucuugcgugcgguuccuccaccgcacgauccugccuggcuccauugccaauagcaucugucagaacaucgaaauuaucauucuggucacacucacccugcuuaucuuuauucugcucucuauccuguccaaaacauacaucugcuaucuucugaugcccguguucauuccuaucgcuuguauuuacggcaucauuuauaauaagagcugcaagaaaugcaagcucugugggcugguuuaccaucccuuuaccgagugcggaacccacugugugugcggcgccagauacgauacaucugaccggaugaaacugcaucgcgcuuccgggcucuguccuggauauaagagccugagagccgcgcgggucaugugcaaauccaagggcccggccucuauccuuagcaucauuacggcugugcugguucucaccuucgugacacccaucaacuccaugguccugggggaaagcaaagagaccuuugagcuugaagaacugccugaugacaugcucgaaauggccucucgcauuaauuccuacuauuucacauguauccugaacuacgcugugagcuggggacuggucauuaucggccuccugauuggccuucuguuuaagaaguaucaacacagauuccucaauaucuacgccauguauugcgaggaaugugacauguaccacgauaaaucugggcugaagcggcauggagacuucaccaacaaaugccgccaguguacgugcggccaguacgaggaugccgcugggcuuauggcgcacagaaagacauauaauugccuggugcaguacaaagccaaguggaucaugaacuuucucauuaucuauauuuuccugauccugauuaaggacagcgcuaucguugugcaagccgccggaaccgauuuuaccacaugucucgagaccgaauccaucaacuggaauugcacaggccccuuccugaaccuugggaauugucagaaacagcaaaagaaagagccuuacacgaacauugcuacccagcugaagggacucaaagccaucucuguccuggacauucccaucauuacaggcaucccggaugacaucgcgggcgcucugcgguauauugaagagagagaagauuuucaugugcagcuuaccaucgaguacgccaugcucagcaaguauugcgacuacuacacacaguucuccgauaauagcggguauucucaaaccacguggcgcguuuaccugcggucccacgacuuugaggccuguauucuguauccuaaccagcauuucugcagaugugugaagaauggagaaaaaugcagcagcuccaacugggacuuugcuaauggcaugaaggauuacuauagcgggaaacaggccaaguucgacaaagaucucaaccuggcucuuaccgcccugcaccacgcguuucgcggaacauccucugccuacaucgcuaccaugcucagcaagaaguccaaugacgaucugauuacauauaccaacaaaaucaagacgaaauuccccggcaaugcccugcuuaaggcuaucauugacuacaucgccuacaugaaaucucucccugggauggcgaacuuuaaguaugaugaguucugggacgaacugcuguacaaacccaaucccgccaaggcuagcaaccucgcccggggcaaggaguccagcuauaacuucaaacuggcuauuucuuccaagagcaucaaaacauguaagaaugucaaagauguggccugccuuucuccuagauccggagccauuuacgcuagcaucauugcguguggcgaaccgaacgggcccucuguguaucgcaagccuagcggaggcguuuuucaguccagcaccgaccggucuaucuacugccugcucgauucccauugccuggaggaguucgaagccaucagccaagaggaacuggacgcugucaagaaauccaaguguugggagauugaguaucccgaugugaaaccucuucaggaaucugacgggacaaagagcugcagaaugaaagacuccggaaauuguaacguggccaccaaucgcuggcccaucauucagugcgagaacgauaaguuuuacuacucugaacuccagaaggacuaugauaaaacccaagacaucggccacuacugucugagcccggggugcacaacgguccgguauccuauuaaucccaagcauaucuccaacuguaauuggcaagugucuagaagcuccaucgccaaaauugauguucacaacaucgaggacauugaacaguacaagaaagcuaucacccagaagcugcagacaagccucucucuguucaaguaugccaaaaccaagaaucuuccucacauuaaacccaucuacaaguauaucacaauugagggcaccgagacggcggaaggaaucgaguccgcuuacauugaaagcgaggugccugcccuggccggcgcuucuaucggguuuaaaauuaacuccaaggaaggaaaacaucuccuggaugucaucgccuacgugaagucugcgucuuauuccagcguuuacgcuaagcuguauuccacaggccccaccagcgggauuaauaccaaacacgacgagcuuugcacaggaccguguccugccaacaucaaucaucaggugggcuggcucaccuucgcccgcgagcggacaucuagcugggggugcgaagaguuuggcugucuggcugucuccgauggaugcguguucggcucuugccaggacaucauuaaggaggagcugagcguuuacagaaaagaaacggaggaggugaccgaugucgaacucugucugacauuuuccgacaagaccuauugcacaaaccuuaaccccgugacccccaucauuacggaucuguucgaggugcaauuuaaaaccgucgaaacauacucucucccucggaucguugccgugcagaaucacgagauuaagaucgggcagaucaacgaccugggaguguauagcaagggcugugggaauguccagaaagugaacggaaccguuuacggcaauggggugccgcgcuucgacuaccugugccaucuugcuuccagaaaggaggucauugugcggaaauguuuugauaacgacuaucaagccugcaaguuccugcagucucccgcgagcuacagacucgaagaggauuccggcacaguuaccaucauugacuauaaaaagauccugggaacaauuaagaugaaagccauccucggcgaugugaaguacaaaaccuucgcugacagcgucgauaucacggccgaagggucuuguacaggaugcauuaauuguuuugagaacauccacugcgaacugacccuucacaccacaauugaggcuuccuguccuaucaagagcucuugcaccguguuccaugaccgcauucugguuacgcccaaugagcacaaauaugcccucaagauggugugcacagaaaagccuggcaacacccugacaaucaaagucuguaauaccaagauugaggccuccauggcucugguggaugcgaaacccaucaucgaacuugccccuguggaccagacagcuuacauucgggagaaggaugaaagaugcaaaaccuggaugugucgcgucagagacgaggggcugcagguuauccucgagcccuuuaagaaccuguucggaagcuauauuggcaucuuuuacacguucauuaucuccaucguggccauucucgugaucauuuacguccugcuuccgaucugcuuuaagcugcgggacacccuccgcaaacaugaagaugccuauaagagagagaugaaaauucgguga

SEQ ID NO: 14302 - RNA, 4326 nt, Artificial Sequence
  derived and/or modified CDS sequence (opt5) from LACV(Dallas/TX/2009)__GU591165.1__GP
augauccggauucuggugcucaucgucguuaccgccgcuagccccguguaccagagaugcuuccaagacggcgccauugugaagcagaacccuuccaaagaggcggucacagaagugugucugaaggaugacguuucuaugaucaaaacggaggcucgcuaugugaagaaugccaccggggucuuuagcaacaauguggccauuagaaaauggcuuguuuccgauuggcacgacugccggccgaagaagaucgugggaggccauaucaacgucauugaagugggggaugaccugucucuccacacagagagcuacguguguuccgcugauugcaccaucggagucgacaaagaaacagcccagguucgccugcagaccgauacaaccaaucauuucgagauugcuggcacgaccgugaagucugggugguuuaaaagcacaaccuauaucacacuugaccaaaccugugagcaccugaagguguccugcggacccaaaagcguccaguuccaugccuguuuuaaccagcacaugucuugcgugagauuccuccaccggacgauucugccuggcuccaucgcgaauagcauuugucagaacaucgaaaucauuauccugguuacacucacccugcuuauuuuuauccugcucucuauucuguccaagacauacaucugcuaucuucugaugcccaucuucauuccuauggccuacauguauggcgugaucuacaauaagagcuguaaaaagugcaaacucugcgggcuggucuaccaucccuuuaccgaguguggaacccacugcguguguggcgcucgcuaugauacaucugacagaaugaagcugcaucgggccuccgggcucugcccuggauacaaaagccugcgcgcugccagaguuauguguaaguccaaaggcccggcgucuauucuuagcaucauuacggccgugcugguccucaccuucgugacacccaucaacuccaugguccugggggaaagcaaggagaccuuugagcuugaagaacugccugaugacaugcucgaaauggcucugcggaucaauucuuauuacuucacaugcauucugaacuaugccguguccuggggacucaucauugcuggccugcuuguuggccugaucuuuaagaaauaccaacaccgcuuccucaauauuuaugccauguacugugaggaaugcgacauguaccacgauaagagcgggcugaaaagacauggagacuucaccucuaagugucggcagugcacguguggccaguaugaggaugccacagggcuuaucacccaccgcaaaaccuacaacugccuggugcaguauaaggcuaaguggaugaugaauuuucucauuaucuacaucuuccugauucugaucaaagacagcgcgauugucgugcaagccacaggaaccgauuuuacaacgugccucgagaccgaauccaucaacuggaacuguacaggccccuuccugaaucuugggaacugccagaagcagcagaaaaaggagccuuauaccaauauugcuacacaacugaaaggacucaaggccaucucuguucuggacauccccauuaucaccggcauuccggaugacaucgccggcgcucugagauacauugaagagaaggaagauuuucaugugcagcuuacgaccgaguaugccaugcucagcaaauacugugacuacuauacacaguucuccgauaacagcggguacucucaaaccacauggcgggucuaucugagaucccacgacuuugaggcgugcauccuguacccuaaucagcauuucugucgcugcgugaagaacggagaaaaauguucuagcuccaauugggacuuugcuaacgagaugaagaauuauuacagcggcaaacaggccaaguucgauaaggaccucaaccuggcccuuaccgcucugcaccacgccuuucgggggacguccucugcuuauaucgccacaaugcucagcaaaaaguccaaugaugaccugguggcguacaccaacaaaauuaaggccaaauuccccggaaaugcucugcuuaaggccaucauugauuacaucgcuuauaugaaaggccucccugacauggccaacuuuaaguacgaugaguucugggacgagcugcuguauaagcccaaucccgcgaaagccucuaaccucgcuagagggaaggaaagcuccuacaacuucaaacuggccguuagcucuaaguccauucgcacaugcaaaaaugucaaggauguggcuugucuuagcccucggucuggcgccaucuauuccagcaucauugccugcggagagccgaacggccccucuguguacagaaagccuagcgggggagucuuucaguccagcaccgaccgcucuaucuauugucugcucgauucccauugccuggaggaguucgaagcuauuagccaagaggaacuggacgcggugaaaaaguccaaaugcugggagaucgaauaccccgauauucggccucuucaggagucugacggcagcaaguccuguagaaugaaagacucugggaauugcaacguugccaccaaucgcuggcccgugaugcagugugaaaacgauaaguuuuacuauagcgagcuccagaaggacuacgauaaaacacaagacaucggacacuauugccuguccccgggcuguacgaccauucgguacccuaucaaucccaagcauaucucuaacugcaauuggcaggucagcagauccagcauugcuaaaaucgaugugcacaacguugaagacauugagcaguauaagaaagccaucacacagaagcugcaaaccucucucucccuguucaaguacgccaaaacaaagaaucuuccucacauuaaacccaucuauaaguacaucaccauugaggggacggaaacagcugagggcaucgaaagcgccuacauugagucugaagugccugcgcuggcuggaaccuccaucggcuuuaaaauuaacagcaaggaggggaaacaucuccuggaugucaucgccuaugugaagucugccuccuacagcuccguuuaugcuaagcuguacagcaccggacccacaucuggcaucaauaccaaacacgacgagcuuuguacagggccgugcccugccaacauuaaucaucaggugggauggcucacguucgcgcgcgaacggaccagcuccuggggcugugaggaauuugggugccuggcugucucugauggcuguguguucggaagcugccaggacaucauuaaggaggaacuguccguguauagaaaagauacagaggaggucaccaacguugaacucugccugacauuuucugacaagaccuacuguacgaaccuuaaucccgugacccccaucauuacagaucuguucgaggugcaauuuaaaaccgucgaaacauauagccucccucggaucguggccguucagaaccacgagauuaagaucggccagaucaaugaccuggggguguacuccaagggaugcggcaacguccagaaagugaaugggaccguuuacggaaacggcgugccgcgcuucgacuaucugugucaucuugccucuagaaaggaggucauugugcggaaaugcuuugauaaugacuaccaggcuuguaaguuccugcaaagccccgccuccuauagacucgaagaggauagcgggacaguuaccaucauugacuacaaaaagauccugggcacgauuaagaugaaagcuauccucggagaugugaaguauaaaacauucgccgacucugucgauaucaccgcggaaggcuccugcgccggguguauuaacugcuuugagaauauccacugugaacugacccuucacacaaccauugaggcuagcugcccuaucaagucuuccuguacgguguuccaugaccgcauucuggugacacccaacgagcacaaauacgcccucaagauggucugcaccgaaaagccuggaaauacacugaccaucaaaguuugcaacacacggaucgaggugagcauggcucugguggaugccaagcccauuaucgaacuugccccugucgaccagaccgcuuauauuagagagaaagaugaacgcuguaagacguggaugugcagagugcgggacgagggccugcagguuauccucgagcccuuuaaaaaucuguucggguccuacauuggaaucuuuuacaccuucauuaucucuaucauugcgcuccuggugaucauuuauguccuucugccgaucuguuuuaagcuccgcgacacacugagaaagcaugaugacgccuacaaacgggaaaugaagauucgcuga

SEQ ID NO: 14303 - RNA, 4326 nt, Artificial Sequence
  derived and/or modified CDS sequence (opt5) from LACV(Fort Bend County/TX/2009)__GU591168.1__GP
augaucagaaugcuggugcucauugucguuaccgccgcuagccccguguaccagcggugcuuccaagacggcgccaucgugaagcagaacccuuccaaagaggcggucacagaagugugucugaaggaugacguuucuaugauuaaaacggaggcucgcuaugugaagaaugccaccggggucuuuagcaacaauguggccaucagaaaauggcuuguuuccgauuggcacgacugccggccgaagaagauugugggaggccauaucaacgucaucgaagugggggaugaccugucucuccacacagagagcuacguguguuccgcugauugcaccauuggagucgacaaagaaacagcccagguucgccugcagaccgauacaaccaaucauuucgagaucgcuggcacgaccgugaagucugggugguuuaaaagcacaaccuauauuacacuugaccaaaccugugagcaccugaagguguccugcggacccaaaagcguccaguuccaugccuguuuuaaccagcacaugucuugcgugagauuccuccaccggacgauccugccuggcuccauugcgaauagcaucugucagaacauugaaaucaucauucugguuacacucacccugcuuaucuuuauucugcucucuauccugucccgcacauacauuugcuaucuucugaugcccaucuucaucccuauugccuacauguauggcgugaucuacaauaagagcuguaagaaaugcaagcucugcgggcuggucuaccaucccuuuaccgaguguggaacccacugcguguguggcgcuagauaugauacaucugaccggaugaaacugcaucgcgccuccgggcucugcccuggauacaagagccugagagcugcccggguuauguguaaauccaagggcccggcgucuauucuuagcaucauuacggccgugcugguccucaccuucgugacacccaucaacuccaugguccugggggaaagcaaagagaccuuugagcuugaagaacugccugaugacaugcucgaaauggcucugcgcaucaauucuuauuacuucacaugcauucugaacuaugccguguccuggggacucaucauugcuggccugcuuguuggccugaucuuuaagaaguaccaacacagauuccucaauauuuaugccauguacugugaggaaugcgacauguaccacgauaaaagcgggcugaagcggcauggagacuucaccaacaaaugucgccagugcacguguggccaguaugaggaugccgcugggcuuauggcgcacagaaagacauacaauugccuggugcaguauaaagccaaguggaugaugaacuuucucaucauuuacaucuuccugauccugauuaaggacucugcuaucgucgugcaagccaccggaaccgauuuuacaaccugccucgagacagaaagcauuaacuggaauuguacgggccccuuccugaaccuugggaauugccagaaacagcaaaagaaagagccuuauaccaacaucgccacacagcugaagggacucaaagcuauuuccguucuggacauccccaucauuaccggcaucccggaugacauugccggcgcgcugcgguacaucgaagagaaggaagauuuucauauucagcuuacaaccgaguaugcuaugcucucuaaguacugugacuacuauacgcaguucagcgauaauuccggguacagccaaaccacauggagaguguaucugcgcucucacgacuuugaggccugcauccuguacccuaaccagcauuucugucggugcgucaaaaauggagaaaaguguuccagcucuaacugggacuuugccaaugagaugaaaaacuauuacuccggcaagcaggcuaaauucgauaaggaccucaaucuggcccuuaccgcucugcaccacgccuuuagagggacaagcuccgcguauaucgccaccaugcucucuaagaaaagcaacgaugaccugauugcuuacacgaauaagaucaaagccaaguuccccggaaacgcucugcuuaaagccauuaucgauuacauugcguauaugaagggccucccugacauggccaauuuuaaauacgaugaauuuugggacgagcugcuguauaagcccaaccccgcuaaggccuccaaccucgcucgcgggaaagaaucuagcuacaauuucaagcuggccaucuccagcaaaucuaucaagacaugcaaaaacgugaaggauguggccugucuuuccccucggagcggcgcuauuuauucuuccaucauugcgugcggagagccgaauggccccagcguuuacagaaagccuucugggggagucuuucagagcuccaccgaccgcagcaucuauugucugcucgauucucauugccuggaggaguucgaggccauuucccaagaagaacuggacgcugugaaaaagagcaaaugcugggagaucgaauaccccgaugugcggccucuucaggaguccgacggcgccaagucuuguagaaugaaagacagcgggaacugcaaugucgccacaaaccgcuggcccgugaugcagugugaaaaugauaaguuuuacuauuccgagcuccagaaggacuacgauaaaacccaagacauuggacacuauugccugucuccgggcuguaccacaauccgguacccuaucaaccccaagcauauuagcaauugcaacuggcagguuuccagaucuagcaucgcuaaaauugaugugcacaaugucgaagacaucgagcaguauaagaaagccauuacgcagaagcugcaaaccucccucagccuguucaaguacgcgaaaacaaagaaccuuccucacaucaaacccaucuauaaguacauuaccaucgaggggacagaaaccgcugagggcauugaaucugccuacaucgaguccgaagugccugcccuggcuggaacgagcauuggcuuuaaaaucaauucuaaggaggggaaacaucuccuggauguuaucgccuaugugaaguccgcgagcuacucuuccgucuaugcuaagcuguacagcacaggacccaccuccggcauuaacaccaaacacgacgagcuuuguacagggccgugcccugccaauaucaaccaucaggugggauggcucaccuucgcccgcgaacggacaagcucuuggggcugugaggaauuugggugccuggcuguuagcgauggcuguguguucggauccugccaggacauuaucaaggaggaacugucugucuauagaaaagagacggaggaagugaccaacguggagcucugccugacauuuagcgauaagaccuacuguacaucccuuaaucccgucacccccauuaucacggaccuguucgaaguucaauuuaaaaccguggagacauauucucucccucggauuguggccguccagaaccacgagaucaagaucggccagauuaaugaucuggggguguacagcaagggaugcggcaacguucagaaagugaaugggaccgucuacggaaacggcgugccgcgcuucgacuaucugugucaucuugcuuccagaaaggaaguuaucgugcggaaaugcuuugacaaugauuaccaagccuguaaguuccugcagucucccgcgagcuauagacucgaggaagacuccgggacagucaccauuaucgauuacaaaaagauucugggcacaaucaagaugaaagccauccucggagacgugaaguauaaaaccuucgcugauagcguugacauuacggccgagggcucuugcgcuggguguaucaacugcuuugaaaauauucacugugagcugacacuucacaccaccaucgaggccuccugcccuauuaagagcucuuguacaguguuccaugaucgcauccuggucacccccaacgaacacaaauacgcccucaagauggugugcacggagaagccuggaaauacacugaccaucaaagugugcaacacacggauugaggcuuccauggcgcuggucgacgccaagcccaucauugagcuugcuccuguugaucagaccgccuauaucagagaaaaagacgagcgcuguaagacauggaugugcagagugcgggaugagggccuccaggugauucuggaacccuuuaaaaaucuguucgggagcuacaucggaauuuucuacaccuucaucaucuccauuaucgcccuccuggucauuaucuaugugcuucugccgauuuguuuuaagcuccgcgacacgcugagaaagcaugacgaugcuuacaaacgggagaugaagauccgcuga

SEQ ID NO: 14304 - RNA, 4326 nt, Artificial Sequence
  derived and/or modified CDS sequence (opt5) from LACV(LAC22988-89)__U18980.1__GP
augaucugcauucuggugcucaucaccgucgccgcugccagccccguuuaccagagauguuuccaagacggcgcgauugugaagcagaacccuuccaaagaggcugugacagaagucugccugaaggaugacgugucuaugaucaaaacggaggcccgguauguucgcaaugccaccgggguguuuagcaacaaugucgcuauuagaaaguggcuuguguccgauuggcacgacugucggccgaaaaagaucguuggaggccauaucaacgugauugaagucggggaugaccugucucuccacacagagagcuacgugugcuccgccgauuguaccaucggaguggacaaggaaacagcucagguccgccugcagaccgauacaaccaaucauuucgagauugccggcacgaccguuaaaucugggugguuuaagagcacaaccuauaucacacuugaccaaaccugcgagcaccugaaaguguccuguggacccaagagcgugcaguuccaugcgugcuuuaaccagcacaugucuugugucagauuccuccaccggacgauucugccuggcuccaucgccaauagcauuugccagaacaucgaaaucauuauccuggugacacucacccugcuuauuuuuauccugcucucuauucuguccaaaacauacaucuguuaucuucugaugcccaucuucauuccuaucgcuuacauuuauggcaucauuuacaauaagagcugcaagaaaugcaagcucugugggcugguuuaccaucccuuuaccgagugcggaacccacugugugugcggcgcccgcuaugauacaucugacagaaugaaacugcaucgggcuuccgggcucuguccuggauacaagagccugcgcgccgcgagagucaugugcaaauccaagggcccggccucuauccuuagcaucauuacggcugugcugguucucaccuucgugacacccaucaacuccaugguccugggggaaagcaaagagaccuuugagcuugaagaucugccugacgacaugcucgagauggccucucggauuaauuccuauuaccugacauguauccugaacuaugcugugagcuggggacucgucauuaucggccugcuuauuggccuucucuucaagaaguaccaacaccgcuuucugaauguguaugccauguacugcgaagagugugauauguaccacgacaaaucugggcuuaagagacauggagauuucaccaacaaaugccggcaguguacgugcggccaguaugaagacgccgcugggcugauggcgcaccgcaagacauacaauugccucguucaguauaaagccaaguggaugaugaacuuccugaucaucuacauuuuucugauccucauuaaggauagcgcuaucgugguccaagccgccggaaccgacuucaccacaugucuggagaccgaguccauuaacuggaauugcacaggccccuuucuuaaccuggggaauugucagaaacagcaaaagaaagaaccuuauacgaacaucgcuacccagcucaagggacugaaagccaucucugugcuggauguucccauuaucacaggcauuccggacgauaucgcgggcgcucuuagauacauugaggaaaaggaggacuuccaugugcagcucaccaucgaauaugccaugcugagcaaguacugcgauuacuauacacaguuuuccgacaauagcggguacucucaaaccacguggcgggucuaucugagaucccacaacuucgaggccuguauccucuacccuaaucagcauuuuugccgcugugugaaaaacggagagaagugcucuagcuccaauugggacuucgcuaacgaaaugaaagauuauuacagcggcaagcagaccaaauuugacaaggaucugaaucuugcccugacagcucuccaccacgccuuccgggggaccuccucugcguauauugccacaaugcugagcaagaaauccaacgacgaucugaucgcuuacaccaauaagauuaaaacgaaguuucccggaaacgcccuucucaaagcuaucauugacuacaucgccuauaugaagucucugccuggcauggcgaauuucaaauacgaugaguuuugggacgaacugcucuauaagcccaaccccgccaaggcuagcaaccuggccagagggaaagaguccagcuacaauuucaagcuggcuaucucuuccaaaagcauuaagaucuguaaaaacgugaaggauguugccugccugucuccucgcuccggcgccauuuaugcuagcaucauugcguguggagaaccgaauggccccucugucuaccggaagccuagcgggggaguguuccaguccagcacagacagaucuaucuauugccuccuggauucccauugccuggaggaguuugaagccauuggccaagaggaacuugacgcugugaaaaagagcaaauguugggagaucgaguaccccgaugucaagcucauccaggaaggggacggaaccaaauccugccgcaugaaggacucuggcaacuguaauguggccacaaaccgguggccuguuauucagugcgagaaugauaaguucuacuauagcgaacugcagaaagacuacgauaaggcccaagacaucgggcacuauugucugucccccggcugcaccaccgugagauacccgauuaacccuaaacauaucucuaauuguaacuggcaggucagccgcuccucuauugcuaagaucgaugugcacaauaucgaggacauugaacaguauaaaaaggccaucacacagaagcuccaaacgagccugucccuuuuuaaauacgcgaagaccaaaaaccugccccacauuaagccuaucuauaaauacauuacaaucgagggaaccgagacagcugaaggcaucgagagcgccuacauugaaucugagguucccgcccucgcugggaccuccaucggauucaagauuaauagcaaagaaggcaagcaucugcuggaugugaucgccuaugucaagucugcguccuacagcucuguguauacgaaacuuuacuccacagggccuaccagcggaauuaacaccaagcacgacgagcucugcacaggccccuguccggcuaauaucaaccaucagguuggguggcugaccuuugcccgggagagaacauccagcuggggcugcgaagaguucggaugucuggccgugucugauggcugcgucuuugggagcugccaggacauuaucaaagaggaacucuccguguaucgcaaggaaacggaggaggugaccgaugucgaacugugucuuacauucucugacaaaaccuacugcacaaaccugaauccuguuacccccaucauuacggaucucuuugaggugcaauucaagaccguggaaacauauagccugccccggaucgucgcugugcagaaccacgagauuaagaucggacagauuaaugaccugggcguuuacuccaaaggguguggaaacgugcagaaggucaauggcaccaucuacgggaacggcgugccuagauuugacuaucuuugccaucuggccucucggaaagagguuaucgugcgcaaguguuucgauaaugacuaccaggcuugcaaauuucuccaaagcccggccuccuauagacuggaagaggauucuggaacagucaccauuaucgacuacaagaagauucucggcacaaucaaaaugaaggcgauucugggggaugugaaauauaagaccuucgccgacagcguugauaucacggcugaaggauccuguacaggcugcaucaacuguuucgagaauauucacugcgaacuuacccugcacaccacaaucgaggccagcugucccauuaaaucuuccugcaccguguuucaugaccggauccucgucacgccuaacgagcacaaguacgcucugaagauggugugcacagaaaaacccgggaauacccugacaauuaagguguguaacaccaaagucgaggccagcauggcccuuguugaugcuaagccuaucauugaacuggcgcccguggaccagacagccuauaucagagagaaagaugaacgcugcaagaccuggaugugucgggugagagacgagggacuccaggucauccuggagccuuucaagaaucucuuuggcucuuacauuggcaucuucuacacguuuauuaucuccauugugguucugcuugugaucaucuauguccugcuccccauuugcuucaaacugcgcgacacccugagaaagcaugaagaugcuuacaaacgggagaugaagauccgcuga

SEQ ID NO: 14305 - RNA, 4326 nt, Artificial Sequence
  derived and/or modified CDS sequence (opt5) from LACV(LAC30928-31)__U18979.1__GP
augaucugcauucuggugcucaucaccgucgccgcugccagccccguuuaccagagauguuuccaagacggcgcgauugugaagcagaacccuuccaaagaggcugugacagaagucugccugaaggaugacgugucuaugaucaaaacggaggcccgguauguucgcaaugccaccgggguguuuagcaacaaugucgcuauuagaaaguggcuuguguccgauuggcacgacugucggccgaaaaagaucguuggaggccauaucaacgugauugaagucggggaugaccugucucuccacacagagagcuacgugugcuccgccgauuguaccaucggaguggacaaggaaacagcucagguccgccugcagaccgauacaaccaaucauuucgagauugccggcacgaccguuaaaucugggugguuuaagagcacaaccuauaucacacuugaccaaaccugcgagcaccugaaaguguccuguggacccaagagcgugcaguuccaugcgugcuuuaaccagcacaugucuugugucagauuccuccaccggacgauucugccuggcuccaucgccaauagcauuugccagaacaucgaaaucauuauccuggugacacucacccugcuuauuuuuauccugcucucuauucuguccaaaacauacaucuguuaucuucugaugcccaucuucauuccuaucgcuuacauuuauggcaccaucuacaauaagagcugcaagaaaugcaagcucugugggcugguuuaccaucccuuuaccgagugcggaacacacugugugugcggcgcccgcuaugauacgucugacagaaugaaacugcaucgggcuuccgggcucuguccuggauacaagagccugcgcgccgcgagagucaugugcaaauccaagggcccggccucuauucuuagcaucaucaccgcugugcugguucucacauucgugacccccauuaacuccaugguccugggggaaagcaaagagacauuugagcuugaagaucugccugacgacaugcucgagauggccucucggaucaauuccuauuaccugaccuguauucugaacuaugcugugagcuggggacucgucaucauuggccugcuuaucggccuucucuucaagaaguaccaacaccgcuuucugaauguguaugccauguacugcgaagagugugauauguaccacgacaaaucugggcuuaagagacauggagauuucacgaacaaaugccggcaguguacaugcggccaguaugaagacgccgcugggcugauggcgcaccgcaagaccuacaauugccucguucaguauaaagccaaguggaugaugaacuuccugauuaucuacaucuuucugauucucaucaaggauagcgcuauugugguccaagccgccggaaccgacuucacaaccugucuggagacagaguccaucaacuggaauugcacgggccccuuucuuaaccuggggaauugucagaaacagcaaaagaaagaaccuuauaccaacauugcuacacagcucaagggacugaaagccaucucugugcuggauguucccaucauuaccggcaucccggacgauauugcgggcgcucuuagauacaucgaggaaaaggaggacuuccaugugcagcucacaauugaauaugccaugcugagcaaguacugcgauuacuauacccaguuuuccgacaauagcggguacucucaaacgaccuggcgggucuaucugagaucccacgacuucgaggccuguauccucuacccuaaccagcauuuuugccgcugugugaaaaauggagagaagugcucuagcuccaaccgggauuucgcuaaugaaaugaaagacuauuacagcggcaagcagacaaaauuugauaaggaccugaaccuugcccugaccgcucuccaccacgccuucagagggacauccucugcguauaucgccaccaugcugagcaagaaauccaaugaugaccugauugcuuacacgaacaagaucaaaacaaaguuucccggaaaugcccuucucaaagcuauuaucgauuacauugccuauaugaagucucugccuggcauggcgaacuucaaauacgacgaguuuugggaugaacugcucuauaagcccaaucccgccaaggcuagcaaccuggcccgcgggaaagaguccagcuacaacuucaagcuggcuaucucuuccaaaagcaucaagauuuguaaaaaugugaaggacguugccugccugucuccucgguccggcgccaucuaugcuagcauuaucgcguguggagaaccgaacggccccucugucuacagaaagccuagcgggggaguguuccaguccagcaccgaucccucuauuuauugccuccuggacucccauugccuggaggaguuugaagccaucggccaagaggaacuugaugcugugaaaaagagcaaauguugggagauugaguacccugacgucaagcucauccaggaaggggacggaacaaaauccugccgcaugaaggauucuggcaauuguaacguggccaccaaucgguggcccguuauccagugcgagaacgacaaguucuacuauagcgaacugcagaaagauuacgacaagacccaagauauugggcacuauugucuguccccgggcugcacaacggugagauacccuaucaaucccaaacauauuucuaacuguaauuggcaggucagccgcuccucuaucgccaagauugacgugcacaacaucgaggauaucgaacaguauaaaaaggcuauuacccagaagcuccaaacaagccugucccuuuuuaaauacgccaagaccaaaaaucugccucacaucaagcccauuuauaaauacaucacaauugagggaaccgagacggcggaaggcaucgagagcgcuuacaucgaaucugagguuccugcccucgccgggacauccauuggauucaagaucaacagcaaagaaggcaagcaucugcuggacgugauugcuuaugucaagucugccuccuacagcucuguguauaccaaacuuuacuccaccgggcccacaagcggaaucaauaccaagcacgaugagcucugcacaggcccguguccugcgaacauuaaucaucagguuggguggcugacguuugcucgggagagaaccuccagcuggggcugcgaagaguucggaugucuggccgugucugacggcugcgucuuugggagcugccaggauaucauuaaagaggaacucuccguguaucgcaaggaaacagaggaggugaccgacgucgaacugugucuuacauucucugauaaaaccuacugcacgaaccugaaccccguuacccccaucaucacagaccucuuugaggugcaauucaagaccguggaaacauauagccugccucggauugucgccgugcagaaucacgagaucaagauuggacagaucaacgaccugggcguuuacuccaaaggguguggaaaugugcagaaggucaacggcaccauuuacgggaauggcgugccgagauuugauuaucuuugccaucuggcuucucggaaagagguuaucgugcgcaaguguuucgacaacgauuaccaagccugcaaauuucuccagagccccgcuuccuauagacuggaagaggacucuggaacagucaccaucauugauuacaagaagauccucggcacgauuaaaaugaaggccauccugggggacgugaaauauaagacauucgcggauagcguugacauuaccgccgaaggauccuguaccggcugcaucaauuguuucgagaacauccacugcgaacuuacacugcacaccacgauugaggcuagcuguccuaucaaaucuuccugcacaguguuucaugaucggauucucgucacccccaaugagcacaaguacgcccugaagauggugugcacagaaaaaccugggaacacccugacaaucaagguguguaauaccaaaauugaggcuagcauggcccuugucgacgccaagcccaucauugaacuggcuccuguugaucagacggcguauaucagagagaaagacgaacgcugcaagaccuggaugugucgggugagagacgagggacuccaggugauccuggagcccuucaagaaccucuuuggcucuuacauuggcaucuucuacacauuuauuaucuccauugucgcccugcuugugaucaucuauguucugcucccgauuugcuucaaacugcgcgauacccugagaaagcaugaagacgcuuacaaacgggagaugaagauccgcuga

SEQ ID NO: 14306 - RNA, 4326 nt, Artificial Sequence
  derived and/or modified CDS sequence (opt5) from LACV(LAC76-40)__U70206.1__GP
augaucugcauucuggugcucaucaccgucgccgcugccagccccguuuaccagagauguuuccaagacggcgcgauugugaagcagaacccuuccaaagaggcugugacagaagucugccugaaggaugacgugucuaugaucaaaacggaggcccgguauguucgcaaugccaccgggguguuuagcaacaaugucgcuauuagaaaguggcuuguguccgauuggcacgacugucggccgaaaaagaucguuggaggccauaucaacgugauugaagucggggaugaccugucucuccacacagagagcuacgugugcuccgccgauuguaccaucggaguggacaaggaaacagcucagguccgccugcagaccgauacaaccaaucauuucgagauugccggcacgaccguuaaaucugggugguuuaagagcacaaccuauaucacacuugaccaaaccugcgagcaccugaaaguguccuguggacccaagagcgugcaguuccaugcgugcuuuaaccagcacaugucuugugucagauuccuccaccggacgauucugccuggcuccaucgccaauagcauuugccagaacaucgaaaucauuauccuggugacacucacccugcuuauuuuuauccugcucucuauucuguccaaaacauacaucuguuaucuucugaugcccaucuucauuccuaucgcuuacauuuauggcaucauuuacaauaagagcugcaagaaaugcaagcucugugggcugguuuaccaucccuuuaccgagugcggaacccacugugugugcggcgcccgcuaugauacaucugacagaaugaaacugcaucgggcuuccgggcucuguccuggauacaagagccugcgcgccgcgagagucaugugcaaauccaagggcccggccucuauccuuagcaucauuacggcugugcugguucucaccuucgugacacccaucaacuccaugguccugggggaaagcaaagagaccuuugagcuugaagaucugccugacgacaugcucgagauggccucucggauuaauuccuauuaccugacauguauccugaacuaugcugugagcuggggacucgucauuaucggccugcuuauuggccuucucuucaagaaguaccaacaccgcuuucugaauguguaugccauguacugcgaagagugugauauguaccacgacaaaucugggcuuaagagacauggagauuucaccaacaaaugccggcaguguacgugcggccaguaugaagacgccgcugggcugauggcgcaccgcaagacauacaauugccucguucaguauaaagccaaguggaugaugaacuuccugaucaucuacauuuuucugauccucauuaaggauagcgcuaucgugguccaagccgccggaaccgacuucaccacaugucuggagaccgaguccauuaacuggaauugcacaggccccuuucuuaaccuggggaauugucagaaacagcaaaagaaagaaccuuauacgaacaucgcuacccagcucaagggacugaaagccaucucugugcuggauguucccauuaucacaggcauuccggacgauaucgcgggcgcucuuagauacauugaggaaaaggaggacuuccaugugcagcucaccaucgaauaugccaugcugagcaaguacugcgauuacuauacacaguuuuccgacaauagcggguacucucaaaccacguggcgggucuaucugagaucccacgacuucgaggccuguauccucuacccuaaccagcauuuuugccgcugugugaaaaauggagagaagugcucuagcuccaacugggauuucgcuaaugaaaugaaagacuauuacagcggcaagcagaccaaauuugauaaggaccugaaccuugcccugacagcucuccaccacgccuuccgggggaccuccucugcguauauugccacaaugcugagcaagaaauccaaugaugaccugaucgcuuacaccaacaagauuaaaacgaaguuucccggaaaugcccuucucaaagcuaucauugauuacaucgccuauaugaagucucugccuggcauggcgaacuucaaauacgacgaguuuugggaugaacugcucuauaagcccaaucccgccaaggcuagcaaccuggccagagggaaagaguccagcuacaacuucaagcuggcuaucucuuccaaaagcauuaagacauguaaagacgugaaggauguugccugccugucuccucgcuccggcgccaucuaugcuagcauuaucgcguguggagaaccgaauggccccucugucuaccggaagccuagcgggggaguguuccaguccagcaccgacagaucuauuuauugccuccuggauucccauugccuggaggaguuugaagccaucggccaagaggaacuugacgcugugaaaaagagcaaauguugggagauugaguaccccgacgucaagcucauccaggaaggggauggaacaaaauccugccgcaugaaggacucuggcaacuguaauguggccaccaaccgguggccuguuauccagugcgagaaugauaaguucuacuauagcgaacugcagaaagacuacgauaagacccaagacauugggcacuauugucugucccccggcugcacaacggugagauacccgaucaacccuaaacauauuucuaauuguaacuggcaggucagccgcuccucuaucgccaagauugaugugcacaauaucgaggacaucgaacaguauaaaaaggcuauuacccagaagcuccaaacaagccugucccuuuuuaaauacgccaagaccaaaaaccugccccacaucaagccuauuuauaaauacaucacaauugagggaaccgagacggcggaaggcaucgagagcgcuuacaucgaaucugagguucccgcccucgccgggacauccauuggauucaagaucaauagcaaagaaggcaagcaucugcuggaugugauugcuuaugucaagucugccuccuacagcucuguguaugcgaaacuuuacuccaccgggccuaccagcggaaucaacacaaagcacgacgagcucugcaccggccccuguccggcuaauauuaaccaucagguuggguggcugacauuugcccgggagagaacguccagcuggggcugcgaagaguucggaugucuggccgugucugauggcugcgucuuugggagcugccaggacaucauuaaagaggaacucuccguguaucgcaaggaaaccgaggaggugacagaugucgaacugugucuuaccuucucugacaaaacauacugcaccaaucugaacccuguuacgcccaucaucaccgaccucuuugaggugcaauucaagacaguggaaaccuauagccugccccggauugucgcugugcagaaccacgagaucaagauuggacagaucaaugaucugggcguuuacuccaaaggguguggaaacgugcagaaggucaauggcacaauuuacgggaacggcgugccuagauuugacuaucuuugccaucuggccucucggaaagagguuaucgugcgcaaguguuucgauaaugacuaccaggcuugcaaauuucuccaaagcccggccuccuauagacuggaagaggauucuggaaccgucacaaucauugacuacaagaagauccucggcaccauuaaaaugaaggcgauccugggggaugugaaauauaagacguucgccgacagcguugauauuacagcugaaggauccuguaccggcugcaucaacuguuucgagaauauccacugcgaacuuacccugcacacaaccauugaggccagcugucccaucaaaucuuccugcacgguguuucaugaccggauucucgucacaccuaacgagcacaaguacgcucugaagauggugugcaccgaaaaacccgggaauacacugaccaucaagguguguaacacaaaaauugaggccagcauggcccuugucgaugcuaagccuaucauugaacuggcgcccguugaccagaccgccuauaucagagagaaagacgaacgcugcaagacguggaugugucgggugagagaugagggacuccaggugauccuggagccuuucaagaaucucuuuggcucuuacauuggcaucuucuacaccuuuauuaucuccauugucgcucugcuugugaucaucuauguucugcuccccauuugcuucaaacugcgcgacacacugagaaagcaugaagaugccuacaaacgggagaugaagauccgcuga

SEQ ID NO: 14307 - RNA, 4326 nt, Artificial Sequence
  derived and/or modified CDS sequence (opt5) from LACV(LAC79-283)__U70207.1__GP
augauccggauucuggugcucaucgccgucaccgcugccagccccguuuaccagagaugcuuccaagacggcgcgauugugaagcagaacccuuccaaagaggcugugacagaagucugucugaaggaugacgugucuaugaucaaaacggaggcccgcuauauuagaaaugccaccgggguuuuuagcaacaauguggcuauccggaaguggcuugucuccgauuggcacgacugccgcccgaaaagaaucauuggaggccauaucaacgugauugaaguuggggaugaccugucucuccacacagagagcuacguguguuccgccgauugcaccaucggagucgacaaggaaacagcucaggugcggcugcagaccgauacaaccaaucauuucgagauugccggcacgaccgugaagucugggugguuuaaaagcacaaccuauaucacacuugaccaaaccugugagcaccugaaggucuccugcggacccaaaagcguucaguuccaugcguguuuuaaccagcacaugucuugcgugcgcuuccuccacagaacgauucugccuggcuccaucgccaauagcaucugucagaacauugaaaucauuauccuggugacacucacccugcuuauuuuuauccugcucucuauccuguccaagacauacauuugcuaucuucugaugcccaucuucauuccuaucgcuuacauuuauggcaucaucuacaauaaaagcuguaagaagugcaaacucugcgggcuggucuaccaucccuuuaccgaguguggaacccacugcguguguggcgcccgguaugauacaucugaccgcaugaagcugcauagagcuuccgggcucugcccuggauacaaaagccugcgggccgcgcgcguuauguguaaguccaaaggcccggccucuauucuuagcaucauuacggcugugcugguccucaccuucgugacacccaucaacuccaugguucugggggaaagcaaggagaccuuugagcuugaagaacugccugaugacaugcucggaauggccucuagaauuaauuccuauuacuucacaugcauccugaacuaugcugugagcuggggccuggucauuaucggccuccugaccgggcuucuguuuaaaaaguaccaacaccgguuccucaauguguaugccauguacugugaagagugcgacauguaccacgauaagucuggacugaaacgccauggcgacuucacgaacaaguguagacagugcacaugugggcaguaugaagaugccaccggacuuauggcucaccggaaaaccuacaauugccugguccaguauaaggcgaaauggaugaugaacuuucucgugaucuacauuuuccugauccugauuaaggacagcgccaucguugugcaagcugccggcacagauuuuaccacaugccucgagacggaguccauuaacuggaauuguaccgggcccuuccugaaccuuggaaauugccagaagcagcagaaaaaggaaccuuauacaaacaucgccacccaacugaaaggccucaaggcuaucucuguccuggacauucccaucauuacaggcaucccggaugacauugccggggcgcugagauacaucgaggaacgcgaggauuuucaugugcagcuuaccaucgaauaugcuaugcucagcaaauacugugacuacuauacgcaguucuccgauaauagcggauacucucaaaccacauggcggguuuaucugagaucccacgacuuugaggccugcauucuguacccuaaccagcauuucugucgcugcgugaagaauggcgagaaguguucuagcuccaacugggacuuugccaaugaaaugaaagauuucuauagcgggaagcagaccaaauuugacaaggaucucaaccuggcucuuacagcccugcaccacgcuuuccggggaaccuccucugccuacaucgcgacgaugcucagcaaaaaguccaaugacgaucugauugccuauacaaacaagaucaaaaccaaguuucccggcaaugcucugcuuaaagccauuaucgacuacaucgcuuacaugaagucucucccugggauggccaacuucaaacaugaugaguucugggacgaacugcuguauaagcccaaucccgcgaaagccagcaaccucgcuagaggcaaggaguccagcuacaacuuuaagcuggccauuucuuccaaaagcaucaagacaugcaaaaaugucaaggauguggcuugucuuucuccucgcuccggagccauuuaugccagcaucauugcuugcggcgaaccgaacgggcccucuguguaccggaaaccuagcggaggcguuuuccaguccagcaccgacagaucuaucuauugucugcucgauucccacugccuggaggaguuugaagcgauuagccaagaggaacuggacgccgucaagaaguccaaaugcugggagaucgaguaccccgaugugaagccucuucaggaaggggacggaaccaaaucuugucgcaugaaggacagcggcaauugcaacguggcuacaaaucgguggcccgucauccagugugagaacgauaaauucuauuacuccgaacuccagaaggacuacgauaagacgcaagacauugggcauuauugccugucuccgggcuguaccacagugagauacccuaucaaucccaaacacauuagcaacugcaauuggcagguuucccgcucuagcaucgccaagauugaugugcacaacaucgaggacaucgaacaguauaaaaaggccauuacccagaaacugcaaacaucccucagccuguuuaaguacgcuaagaccaaaaaucuuccucauaucaagcccauuuauaaauacaucacgauugagggaacagagaccgccgaaggcaucgagucugcguauaucgaauccgaggucccugcucuggccgggaccagcauuggauucaagaucaacucuaaagaaggcaagcaccuccuggaugugauugccuacguuaaauccgcuagcuacucuuccguguaugccaagcuguacagcacagggcccaccuccggaaucaauacaaagcaugacgagcuuuguacgggcccgugcccugcgaacauuaaucaccaggucggguggcucaccuuugcucgggagagaacaagcucuuggggcugugaagaguucggaugccuggccgugagcgauggcuguguuuuuggguccugccaggacaucauuaaagaggagcugucuguguaucggaaggaaaccgaggaggucacagauguggaacucugccugaccuucagcgacaaaacguacuguaccaaccuuaaccccgugacacccaucaucaccgaucuguuugagguccaauucaauacaguugaaaccuauucccucccucgcauuguggccgugcagaaccaugagaucaagauuggacagaucaaugaccugggcgucuacucuaaagggugcggaaacgugcagaagguuaauggcacaguguaugggaacggcgucccgagauuugacuaccugugucaccuugcuagccggaaggaggugauuguuagaaaaugcuucgauaaugacuaccaagccuguaaguuccugcagucccccgcuucuuaucgccucgaagaggauagcggaaccgugacgaucaucgacuacaaaaagauucugggcacaaucaaaaugaaggccauucucggggaugucaaguauaaaaccuuugcggacuccguggauaucaccgccgaaggaagcugcacaggcuguauuaacugcuucgagaauauccacugugaacugacccuucauacgacaaucgaggcuucuugcccuauuaaguccagcuguaccguuuuucacgaccggauccuggugacacccaacgagccucaguacgcccucaaaauggucugcaccgaaagacccgggaauacacugaccauuaaggugugcaacacgaaaaucgaggcuucuauggcccugguggaugccaagccuauuaucgaacuugcucccgucgaccagaccgcguauauucgcgagaaggaugaaagauguaaaacauggaugugccggguucgcgacgagggacugcaagugauccucgagccguucaagaaucuguuuggcuccuacaucggcauuuucuauaccuuuaucauuagcaugguggcccuccuggucaucauuuacgugcuucugccuaucuguuucaaacucagagacacacugcggaagcaugaagaugcuuacaaacgcgagaugaagaucagauga

SEQ ID NO: 14308 - RNA, 4326 nt, Artificial Sequence
  derived and/or modified CDS sequence (opt5) from LACV(LAC81-4)__U70208.1__GP
augauccggauucuggugcucaucgccgucaccgcugccagccccguuuaccagagaugcuuccaagacggcgcgauugugaagcagaacccuuccaaagaggcugugacagaagucugucugaaggaugacgugucuaugaucaaaacggaggcccgcuauauuagaaaugccaccgggguuuuuagcaacaauguggcuauccggaaguggcuugucuccgauuggcacgacugccgcccgaaaaagaucauuggaggccauaucaacgugauugaaguuggggaugaccugucucuccacacagagagcuacguguguuccgccgauugcaccaucggagucgacaaggaaacagcucaggugagacugcagaccgauacaaccaaucauuucgagauugccggcacgaccgugaaaucugggugguuuaagagcacaaccuauaucacacuugaccaaaccugugagcaccugaaagucuccugcggacccaagagcguucaguuccaugcguguuuuaaccagcacaugucuugcgugcgguuccuccaccgcacgauucugccuggcuccaucgccaauagcaucugucagaacauugaaaucauuauccuggugacacucacccugcuuauuuuuauccugcucucuauccuguccaaaacauacauuugcuaucuucugaugcccaucuucauuccuaucgcuuacgucuauggcauuaucuacaauaagagcuguaagaaaugcaagcucugcgggcugguguaccaucccuuuaccgaguguggaacccacugcguuuguggcgccagauaugauacaucugaccggaugaaacugcaucgcgcuuccgggcucugcccuggauacaagagccugagagccgcgcgggugauguguaaauccaagggcccggccucuauccuuagcauuaucacggcuguccuggugcucaccuucguuacacccauuaacuccauggugcugggggaaagcaaagagaccuuugagcuugaagaacugccugaugacaugcucggaauggccucucgcaucaauuccuauuacuucacaugcauucugaacuaugcugucagcuggggccuggugaucauuggccuccugaccgggcuucuguuuaagaaguaccaacacagauuccucaaugucuaugccauguacugugaagagugcgacauguaccacgauaaaucuggacugaagcggcauggcgacuucacgaacaaaugucgccagugcacaugugggcaguaugaagaugccaccggacuuauggcucacagaaagaccuacaauugccuggugcaguauaaagcgaaguggaugaugaacuuucucguuaucuacaucuuccugauucugaucaaggacagcgccauugugguccaagcugccggcacagauuuuaccacaugccucgagacggaguccaucaacuggaauuguaccgggcccuuccugaaccuuggaaauugccagaaacagcaaaagaaagaaccuuauacaaacauugccacccagcugaagggccucaaagcuaucucugugcuggacauccccauuaucacaggcauuccggaugacaucgccggggcgcugcgguacauugaggaaagagaggauuuucauguucagcuuaccaucgaauaugcuaugcucagcaaguacugugacuacuauacgcaguucuccgauaauagcggauacucucaaaccacauggcgcguguaucugcggucccacgacuuugaggccugcauccuguacccuaaccagcauuucuguagaugcgucaagaauggcgagaaauguucuagcuccaacugggacuuugccaaugaaaugaaggauuucuauagcgggaaacagaccaaguuugacaaagaucucaaccuggcucuuacagcccugcaccacgcuuuccgcggaaccuccucugccuacauugcgacgaugcucagcaagaaguccaaugacgaucugaucgccuauacaaacaaaauuaagaccaaauuucccggcaaugcucugcuuaaggccaucauugacuacaucgcuuacaugaaaucucucccugggauggccaacuucaagcaugaugaguucugggacgaacugcuguauaaacccaaucccgcgaaggccagcaaccucgcucggggcaaggaguccagcuacaacuuuaaacuggccaucucuuccaagagcauuaaaacaugcaagaaugugaaagauguggcuugucuuucuccuagauccggagccaucuaugccagcauuaucgcuugcggcgaaccgaacgggcccucuguuuaccgcaagccuagcggaggcgucuuccaguccagcaccgaccggucuauuuauugucugcucgauucccacugccuggaggaguuugaagcgaucagccaagaggaacuggacgccgugaagaaauccaagugcugggagauugaguaccccgaugugaaaccucuucaggaaggggacggaaccaagucuuguagaaugaaagacagcggcaauugcaacgucgcuacaaaucgcuggcccgugauccagugugagaacgauaaguucuauuacuccgaacuccagaaggacuacgauaaaacgcaagacaucgggcauuauugccugucuccgggcuguaccacaguucgguacccuauuaaucccaagcacaucagcaacugcaauuggcaaguguccagaucuagcauugccaaaaucgauguccacaacauugaggacaucgaacaguauaagaaagccaucacccagaagcugcagacaucccucagccuguuuaaguacgcuaaaaccaagaaucuuccucauauuaaacccaucuauaaguacauuacgaucgagggaacagagaccgccgaaggcauugagucugcguauaucgaauccgaggugccugcucuggccgggaccagcaucggauucaaaauuaacucuaaggaaggcaaacaccuccuggauguuaucgccuacgugaaguccgcuagcuacucuuccgucuaugccaagcuguacagcacagggcccaccuccggaauuaauacaaaacaugacgagcuuuguacgggcccgugcccugcgaacaucaaucaccaggugggguggcucaccuuugcucgcgagcggacaagcucuuggggcugugaagaguucggaugccuggccguuagcgauggcuguguguuuggguccugccaggacauuaucaaggaggagcugucugucuauagaaaagaaaccgaggaggugacagauguggaacucugccugaccuucagcgacaagacguacuguaccaaccuuaaccccgucacacccauuaucaccgaucuguuugagguucaauucaaaacaguggaaaccuauucccucccucggaucguggccguccagaaucaugagauuaagaucggacagauuaacgaccugggcguguacucuaaggggugcggaaauguucagaaagugaacggcacagucuaugggaauggcgugccgcgcuuugacuaccugugucaccuugcuagcagaaaggagguuaucgugcggaaaugcuucgauaacgacuaccaagccuguaaguuccugcagucccccgcuucuuauagacucgaagaggauagcggaaccgucacgauuaucgacuacaaaaagauccugggcacaauuaagaugaaagccauccucggggaugugaaguauaaaaccuuugcggacuccguugauauuaccgccgaaggaagcugcacaggcuguaucaauugcuucgagaacauucacugugaacugacccuucauacgacaaucgaggcuucuugcccuaucaaguccagcuguaccguguuucacgaccgcauucuggucacacccaaugagccucaguacgcccucaaaauggugugcaccgaacggcccgggaacacacugaccaucaaggugugcaauacgaagauugaggcuucuauggcccuggucgaugccaaaccuaucauugaacuugcucccguugaccagaccgcguauaucagagagaaggaugaacgcuguaaaacauggaugugcagagugcgggacgagggacugcaagugauucucgagccguucaagaaccuguuuggcuccuacaucggcaucuucuauaccuuuauuaucagcauggucgcccuccuggugauuaucuacguucuucugccuauuuguuucaaacuccgcgacacacugagaaagcaugaagaugcuuacaagcgggagaugaaaauccgcuga

SEQ ID NO: 14309 - RNA, 4326 nt, Artificial Sequence
  derived and/or modified CDS sequence (opt5) from LACV(LACR56869)__U70205.1__GP
augaucugcauucuggugcucaucaccgucgccgcugccagccccguuuaccagagauguuuccaagacggcgcgauugugaagcagaacccuuccaaagaggcugugacagaagucugccugaaggaugacgugucuaugaucaaaacggaggcccgguauguucgcaaugccaccgggguguuuagcaacaaugucgcuauuagaaaguggcuuguguccgauuggcacgacugucggccgaaaaagaucguuggaggccauaucaacgugauugaagucggggaugaccugucucuccacacagagagcuacgugugcuccgccgauuguaccaucggaguggacaaggaaacagcucagguccgccugcagaccgauacaaccaaucauuucgagauugccggcacgaccguuaaaucugggugguuuaagagcacaaccuauaucacacuugaccaaaccugcgagcaccugaaaguguccuguggacccaagagcgugcaguuccaugcgugcuuuaaccagcacaugucuugugucagauuccuccaccggacgauucugccuggcuccaucgccaauagcauuugccagaacaucgaaaucauuauccuggugacacucacccugcuuauuuuuauccugcucucuauucuguccaaaacauacaucuguuaucuucugaugcccaucuucauuccuaucgcuuacauuuauggcaucauuuacaauaagagcugcaagaaaugcaagcucugugggcugguuuaccaucccuuuaccgagugcggaacccacugugugugcggcgcccgcuaugauacaucugacagaaugaaacugcaucgggcuuccgggcucuguccuggauacaagagccugcgcgccgcgagagucaugugcaaauccaagggcccggccucuauccuuagcaucauuacggcugugcugguucucaccuucgugacacccaucaacuccaugguccugggggaaagcaaagagaccuuugagcuugaagaucugccugacgacaugcucgagauggccucucggauuaauuccuauuaccugacauguauccugaacuaugcugugagcuggggacucgucauuaucggccugcuuauuggccuucucuucaagaaguaccaacaccgcuuucugaauaucuaugccauguacugcgaagagugugauauguaccacgacaaaucugggcuuaagagacauggagauuucaccaacaaaugccggcaguguacgugcggccaguaugaagacgccgcugggcugauggcgcaccgcaagacauacaauugccucgugcaguauaaagccaaguggaugaugaacuuccugaucauuuacaucuuucugauucucaucaaggauagcgcuauuguugugcaagccgccggaaccgacuucaccacaugucuggagaccgaguccaucaacuggaauugcacaggccccuuucuuaaccuggggaauugucagaaacagcaaaagaaagaaccuuauacgaacaucgcuacccagcucaagggacugaaagccauuucuguccuggaugugcccaucauuacaggcaucccggacgauauugcgggcgcucuuagauacaucgaggaaaaggaggacuuccauguucagcucaccaucgaauaugccaugcugagcaaguacugcgauuacuauacacaguuuuccgacaauagcggguacucucaaaccacguggcggguguaucugagaucccacgacuucgaggccuguauucucuacccuaaccagcauuuuugccgcugugucaaaaauggagagaagugcucuagcuccaacugggauuucgcuaaugaaaugaaagacuauuacagcggcaagcagaccaaauuugauaaggaccugaaccuugcccugacagcucuccaccacgccuuccgggggaccuccucugcguauauggccacaaugcugagcaagaaauccaaugaugaccugaucgcuuacaccaacaagauuaaaacgaaguuucccggaaaugcccuucucaaagcuaucauugauuacaucgccuauaugaagucucugccuggcauggcgaacuucaaauacgacgaguuuugggaugaacugcucuauaagcccaaucccgccaaggcuagcaaccuggccagagggaaagaguccagcuacaacuucaagcuggcuaucucuuccaaaagcauuaagacauguaaaaaugugaaggacguggccugccugucuccucgcuccggcgccaucuaugcuagcauuaucgcguguggagaaccgaacggccccucuguuuaccggaagccuagcgggggagucuuccaguccagcaccgauagaucuauuuauugccuccuggacucccauugccuggaggaguuugaagccaucggccaagaggaacuugaugcugugaaaaagagcaaauguugggagauugaguaccccgacgugaagcucauccaggaaggggacggaacaaaauccugccgcaugaaggauucuggcaauuguaacgucgccaccaaucgguggccugugauccagugcgagaacgacaaguucuacuauagcgaacugcagaaagauuacgacaagacccaagauauugggcacuauugucugucccccggcugcacaacgguuagauacccgaucaauccuaaacauauuucuaacuguaauuggcaagugagccgcuccucuaucgccaagauugacguccacaacaucgaggauaucgaacaguauaaaaaggcuauuacccagaagcuccagacaagccugucccuuuuuaaauacgccaagaccaaaaaucugccccacaucaagccuauuuauaaauacaucacaauugagggaaccgagacggcggaaggcaucgagagcgcuuacaucgaaucugaggugcccgcccucgccgggacauccauuggauucaagaucaacagcaaagaaggcaagcaucugcuggacguuauugcuuaugugaagucugccuccuacagcucugucuauaccaaacuuuacuccaccgggccuacaagcggaaucaauaccaagcacgaugagcucugcacaggccccuguccggcgaacauuaaucaucaggacggguggcugacguuugcucgggagagaaccuccagcuggggcugcgaagaguucggaugucuggccgugucugauggcugcguuuuugggagcugccaggacaucauuaaagaggaacucuccguguaucgcaaggaaacagaggaggucaccgauguggaacugugucuuacauucucugacaaaaccuacugcacgaaccugaacccugugacccccaucaucacagaccucuuugagguccaauucaagaccguugaaacauauagccugccccggauuguggccgugcagaaucacgagaucaagauuggacagaucaacgaucugggcgucuacuccaaaggguguggaaaugugcagaagguuaacggcaccauuuacgggaauggcgugccuagauuugacuaucuuugccaucuggcuucucggaaagaggucaucgugcgcaaguguuucgauaacgacuaccaagccugcaaauuucuccagagcccggcuuccuauagacuggaagaggauucuggaacaguuaccaucauugacuacaagaagauccucggcacgauuaaaaugaaggccauccugggggaugugaaauauaagacauucgcggacagcgucgauauuaccgccgaaggauccuguaccggcugcaucaauuguuucgagaacauccacugcgaacuuacacugcacaccacgauugaggcuagcugucccaucaaaucuuccugcacaguguuucaugaccggauucucguuaccccuaaugagcacaaguacgcccugaagauggugugcacagaaaaacccgggaacacccugacaaucgaggucuguaauaccaagauugaagcuagcauggcccuuguggaugccaaaccuaucauugagcuggcucccguggaccagacgaccuauaucagagaaaaggacgagcgcugcaaaacauggaugugucgggucagagaugagggacuccagguuauccuggaaccuuucaagaaccucuuuggcucuuacauuggcaucuucuacaccuuuauuaucuccauuguggcgcugcuugugaucaucuauguccugcuccccauuugcuucaagcugcgcgacacacugagaaaacaugaggaugccuacaagcgggaaaugaaaauccgcuga

SEQ ID NO: 14310 - RNA, 4326 nt, Artificial Sequence
  derived and/or modified CDS sequence (opt5) from LACV(NAT_Crawford_WI_2007)__GU596383.1__GP
augauccggauucuggugcucaucgccgucaccgcugccagccccguuuaccagagaugcuuccaagacggcgcgauugugaagcagaacccuuccaaagaggcugugacagaagucugucugaaggaugacgugucuaugaucaaaacggaggcccgcuauguuagaaaugccaccgggguguuuagcaacaaugucgcuauucggaaguggcuuguguccgauuggcacgacugccgcccgaaaaagaucaucggaggccauauuaacguuaucgaagugggggaugaccugucucuccacacagagagcuacgucuguuccgccgauugcaccauuggaguggacaaggaaacagcucaggugagacugcagaccgauacaaccaaucauuucgagaucgccggcacgaccgucaaaucugggugguuuaagagcacaaccuauauuacacuugaccaaaccugugagcaccugaaaguuuccugcggacccaagagcgugcaguuccaugcguguuuuaaccagcacaugucuugcgugcgguuccuccaccgcacgauccugccuggcuccauugccaauagcaucugucagaacaucgaaauuaucauucuggucacacucacccugcuuaucuuuauucugcucucuauccuguccaaaacauacaucugcuaucuucugaugcccauuuucaucccuauugcuuacguguauggcaucauuuacaauaagagcuguaagaaaugcaagcucugcgggcugguuuaccaucccuuuaccgaguguggaacccacugcguguguggcgccagauaugauacaucugaccggaugaaacugcaucgcgcuuccgggcucugcccuggauacaagagccugagagccgcgcgggucauguguaaauccaagggcccggccucuauccuuagcaucauuacggcugugcugguucucaccuucgugacacccaucaacuccaugguccugggggaaagcaaagagaccuuugagcuugaagaacugccugaugacaugcucgaaauggccucucgcauuaauuccuauuacuucacaugcauccugaacuaugcugugagcuggggacuggucauuaucggccuccugaccggccuucuguuuaagaaguaccaacacagauuccucaauguguaugccauguacugugaggaaugcgacauguaccacgauaaaucugggcugaagcggcauggagacuucacgaacaaaugucgccagugcacauguggccaguaugaggaugccaccgggcuuauggcucacagaaagaccuacaauugccugguucaguauaaagcgaaguggaugaugaacuuucucauuaucuacaucuuccugauucugaucaaggacagcgccauugugguccaagcugccggaacagauuuuaccacaugccucgagacggaauccaucaacuggaauuguaccggccccuuccugaaccuugggaauugccagaaacagcaaaagaaagagccuuauacaaacauugccacccagcugaagggacucaaagcuaucucugugcuggacauccccauuaucacaggcauuccggaugacaucgccggcgcgcugcgguacauugaagagagagaagauuuucauguucagcuuaccaucgaguaugcuaugcucagcaaguacugugacuacuauacgcaguucuccgauaauagcggguacucucaagccaccuggcgcguguaucugcggucccacgacuuugaggccugcauccuguacccuaaccagcauuucuguagaugcgucaagaauggagaaaaauguucuagcuccaacugggacuuugcuaaugagaugaaggauuucuauagcggcaaacagacaaaguuugacaaagaucucaaccuggcccuuaccgcucugcaccacgccuuccgcgggacauccucugcguacauugccaccaugcucagcaagaaguccaaugacgaucugaucgcuuauacgaacaaaauuaagacaaaauuucccggaaaugcccugcuuaaggcuaucauugacuacaucgccuacaugaaaucucucccuggcauggcgaacuucaaguaugaugaguucugggacgagcugcuguacaaacccaaucccgccaaggcuagcaaccucgcccgggggaaggaauccagcuauaacuuuaaacuggcuaucucuuccaagagcauuaaaaccugcaagaaugugaaagauguggccugucuuucuccuagauccggcgccaucuacgcuagcauuaucgcgugcggagagccgaacggccccucuguuuaucgcaagccuagcgggggagucuuccaguccagcacagaccggucuauuuacugucugcucgauucccauugccuggaggaauuugaggccaucagccaagaagaacuggacgcugugaagaaauccaagugcugggagauugaauaucccgaugugaaaccucuucaggagucugacggcaccaagagcuguagaaugaaagacuccgggaauugcaacgucgccaccaaucgcuggcccgugauccagugugaaaacgauaaguucuacuacucugagcuccagaaggacuaugauaaaacacaagacaucggacacuacugccugagcccgggcuguacgaccguucgguauccuauuaaucccaagcauaucuccaacugcaauuggcaagugucuagaagcuccauugccaaaaucgauguccacaacauugaagacaucgagcaguacaagaaagcuaucacacagaagcugcaaaccagccucucucuguuuaaguaugccaaaacaaagaaucuuccucacauuaaacccaucuacaaguauauuaccaucgaggggacggaaacagcggagggcauugaauccgcuuacaucgagagcgaagugccugcccuggccggaaccucuaucggcuucaaaauuaacuccaaggaggggaaacaucuccuggauguuaucgcuuacgucaagagcgccucuuauuccagcguguacgcgaagcuguauuccaccggacccacaagcggcauuaauaccaaacacgacgagcuuuguacagggccgugcccugcuaacaucaaucaucaggugggauggcucacguuugcccgcgaacggaccucuagcuggggcugugaggaguucgggugccuggccguuuccgauggcuguguguuuggaucuugccaggacauuaucaaggaggaacugagcgucuacagaaaagagacagaggaagugaccgauguggagcucugccugacauucuccgacaagaccuauuguacgaaccuuaaccccgucacccccauuaucacagaucuguuugaaguucaauucaaaaccguggagacauacucucucccucggaucguggcuguccagaaucacgagauuaagaucggccagauuaacgaccuggggguguauagcaagggaugcggcaauguucagaaagugaacgggaccgucuacggaaauggcgugccgcgcuuugacuaccugugucaucuugccuccagaaaggaaguuaucgugcggaaaugcuucgauaacgacuaucaggcuuguaaguuccugcagucucccgccagcuacagacucgaggaagauuccgggacagucaccauuaucgacuauaaaaagauccugggcacgauuaagaugaaagcgauccucggagaugugaaguacaaaacauuugccgacagcguugauauuaccgcugagggcucuugcaccggguguaucaauugcuucgaaaacauucacugugagcugacacuucacaccacgaucgaggccuccugcccuaucaagagcucuuguacaguguuucaugaccgcauucuggucacccccaaugaacacaaauaugcucucaagauggugugcacagagcggccuggaaacacccugacaaucaaggugugcaauaccaaaauugaagccuccauggcccuggucgaugcuaagcccaucauugagcuugcgccuguugaccagacggccuacaucagagaaaaagaugagcgcuguaagaccuggaugugcagagugcgggacgagggccuccaggugauucuggaacccuucaaaaaccuguuugggagcuauaucggaaucuucuacacauuuauuaucuccauugucgcucuccuggugaucauuuacguucuucugccgaucuguuucaagcuccgcgacacccugagaaagcaugaggaugccuauaaacgggaaaugaagauccgcuga

SEQ ID NO: 14311 - RNA, 4326 nt, Artificial Sequence
  derived and/or modified CDS sequence (opt5) from LACV(77)__DQ196119.1__GP
augaucugcauucuggugcucaucaccgucgccgcugccagccccguuuaccagagauguuuccaagacggcgcgauugugaagcagaacccuuccaaagaggcugugacagaagucugccugaaggaugacgugucuaugaucaaaacggaggcccgguauguucgcaaugccaccgggguguuuagcaacaaugucgcuauuagaaaguggcuuguguccgauuggcacgacugucggccgaaaaagaucguuggaggccauaucaacgugauugaagucggggaugaccugucucuccacacagagagcuacgugugcuccgccgauuguaccaucggaguggacaaggaaacagcucagguccgccugcagaccgauacaaccaaucauuucgagauugccggcacgaccguuaaaucugggugguuugagagcacaaccuauaucacacuugaccaaaccugcgaacaccugaagguguccuguggacccaaaagcgugcaguuccaugcgugcuuuaaccagcacaugucuugugucagauuccuccaccggacgauucugccuggcuccaucgccaauagcauuugccagaacaucgagaucauuauccuggugacacucacccugcuuauuuuuauccugcucucuauucuguccaagacauacaucuguuaucuucugaugcccaucuucauuccuaucgcuuacauuuauggcaccaucuacaauaaaagcugcaagaagugcaaacucugugggcugguuuaccaucccuuuaccgaaugcggaacacacuguauuugcggcgcccgcuaugauacgucugacagaaugaagcugcaucgggcuuccgggcucuguccuggauacaaaagccugcgcgccgcgagagugaugugcaaguccaaaggcccggccucuauccuuagcaucauuaccgcuguccuggugcucacauucguuacccccaucaacuccauggugcugggggagagcaaggagacauuugaacuugaggaucugccugacgacaugcucgaaauggccucucggauuaauuccuauuaccugaccuguauccugaacuaugcugucagcuggggacucgugauuaucggccugcuuauuggccuucucuucaaaaaguaccaacaccgcuuucugaaugucuaugccauguacugcgaggaaugugauauguaccacgacaagucugggcuuaaaagacauggagauuucacgaacaagugccggcaguguacaugcggccaguaugaggacgccgcugggcugauggcgcaccgcaaaaccuacaauugccucgugcaguauaaggccaaauggaugaugaacuuccugaucaucuacauuuuucugauccucauuaaggauagcgcuaucguugugcaagccgccggaaccgacuucacaaccugucuggagacagaauccauuaacuggaauugcacgggccccuuucuuaaccuggggaauugucagaagcagcagaaaaaggagccuuauaccaacaucgcuacacagcucaaaggacugaaggccaucucuguccuggaugugcccauuaucaccggcauuccggacgauaucgcgggcgcucuuagauacauugaagagaaagaagacuuccauguucagcucacaaucgaguaugccaugcugagcaaguacugcgauuacuauacccaguuuuccgacaauagcggguacucucaaacgaccuggcggguguaucugagaucccacgacuucgaggccuguauccucuacccuaaccagcauuuuugccgcugugucaagaauggagaaaaaugcucuagcuccaaccgggauuucgcuaaugagaugaaggacuauuacagcggcaaacagacaaaguuugauaaagaccugaaccuugcccugaccgcucuccaccacgccuucagagggacauccucugcguauauugccaccaugcugagcaagaaguccaaugaugaccugaucgcuuacacgaacaaaauuaagacaaaauuucccggaaaugcccuucucaaggcuaucauugauuacaucgccuauaugaaaucucugccuggcauggcgaacuucaaguacgacgaauuuugggaugagcugcucuauaaacccaaucccgccaaggcuagcaaccuggcccgcgggaaggaauccagcuacaacuucaaacuugcuaucucuuccaagagcauuaaaaccuguaagaaugugaaagacguggccugccugucuccucgguccggcgccaucuaugcuagcauuaucgcguguggagagccgaacggccccucuguuuacagaaagccuagcgggggagucuuccaguccagcacagaucaaucuauuuauugccuccuggacucccauugccuggaggaauuugaggccaucggccaggaagaacuugaugcugugaagaaaagcaaguguugggagauugaauaccccgacgugaaacucauccaggagggggacggaaccaaguccugccgcaugaaagauucuggcaauuguaacgucgccaccaaucgguggccugugauccagugcgaaaacgacaaguucuacuauagcgagcugcaaaaggauuacgacaaaacacaggauauugggcacuauugucugucccccggcugcacgaccguuagauacccgaucaauccuaagcauauuucuaacuguaauuggcaagugagccgcuccucuaucgccaaaauugacguccacaacaucgaagauaucgagcaguauaagaaagcuauuacacaaaagcuccagaccagccugucccuuuuuaaguacgccaaaacaaagaaucugccccacaucaaaccuauuuauaaguacaucaccauugagggaacggaaacagcggagggcaucgaaagcgcuuacaucgagucugaagugcccgcccucgccgggaccuccauuggauucaaaaucaacagcaaggagggcaaacaucugcuggacguuauugcuuaugugaagucugccuccuacagcucugucuauaccaagcuguacuccacagggccuaccagcggaaucaauacaaaacacgaugagcucugcacgggccccuguccggcgaacauuaaucaucaggugggguggcugaccuuugcucgggaaagaacauccagcuggggcugcgaggaguucggaugucuggccguuucugacggcugcguguuugggagcugccaagauaucauuaaggaggaacucuccgucuaucgcaaagagaccgaggaagugacagacguggagcugugucuuaccuucucugauaagacguacugcaccaaccugaacccugucacacccaucaucaccgaccucuuugaaguucaguucaaaacaguggaggccuauagccugccccggauuguggcuguccagaaucacgagaucaagauuggacagaucaacgaccugggcguguacuccaagggguguggaaauguucaaaaagugaacggcaccauuuacgggaauggcgucccuagauuugauuaucuuugccaucuggccucucggaaggaagugaucguucgcaaauguuucgacaacgauuaccaggcuugcaaguuucuccagagcccggccuccuauagacuggaggaagacucuggaacagugaccaucauugauuacaaaaagauccucggcacgauuaagaugaaagcgauccugggggacgucaaguauaaaacauucgccgauagcguggacauuaccgcugagggauccuguaccggcugcaucaauuguuucgaaaacauccacugcgagcuuacacugcacaccacgauugaggccagcugucccaucaagucuuccugcacaguuuuucaugaucggauucucgugaccccuaaugaacacaaauacgcucugaagauggucugcacagagaagcccgggaacacccugacaaucaaaguguguaauaccaagauugaagccagcauggcccuuguggacgcuaaaccuaucauugagcuggcgcccgucgaucagacggccuauaucagagaaaaggacgagcgcugcaaaaccuggaugugucggguuagagacgagggacuccaagugauccuggaaccuuucaagaaccucuuuggcucuuacauuggcaucuucuacacauuuauuaucuccauuguggcucugcuugucaucaucuaugugcugcuccccauuugcuucaagcugcgcgauacccugagaaaacaugaggacgccuacaagcgggaaaugaaaauccgcuga

SEQ ID NO: 14312 - RNA, 4326 nt, Artificial Sequence
  derived and/or modified CDS sequence (opt5) from LACV(LACV/00/NC-M (NC00-283))__GU206112.1__GP
augauccggauucuggugcucaucgccgucaccgcugccagccccguuuaccagcggugcuuccaagacggcgcgauugugaagcagaacccuuccaaagaggcugugacagaagucugucugaaggaugacgugucuaugaucaaaacggaggcccgcuauguuagaaaugccaccgggguguuuagcaacaaugucgcuauucggaaguggcuuguguccgauuggcacgacugccgcccgaaaaagaucaucggaggccauauuaacguuaucgaagugggggaugaccugucucuccacacagagagcuacgucuguuccgccgauugcaccauuggaguggacaaggaaacagcucaggugagacugcagaccgauacaaccaaucauuucgagaucgccggcacgaccgucaaaucugggugguuuaagagcacaaccuauauuacacuugaccaaaccugugagcaccugaaaguuuccugcggacccaagagcgugcaguuccaugcguguuuuaaccagcacaugucuugcgugcgguuccuccaccgcacgauccugccuggcuccauugccaauagcaucugucagaacaucgaaauuaucauucuggucacacucacccugcuuaucuuuauucugcucucuauccuguccaaaacauacaucugcuaucuucugaugcccauuuucaucccuauugcuuacauguauggcaucauuuacaauaagagcuguaagaaaugcaagcucugcgggcugguguaccaucccuuuaccgaguguggaacccacugcguuuguggcgccagauaugauacaucugaccggaugaaacugcaucgcgcuuccgggcucugcccuggauacaagagccugagagccgcgcgggugauguguaaauccaagggcccggccucuauccuuagcaucauuacggcuguccuggugcucaccuucguuacacccaucaacuccauggugcugggggaaagcaaagagaccuuugagcuugaagaacugccugaugacaugcucgaaauggccucucgcauuaauuccuauuacuucacaugcauccugaacuaugcugucagcuggggacuggugauuaucggccuccugaccggccuucuguuuaagaaguaccaacacagauuccucaaugucuaugccauguacugugaggaaugcgacauguaccacgauaaaucugggcugaagcggcauggagacuucacgaacaaaugucgccagugcacauguggccaguaugaggaugccgcugggcuuauggcgcacagaaagaccuacaauugccuggugcaguauaaagccaaguggaugaugaacuuucucauuaucuacaucuuccugauucugaucaaggacagcgcuauuguugugcaagccgccggaaccgauuuuacaaccugccucgagacagaauccaucaacuggaauuguacgggccccuuccugaaccuugggaauugccagaaacagcaaaagaaagagccuuauaccaacauugcuacacagcugaagggacucaaagccaucucuguccuggacauccccauuaucaccggcauuccggaugacaucgcgggcgcucugaaguacauugaagagagagaagauuuucaugugcagcuuacaaucgaguaugccaugcucagcaaguacugugacuacuauacccaguucuccgauaauagcggguacucucaaacgaccuggagaguuuaucugcgcucccacgacuuugaggccugcauccuguacccuaaccagcauuucugucggugcgugaaaaauggagaaaaguguucuagcuccaacugggacuuugcuaaugagaugaaagauuauuacagcggcaagcagacaaaauucgacaaggaucucaaccuggcccuuaccgcucugcaccacgccuuuagagggacauccucugcguauauugccaccaugcucagcaagaaauccaaugacgaucugaucgcuuacacgaacaagauuaaaacaaaguuccccggaaaugcccugcuuaaagcuaucauugacuacaucgccuauaugaagucucucccuggcaugaccaacuuuaaauacgauaaguucugggacgaacugcuguauaagcccaaucccgcgaaagccagcaaccucgcucgcgggaaggaguccagcuacaacuucaaacuggccaucucuuccaagagcauuaaaacaugcaagaaugucaaggauguggcuugucuuucuccucgguccggcgccaucuaugccagcauuaucgcuugcggagaaccgaacggccccucuguguacagaaaaccuagcgggggaguuuuucaguccagcaccgaccgcucuauuuauugucugcucgauucccauugccuggaggaguucgaagcgaucaaucaagaggaacuggacgccgucaagaaaagcaagugcugggagauugaguacuccgaugugaaaccccuucaggaaggcgacgggaccaagucuugucggaugaaggacagcggaaacugcaauguggcuacaaacagauggccugucauccagugugagaaugauaaauuuuacuauuccgaacuccagaaggacuacgauaaaacgcaagacaucggccacuauugccugucucccggguguaccacagugcgcuacccgauuaacccuaagcauaucagcaauugcaacuggcagguuucccggucuagcauugccaaaaucgaugugcacaauauugaggacaucgaacaguauaagaaggccaucacccagaaacugcaaacaucccucagccuguucaaguacgcuaaaaccaagaaccuuccccacauuaaaccuaucuauaaguacauuacgaucgagggcacagagaccgccgaaggaauugagucugcguacaucgaauccgagguccccgcucuggccggcaccagcaucggguuuaaaauuaauucuaaggaaggaaagcaucuccuggaugugaucgccuauguuaaauccgcuagcuacucuuccguguaugccaagcuguacagcacaggcccuaccuccgggauuaacacaaaacacgacgagcuuuguacgggacccugcccggcgaauaucaaccaucaggucggcuggcucaccuucgcuaaggagagaacaagcucuugggggugugaagaguuuggcugccuggccgugagcgauggauguguuuucggcuccugccaggacauuaucaaagaggagcugucuguguaucgcaaggaaaccgaggaggucacagauguggaacucugccugaccuuuagcgacaagacguacuguaccaaccuuaauccugugacacccauuaucaccgaucuguucgagguccaauuuaaaacaguugaaaccuauucccucccccggaucguggccgugcagaaccacgagauuaagaucgggcagauuaaugaccugggagucuacucuaaaggcugcgggaacgugcagaagguuaauggaacaguguacggcaacggggucccuagauucgacuaucugugucaucuugcuagccggaaagaggugaucguucgcaagugcuuugauaaugacuaccaagccuguaaguuccugcaguccccggcuucuuauagacucgaagaggauagcggcaccgugacgauuaucgacuacaaaaagauccugggaacaauuaaaaugaaggccauccucggcgaugucaaauauaagaccuucgcggacaacguggauauuaccgccgaaggguccugcacaggauguaucaauugcuuugagaacauucacugugaacugacccuucacacgacaaucgaggcuagcugccccaucaagucuuccuguaccguuuuccaugaccggauucuggugacaccuagcgagcacaaauacgcccucaagauggucugcaccgaaaaacccggcaauacacugaccaucaaggugugcaacacgaaaauugaggcuucuauggcccugguggaugccaagccuaucauugaacuugcucccgucgaccagaccgcguauaucagagagaaggaugaacgcuguaaaacauggaugugccggguuagagacgaggggcuccaggugauucuggagccuuuuaagaaucuguucggauccuacaucggcaucuuuuacaccuucauuaucagcauuauggcccuccuggugaucauuuauguccuucugcccaucuguuuuaaacuccgcgacacacugagaaagcaugaagaugcuuacaaacgggagaugaagauccgcuga

SEQ ID NO: 14313 - RNA, 4326 nt, Artificial Sequence
  derived and/or modified CDS sequence (opt5) from LACV(LACV/00/WV-M (WV00-3178))__GU206148.1__GP
augauccggauucuggugcucaucgccauuaccgcugccagccccgucuaccagagaugcuuccaagacggcgcgaucguuaagcagaacccuuccaaagaggcugugacagaagugugucugaaggaugacgucucuaugauuaaaacggaggcccgcuaugugagaaaugccaccgggguuuuuagcaacaauguggcuauccggaaguggcuugucuccgauuggcacgacugccgcccgaaaaagaucauuggaggccauaucaacgugauugaaguuggggaugaccugucucuccacacagagagcuacguguguuccucugauugcaccaucggagucgacaaggaaacagcccaggugagacugcagaccgauacaaccaaucauuucgagauugcuggcacgaccgugaaaagcgggugguuuaaguccacaaccuauaucacacuugaccaaaccugugagcaccugaaagucagcugcggacccaagucuguucaguuccaugccuguuuuaaccagcacauguccugcgugcgguuccuccaccgcacgauucugccuggcagcaucgcgaauagcaucugucagaacauugaaaucauuauccuggugacacucacccugcuuauuuuuauccugcucuccauccugagcaaaacauacauuugcuaucuucugaugcccaucuucauuccuaucgccuacauuuauggcaucaucuacaauaagucuuguaagaaaugcaagcucugcgggcuggucuaccaucccuuuaccgaguguggaacccacugcguguguggcgcuagauaugauacauccgaccggaugaaacugcaucgcgccagcgggcucugcccuggauacaagucccugagagcugcccggguuauguguaaaucuaagggcccggcgagcauucuuuccaucauuacggccgugcugguccucaccuucgugacacccaucaacagcaugguucugggggaaucuaaagagaccuuugagcuugaagaacugccugaugacaugcucgaaauggcuucccgcauuaauagcuauuaccugacaugcauccugaacuaugccgugucuuggggacucgucauuaucggccugcuuaccggccuucucuucaagaaguaccaacacagauuucugaauacguaugcuauguacugugaggaaugcgacauguaccacgauaaaagcgggcuuaagcggcauggagacuucacaaacaaaugucgccagugcaccuguggccaguaugaggaugccgccgggcugaugacccacagaaagacauacaauugccucgugcaguauaaagcuaaguggaugaugaacuuccugaucauuuacaucuuucugauucucaucaaggacuccgcgauuaucguccaagccgcuggaaccgauuucacaacgugccuggagaccgaaucuaucaacuggaauuguacaggccccuuucuuaaccuggggaauugccagaaacagcaaaagaaagagccuuauaccaacauugccacacagcucaagggacugaaagccaucagcgugcuggacauucccaucauuaccggcaucccggaugacaucgcuggcgcccuucgguacauugaagagagagaagauuuccauguucagcucacgaccgaguaugcgaugcugucccgcuacugugacuacuauacacaguuuagcgauaauucucgguacucccaaaccacauggagaguguaucugcgcagccacgacuucgaggcuugcauccucuacccuaaccagcauuuuugucggugcgucaagaauggggaaaaguguucuuccagcaacugggacuucgccaaugagaugaaagauuauuacuccggaaagcagaccaaauuugacaaggaucugaaccuugcccugacggcucuccaccacgccuucagaggcacaucuagcgcuuauauugccaccaugcuguccaaaaagucuaaugacgaucugaucacauacaccaacaagauuaaaaccaaguuucccgggaaugcgcuucucaaagccaucaucgacuacauugcuuauaugaagucucugccuggaauggccaacuucaaauacgaugaauuuugggacgagcugcucuauaagcccaaucccgcuaaaacauccaaccuggcccgcggcaaggaaagcacguacaacuucaagcuggcgaucucuuccaaaagcauuaagaccugcaaaaaugugaaggauguugccugucugucuccucgguccggggcuaucuaugccagcauuaucgcuugcggcgagccgaacggacccucuguguacagaaaaccuagcggcggggucuuccaguccagcacagaccgcucuauuuauugucuccuggauucccauugccuggaggaauuugaggccaucagccaagaggagcuugacgccgugaagaaguccaaaugcugggagaccgaauaccccgaggugaagccucuccaggaaucugauggaacaaaaagcugucggaugaaggacuccggcaauugcaacguugcuaccaauagauggcccgucauccagugugagaacgacaaauucuacuauucugaacugcagaaggauuacgacaagacgcaagauauugggcacuauugccugagcccgggauguacaaccgugcgcuacccuaucaaucccaaacauauuuccaacugcaauuggcaagugucucggagcuccaucgcgaagauugacguccacaacaucgaggauaucgagcaguauaaaaaggccauuacccagaaacuccagacaagccugucucuuuuuaaguacgcuaagaccaaaaaucugccucacaucaagcccauuuauaaauacaucacaauugaaggcacggagaccgccgaagggaucgaguccgccuacaucgaaagcgaggugccugcucucgccggcacaucuauuggauucaagaucaacuccaaagagggcaagcaucugcuggacguuauugcguaugugaaaagcgcuucuuacuccagcgucuaugccaaacuuuacuccaccgggcccacaagcggaaucaauaccaagcacgaugaacucuguacgggcccgugcccugccaacauuaaucaucagaucggguggcugaccuuugcuaaggagagaacaucuagcuggggaugugaagaguucggcugccuggccguguccgacggguguguuuuuggcucuugccaggauauuaucaaggaggaacucagcguguaucggaaagagaccgaagaggucacagacguggaacugugccuuaccuucuccgauaagacauacuguaccaaccugaaccccguuacgcccaucauuacagaccucuuugaggugcaauucaaaaccgucgagaccuauucucugccucgcaucguggcggugcagaaucacgaaauuaagaucggacagauuaacgaucugggcgucuacagcaaggggugcggaaauguucagaaagugaacggcacaguguacgggaauggagucccgagauuugacuaucuuugucaucuggcuucccggaaggaggugaucguuagaaaaugcuucgacaacgauuaccaagccuguaaguuucuccagucucccgccagcuaucgccuggaagaggacuccggcaccgugacgaucauugauuacaaaaagauccucgggacaauuaagaugaaagcuauccugggcgacgucaaguauaaaaccuucgccgaaagcguggauauuacagcugagggaucuugcaccggcuguaucaauugcuucgagaacauccacugugaacuuacacugcacaccacgauugaggccuccugcccuaucaagagcucuuguaccguuuuucaugaccggauucucgugacacccaaugaacacaaauacgcgcugaagauggucugcaccgagagaccugggaacacacugaccaucaaggugugcaauacgaaaauugaagccuccaugacacuuguugaugcuaagcccaucauugagcuggccccuguggaccagaccgcuuauauccgcgagaaagaugaaagauguaagacauggaugugccggguccgcgacgagggacuccaggugauccuggaacccuucaaaaaccucuuuggcagcuacauugggaucuucuacaccuuuauuaucuccauuguggcccugcuugucaucaucuauguucugcucccgauuuguuucaagcugagagauacccugcggaagcaugaggacgccuacaaacgcgaaaugaagaucagauga

SEQ ID NO: 14314 - RNA, 4326 nt, Artificial Sequence
  derived and/or modified CDS sequence (opt5) from LACV(LACV/03/NY-M (41030016))__GU206130.1__GP
augaucuacauucuggugcucaucgccgucaccgcugccagccccguuuaucagagaugcuuccaagacggcgcgauugugaagcagaacccuuccaaagaggcugugacagaagucugucugaaggaugacgugucuaugaucaaaacggaggcccgguacauucgcaaugccaccgggguuuuuagcaacaauguggcuaucagaaaguggcuugucuccgauuggcacgacugccggccgaaaaagaucgugggaggccauauuaacguuaucgaagugggggaugaccugucucuccacacagagagcuaugucuguuccgccgauugcaccauuggaguggacaaggaaacagcucaggugcgccugcagaccgauacaaccaaucauuucgagaucgccggcacgaccgucaaaucugggugguuuaagagcacaaccuacauuacacuugaccaaaccugugagcaccugaaaguuuccugcggacccaagagcauccaguuccaugcguguuuuaaccagcacaugucuugcgugagauuccuccaccggacgauucugccuggcuccaucgccaauagcaucugucagaacauugaaaucauuauccuggugacacucacccugcuuauuuuuauccugcucucuauccuguccaaaacauauauuugcuaccuucugaugcccgucuucaucccuauugcuuauguguacggcaucauuuacaauaagagcuguaagaaaugcaagcucugcgggcugguuuaucaucccuuuaccgaguguggaacccacugcguguguggcgcccgcuacgauacaucugacagaaugaaacugcaucgggcuuccgggcucugcccuggauauaagagccugcgcgccgcgagagucauguguaaauccaagggcccggccucuauccuuagcaucauuacggcugugcugguucucaccuucgugacacccaucaacuccaugguccugggggaaagcaaagagguguuugagcuugaagaacugccugaugacaugcucgaaauggcccugcggauuaauuucuacuauuuuaccugcauccugaacuacgcugucucuuggucccucgugauuaucggacugcuuacaggccuccuguucaagcgcuaucaacacaaguuccugaauauuuacgccauguacugugaggaaugcgacauguaucacgauaaaagcggccuuaagagacauggggacuuuaccaacaaaugucggcagugcacguguggacaguacgaggaugccacaggccugaugacccaccgcaagaccuauaauugccucguucaguacaaagcuaaguggaucaugaacuuccugaucauuuauaucuuucuggugcucauuaaggacucugcgaucauuguccaagccgcugggacagauuucagcuccugccuggagaccgaaucuaucaacuggaauuguacaggacccuuucuuaaccugggcaauugccagaaacagcaaaagaaagagccuuacacgaacaucgccgcccagcucaaggggcugagagcuauuagcgugcuggacauccccaugauuaccgaaaucccggaugacauugccuccgcgcuucgguauaucgaggaaagagaggcuuuccauguucagcucacagccgaguacgccaugcugacccgcuacugugauuauuacacacaguuuagcgacaauucuggauauucccaaaccacguggcggguguaccugagaagccacgauuucgaggcuugcaucauguauccuaaccagcauuuuugucgcugcgucaaaaauggcgagaaguguucuuccagcaacugggacuucgccaaugaaaugaaggacuacuauuccggcaaacaggcuaaguuugauaaagaccucaaccuggcccuuaccgcgcugcaccacgccuuccgggggacaucuagcgcuuacauugccgcuaugcucuccaagaaaucuaaugaugaccugaucaccuacacaaacaagauuaagaccaaauuucccggaaaugcccugcuuaaggcgaucauugauuauaucgccuacaugaaaggccucccugggauggcuagcuucaagcaugacgaguucugggaugaacugcuguauaaacccacgcccacaaaggccccuaaccucgcuagaggacgcgaguccagcuacaauuuuaaacuggccaucucuuccaagagcauuaagaccugcaaaaacgugaaggacguggccugucuuucuccgcgguccggcgcuaucuaugcgagcauuaucgccugcggggagcccaacggcccuucuguuuacagaaaacccagcaauggagucuuccaguccagcacagaucaaucuauguauugucugcucgacucccacugccuggaagaguuugaagcuauuagccaggaggagcuggaugccgugaagaaauccaagugcugggaaaucgaguacccugacauuaagccccuucaggaaucugauggcaccaaaagcugucgcaugaaggacuccgggaacugcaauguggccaccaaccgguggccggucauccagugugagaaugacaaauucuacuauucugaacuccaaaaggauuacgacaaaacacaggauaucggacauuauugccugagcccuggcuguacgaccgugagauaccccauuaacccuaagcacaucuccaauugcaacuggcagguuucucgcagcuccauugcuaagaucgacgugcacaauauugaggauaucgagcaguauaaaaaggccaucacacaaaaacugcagaccagccucucucuguuuaaguacgcgaaaacaaagaaccuuccccauauuaagccuaucuauaaauacauuaccaucgaagggacggagacagcugaaggaauugaguccgccuacaucgaaagcgagguccccgcccuggcuggcaccucuaucggguucaagauuaauuccaaagagggcaagcaccuccuggacgugaucgccuauguuaaaagcgcgucuuacuccagcguguauaccaagcuguacuccacaggaccgaccagcggcauuaacacaaaacaugaugaacuuuguacggggccuugccccgcuaauaucaaccaccaggucggauggcucaccuuugccaaggagcggacaucuagcuggggcugugaagaguucgggugccuggccguguccgacggauguguuuuuggcucuugccaagauauuaucaaggaggaacugagcguguauagaaaagagaccgaagaggucacagacguggaacucugccugaccuucuccgauaagacguacuguaccaaucuuaaccccgugacaccuauuaucaccgaccuguuugagguccaguucaaaacaguugagaccuauucucucccgcggaucguggcugugcagaaccaugaaauuaagaucgggcagauuaaugaucugggcgucuacagcaaaggaugcggcaacgugcaaaagguuaaugggacaguguacggaaacggcgucccccgcuuugacuaucugugucaccuugccuccagaaaggaggugaucguucggaaaugcuucgacaaugauuaccaggcuuguaaguuccugcagucuccugccagcuauagacucgaagaggacuccgggaccgugacggucauugauuacaaaaagauccugggaacaaucaaaaugaaggcgauucucggcgacgugaaguauaaaaccuuugccgauaacguugacaucaccgcugaagggagcugcacaggcuguauuaauugcuucgagaacauccacugugagcugacccuucauacgacaauugaagccucuugccccaucaaguccagcuguaccguguuucacgaucgcauccuggucacaccuaaugagcauaaauacgcucucaagguggugugcaccgaaaaacccggaaacacacugaccauuaaggucugcaauacgaagaucgaggccucuauggcccugguugacgcuaaaccuauuaucgaacuugcgcccguggaucagaccgccuauauucgggagaaggacgagagauguaaaacauggaugugccgcgugagagaugaaggccugcaagucauccucgagccguucaagaaccuguuuggguccuacauuggaaucuucuacaccuuuaucauuagcaucguggcucuccugguuauuaucuauauucuucugccuaucuguuucaaacuccgggacacacugcgcaagcacgaagacgccuacaagagagagaugaaaauccgguga

SEQ ID NO: 14315 - RNA, 4326 nt, Artificial Sequence
  derived and/or modified CDS sequence (opt5) from LACV(LACV/06/NY(1)-M (06MS2900303))__GU206118.1__GP
augaucuacauucuggugcucaucgccgucaccgcugccagccccguuuaucagagaugcuuccaagacggcgcgauugugaagcagaacccuuccaaagaggcugugacagaagucugucugaaggaugacgugucuaugaucaaaacggaggcccgguacauucgcaaugccaccgggguuuuuagcaacaauguggcuaucagaaaguggcuugucuccgauuggcacgacugccggccgaaaaagaucgugggaggccauauuaacguuaucgaagugggggaugaccugucucuccacacagagagcuaugucuguuccgccgauugcaccauuggaguggacaaggaaacagcucaggugcgccugcagaccgauacaaccaaucauuucgagaucgccggcacgaccgucaaaucugggugguuuaagagcacaaccuacauuacacuugaccaaaccugugagcaccugaaaguuuccugcggacccaagagcauccaguuccaugcguguuuuaaccagcacaugucuugcgugagauuccuccaccggacgauucugccuggcuccaucgccaauagcaucugucagaacauugaaaucauuauccuggugacacucgcucugcuuauuuuuauccugcucucuauccuguccaaaaccuauauuugcuaccuucugaugcccgucuucaucccuauugccuauguguacggcguuaucuacaauaagagcuguaagaaaugcaagcucugcgggcugguguaucaucccuuuacagaguguggaacccacugcgucuguggcgcucgcuacgauaccucugacagaaugaaacugcaucgggccuccgggcucugcccuggauauaagagccugcgcgcggccagagugauguguaaauccaagggcccggcuucuauucuuagcaucaucacagccguucuggugcucacguucgucacccccauuaacuccauggugcugggggaaagcaaagaggucuuugagcuugaagaacugccugaugacaugcucgaaauggcucugcggaucaauuucuacuauuuuacaugcauucugaacuacgccgugucuuggucccucguuaucauuggacugcuuaccggccugcuguucaagcgcuaucaacacaaguuccugaauaucuacgccauguacugugaggaaugcgacauguaucacgauaaaagcggccuuaagagacauggggacuuuacaaacaaaugucggcagugcaccuguggacaguacgaggaugcuacgggccugaugacacaccgcaagaccuauaauugccucgugcaguacaaagcgaaguggauuaugaacuuccugaucaucuauauuuuucugguccucaucaaggacucugccauuaucgugcaagcugccgggaccgauuucagcuccugccuggagacagaaucuauuaacuggaauuguaccggacccuuucuuaaccugggcaauugccagaaacagcaaaagaaagagccuuacgccaacaucgcugcccagcucaaggggcugaaagcgaucagcguucuggacauucccaugaucacagaaauuccggaugacaucgcuuccgcccuuagauauauugaggaacgggaggccuuccaugugcagcucacggcugaguacgccaugcugaccagauacugugauuauuacacacaguuuagcgacaauucuggauauucccaaaccacauggcgcgucuaccugcggagccacgauuucgaggcuugcaucauguauccuaaccagcauuuuuguagaugcgugaagaauggcgagaaguguucuuccagcaacugggacuucgccaauggcaugaaagacuacuauuccgggaagcaggcgaaauuugauaaggaccucaaccuggcccuuaccgcucugcaccacgccuuccgcggaacgucuagcgcuuacaucgccaccaugcucuccaaaaagucuaaugaugaccugauugcguacacaaacaagaucaaaaccaaguuucccggcaaugcccugcuuaaagcuauuaucgauuauauugccuacaugaaggggcucccuggaauggcuaacuucaaacaugacgaguucugggaugagcugcuguauaagcccacacccaccaaagccccuaaucucgcccggggcagagaaagcuccuacaacuuuaagcuggcuaucagcucuaaguccaucaaaacgugcaagaacgugaaagacguugcgugucuuagcccgcgcucuggggccauuuaugcuuccaucauugccugcggcgagcccaauggaccuagcgucuaccggaagccccugaacggcguguuccagucuagcacagaucaauccauguauugucuccuggacagccacugccuggaggaauuugaggccaucucucaggaagaacuugaugcugugaaaaaguccaagugcugggagauugaauacagcgacaucaaaccucuccaggaguccgaugggaccaagucuuguagaaugaaagacagcggaaauugcaacgucgccacaaaucgcuggcccgugauucagugugaaaacgacaaguucuacuauuccgagcugcaaaaagauuacgacaagacccaggauaucggccauuauugccugucuccgggguguaccacaguucgguacccuaucaaucccaagcacauuagcaacugcaauuggcaaguguccagaucuagcaucgcgaaaauugacguccacaacaucgaagauauugagcaguauaagaaagcuaucacgcagaagcuccagaccucccugagccuuuuuaaauacgccaagacaaagaaucugccucauaucaaacccauuuauaaguacaucaccauugagggaacagaaaccgccgagggcaucgaaucugcuuacauugaguccgaagugccugcccucgcggggacgagcaucggcuucaaaaucaacucuaaggagggaaaacaccuccuggacguuauugcuuaugugaaguccgccagcuacucuuccgucuauacaaaacuuuacagcaccggccccaccuccgggaucaauacaaagcaugaugagcucuguaccggaccgugcccugccaacauuaaucaccaggugggcuggcugacauuugcuaaggaacgcacgagcucuugggggugugaggaguucggaugccuggccguuagcgacggcuguguguuuggguccugccaagauaucauuaaagaagaacucucugucuaucggaaggagaccgaggaagugacagacguggagcugugccuuaccuucagcgauaaaacauacuguaccaaccugaaccccgucacgcccaucauuaccgaccucuuugaaguucaguucaagacaguggagaccuauucccugccuagaaucguggcuguccagaaucaugagaucaaaauuggccagaucaacgaucugggaguguacucuaagggcugcgggaauguucaaaaggugaacggaacagucuacggcaauggggugccgcgguuugacuaucuuugucaccuggccagccgcaaagaaguuauugugagaaagugcuucgacaacgauuaccaggcguguaaauuccuccagucccccgccucuuaucggcuggaggaagacagcggaaccgucacagugaucgauuacaagaaaauucucggcaccaucaagaugaaggcuauccugggggacguuaaauauaagacguuugccgauaauguggacauuacagcugagggcuccugcaccggauguaucaacugcuucgaaaauauucacugugagcuuacccugcauacaaccaucgaggccagcugcccuauuaaaucuuccuguacggucuuucacgauagaauccucgugacacccaacgaacauaaguacgcccugaaaguggucugcaccgagaagccuggcaauacacugaccaucaagguuugcaacacaaaaauugaagcuagcauggcgcuuguggacgccaagcccaucauugagcuggcuccuguggaucagaccgccuauauccgcgaaaaagacgagcgguguaagacguggaugugcagaguccgcgaugaggggcuccaagugauucuggaacccuucaaaaaucucuuuggaucuuacaucggcauuuucuacaccuuuaucaucuccauuguuacacugcuugugaucauuuauauccugcucccgauuuguuucaaggucagagacacccugcggaagcacgaggacgccuacaaacgcgaaaugaagaucagauga

SEQ ID NO: 14316 - RNA, 4326 nt, Artificial Sequence
  derived and/or modified CDS sequence (opt5) from LACV(LACV/06/NY(2)-M (06MS350140))__GU206109.1__GP
augaucuacauucuggugcucaucgccgucaccgcugccagccccguuuaucagagaugcuuccaagacggcgcgauugugaagcagaacccuuccaaagaggcugugacagaagucugucugaaggaugacgugucuaugaucaaaacggaggcccgguacauucgcaaugccaccgggguuuuuagcaacaauguggcuaucagaaaguggcuugucuccgauuggcacgacugccggccgaaaaagaucgugggaggccauauuaacguuaucgaagugggggaugaccugucucuccacacagagagcuaugucuguuccgccgauugcaccauuggaguggacaaggaaacagcucaggugcgccugcagaccgauacaaccaaucauuucgagaucgccggcacgaccgucaaaucugggugguuuaagagcacaaccuacauuacacuugaccaaaccugugagcaccugaaaguuuccugcggacccaagagcauccaguuccaugcguguuuuaaccagcacaugucuugcgugagauuccuccaccggacgauucugccuggcuccaucgccaauagcaucugucagaacauugaaaucauuauccuggugacacucgcucugcuuauuuuuauccugcucucuauccuguccaaaaccuauauuugcuaccuucugaugcccgucuucaucccuauugccuauguguacggcguuaucuacaauaagagcuguaagaaaugcaagcucugcgggcugguguaucaucccuuuacagaguguggaacccacugcgucuguggcgcucgcuacgauaccucugacagaaugaaacugcaucgggccuccgggcucugcccuggauauaagagccugcgcgcggccagagugauguguaaauccaagggcccggcuucuauucuuagcaucaucacagccguucuggugcucacguucgucacccccauuaacuccauggugcugggggaaagcaaagaggucuuugagcuugaagaacugccugaugacaugcucgaaauggcucugcggaucaauuucuacuauuuuacaugcauucugaacuacgccgugucuuggucccucguuaucauuggacugcuuaccggccugcuguucaagcgcuaucaacacaaguuccugaauaucuacgccauguacugugaggaaugcgacauguaucacgauaaaagcggccuuaagagacauggggacuuuacaaacaaaugucggcagugcaccuguggacaguacgaggaugcuacgggccugaugacacaccgcaagaccuauaauugccucgugcaguacaaagcgaaguggauuaugaacuuccugaucaucuauauuuuucugguccucaucaaggacucugccauuaucgugcaagcugccgggaccgauuucagcuccugccuggagacagaaucuauuaacuggaauuguaccggacccuuucuuaaccugggcaauugccagaaacagcaaaagaaagagccuuacgccaacaucgcugcccagcucaaggggcugaaagcgaucagcguucuggacauucccaugaucacagaaauuccggaugacaucgcuuccgcccuuagauauauugaggaacgggaggccuuccaugugcagcucacggcugaguacgccaugcugaccagauacugugauuauuacacacaguuuagcgacaauucuggauauucccaaaccacauggcgcgucuaccugcggagccacgauuucgaggcuugcaucauguauccuaaccagcauuuuuguagaugcgugaagaauggcgagaaguguucuuccagcaacugggacuucgccaaugaaaugaaagacuacuauuccggcaagcaggcgaaauuugauaaggaccucaaccuggcccuuaccgcucugcaccacgccuuccgcgggacgucuagcgcuuacaucgccaccaugcucuccaaaaagucuaaugaugaccugauugcguacacaaacaagaucaaaaccaaguuucccggaaaugcccugcuuaaagcuauuaucgauuauauugccuacaugaagggccucccugggauggcuaacuucaaacaugacgaguucugggaugaacugcuguauaagcccacacccaccaaagccccuaaucucgcccggggaagagagagcuccuacaacuuuaagcuggcuaucagcucuaaguccaucaaaacgugcaagaacgugaaagacguugcgugucuuagcccgcgcucuggcgccauuuaugcuuccaucauugccugcggggagcccaauggcccuagcgucuaccggaagccccugaacggaguguuccagucuagcacagaucaauccauguauugucuccuggacagccacugccuggaagaguuugaagccaucucucaggaggagcuugaugcugugaaaaaguccaagugcugggaaauugaguacccugacaucaaaccccuccaggaaagcgauggcaccaaguccuguagaaugaaagacucugggaauugcaacgucgccacaaaucgcuggccggugauucagugugagaacgacaaguucuacuauagcgaacugcaaaaagauuacgacaagacccaggauaucggacauuauugccuguccccuggcuguaccacaguucgguaccccaucaauccuaagcacauuucuaacugcaauuggcaagugagcagauccucuaucgcgaaaauugacguccacaacaucgaggauauugagcaguauaagaaagcuaucacgcagaagcuccagaccagccugucccuuuuuaaauacgccaagacaaagaaucugccccauaucaaaccuauuuauaaguacaucaccauugaagggacagagaccgccgaaggaaucgagagcgcuuacauugaaucugaggugcccgcccucgcgggcacguccaucggguucaaaaucaacagcaaggagggcaaacaccuccuggacguuauugcuuaugugaagucugccuccuacagcucugucuauacaaaacuuuacuccaccggaccgaccagcggcaucaauacaaagcaugaugaacucuguaccgggccuugccccgccaacauuaaucaccaggugggauggcugacauuugcuaaggagcgcacguccagcuggggcugugaagaguucgggugccuggccguuucugacggauguguguuuggcagcugccaagauaucauuaaagaggaacucuccgucuaucggaaggagaccgaagaggugacagacguggaacugugccuuaccuucucugauaaaacauacuguaccaaccugaaccccgucacgccuaucauuaccgaccucuuugagguucaguucaagacaguggagaccuauagccugccgagaaucguggcuguccagaaucaugaaaucaaaauugggcagaucaacgaucugggcguguacuccaagggaugcggcaauguucaaaaggugaacgggacagucuacggaaauggcgugccccgguuugacuaucuuugucaccuggccucucgcaaagagguuauugugagaaagugcuucgacaacgauuaccaggcguguaaauuccuccagagcccugccuccuaucggcuggaagaggacucugggaccgucacagugaucgauuacaagaaaauucucggaaccaucaagaugaaggcuauccugggcgacguuaaauauaagacguuugccgauaauguggacauuacagcugaagggagcugcaccggcuguaucaacugcuucgagaauauucacugugagcuuacccugcauacaaccaucgaagccuccugccccauuaaaagcucuuguacggucuuucacgauagaauccucgugacaccuaacgagcauaaguacgcccugaaaguggucugcaccgaaaagcccggaaauacacugaccaucaagguuugcaacacaaaaauugaggcuuccauggcgcuuguggacgccaagccuaucauugaacuggcucccguggaucagaccgccuauauccgcgagaaagacgagcgguguaagacguggaugugcagaguccgcgaugaaggccuccaagugauucuggagccguucaaaaaucucuuugggagcuacaucggaauuuucuacaccuuuaucaucucuauuguuacacugcuugugaucauuuauauccugcucccuauuuguuucaagcugagagacacccugcggaagcacgaagacgccuacaaacgcgagaugaagaucagauga

SEQ ID NO: 14317 - RNA, 4326 nt, Artificial Sequence
  derived and/or modified CDS sequence (opt5) from LACV(LACV/06/NY(3)-M (06MS270036))__GU206121.1__GP
augaucuacauucuggugcucaucgccgucaccgcugccagccccguuuaucagagaugcuuccaagacggcgcgauugugaagcagaacccuuccaaagaggcugugacagaagucugucugaaggaugacgugucuaugaucaaaacggaggcccgguacauucgcaaugccaccgggguuuuuagcaacaauguggcuaucagaaaguggcuugucuccgauuggcacgacugccggccgaaaaagaucgugggaggccauauuaacguuaucgaagugggggaugaccugucucuccacacagagagcuaugucuguuccgccgauugcaccauuggaguggacaaggaaacagcucaggugcgccugcagaccgauacaaccaaucauuucgagaucgccggcacgaccgucaaaucugggugguuuaagagcacaaccuacauuacacuugaccaaaccugugagcaccugaaaguuuccugcggacccaagagcauccaguuccaugcguguuuuaaccagcacaugucuugcgugagauuccuccaccggacgauucugccuggcuccaucgccaauagcaucugucagaacauugaaaucauuauccuggugacacucgcucugcuuauuuuuauccugcucucuauccuguccaaaaccuauauuugcuaccuucugaugcccgucuucaucccuauugccuauguguacggcguuaucuacaauaagagcuguaagaaaugcaagcucugcgggcugguguaucaucccuuuacagaguguggaacccacugcgucuguggcgcucgcuacgauaccucugacagaaugaaacugcaucgggccuccgggcucugcccuggauauaagagccugcgcgcggccagagugauguguaaauccaagggcccggcuucuauucuuagcaucaucacagccguucuggugcucacguucgucacccccauuaacuccauggugcugggggaaagcaaagaggucuuugagcuugaagaacugccugaugacaugcucgaaauggcucugcggaucaauuucuacuauuuuacaugcauucugaacuacgccgugucuuggucccucguuaucauuggacugcuuaccggccugcuguucaagcgcuaucaacacaaguuccugaauaucuacgccauguacugugaggaaugcgacauguaucacgauaaaagcggccuuaagagacauggggacuuuacaaacaaaugucggcagugcaccuguggacaguacgaggaugcuacgggccugaugacacaccgcaagaccuauaauugccucgugcaguacaaagcgaaguggauuaugaacuuccugaucaucuauauuuuucugguccucaucaaggacucugccauuaucgugcaagcugccgggaccgauuucagcuccugccuggagacagaaucuauuaacuggaauuguaccggacccuuucuuaaccugggcaauugccagaaacagcaaaagaaagagccuuacgccaacaucgcugcccagcucaaggggcugaaagcgaucagcguucuggacauucccaugaucacagaaauuccggaugacaucgcuuccgcccuuagauauauugaggaacgggaggccuuccaugugcagcucacggcugaguacgccaugcugaccagauacugugauuauuacacacaguuuagcgacaauucuggauauucccaaaccacauggcgcgucuaccugcggagccacgauuucgaggcuugcaucauguauccuaaccagcauuuuuguagaugcgugaagaauggcgagaaguguucuuccagcaacugggacuucgccaauggcaugaaagacuacuauuccgggaagcaggcgaaauuugauaaggaccucaaccuggcccuuaccgcucugcaccacgccuuccgcggaacgucuagcgcuuacaucgccaccaugcucuccaaaaagucuaaugaugaccugauugcguacacaaacaagaucaaaaccaaguuucccggcaaugcccugcuuaaagcuauuaucgauuauauugccuacaugaaggggcucccuggaauggcuaacuucaaacaugacgaguucugggaugagcugcuguauaagcccacacccaccaaagccccuaaucucgcccggggcagagaaagcuccuacaacuuuaagcuggcuaucagcucuaaguccaucaaaacgugcaagaacgugaaagacguugcgugucuuagcccgcgcucuggggccauuuaugcuuccaucauugccugcggcgagcccaauggaccuagcgucuaccggaagccccugaacggcguguuccagucuagcacagaucaauccauguauugucuccuggacagccacugccuggaggaauuugaggccaucucucaggaagaacuugaugcugugaaaaaguccaagugcugggagauugaauacagcgacaucaaaccucuccaggaguccgaugggaccaagucuuguagaaugaaagacagcggaaauugcaacgucgccacaaaucgcuggcccgugauucagugugaaaacgacaaguucuacuauuccgagcugcaaaaagauuacgacaagacccaggauaucggccauuauugccugucuccgggguguaccacaguucgguacccuaucaaucccaagcacauuagcaacugcaauuggcaaguguccagaucuagcaucgcgaaaauugacguccacaacaucgaagauauugagcaguauaagaaagcuaucacgcagaagcuccagaccucccugagccuuuuuaaauacgccaagacaaagaaucugccucauaucaaacccauuuauaaguacaucaccauugagggaacagaaaccgccgagggcaucgaaucugcuuacauugaguccgaagugccugcccucgcggggacgagcaucggcuucaaaaucaacucuaaggagggaaaacaccuccuggacguuauugcuuaugugaaguccgccagcuacucuuccgucuauacaaaacuuuacagcaccggccccaccuccgggaucaauacaaagcaugaugagcucuguaccggaccgugcccugccaacauuaaucaccaggugggcuggcugacauuugcuaaggaacgcacgagcucuugggggugugaggaguucggaugccuggccguuagcgacggcuguguguuuggguccugccaagauaucauuaaagaagaacucucugucuaucggaaggagaccgaggaagugacagacguggagcugugccuuaccuucagcgauaaaacauacuguaccaaccugaaccccgucacgcccaucauuaccgaccucuuugaaguucaguucaagacaguggagaccuauucccugccuagaaucguggcuguccagaaucaugagaucaaaauuggccagaucaacgaucugggaguguacucuaagggcugcgggaauguucaaaaggugaacggaacagucuacggcaauggggugccgcgguuugacuaucuuugucaccuggccagccgcaaagaaguuauugugagaaagugcuucgacaacgauuaccaggcguguaaauuccuccagucccccgccucuuaucggcuggaggaagacagcggaaccgucacagugaucgauuacaagaaaauucucggcaccaucaagaugaaggcuauccugggggacguuaaauauaagacguuugccgauaauguggacauuacagcugagggcuccugcaccggauguaucaacugcuucgaaaauauucacugugagcuuacccugcauacaaccaucgaggccagcugcccuauuaaaucuuccuguacggucuuucacgauagaauccucgugacacccaacgaacauaaguacgcccugaaaguggucugcaccgagaagccuggcaauacacugaccaucaagguuugcaacacaaaaauugaagcuagcauggcgcuuguggacgccaagcccaucauugagcuggcuccuguggaucagaccgccuauauccgcgaaaaagacgagcgguguaagacguggaugugcagaguccgcgaugaggggcuccaagugauucuggaacccuucaaaaaucucuuuggaucuuacaucggcauuuucuacaccuuuaucaucuccauuguuacacugcuugugaucauuuauauccugcucccgauuuguuucaagcugagagacacccugcggaagcacgaggacgccuacaaacgcgaaaugaagaucagauga

SEQ ID NO: 14318 - RNA, 4326 nt, Artificial Sequence
  derived and/or modified CDS sequence (opt5) from LACV(LACV/65/OH-M (W17258))__GU206124.1__GP
augauccggauucuggugcucaucgccgucaccgcugccaaccccguuuaccagagaugcuuccaagacggcgcgauugugaagcagaauccuagcaaagaggcugugacagaagucugucugaaggaugacguguccaugaucaaaacggaggcccgcuauauuagaaacgccaccgggguguuuucuaauaacguggcuauccggaaguggcuugucagcgauuggcacgacugccgcccgaaaaagaucauuggaggccauaucaaugugauugaaguuggggaugaccugucccuccacacagagucuuacguguguagcgccgauugcaccaucggagucgacaaggaaacagcucaggugagacugcagaccgauacaaccaaccauuucgagauugccggcacgaccgugaaauccgggugguuuaagucuacaaccuauaucacacuugaccaaaccugugagcaccugaaagucagcugcggacccaaguccguucaguuccaugcguguuuuaaucagcacaugagcugcgugcgguuccuccaccgcacggugcugccuggcucuauugccaacuccaucugucagaauaucgaaauuaucauucuggucacacucacccugcuuaucuuuauucugcucagcauccugucuaaaacauacaucugcuaucuucugaugcccauuuucaucccuauugcuuacguguauggcaucauuuacaacaaguccuguaagaaaugcaagcucugcgggcugguuuaccaucccuuuaccgaguguggaacccacugcguguguggcgccagauaugauacaagcgaccggaugaaacugcaucgcgcuucugggcucugcccuggauacaagucccugagagccgcgcgggucauguguaaaagcaagggcccggccuccauccuuucuaucauuacggcugugcugguucucaccuucgugacacccaucaauagcaugguccugggggaauccaaagagaccuuugagcuugaagaacugccugaugacaugcucgaaauggccagccgcauugacucuuauuacuucacaugcauccugaacuaugcuguguccuggggacuggucauuaucggccuccugaccggccuucuguuuaagaaguaccaacacagauuccucaauguguaugccauguacugugaggaaugcgauauguaccacgacaaaagcgggcugaagcggcauggagauuucacgaacaaaugucgccagugcacauguggccaguaugaggacgccaccgggcuuauggcucacagaaagaccuacaauugccugguucaguauaaagcgaaguggaugaugaacuuucucauuaucuacaucuuccugauucugaucaaggauucugccauugugguccaagcugccggaacagacuuuaccacaugccucgagacggaaaacaucaauuggaacuguaccggccccuuccugaaucuugggaacugccagaaacagcaaaagaaagagccuuauacaaauauugccacccagcugaagggacucaaagcuaucagcgugcuggauauccccauuaucacaggcauuccggacgauaucgccggcgcgcugcgguacauugaagagaaggaagacuuucauguucagcuuaccaucgaguaugcuaugcucuccaaguacugugauuacuauacgcaguucucugacaacagcggguacucccaaaccacauggagaguguaucugcgcagccacgacuuugaggccugcauccuguacccuaaucagcauuucugucggugcgucaaaaacggagaaaaguguucuuccagcaauugggauuuugccaacgagaugaaagacuucuauucuggcaagcagaccaaauuugauaaggaccucaaucuggcucuuacagcccugcaccacgcuuucagagggaccuccagcgccuacauugcgacgaugcucuccaagaaaucuaacgaugaccugaucgccuauacaaauaagauuaaaaccaaguuucccggaaacgcucugcuuaaagccaucauugauuacaucgcuuacaugaaaagccucccuggcauggccaauuucaaguaugacgaguucugggaugagcugcuguacaagcccaaccccgcgaaggccuccaaccucgcucgcgggaaagaaucuagcuauaauuuuaagcuggccaucuccagcaaaucuauuaagacaugcaaaaacgugaaggacguggcuugucuuuccccucggagcggcgccaucuacgccucuauuaucgcuugcggagagccgaauggccccuccguuuauagaaagccuagcgggggagucuuccagucuagcaccgaucgcuccauuuacugucugcucgacagccauugccuggaggaauuugaggcgaucucucaagaggaacuggaugccgugaaaaaguccaaaugcugggagauugaauaucccgacgugaagccucuucaggagggcgacgggaccaaaagcugucggaugaaggauuccggaaacugcaaugucgcuacaaacagauggcccgugauccagugugaaaaugacaaguucuacuacucugagcuccagaaagauuaugacaagacgcaagauaucggccacuacugccugagcccgggguguaccacaguucgcuauccuauuaaccccaaacauaucuccaauugcaacuggcaagugucucggagcuccauugccaagaucgacguccacaauauugaagauaucgagcaguacaaaaaggccaucacccagaagcugcagacaucucucagccuguuuaaauaugcuaagaccaaaaaccuuccucacauuaagcccaucuacaaauauauuacgaucgagggcacagaaaccgccgagggaauugaauccgcguacaucgagagcgaagugccugcucuggccggcaccucuaucggguucaagauuaauuccaaagagggaaagcaucuccuggacguuaucgccuacguuaagagcgcuucuuauuccagcgucuacgccaaacuguauucuacaggccccaccuccgggauuaacacaaagcacgaugagcuuuguacgggaccgugcccugcgaauaucaaccaucaggugggcuggcucaccuuugcuagagaacgcacaagcuccugggggugugaggaguucggcugccuggccguuagcgacggauguguguuuggcucuugccaggauauuaucaaagaagaacugagcgucuaccggaaggagaccgaggaagugacagacguggagcucugccugaccuucuccgauaaaacguauuguaccaaccuuaaucccgucacacccauuaucaccgaccuguuugaaguucaauucaagacaguggagaccuacucucucccuagaaucguggccguccagaaccacgagauuaagaucgggcagauuaaugaccugggaguguauagcaaaggcugcgggaacguucagaaggugaauggaacagucuacggcaacggggugccgcgguuugauuaccugugucaucuugcuucccgcaaagaaguuaucgugagaaagugcuucgacaaugauuaucaagccuguaaauuccugcagucucccgcuagcuaccggcucgaggaagacuccggcaccgucacgauuaucgauuauaagaagauccugggaacaauuaaaaugaaggccauccucggcgacgugaaauacaagaccuuugcggauucuguugacauuaccgccgaggggagcugcacaggauguaucaacugcuucgaaaauauucacugugagcugacccuucacacgacaaucgaggcuuccugcccuaucaaaagcucuuguaccguguuucaugaucgcauucuggucacacccaacgaacacaaguaugcccucaagauggugugcaccgagaaaccuggcaauacacugaccaucaaggugugcaacacgaaaauugaggcuuccauggcccuggucgacgccaagcccaucauugaacuugcuccuguugaucagaccgcguacaucagagaaaaagacgagcgguguaagacauggaugugcagagugcgcgacgaggggcuccaggugauucuggaacccuucaagaaucuguuuggaagcuauaucggcaucuucuacaccuuuauuaucucuauugucgcccuccuggugaucauuuacguucuucugccgaucuguuucaaacucagagauacacugcggaagcaugaggacgcuuauaaacgcgaaaugaagaucagauga

SEQ ID NO: 14319 - RNA, 4326 nt, Artificial Sequence
  derived and/or modified CDS sequence (opt5) from LACV(LACV/67/NY-M (67-8109))__GU206115.1__GP
augaucugcauucuggugcucaucaccgucgccgcugccagccccguuuaccagagauguuuccaagacggcgcgauugugaagcagaacccuuccaaagaggcugugacagaagucugccugaaggaugacgugucuaugaucaaaacggaggcccgguauguucgcaaugccaccgggguguuuagcaacaaugucgcuauuagaaaguggcuuguguccgauuggcacgacugucggccgaaaaagaucguuggaggccauaucaacgugauugaagucggggaugaccugucucuccacacagagagcuacgugugcuccgccgauuguaccaucggaguggacaaggaaacagcucagguccgccugcagaccgauacaaccaaucauuucgagauugccggcacgaccguuaaaucugggugguuuaagagcacaaccuauaucacacuugaccaaaccugcgagcaccugaaaguguccuguggacccaagagcgugcaguuccaugcgugcuuuaaccagcacaugucuugugucagauuccuccaccggacgauucugccuggcuccaucgccaauagcauuugccagaacaucgaaaucauuauccuggugacacucacccugcuuauuuuuauccugcucucuauucuguccaaaacauacaucuguuaucuucugaugcccaucuucauuccuaucgcuuacauuuauggcaccaucuacaauaagagcugcaagaaaugcaagcucugugggcugguuuaccaucccuuuaccgagugcggaacacacugugugugcggcgcccgcuaugauacgucugacagaaugaaacugcaucgggcuuccgggcucuguccuggauacaagagccugcgcgccgcgagagucaugugcaaauccaagggcccggccucuauucuuagcaucaucaccgcugugcugguucucacauucgugacccccauuaacuccaugguccugggggaaagcaaagagacauuugagcuugaagaucugccugacgacaugcucgagauggccucucggaucaauuccuauuaccugaccuguauucugaacuaugcugugagcuggggacucgucaucauuggccugcuuaucggccuccuguucaagaaguaccaacaccgcuuucugaauguguaugccauguacugcgaagagugugauauguaccacgacaaaucugggcuuaagagacauggagauuucacgaacaaaugccggcaguguacaugcggccaguaugaagacgccgcugggcugauggcgcaccgcaagaccuacaauugccucguucaguauaaagccaaguggaugaugaacuuccugauuaucuacaucuuucugauucucaucaaggauagcgcuauugugguccaagccgccggaaccgacuucacaaccugucuggagacagaguccaucaacuggaauugcacgggccccuuucuuaaccuggggaauugucagaaacagcaaaagaaagaaccuuauaccaacauugcuacacagcucaagggacugaaagccaucucugugcuggauguucccaucauuaccggcaucccggacgauauugcgggcgcucuuagauacaucgaggaaaaggaggacuuccaugugcagcucacaauugaauaugccaugcugagcaaguacugcgauuacuauacccaguuuuccgacaauagcggguacucucaaacgaccuggcgggucuaucugagaucccacgacuucgaggccuguauccucuacccuaaccagcauuuuugccgcugugugaaaaauggagagaagugcucuagcuccaaccgggauuucgcuaaugaaaugaaagacuauuacagcggcaagcagacaaaauuugauaaggaccugaaccuugcccugaccgcucuccaccacgccuucagagggacauccucugcguauaucgccaccaugcugagcaagaaauccaaugaugaccugauugcuuacacgaacaagaucaaaacaaaguuucccggaaaugcccuucucaaagcuauuaucgauuacauugccuauaugaagucucugccuggcauggcgaacuucaaauacgacgaguuuugggaugaacugcucuauaagcccaaucccgccaaggcuagcaaccuggcccgcgggaaagaguccagcuacaacuucaaacuugcuaucucuuccaaaagcaucaagaccuguaaaaaugugaaggacguugccugccugucuccucgguccggcgccauuuaugcuagcaucauugcguguggagaaccgaacggccccucugucuacagaaagccuagcgggggaguguuccaguccagcacagaucaaucuaucuauugccuccuggacucccauugccuggaggaguuugaagccauuggccaggaggaacuugaugcugugaaaaagagcaaauguugggagaucgaguaccccgacgucaagcucauucaggaaggggacggaaccaaauccugccgcaugaaggauucuggcaauuguaacguggccaccaaucgguggccuguuauccagugcgagaacgacaaguucuacuauagcgaacugcaaaaagauuacgacaagacacaggauaucgggcacuauugucugucccccggcugcacgaccgugagauacccgauuaauccuaaacauaucucuaacuguaauuggcaggucagccgcuccucuauugccaagaucgacgugcacaacauugaggauaucgaacaguauaaaaaggcuaucacacaaaagcuccagaccagccugucccuuuuuaaauacgccaagacaaagaaucugccccacauuaagccuaucuauaaauacauuaccaucgagggaacggagacagcggaaggcauugagagcgcuuacaucgaaucugagguucccgcccucgccgggaccuccaucggauucaagauuaacagcaaagaaggcaagcaucugcuggacgugaucgcuuaugucaagucugccuccuacagcucuguguauaccaaacuuuacuccacagggccuaccagcggaauuaauacaaagcacgaugagcucugcacgggccccuguccggcgaacaucaaucaucagguuggguggcugaccuuugcucgggagagaacauccagcuggggcugcgaagaguucggaugucuggccgugucugacggcugcgucuuugggagcugccaagauauuaucaaagaggaacucuccguguaucgcaaggaaaccgaggaggugacagacgucgaacugugucuuaccuucucugauaaaacguacugcaccaaccugaacccuguuacacccauuaucaccgaccucuuugaggugcaguucaagacaguggaaaccuauagccugccccggaucgucgccgugcagaaucacgagauuaagaucggacagauuaacgaccugggcguuuacuccaaaggguguggaaaugugcaaaaggucaacggcacaaucuacgggaauggcgugccuagauuugauuaucuuugccaucuggcuucucggaaagagguuauugugcgcaaguguuucgacaacgauuaccaggccugcaaauuucuccagagcccggcuuccuauagacuggaagaggacucuggaaccgucacgaucaucgauuacaagaagauucucggcacaaucaaaaugaaggccauucugggggacgugaaauauaagaccuucgcggauagcguugacaucaccgccgaaggauccuguacaggcugcauuaauuguuucgagaacauccacugcgaacuuacccugcacacgacaaucgaggcuagcugucccauuaaaucuuccugcaccguguuucaugaucggauccucgucacaccuaaugagcacaaguacgcccugaagauggugugcaccgaaaaacccgggaacacacugaccauuaagguguguaauacgaaaaucgaggcuagcauggcccuugucgacgccaagccuauuaucgaacuggcucccguugaucagaccgcguauauuagagagaaagacgaacgcugcaagacauggaugugucgggugagagacgagggacuccaagugauccuggagccuuucaagaaccucuuuggcucuuacaucggcauuuucuacaccuuuaucauuuccaucgucgcccugcuugugauuaucuauguucugcuccccaucugcuucaaacugcgcgauacacugagaaagcaugaagacgcuuacaaacgggagaugaagauucgcuga

SEQ ID NO: 14320 - RNA, 4326 nt, Artificial Sequence
  derived and/or modified CDS sequence (opt5) from LACV(LACV/74/NY-M (74-32813))__GU206142.1__GP
augaucagaaugcuggugcucauugucguuaccgccgcuagccccguguaccagcggugcuuccaagacggcgccaucgugaagcagaacccuuccaaagaggcggucacagaagugugucugaaggaugacguuucuaugauuaaaacggaggcucgcuaugugaagaaugccaccggggucuuuagcaacaauguggccaucagaaaauggcuuguuuccgauuggcacgacugccggccgaagaagauugugggaggccauaucaacgucaucgaagugggggaugaccugucucuccacacagagagcuacguguguuccgcugauugcaccauuggagucgacaaagaaacagcccagguucgccugcagaccgauacaaccaaucauuucgagaucgcuggcacgaccgugaagucugggugguuuaaaagcacaaccuauauuacacuugaccaaaccugugagcaccugaagguguccugcggacccaaaagcguccaguuccaugccuguuuuaaccagcacaugucuugcgugagauuccuccaccggacgauccugccuggcuccauugcgaauagcaucugucagaacauugaaaucaucauucugguuacacucacccugcuuaucuuuauucugcucucuauccuguccaagacauacauuugcuaucuucugaugcccaucuucaucccuauugccuacauguauggcgugaucuacaauaagagcuguaaaaagugcaaacucugcgggcuggucuaccaucccuuuaccgaguguggaacccacugcguguguggcgcucgcuaugauacaucugacagaaugaagcugcaucgggccuccgggcucugcccuggauacaaaagccugcgcgcugccagaguuauguguaaguccaaaggcccggcgucuauucuuagcaucauuacggccgugcugguccucaccuucgugacacccaucaacuccaugguccugggggaaagcaaggagaccuuugagcuugaagaacugccugaugacaugcucgaaauggcucugcggaucaauucuuauuacuucacaugcauucugaacuaugccguguccuggggacucaucauugcuggccugcuuguuggccugaucuuuaagaaauaccaacaccgcuuccucaauauuuaugccauguacugugaggaaugcaacauguaccacgacaagagcgggcugaaaagacauggagauuucaccaauaagugucggcagugcacguguggccaguaugaggacgccacagggcuuaucacccaccgcaaaaccuacaacugccuggugcaguauaaggcuaaguggaugaugaacuuucucauuaucuacaucuuccugauucugaucaaagauucugcgauugucgugcaagccacaggaaccgacuuuacaacgugccucgagaccgaaagcaucaauuggaacuguacaggccccuuccugaaucuugggaacugccagaagcagcagaaaaaggagccuuauaccaauauugcuacacagcugaaaggacucaaggccaucuccguucuggauauccccauuaucaccucuauuccggacgauaucgccggcgcucugagauacauugaagagaaggaagacuuucaugugcagcuuacgaccgaguaugccaugcucagcaaauacugugauuacuauacacaguucuccgacaacagcggcuacucucaaaccacauggcgggucuaucugagaucccacgauuuugaggcgugcauccuguacccuaaucagcauuucuguaagugcgugaaaaacggggaaaaguguuccucuuccaauugggacuuugcuaacgagaugaaaaauuauuacagcggaaagcaggccaaguucgacaaagaucucaaccuggcccuuaccgcucugcaccacgccuuucgcggcacguccucugcuuauaucgccgcgaugcucagcaagaaauccaaugacgaucugauugccuacacaaacaagaucaaagcuaaguuccccgggaaugcccugcuuaaagcuauuaucgacuacauugccuauaugaagggacucccugaaauggcgaacuuuaaguacgaugaguucugggacgaacugcuguauaaacccaaccccgccaaggcuucuaaucucgcccggggcaaagagagcuccuacaacuucaagcuggcuaucagcucuaaauccaucaagaccugcaagaaugugaaagauguugccugucuuagcccuagaucuggggccauuuauuccagcaucauugcuugcggcgagccgaacggacccucugucuaccgcaagccuagcggcgggguguuucaguccagcacagaccggucuaucuauugucugcucgauucccauugccuggaagaguucgaagcgauuagccaagaggagcuggacgccgugaaaaaguccaaaugcugggaaaucgaguaccccgaugucagaccucuucaggaaucugacggagcuaagagcugucgcaugaaggauuccggcaauugcaacguggccaccaaucgguggcccguuaugcagugugagaacgacaaauuuuacuauucugaacuccagaaggacuacgauaaaacccaagacauugggcacuauugccugagcccgggauguacaacgaucagauacccuaucaaucccaagcauauuuccaacugcaauuggcaagugucucgcagcuccaucgccaaaauugauguccacaacguggaggacaucgagcaguauaagaaggcuauuacccagaaacugcaaacaagccucucucuguucaaguacgccaaaaccaagaaucuuccucacaucaaacccaucuauaaguacauuacaaucgaaggcaccgagacggcggaagggauugaguccgcuuacaucgaaagcgagguuccugcccuggccggcacaucugugggauuuaaaauuaacuccaaggagggcaagcaucuccuggaugucaucgcuuaugugaaaagcgccucuuacuccagcguuuaugcgaagcuguacuccaccgggcccaccagcggaaucaauacaaaacacgacgaacuuuguaccggcccgugcccugcuaacauuaaccaucaggugggguggcucacauucgcccgggagagaacgucuagcuggggaugugaagaguuuggcugccuggccgucuccgauggguguguguucggcucuugccaggacaucauuaaggaggagcugagcguguaucgcaaagagaccgaagaggucacaaauguugaacucugccugaccuuuuccgauaagacauacuguaccaaccuuaaucccgugacgcccaucauuaccgaccuguucgaggugcaauuuaagacagucgagaccuauucucucccucggaucguggcuguucagaaccacgaaauuaaaaucggacagaucaaugaucugggcguguacagcaaggggugcggaaacguccagaaagugaauggcacaguuuacgggaacggagugccgagauucgacuaucugugucaucuugccucccggaaggaggucauugugcgcaaaugcuuugauaaugacuaccaggcuuguaaguuccugcaaucucccgccagcuauagacucgaagaggacuccggcaccguuacaaucauugauuacaagaaaauccuggggaccauuaagaugaaagcgauccucggcgacgugaaguauaaaacguucgccgauagcgucgacaucacagcugaaggaucuugcgccggcuguauuaacugcuuugagaauauccacugugagcugacccuucacaccacaauugaagcuagcugcccuaucaagagcucuuguaccguguuccaugaucggauucuggugacgcccaacgagcacaaguacgcccucaaaauggucugcacagaaaagccugggaauacccugacaaucaaaguuugcaacaccagaaucgaggccuccauggcucugguggacgcgaagcccauuaucgaacuugccccuguggaucagacagcuuauauucgcgagaaagacgagcgguguaagaccuggaugugcagaguccgcgaugaaggacuccaggugauccuggagcccuuuaagaaucuguucggcagcuacauugggaucuuuuacacguucauuaucuccaucauugcccuccugguuaucauuuaugugcuucugccgaucuguuuuaaacucagagacacccugcggaagcaugaugacgccuacaaacgcgaaaugaagauuagauga

SEQ ID NO: 14321 - RNA, 4326 nt, Artificial Sequence
  derived and/or modified CDS sequence (opt5) from LACV(LACV/93/MO-H)__GU206139.1__GP
augaucugcauucuggugcucaucaccgucgccgcugccagccccguuuaccagagauguuuccaagacggcgcgauugugaagcagaacccuuccaaagaggcugugacagaagucugccugaaggaugacgugucuaugaucaaaacggaggcccgguauguucgcaaugccaccgggguguuuagcaacaaugucgcuauuagaaaguggcuuguguccgauuggcacgacugucggccgaaaaagaucguuggaggccauaucaacgugauugaagucggggaugaccugucucuccacacagagagcuacgugugcuccgccgauuguaccaucggaguggacaaggaaacagcucagguccgccugcagaccgauacaaccaaucauuucgagauugccggcacgaccguuaaaucugggugguuuaagagcacaaccuauaucacacuugaccaaaccugcgagcaccugaaaguguccuguggacccaagagcgugcaguuccaugcgugcuuuaaccagcacaugucuugugucagauuccuccaccggacgauucugccuggcuccaucgccaauagcauuugccagaacaucgaaaucauuauccuggugacacucacccugcuuauuuuuauccugcucucuauucuguccaaaacauacaucuguuaucuucugaugcccaucuucauuccuaucgcuuacauuuauggcaucauuuacaauaagagcugcaagaaaugcaagcucugugggcugguuuaccaucccuuuaccgagugcggaacccacugugugugcggcgcccgcuaugauacaucugacagaaugaaacugcaucgggcuuccgggcucuguccuggauacaagagccugcgcgccgcgagagucaugugcaaauccaagggcccggccucuauccuuagcaucauuacggcugugcugguucucaccuucgugacacccaucaacuccaugguccugggggaaagcaaagagaccuuugagcuugaagaucugccugacgacaugcucgagauggccucucggauuaauuccuauuaccugacauguauccugaacuaugcugugagcuggggacucgucauuaucggccugcuuauuggccuucucuucaagaaguaccaacaccgcuuucugaauaucuaugccauguacugcgaagagugugauauguaccacgacaaaucugggcuuaagagacauggagauuucaccaacaaaugccggcaguguacgugcggccaguaugaagacgccgcugggcugauggcgcaccgcaagacauacaauugccucgugcaguauaaagccaaguggaugaugaacuuccugaucauuuacaucuuucugauucucaucaaggauagcgcuauuguugugcaagccgccggaaccgacuucaccacaugucuggagaccgaguccaucaacuggaauugcacaggccccuuucuuaaccuggggaauugucagaaacagcaaaagaaagaaccuuauacgaacaucgcuacccagcucaagggacugaaagccauuucuguccuggaugugcccaucauuacaggcaucccggacgauauugcgggcgcucuuagauacaucgaggaaaaggaggacuuccauguucagcucaccaucgaauaugccaugcugagcaaguacugcgauuacuauacacaguuuuccgacaauagcggguacucucaaaccacguggcggguguaucugagaucccacgacuucgaggccuguauucucuacccuaaccagcauuuuugccgcugugucaaaaauggagagaagugcucuagcuccaacuggggcuucgcuaaugaaaugaaagauuauuacagcgggaagcagaccaaauuugacaaggaucugaaccuugcccugacagcucuccaccacgccuuccggggaaccuccucugcguauauggccacaaugcugagcaagaaauccaaugacgaucugaucgcuuacaccaacaagauuaaaacgaaguuucccggcaaugcccuucucaaagcuaucauugacuacaucgccuauaugaagucucugccugggauggcgaacuucaaauacgaugaguuuugggacgaacugcucuauaagcccaaucccgccaaggcuagcaaccuggccagaggcaaagaguccagcuacaacuucaagcuggcuaucucuuccaaaagcauuaagacauguaaaaaugugaaggauguggccugccugucuccucgcuccggagccaucuaugcuagcauuaucgcguguggcgaaccgaacgggcccucuguuuaccggaagccuagcggaggcgucuuccaguccagcaccgacagaucuauuuauugccuccuggauucccauugccuggaggaguuugaagccaucgggcaagaggaacuugacgcugugaaaaagagcaaauguugggagauugaguaccccgaugugaagcucauccaggaaggagacggcacaaaauccugccgcaugaaggacucugggaauuguaacgucgccaccaaucgguggccugugauccagugcgauaacgacaaguucuacuauagcgagcugcagaaagauuacgacaagacccaagauauuggccacuauugucugucccccggaugcacaacgguuagauacccgaucaauccuaaacauauuucuaacuguaauuggcaagugagccgcuccucuaucgccaagauugacguccacaacaucgaagauaucgagcaguauaaaaaggcuauuacccagaagcuccagacaagccugucccuuuuuaaauacgccaagaccaaaaaucugccccacaucaagccuauuuauaaauacaucacaauugaaggcaccgagacggcggaggggaucgaaagcgcuuacaucgagucugaagugcccgcccucgccggaacauccauuggcuucaagaucaacagcaaagaggggaagcaucugcuggacguuauugcuuaugugaagucugccuccuacagcucugucuauaccaaacuuuacuccaccggaccuacaagcggcaucaauaccaagcacgaugaacucugcacagggcccuguccggcgaacauuaaucaucaggacggcuggcugacguuugcucgggagagaaccuccagcuggggaugcgaggaguucggcugucuggccgugucugaugggugcguuuuuggaagcugccaggacaucauuaaagaagaacucuccguguaucgcaaggagacagaagaggucaccgauguggagcugugucuuacauucucugacaaaaccuacugcacgaaccugaacccugugacccccaucaucacagaccucuuugaaguccaauucaagaccguugagacauauagccugccccggauuguggccgugcagaaucacgaaaucaagauuggccagaucaacgaucugggggucuacuccaaaggauguggcaaugugcagaagguuaacgggaccauuuacggcaauggagugccuagauuugacuaucuuugccaucuggcuucucggaaagaggucaucgugcgcaaguguuucgauaacgacuaccaagccugcaaauuucuccagagcccggcuuccuauagacuggaggaagauucuggcacaguuaccaucauugacuacaagaagauccucgggacgauuaaaaugaaggccauccugggagaugugaaauauaagacauucgcggacagcgucgauauuaccgccgagggcuccuguaccgggugcaucaauuguuucgaaaacauccacugcgagcuuacacugcacaccacgauugaagcuagcugucccaucaaaucuuccugcacaguguuucaugaccggauucucguuaccccuaaugagcacaaguacgcccugaagguggucugcacagagaaacccggaaacacccugacaaucgaaguguguaauaccaagauugaggcuagcauggcccuuguggaugccaaaccuaucauugaacuggcucccgucgaccagacgaccuauaucagagagaaggacgaacgcugcaaaacauggaugugucggguuagagaugagggccuccaggugauccuggagccuuucaagaaccucuuuggcucuuacauugggaucuucuacaccuuuauuaucuccauuguggcgcugcuugucaucaucuaugugcugcuccccauuugcuucaagcugcgcgacacacugagaaaacaugaagaugccuacaagcgggagaugaaaauccgcuga

SEQ ID NO: 14322 - RNA, 4326 nt, Artificial Sequence
  derived and/or modified CDS sequence (opt5) from LACV(LACV/95/OH-H (CCH-MB96))__GU206136.1__GP
augauccggauucuggugcucaucgccgucaccgcugccagccccguuuaccagagaugcuuccaagacggcgcgauugugaagcagaacccuuccaaagaggcugugacagaagucugucugaaggaugacgugucuaugaucaaaacggaggcccgcuauauuagaaaugccaccgggguuuuuagcaacaauguggcuauccggaaguggcuugucuccgauuggcacgacugccgcccgaaaaagaucauuggaggccauaucaacgugauugaaguuggggaugaccugucucuccacacagagagcuacguguguuccgccgauugcaccaucggagucgacaaggaaacagcucaggugagacugcagaccgauacaaccaaucauuucgagauugccggcacgaccgugaaaucugggugguuuaagagcacaaccuauaucacacuugaccaaaccugugagcaccugaaagucuccugcggacccaagagcguucaguuccaugcguguuuuaaccagcacaugucuugcgugcgguuccuccaccgcacgauucugccuggcuccaucgccaauagcaucugucagaacauugaaaucauuauccuggugacacucacccugcuuauuuuuauccugcucucuauccuguccaaaacauacauuugcuaucuucugaugcccaucuucauuccuaucgcuuacgucuauggcauuaucuacaauaagagcuguaagaaaugcaagcucugcgggcugguguaccaucccuuuaccgaguguggaacccacugcguuuguggcgccagauaugauacaucugaccggaugaaacugcaucgcgcuuccgggcucugcccuggauacaagagccugagagccgcgcgggugauguguaaauccaagggcccggccucuauccuuagcaugauuacggcuguccuggugcucaccuucguuacacccaucaacuccauggugcugggggaaagcaaagagaccuuugagcuugaagaacugccugaugacaugcucgaaauggucucucgcauuaauuccuauuacuucacaugcauccugaacuaugccgugagcuggggacugauuaucauuggccuccugaccggccuucuguuuaagaaguaccaacacagauuccucaaugucuaugcuauguacugugaggaaugcgacauguaccacgauaaaucugggcugaagcggcauggagacuucacgaacaaaugucgccagugcacauguggccaguaugaggaugccgccgggcuuauggcucacagaaagaccuacaauugccuggugcaguauaaagcgaaguggaugaugaacuuucucaucaucuacauuuuccugauccugauuaaggacagcgccaucguugugcaagcugccggaaccgauuuuacaaccugccucgagacagaauccauuaacuggaauuguacgggccccuuccugaaccuugggaauugccagaaacagcaaaagaaagagccuuauaccaacaucgccacacagcugaagggacucaaagcuaucucuguccuggacauucccaucauuaccggcaucccggaugacauugccggcgcgcugcgguacaucgaagagagagaagauuuucaugugcagcuuacaaucgaguaugcuaugcucagcaaguacugugacuacuauacccaguucuccgauaauagcggguacucucaaacgaccuggcgcguuuaucugcggucccacgacuuugaggccugcauucuguacccuaaccagcauuucuguagaugcgugaagaauggagaaaaauguucuagcuccaacuggggcuuugccaaugagaugaaggacuucuauagcgggaaacagacaaaguuugauaaagaccucaaccuggcucuuaccgcccugcaccacgcuuuccgcggaacauccucugccuacaucgcgaccguccucagcaagaaguccaaugaugaccugauugccuauacgaacaaaaucaagacaaaauuucccggcaaugcucugcuuaaggccauuaucgauuacaucgcuuacaugaaaucucucccugggauggccaacuucaaguaugacgaguucugggaugagcugcuguacaaacccaaucccgcgaaggccagcaaccucgcucggggcaaggaauccagcuauaacuuuaaacuggccauuucuuccaagagcaucaaaaccugcaagaaugugaaagacguggcuugucuuucuccuagauccggagccauuuacgccagcaucauugcuugcggcgagccgucugggcccagcguuuaucgcaagccucccggaggcgucuuccaguccagcacagaucggucuaucuacugucugcucgacucccauugccuggaggaauuugaggcgauuagccaagaagaacuggaugccgugaagaaauccaagugcugggagaucgaauauccugacgugaaaccccuucaggagucugaugggaccaagagcuguagaaugaaagacuccggaaacugcaaugucgcuaccaaccgcuggccggugauccagugugaaaaugacaaguucuacuacucugagcuccagaaggauuaugacaaaacacaagauauuggccacuacugccugagcccuggguguacgaccguucgguaucccaucaacccuaagcauauuuccaauugcaacuggcaagugucuagaagcuccaucgccaaaauugacguccacaauaucgaagauaucgagcaguacaagaaagccauuacacagaagcugcaaaccagccucucucuguuuaaguaugcuaaaacaaagaaccuuccccacaucaaaccuauuuacaaguauaucaccauugagggcacggaaacagccgagggaaucgaauccgcguacaucgagagcgaagugcccgcucuggccggcaccucuauuggguucaaaaucaauuccaaggagggaaaacaucuccuggacguuauugccuacgucaagagcgcuucuuauuccagcguguacaccaagcuguauuccacaggcccgaccagcgggaucaacacaaaacacgaugagcuuuguacgggaccuugccccgccaauauuaaccaucaggugggcuggcucaccuuugcgcgcgaacggacaucuagcugggggugugaggaguucggcugccuggcuguuuccgacggauguguguuuggcucuugccaggauaucauuaaggaggaacugagcgucuacagaaaagagaccgaggaagugacagacguggagcucugccugaccuucuccgauaagacguauuguaccaaucuuaaccccgucacaccuaucaucaccgaccuguuugaaguucaauucaaaacaguggagaccuacucucucccgcggauuguggccguccagaaccacgagaucaagauugggcagaucaaugaucugggaguguauagccgcggcugcgggaacguucagaaggugaauggaacagucuacggcaacggggugcccagauuugacuaccugugucaucuugccucccggaaagaaguuauugugagaaagugcuucgacaaugauuaucaggcuuguaaauuccugcagucuccugccagcuaccgccucgaggaagacuccggcaccgucacgaucaucgauuauaagaaaauucugggaacaaucaagaugaaggcuauucucggcgacgugaaauacaagaccuuugccgauagcguugacaucaccgcggaggggucuugcacaggauguauuaacugcuucgaaaauauccacugugagcugacccuucacacgacaaucgaggccuccugccccauuaaaagcucuuguaccguguuucaugaucggauccuggucacaccuaacgaacacaaguaugcucucaaaauggugugcaccgagaagcccggcaauacacugaccauuaaggugugcaacacgaaaaucgaagccuccauggcucuggucgacgccaagccuauuaucgagcuugcccccguugaucagaccgcuuacauuagagaaaaagacgagcgcuguaagacauggaugugcagagugcgggaugaggggcuccaggugauccuggaaccguucaaaaaucuguuuggaagcuauaucggcauuuucuacaccuuuaucauuuccaucgucgcgcuccuggugauuaucuacguucuucugccuaucuguuucaagcuccgcgacacacugagaaagcaugaggacgccuauaaacgggaaaugaagauucgcuga

SEQ ID NO: 14323 - RNA, 4326 nt, Artificial Sequence
  derived and/or modified CDS sequence (opt5) from LACV(LACV/95/WV-H)__GU206133.1__GP
augaucugcauucuggugcucaucaccgucgccgcugccagccccguuuaccagagauguuuccaagacggcgcgauugugaagcagaacccuuccaaagaggcugugacagaagucugccugaaggaugacgugucuaugaucaaaacggaggcccgguauguucgcaaugccaccgggguguuuagcaacaaugucgcuauuagaaaguggcuuguguccgauuggcacgacugucggccgaaaaagaucguuggaggccauaucaacgugauugaagucggggaugaccugucucuccacacagagagcuacgugugcuccgccgauuguaccaucggaguggacaaggaaacagcucagguccgccugcagaccgauacaaccaaucauuucgagauugccggcacgaccguuaaaucugggugguuuaagagcacaaccuauaucacacuugaccaaaccugcgagcaccugaaaguguccuguggacccaagagcgugcaguuccaugcgugcuuuaaccagcacaugucuugugucagauuccuccaccggacgauucugccuggcuccaucgccaauagcauuugccagaacaucgaaaucauuauccuggugacacucacccugcuuauuuuuauccugcucucuauucuguccaaaacauacaucuguuaucuucugaugcccaucuucauuccuaucgcuuacauuuauggcaccaucuacaauaagagcugcaagaaaugcaagcucugugggcugguuuaccaucccuuuaccgagugcggaacacacugugugugcggcgcccgcuaugauacgucugacagaaugaaacugcaucgggcuuccgggcucuguccuggauacaagagccugcgcgccgcgagagucaugugcaaauccaagggcccggccucuauucuuagcaucaucaccgcugugcugguucucacauucgugacccccauuaacuccaugguccugggggaaagcaaagagacauuugagcuugaagaucugccugacgacaugcucgagauggccucucggaucaauuccuauuaccugaccuguauucugaacuaugcugugagcuggggacucgucaucauuggccugcuuaucggccuccuguucaagaaguaccaacaccgcuuucugaauguguaugccauguacugcgaagagugugauauguaccacgacaaaucugggcuuaagagacauggagauuucacgaacaaaugccggcaguguacaugcggccaguaugaagacgccgcugggcugauggcgcaccgcaagaccuacaauugccucguucaguauaaagccaaguggaugaugaacuuccugauuaucuacaucuuucugauucucaucaaggauagcgcuauugugguccaagccgccggaaccgacuucacaaccugucuggagacagaguccaucaacuggaauugcacgggccccuuucuuaaccuggggaauugucagaaacagcaaaagaaagaaccuuauaccaacauugcuacacagcucaagggacugaaagccaucucugugcuggauguucccaucauuaccggcaucccggacgauauugcgggcgcucuuagauacaucgaggaaaaggaggacuuccaugugcagcucacaauugaauaugccaugcugagcaaguacugcgauuacuauacccaguuuuccgacaauagcggguacucucaaacgaccuggcgggucuaucugagaucccacgacuucgaggccuguauccucuacccuaaccagcauuuuugccgcugugugaaaaauggagagaagugcucuagcuccaacugggauuucgcuaaugaaaugaaagacuauuacagcggcaagcagacaaaauuugauaaggaccugaaccuugcccugaccgcucuccaccacgccuuccgggggacauccucugcguauaucgccaccaugcugagcaagaaauccaaugaugaccugauugcuuacacgaacaagaucaaaacaaaguuucccggaaaugcccuucucaaagcuauuaucgauuacauugccuauaugaagucucugccuggcauggcgaacuucaaauacgacgaguuuugggaugaacugcucuauaagcccaaucccgccaaggcuagcaaccuggccagagggaaagaguccagcuacaacuucaaacuugcuaucucuuccaaaagcaucaagaccuguaaaaaugugaaggacguugccugccugucuccucgcuccggcgccauuuaugcuagcaucauugcguguggagaaccgaacggccccucugucuaccggaagccuagcgggggaguguuccaguccagcacagaucaaucuaucuauugccuccuggacucccauugccuggaggaguuugaagccauuggccaggaggaacuugaugcugugaaaaagagcaaauguugggagaucgaguaccccgacgucaagcucauucaggaaggggacggaaccaaauccugcagaaugaaggauucuggcaauuguaacguggccaccaaucgcuggccuguuauccagugcgagaacgacaaguucuacuauagcgaacugcaaaaagauuacgacaagacacaggauaucgggcacuauugucugucccccggcugcacgaccgugcgguacccgauuaauccuaaacauaucucuaacuguaauuggcaggucagcagauccucuauugccaagaucgacgugcacaacauugaggauaucgaacaguauaaaaaggcuaucacacaaaagcuccagaccagccugucccuuuuuaaauacgccaagacaaagaaucugccccacauuaagccuaucuauaaauacauuaccaucgagggaacggagacagcggaaggcauugagagcgcuuacaucgaaucugagguucccgcccucgccgggaccuccaucggauucaagauuaacagcaaagaaggcaagcaucugcuggacgugaucgcuuaugucaagucugccuccuacagcucuguguauaccaaacuuuacuccacagggccuaccagcggaauuaauacaaagcacgaugagcucugcacgggccccuguccggcgaacaucaaucaucagguuggguggcugaccuuugcucgcgagcggacauccagcuggggcugcgaagaguucggaugucuggccgugucugacggcugcgucuuugggagcugccaagauauuaucaaagaggaacucuccguguauagaaaggaaaccgaggaggugacagacgucgaacugugucuuaccuucucugauaaaacguacugcaccaaccugaacccuguuacacccauuaucaccgaccucuuugaggugcaguucaagacaguggaaaccuauagccugccccgcaucgucgccgugcagaaucacgagauuaagaucggacagauuaacgaccugggcguuuacuccaaaggguguggaaaugugcaaaaggucaacggcacaaucuacgggaauggcgugccucgguuugauuaucuuugccaucuggcuucuagaaaagagguuauugugcggaaguguuucgacaacgauuaccaggccugcaaauuucuccagagcccggcuuccuaucgccuggaagaggacucuggaaccgucacgaucaucgauuacaagaagauucucggcacaaucaaaaugaaggccauucugggggacgugaaauauaagaccuucgcggauagcguugacaucaccgccgaaggauccuguacaggcugcauuaauuguuucgagaacauccacugcgaacuuacccugcacacgacaaucgaggcuagcugucccauuaaaucuuccugcaccguguuucaugauagaauccucgucacaccuaaugagcacaaguacgcccugaagauggugugcaccgaaaaacccgggaacacacugaccauuaagguguguaauacgaaaaucgaggcuagcauggcccuugucgacgccaagccuauuaucgaacuggcucccguugaucagaccgcguauauucgggagaaagacgaaagaugcaagacauggaugugucgcgugcgggacgagggacuccaagugauccuggagccuuucaagaaccucuuuggcucuuacaucggcauuuucuacaccuuuaucauuuccaucgucgcccugcuugugauuaucuauguucugcuccccaucugcuucaaacugagagauacacugcgcaagcaugaagacgcuuacaaaagagagaugaagauucgguga

SEQ ID NO: 14324 - RNA, 4326 nt, Artificial Sequence
  derived and/or modified CDS sequence (opt5) from LACV(LACV/96/WV-M (WV96-3955))__GU206145.1__GP
augaucuacauucuggugcucaucgccgucaccgcugccagccccguuuaucagagaugcuuccaagacggcgcgauugugaagcagaacccuuccaaagaggcugugacagaagucugucugaaggaugacgugucuaugaucaaaacggaggcccgguacauucgcaaugccaccgggguuuuuagcaacaauguggcuaucagaaaguggcuugucuccgauuggcacgacugccggccgaaaaagaucacaggaggccauauuaacgugaucgaaguuggggaugaccugucucuccacaccgagagcuauguguguuccgccgauugcacaauuggagucgacaaggaaaccgcucaggugcgccugcagacagauaccacgaaucauuucgagaucgccggcaccacagugaaaucugggugguuuaagagcaccacauacauuacccuugaccaaacgugugagcaccugaaagucuccugcggacccaagagcguucaguuccaugcguguuuuaaccagcacaugucuugcgugagauuccuccaccggacaauccugccuggcuccauugccaauagcaucugucagaacaucgaaauuaucauucuggugacccucacacugcuuaucuuuauucugcucucuauccuguccaaaaccuauaucugcuaccuucugaugcccauuuucaucccuauugcuuaugucuacggcaucauuuacaauaagagcuguaagaaaugcaagcucugcgggcugguguaucaucccuuuaccgaguguggaacacacugcguuuguggcgcccgcuacgauacgucugacagaaugaaacugcaucgggcuuccgggcucugcccuggauauaagagccugcgcgccgcgagagugauguguaaauccaagggcccggccucuauccuuagcaucauuaccgcuguccuggugcucacauucguuacccccaucaacuccauggugcugggggaaagcaaagaggucuuugagcuugaagaacugccugaugacaugcucgaaauggcccugcggauuaauucuuacuauuucacaugcauccugaacuacgcuguguccuggggacucauuaucauuggccugcuuaccggccugcucuuuaagaaguaucaacaccgcuuccugaauaucuacgccauguacugugaggaaugcgacauguaucacgauaaaagcgggcuuaagagacauggagacuucacgaacaaaugucggcagugcacauguggccaguacgaggaugccgcugggcugaugacccaccgcaagaccuauaauugccucguccaguacaaagcgaaguggaucaugaacuuucugauuguguauaucuuccugauucucaucaaggacucugccauuaucguuagagcugccggaacagauuuuagcuccugccuggagaccgaaaucauuaacuggaauuguacaggccccuuccuuaaccuggggaauugccaacggcagcagaaaaaggagccuuacgccaacaucgcugcccaacucaaaggacugaaggcgauuucugugcuggacauccccaugauuacggaaaucccggaugacaucgcuagcgcccuuagauauauugaggaacgcgaggccuuucauguccagcucaccgcugaguacgccaugcugucccgguacugugauuauuacacacaguucagcgacaauucuggcuauucccagaccacauggagaguguaccugcgcagccacgauuuugaggcuugcauccucuauccuaaccaacauuucugucggugcguuaaaaauggcgagaaguguucuuccgccaacugggacuuugcgaaugaaaugaaggacuacuauagcgggaaacaggccaaguucgauaaagaccugaaccuugcucugaccgccaugcaccacgcuuuuagaggaacguccucugccuacauggcggccaugcucagcaagaaauccaaugaugaccugauuaccuacacaaacaagcugaagaccaaauuccccggcaaugcucugcucaaggccaucauugauuauaucgcuuacaugaaagggcugccuggaauggccaacuuuaagcaugacgaguucugggaugaacugcucuauaaacccacacccaccaaggccccuaaucuggcucgcggccgggagucuagcuacaacuucgagcuugcgaucuccagcaaaucuauuaagacgugcaagaacgugaaagacgucgccugucuguccccgagaagcggggcuaucuaugccucuauuaucgccugcggcgaacccaauggaccuuccguguaccgcaagcccagcggcgggguguuucagucuagcacagaucaguccauguauugucuccuggacagccacugccuggaggaguucgaagcuauuucucaagaggaacuugaugccguuaaaaaguccaaaugcugggagaucgaauacccugacgucaagcuccugcaggagaacgauggaaccaagagcugucggaugaaagacuccggcaauugcaacguggcgacaaauagauggcccgugauucagugugaaaacgacaaguuuuacuauucugagcugcagaaagauuacgacaagacccaagauaucgggcauuauugccucagcccgggaugugcuaccauccgcuacccuauuaaucccaaacacaucuccaacugcaauuggcaggucucucggagcuccauugccaagaucgacgugcacaacauugaggauaucgaacaguauaagaaagccaucacacagaagcugcaaacgucucuuagccuguucaaauacgcuaagaccaaaaaucucccucauauuaagcccaucuauaaguacauuacaaucgagggcaccgaaacagccgaggggauugaauccgcguacaucgagagcgagguuccugcucuggccggcaccucuaucggauuuaaaauuaacuccaaggaaggcaaacaccuucuugacgugaucgccuaugucaagagcgcuucuuacuccagcguguauacgaaacucuacucuacagggcccaccuccggaguuaauaccaagcaugaugagcuguguacaggcccgugcccugccaacauuaaucaccaggugggguggcugaccuucgcuagagaacggacaagcuccuggggaugugaggaauuuggcugccucgccgucagcgacggguguguguucggcucuugccaggauaucauuaaagaggagcugagcguuuaucgcaaggaaacggaggaagugaccgacgucgagcuuugccugacauuuuccgauaagaccuacuguacaaaccucaaccccgugacccccaucauuacggaccuguucgaggugcaauuuaaaaccgucgaaacauauucucugccuagaaucguugcggugcagaaucaugagaucaagauuggacagaucaacgaucuuggcguguacagcaaagggugcggaaauguccagaaggugaacggcaccauuuacgggaauggaguuccgcgguucgacuaucugugucaccucgccuccagaaaagaagugaucguccgcaagugcuuugacaacgauuaccaggcuuguaaguuccugcaaucucccgccagcuaucggcucgaggaagacuccggcacagugaccauuaucgauuacaaaaagauccuggggacaauuaaaaugaaggcuauccuuggcgacguuaaauauaagaccuucgccgauaauguggacauuacggccgagggaucuugcacaggcuguaucaacugcuuugagaauauucacugugaacugacccuccauaccacaaucgaggcuagcugcccuaucaaguccagcuguaccgucuuccacgaucgcauucuggugacgcccaacgaacauaaauacgcgcugaagguugugugcacagagaaaccugggaauacccuuacaaucaaggucugcaacaccaaaauugaagccgcuauggcccugguggacgccaagcccaucauugagcucgcuccuguggaucagacagccuauaucagagagaaggacgaaagauguaaaaccuggaugugccggguccgcgaugagggacugcagguuauucucgaacccuuuaagaaucuguucggcucuuacaucgggaucuuuuacacguucauuaucuccauuguggcgcuucuggugaucauuuauauccuccugccgaucuguuuuaaacugagagacacccuucggaagcacgaggacgcuuacaaacgcgaaaugaagauuagauga

SEQ ID NO: 14325 - RNA, 4326 nt, Artificial Sequence
  derived and/or modified CDS sequence (opt5) from LACV(LACV/97/NC-M (NC97-7306))__GU206127.1__GP
augauccggauucuggugcucaucgccgucaccgcugccagccccguuuaccagagaugcuuccaagacggcgcgauugugaagcagaacccuuccaaagaggcugugacagaagucugucugaaggaugacgugucuaugaucaaaacggaggcccgcuauauuagaaaugccaccgggguuuuuagcaacaauguggcuauccggaaguggcuugucuccgauuggcacgacugccgcccgaaaaagaucauuggaggccauaucaacgugauugaaguuggggaugaccugucucuccacacagagagcuacguguguuccgccgauugcaccaucggagucgacaaggaaacagcucaggugagacugcagaccgauacaaccaaucauuucgagauugccggcacgaccgugaaaucugggugguuuaagagcacaaccuauaucacacuugaccaaaccugugagcaccugaaagucuccugcggacccaagagcguucaguuccaugcguguuuuaaccagcacaugucuugcgugcgguuccuccaccgcacgauucugccuggcuccaucgccaauagcaucugucagaacauugaaaucauuauccuggugacacucacccugcuuauuuuuauccugcucucuauccuguccaaaacauacauuugcuaucuucugaugcccaucuucauuccuaucgcuuacgucuauggcauuaucuacaauaagagcuguaagaaaugcaagcucugcgggcugguguaccaucccuuuaccgaguguggaacccacugcguuuguggcgccagauaugauacaucugaccggaugaaacugcaucgcgcuuccgggcucugcccuggauacaagagccugagagccgcgcgggugauguguaaauccaagggcccggccucuauccuuagcaugauuacggcuguccuggugcucaccuucguuacacccaucaacuccauggugcugggggaaagcaaagagaccuuugagcuugaagaacugccugaugacaugcucgaaauggucucucgcauuaauuccuauuacuucacaugcauccugaacuaugccgugagcuggggacugauuaucauuggccuccugaccggccuucuguuuaagaaguaccaacacagauuccucaaugucuaugcuauguacugugaggaaugcgacauguaccacgauaaaucugggcugaagcggcauggagacuucacgaacaaaugucgccagugcacauguggccaguaugaggaugccgccgggcuuauggcucacagaaagaccuacaauugccuggugcaguauaaagcgaaguggaugaugaacuuucucaucaucuacauuuuccugauccugauuaaggacagcgccaucguugugcaagcugccggaaccgauuuuacaaccugccucgagacagaauccauuaacuggaauuguacgggccccuuccugaaccuugggaauugccagaaacagcaaaagaaagagccuuauaccaacaucgccacacagcugaagggacucaaagcuaucucuguccuggacauucccaucauuaccggcaucccggaugacauugccggcgcgcugcgguacaucgaagagagagaagauuuucaugugcagcuuacaaucgaguaugcuaugcucagcaaguacugugacuacuauacccaguucuccgauaauagcggguacucucaaacgaccuggcgcguuuaucugcggucccacgacuuugaggccugcauucuguacccuaaccagcauuucuguagaugcgugaagaauggagaaaaauguucuagcuccaacugggacuuugccaaugagaugaaggauuucuauagcggcaaacagacaaaguuugacaaagaucucaaccuggcucuuaccgcccugcaccacgcuuuccgcgggacauccucugucuacaucgccaccaugcucagcaagaaguccaaugacgaucugauugcguauacgaacaaaaucaagacaaaauuucccggaaaugcccugcuuaaggcuauuaucgacuacaucgccuacaugaaaucucucccuggcauggcuaacuucaaguaugaugaguucugggacgagcugcuguacaaacccaaucccgccaaggcgagcaaccucgcccgggggaaggaauccagcuauaacuuuaaacuggcuauuucuuccaagagcaucaaaaccugcaagaaugugaaagauguggccugucuuucuccuagauccggcgcuauuuacgccagcaucauugccugcggagagccgaacggccccucuguuuaucgcaagccucccgggggagucuuccagagcuccacagaccggagcaucuacugucugcucgauucucauugccuggaggaauuugaggcuauuucccaagaagaacuggacgcggugaagaaaagcaagugcugggagaucgaauauccugaugugaaaccccuucaggaguccgacggcaccaagucuuguagaaugaaagacagcgggaauugcaacgucgccaccaaucgcuggccggugauccagugugaaaacgauaaguucuacuacuccgagcuccagaaggacuaugauaaaacacaagacauuggacacuacugccugucuccuggcuguacgaccguucgguaucccaucaauccuaagcauauuagcaacugcaauuggcaaguguccagaucuagcaucgcuaaaauugauguccacaacaucgaagacaucgagcaguacaagaaagccauuacacagaagcugcaaaccucccucagccuguuuaaguaugccaaaacaaagaaucuuccccacaucaaaccuauuuacaaguauaucaccauugaggggacggaaacagcugagggcaucgaaucugccuacaucgaguccgaagugcccgcgcuggcuggaaccagcauuggcuucaaaaucaacucuaaggaggggaaacaucuccuggauguuauugccuacgugaaguccgccagcuauucuuccgucuacaccaagcuguauagcacaggaccgaccuccggcaucaauacaaaacacgacgagcuuuguacggggccuugccccgcuaacauuaaucaucaggugggauggcucaccuuugcccgcgaacggacaagcucuuggggcugugaggaguucgggugccuggcgguuagcgauggcuguguguuuggauccugccaggacaucauuaaggaggaacugucugucuacagaaaagagaccgaggaagugacagauguggagcucugccugaccuucagcgacaagacguauuguaccaaccuuaaccccgucacaccuaucaucaccgaucuguuugaaguucaauucaaaacaguggagaccuacucccucccgcggauuguggcuguccagaaucacgagaucaagauuggccagaucaacgaccuggggguguauucuaaggccugcggaaauguucagaaagugaacggcacagucuacgggaauggagugccccgcuuugacuaccugugucaucuugccagcagaaaggaaguuauugugcggaaaugcuucgauaacgacuaucaggcuuguaaguuccugcaguccccugccucuuacagacucgaggaagauagcggcaccgucacgaucaucgacuauaaaaagauucuggggacaaucaagaugaaagcuauucucggcgaugugaaguacaaaaccuuugccgacuccguugauaucaccgcggagggaagcugcacaggcuguauuaauugcuucgaaaacauccacugugagcugacccuucacacgacaaucgaggccucuugccccauuaaguccagcuguaccguguuucaugaccgcauccuggucacaccuaaugaacacaaauaugcucucaagauggugugcaccgagcggcccgggaacacacugaccauuaaggugugcaauacgaaaaucgaagccucuauggcucuggucgaugccaagccuauuaucgagcuugcccccguugaccagaccgcuuacauuagagaaaaagaugagcgcuguaagacauggaugugcagagugcgggacgagggacuccaggugauccuggaaccguucaaaaaccuguuuggcuccuauaucgggauuuucuacaccuuuaucauuagcaucgucgcgcuccuggugauuaucuacguucuucugccuaucuguuucaagcuccgcgacacacugagaaagcaugaggaugccuauaaacgggaaaugaagauucgcuga

SEQ ID NO: 14326 - RNA, 4326 nt, Artificial Sequence
  derived and/or modified CDS sequence (opt5) from LACV(LACV/human/1960)__EF485031.1__GP
augaucugcauucuggugcucaucaccgucgccgcugccagccccguuuaccagagauguuuccaagacggcgcgauugugaagcagaacccuuccaaagaggcugugacagaagucugccugaaggaugacgugucuaugaucaaaacggaggcccgguauguucgcaaugccaccgggguguuuagcaacaaugucgcuauuagaaaguggcuuguguccgauuggcacgacugucggccgaaaaagaucguuggaggccauaucaacgugauugaagucggggaugaccugucucuccacacagagagcuacgugugcuccgccgauuguaccaucggaguggacaaggaaacagcucagguccgccugcagaccgauacaaccaaucauuucgagauugccggcacgaccguuaaaucugggugguuuaagagcacaaccuauaucacacuugaccaaaccugcgagcaccugaaaguguccuguggacccaagagcgugcaguuccaugcgugcuuuaaccagcacaugucuugugucagauuccuccaccggacgauucugccuggcuccaucgccaauagcauuugccagaacaucgaaaucauuauccuggugacacucacccugcuuauuuuuauccugcucucuauucuguccaaaacauacaucuguuaucuucugaugcccaucuucauuccuaucgcuuacauuuauggcaccaucuacaauaagagcugcaagaaaugcaagcucugugggcugguuuaccaucccuuuaccgagugcggaacacacugugugugcggcgcccgcuaugauacgucugacagaaugaaacugcaucgggcuuccgggcucuguccuggauacaagagccugcgcgccgcgagagucaugugcaaauccaagggcccggccucuauucuuagcaucaucaccgcugugcugguucucacauucgugacccccauuaacuccaugguccugggggaaagcaaagagacauuugagcuugaagaucugccugacgacaugcucgagauggccucucggaucaauuccuauuaccugaccuguauucugaacuaugcugugagcuggggacucgucaucauuggccugcuuaucggccuucucuucaagaaguaccaacaccgcuuucugaauguguaugccauguacugcgaagagugugauauguaccacgacaaaucugggcuuaagggacauggcgauuucacgaacaaaugcagacaguguacaugcgggcaguaugaagacgccgcuggacugauggcgcaccggaagaccuacaauugccucguucaguauaaagccaaguggaugaugaacuuccugauuaucuacaucuuucugauucucaucaaggauagcgcuauugugguccaagccgccggcaccgacuucacaaccugucuggagacagaguccaucaacuggaauugcacggggcccuuucuuaaccugggaaauugucagaaacagcaaaagaaagaaccuuauaccaacauugcuacacagcucaagggccugaaagccaucucugugcuggauguucccaucauuaccggcaucccggacgauauugcgggggcucugcgcuacaucgaggaaaaggaggacuuccaugugcagcucacaauugaauaugccaugcugagcaaguacugcgauuacuauacccaguuuuccgacaauagcggauacucucaaacgaccuggagagucuaucugcggucccacgacuucgaggccuguauccucuacccuaaccagcauuuuugcagaugugugaaaaauggcgagaagugcucuagcuccaacugggauuucgcuaaugaaaugaaagacuauuacagcgggaagcagacaaaauuugauaaggaccugaaccuugcccugaccgcucuccaccacgccuuccgcggaacauccucugcguauaucgccaccaugcugagcaagaaauccaaugaugaccugauugcuuacacgaacaagaucaaaacaaaguuucccggcgaugcccuucucaaagcuauuaucgacuacauugccuauaugaagucucugccugggauggcgaauuucaaauacgaugaguuuugggacgaacugcucuauaagcccaaccccgccaaggcuagcaaucuggcccggggcaaagaguccagcuacaacuucaaacuugcuaucucuuccaaaagcaucaagaccuguaaaaacgugaaggauguugccugccugucuccuagauccggagccauuuaugcuagcaucauugcguguggcgaaccgaaugggcccucugucuaccgcaagccuagcggaggcguguuccaguccagcacagaccaaucuaucuauugccuccuggauucccauugccuggaggaguuugaagccauugggcaggaggaacuugacgcugugaaaaagagcaaauguugggagaucgaguaccccgacgucaagcucauucaggaaggagauggcaccaaauccugccggaugaaggacucugggaacuguaauguggccaccaacagauggccuguuauccagugcgagaaugauaaguucuacuauagcgaacugcaaaaagacuacgauaagacacaggacaucggccacuauugucugucccccggaugcacgaccgugcgcuacccgauuaacccuaaacauaucucuaauuguaacuggcaggucagccgguccucuauugccaagaucgaugugcacaauauugaggacaucgaacaguauaaaaaggcuaucacacaaaagcuccagaccagccugucccuuuuuaaauacgccaagacaaagaaccugccccacauuaagccuaucuauaaauacauuaccaucgagggcacggagacagcggaagggauugagagcgcuuacaucgaaucugagguucccgcccucgccggaaccuccaucggcuucaagauuaauagcaaagaagggaagcaucugcuggaugugaucgcuuaugucaagucugccuccuacagcucuguguauaccaaacuuuacuccacaggaccuaccagcggcauuaacacaaagcacgacgagcucugcacggggcccuguccggcgaauaucaaccaucagguuggcuggcugaccuuugcuagagagcgcacauccagcuggggaugcgaagaguucggcugucuggccgugucugaugggugcgucuuuggaagcugccaagacauuaucaaagaggaacucuccguguaucggaaggaaaccgaggaggugacagaugucgaacugugucuuaccuucucugacaaaacguacugcaccaaucugaacccuguuacacccauuaucaccgaccucuuugaggugcaguucaagacaguggaaaccuauagccugcccagaaucgucgccgugcagaaccacgagauuaagaucggccagauuaaugaucuggggguuuacuccaaaggauguggcaacgugcaaaaggucaaugggacaaucuacggcaacggagugccucgcuuugacuaucuuugccaucuggcuucucggaaagagguuauugugagaaaguguuucgauaaugacuaccaggccugcaaauuucuccagagcccggcuuccuaucggcuggaagaggauucuggcaccgucacgaucaucgacuacaagaagauucucgggacaaucaaaaugaaggccauucugggagaugugaaauauaagaccuucgcggacagcguugauaucaccgccgaaggcuccuguacagggugcauuaacuguuucgagaauauccacugcgaacuuacccugcacacgacaaucgaggcuagcugucccauuaaaucuuccugcaccguguuucaugaccgcauccucgucacaccuaacgagcacaaguacgcccugaagauggugugcaccgaaaaacccggaaauacacugaccauuaagguguguaacacgaaaaucgaggcuagcauggcccuugucgaugccaagccuauuaucgaacuggcucccguugaccagaccgcguauauuagagagaaagacgaacggugcaagacauggauguguagagugcgcgaugagggccuccaagugauccuggagccuuucaagaaucucuuuggcucuuacaucgggauuuucuacaccuuuaucauuuccaucgucgcccugcuugugauuaucuauguucugcuccccaucugcuucaaacugcgggacacacugagaaagcaugaagaugcuuacaaacgcgagaugaagauuagauga

SEQ ID NO: 14327 - RNA, 4326 nt, Artificial Sequence
  derived and/or modified CDS sequence (opt5) from LACV(LACV/mosquito/1978)__EF485037.1__GP
augauccgcauucuggugcucaucgccgucaccgcugccagccccguuuaccagcggugcuuccaagacggcgcgauugugaagcagaacccuuccaaagaggcugugacagaagucugucugaaggaugacgugucuaugaucaaaacggaggcccgcuauguuagaaaugccaccgggguguuuagcaacaaugucgcuauucggaaguggcuuguguccgauuggcacgacugccgcccgaaaaagaucaucggaggccauauuaacguuaucgaagugucugaugaccugagccuccacacagaguccuacgucuguucugccgauugcaccauugggguggacaaggaaacagcucaggugagacugcagaccgauacaaccaaucauuucgagaucgccggaacgaccgucaaaagcggcugguuuaaguccacaaccuauauuacacuugaccaaaccugugagcaccugaaaguuagcugcgggcccaagucugugcaguuccaugcguguuuuaaccagcacauguccugcgugcgguuccuccaccgcacgauccugccuggaagcauugccaauucuaucugucagaacaucgaaauuaucauucuggucacacucacccugcuuaucuuuauucugcucuccauccugagcaaaacauacaucugcuaucuucugaugcccauuuucaucccuauugcuuacauguauggcaucauuuacaauaagucuuguaagaaaugcaagcucugcggccugguguaccaucccuuuaccgagugugggacccacugcguuuguggagccagauaugauacauccgaccggaugaaacugcaucgcgcuagcggccucugcccuggguacaagucccugagagccgcgcgggugauguguaaaucuaagggaccggccagcauccuuuccaucauuacggcuguccuggugcucaccuucguuacacccaucaacagcauggugcugggcgaaucuaaagagaccuuugagcuugaagaacugccugaugacaugcucgaaauggccucccgcauuaauagcuauuacuucacaugcauccugaacuaugcugucucuugggggcuggugauuaucggacuccugaccggccuucuguuuaagaaguaccaacacagauuccucaauauuuaugccauguacugugaggaaugcgacauguaccacgauaaaagcggccugaagcggcauggggacuucacgaacaaaugucgccagugcacauguggacaguaugaggaugccgcuggccuuauggcgcacagaaagaccuacaauugccugguccaguauaaagccaaguggaugaugaacuuucucaucaucuacauuuuccugauccugauuaaggacuccgcuaucgugguucaagccgccgggaccgauuuuacaaccugccucgagacagaaucuauugacuggaacuguacgggacccuuccugaaucuuggcaacugccagaaacagcaaaagaaagagccuuauaccaauaucgcuacacagcugaaggggcucaaagccaucagcgugcuggauauucccaucauuacccggaucccggacgauauugcgggagcucugagauacaucgaagagagagaagacuuucauguccagcuuacaaccgaguaugccaugcucuccaaguacugugauuacuauacgcaguucagcgacaacucuggcuacucccaaaccacauggcggguguaucugagaagccacgacuuugaggccugcauccuguacccuaaucagaacuucugucgcugcguuaagaauggcgaaaaauguucuuccagcaacugggauuuugcuaaugagaugaaggacuauuaccccgggaaacaggccaaguucgauaaagaccucaaccuggcucuuaccgcccugcaucacgcguuucggggaacauccucugccuauauugcuaccaugcucagcaagaaguccaaugaugaccugaucgccuacacgaacaaaauuaagacaaaauucccuggcaaugcucugcuuaaggccaucauugauuacaucgcguauaugaaaucucuccccgggauggccaacuuuaaguacgacgaguucugggaugagcugcuguauaaacccaauccugcuaaggccagcaaccucgcuagaggaaaggaauccagcuacaacuucaaacuggccaucucuuccaagagcauuaaaaccugcaagaaugugaaagacgucgccugucuuucuccgcgcuccggcgcuaucuaugcgagcauuaucgccugcggggagcccaacggcccuucuguguaccggaagcccagcggaggcguguuucaguccagcacagauagaucuauuuauugucugcucgacucccacugccuggaggaguucgaggcuaucagccaagaagaacuggaugccguuaagaaauccaagugcugggagauugaauacucugacgucaaaccucuucaggaggggaauggaaccaagagcugucgcaugaaagacuccggcaacugcaauguggccaccaaccgguggcccgugauccagugugaaaaugauaaguuuuacuauucugagcuccagaaggacuacgauaaaacacaagacaucgggcauuauugccugagcccgggauguacgaccgucagauacccuauuaaccccaagcacaucuccaauugcaacuggcaagugucucgcagcuccauugcuaaaaucgauguucauaauauugaagacaucgagcaguauaagaaagccaucacacagaagcugcagaccagccucucucuguucaaguacgcgaaaacaaagaaccuuccucacauuaaacccaucuauaaguacauuaccaucgagggcacggaaacagcugaggggauugaauccgccuacaucgagagcgaagugccugcccuggcuggcaccucuaucggauuuaaaauuaauuccaaggagggcaaacaccuccuggaugucaucgccuauguuaagagcgcgucuuacuccagcguguaugcuaagcuguacuccaccgggcccacaagcggaauuaacaccaaacaugacgagcuuuguacaggcccgugcccugccaauaucaaccaccaggugggguggcucacguucgccaaggaacggaccucuagcuggggaugugaggaauuuggcugccuggcugucuccgauggguguguguucggcucuugccaggacauuaucaaagaggaacugagcguuuauagaaaggagacagaggaagugaccgaugucgagcucugccugacauuuuccgacaaaaccuacuguacgaaccuuaaucccgugacccccauuaucacagaucuguucgaagugcaauuuaagaccgucgagacauauucucucccucggaucguugccgugcagaaccaugagauuaagaucggacagauuaaugaccugggcguguacagcaaagggugcggaaacguccagaaggugaauggcaccguuuacgggaacggagugccgcgcuucgacuaucugugucaccuugcuuccagaaaagaagucaucgugcggaagugcuuugauaaugacuaccaagccuguaaauuccugcagucucccgcgagcuauagacucgaggaagauuccggcacaguuaccauuaucgacuacaagaagauccuggggacgauuaaaaugaaggccauccucggcgaugugaaauauaagacauucgcugacagcgucgauauuaccgccgagggaucuugcaccggcuguaucaacugcuuugaaaauauucauugugagcugacacuucacaccacgaucgaggcuuccugcccuaucaaaagcucuuguacaguguuccacgaccgcauucugguuacccccaacgaacauaaguacgcccucaagauggugugcacagagaaaccugggaauacccugacaaucaaggucugcaacaccaaaauugaagccuccauggcucugguggaugcgaagcccaucauugagcuugccccuguggaccagacggcuuauauccgggaaaaagaugagagauguaagaccuggaugugccgcgucagagacgagggacugcagguuauucucgaacccuuuaagaaucuguucggcagcuacaucgggaucuuuuacacauucauuaucuccauuguggcccuccuggccaucauuuaugugcuucugccgaucuguuuuaaacuccgggacacccugcgcaagcacgaggaugcuuacaaaagagaaaugaagauccgguga

SEQ ID NO: 14328 - RNA, 4326 nt, Artificial Sequence; identical to SEQ ID NO: 14297
  derived and/or modified CDS sequence (opt5) from LACV__KP271111.1__GP

SEQ ID NO: 14329 - RNA, 4263 nt, Artificial Sequence
  derived and/or modified CDS sequence (opt5) from OROV(BeAn19992)__NC_005775.1__GP
auggccaaccugaucauuaucagcauggugcucggcgucgcuuacgggcacccccuguccaccucucaaauuggagacagaugcuucgccggcgggaaucuuuuuaaggagaugaaccugagcguuggacucggcgaaaucugugugaaagaugacauuuccaucgugaagucuacaacggucuucagcaaaaauaagccugcgcuggaggcuaccacaaaauuuuaucgguccuucaucgugaaggauuggucugaaugcaacccgguucuugacaaguuugggaauuucauggugcugagcgucgaugacaacggacauauuauccccaaaauguacaccugucgcgccgccugcgauauuagacucaauaaggacaacgcugagaucauucuguccagcacaaaacugaaucacuuugaaaucgugggcaccacaucuaccuccggcugguucaagaacacgauuaccaauaaccucgagcauacaugugagcacguuaccgugaauugcgggcagaaaagcgucaaguuucaugccuguuuccggcagcaccgcggaugcaucagauuuuucaagggcacauauaugccuuacucuaugaucgaagcuaugugugugaacauugagcugaucauucuuacccuguauaucuuugccgcgauuaucuucgcccucaucauuacgaaauccuacguggcuuaucugcuucugccccucuucuacccugucacaugguuuuacgggaagguuuauaaaaagaucaauagcugccccaacugucugcuggccucucacccuuucaccuccugcccgaaauuuugcauuuguggaagccgguucuccugcacagaagcucucaaggugcaucgcaugggcaaagauugucugggguacaagucucuuagcaaggccagacagaugugcaaauccaagagcuggucuuuuaccgcggccauccugaccggacucauucugauggaguucaucucccccaucgcuggcgagcggauguauaaacuugaagaacuggccgacgaauuuauuaagcucacagagcaagugaacauccuggaacgcgagauggagguccugaaacaaagcauuaucgugauguucgcuauuauccucguucugcuucuguuugaaaauaugauuuucaacagacucuuucggaucuucuaccgcucuuguagcaugugcggccugauccacuauagaccugggcuuaagauugaucugacgaagaccaaucgguguggauccugcaucuguggcuuugacgagcagcagucuagcggguucgaauacgagauuuuccucaaagauaugcaugugcagaaggaauccugcaaauuuagcccccgcgucaaccacuucagaaauaucaaggcccugcuguuugcccucgugauuugugcuacaaucuauaccguuuacgcggacgaggacugccugucuaaagauaucaagauuacauaccaagagcuucacaacugcaucggaccuaagauuaugggcgacaccuguguguccaaaagcgaacuguauucugaucucuucuccaagaaucuggucacggaguacgacaaaaaguauuuugaacccgauacagugaacgaccaguucaauaaaaucgaguuugcccaggaugcucaucggaugauucugcuugaaagaauccucuacaagaccgagugcgagaugcugagccugaagaaaaacuccgggccguauaaugucgccuggcgcaccuaccucaagaaccacaauaucgaccuguguucucggcauaacuauaaaaugauuugccaguguaucaauacacacagcaugugcaacaacaccgauauugacuacaauaaggaaaucgagacauacuauaaauccaacgccgcugccuacagagcggaucuuaauacgauuauggacacccugaagacagcuuuccgcggacucaccaaagugcugaucgaaaacuauaucgagaaggacgauucugacgcccugaaggcccuuuuuagcaauauuacagauuccguucaagacaacuaccagaugaucggcauucucaaauucgcuagcaagcugcuggauaucaaucucggccggucuaccagauccgcccaucacagcauuaugacgaacgagaucccuaaaucuaaucccuuuaccgacuauuccuacagcaaccugaauauuaaggaauguaugucuccugagagccuuaaaugcuucaagaagcgcggguccacaccccacaccaaccaucugcucuguaaaaucgauaauaaguauaaggcuuuugacuggcccgaaaucgagacaauucagaaaggacaaaaacugugccugggcgauagccacuguaaccuugaguucaccgccaucacggcggacaagauuaugucucucacaaauugcuacaaggaguccuucaccgcccagccugcugauaugcaggccgggaucaaaaagugcagcgcugacgagauuggagaauguacaacccuggaggauaaaaccuggccgaucaucuuuugcggcgggaaguacuauuacuccgacucuaaagaacaugccaaggacggcagcauuaacaacuauugucugacaaauaagugcuccgagcagcgguuccccauccacgaaaacugguuuaaaaaguguaauugggauaaaacgcacaaggaguucucuaccaugagacaaauuaacuacaaugacaucacaagcuaucgcaaagcgauugaguccgaaaucggaaccgaucucaugacacaucacuacaagccuaccaaaaaccugccccauguggucccucgguaucacucuaucgacgugcagggcacggagagcacagaagggauuaucaauggauuuauucagaacaccauccccgccauuuccggccuugggguuggauaccaucugaauuuccagagcaaccaacucuuugauaucgugauuuucgucaagaaggcuguguacaaagcccaguaucagaaggcuuacaccacaggcccgucuaucuccaucaauauugagcacaacgaaagaugcaccgggcacuguccugagaaaauccccgccaaggagggcuggcugacauuuagcaaagaacauacgucuuccuggggaugcgaggaauauggcugucuggccauugacaccgggugccuuuacggaagcugucaggaugugauccgcccugagcucgacguuuauaagaagauuggcucugaggucucccugaucgaaaucugcauuacacugccccacgagaccuacugcaaugauauggacauccucgaaccuauuaucggggauaaacugagcgcuuccuuccaaaacacacagaccaaucagcuucccacgcugauugcguauaagaaaggaaagaucuacaccggccagaucaacgacauugggaacacagcccuccaauguggcagcauccaggugauuaauggaucuaccaucggcacagggagcccgaaauuugauuacauuugccaugcuaugcggagaaaggacgugaucguccggaaguguuucaacgacaauuaucaguccugcacccgccuggagaaaagaaacgaucugauuccuuaccggaagggagacgugaucgaaguuucuaaaacaggcagcaauauggggcaaaugaccuucaagaucgagcuuggagauauuaacuauaaaaucuuuacgaaguccauugaccugcagaugucuggcaucugugccgggugcauugauugugccgagggcaucagcugcuccaucaaugcugaagugcccgccgagacagucugucacugcaagaccaacugugaagacuucauuaauaacaucguguuuucuccccagauuaaaaauuacaacaucaagguucauugcaaaagcaagguggagaaaauuaccgcgcacaucugcggaagagauaucgaccuccagcugacaauuaagccuuauaaucaaaagaucgaucucucccagcuggacgaaagcaacuacauucgcgaggaggaucuucaguguggcaccuggcugugcaaaguccagaaggaagggaucgacauuaucuucaaaggacucuuuucuggccuggggcgguauuggacgauucugaucuacuccaucauuggagugguuaucauugugauccuugucuacauucugcucccgaucggcagacugcucaaggcuuuccugauccgccacgagauugaauaugccauggagcagaaaaucaaguga

SEQ ID NO: 14330 - RNA, 4263 nt, Artificial Sequence
  derived and/or modified CDS sequence (opt5) from OROV(BeH759021)__KP691607.1__GP
auggccaaccugaucauuaucagcauggugcucuccgucgcuuacggccacccccugucuaccagccagauuggggacagaugcuucgccggaggcaaucuuuuuaaggagaugaaccuguccguugggcucggagaaaucugugugaaagaugacauuucuaucgugaaguccacaacggucuucuccaaaaaucggccugcgcuggaggcuaccacaaaguuuuaucgcucuuucaucgugaaagauuggagcgaaugcaacccgguucuugacaaguuuggcaauuucauggugcuguccgucgaugacaacgggcauauuaugcccaagauguacaccuguagagccgccugcgauauccggcucaauaaagacaacgcugagauuauccugagcucuacaaagcugaaucacuuugaaauugugggaaccacauccaccagcggcugguucaaaaacacgaucaccaauaaccucgagcauacaugugagcacguuaccgugaauugcggccaaaagucugucaaauuucaugccuguuuccgccagcacagagggugcauucgguuuuucaagggaacauauaugccuuacuccaugaucgaagcuaugugugugaacaucgagcugauuauccuuacccuguauauuuuugccgcgaucauuuucgcccucaucaucacaaagagcuacguggcuuaucugcuucugccccucuucuacccugucacgugguuuuacggcaaaguuuauaagaaaauuaauucuugccccaacugucugcuggccucccacccuuucaccagcugcccgaagaucugcauuugugggucccgcuuuucuugcacagaagcucucaaagugcauagaaugggaaaggauugucugggcuacaaaagccuuuccaaggcccggcagaugugcaagagcaaaucuugguccuucaccgcggccauccugaccgggcucauucugauggaguuuaucagccccaucgcuggagagcgcauguauaagcucgaggagcuggccgacgaguucauuaaacucacagaacaggugaacauccuggaaagagaaauggagguccugaagcaaucuauuaucgugauguuugcuauuauccucguucugcuucuguucgaaaauaugauuuuuaaccggcuuuucagcaucuuuuaccgcuccuguucuaugugcggccugauccacuauagaccuggccuuaaaauugaucugacgaagaccaauaagugugggagcugcaucuguggauucaacgagcagcaguccagcggcuuugaauacgagauuuuccucaaagacaugcauauccagaaggaaucuugcaaauucagcccccgggugaaucacuuucgcaacauuaaggcccugcuguucgcccucgucaucugugcuacaaucuauaccguguacgcggaugaggacugccugagcaaagacauuaagaucacauaccaagagcuucacaauugcauugggccuaagaucaugggaaacaccuguguuucuaaaaaugaacuguauuccgaucucuuuagcaagaaccuggugacggaguacgacaaaaaguauuucgaacccgauacagucaaugaccaguuuaacaaaauugaguucgcccaggaugcucauagaaugauccugcuugaacggauccucuacaagaccgagugcgagaugcugucccugaagaaaaauucuggcccguauaacguggccuggagaaccuaccucaagaaucacaacauugaccuguguagccgccauaacuauaaaaugaucugccaguguauuaauacacacuccaugugcaagaacaccgauaucgacuacaauaaagaaauugagacauacuauaagucuaacgccgcugccuaccgggcggaucuuaauacgaucauggacacccugaaaacagcuuuuagagggcucaccaagguccugaucgaaaacuauauugagaaggaugacagcgacgcccugaaagcccuuuucuccaauaucacagauagcgugcaagacaacuaccagaugauuggaauccucaaguuugcuucuaaacugcuggauauuaaucucggccgcuccacccggagcgcccaucacucuaucaugacgaacgagauuccuaaguccaaucccuucaccgacuauagcuacucuaacguuaauaucaaagaauguaugagcccugagucccugaagugcuuuaagaaaagagauagcacaccccacaccaaccaucuucuguguaagaucgacucuaaauauaaggcuuucgauuggcccgaaauugagacaauccagaaaggccaaaagcucugccugggggacucccacuguaaucuggaauuuaccgccauuacggcggauaagaucaugagccuuacaaacugcuacaaagaguccuucaccgcccagccugcugacaugcagacaggaauuaagaaaugcucugccgaugagaucggcgaauguaccacccucgaggacaagacauggccgaucguguucugcgggggaaaauacuauuacagcgauuccaaggaacaugcuaaggacggcucuauuaacaauuauugucugacgaacaaaugcagcgagcagcgcuuucccauccacgaaaauugguucaagaaauguaacugggacaagacccacaaagaguuuuccacaaugcggcaaauuaauuacaacgauaucaccucuuauagaaaggccauugagagcgaaaucggguccgaccugaugacacaucacuacaaaccuaccaagaaucucccccaugucgugccucgcuaucacagcaucgauguucagggcacggagucuacagaaggaauuaucaacggcuucauucagaauaccauccccgcgauuuccgggcugggagugggcuaccaucuuaacuuuaaggggaaucagcuguucgacaucgucauuuuugugaaaaaggccguguacaaagcucaauaucagaaggccuacaccacaggaccgagcaucucuaucaacauugagcacaaugaacggugcaccggccacuguccugagaaaauccccgcuaaggagggguggcucacauucuccaaggaacauacgagcucuuggggcugcgaggaauauggaugucuggccauugauaccggcugccuguacggguccugucaggacguuaucagaccugagcuugaugucuauaaaaagauuggaagcgaggugucccucaucgaaaucugcauuacacugccccacgagaccuacugcaacgacauggauauccuggaaccuauuaucggcgacaaacucagcgccucuuuucagaauacacaaaccaaccagcugcccacgcuuauugcuuauaagaaagggaagaucuacaccggacagaucaacgauauuggcaauacagcgcugcagugugggagcauccaagugauuaacggcuccaccaucggaacaggcucuccgaaguucgacuacauuugccaugccaugcgccggaaagaugucaucgugagaaaguguuuuaaugacaacuaucagagcugcacccggcucgagaaacgcaaugaccugauuccuuacagaaagggggauguuaucgaaguguccaaaacaggaucuaacaugggccagaugaccuucaagaucgagcugggggacgucaauuauaagauuuucacgaaaagcaucgaucuucaaauguccggaauuugugcuggcugcaucgacugugccgaggggauuucuugcagcaucaacgccgaagugcccgcugagacaguuugucacugcaagaccaauugugaagauuuuaucaacaauauuguguucagcccccagaucaaaaacuacaauauuaagguccauugcaaauccaagguggagaagaucauugcccacaucugcggccgggacaucgaucugcagcucaccguuaaaccuuauaaccagaagauugaccugucucaacucgaugaauccaauuacaucagagaggaggaccugcaguguggaacauggcuuugcaaagugcagaaggaaggcgucgauauuaucuuuaaagggcuguucagcggacucggccgcuauuggaccauucugaucuacucuauuaucgggguggugaucauugucauccugguuuacauucuucugccgaucggacggcuccugaaggcguuucucauuagacacgagaucgaauaugcuauggagcagaaaaucaaguga

SEQ ID NO: 14331 - RNA, 4263 nt, Artificial Sequence
  derived and/or modified CDS sequence (opt5) from OROV(BeH759022)__KP691610.1__GP
auggccaaccugaucauuaucagcauggcucucuccguggccuacggccacccccugucuaccagccagauuggggacagaugcuucgcgggaggcaaucuuuuuaaggagaugaaccuguccgucgggcucggagaaaucuguguuaaagaugacauuucuaucgugaaguccacaacgguguucuccaaaaaucggccugcucuggaggccaccacaaaguuuuaucgcucuuucaucgucaaagauuggagcgaaugcaacccggugcuugacaaguuuggcaauuucaugguucuguccguggaugacaacgggcauauuaugcccaagauguacaccuguagagccgcuugcgauauccggcucaauaaagacaacgccgagauuauccugagcucuacaaagcugaaucacuuugaaauugucggaaccacauccaccagcggcugguucaaaaacacgaucaccaauaaccucgagcauacaugugagcacgugaccguuaauugcggccaaaagucugugaaauuucaugcuuguuuccgccagcacagagggugcauucgguuuuucaagggaacauauaugccuuacuccaugaucgaagccaugugugucaacaucgagcugauuauccuuacccuguauauuuuugcggccaucauuuucgcucucaucaucacaaagagcuacguggccuaucugcuucugccccucuucuacccugugacgugguuuuacggcaaagucuauaagaaaauuaauucuugccccaacugucugcuggcuucccacccuuucaccagcugcccgaagaucugcauuugugggucccgcuuuucuugcacagaagcccucaaaguucauagaaugggaaaggauugucugggcuacaaaagccuuuccaaggcgcggcagaugugcaagagcaaaucuugguccuucaccgccgcuauccugaccgggcucauucugauggaguuuaucagccccaucgccggagagcgcauguauaagcucgaggagcuggcugacgaguucauuaaacucacagaacaggugaacauccuggaaagagaaauggaggugcugaagcaaucuauuaucgucauguuugccauuauccucgugcugcuucuguucgaaaauaugauuuuuaaccggcuuuucagcaucuuuuaccgcuccuguucuaugugcggccugauccacuauagaccuggccuuaaaauugaucugacgaagaccaauaagugugggagcugcaucuguggauucaacgagcagcaguccagcggcuuugaauacgagauuuuccucaaagacaugcauauccagaaggaaucuugcaaauucagcccccggguuaaucacuuucgcaacauuaaggcccugcuguucgcucucgugaucugugcgacaaucuauaccgucuacgccgaugaggacugccugagcaaagacauuaagaucacauaccaagagcuucacaauugcauugggccuaagaucaugggaaacaccugugugucuaaaaaugaacuguauuccgaucucuuuagcaagaaccugguuacggaguacgacaaaaaguauuucgaacccgauacagugaaugaccaguuuaacaaaauugaguucgcucaggaugcccauagaaugauccugcuugaacggauccucuacaagaccgagugcgagaugcugucccugaagaaaaauucuggcccguauaacgucgccuggagaaccuaccucaagaaucacaacauugaccuguguagccgccauaacuauaaaaugaucugccaguguauuaauacacacuccaugugcaagaacaccgauaucgacuacaauaaagaaauugagacauacuauaagucuaacgcugccgcguaccgggcugaucuuaauacgaucauggacacccugaaaacagccuuuagagggcucaccaaggugcugaucgaaaacuauauugagaaggaugacagcgacgcccugaaagcucuuuucuccaauaucacagauagcguccaagacaacuaccagaugauuggaauccucaaguuugccucuaaacugcuggauauuaaucucggccgcuccacccggagcgcucaucacucuaucaugacgaacgagauuccuaaguccaaucccuucaccgacuauagcuacucuaacgugaauaucaaagaauguaugagcccugagucccugaagugcuuuaagaaaagagauagcacaccccacaccaaccaucuucuguguaagaucgacucuaaauauaaggccuucgauuggcccgaaauugagacaauccagaaaggccaaaagcucugccugggggacucccacuguaaucuggaauuuaccgcgauuacggccgauaagaucaugagccuuacaaacugcuacaaagaguccuucaccgcucagccugccgacaugcagacaggaauuaagaaaugcucugcugaugagaucggcgaauguaccacccucgaggacaagacauggccgaucguuuucugcgggggaaaauacuauuacagcgauuccaaggaacaugccaaggacggcucuauuaacaauuauugucugacgaacaaaugcagcgagcagcgcuuucccauccacgaaaauugguucaagaaauguaacugggacaagacccacaaagaguuuuccacaaugcggcaaauuaauuacaacgauaucaccucuuauagaaaggcgauugagagcgaaaucggguccgaccugaugacacaucacuacaaaccuaccaagaaucucccccauguggucccucgcuaucacagcaucgaugugcagggcacggagucuacagaaggaauuaucaacggcuucauucagaauaccauccccgccauuuccgggcugggaguuggcuaccaucuuaacuuuaaggggaaucagcuguucgacaucgugauuuuugucaaaaaggcuguguacaaagcccaauaucagaaggcuuacaccacaggaccgagcaucucuaucaacauugagcacaaugaacggugcaccggccacuguccugagaaaauccccgccaaggagggguggcucacauucuccaaggaacauacgagcucuuggggcugcgaggaauauggaugucuggccauugauaccggcugccuguacggguccugucaggacgugaucagaccugagcuugauguuuauaaaaagauuggaagcgaggucucccucaucgaaaucugcauuacacugccccacgagaccuacugcaacgacauggauauccuggaaccuauuaucggcgacaaacucagcgcuucuuuucagaauacacaaaccaaccagcugcccacgcuuauugcguauaagaaagggaagaucuacaccggacagaucaacgauauuggcaauacagcccugcagugugggagcauccaagugauuaacggcuccaccaucggaacaggcucuccgaaguucgacuacauuugccaugcuaugcgccggaaagaugugaucgucagaaaguguuuuaaugacaacuaucagagcugcacccggcucgagaaacgcaaugaccugauuccuuacagaaagggggaugugaucgaaguuuccaaaacaggaucuaacaugggccagaugaccuucaagaucgagcugggggacgugaauuauaagauuuucacgaaaagcaucgaucuucaaauguccggaauuugugccggcugcaucgacugugccgaggggauuucuugcagcaucaacgcugaaguccccgccgagacagugugucacugcaagaccaauugugaagauuuuaucaacaauauuguuuucagcccccagaucaaaaacuacaauauuaaggugcauugcaaauccaaggucgagaagaucauugcgcacaucugcggccgggacaucgaucugcagcucaccgugaaaccuuauaaccagaagauugaccugucucaacucgaugaauccaauuacaucagagaggaggaccugcaguguggaacauggcuuugcaaaguucagaaggaaggcguggauauuaucuuuaaagggcuguucagcggacucggccgcuauuggaccauucugaucuacucuauuaucggggucgugaucauugugauccuggucuacauucuucugccgaucggacggcuccugaaggcuuuucucauuagacacgagaucgaauaugccauggagcagaaaaucaaguga

SEQ ID NO: 14332 - RNA, 4263 nt, Artificial Sequence
  derived and/or modified CDS sequence (opt5) from OROV(BeH759040)__KP691616.1__GP
auggccaaccugaucauuaucagcaugauucucuccguggcuuacggccacccccugucuaccagccagaucggggacagaugcuucgccggaggcaaucuuuuuaaggagaugaaccuguccgucgggcucggagaaauuuguguuaaagaugacaucucuaucgucaagagcacaacgguguucuccaaaaaucggccugcgcuggaggcuaccacaaaguuuuaucgcucuuucauugugaaagauuggagcgaaugcaacccggugcuugacaaguuuggcaauuucaugguucuguccguggaugacaacgggcauaucaugcccaagauguacaccuguagagccgccugcgauauucggcucaauaaagacaacgcugagaucauucugagcucuacaaagcugaaucacuuugaaaucgucggaaccacauccaccagcggcugguucaaaaacacgauuaccaauaaccucgagcauacaugugagcacgugaccguuaauugcggccaaaagucugugaaauuucaugccuguuuccgccagcacagagggugcauccgguuuuucaagggaacauauaugccuuacuccaugaucgaagcuaugugugucaacauugagcugaucauucuuacccuguauaucuuugccgcgauuaucuucgcccucaucauuacaaagagcuacguggcuuaucugcuucugccccucuucuacccugugacgugguuuuacggcaaagucuauaagaaaaucaauucuugccccaacugucugcuggccucccacccuuucaccagcugcccgaagauuugcaucugugggucccgcuuuucuugcacagaagcucucaaaguucauagaaugggaaaggauugucugggcuacaaaagccuuuccaaggcccggcagaugugcaagagcaaaucuugguccuucaccgcggccauucugaccgggcucauccugauggaguuuaucagccccauugcuggagagcgcauguauaagcucgaggagcuggccgacgaguucaucaaacucacagaacaggugaacauucuggaaagagaaauggaggugcugaagcaaucuaucauugucauguuugcuaucauucucgugcugcuucuguucgaaaauaugaucuuuaaccggcuuuucagcaucuuuuaccgcuccuguucuaugugcggccugauucacuauagaccuggccuuaaaaucgaucugacgaagaccaauaagugugggagcugcauuuguggauucaacgagcagcaguccagcggcuuugaauacgagaucuuccucaaagacaugcauauucagaaggaaucuugcaaauucagcccccggguuaaucacuuucgcaacaucaaggcccugcuguucgcccucgugaucugugcuacaauuuauaccgucuacgcggaugaggacugccuguccaaagacaucaagauuacauaccaagagcuucacaauugcaucgggccuaagauuaugggaaacaccugugugucuaaaaaugaacuguauuccgaucucuuuagcaagaaccugguuacggaguacgacaaaaaguauuucgaacccgauacagugaaugaccaguuuaacaaaaucgaguucgcccaggaugcucauagaaugauccugcuugaacggauucucuacaagaccgagugcgagaugcugucccugaagaaaaauucuggcccguauaacgucgccuggagaaccuaccucaagaaucacaacaucgaccuguguagccgccauaacuauaaaaugauuugccaguguaucaauacacacuccaugugcaagaacaccgauauugacuacaauaaagaaaucgagacauacuauaagucuaacgccgcugccuaccgggcggaucuuaauacgaucauggacacccugaaaacagcuuuuagagggcucaccaaggugcugauugaaaacuauaucgagaaggaugacagcgacgcccugaaagcccuuuucuccaauauuacagauagcguccaagacaacuaccagaugaucggcauucucaaguuugcuucuaaacugcuggauaucaaucucggacgcuccacccggagcgcccaucacucuauuaugacgaacgagaucccuaaguccaaucccuucaccgacuauagcuacucuaacgugaauaucaaagaauguaugagcccugagucccugaagugcuuuaagaaaagagauagcacaccccacaccaaccaucuucuguguaagauugacucuaaauauaaggcuuucgauuggcccgaaaucgagacaauucagaaaggccaaaagcucugccugggggacucccacuguaaucuggaauuuaccgccaucacggcggauaagauuaugagccuuacaaacugcuacaaagaguccuucaccgcccagccugcugacaugcagacaggaaucaagaaaugcucugccgaugagaucggcgaauguaccacccucgaggacaagacauggccgauuguuuucugcgggggaaaauacuauuacagcgauuccaaggaacaugcuaaggacggcucuaucaacaauuauugucugacgaacaaaugcagcgagcagcgcuuucccauucacgaaaauugguucaagaaauguaacugggacaagacccacaaagaguuuuccacaaugcggcaaaucaauuacaacgauauuaccucuuauagaaaggccaucgagagcgaaaucggguccgaccugaugacacaucacuacaaaccuaccaagaaucucccccauguggucccucgcuaucacagcauugaugugcagggcacggagucuacagaaggaaucauuaacggcuucauccagaauaccauucccgcgaucuccgggcugggaguuggcuaccaucuuaacuuuaaggggaaucagcuguucgacauugugaucuuugucaaaaaggccguguacaaagcucaauaucagaaggccuacaccacaggaccgagcaucucuauuaacaucgagcacaaugaacggugcaccggccacuguccugagaaaauucccgcuaaggagggguggcucacauucuccaaggaacauacgagcucuuggggcugcgaggaauauggaugucuggccaucgauaccggcugccuguacggguccugucaggacgugauuagaccugagcuugauguuuauaaaaagaucggaagcgaggucucccucaucgaaauuugcaucacacugccccacgagaccuacugcaacgacauggauauucuggaaccuaucauuggcgacaaacucagcgccucuuuucagaauacacaaaccaaccagcugcccacgcuuaucgcuuauaagaaagggaagaucuacaccggacagauuaacgauaucggcaauacagcgcugcagugugggagcauucaagugaucaacggcuccaccauuggaacaggcucuccgaaguucgacuacaucugccaugccaugcgccggaaagaugugauugucagaaaguguuuuaaugacaacuaucagagcugcacccggcucgagaaacgcaaugaccugaucccuuacagaaagggggaugugaucgaaguuuccaaaacaggaucuaacaugggccagaugaccuucaagauugagcugggggacgugaauuauaagaucuucacgaaaagcauugaucuucaaauguccggaaucugugcuggcugcauugacugugccgaggggaucucuugcagcaucaacgccgaaguccccgcugagacagugugucacugcaagaccaauugugaagauuuuauuaacaauaucguuuucagcccccagauuaaaaacuacaauaucaaggugcauugcaaauccaaggucgagaagauuaucgcccacaucugcggccgggacauugaucugcagcucaccgugaaaccuuauaaccagaagaucgaccugucucaacucgaugaauccaauuacauuagagaggaggaccugcaguguggaacauggcuuugcaaaguucagaaggaaggcguggauaucauuuuuaaagggcuguucagcggacucggccgcuauuggaccauccugauuuacucuaucaucggggucgugauuaucgugauucuggucuacauccuucugccgauuggacggcuccugaaggcguuucucaucagacacgagaucgaauaugcuauggagcagaaaauuaaguga

SEQ ID NO: 14333 - RNA, 4263 nt, Artificial Sequence
  derived and/or modified CDS sequence (opt5) from OROV(BeH759146)__KP691631.1__GP
auggccaaccugaucauuaucagcauggugcucuccgucgcuuacggccacccccugucuaccagccagauuggggacagaugcuucgccggaggcaaucuuuuuaaggagaugaaccuguccguugggcucggagaaaucugugugaaagaugacauuucuaucgucaagagcacaacgguguucuccaaaaaucggccugcgcuggaggcuaccacaaaguuuuaucgcucuuucaucgugaaagauuggagcgaaugcaacccgguucuugacaaguuuggcaauuucauggugcuguccgucgaugacaacgggcauauuaugcccaagauguacaccuguagagccgccugcgauauccggcucaauaaagacaacgcugagauuauccugagcucuacaaagcugaaucacuuugaaauugugggaaccacauccaccagcggcugguucaaaaacacgaucaccaauaaccucgagcauacaugugagcacguuaccgugaauugcugucaaaagucugucaaauuucaugccugcuuccgccagcacagaggcuguauucgguuuuucaaggggacauauaugccuuacuccaugaucgaagcuaugugcgugaacaucgagcugauuauccuuacccuguauauuuuugccgcgaucauuuucgcccucaucaucaccaagagcuacguggcuuaucugcuucugccccucuucuacccugucacaugguuuuacggaaaaguuuauaagaaaauuaauucuugucccaacugccugcuggccucccacccuuucaccagcugcccgaagaucuguauuugcggcucccgcuuuucuuguacagaagcucucaaagugcauagaauggggaaggauugccugggauacaaaagccuuuccaaggcccggcagauguguaagagcaaaucuugguccuucaccgcggccauccugaccggccucauucugauggaguuuaucagccccaucgcuggggagcgcauguauaagcucgaggagcuggccgacgaguucauuaaacucacagaacaggugaacauccuggaaagagaaauggagguccugaagcaaucuauuaucgugauguuugcuauuauccucguucugcuucuguucgaaaauaugauuuuuaaccggcuuuucagcaucuuuuaccgcuccugcucuauguguggacugauccacuauagaccuggccuuaaaauugaucugacgaagaccaauaagugcggcagcuguaucugcggguucaacgagcagcaguccagcggauuugaauacgagauuuuccucaaagacaugcauauccagaaggaaucuuguaaauucagcccccgggugaaucacuuucgcaacauuaaggcccugcuguucgcccucgucaucugcgcuacaaucuauaccguguacgcggaugaggacugccuguccaaagacauuaagaucacauaccaagagcuucacaauuguauuggcccuaagaucauggggaauaccugcguuucuaaaaacgaacuguauuccgaucucuuuagcaagaaccuggugacggaguacgacaaaaaguauuucgaacccgauacagucaaugaccaguuuaacaaaauugaguucgcccaggaugcucauagaaugauccugcuugaacggauccucuacaagaccgagugugagaugcugucccugaagaaaaauucuggaccguauaacguggccuggagaaccuaccucaagaaucacaacauugaccugugcagccgccauaacuauaaaaugaucugucagugcauuaauacacacuccauguguaagaacaccgauaucgacuacaauaaagaaauugagacauacuauaagucuaacgccgcugccuaccgggcggaucuuaauaucaucauggacacgcugaaaaccgcuuuuagaggccucacaaagguccugauugaaaacuauaucgagaaggaugacagcgacgcccugaaagcccuuuucuccaauauuaccgauagcgugcaagacaacuaccagaugaucgggauucucaaguuugcuucuaaacugcuggauaucaaucucggacgcuccacacggagcgcccaucacucuauuaugaccaacgagaucccuaaguccaaucccuucacggacuauagcuacucuaacguuaauaucaaagaaugcaugagcccugagucccugaaguguuuuaagaaaagagauagcacgccccacacaaaccaucuucugugcaagauugacucuaaauauaaggcuuucgauuggcccgaaaucgagaccauucagaaaggccaaaagcucugucugggcgacucccacugcaaucuggaauuuacagccaucaccgcggauaagauuaugagccuuacgaacugcuacaaagaguccuucacagcccagccugcugacaugcagaccgggaucaagaaauguucugccgaugagaucggagaaugcacaacccucgaggacaagaccuggccgauuguguucuguggcgggaaauacuauuacagcgauuccaaggaacaugcuaaggacggaucuaucaacaauuauugccugacaaacaaauguagcgagcagcgcuuucccauucacgaaaauugguucaagaaaugcaacugggacaagacgcacaaagaguuuuccaccaugcggcaaaucaauuacaacgauauuacaucuuauagaaaggccaucgagagcgaaaucggcuccgaccugaugacccaucacuacaaaccuacaaagaaucucccccaugucgugccucgcuaucacagcauugauguucaggggaccgagucuacggaaggcaucauuaacggauucauccagaauacaauucccgcgaucuccggccugggggugggauaccaucuuaacuuuaagggcaaucagcuguucgacauugucaucuuugugaaaaaggccguguacaaagcucaauaucagaaggccuacaccaccgggccgagcaucucuauuaacaucgagcacaaugaacgguguacaggacacugcccugagaaaauucccgcuaaggagggcuggcucaccuucuccaaggaacauacaagcucuugggggugugaggaauauguuugccuggccaucgauacgggcugucuguacggauccugccaggacgucauuagaccugagcuugauguguauaaaaagaucggcagcgaggugucccucaucgaaauuugcaucacccugccccacgagacauacuguaacgacauggauauucuggaaccuaucauuggggacaaacucagcgccucuuuucagaauacccaaacaaaccagcugcccacccuuaucgcuuauaagaaaggaaagaucuacacgggccagauuaacgauaucgggaauaccgcgcugcagugcggaagcauucaagucaucaacggcuccacaauugggaccggcucuccgaaguucgacuacaucugucaugccaugcgccggaaagaugugauuguuagaaagugcuuuaaugacaacuaucagagcuguacacggcucgagaaacgcaaugaccugaucccuuacagaaagggagaugugaucgaagucuccaaaaccggcucuaacauggggcagaugacauucaagauugagcugggagacgugaauuauaagaucuucaccaaaagcauugaucuucaaauguccggcaucugcgcuggguguauugacugcgccgagggaaucucuuguagcaucaacgccgaaguucccgcugagacggugugccacuguaagacaaauugcgaagauuuuauuaacaauaucgucuucagcccccagauuaaaaacuacaauaucaaggugcauugcaaauccaagguugagaagauuaucgcccacaucuguggccgggacauugaucugcagcucaccgugaaaccuuauaaccagaagaucgaccugucucaacucgaugaauccaauuacauuagagaggaggaccugcagugcgggaccuggcuuuguaaaguccagaaggaaggcguggauaucauuuuuaaaggacuguucagcggccucgggcgcuauuggacaauccugauuuacucuaucaucggaguggucauuaucguuauucugguguacauccuucugccgauuggccggcuccugaaggcguuucucaucagacacgagaucgaauaugcuauggagcagaaaauuaaguga

SEQ ID NO: 14334 - RNA, 4263 nt, Artificial Sequence
  derived and/or modified CDS sequence (opt5) from OROV(BeH759620)__KP691622.1__GP
auggccaaccugaucauuaucagcauggugcucuccgucgcuuacggccacccccugucuaccagccagauuggggacagaugcuucgccggaggcaaucuuuuuaaggagaugaaccuguccguugggcucggagaaaucugugugaaagaugacauuucuaucgugaaguccacaacggucuucuccaaaaaucggccugcgcuggaggcuaccacaaaguuuuaucgcucuuucaucgugaaagauuggagcgaaugcaacccgguucuugacaaguuuggcaauuucauggugcuguccgucgaugacaacgggcauauuaugcccaagauguacaccuguagagccgccugcgauauccggcucaauaaagacaacgcugagauuauccugagcucuacaaagcugaaucacuuugaaauugugggaaccacauccaccagcggcugguucaaaaacacgaucaccaauaaccucgagcauacaugugagcacguuaccgugaauugcggccaaaagucuauuaaauuucaugccuguuuccgccagcacagagggugcauccgguuuuucaagggaacauauaugccuuacuccaugaucgaagcuaugugugucaacauugagcugaucauucuuacccuguauaucuuugccgcgauuaucuucgcccucaucauuacaaagagcuacguggcuuaucugcuucugccccucuucuacccugugacgugguuuuacggcaaagucuauaagaaaaucaauucuugccccaacugucugcuggccucccacccuuucaccagcugcccgaagauuugcaucugugggucccgcuuuucuugcacagaagcucucaaaguucauagaaugggaaaggauugucugggcuacaaaagccuuuccaaggcccggcagaugugcaagagcaaaucuugguccuucaccgcggccauucugaccgggcucauccugauggaguuuaucagccccauugcuggagagcgcauguauaagcucgaggagcuggccgacgaguucaucaaacucacagaacaggugaacauucuggaaagagaaauggaggugcugaagcaaucuaucauugucauguuugcuaucauucucgugcugcuucuguucgaaaauaugaucuuuaaccggcuuuucagcaucuuuuaccgcuccuguucuaugugcggccugauucacuauagaccuggccuuaaaaucgaucugacgaagaccaauaagugugggagcugcauuuguggauucaacgagcagcaguccagcggcuuugaauacgagaucuuccucaaagacaugcauauucagaaggaaucuugcaaauucagcccccggguuaaucacuuucgcaacaucaaggcccugcuguucgcccucgugaucugugcuacaauuuauaccgucuacgcggaugaggacugccugagcaaagacaucaagauuacauaccaagagcuucacaauugcaucgggccuaagauuaugggaaacaccugugugucuaaaaaugaacuguauuccgaucucuuuagcaagaaccugguuacggaguacgacaaaaaguauuucgaacccgauacagugaaugaccaguuuaacaaaaucgaguucgcccaggauucccauagaaugauccugcuugaacggauucucuacaagaccgagugcgagaugcugucucugaagaaaaauagcggcccguauaacgucgcuuggagaaccuaccucaagaaucacaacaucgaccuguguucccgccauaacuauaaaaugauuugccaguguaucaauacacacucuaugugcaagaacaccgauauugacuacaauaaagaaaucgagacauacuauaagagcaacgccgccgcuuaccgggccgaucuuaauacgaucauggacacccugaaaacagcguuuagagggcucaccaaggugcugauugaaaacuauaucgagaaggaugacuccgacgcucugaaagcccuuuucagcaauauuacagauucuguccaagacaacuaccagaugaucggcauucucaaguuugccuccaaacugcuggauaucaaucucggacgcagcacccggucugcucaucacuccauuaugacgaacgagaucccuaagagcaaucccuucaccgacuauucuuacagcaacgugaauaucaaagaauguauguccccugagagccugaagugcuuuaagaaaagagauucuacaccccacaccaaccaucuucuguguaagauugacuccaaauauaaggccuucgauuggcccgaaaucgagacaauucagaaaggccaaaagcucugccugggggacagccacuguaaucuggaauuuaccgcuaucacggccgauaagauuaugucccuuacaaacugcuacaaagagucuuucaccgcgcagccugccgacaugcagacaggaaucaagaaaugcagcgcugaugagaucggcgaauguaccacccucgaggacaagacauggccgauuguuuucugcgggggaaaauacuauuacuccgauucuaaggaacaugccaaggacggcagcaucaacaauuauugucugacgaacaaaugcuccgagcagcgcuuucccauucacgaaaauugguucaagaaauguaacugggacaagacccacaaagaguuuucuacaaugcggcaaaucaauuacaacgauauuaccagcuauagaaaggcuaucgaguccgaaaucgggagcgaccugaugacacaucacuacaaaccuaccaagaaucucccccauguggucccucgcuaucacucuauugaugugcagggcacggaguccacagaaggaaucauuaacggcuucauccagaauaccauucccgccaucagcgggcugggaguuggcuaccaucuuaacuuuaaggggaaucagcuguucgacauugugaucuuugucaaaaaggcgguguacaaagcccaauaucagaaggcuuacaccacaggaccgucuaucuccauuaacaucgagcacaaugaacggugcaccggccacuguccugagaaaauucccgccaaggagggguggcucacauucagcaaggaacauacgucuuccuggggcugcgaggaauauggaugucuggcuaucgauaccggcugccuguacgggagcugucaggacgugauuagaccugagcuugauguuuauaaaaagaucggauccgaggucagccucaucgaaauuugcaucacacugccccacgagaccuacugcaacgacauggauauucuggaaccuaucauuggcgacaaacucucugccagcuuucagaauacacaaaccaaccagcugcccacgcuuaucgccuauaagaaagggaagaucuacaccggacagauuaacgauaucggcaauacagcucugcaguguggguccauucaagugaucaacggcucuaccauuggaacaggcagcccgaaguucgacuacaucugccaugcgaugcgccggaaagaugugauugucagaaaguguuuuaaugacaacuaucaguccugcacccggcucgagaaacgcaaugaccugaucccuuacagaaagggggaugugaucgaaguuucuaaaacaggaagcaacaugggccagaugaccuucaagauugagcugggggacgugaauuauaagaucuucacgaaauccauugaucuucaaaugucuggaaucugugccggcugcauugacugugcugaggggaucagcugcuccaucaacgccgaaguccccgccgagacagugugucacugcaagaccaauugugaagauuuuauuaacaauaucguuuucagcccccagauuaaaaacuacaauaucaaggugcauugcaaaucuaaggucgagaagauuaucgcucacaucugcggccgggacauugaucugcagcucaccgugaaaccuuauaaccagaagaucgaccugucccaacucgaugaaagcaauuacauuagagaggaggaccugcaguguggaacauggcuuugcaaaguucagaaggaaggcguggauaucauuuuuaaagggcuguucucuggacucggccgcuauuggaccauccugauuuacuccaucaucggggucgugauuaucgugauucuggucuacauccuucugccgauuggacggcuccugaaggccuuucucaucagacacgagaucgaauaugcgauggagcagaaaauuaaguga

SEQ ID NO: 14335 - RNA, 4263 nt, Artificial Sequence
  derived and/or modified CDS sequence (opt5) from OROV(BeAn19991)__KP052851.1__GP
auggccaaccugaucauuaucagcauggugcucggcgucgcuuacgggcacccccuguccaccucucagauuggagacagaugcuucgccggcgggaaucuuuuuaaggagaugaaccugagcguuggacucggcgaaaucugugugaaagaugacauuuccaucgugaagucuacaacggucuucagcaaaaauaagccugcgcuggaggcuaccacaaaauuuuaucgguccuucaucgugaaggauuggucugaaugcaacccgguucuugacaaguuugggaauuucauggugcugagcgucgaugacaacggacauauuauccccaaaauguacaccugucgcgccgccugcgauauuagacucaauaaggacaacgcugagaucauucuguccagcacaaaacugaaucacuuugaaaucgugggcaccacaucuaccuccggcugguucaagaacacgauuaccaauaaccucgagcauacaugugagcacguuaccgugaauugcgggcaaaaauccgucaaguuucaugccuguuuccggcagcaccgcggaugcaucagauuuuucaagggcacauauaugccuuacucuaugaucgaagcuaugugugugaacauugagcugaucauucuuacccuguauaucuuugccgcgauuaucuucgcccucaucauuacgaaauccuacguggcuuaucugcuucugccccucuucuacccugucacaugguuuuacgggaagguuuauaaaaagaucaauagcugccccaacugucugcuggccucucacccuuucaccuccugcccgaaaauuugcaucuguggaagccgguuuuccugcacagaagcucucaaggugcaucgcaugggcaaagauugucugggguacaagucucuuagcaaggccagacagaugugcaaauccaagagcuggucuuucaccgcggccauucugaccggacucauccugauggaguuuaucucccccauugcuggcgagcggauguauaaacuugaggagcuggccgacgaauuuaucaagcucacagaacaggugaacauucuggaacgcgagauggagguccugaaacaaagcaucauugugauguuugcuaucauucucguucugcuucuguucgaaaauaugaucuuuaacagacucuuccggaucuuuuaccgcucuuguagcaugugcggccugauucacuauagaccugggcuuaagaucgaucugacgaagaccaaucgguguggauccugcauuuguggcuucgacgagcagcagucuagcggguuugaauacgagaucuuccucaaagauaugcaugugcagaaggaauccugcaaauucagcccccgcgucaaccacuuuagaaauauuaaggcccugcuguucgcccucgugaucugugcuacaaucuauaccguuuacgcggacgaggacugccugucuaaagauauuaagaucacauaccaagagcuucacaacugcauuggaccuaagaucaugggcgacaccuguguguccaaaagcgaacuguauucugaucucuuuuccaagaaucuggucacggaguacgacaaaaaguauuucgaacccgauacagugaacgaccaguuuaauaaaauugaguucgcccaggaugcucaucggaugauccugcuugaaagaauccucuacaagaccgagugcgagaugcugagccugaagaaaaacuccgggccguauaaugucgccuggcgcaccuacuuuaagaaccacaauauugaccucuguucucggcauaacuauaaaaugaucugccaguguauuaauacacacagcaugugcaagaacaccgauaucgacuacaacaaagaaauugagacauacuauaaguccaaugccgcugccuacagagcggaucugaacacgaucauggacacccuuaaaacagcuuuccgcggacugaccaaggugcucaucgaaaauuauauugagaaggacgauucugacgcccugaaagcccuguuuagcaacaucacagauuccguucaagacaauuaccagaugauuggcauccuuaaguucgcuagcaaacuccuggauauuaaccugggccggucuaccagauccgcccaucacagcaucaugacgaaugagauuccuaagucuaaccccuuuaccgacuauuccuacagcaaucucaacaucaaagaauguaugucuccugagagccugaagugcuucaagaaacgcgauuccacaccccacaccaaucaucuucuguguaagaucgacaacaaauauaaggcuuuugauuggcccgaaauugagacaauccagaaagggcaaaagcucugccugggagacagccacuguaaucuggaguucaccgccauuacggcggauaagaucaugucucuuacaaacugcuacaaagaauccuucaccgcccagccugcugacaugcaggccggcauuaagaaaugcagcgcugaugagaucggggaauguacaacccucgaggacaagaccuggccgaucauuuucugcggaggcaaauacuauuacuccgacucuaaggaacaugccaaggaugggagcaucaauaacuauugucugacaaacaaaugcuccgagcagcgguuccccauucacgaaaauugguuuaagaaauguaacugggacaagacgcacaaagaguucucuaccaugagacaaaucaauuacaacgauauuacaagcuaucgcaaggcgaucgaguccgaaaucggcaccgaccugaugacacaucacuacaaaccuaccaagaaucucccccauguggucccucgguaucacucuauugaugugcagggaacggagagcacagaaggcaucauuaacggguuuauccagaauaccauucccgccaucuccggacugggcguuggguaccaucuuaacuucaagggaaaucagcuguuugacauugugaucuucgucaaaaaggcuguguacaaagcccaauaucagaaggcuuacaccacaggcccgagcaucucuauuaacaucgagcacaaugaaagaugcaccgggcacuguccugagaaaauucccgccaaggagggcuggcucacauuuuccaaggaacauacgagcucuuggggaugcgaggaauauggcugucuggccaucgauaccgggugccuguacggauccugucaggacgugauucgcccugagcuugauguuuauaaaaagaucggcagcgaggucucucucaucgaaauuugcaucacacugccccacgagaccuacugcaacgacauggauauucuggaaccuaucauuggggacaaacucuccgcuagcuuccagaauacacaaaccaaccagcugcccacgcuuaucgcguauaagaaaggaaagaucuacaccggccagauuaaugauaucgggaacacagcccugcaguguggcuccauucaagugaucaacggaagcaccauuggcacagggucuccgaaguuugacuacaucugccaugcuaugcggagaaaagacgugauuguccggaaguguuucaaugauaacuaucagagcugcacccgccucgagaaaagaaaugaccugaucccuuaccggaagggagaugugaucgaaguuuccaaaacaggcucuaacauggggcagaugaccuucaagauugagcugggagacaucaauuauaagauuuuuacgaaaagcaucgaucuucaaauguccggcauuugugccgggugcaucgacugugccgagggcaucucuugcagcauuaacgcugaagugcccgccgagacagucugucacugcaagaccaauugugaagauuucaucaacaauauuguguuuagcccccagaucaaaaacuacaauauuaagguucauugcaaaucuaagguggagaagaucaccgcgcacaucugcggaagagacauugaucugcagcucacaaucaaaccuuauaaccagaagauugaccugagccaacucgaugaauccaauuacauccgcgaggaggaccugcaguguggcaccuggcuuugcaaaguccagaaggaagggauugacaucauuuucaaaggacuguuuagcggccucgggcgguauuggacgauccugaucuacucuauuaucggagugguuauuaucgugauucuggucuacauccuucugccgaucggcagacuccugaaggcuuuccucauucgccacgagaucgaauaugccauggagcagaaaauuaaguga

SEQ ID NO: 14336 - RNA, 4263 nt, Artificial Sequence
  derived and/or modified CDS sequence (opt5) from OROV(Tr9760)__AF312381.2__GP
auggccaaccugaucauuaucagcauggugcucuccauugcuuacggccacccccugucuaccagccagaucggggacagaugcuucgccggaggcaaucuuuuuaaggagaugaaccuguccgucgggcucggagaaauuuguguuaaagaugacaucucuaucgucaagagcacaacgguguucuccaaaaauaagcuggcgcuugaggcuaccacaaaauuuuaucggucuuucauugugaaggauuggagcgaaugcaacccugugcuggacaaguuuggcaauuucaugguucucuccguggaugacaacgggcauaccaucccgaaaauguacacaugucgcgccgccugcgauauuagacugaauaaggacaacgcugagaucauucugagcucuaccaaacucaaucacuuugaaaucgucggaacaaccuccacgagcggcugguucaagaacaccauuacaaauaaccuggagcauaccugugagcacgugacaguuaauugcggccaaaaaucugugaaguuucaugccuguuuccggcagcaccgcgggugcgucagauuuuucaagggaaccuauaugccccacuccaugaucgaagcuaugugugugaacaucgagcuuauuauccugacgcucuacauuuuugccgcgaucauuuucgcccugaucaucacaaaaagcuauguggcuuaccuucugcucccucuguucuaucccgccaccugguuuuacggcaaggucuacaaaaagauuaauucuugcccuaacugucugcucgcuucccaucccuucacaagcugcccuaaaaucugcauuugugggucccgguuuucuugcaccgaagcccugaagguucaccgcaugggaaaagauugucuuggcuauaagagccuguccaaggcgagacagaugugcaaaagcaagucuugguccuucaccgccgcuauccucacagggcugauucuuauggaguuuaucagcccgaucgccggagagcggauguacaaacuggaggagcucgcugacgaguucauuaagcugacggaacaggugaacauccuggaacgcgaaauggaggugcucaaacaaucuauuaucgucauguuugccauuauccuggugcuucugcuguucgaaaauaugauuuuuaacagacuguuccggaucuuuuaucgcagcuguuccaugugcggccuuauccauuacagacccggccugaagauugaucucaccaagacaaaucggugugggucuugcaucuguggauucgacgagcagcagagcuccggcuuugaauaugagauuuuccugaccgauaugcacguucagaaagaaagcugcaaguucucuccucgcgugaaccacuuuagaaauacaaaagcccuccucuucgcucuggucaucugugcgaccauuuacacgguguaugccgacgaggacugccuuuccaaggauaucaaaaucacauaccaagagcugcauaacugcauugggcccaagaucaugggagacaccuguguuagcaagucugaacucuacuccgaucuguuuagcaaaaaucuggugaccgaguaugacaagaaauacuucgaaccugauacagucaacgaccaguuuaauaagauugaguucgcucaggaugcccaccggaugauccuucucgaacgcauucuguauaaaaccgagugcgagaugcugucccucaagaagaacucuggccccuacaauguggccuggagaacacaucugaaaaaccacaauaucgaccuuuguagccggcauaacuauaagaugaucugccaguguauuaaugcucacuccaugugcaaaaacacggauaucgacuacaacaaggaaauugagaccuauuacaaaucuaaugccgcggcuuacagagccgggcugaacacaaucauggauacccucaagacagccuuucgcggacugaccaaaguccugauugaaaauuauaucgagaaggacgacagcgaugcucuuaaggcccucuucuccaacaucacggacagcgugcaagauaauuaccagaugauuggcauccugaaauuugcuucuaagcugcucgacauuaaccugggccgguccaccagaagcgcccaccauucuaucaugacaaaugagauuccgaaauccaacccuuucaccgauuauagcuacucuaauguuaacaucaaggaauguaugagccccgagucccuuaaaugcuuuaagaagcgcgacagcacaccucacaccaaucaucugcucuguaaaauugauaacaaguauaaagcguucgacuggcccgaaaucgagacgauccagaaggggcaaaaacugugccugggagauucucacuguaaucuugaauuuacagccauuaccgcugaccggaucaugucccucacaaacugcuacaaggagagcuucaccgcccagcccgcugauaugcaggccggcauuaagaaaugcuccgcggacgagaucggggaauguaccacacuggaggauaagacguggccuauuguguucugcucuggaaaauauuacuacagcgacuccaaggaacacgccaaagacggcucuaucaauaacuauugucugaccaacaagugcagcgagcagagauuuccgauccaugaaaauugguucaagaaauguaacugggauaagacacacaaagaguuucgccccuacgagaccaauaacuauaaugacauuacauccuaccggaaggcuaucgaaucugagauugggaccgaucucaugacgcaucacuauaaaccuacaaagaaccugccccaugucgugccuagauaccacagcaucgacguucaaggcaccgaauccaccgagggaauuaucaauggcuucauccagaacacaauucccgccaucagcgggcuugaugugggauaucaccugaauuuuaaaggcaaccaacucuucgacauugucaucuuugugaagaaggcuguguacaaagcccaguaccagaaggccuauaccacagggccgucuauuuccaucaauauugaacauaacgagcgcugcacgggacacuguccugagaaaauccccgcuaaggaaggcuggcugaccuucagcaaagagcauacaucuuccugggggugcgaagaguacggcugucuggcgaucgauaccggaugccuuuauggcagcugucaggacguuauucggccugagcucgaugucuacaagaagaucgggucugaagccucccugauugagaucugcauuacacugccccacgaaaccuauugcaaugacauggauauccucgagccuaucauuggagacaaacugagcgcuuccuuucagaacacgcagaccaaucaacuucccacacugaucgccuacaagaaaggcaagauuuauaccgggcagaucaacgauauuggaaacacagcccuccaguguggcagcauccaggugaucaaugggucuaccauuggcacaggaagcccgaaauucgacuacaucugccaugcuaugagacggaaggacgugauuguccgcaaguguuuuaacgauaauuaccaauccugcaccagacuggaaaaacggaacgaccugaucccuuauagaaagggcgaugugauugagguuucuaaaacggggagcaauaugggacagaugacauucaagaucgagcuuggcgacauuaacuacaaaaucuucaccaaguccguggaucugcagaugucugggaucugugccggaugcauugacugugcggaaggcaucagcugcuccauuaaugcugagguccccgccgaaaccgugugucacugcaagacaaacugugaggauuuuaucaauaacauuguuuucucuccccaaaucaaaaauuauaacaucaaggugcacugcaaaagcaaggucgagaaaauuaccgcccauaucugcgggcgcgacauugaucuccagcugacggugaagccuuacaaucagaagaucgaccucucccagcuggaugaaagcaacuauauucgggaggaagaccuucaauguggcacauggcugugcaaaguucagaaggagggaaucgacaucauguuuaaaggccucuucucugggcugggaagauacuggaccauucugaucuauuccauuaucggcguggucauuaucgugauucuuguguacauccugcucccgaucgggcgccugcucaaggcuuuucugauuagacacgaaaucgaguacgccauggaacagaaaauuaaguga

SEQ ID NO: 14337 - RNA, 4263 nt, Artificial Sequence
  derived and/or modified CDS sequence (opt5) from OROV(TRVL-9760)__KC759123.1__GP
auggccaaccugaucauuaucagcauggugcucuccauugcuuacggccacccccugucuaccagccagaucggggacagaugcuucgccggaggcaaucuuuuuaaggagaugaaccuguccgucgggcucggagaaauuuguguuaaagaugacaucucuaucgucaagagcacaacgguguucuccaaaaauaagcuggcgcuugaggcuaccacaaaauuuuaucggucuuucauugugaaggauuggagcgaaugcaacccugugcuggacaaguuuggcaauuucaugguucucuccguggaugacaacgggcauaucauuccgaaaauguacaccugucgcgccgccugcgauaucagacugaauaaggacaacgcugagauuauccugagcucuacaaaacucaaucacuuugaaauugucggaaccacauccaccagcggcugguucaagaacacgaucaccaauaaccuggagcauacaugugagcacgugaccguuaauugcggccaaaaaucugugaaguuucaugccuguuuccggcagcaccgcgggugcaucagauuuuucaagggaacauauaugcccuacuccaugauugaagcuaugugugucaacaucgagcuuauuauccugacccucuauauuuuugccgcgaucaucuucgcccugauuaucacgaaaagcuacguggcuuaucuucugcucccucuguucuaccccgccacaugguuuuacggcaagguguauaaaaagauuaauucuugcccuaacugucugcucgcuucccaccccuucaccagcugcccuaaaaucugcauuugugggucccgguuuucuugcacagaagcccugaagguccaucgcaugggaaaagauugucuuggcuacaagagccuguccaaggcgagacagaugugcaaaagcaagucuugguccuucaccgccgcuauccucaccgggcugauccuuauggaguuuauuagcccgaucgccggagagcggauguauaaacuggaggaacucgcugccgaauuuauuaagcugacagagcagguuaacauccuggaacgcgagauggaggugcucaaacaaucuauuaucgugauguuugccauuauccugguccuucugcuguucgaaaauaugaucuuuaacagacuguuccggauuuucuaccgcagcuguuccaugugcggccuuauccacuauagacccggccugaagauugaccucacgaagaccaaucggugugggucuugcaucuguggauucgaugagcagcagagcuccggcuuugaauacgagauuuuccugaaagacaugcaugugcagaaggaaagcugcaaauucucuccucgcguuaaccacuuuagaaauacaaaggcucuccucuucgcgcuggugaucugugccaccaucuauacagucuacgcugaugaggacugccuuuccaaagacauuaagaucaccuaccaagagcugcacaacugcauugggcccaagaucaugggagauacgugugugagcaaaucugaacucuauuccgaccuguuuagcaagaaucugguuacagaguacgauaaaaaguauuucgaaccugacaccgugaacgaucaguuuaauaaaauugaguucgcccaggacgcccaucggaugauccuucucgaaagaauccuguacaagaccgagugcgagaugcugucccucaagaaaaacucuggccccuauaaugucgcuuggcgcacauaccugaagaaccacaauauugaucuuuguagccggcauaacuauaaaaugaucugccaguguauuaaugcccacuccaugugcaagaacaccgacaucgauuacaacaaagaaauugagacauacuauaagucuaaugcggcugccuacagagccgaccugaacacgaucauggauacccucaaaacagcuuuucgcgggcugaccaaggugcugaucgaaaauuauauugagaaggacgacagcgaugcccuuaaagcucucuucuccaacaucacagacagcguccaagauaauuaccagaugauuggaauccugaaguuugccucuaaacugcucgacauuaaccugggccgguccaccagaagcgcgcaucacucuaucaugacgaaugagauuccgaaguccaacccuuucaccgauuauagcuacucuaaugugaacaucaaagaauguaugagccccgagucccuuaagugcuuuaagaaacgcgacagcacaccucacaccaaucaucugcucuguaagaucgauaacaaauauaaggccuucgacuggcccgaaauugagacaauccagaaaggccaaaagcugugccugggggauucucacuguaaucuugaauuuaccgcuauuacggccgaccggaucaugucccucacaaacugcuacaaggagagcuucaccgcucagcccgccgauaugcaggcgggaauuaaaaagugcuccgccgacgagaucggcgaauguacaacccuggaggauaaaaccuggccuaucguuuucugcucugggaaguacuauuacagcgacuccaaagaacaugcuaaggacggaucuauuaauaacuauugucugacaaacaagugcagcgagcagagauuuccgauccacgaaaauugguucaaaaaguguaacugggauaaaacgcacaaggaguuuuccaccaugcgccaaauuaauuacaacgacaucacaucuuaucggaaagccauugagagcgaaaucggcaccgaucucaugacacaucacuacaagcccaccaaaaaucugccucaugugguccccagauaucacuccaucgacgugcaggggacggagagcacagaaggcauuaucaacggauucauucagaauaccaucccugcuauuucuggccuugggguuggauaccaucugaacuuuaagggcaaucaacucuucgauaucgugauuuuugucaagaaagccguguacaaggcccaguaucagaaggcuuacaccacagggcccuccaucagcaucaacauugagcacaaugaacgcugcaccggacacuguccggagaaaaucccugcgaaagagggcuggcugacauucucuaaggaacauacguccagcugggggugcgaggaauauggcugucuggccauugacaccggaugccuuuacggcucuugucaggaugugauccggcccgagcucgacguuuauaagaaaauuggguccgaggcuagccugaucgaaaucugcauuacacugccucacgagaccuacugcaacgauauggacauccucgaacccauuaucggagauaagcuguccgccagcuuucagaauacacaaaccaaccagcuuccuacgcugauugccuauaaaaagggcaaaaucuacaccgggcagaucaaugacauuggaaacacagcucuccaguguggcucuauccaagucauuaacgggagcaccaucggcacaggaucccccaaguucgauuacauuugccaugccaugagacggaaggacgugaucgugcgcaaauguuuuaaugacaacuaucagucuugcaccagacuggagaagcggaaugaucugauuccguacagaaaaggcgacgucaucgaagugagcaagacaggguccaacaugggacagaugaccuucaaaaucgagcuuggcgauauuaauuauaagaucuucacgaagucuguugaccugcaaaugagcgggauuugugcgggaugcaucgauugugcugagggcauuuccugcucuaucaacgccgaagugccugccgagacagucugucacugcaaaaccaauugugaagacuuuaucaacaauauuguguucagcccccagaucaagaacuacaauauuaaaguucauugcaaguccaaaguggagaagaucaccgcucacauuugcgggcgcgauaucgaccuccagcugacagucaagcccuauaaccagaaaaucgaucucagccaacuggacgaaucuaauuacauucgggaggaggaucuucaguguggcaccuggcugugcaaggugcagaaagaaggaaucgacauuauguuuaagggccucuucuccgggcugggaagauauuggacgauccugauuuacagcaucauuggcguugugaucaucgucauucuuguguacauccugcucccuauugggcgccugcucaaagccuuucugaucagacacgagauugaauaugcgauggagcagaagaucaaauga

SEQ ID NO: 14338 - RNA, 4263 nt, Artificial Sequence
  derived and/or modified CDS sequence (opt5) from OROV(TVP-19244/DEI-216)__KP795073.1__GP
auggccaaccugaucauuaucagcaugauucucggcaucgcuuacgggcacccccuguccaccucucagauuggagacagaugcuucgccggcgggauccuuuuuaaggagaugaaucugagcgugggacucggcgaaaucugugucaaagaugacauuuccaucguuaagucuacaacggcguucagcaaaaacgcucuggcccuugaggccaccacaaaguuuuaucgguccuucauugugaaagauuggucugaaugcaauccugugcuggacaaguuugggaacuucaugguccucaauguggaugacaacggacaucugguuccgaagauguacaccugucgcgcugccugcgauaucagacugaauaaagacaacgcugagauuauccucagcuccacaaagcugaaucacuuugaaauugugggcaccacaagcaccucuggcugguucaaaaacacgaucaccaauaaccuugagcauacaugugagcacgucaccgugaauugcgggcaaaaguccguuaaauuucaugccuguuuccggcagcaccgcggaugcaucagauuuuucaagggcacauauaugcccuacagcaugauugaagcgaugugugugaacaucgagcugauuauccucacccuguauauuuuugccgcuaucaucuucgcccuuauuaucacgaagucuuacauugcuuaucugcuccugccucuguucuaccccgucacauggcucuacgggaaaguguauaagcggaucaauuccugcccuaacugucugcuugccagccaccccuuuaccucuugcccuaaaauuugcaucuguggaucccgcuucagcugcacagaagcgcugaaggugcauagaaugggcaaagauugucucggguacaagucccugucuaaagcccggcagaugugcaagagcaaguccuggagcuuuaccgcugccauccuuaccggacugauucucauggaguucgucucuccgaucgcuggcgagcgcauguauaaacuggaagaacuggccgacgauuacauugaacucacagagcagguuaacauccugggcaaggaaauuaaaauccuuaagcaauccauuaucgugaugcuggccaucauucucauccugcuucugagcgagaauauuaucuuuaacuaucucuucucuacgcuguacagaagcuguuccaugugcgggcugauucacuaucggcccggacucaaaguggacucuaccaagacaaauaaguguggcagcugcaucuguggguuugaugagcagcaguccagcggauucgaauacgaggucuuucugaaagacaugcaugugcagcgcgaaucuugcaaguucggcccuagaguuaaccacuuucggaauaccaaaauccuucuguucacaguggcuauuuguaccuccuuuuacacggucuaugcggacgaggauugccucagcaagaacauccgcauuacauaccaagaacugcacaauugcaucgggccccauauuaugggagacaccuguaugucuaaauccgagcuguauagcgaucuucucuccaagaaccugaucaccgaguacgacaagaaauauuucgaaccugauacagugaaugaccaguucaacaagaucgaguuugcccaggaugcucacagaaugauucugcucgaacggauccuguacaaaaccgagugcgaaaugcuuucucugaagaaaaauagcggccccuauaacguugccuggagaacauaccucaagaaucauaacauugaccuguguucccgccacaauuacaagaugaucugccaguguauuaacacgcauucuaugugcaaaaacaccgauaucgacuucaauaaggagaucgagacauauuacaaagccaacgcugccgcguaucggagcgauuuuaauaccauuaucgacacacugaagaccgcuuucagaggccuuacgaaagugcucauugaaaacuacaucgagaaggacgauuccgacgcccugaaagcccuguuuagcaauauuaccgauucuguccaagacaacuaucagaugguggggguccucaaguucgcuuccaagcugcuuaauaucagccugggacgcacaacccggucugcccagcacuccauuaugacaaacgaaaucccgaaaagcaauccuuuuaccgauuacucuuauagcuccgugaacaucaaggaguguaugagccccgagucucucaaaugcuucaagaaaagagacuccgcuccucacaugaaucaucugcuguguaagauggauaacaaguacaaagccuuugacuggcccgaaauugagacgguucaaaagggccagaaacuuugccucggggauagccacuguaaucuggaguucacagcgaucaccgccgacaagauuaugucccugacaaacugcuacaaagagucuuuuaccgcucagcccgccgauaugcagaccggaaucaagaagugcagcgcugacgaaauuggcgaguguaucacacucgaggauaaauccuggccuaucguguucugcggggacaaguauuacuauucugacggcaaagaacaugccaaggauggaagcauuaauaacuacugucuggcgaacaaaugcuccgagcaacgcuuuccgauccacaagaauugguucaagaaauguaacugggacaagacgcacaaagaguucaccacaaugcggcagauuaauuauaacgauaucaccucuuacagaaaggccauugaaagcgaaaucggcacagaccuuaugacccaucacuauaaacccacgaagaaucugccucaugucgugccccgcuaccacuccaucgauguucaggggacagagagcaccgagggaauuaucaacggcuuuauucagaauaccaucccugcuauuucugggcucggagugggcuaccaucugggguucaaaggcaaccaacuguuugacaucgucauuuucgugaagaaggccguguauaaagcucaguaccagaagguuuauacaaccggacccuccaucagcaucaauauugaacacaacgagaaaugcacaggccacuguccggaaaagaucccugccaaagagggguggcuuacguuuucuaaggaacauaccuccagcuggggaugcgaggaguacggcugucucgccauugauacagggugccuguauggaucuugucaggacgucauccggcccgaacuggauauuuacaagaaaaucggcuccgaggcuagccucaucgaaauuugcaucacccugccucacgagacauauugcaaugacauggauauucuugagcccaucauuggggacaagcuguccgcgagcuuccaaaacacccagacgaaucagcucccuaaccugauggccuacaaaaagggcaaaguguacaccggacagaucaaugaugugggcaacacagcucugcaaugugggucuauccaggucgugaacggaagcaccauuggcuccgggaaucccaaguuugacuauaucugccaugccaugagacgcaaggacguuauugugcggaaauguuucaacgauaauuaccagucuugcacaagacuuaacccgcggaaugaccugaucccuuaucgcaagggagauauuaucgaaauuagcaaaaccggcuccaacauggggcaaaugacauuuaagaucgagcucggcgacaucaauuacaaaauuuucaccaagucugucgaucugcagaugagcggaaucugugccggcugcauugacugugcugaagggaucuccugcucuauuaacgccgaugugagcgcggagacgguuugucacugcaagacaaauugugaagacuuuaucuccaacaucgugauuagcccccagaucaaaaccuauaauauuaagguccauugcaaaucuaaggugaaaaagaucaccgcuaacauuugcggaagaaauaucgaucuccagcugacaguuaagcccuacaaccagaaaaucgaccuuucccaacuggaugagagcaauuauauuaaggaggaagaccuccaguguggcaccuggcugugcaaagugcagaaggaggggaucgacauugucuucaaaggacuguucucuggccuuggcaaguacugggccauccugauuuacuccaucauugggaucaucguggugauucuccugaucuauguccuccugccuauuggacggcuucugaaagccuuucucaucaagaacgaaauugaguacacgauggaacaaaagaucaaauga

SEQ ID NO: 14339 - RNA, 4263 nt, Artificial Sequence
  derived and/or modified CDS sequence (opt5) from OROV(TVP-19249/GML-444672)__KP795076.1__GP
auggccaaccugaucauuuucagcaucauucucggcaucgcuuacgggcacccccuguccaccucucagauuggagacagaugcuuugccggcgggagccuuuucaaggagaugaaucuguccgugggacucggcgaaaucugugucaaagaugacaucucuauuguuaagagcacaacggcguuuuccaaaaacacccuggcucuugaggccacaaccaaguucuaucggucuuuuaucgugaaagauuggagcgaaugcaauccugugcuggacaagcucgggaacuucaugguccugaauguggaugacaacggacaucugguuccgcgcauguacacauguagagccgcuugcgauauucggcucaauaaggacaacgccgagaucauucuguccagcaccaaacuuaaucacuuugaaaucgugggcacaaccucuacguccggcugguucaagaacaccauuacaaauaaccuggagcauaccugugagcacgucacagugaauugcgggcaaaagagcguuaaguuucaugcuuguuuccgccagcacagaggaugcauccgguuuuucaaaggcaccuauaugcccuacucuaugaucgaagccauguguauuaacaucgagcucauuauccugacgcuuuauauuuuugcggccaucaucuucgcucugauuaucacaaaguccuacauugccuaucuccugcugccucucuucuaccccgugaccuggcuguacgggaaggucuauaaacgcaucaauagcugcucuaacugucuucuggcuucccacccuuuuacaagcugccccaagauuugcaucuguggauccagauucucuugcaccgaagcccucaaagugcaucggaugggcaaggauugucugggguacaaaagccuuuccaaggcgcgccagaugugcaaaagcaagucuugguccuuuaccgccgcuauccugacaggacucauucugauggaguucgugagcccuaucgccggcgagagaauguauaagcuggaggaacucgcugacgauuacauugaaauggccgagcgggucggcaugcuggaaaaagagaucaagguucuuaaacaguuuacgauugugaugcuggugaucauucucauccugcuucuguucgagaacaccaucuuuaauuaucucuucaacacacuguaccgcucuuguagcaugugcgggcugauucacuauagaccgggacucaaggucgaccugaccaaaacaaauaaguguggcuccugcaucuguggguuugaugaacaacagucuagcggauucgaguacgaaguguuucuuaaggacaugcauauucagcgggaguccugcaaauucggcccccgcguuaaccacuuuagaaauaccaagauccuucucuucacgauugccaucuguacgagcuucuacaccguguaugcugacgaagauugccugucuaaaaacaucaagauuaccuaccaggagcugcacaauugcaucgggccuuauauuaugggagacacaugugucuccaaaagcgagcuuuacucugaucuccuguccaagaaccugaucaccgaauaugacaagaaauacuuugagcccgauacagugaaugaccaauucaacaagauugaauuugcgcaggaugcccaucggaugauccuccuggagagaauccuuuauaaaacggaaugcgagaugcugagccucaagaaaaauuccggcccuuacaacguugcuuggcgcaccuaccugaagaaucacaacauugaccuguguucucggcauaauuauaagaugaucugccaguguauuaacaugcacagcaugugcaaaaacacagauaucgacuucaauaacgagauugaaaccuacuauaaggccaaugccgcugccuacagauccgauuuuuauacaaucaucgacacccuuaaaacggcguuccgcggccucaccaaggugcugauugagaacuacaucgaaaaagacgauucugacgcucugaaggcccucuuuagcaauauuacaaacuccguccaggauaauuaucaaaugguggggguccugaaauucgccagcaaacuucugaacaucucucucggacgguccaccagaagcgcucagcauucuauuaugacaaaugagauccccaaguccaacccguuuaccgacuacagcuacucuagcgugaauauuaaagaguguauguccccugaaagccugaagugcuucaaaaagcgcgauucuguuccccacacgaaccaucugcuuuguaaaauggacaauaaguauaaggccuuugauuggccugagaucgaaacagugcagaaaggccaaaagcucugccugggggacucccacuguaaccuggaguucaccgcuaucacagccgauaaaauuaugagccucaccaauugcuacaaggaauccuuuaccgcgcagcccgccgacaugcagacaggaaucaaaaagugcucugcugaugagauuggcgaguguaucacgcuggaagacaaggccuggcccauugucgugugcggggauaaauauuacuauagcgacggcaaggagcacgcuaaagacggauccaucaacaacuacugucuugccaauaagugcucugaacagcgguucccuauccauaaaaacugguucaagaaguguaauugggauaaaacccacaaggaguuuacaaccaugagacaaauuaacuauaaugacaucacaagcuaccgcaaagcgauugaauccgagaucggcaccgaucugaugacgcaccauuacaagccgaccaaaaaccucccccacguugugccucgguaucauucuauugacguccaggggacagagagcaccgaaggaaucaucaauggcuucauucagaacacaauccccgccauuuccgggcugggagugggcuaccaccugggguuuagaggcaaucagcuuuucgauaucgugauuuuuguuaagaaagcugucuauaaggcccaauaccagaagguguauaccacaggaccuagcaucucuauuaacaucgagcauaaugaaaaaugcacgggccacugucccgagaagaucccggcuaaagaaggguggcucaccuucuccaaggagcacacaagcucuuggggaugcgaggaauacggcugucuggccauugacaccgggugccuguauggauccugucaggaugugauccgcccugagcucgacauuuacaaaaagaucggcagcgaagccucucugauugagaucugcaucacacuuccccaugagaccuacugcaacgauauggacauucuggaaccuaucauuggggauaagcucuccgcuagcuuucagaauacgcaaaccaaccagcugcccguccugauggcguauaaaaagggcaaaguguacacaggacagaucaaugacguuggcaacaccgcccuucaguguggguccauucaaguggucaacggaagcacaaucggcucugggaauccuaaguucgauuauaucugccacgcuaugcggagaaaagacgugauuguucggaaguguuuuaacgacaauuaccagagcugcacccgccuggaugccagaaacgaccucauccccuaucggaagggagauauuaucgagauuuccaaaacaggcucuaauauggggcagaugaccuucaagaucgaacugggcgacauuaacuacaaaaucuuuacaaagagcguggaucuccaaauguccggaaucugugccggcugcauugacugugcugaggggaucucuugcagcauuaaugccgaugucuccgcggaaacagugugucauugcaaaaccaacugugaggacuucaucucuaauauuguuaucagcccgcagaucaagaccuauaacauuaaggugcacugcaaauccaaggucgagaaaaucacagcuaauauuugcggaagaaacaucgaucugcagcuuaccgugaagccuuacaaucagaaaauugaccugagccaacucgaugaaucuaacuacaucaaggaggaagaccugcaguguggcacguggcugugcaaggugcagaaagaggggaucgacauugucuucaagggacuguuuuccggccugggcaaauauuggacaauccucauuuacagcaucauugggaucauuguuaucgugcugcucaucuaugugcugcuucccauuggacgccugcucaaggccuuccugaucaaaaaugaaauugaguacaccauggagcagaagaucaaauga

SEQ ID NO: 14340 - RNA, 4263 nt, Artificial Sequence
  derived and/or modified CDS sequence (opt5) from OROV(TVP-19254/GML-480914)__KP795082.1__GP
auggccaaccugaucauuaucagcauggugcucuccgucgcuuacggccacccccugucuaccagccagauuggggacagaugcuucgccggaggcaaucuuuuuaaggagaugaaccuguccguugggcucggagaaaucugugugaaagaugacauuucuaucgucaagagcacaacggcguucuccaaaaauaagccugcucuggaggccaccacaaaauuuuaucggucuuucaucgugaaggauuggagcgaaugcaacccggugcuugacaaguuuggcaauuucaugguucuguccguggaugacaacgggcauauuauccccaaaauguacaccugucgcgccgcuugcgauauuagacucaauaaggacaacgccgagaucauucugagcucuacaaaacugaaucacuuugaaaucgucggaaccacauccaccagcggcugguucaagaacacgauuaccaauaaccucgagcauacaugugagcacgugaccguuaauugcggccaaaaaucugugaaguuucaugcuuguuuccggcagcaccgcgggugcaucagauuuuucaagggaacauauaugccuuacuccaugaucgaagccaugugugucaacauugagcugaucauucuuacccuguauaucuuugcggccauuaucuucgcucucaucauuacgaaaagcuacguggccuaucugcuucugccccucuucuacccugugacaugguuuuacggcaaggucuauaaaaagaucaauucuugccccaacugucugcuggcuucccacccuuucaccagcugcccgaaaauuugcaucugugggucccgguuuucuugcacagaagcccucaagguucaucgcaugggaaaagauugucugggcuacaagagccuuuccaaggcgagacagaugugcaaaagcaagucuugguccuucaccgccgcuauucugaccgggcucauccugauggaguuuaucagccccauugccggagagcggauguauaaacuugaagaacuggcugacgaguucaucaagcucacagaacaggugaacauucuggaacgcgagauggaggugcugaaacaaucugucaucgugaugcucgccauuauccugguucuucugcucuuugaaaauaugauuuucaacagacuguuucggaucuucuaccgcagcuguuccaugugcggccuuauccacuauagaccuggccugaagauugaucucacgaagaccaaucggugugggucuugcaucuguggauuugacgagcagcagagcuccggcuucgaauacgagauuuuucugaaagauaugcauauccagaaggaaagcugcaaauucucuccccgcgugaaccacuucagaaauauuaaggcccugcucuuugcucuggucaucugugcgacaaucuauaccguguacgccgacgaggacugccuuuccaaaaacauuaagaucacauaccaagagcugcacaauugcauugggccuaagaucaugggagauaccuguguuagcaaaucugaacucuauuccgaccuguucagcaagaaccuggugacggaguacgauaaaaaguauuuugaacccgacacaauuaaugaucaguucaacaaaaucgaguuugcucaggacgcccaucggaugauccuucucgaacgcauucuguacaagaccgagugcgagaugcugucccucaagaaaaauucuggcccguauaacgucgccuggagaaccuaccugaagaaucacaacaucgaucuuuguagccggcauaauuauaaaaugauuugccaguguaucaacacacacuccaugugcaagaacaccgacauugauuacaauaaagaaaucgagacauacuauaagucuaacgcugccgcguacagagcugaccugaauacgaucauugauacccucaaaacagccuuccgcgggcugaccaaggugcugaucgaaaacuauauugagaaggacgacagcgaugcccuuaaagcucucuuuuccaauaucacagacagcguccaagauaacuaccagaugauuggaauccugaaguucgccucuaaacugcucgacauuaaucugggccgguccaccagaagcgcucaucacucuaucaugacgaacgagaucccuaaguccaaucccuuuaccgauuauagcuacucuaacgugaauauuaaagaauguaugagcccugagucccuuaagugcuucaagaaacgcgacagcacaccccacaccaaccaucugcucuguaagaucgauaauaaauauaaggccuuugacuggcccgaaauugagacaauccagaaaggccaaaagcugugccugggggauucucacuguaaccuugaguucaccgcgauuacggccgacaagaucaugucccucacaaauugcuacaaagagagcuuuaccgcucagccugccgauaugcaggcuggaaucaagaaaugcuccgccgacgagauuggcgaauguacaacccuggaggauaagaccuggccgaucguuuucugcgggggaaaauacuauuacucugacagcaaggaacaugcgaaggacggcuccauuaacaacuauugucugacaaauaaaugcucugagcagcgguuccccauccacgaaaacugguuuaagaaauguaauugggauaagacgcacaaagaguucagcaccaugaagcaaauuaacuacaaugacaucacauccuauagaaaagccaucgagucugaaauugggaccgaucucaugacacaucacuacaagccuaccaagaaccugccccauguggucccucgcuaucacagcaucgacgugcagggcacggaguccacagaaggacuuauuaauggcuuuauccagaacaccauucccgcuaucagcgggcugggaguuggcuaccaucucaauuucaaagggaaccagcuguuugauauugugaucuucgucaagaaagccguguacaaggcucaauaucagaaagccuacaccacaggaccgucuaucuccauuaauaucgagcacaacgaacggugcaccggccacuguccugagaagauucccgccaaggagggguggcugacauuuagcaaagaacauacgucuuccuggggcugcgaggaauauggaugucuugcuaucgacaccggcugccucuacgggagcugucaggaugugauuagaccugagcuggacguuuauaagaaaaucggaucugaggucucccugaucgaaauuugcaucacacucccccacgagaccuacugcaaugauauggacauucuggaaccuaucauuggcgauaaacuuagcgcguccuuccagaacacacaaaccaaucagcugcccacgcucaucgccuauaagaaggggaagaucuacaccggacagauuaacgacaucggcaacacagcucugcagugugggagcauucaagugaucaauggcucuaccauuggaacaggcagcccgaaauuugauuacaucugccaugccaugcgccggaaggacgugauugucagaaaauguuucaacgacaauuaucaguccugcacccggcuggagaagcgcaacgaucuuaucccuuacagaaaaggggacgugaucgaaguuucuaagacaggaagcaauaugggccagaugaccuuuaagauugagcugggggauaucaacuauaaaauuuucacgaaguccaucgaccuccaaaugucuggaauuugugccggcugcaucgauugugcugaggggaucagcugcuccauuaaugccgaagugucugcggagacagucugucacugcaaaaccaacugugaagacuucaucaauaacauuguguuuagcccccagaucaagaauuacaacauuaaaguucauugcaaguccaagguggagaaaaucaucgcucacauuugcggcaaggauaucgaccugcagcucaccgucaaacccuauaaucagaagauugaucugagccaacuugacgaaucuaacuacauccgggaggaggaucugcaguguggaacauggcucugcaaagugcagaaggaaggcauugacaucauuuucaaagggcuguuuuccggacugggcagauauuggaccauccuuaucuacagcauuaucgggguugugauuaucgucauucugguguacauccuccugccuaucggacgccuccugaaggccuuccuuauucggcacgagaucgaauaugccauggagcagaagauuaaauga

SEQ ID NO: 14341 - RNA, 4263 nt, Artificial Sequence
  derived and/or modified CDS sequence (opt5) from OROV(TVP-19256/IQE-7894)__KP795085.1__GP
auggccaaccugaucauuaucagcaugauucucggcaucgcuuacgggcacccccuguccaccucucagauuggagacagaugcuucgccggcgggagccuuuuuaaggagaugaaucuguccgugggacucggcgaaaucugugucaaagaugacaucucuauuguuaagagcacaacggcguucuccaaaaacgcucuggcccuugaggccaccacaaaguuuuaucggucuuucaucgugaaagauuggagcgaaugcaauccugugcuggacaaguuugggaacuucaugguccucaauguggaugacaacggacaucugguuccgaagauguacaccugucgcgcugccugcgauauuagacugaauaaagacaacgcugaggugauccucuccagcacaaagcugaaucacuuugaaauugucggcaccacaucuaccuccggcugguucaaaaacacgaucaccaauaaccuugagcauacaugugagcacgugaccguuaauugcgggcaaaagagcgugaaauuucaugccuguuuccggcagcaccgcggaugcauuagauuuuucaagggcgcguauaugcccuacucuaugaucgaagccaugugugucaacaucgagcugauuauccucacacuguauauuuuugcugccaucauuuucgcucuuaucaucaccaaguccuacauugccuaucugcuccugccucuguucuaccccgugacguggcucuacgggaaaguguauaagcggaucaauagcugcccuaacugucugcuugcgucucaccccuuuacauccugcccuaaaauuugcaucuguggaagccgcuucuccugcaccgaagcccugaagguccauagaaugggcaaagauugucucggguacaagucucugagcaaagcucggcagaugugcaaguccaagagcuggucuuuuacagccgcuauucuuaccggacugauccucauggaguucguuuccccgaucgccggcgagcgcauguauaaacuggaggagcuggccgacgauuacauugaacucgcugaacaggugaacauccugggcaaggaaauuaaaauccuuaagcaaagcauuaucgugaugcuggcgauuauccucauccugcuucugucugagaauauuaucuuuaacuaucucuucaaaacccuguacagaagcuguuccaugugcgggcugauucacuaucggcccggacucaaggucgaccugacaaagacgaauaaauguggcucuugcaucuguggguuugaugagcagcagagcuccggauucgaauacgagguguuucuuaaggacaugcauguucagcgcgaaagcugcaaauucggcccuagagugaaccacuuucggaauaccaagauucuccucuucacaaucgccaucuguaccucuuuuuacacagucuaugcugacgaggauugccuguccaaaaacauucgcaucaccuaccaagaacugcacaauugcauugggccccauaucaugggagacacguguaugagcaagucugagcuuuauuccgaucuccugagcaagaaccugauuacagaguacgacaaaaaguauuucgaaccugauaccgugaaugaccaguucaacaaaaucgaguuugcccaggaugcccacagaaugauccuccuggaacggauucuuuacaagaccgagugcgaaaugcugucccucaaaaagaacucuggccccuauaauguugcuuggagaacauaccugaagaaucauaacaucgaccuguguagccgccacaauuacaaaaugauuugccaguguaucaacacccauuccaugugcaagaacacagauauugacuucaauaaagagaucgagacguauuacaaggccaacgcggcugccuaucggucugauuuuaauaccaucauugacacacuuaaaaccgccuucagaggccucacaaaggugcugaucgaaaacuacauugagaaagacgauagcgacgcucugaaggcccucuuuuccaauaucaccgauagcguccaagacaacuaucagaugguggggguccugaaguucgcuucuaaacuucugaauauuucccucggacgcacgacccggagcgcccagcacucuaucaugacaaacgaaauuccgaaguccaauccuuuuaccgauuacagcuauucuagcgugaacaucaaagaguguaugucccccgagagccugaagugcuucaaaaagagagacucuguuccucacacaaaucaucugcuuuguaagauggauaacaaauacaagguguuugacuggcccgaaaucgagaccguccaaaaaggccagaagcucugccugggggauucccacuguaaucuggaguucacggcgauuacagccgacaaaaucaugagccucaccaacugcuacaaggaauccuuuacagcucagcccgccgauaugcagaccggaauuaagaaaugcucugcugacgaaaucggcgaguguauuacccuggaggauaagagcuggccuaucguguucugcggggacaaauauuacuauuccgaaggcaaggagcaugccaaagacggaucuaucaauaacuacugucuugcgaacaagugcagcgaacaacgcuuuccgauucacaagaauuggcugaaaaaguguaacugggauaaaacacacaaggaguucacgaccaugcggagaaucaauuauaacgacauuacauccuaccgcaaagccaucgaaucugagauuggcaccgaucucaugacacaucacuauaagcccaccaaaaaucugccucauguugugccccgguaccacagcaucgacguccaggggacggaguccacagaaggaaucauuaacggcuucauccagaauaccauuccugcuaucagcgggcugggagugggcuaccaucuuggguuuaagggcaaccagcuguucgauauugugaucuuuguuaagaaagccgucuauaaggcucaauaccagaaaguguauaccacaggacccucuauuuccaucaauaucgagcacaacgaaaagugcaccggccacuguccggagaaaauuccugccaaggaaggguggcugacauucagcaaggagcauacgucuuccuggggaugcgaggaauacggcugucuggccaucgacaccgggugccucuauggaagcugucaggaugugauuagacccgagcuggacaucuacaaaaagauuggcucugaggcuucccuuaucgaaaucugcauuacacugccucacgagaccuauugcaaugauauggacauccucgaacccauuaucggggauaaacugagcgcguccuuucagaacacacaaaccaaucagcugccuaaccuuauggccuacaagaaaggcaaggucuacacgggacagauuaaugacgugggcaacaccgcucugcagugugggagcauccaaguugugaacggaucuacaaucggcagcgggaaucccaaguucgauuauauuugccaugccaugcgccggaaagacgucaucgugagaaaguguuuuaacgacaauuaccaguccugcacccggcucgauccgcgcaacgaccugauuccuuauagaaaaggagauaucguugagauuucuaagacaggcagcaauauggggcagaugaccuucaaaaucgaacucggcgacauuaacuacaagaucuuuacaaaguccguggaucugcaaaugucuggaaucugugccggcugcauugacugugcugaggggaucagcugcuccauuaaugccgaugcgucugcugaaaccgucugucacugcaaaacgaacugugaggacuucaucagcaauauugugaucagcccccagaucaagacauauaacauuaaaguucauugcaaguccaaaguggagaagaucaccgccaauauuugcggacggaacaucgaucuucagcugaccgucaagcccuacaaucagaaaauugaccucucucaacuggaugaauccaacuauaucaaggaggaagaccugcaguguggcacauggcuuugcaaagugcagaaggaggggaucgacauuguguuuaaaggacuguucagcggccucggcaaguacugggccauccugauuuacucuaucauuggggucaucguugugauucuccugaucuaugugcuucugccuaucggaagacuccugaaggcuuuccugauuaaaaaugaaaucgaguacaccauggagcagaagauuaaauga

SEQ ID NO: 14342 - RNA, 4263 nt, Artificial Sequence
  derived and/or modified CDS sequence (opt5) from OROV(TVP-19257/IQT-1690)__KP795088.1__GP
auggccaaccugaucauuauccccaugauucucggcaucgcuuacgggcacccucugagcaccucccaaauuggagacagaugcuucgccggcgggucucuuuuuaaggagaugaaucugagcgugggacucggcgaaaucugugucaaagaugacaucuccauuguuaagucuacaacggcguucagcaaaaacgcucuggcccuugaggccaccacaaaguuuuaucgguccuucaucgugaaagauuggucugaaugcaauccggugcuggacaaguuugggaacuucaugguccucaauguggaugacaacggacaucugguucccaagauguacaccugucgcgcugccugcgauauuagacugaauaaagacaacgcugagaucauucucagcuccacaaagcugaaucacuuugaaaucgugggcaccacaagcaccucuggcugguucaaaaacacgauuaccaauaaccuugagcauacaugugagcacgucaccgugaauugcgggcaacgguccguuaaguuucaugccuguuuccgccagcacagaggaugcauccgguuuuucaaaggcacauauaugccuuacagcaugaucgaagcgaugugugugaacauugagcugaucauucucacccuguauaucuuugccgcuauuaucuucgcccuuaucauuacgaagucuuacaucgcuuaucugcuccugccccuguucuacccugucacauggcucuacgggaagguguauaaacgcauuaauuccugccccaacugucugcuugccagccacccuuuuaccucuugcccgaagaucugcauuuguggauccagauucagcugcacagaagcgcugaaagugcaucggaugggcaaggauugucucggguacaaaucccugucuaaggcccgccagaugugcaaaagcaaguccuggagcuuuaccgcugccauccuuaccggacugauccucauggaguucgucucucccauugcuggcgagagaauguauaagcuggaggaacuggccgacgauuacaucgaacucgccgagcagguuaacauucugggcaaagaaaucaagauucuuaaacaauccaucauugugaugcuggcuaucauccucauucugcuucugagcgagaauaucauuuuuaacuaucucuucaauacacuguaccggucuuguagcaugugcgggcugauccacuaucgcccuggacucaagguggaccugacgaaaaccaacaaguguggcuccugcauuuguggguuugaugagcagcagucuagcggauucgaauacgaggucuuucuuaaggacaugcaugugcagagagaauccugcaaauucggcccccggguuaaucacuuucgcaacacaaagauccuccuguucaucauugcgaucuguaccagcuuuuacacaguguaugccgacgaggauugccugucuaaaaauauuagaaucaccuaccaagaacugcacaacugcauugggccucauaucaugggagacacguguauguccaagagcgagcuuuauucugaucuccuguccaaaaaucugaucacagaguacgacaagaaguauuucgaacccgauaccgucaacgaccaguucaauaaaauugaguuugcucaggaugcccaccggaugauccuccuggaacgcauucuuuacaagaccgagugcgaaaugcugagccucaaaaagaacuccggcccguauaauguggccuggagaacauaccugaaaaaccauaauaucgaccuguguucucggcacaacuacaagaugauuugccaguguaucaacacccauagcaugugcaagaauacagauaucgacuucaacaaagagauugagacguauuacaaggcuaaugccgcggcuuauagauccgauuuuaacaccaucauugacacacuuaaaaccgccuuccgcggccucacaaagguucugaucgaaaauuacauugagaaagacgauucugacgcccugaaggcucucuuuagcaacaucaccgauuccgugcaagacaauuaucagauggucggggugcugaaauucgccagcaaacuucugaacauuucucucggacggacgaccagauccgcucagcacagcaucaugacaaaugaaaucccuaagucuaaccccuuuaccgauuacuccuauagcucugucaauauuaaagaguguaugagcccugagucccugaagugcuucaaaaagcgcgacagcgcuccccacacaaaccaucugcuuuguaaaauggauaauaaguacaaggcguuugacuggcccgaaaucgagaccgugcaaaaaggccagaagcucugccugggggauucucacuguaaccuggaauuuacggccauuacagcugacaaaaucaugucccucaccaauugcuacaaggagagcuucacagcccagccugcugauaugcagaccggaguuaaaaagugcuccgccgacgaaauuggcgaguguaucacccuggaggauaagucuuggccgaucguguucugcggggacaaauauuacuauagcgacggcaaggaacaugcgaaagauggauccauuaacaacuacugucuugccaauaagugcucugagcaacgguuucccauccacaaaaacugguucaagaaguguaauugggacaaaacacacaaggaguucacgaccaugagacagauuaacuauaaugauaucacaagcuaccgcaaagcuauugaauccgaaaucggcaccgaccugaugacacaucacuauaagccuaccaaaaaccucccccaugucgugccucgguaccacucuaucgauguucaggggacggagagcacagagggaauuaucaauggcuuuauucagaacaccauccccgccauuuccgggcugggagugggcuaccaucugggguucaagggcaaucaacuuuuugacaucgucauuuucgugaaaaaggcuguguauaaggcccaguaccagaaaguuuauaccacaggaccgagcaucucuaucaacauugaacacaaugagaagugcaccggccacuguccugaaaagauccccgccaaggagggguggcucacauuuuccaaagaacauacgagcucuuggggaugcgaggaguacggcugucuggcuauugauaccgggugccuguauggauccugucaggacgucaucagaccugaacucgauauuuacaagaagaucggcagcgaggcgucucugcuugaaaucugcauuacacugccccacgagaccuauugcaacgacauggauauccucgagccuauuaucggggacaaacuguccgccagcuuccaaaauacacagaccaaccagcugcccaaucuuauggcuuacaagaaaggcaagguguacacgggacagauuaacgaugugggcaacaccgcccugcaauguggguccauccaggucgugaauggaagcacaaucggcucugggaacccgaaauuugacuauauuugccaugccaugcgccggaaggacguuaucgugagaaaguguuucaaugauaacuaccagagcugcacccggcucgacccucgcaaugaucugauucccuauagaaaaggagacaucauugaaaucuccaagacaggcucuaacauggggcaaaugaccuuuaaaauugagcucggcgauaucaauuacaagaucuucacaaaaagcgucgaccugcagauguccggaauuugugcuggcugcaucgauugugccgaagggauuucuugcagcaucaacgcggacguguccgcugagaccguuugucacugcaagacgaauugugaagauuuuauuucuaacaucgugaucagcccccagauuaagacauauaauaucaaaguccauugcaaguccaaaguggagaagauuaccgccaacaucugcggacggaauauugaccuucagcugaccguuaaaccuuacaaccaaaagaucgaucucagccagcuggacgagucuaauuauaucaaggaagaggaccugcaguguggcacauggcuuugcaaagugcagaaggaagggauugauaucgucuucaaaggacuguucuccggccucggcaaguacugggccauucugaucuacagcauuaucgggauuaucguggugauccuccugauuuauguccuucugccgaucggaagacuccugaaagccuuucugauuaagaacgagaucgaauacaccauggagcagaaaauuaaguga

SEQ ID NO: 14343 - RNA, 4263 nt, Artificial Sequence
  derived and/or modified CDS sequence (opt5) from OROV(TVP-19258/IQT-4083)__KP795091.1__GP
auggccaaccugaucauuaucagcaugauucucggcaucgcuuacgggcacccccuguccaccucucagauuggagacagaugcuucgccggcgggagccuuuuuaaggagaugaaucuguccgugggacucggcgaaaucugugucaaagaugacaucucuauuguuaagagcacaacggcguucuccaaaaacgcucuggcccuugaggccaccacaaaguuuuaucggucuuucaucgugaaagauuggagcgaaugcaauccugugcuggacaaguuugggaacuucaugguccucaauguggauaacaauggacaucugguuccgaagauguacaccugucgcgcugccugcgacauuagacugaacaaagauaaugcugagaucauucucuccagcacaaagcugaaccacuuugaaaucgugggcaccacaucuaccuccggcugguucaaaaauacgauuaccaacaaucuugagcauacaugugagcacgucaccgugaacugcgggcaaaagagcguuaaauuucaugccuguuuccggcagcaccgcgcgugcaucagauuuuucaagggaacauauaugcccuacucuaugaucgaagccaugugugugaauauugagcugaucauucucacccuguauaucuuugcugccauuaucuucgcucuuaucauuacgaaguccuacaucgccuaucugcuccugccucuguucuaccccgcgacauggcucuacggcaaagucuauaagcggauuaacagcugcccuaacugucugcuugccucucaccccuuuaccuccugcccuaaaaucugcauuugugggagccgcuucuccugcacagaagcucugaaggugcauagaaugggaaaagacugucucggcuacaagucucugagcaaagcccggcagaugugcaaguccaagagcuggucuuuuaccgcugccauccuuaccgggcugauccucauggaguucguguccccgauugccggagagcgcauguauaaacuggaagaacuggcugaugacuacaucgaacucacagagcaggucaauauucugggcaaggaaaucaaaauucuuaagcaaagcaucauuguuaugcuggcgaucauccucauucugcuucugucugagaacaucauuuuuaauuaucucuucaacacgcuguacagaagcuguuccaugugcggccugauccacuaucggcccgggcucaaaguggaucugaccaagacaaauaaguguggaucuugcauuuguggcuuugacgagcagcagagcuccggguucgaauacgagguguuucuuaaagauaugcauguccagcgcgaaagcugcaaguucggaccuagagugaaccacuuucggaauaccaaaauccuucucuucacaaucgccauuuguaccucuuuuuacacgguuuaugcugacgaggacugccuguccaagaacauccgcauuacauaccaagaacugcacaauugcaucggcccccauauuaugggggauaccuguaugccuaaaagcgagcuuuauucugaccuccuguccaagaaccugaucaccgaguacgauaagaaauauuucgaacccgacacagugaaugaucaguucaacaagaucgaguuugcccaggacgcccacagaaugauucuccuggaacggauccuuuacaaaaccgagugcgaaaugcugagccucaagaaaaauuccggaccguauaacgucgcuuggagaacauaccugaagaaucauaacauugaucuguguucucgccacaacuacaagaugaucugccaguguauuaauacgcauagcaugugcaaaaacaccgacaucgauuucaauaaggagaucgagacauauuacaaagccaacgcggcugccuaucgguccgacuuuaauaccauuaucgauacacuuaagaccgccuucagaggccucacgaaagugcugauugaaaacuacaucgagaaggacgacucugaugcucugaaagcccucuuuagcaauauuaccgacuccguucaagauaacuaucagauggugggcguccugaaguucgcuagcaagcugcugaauaucucucucgggcgcacaacccgguccgcccagcacagcauuaugacaaacgaaaucccuaaaucuaaucccuuuaccgacuacuccuauagcucuaucaacauuaaggaguguaugagcccugagucccugaaaugcuucaagaaaagagauagcgcgccccacacgaaucaucugcuuuguaagaucgacaacaaguacaaagccuuugauuggcccgaaauugagacagugcaaaagggacagaaacucugccugggcgacucucacuguaaucuggaguucaccgcuaucacagccgauaagauuaugucccucaccaacugcuacaaagagagcuuuaccgcucagccugccgacaugcagacagggaucaagaagugcuccgcggaugaaaucggagaguguauuacgcuggaggacaaaucuuggccgaucauuuucugcggcgauaaguauuacuauagcgacgggaaagaacaugccaaggacggcuccaucaacaauuacugucuugcuaacaaaugcucugagcaacgcuuucccauucacaagaauugguucaagaaauguaacugggauaagacccacaaagaguucacaaccaugcggcagaucaauuauaacgacaucacaagcuacagaaaggccauugaauccgaaaucggaaccgaucugaugacgcaucacuauaaaccuacaaagaaucucccccaugucgugccucgcuaccacucuauugacguucagggcaccgagagcaccgaggggaucauuaacggauuuauccagaauacaauucccgcuaucuccggccugggggugggauaccaucugggcuucaaagggaaccaacuuuuugauaucgucauuuucgugaagaaggccguuuauaaagcccaguaccagaagguguauaccacaggcccgagcaucucuauuaauaucgaacacaacgagaaaugcacgggacacuguccugaaaagauucccgcuaaagagggcuggcucaccuuuuccaaggaacauacaagcucuugggggugcgaggaguacggaugucuggcgaucgacaccggcugccuguauggguccugucaggaugucauccggccugaacucgacauuuacaagaaaaucggaagcgaggccucucugauugaaaucugcauuacacuuccccacgagaccuauugcaaugauauggacauccuggagccuaucauuggcgauaagcucuccgcuagcuuccaaaacacgcagaccaaucagcugcccaaccugauggccuacaaaaaggggaaaguguacacaggccagaucaacgacgugggaaauaccgcccuucaauguggcuccauucagguugucaacgggagcacaaucggaucuggcaauccgaaguuugauuauauuugccaugcuaugagacgcaaggacgugaucgugcggaaauguuucaacgacaauuaccagagcugcaccagacuggauccucggaacgaccucauucccuaucgcaagggggauaucaucgaaauuuccaaaacaggaucuaauaugggccaaaugaccuuuaagaucgagcugggggacauuaacuacaaaaucuucacgaaaagcgucgaucuccagauguccggcauuugugccggaugcaucgacugugcggaaggcaucucuugcagcauuaaugcugauguguccgccgagacaguuugucacugcaagaccaacugugaagacuuuaucucuaauauugugaucagcccccagauuaaaaccuauaacaucaagguccauugcaaauccaagguggagaaaaucacagccaauauuugcgagagaaacaucgaucugcagcuuaccguuaagccuuacaaucaaaagauugaccugagccagcucgaugaaucuaacuauaucaaagaggaagaccugcagugugggacguggcugugcaaggugcagaaagagggaauugacaucgucuucaagggccuuuucuccgggcugggaaaauacugggcuauucucaucuacagcaucauuggcaucauugugguuauccugcucauuuaugugcugcuuccgaucggccggcugcucagagccuuucugaucaagaaugaaauugaguacacaauggagcaaaagaucaaguga

SEQ ID NO: 14344 - RNA, 4263 nt, Artificial Sequence
  derived and/or modified CDS sequence (opt5) from OROV(TVP-19259/IQT-7085)__KP795094.1__GP
auggccaaccugaucauuaucagcaugauucucggcaucgcuuacgggcacccccuguccauuucucagaucggagacagaugcuucgccggcgggagccuuuuuaaggagaugaaucuguccgugggacucggcgaaaucugugucaaagaugacauuucuaucguuaagagcaccacagcguucuccaaaaacgcucuggcccuugaggccacgaccaaguuuuaucggucuuucauugugaaagauuggagcgaaugcaauccugugcuggacaaguuugggaacuucaugguccucaauguggaugacaacggacaucugguuccgaagauguacacaugucgcgcugccugcgauaucagacugaauaaagacaacgcugagauuauccucuccagcaccaagcugaaucacuuugaaauugugggcacaaccucuacauccggcugguucaaaaacaccaucacgaauaaccuugagcauaccugugagcacgucacagugaauugcgggcaaaagagcguuaaauuucaugccuguuuccggcagcaccgcggaugcaucagauuuuucaagggcaccuauaugcccuacucuaugauugaagcgaugugugugaacaucgagcugauuauccucacacuguauauuuuugccgcuaucaucuucgcccuuauuaucaccaaguccuacauugcuuaucugcuccugccucuguucuaccccgucacguggcucuacgggaaaguguauaagcggaucaauagcugcccuaacugucugcuugccucucaccccuuuacauccugcccuaaaauuugcaucuguggaagccgcuucuccugcaccgaagcgcugaaggugcauagaaugggcaaagauugucucggguacaagucucugagcaaagcccggcagaugugcaaguccaagagcuggucuuuuacagcugccauccuuaccggacugauucucauggaguucgucuccccgaucgcuggcgagcgcauguauaaacuggaagaacuggccgacgauuacauugaacucgccgagcagguuaacauccugggcaaggaaauuaaaauccuuaagcaaagcauuguggugaugcuggcuaucauccucauucugcuucugucugagaauaucauuuuuaacuaucucuucaauacccuguacagaagcuguuccaugugcgggcugauccacuaucggcccggacucaaagucgaccugacaaagacgaacaaguguggcucuugcauuuguggguuugaugagcagcagagcuccggauucgaauacgagguguuucuuaaagacaugcauguucagcgcgaaagcugcaaguucggcccuagagugaaucacuuucggaacaccaaaauccuucucuucacaaucgcgauuuguaccucuuuuuacacagucuaugccgacgaggauugccuguccaagaauauccgcauuaccuaccaagaacugcacaacugcaucgggccccauauuaugggagacacguguaugagcaaaucugagcuuuauuccgaucuccugagcaagaaucugaucacagaguacgacaagaaauauuucgaaccugauaccgugaacgaccaguucaauaagaucgaguuugcucaggaugcccacagaaugauucuccuggaacggauccuuuacaaaaccgagugcgaaaugcugucccucaagaaaaacucuggccccuauaauguugccuggagaacauaccugaagaaccauaauauugaccuguguagccgccacaacuacaagaugaucugccaguguauuaacacccauuccaugugcaaaaauacagauaucgacuucaacaaggagaucgagacguauuacaaagcuaaugccgcggcuuaucggucugauuuuaacaccauuaucgacacacuuaagaccgccuucagaggccucacaaaagugcugauugaaaauuacaucgagaaggacgauagcgacgcccugaaagcucucuuuuccaacauuaccgauagcguccaagacaauuaucagaugguggggguccugaaguucgccucuaagcugcugaacaucucccucggacgcacgacccggagcgcucagcacucuauuaugacaaaugaaaucccgaaauccaacccuuuuaccgauuacagcuauucuagcgugaauaucaaggaguguaugucccccgagagccugaaaugcuucaagaaaagagacucugccccucacacaaaccaucugcuuuguaagauggauaauaaguacaaagcguuugacuggcccgaaauugagaccguucaaaagggccagaaacucugccugggggauucccacuguaaccuggaguucacggccaucacagcugacaagauuaugagccucaccaauugcuacaaagaguccuuuacagcccagcccgcugauaugcagaccggaaucaagaagugcucugccgacgaaauuggcgaguguaucacccuggaggauaaaagcuggccuaucguguucugcggggacaaguauuacuauuccgacggcaaagaacaugcgaaggauggaucuauuaacaacuacugucuugccaauaaaugcagcgagcaacgcuuuccgauccacaagaacugguucaagaaauguaauugggacaagacacacaaagaguucacgaccaugcggcagauuaacuauaaugauaucacauccuacagaaaggcuauugaaucugaaaucggcaccgaccugaugacacaucacuauaaacccaccaagaaccucccucaugucgugccccgcuaccacagcaucgauguucaggggacggaguccacagagggaauuaucaauggcuuuauucagaacaccaucccugccauuagcgggcugggagugggcuaccaucugggguucaaaggcaaucaacuuuuugacaucgucauuuucgugaagaaggcuguguauaaagcccaguaccagaagguuuauaccacaggacccucuaucuccaucaacauugaacacaaugagaaaugcaccggccacuguccggaaaagaucccugccaaagagggguggcucacauuuagcaaggaacauacgucuuccuggggaugcgaggaguacggcugucuggcuauugauaccgggugccuguauggaagcugucaggacgucauccggcccgaacucgauauuuacaagaaaaucggcucugaggcgucccugaucgaaauuugcaucacacuuccucacgagaccuauugcaacgacauggauauucuggagcccaucauuggggacaagcucagcgccuccuuccaaaauacacagaccaaccagcugccuaaucugauggcuuacaaaaagggcaaaguguacacgggacagaucaacgaugugggcaacaccgcccuucaaugugggagcauccaggucgugaauggaucuacaauuggcagcgggaaccccaaguuugacuauaucugccaugccaugagacgcaaggacguuauugugcggaaauguuucaaugauaacuaccaguccugcaccagacuggacccgcggaaugaucucaucccuuaucgcaagggagacauuaucgaaauuucuaaaacaggcagcaacauggggcaaaugaccuuuaagaucgagcugggcgauaucaauuacaaaauuuucacaaaguccgucgaccuccagaugucuggaaucugugcuggcugcauugauugugccgaagggaucagcugcuccauuaacgcggacgugucugcugagaccguuugucacugcaagacgaauugugaagauuuuaucagcaacaucgugauuagcccccagaucaaaacauauaauauuaagguccauugcaaauccaagguggagaaaaucaccgccaacauuugcggaagaaauaucgaccugcagcuuaccguuaagcccuacaaccaaaagaucgaucugucucagcucgacgaguccaauuauauuaaagaagaggaccugcaguguggcacauggcugugcaaggugcagaaagaagggaucgauauugucuucaagggacuuuucagcggccugggcaaauacugggccauccucauuuacucuaucauuggggugaucguggucauccugcucauuuauguucugcuuccuaucggacggcugcucaaggcuuuucugauuaaaaacgagaucgaauacaccauggagcaaaagauuaaguga

SEQ ID NO: 14345 - RNA, 4263 nt, Artificial Sequence
  derived and/or modified CDS sequence (opt5) from OROV(TVP-19262/OBS-9478)__KP795100.1__GP
auggccaaccugaucauuaucagcaugauucucggcaucgcuuacgggcacccccuguccaccucucagauuggagacagaugcuucgccggcgggagccuuuuuaaggagaugaaucuguccgugggacucggcgaaaucugugucaaagaugacaucucuauuguuaagagcacaacggcguucuccaaaaacgcucuggcccuugaggccaccacaaaguuuuaucggucuuucaucgugaaagauuggagcgaaugcaauccugugcuggacaaguuugggaacuucaugguccucaauguggauaacaauggacaucugauuccgaagauguacaccugucgcgcugccugcgacaucagacugaacaaagauaaugcugagauuauccucuccagcacaaagcugaaccacuuugaaauuaucggcaccacaucuaccuccggcugguucaaaaauacgaucaccaacaaucuugagcauacaugugagcacguuaccgugaacugcgggcaaaagagcgucaaauuucaugccuguuuccggcagcaccgcggaugcauuagauuuuucaagggcacauauaugcccuacucuaugaucgaagcgaugugugugaauauugagcugaucauucucacccuguauaucuuugccgcuaucauuuucgcccuuaucauuacgaaguccuacaucgcuuaucugcuccugccucuguucuaccccgccacauggcucuacgggaaaguuuauaagcggauuaacagcugcccuaacugucugcuugcgucucaccccuuuaccuccugcccuaaaaucugcaucuguggaagccgcuucuccugcacagaagcccugaaggugcauagaaugggcaaagacugucucggguacaagucucugagcaaagcucggcagaugugcaaguccaagagcuggucuuuuaccgccgcuauucuuaccggacugauccucauggaguucgucuccccgauugccggcgagcgcauguauaaacuggaagaacuggccgaugacuacaucgaacucacagaacaggugaauauucugggcaaggaaaucaaaauucuuaagcaaagcaucaucgugaugcuggcuauuauccucauucugcuucugucugagaacaucauuuuuaauuaucucuucaacacgcuguacagaagcuguuccaugugcgggcugauccacuaucggcccggacucaaagucgaucugaccaagacaaauaaguguggcucuugcaucuguggguuugacgagcagcagagcuccggauucgaauacgagguuuuucuuaaagauaugcaugugcagcgcgaaagcugcaaguucggcccuagagugaaccacuuucggaauaccaaaauucuccuguucacaaucgcgauuuguaccucuuuuuacacggucuaugccgacgaggacugccuguccaagaacauccgcauuacauaccaagaacugcacaauugcaucgggccccauaucaugggagauaccuguaugccuaaaagcgagcuuuauucugaccuccuguccaagaaccugauuaccgaguacgauaagaaauauuucgaacccggcacagugaaugaccaguucaacaagaucgaguuugcucaggaugcccacagaaugauucuccuggaacggauccuuuacaaaaccgagugcgaaaugcugagccucaagaaaaauuccggcccguauaacguugccuggagaacauaccugaagaaucauaacauugaccuguguucucgccacaacuacaagaugaucugccaguguaucaauacgcauagcaugugcaaaaacaccgauauugacuucaauaaggagaucgagacauauuacaaagcuaacgccgcggcuuaucgguccgauuuuaauaccauuaucgacacacuuaagaccgccuucagagggcucacgaaagugcugauugaaaacuacaucgagaaggaugacucugacgcccugaaagcucucuuuagcaauauuaccgauuccguccaagacaacuaucagauggugggaguucugaaguucgccagcaaacuucugaauaucucucucggccgcacaacccgguccgcucagcacagcaucaugacaaacgaaauuccuaaaucuaaucccuuuaccgauuacuccuauagcucuaucaacauuaaggaguguaugagcccugagucccugaaaugcuucaagaaaagagacagcgcgccccacacgaaucaucugcuuuguaagaucgauaacaaguacaaagccuuugacuggcccgaaauugagacagugcaaaaggggcagaaacucugccugggagauucucacuguaaucuggaguucaccgccaucacagcugacaagaucaugucccucaccaacugcuacaaagagagcuuuaccgcccagccugcugauaugcagacaggcauuaagaagugcuccgccgacgaaaucggggaguguauuacgcuggaggauaaaucuuggccgaucauuuucugcggcgacaaguauuacuauagcgauggaaaagaacaugcgaaggacggcuccaucaacaauuacugucuugccaacaaaugcucugagcaacgcuuucccauccacaagaauugguucaagaaauguaacugggacaagacccacaaagaguucacaauuaugcggcagaucaauuauaacgauauuaccagcuacagaaaggcuaucgaguccgaaauugggacagaccugaugacccaucacuauaaaccuacgaagaaucucccccaugucgugccucgcuaccacucuaucgauguccagggaacagagagcaccgagggcauuaucaacggguuuauccagaauaccauucccgccaucuccggacugggcgugggguaccaucugggcuucaaaggaaaccaacuuuuugacauuguuaucuucgugaagaaggcugucuauaaagcccaguaccagcggguguauacaaccggcccgagcauuucuaucaauaucgaacacaacgagaagugcacagggcacuguccugaaaagauucccgccaaggagggauggcucacguuuuccaaagaacauaccagcucuuggggcugcgaggaguacgggugucuggcuaucgauacaggaugccuguauggcuccugucaggacguuauuagaccugaacucgauaucuacaagaagauugggagcgaggcgucucugaucgaaaucugcauuacccuuccccacgagacauauugcaaugacauggauauccuggagccuauuaucggcgacaaacucuccgccagcuuccaaaacacccagacgaaucagcugcccaaccugauggcuuacaagaaaggaaagguguacaccggccagauuaacgaugucgggaauacagcccuucaauguggauccauccagguggugaacggcagcauuaucgggucuggaaauccgaaauuugacuauaucugccaugccaugcgccggaaggauguuauugucagaaaguguuucaacgacaauuaccagagcugcacccggcuggacccucgcaacgaucucauccccuauagaaaaggcgacauuaucgaaauuuccaagacagggucuaauaugggccaaaugaccuuuaaaaucgagcugggagauaucaacuacaagauuuucacaaaaagcguggaccuccagauguccggcaucugugcugggugcauugauugugccgaaggaaucucuugcagcauuaaugcggacguguccgcugagaccgucugucacugcaagacgaacugugaagauuuuaucucuaauaucgugauuagcccccagaucaagacauauaacauuaaaguucauugcaaguccaaaguggagaagaucaccgccaauauuugcgagcggaacaucgaccugcagcuuaccgucaaaccuuacaaucaaaagauugaucugagccagcucgacgaaucuaacuauaucaaggaggaagaucugcaguguggcacauggcugugcaaagugcagaaggaggggaucgacauuguuuucaaaggacuuuucuccggccugggcaaguacugggccauccucauuuacagcaucauugggaucaucguggucauucugcucaucuaugugcugcuuccgauuggaagacugcuccgcgcuuuucugaucaaaaaugaaauugaguacaccauggagcaaaagaucaaauga

SEQ ID NO: 14346 - RNA, 4299 nt, Artificial Sequence
  derived and/or modified CDS sequence (opt5) from OROV/FPV(Aus Ch 16129)__KF697137.1__GP
augaaguucgugagcauccugcucuuugucuccuggcugggcgccaccuaccagaaccccguuucucacagacaaauuggggagcggugcuucgcuggaggcagccuuaucaaaacagugaaucagacguccggggugucugaagucugugugcgcgacgauauuagcaugaucaaguccauuguucauaccacaaaagccucugacaccgcggugaacaauuauaucagauuuuaccgggucuucaucgugaaggaguggcacgauugcaacccuuuuccggaccccaaaggaacauucaugguucuggaugugagcuccaccaaucaucucgaaccuauuacauauaccugucgcacgcccugcgagaucacccuggacaaggauagcgcugaagucacacuuucuucccagaagaugaaccacuacgagauuagcggcucuaccaucaauaacgggugguuuaaaaauuccauuagcgugucucuggagcauacaugugaacacaucaccguguccugcggacagaagacggucagauuccacgccuguuuucggcaacaucgcagcugcacaagauucuuuaaaaacuccaugaugccugcccggaugaccgagucuauuugucagaaucucgaaaucauccugcugacaugcuucagcuuuguuuguuucauuuuccucugcaucauuaccaagaccuauguggcuuacgugcugauccccgucuuuuauccuuucacauacauuuacggccgccuuuaugacaaauacuuuaagcugugcgagaacugucuccuggccgugcacccguucacgcccugcgagaccguuugugugugcggcucccaguaugcuaauacagaacagcuuagaacccaucggaugacaaacaauuguaagggguacaaaagccugucuaagucccgcgccaugugcaaaagcaagggauguucuuuugucguggcgaucuucugcagcaucauuuucuucuccuuuaucaccccuauuaacucucaagaguauaaacucagcgaucugcccgacgaauuuacgagacuggaggaagagaacacaaugcucaagauccggcugcuuguuauuaaaaucaccaucuccgugauuagcgucaccaucacagugaccucucugacagagcgcaaggucuuucaggaacucuucaaugccauuuacagacacuguccuuuuugcggcaugauccaccggagacgcgggcugcgggugguuaacuccacgaccaauaaguguggaacaugcauuugcggcuauaaagaggaaaccgagcaugggguggaauacgagaucuuccuuaagacaaugcaccaggagaacgucaauuguauguucaaacccagccagagacauuuucgcaacuucaagauucugaucgcuuuucucgccaugugcaugaucauuaccucuguguccgcugaugaaaaacacugucugaaguacaaggagccgguuaaacugagcaaucucacggaaugccauucccuguggcuuaacaucaccgagugucaaauuaaucagucuacacuguucgaaacccucaagggagagcagcuggugacagacuuugauaaaccugacuucaccaucaugggccaaaaguaugacauugccauggagcggaucgaaaacgcgcagaaucuucaccacaugauccugcucgaguaccugcaugccaaaagcaacugccugaaguauaagcagcucaaauccaauucuggccccuacaacauuccuuggagaacguauauccacgggcauggacuggaugucuguggccaguacagcuauaaacuuauuugcaaguguaucuccacagggaugcacugcgaaaauaccgcucuggacauuuacaacgagaugcgccaauuuuacacaaacaaucaggagaacuauaaucucgaucugaacaccgugaucaaggccaucggacuggcuaugcggggcauugggcagaugaucauugaagaguucuuuggagaaagccagaucgaggaacuuucuaauuuccucaacaugaccuccaaaaaucugggcacaaacaagcaacugauuggccucaucaauuuugggcugaugcuucuggacaucaaccagacgaagacaccccagauugaucccaaaccuagaacccuccaggcccgcagcucuaucccgaccggaacagagauuaccgacuggacgaagggccaauccaaaaucaagacaugugccgaguacagcacccugaccugccagucuuggcggaaaacagugaauaccaagagcuuccugaugugcaaaguuuccagcaaguggcacgucuauaacuggcccgaaauuccuacaguggugagaaauucuaaacuuugucucggggauuaccauugcaacauggaguuuacgcccaucgacgcugaugaagcgcugaagcagcugcgcuguuauaagaccgaguucgucccuucccccgacggaauggaugaaagcauuaaaaagugcacacucgagaaauucggcggguguaccacagccaauggccacuccuggaccaucauggugugcaacggacgguacuaucagacgaacaccagagagcaugcuaaggacggccugcuuaauucuuacuguuuugaaccgaagugccaaagcgggcggcacccuauccauaaauccuuccugaacaauuguauuuggaaggagucuagccgccagaucauugaaacaagaaccaucgaguacaacaauauugaagacuauaaaaaguccguugagucugauaucaaaagcgaccucacaauccaccacuuuaagcccaccaagaaccugccucuggugacacccaccuacauuuccgucguggccgauggaacgaugguuagcgacggcauccagaaugccuaugugaaagggacaauuccuggaaucucuggcgucgcuaccgggcuucaugugaagacccccgauggcauucuccugauggacaucaucguuuacgugcggaaagcccuguauaaggcgaacuacgagaaaauuuauuccacaggaccgaccaucggcauuaaugucaagcacaacgaaaagugcacggggacauguccugagcauauccccaaagaugaaggauggcucaccuucagcaaggagcacacaucuaauuggggcugcgaggaauacgggugcuuugcuauuaacuccggaugucuguacggcagcugccaagacaucauuagacccgagcuugauaucuauaaacagcagggggaggaacagacccugcucgaacuguguaucacacugccucaugagaccuucugcaaugaccuugaugugcucgagccggugauuacggacaagcugcaacuggauuuucagaccacacagucugaccaccuccccgaacuggucgcccuuaaaaagggccugauccucaccggacagcugaacgaccugggcaauacagccgcuauguguggguccguucaacuugugaacaaaaccauuuacggacagggcaacccuaaguucgauuuuaucugccacgccaugcgccggaaggacgugauugucagacgcuguuaugauaaucauuacagcacgugcgcucugcucaaacagagaaacgaccugcuccacaaggaggugaaugaucagauguccaucacaguuaacgggaaaaaucugggacuuaucaacuuccggcugaaucucggcgaccugaacuauaagcuguuugugaaugaacccaacuucgagcuuaccgggcaaugugccggcugcauuagcugugcggaugaaaucucuugccagcugaauauuaucgccgaccaugaguucacaugcaaagucagcuccucuuguaaccucuacauuagcaauaugaugaucaccccugcuaaccacaucuauaaucugaagguguccugccgcgagcacguuucuaacauugaucucgccguguguggacggagcuuuucccugcaugcuacccuuaagcagcacucucaaaaacuggaccucagcgcccuggaugaaacaaauuucgucaaggaggaagaccugagaugcggcacguggcuuuguaaagugaaggaugaggggcuguccuuucucacccgcagcaucuucggaucucugggcacauacugguccuacuuuauuuaugggcucaucuucaugauucugcuuuuuaucgcgauuuacuuccuguauccccugugcaaaagacucaagggacugcuugaagagaacgagcgggaauaccugaucgagagcaagaugaaauga

SEQ ID NO: 14347 - RNA, 4257 nt, Artificial Sequence
  derived and/or modified CDS sequence (opt5) from OROV/IQTV(IQT9924)__KF697143.1__GP
auggacugcaucauuuucuaccugagcuuuuucgccguggucaccgcucaccccguuucccaucaccaggugggcgauagauguuuugccgggggaaaccucaucaaggaccugaauaaaacagugaacauuggcgaggucugcgugcgggaugacaucucuauuaucaagagcacgaccgcgauccaaaaaucccuugaucaucugucuacacgcaccaaguucuauagaguuuacauugugaaagaaugggcugaguguaauccuaucauugacuaugccgggaacuuuaucgucaugaauauugaugacaacggacaccucgugccgcggaugcauacaugccgcgccagcugugauaucagacugaauaagaacgacgcugaaauuauccuuuccucucagaagaccaaucacuacgagaucauuggcacaaccacgguuagcgggugguucaaaaacaccaucaaucugccccucgaacacacaugcgagcauauuaccgugaacuguggacagaagucccugcgguuucacgccugcuuccgcaugcauagaggcuguacacgguuuuucaaaaauaccuauaugccuagcacgaugaucgagcacaugugcgucaaccuggaacucauuaucuuuacacuguacaucuucaccgcucuuguguuugccuauauuaucacaaagucuuacauugcguacauccugcucccccuguucuauccucuuaccuacguguucggcauuaucuauuccaaacugaagcaguguaagaccugcaugcucgccgcucaccccuuuacaaauugcccuaaacgcugugucugcgggagcagauucaacuguacggaggcccugcggguucaucgccugggaagagauugccaaggcuacaagucucucuccaaagcucggcagauguguaagagcaaaucuugguccuuuaucauugccaucuucaccgggcugauucuuauggaauuuaucacaccgauucacggagagcgcaccuauaagcugagcgagcucgcggacgaguucaucgccaugaaaacagaagugaccgugaugcagagauccauuuacaaccagaagauccugaauaucgcccuucugacgcucgucgugcugauuauccugcucgaaacauauauuuuuaagauccuguucucucuucuguaccggagcugcuccauguguggccucauucauuacaaaguugggcugaagaucaaccuucugaccaccaauaaaugcggaacauguaucugcggcuuuagcgagcaacagucuuccggcuucgaauaugagguguuucucaaggauaugcacaaacagagagagagcuguaaguacuuccccaugcugaaccauuuucgcaaucugaagauucucaccacaauccugcuucugauucuccuggccacgucugucagcuccgaaugccugcagaaaccucuuaagaucaaacucgaggaccugcacgaaugcauuggggugaacuuccuggacaagcaauguuauaaucggaaaaaccucuacgagucucugagaagcaagaaucuuaucuccgaaguugauaagaaauauuucgagaacgcugaccuggagggacaguuuaagcgcaucgaauacgcccaggaugcccaccggaugauucuccuggagagaauccuguauagcaccgaaugcgagaugcauacaauucuuaccaauggcggggcuuacaacauccccuggcgcacauaccucaaaaaucacaaccugaaucuguguggaaagcaugugcacaaaauggucugccaaugugugaacacccacacgcagugccucucuaccggcauugacuaucaggaugaaaucacaaaguucuaccaggcggacggggauuccuaucggagcgaccugucuaucauucuugagaccaucuccacagccuuuagaggacugaccaagguccucauugagacguacaucgaacaagauaacagcgaguccaugauuaaacugcugaauacaauccagggcaaggugccuaacaauuaucagaugcuuggcauucucaaauucgcuaucaagaucaugaacauuaaucagacccgcgggguucggucugccagacauacaaucgugagcaacgacauucccauguccgaaccguuuucuaauuucgaggucagcaacaucaauauuaaacaaugucuggagccucugacccucaagugcuuuaccaaacgcggagauagcccccacuccaaccaucugcuuuguaaggaacagucuaaguacaaaguguucgaguggccugaaguugagacagugacgaagaauaacaaacugugccucggcgacacccacuguaaucugaaguuuacagccaccacauccgacgaaaucaucaaacugcuuaacugcuucagcgauaccuauaagcccaaucccggggagauggagauuggacucaagaaaugcaacgcugaaaagaucggcgagugugucacgcuggaaaacucuccuuggccgauuguguacugcgagaauaaauacuauuacuccgaagccaaggagcaugcgaaagacgggagcgugaacucuuauugucugacaaauaagugcaccgaggaucggcuccccaucaacccugcuugguuuaagagcuguaauugggaaaagaacauuaaggagaccgccacaaucaaagaguucguuuacaaugacaucaaguccuauagaaaaagccuggaaucugaaauuaacaccgaucuuaugauccaccacuaccggcccacaaagaaucugccucauauuaagcccaucuauaaaucccucagcauucagggcuccgagacggucgacggacugcagaacucuuuuaucgagggcgaaaugccggccauuagcgggcuggcuaauggauaccaccuuauguacaagggcacccaacuguucgauaucgugaucuucauucgcaaagccguguauaaggcuaacuacuauaaaaucuacacaaccgggccuuccauugccaucaauauggagcauaacgaacagugcacaggacacugucccucuaagauuccuagcaaagagaauuggcucaccuuuuccagagagcauacgucuagcuggggcugcgaagaguaugggugucuggcgaucgacaccggcugccucuacggauccugucaggaugucauccggcccgaaauugacguguauaaaaagagcggcacagagcagucucugaucgaacuuugcauuaccuccgcccacgagacauucugcaacgaucuggacauccucgagccuauuaucggggagaaaaucagcgcuucuuuucaauccacccagagcaaccagcugcccaauauuaucgccuucagaaagggacaaauucugacaggcgcuaucaacgaucuugggaauaccggaucucaguguggcuccauucagcugguuaacaauacgcuccugggggaaggcaacgugaaauuugacuacaucugccacgccaugcgccggaaggacgucauuaucagacgcuguuacaaugaucauuucacaagcugcaaccuccugcagaaaagauccgaccuuaucggaaauauuaacggcaaggaacugcaaaucagcaugucugggcggagcaugggauccaugaaguuuaaaauugagcucggcgauaucaauuauaagcuguacaccgaaaacgcggacauuaccauccgcggggaguguggaggcugcaucgggugugccgaggcugugucuugcagccuggaaguugaguccgccucugaaauucuuuguaaaguggagugcaauugucagccguauaucgaaaacauucugaucaagccucagacaaaaaccuacagcuucaaggcuacgugccucgagaaguccaauacacuggauauuaaaaucugcggcaagcagaucauugcuccccucaccaucaaaucuuauaaccaaaagauugaccugagcaaacuugaugaguccaauuacgucaaggaagaggaccuggccuguaacacauggcugugcaaggugcagaccgaaggauuuaacuucguuuuuagcggccucuucgcuggguucggaagauauuggacaaucgcgauuuacauccugauugccguggucaucauccuuauucugaucuacauucucaugcccaucuuucggcugauucgcaccuuccucaucaaaaaugagaucgaguauacgaccgaacagaagaugagauga

SEQ ID NO: 14348 - RNA, 4257 nt, Artificial Sequence
  derived and/or modified CDS sequence (opt5) from OROV/IQTV(MIS-0397)__KJ866387.1__GP
auggacugcaucauuuucuaccugagcuuuuucgccguggucaccgcucaccccguuucccaucaccaggugggcgauagauguuuugccgggggaaaccucaucaaggaccugaauaaaacagugaacauuggcgaggucugcgugcgggaugacaucucuauuaucaagagcacgaccgcgauccaaaaaucccuugaucaucugucuacacgcaccaaguucuauagaguuuacauugugaaagaaugggcugaguguaauccuaucauugacuaugccgggaacuuuaucgucaugaauauugaugacaacggacaccucgugccgcggaugcauacaugccgcgccagcugugauaucagacugaauaagaacgacgcugaaauuauccuuuccucucagaagaccaaucacuacgagaucauuggcacaaccacgguuagcgggugguucaaaaacaccaucaaucugccccucgaacacacaugcgagcauauuaccgugaacuguggacagaagucccugcgguuucacgccugcuuccgcaugcauagaggcuguacacgguuuuucaaaaauaccuauaugccuagcacgaugaucgagcacaugugcgcuaaccuggaacucauuaucuuuacacuguacaucuucaccgcccuugucuuugcguauauuaucacaaagucuuacauugccuacauccugcucccccuguucuauccucuuaccuacguguucggcauuaucuauuccaaacugaagcaguguaagaccugcaugcucgcugcccaccccuuuacaaauugcccuaaacgcugugugugcgggagcagauucaacuguacggaggcucugcggguccaucgccugggaagagauugccaaggcuacaagucucucuccaaagcccggcagauguguaagagcaaaucuugguccuuuaucauugcgaucuucaccgggcugauucuuauggaauuuaucacaccgauucacggagagcgcaccuauaagcugagcgagcucgccgacgaguucaucgcuaugaaaacagaaguuaccgugaugcagagauccauuuacaaccagaagauccugaauaucgcccuucugacgcucgugguccugauuauccugcucgaaacauauauuuuuaagauccuguucucucuucuguaccggagcugcuccauguguggccucauucauuacaaacuggggcuuaagaucaaccugcucaccaccaauaaaugcggaacauguaucugcggcuuuagcgagcaacagucuuccggcuucgaauaugagguguuucugaaggauaugcacaaacagagagagagcuguaaguacuuccccaugcugaaccauuuucgcaaucucaagauucugaccacaauccuucugcucauucugcuggcuacgucuguuagcuccgaaugccuucagaaaccucucaagaucaaacuggaggaccugcacgaaugcauuggggugaacuuccucgaccggcaauguuauaauagaaaggaucuguacgagucucuucgcagcaaaaaccugaucuccgaagucgacaagaaguauuucgagagcgccgaucucggaggccaguuuaaacggaucgaguacgcccaggacgcucacagaaugauucugcuggaacgcauccuuuauucuaccgagugcgaaaugcauacaauucucaccaaugggggagcguacaacauccccuggcggacauaccugaagaaucacaaccugaaucucuguggcaaacaugugcacaagaugguuugccaaugugugaacacccacacgcagugccuguccaccgggauugauuaucaggacgagaucacaaaauucuaccaggccgauggagacagcuauagaucugaucuuuccaucauucuggaaaccaucagcacagcuuuucgcggccucaccaagguccugauugagacguacaucgagcaagacaauuccgaaucuaugauuaagcugcuuaacacaauccagggcaaagugccuaacaauuaucagaugcucgggauucugaaguucgccaucaaaaucaugaacauuaaucagacccggggagucagaagcgcccgccauacaaucguguccaacgauauucccaugucugagccguuuagcaauuucgaagccuccaacaucaauauuaagcaauguagcgagccucugacccucaaaugcuuuaccaagcggggcgacucuccccacuccaaccaucugcuuuguaaagagcagagcaaguacaagguuuucgaauggccugagaucgaaacagugacgaaaaauaacaagcugugccucggggacacccacuguaaucugaaauuuacagccaccacaucugaugagaucauuaagcugcuuaacugcuucuccgacaccuauaaacccaaucccggagaaauggagaucggccucaagaagugcaacgcggagaaaauuggggaaugugucacgcuggagaauagcccuuggccgaucguguacugcgaaaacaaguacuauuacucugaggcuaaagaacaugccaaggauggcagcguuaacuccuauugucugacaaauaaaugcaccgaggacagacuccccauuaacccugccugguuuaagagcuguaauugggagaagaacaucaaagaaaccgcuacaaucaaggaguucguguacaaugauauuaaaucuuaucggaagucccuggaaagcgagaucaacaccgaccuuaugauucaccacuaccgccccacgaaaaaucugccucauaucaagcccauuuauaagucccucucuauccagggaagcgaaacagucgauggccugcagaacuccuuuauugagggggagaugccggccaucucuggacuggcuaauggcuaccaccuuaccuacaaagggacacaacuguucgacaucgugauuuucaucagaaaggccguguauaaagcgaacuacuauaagauuuacaccacaggaccuagcaucgccauuaauauggaacauaacgagcagugcaccggccacugucccuccaaaaucccuucuaaggaaaauuggcucacguuuagccgggagcauaccuccagcugggggugcgaggaauauggcugucuggcuaucgauacaggaugccucuacggcucuugucaggacguuauuagacccgagaucgaugucuauaaaaaguccgggaacgaacagagccugauugagcuuugcaucaccucugcccacgaaacauucugcaaugaccuggauauucucgagccuaucaucggagagaagauuuccgcuagcuuucaaucuacccaguccaaccagcugcccaacaucauugccuuccgcaaaggccaaauccugacaggggcgauuaaugaccuuggaaacaccggcagccaguguggguccauccagcuggugaauaacacgcuccugggcgaaggaaaugugaaguuugacuacauuugccacgccaugcggagaaaagaugucaucauccgcagauguuacaacgaccauuucacaagcugcaaucuccugcagaagcggucugaucuuauuggcaacaucaaugggaaagagcugcaaauuagcauguccggacgcucuaugggcagcaugaaguuuaagaucgaacucggggacauuaacuauaaacuguacaccgagaaugcugauaucaccaucagaggagaauguggcgggugcauuggcugugccgaggcuguguccugcucucuggagguugaaagcuccucugagauccuuuguaagguggaaugcaacugucagccguauauugagaauauccugauuaaaccucagacaaagaccuacagcuucaaagccacgugccucgaacgguccaacacacuggacaucaagaucugcggaaagcagauuaucgcuccccucaccauuaaaagcuauaaucaaaagaucgaucugucuaaacuugacgaguccaacuacgucaaggaggaagaucuggcuuguaauacauggcugugcaaagugcagaccgagggcuuuaacuucguuuuuagcggacucuucgcgggguucggccgcuauuggacaauugccaucuacauucugaucgcuguggucaucauucuuauccugauuuacauccucaugcccauuuuuagacugauccggaccuuccucaucaagaacgaaauugaguauacgaccgagcagaagaugcgcuga

SEQ ID NO: 14349 - RNA, 4257 nt, Artificial Sequence
  derived and/or modified CDS sequence (opt5) from OROV/MDDV(FMD 1303)__KF697145.1__GP
auggccuuccugcucaucuacgugguccuggcugccgcgguugcuagccacccccuuuccaaccaucagauuggcgacagaugcuuugccgggggaaaucugauccgggagcucaacaagaccgugaauauuggcgaacugugugugcgcgaugacaucucuaugauuaaaagcacaacggccauccaaaaguccgucgggcaccuuucuaccagaacaaaauucuaucggguguacaucguuaaggagugggcugaaugcaacccuauuaucgauuuugccggaaauuucauuaucaugaacauugacgagaauggccaucuggugccgaaaaugcacaccugucgcgcuagcugcgauaucagacucaacaaggacgaugccgaaauuauccuguccucucagaagacaaaucauuaugagaucauugggaccacaagcaucuccggaugguuuaaaaacaccauuaaucugccccucgagcacacgugugaacacaucaccgucaacugcggccagaaaagccugcgguuccaugcguguuuucgcaugcacagaggcugcacacgguucuuuaaaaauaccuacaugccuucuacaaugauugagaccaugugugugaaccuugaacugaucaucuucacgcucuauaucuuuuccgccgcuguuuucgccuacgugauuacaaagagcuauauugcuuacauccugcuucccgucuuuuacccuauuaccuauauccuggggucuaucuacucccgcuucaaacagugcaagacauguaugcucgccgcgcaucccuucaccagcugcccuaagaaaugcguguguggaucuagauuuaauugcaccgaggcccugcgggugcaccgccugggcaaggacugucaaggguauaaaucccucagcaaggcuagacagaugugcaaauccaagucuuggagcuucauuaucgccgucuuuacaggacugauucuuauggaguucaucacgccgauuuccggcgaacggauguacaaacugagcgagcucgcugaagaguuuaucgaaaugaaggaggaggccucugcccugaagaaagcuauuaacaaccuuaagcugcucaauguucugcuguccgcgaucgccacccucgugguggucauggaaacauauaucuucaaaagccuguuuaaccuucuguaccgcucuuguagcaugugcgggcucauucacuauaagaucggacugagagugaaucuucugaccacaaaccggugugggaccugcauuuguggcuucaaugagcagcaguccucuggcuuugaauacgagaucuuccucaaagauaugcauaagcaaagagaaagcugcaaguacuuucccaugcugaaccacuuccgcaauguuaaaauucugacgguguuucuccugcuuacaaugcugaccgcuuccgccagcucugagugucuccagaagccucugaaaaucaagcuggaggaccuucaugaaugcaucggagucaacuuccucaaucggcagugcuauaacucccaggagcuguaccaaagccugaaaucuaagaaucucguguccgaaguugauaagaaauauuucgacaacaagaaucuggaggaucuuuuuaaaagaauugaauacgcccaggacgcucaccgcaugauccugcucgagcggauucuguauagcaccgagugugaaaugcauacaauccugaccaacggcggggccuacaauauucccuggagaacauaucuuaagaaccacaaccucaaucugugcggaaaacacgugcauaagauggucugucagugcaucaacacgcacacccaaugucuguccacaggcaucgacuaccaggaugagauuaccaaguucuaccaggcggacggggauucuuaucgcgcugaccucagcgugauccugcagacaauugccaccgccuuucggggaaugacgaaaguccuuaucgaaaccuacauugagcaagauaauuccgagucuaugaucaagcugcucaacacaaucaaagaaaaggugccuaauaacuaucagaugcugggcauucugaauuucgcuaucaaaauuaugagcguuaaccagaccagaggcgugcgcuccgcccggcauacaaucauuagcaaugacauccccaugucugagaccuuuuccaacuucgaagucagcaauauugaugugaagcagugcacggacccgcuuacacucaaauguuuuaccaagagaggggaugcuccucacucuaaccaucugcugugcaaggagcaaaauaaauacaagguuuucgaauggcccgagaucgagacagugaugaaaaacaauaagcucugucugggagacacccacugcaaccuuaaauuugccgcgaucgccuccgaugaagucauuaagcugcucaacuguuucagcgacaccuauaagccuaaucccggcgagauggaagugggggcuaaaaagugcaacgccgacaaaaucggagagugcauuacacuggaaaauaaccccuggccuaucguguacugugagacgaaguauuacuacucugaugcuaaagagcacgccaaggacggcaauguuaacagcuauugccugaccaauaaguguaacgaagaucgcuuuccgauuaaucccacaugguucaaauccugcagcugggaccggaacgucaaggagaccacaaccaucaaagaauuugugcauaaugauaucucugcguacagaaagucccuugagagcgaaauuuccacggaccuccugauccaccauuaucggccuacaaagaaccugccccacauuaugccugccuacaagucucucaccauccaggggagcgagaccguggauggccugcaaaauuccuucauugagggagaaaugcccgcuaucucuggccuugccaacggguaucaccugaaguacaaaggaaucgagcuguucgacauugucaucuuuauucgcaaggcuguguauaaagccaauuacuacaagaucuauacaaccggcccgagcguugccauuaacauggaacauaacgagcaguguacaggguccugcccuaaaaagauccccgcuaaagagaauuggcugacguucucuaaggaacacaccagcuccuggggaugugaggaauacggcugccuggcgauugauacagggugucuuuauggcagcugccaggacgugaucagaccugaggucgauguguacaagaaagccucugcugaacagucccugaucgagcucuguauuaccagcgcccaugagacauuuugcaacgaccuggauauccucgaacccauuaucggagacaagauuucugccgcuuuccaguccacccagguuaaucaacugccuaacaucaucgccuuuaaaaagggccagauuuucacgggggcgaucaaugaccuuggaaacaccggcagccagugcgggucuauucaacugaucaauaacacacuccugggagagggcaaugugaaauuugauuauauuugucacgcuaugaagcggaaggacgucaucgugagacgcugcuacaacgaucauuucgccuccuguaaucugcuucagaaacggagcgaccugguugggacccucaacggcaaggaacuccagguguccaugagcggaagaucuaugggcagcaugaaauuuaaggucgagcucggggauaucuccuauaaacuguacacagaaaaugccgacauuucuaucagcggagagugcggcggguguauuaacugcgcugaggccaucuccugugcgcuugaaauugauucuagcaccgaggugcugugcaagcucgaauguuccugccagcccuacauccaaaauauucugaucaagccucaggugaaaaaguauucuuucaaagcuacauguuuugagaagcgcaacagccuggaagucaccguuugcaaaaagcagcacacgaucccgcuuacaauuaaguccuacaaucagaaaaucgaccugagcagacucgaugagucuaacuaugugcgggaggaagaccugaccugcaacaccuggcucuguaagguggagaaagaaggaauuggcgucauguucuccgggcuguucgccggcuuuggaaaguacuggagcaucgccauuuaugcucuuaucgcccuggugaucuuccugauucucaucuacauucugguucccaucuuucgccuuauuagaacauuccugaucaaaaaugagguggaguauaccacggaacaaaagaugcgguga

SEQ ID NO: 14350 - RNA, 4257 nt, Artificial Sequence
  derived and/or modified CDS sequence (opt5) from OROV/MDDV(INHRR 17a-10)__KJ866390.1__GP
auggccuuccugcucaucuacgugguccuggcugccaccguugcgagccacccccuuuccaaccaucagauuggcgacagaugcuuugcugggggaaaucugauccgggagcucaacaagacagugaauauuggcgaacugugugugcgcgaugacaucucuaugauuaaaagcacgaccgccauccaaaaguccgucgggcaccuuucuacaagaaccaaauucuaucggguguacaucguuaaggagugggccgaaugcaacccuauuaucgauuuugcuggaaauuucauuaucaugaacauugacgagaauggccaucuggugccgaaaaugcacacaugucgcgccagcugcgauaucagacucaacaaggacgaugcugaaauuauccuguccucucagaagaccaaucauuaugagaucauugggacaaccagcaucuccggaugguuuaaaaacacgauuaaucugccccucgagcacaccugugaacacaucacagucaacugcggccagaaaagccugcgguuccaugccuguuuucgcaugcacagaggcugcacccgguucuuuaaaaauacauacaugccuucuaccaugauugagacgaugugugugaaccuugaacugaucaucuucacacucuauaucuuuuccgcggccguuuucgcuuacgugauuaccaagagcuauauugccuacauccugcuucccgucuuuuacccuauuacauauauccuggggucuaucuacucccgcuucaaacagugcaagaccuguaugcucgcugcccaucccuucaccagcugcccuaagaaaugcguguguggaucuagauuuaauugcacagaggcgcugcgggugcaccgccugggcaaggacugucaaggguauaaaucccucagcaaggccagacagaugugcaaauccaagucuuggagcuucauuaucgcugucuuuacgggacugauucuuauggaguucaucaccccgauuuccggcgaacggauguacaaacugagcgagcucgccgaagaguuuaucgaaaugaaggaggaggcuucugcccugaagaaagccauuaacaaccuuaagcugcucaauguucugcuguccgcuaucgcgacacucgugguggucauggaaaccuguaucuucaaaagccuguuuaaccuucuguaucgcucuugcagcaugugugggcucauucacuacaagaucggacugagagugaaucuucugacaaccaaccggugcggcacguguauuugcggcuucuccgagcagcagucuagcggguuugaauaugagaucuuccucaaagauaugcauaagcaaagagaauccuguaaguacuuucccaugcugaaucacuuccgcaacguuaaaauucugacaguguuucuccugcuuaccaugcugaccgccagcgcuucuuccgagugccuccagaagccucugaaaaucaagcuggaggaccuucaugaaugcaucggagucaauuuccucaaccggcaguguuacaauagccaggagcuguaucaaucucugaaauccaagaaccucgugagcgaaguugauaagaaauacuucgacaauaagaaccuggaggaucuuuuuaaaagaauugaauaugcccaggacgcccaccgcaugauccugcucgagcggauucuguacuccacagagugcgaaaugcauaccauccugacaaauggcggggcuuauaacauucccuggagaacguaccuuaagaaucacaaccucaaccuguguggaaaacacgugcauaagauggucugccaguguaucaauacccacacacaaugccugucuaccggcaucgacuaucaggaugagauuacaaaguucuaccaggccgacggggauagcuaccgcgcggaccucuccaucauucuggaaaccaucgcuacggccuuucggggaaugaccaaagugcuuauugagacauauaucgagcaggauaacucugaaagcaugaucaagcugcucaauaccauuaaagagaaggucccuaacaauuaccaaaugcugggcauccugaacuucgccauuaaaaucauguccgugaaucagacaagaggcguucgcagcgcucggcauaccauuaucucuaacgacauucccauguccgaaacguuuacaaauuucgaggugagcaacaucgaugucaagcaguguaccgacccgcuuacacucaaaugcuuuaccaagagaggggaugccccucacucuaaucaucugcuguguaaggaacagaacaaauauaagguguucgaguggcccgagaucgaaaccguuaugaaaaauaacaagcucugccugggagacacacacuguaaucuuaaauuugcugccauugcguccgaugaggugaucaagcugcucaacugcuucagcgacacguacaagccuaaccccggcgaaauggaggucgggaccaaaaagugcaaugccgacaaaauuggagaauguaucacacuggagaacaaucccuggccuauuguguauugcgagaccaaguacuauuacucugaugcuaaagaacacgccaaggacggcaacgugaauagcuacugucugacaaacaagugcaaugaggaucgcuuuccgaucaaccccaccugguucaaauccuguagcugggaccggaauguuaaggaaacgacaaccaucaaagaguuuguccauaacgauauuucugcuuauagaaagucccuugaaagcgagaucuccaccgaccuccugauucaccauuaccggccuacaaagaaucugccccacaucaugccugccuauaagucucucaccauucaagggagcgagacaguggauggccugcagaacuccuucaucgaaggagacaugcccgcgaucucuggccuugccaauggguaccaccugaaguauaaaggaauugagcuguucgauaucgugauuuuuaucaagaaagcugucuacaaggccaacuauuacaaaauuuacacgaccggcccgagcguggcuaucaauauggaacauaacgagcagugcacaggguccuguccuaagaaaauucccgccaaggagaacuggcugaccuucucuaaggaacacacaagcuccuggggaugcgaggaauauggcugucuggccaucgacaccgggugccuuuacggcagcugucaggauguuauccgcccugagauugacguguauaaaaaggcuucugcggaacaaucccugaucgagcucugcauuacgagcgcccaugagaccuuuugcaaugaucuggacauccucgaacccauuaucggagacaaaaucucugcugccuuccaguccacacaggucaaccagcugccuaauauuaucgccuuuaagaaaggccaaauuuucaccggggcuaucaacgaucuuggaaauacaggcagccagugugggucuauucagcugaucaacaauacccuccugggagagggcaacgugaaguuugacuacaucugccacgccaugaagagaaaagauguuauugugcggagauguuauaaugaccauuucgcguccugcaaccugcuucaaaagcgcagcgaucuggucgggacacucaauggcaaagaacuccagguguccaugagcggacggucuaugggcagcaugaaguuuaaaguugagcucggggacaucuccuacaagcuguauaccgaaaacgcugauauuucuaucagcggagaguguggcgggugcauuaauugugccgaggccaucuccugcgcucuugaaauugacucuagcacggaggugcuguguaagcucgaaugcuccugucagcccuacauccagaacauccugauuaaaccgcaagucaagaaauacucuuucaaggccacaugcuuugagaaaagaaauagccuggaagugaccgugugcaagaagcagcacaccaucccucuuacaauuaaauccuauaaccagaagaucgaucugagccgccucgacgagucuaauuacgucagagaggaagaucugaccuguaacacguggcucugcaaaguugagaaggaaggaauuggcgugauguucuccgggcuguucgcgggcuuuggaaaauauuggagcaucgcuaucuacgcccuuauugcccuggugaucuuccugauucucaucuauauucugguccccaucuuucggcuuauccgcacauuccugauuaagaacgagguggaguacaccacagaacagaagaugagauga

SEQ ID NO: 14351 - RNA, 4257 nt, Artificial Sequence
  derived and/or modified CDS sequence (opt5) from OROV/Perdoes virus(BeAn789726)__KP691625.1__GP
auguucauccaguuuaaccuggccuucuuuugccucagcauuguguguggccacccccugaccaaggaccauaucggggauagaugcuucgcuggaggcaaucuuuuuaaagagauuacacaaacgaccgggcuguccgaaaucuguauuaaggacgauaucucuaucauuaaaagccaggucgagaucaagaaacaguccucugaaguuacauacgccgugaaguucuaucggguguaccucgucaaggaguggagcgaaugcaacccuauucaggaccaacacggauccaucaugauucuggaugugaccaauacaggccuuaucguuccgaaaauguauaccugucgcgcggcuugcgacauuacacuggauaaggacaacgccgagguggucuuuaucucucagaaaaauaacaauuacgagcucgccgggaccacggugaugcauggaugguucaagaacguugugagcaucaaacuggaacacaccugugagcaucugacagcuaccugcggccagaagacagucaaguuucacgccuguuucagacagcaccgggcuugcgcccgcuuucucaaaaccacguauaugcccauugugaugguggaaucccuguguagcaaucuugagcuggucaucuucauuacauacaucuuuguuugccucgcguucgccuucauuaucaccagaacauauguggcuuaccugcuuaucccuguguuuuaccccuucaccuaugccuacggcaagauguaucugaaaugcgucaagaccuguccuaacugccuccuggcuaugcaucccuuuacaaauuguacgaaccugugcauuugugggucucgguucuccaauaccgagagccucaaagugcaccgccugggaaacugcuacggcuauaaggcccuuucuggggcgagauccauguguaaaagcaagguuucuuccuuuacaaccgccauguucuuuggaaucauuauccugagcuucauugcuccucucaauggcgaacggcuguacaaacuuuccgagcugccggaugaauauaucgagauggaaucuacaaucgaggggagcaagcaaaaggagaccauuguggacaucauuaacuacacggcccucguccugauccugauuacaauccuccugcagggcauucuugaaaacuacaucuuucgccugaaauucagauuuugcuccuucugugauaugauccauaugaagaaaaaucucaagauuuuuagcaacaugaccaauaagugcggaaccuguaucugcggcuucaaccaggagauucggucuggguucgacuaugaaguguuuaucaaagauaugcacguuucccgcgagagcugcaaguacaauuaucacaaaaacuacucuuucuauauuaagaugcugcuugugguccugcucgugccccugaucggaacaaccgcugccgaagacacaaaaugucugaaguacgaccucaauaagaacaucgaggaucugaaagacugcuauggccuuaagcugaauauugauaaacaugacacggucgagaacgccuacaagaaucucguggaucagaaacugguuagcgaacuggacagacuugaucucaacaucaugcugggguccaaggagucuauuuuugaagcuaucgagaccagcaugaauauucaccaaaugguguuccuggaauaccucgcguauaagacagacccuaaacuguccgagaucaagcagaacaccggacccuacaauaucgccuggcggacauuuauucauggcaacagccuugaggucugugggaacuauccuuacaaacugaucugcuauuguauuaaucagaagacccacugcgaaaacucuacgguggauuacggaauccaaauucagcccuucuauaaucagcauccgaacuccuacaaaagcgacauggaggcucucaucaagaccguucagaucgccuuucgcggcauuaucaaagugcugauucaauacuaugucgaaaauaacaagacaucugagcuguccaaucuucucaccgagcugagaaacgugaugggcaauaacauccagaugaaggggauucugaaauaccucgaaacauaucugaagaaaccucuucugauggcccggaccaucagaauugcugccaagguggauacgagcggagaccccuacaauaacuucuccacaucuaaagagaauaucaccaaguguaucaagauucagaaacuccgcugcaucacaaagcugacccggauugaacacaacuauauccuguguggcgacagcgagaaaaagcuguaccaguggccugcgaaacccaccauuguugaugacaaugaugcuugccucggggacaagcacugucaucugcccuuuaucccuaucggaaacgaugaagccauuaagacagucaacugcuauguggagguguacgagcaaaauccgggcgacaugaacuccuaccagaaaaagugcgaugccaugaaugucgggacgugucugaccaucaaaaacgaaaauuggcccauugugcagugcaagacaggcaaauauuacuaugcugacggaagaauccacgccaaggauggcaccauuaacacauacuguuucucugagaagugcaaugcugaccgcuauccuauccaucaggauuacaucaacagcuguaauuggcaagaaaccauuaaagacuuucagcacguucgggaguucgugcaccucgauaucgaauccuauaagaaagccauugagagcgacaucaagacggaccuggucgugcauaaauuuagacccguuaagaaccuuccucacgugauucccaucuacaaaucuauuacaguccaggggaccgagaccuccgauggaauccagaaugcguucauccaaggcagcaugccggccauuucugggcuggcuaacggauaccaucucuucacaccugacuccaagcagcuguuugaugugguucuguuccuucgcaaggccagcuauaaagcugaauaccggaagaucuauucuaccggccccacaauugggaucaauguggagcacaacgaaaaaugcacgggcagcuguccuaagaccauugacaaaaaggauaauuggcucacauuuuccaaggagcauaccagccaguggggaugcgaagaguacggcugucuggccaucaacacagggugcgucuucggaucuugucaagacaucauuagacccgagaucgauguguauaaaaugcacggcgcggaacgcuccguggucgagcugugcauuacccucccucacgaaacguacugcaacgaccuggauguucuugagcccaucauuggggacaagauccaggccgcuuuucagaccgugcagagcaaucauaugccgcggcugauggccaucaaaaacaauaaggcuuucacaggacaaauuaacgaucucggcuccaccgccucuuauugugggagcgugcagaaauuuaaugagacaaucauuggccagggagacccuaaguucgauuacgucugccaccuucugaagagaaaagacaucauugugcgccgguguuacuccaacaauuaugaaucuugcaaacuucugacccccagagccgacaucauuguugauaagaagggcgagagccuccaggcuuccaucguggggcugaaccucggacaaaugaauuuuaaaaucaugcugggcgacauuaacuacaagcaguauacagaaucuaauaaccuugaggcgaccgggcagugugucggaugcguggauuguagcgaagacaucguuugcaaucugaagauugagucccagagcgagucuguguguaacaucaaauccgauugcaaucucuaccugagcucuaugcugauucaacccacggucggcgaauauaaccuuaagauguccuguaaugccaaacuggacaaggugaacaucgagaucugcaaacagaaguucguucucccucugacaauuaagagccauaaccagaaaaucgaucucucuaagcuggacgaauccaauuacauucgggaggaagaucuuaaaugcgacaccaugaucuguaaggugaaagaugaggggcugagcuuuauuaccaacucccucuucggcggaaucagcuauuucuggaagauccugauuucuagccugaucgucauuuuucuuaucauucuguucuacuacgugggccucccgauccugcgccucauuaaagacuaucugaaggagaaugaacuugaguaccuggcugaagggaaguga

SEQ ID NO: 14352 - RNA, 4257 nt, Artificial Sequence
  derived and/or modified CDS sequence (opt5) from OROV/Perdoes virus(BeAn790177)__KP691628.1__GP
auguucauccaguuuaaccuggccuucuuuugccucagcauuguguguggccacccccugaccaaggaccauaucggggauagaugcuucgcuggaggcaaucuuuuuaaagagauuacacaaacgaccgggcuguccgaaaucuguauuaaggacgauaucucuaucauuaaaagccaggucgagaucaagaaacaguccucugaaguuacauacgccgugaaguucuaucggguguaccucgucaaggaguggagcgaaugcaacccuauucaggaccaacacggauccaucaugauucuggaugugaccaauacaggccuuaucguuccgaaaauguauaccugucgcgcggcuugcgacauuacacuggauaaggacaacgccgagguggucuuuaucucucagaaaaauaacaauuacgagcucgccgggaccacggugaugcauggaugguucaagaacguugugagcaucaaacuggaacacaccugugagcaucugacagcuaccugcggccagaagacagucaaguuucacgccuguuucagacagcaccgggcuugcgcccgcuuucucaaaaccacguauaugcccauugugaugguggaaucccuguguagcaaucuugagcuggucaucuucauuacauacaucuuuguuugccucgcguucgccuucauuaucaccagaacauauguggcuuaccugcuuaucccuguguuuuaccccuucaccuaugccuacggcaagauguaucugaaaugcgucaagaccuguccuaacugccuccuggcuaugcaucccuuuacaaauuguacgaaccugugcauuugugggucucgguucuccaauaccgagagccucaaagugcaccgccugggaaacugcuacggcuauaaggcccuuucuggggcgagauccauguguaaaagcaagguuucuuccuuuacaaccgccauguucuuuggaaucauuauccugagcuucauugcuccucucaauggcgaacggcuguacaaacuuuccgagcugccggaugaauauaucgagauggaaucuacaaucgaggggagcaaacaaaaggagaccauuguggacaucauuaacuacacggcccucguccugauccugauuacaauccuccugcagggcauucuugaaaacuacaucuuucgccugaaauucagauuuugcuccuucugugauaugauccauaugaagaaaaaucucaagauuuuuagcaacaugaccaauaagugcggaaccuguaucugcggcuucaaccaggagauucggucuggguucgacuaugaaguguuuaucaaagauaugcacguuucccgcgagagcugcaaguacaauuaucacaaaaacuacucuuucuauauuaagaugcugcuugugguccugcucgugccccugaucggaacaaccgcugccgaagacacaaaaugucugaaguacgaccucaauaagaacaucgaggaucugaaagacugcuauggccuuaagcugaauauugauaaacaugacacggucgagaacgccuacaagaaucucguggaucagaaacugguuagcgaacuggacagacuugaucucaacaucaugcugggguccaaggagucuauuuuugaagcuaucgagaccagcaugaauauucaccaaaugguguuccuggaauaccucgcguauaagacagacccuaaacuguccgagaucaagcagaacaccggacccuacaauaucgccuggcggacauuuauucauggcaacagccuugaggucugugggaacuauccuuacaaacugaucugcuauuguauuaagcagaaaacccacugcgaaaauucuacgguggauuacggaauccaaauucagcccuucuauaaccagcauccuaauuccuacaagagcgacauggaggcucucaucaaaaccguucagaucgccuuucgcggcauuaucaaggugcugauucaauacuaugucgaaaacaauaagacaucugagcuguccaaccuucucaccgagcugagaaaugugaugggcaacaauauccagaugaaagggauucugaaguaccucgaaacauaucugaaaaagccgcuucugauggcccggaccaucagaauugcugccaaaguggauacgagcggagaccccuacaacaauuucuccacaucuaaggagaacaucaccaaguguaucaaaauucagaagcuccgcugcaucacaaaacugacccggauugaacacaauuauauccuguguggcgacagcgagaagaaacuuuaccaguggccugcgaagcccaccauuguugaugacaacgaugcuugccucggggacaagcacugucaucugcccuuuaucccuaucggaaaugaugaagccauuaaaacagucaacugcuauguggagguguacgagcaaaacccgggcgacaugaacuccuaccagaagaaaugcgaugccaugaaugucgggacgugucugaccaucaagaaugaaaacuggcccauugugcagugcaaaacaggcaaguauuacuaugcugacggaagaauccacgccaaggauggcaccauuaauacauacuguuucucugagaaaugcaacgcugaccgcuauccuauccaucaggauuacaucaauagcuguaacuggcaagaaaccauuaaggacuuucagcacguucgggaguucgugcaccucgauaucgaauccuauaaaaaggccauugagagcgacaucaaaacggaccuggucgugcauaaguuuagacccguuaaaaaucuuccucacgugauucccaucuacaagucuauuacaguccaggggaccgagaccuccgauggaauccagaacgcguucauccaaggcagcaugccggccauuucugggcuggcuaauggauaccaucucuucacaccugacuccaagcagcuguuugaugugguucuguuccuucgcaaagccagcuauaaggcugaauaccggaaaaucuauucuaccggccccacaauugggaucaacguggagcacaaugaaaagugcacgggcagcuguccuaaaaccauugacaagaaggauaacuggcucacauuuuccaaagagcauaccagccaguggggaugcgaagaguacggcugucuggccaucaauacagggugcgucuucggaucuugucaagacaucauuagacccgagaucgauguguauaagaugcacggcgcggaacgcuccguggucgagcugugcauuacccucccucacgaaacguacugcaacgaccuggauguucuugagcccaucauuggggacaaaauccaggccgcuuuucagaccgugcagagcaaccauaugccgcggcugauggccaucaagaauaacaaggcuuucacaggacaaauuaaugaucucggcuccaccgccucuuauugugggagcgugcagaaguuuaacgagacaaucauuggccagggagacccuaaguucgauuacgucugccaucugcugaaaagaaaggacaucauugugcgccgguguuacuccaauaacuaugaaucuugcaaacuucugacccccagagccgacaucauuguugauaagaaaggcgagagccuccaggcuuccaucguggggcugaaucucggacaaaugaacuuuaagaucaugcugggcgacauuaauuacaagcaguauacagaaucuaacaaucuugaggcgaccgggcagugugucggaugcguggauuguagcgaagacaucguuugcaaccugaaaauugagucccagagcgagucuguguguaauaucaaguccgauugcaaccucuaccugagcucuaugcugauucaacccacggucggcgaauauaaucuuaaaauguccuguaacgccaagcuggacaaagugaauaucgagaucugcaagcagaaguucguucucccucugacaauuaaaagccacaaccagaagaucgaucucucuaaacuggacgaauccaacuacauucgggaggaagaucuuaagugcgacaccaugaucuguaaagugaaggaugaggggcugagcuuuauuaccaauucccucuucggcggaaucagcuauuucuggaaaauccugauuucuagccugaucgucauuuuucuuaucauucuguucuacuacgugggccucccgauccugcgccucauuaaggacuaucugaaggagaacgaacuugaguaccuggcugaagggaaauga

SEQ ID NO: 14353 - RNA, 4284 nt, Artificial Sequence
  derived and/or modified CDS sequence (opt5) from OROV/UTIV(BeAn84785)__KF697155.1__GP
auguuccugaucuuuauucucauccagauugccgcuagcacaccccuguccccucaacaggugggcgacagaugcuucaucgggggaucucuuauuaaggagaucaaccagagcaccggccugggggaagucuguaucaaagaugacauuuccaucauuaagucuaucaauauucagaaaaagaucagcaacgaucaaguucagaauacggugaaauuuuacaagaccuauauugcccgggaguggcacgacugcaacccgaucuucgaugaacauggauccuuuaugguguucgacaucucuaauacaggcagcauuauccccaagaugcacaccugucgcgcgcagugcgagauuacacucaacaaagauaaugcugaagucaucuuuaccuccgccaagacaaaccauuacgaggugagcgggaccacgaccguuaauggaugguucaaacagacaauuucugugucccuggagcacaccugugaacauaucaucgccagcugcggccaaaagucucuuaaauuucacgcuuguuucagacagcaccgguccugcguccgcuuuuucagaaacagcuaucugccuuacaagaugauugagucucucuguaucaauauugaacugaucauuauccugugcuaugcccuccuguguuuuaucuucgcuuacauuaucacaaagaccuauauugccuaccuucugaucccccucuucuacccuauuacguauaucuacggcaaaauuuauaacaaguacuuuaaacggugcaaguccugccugcuugcggugcauccccugacaaauuguaacaaaaccugcguuugugggugccgcuucaauagcacagaggcccucaaggugcacagacugggaaaagacuguaacggcuuuaaggcucuguccaaggcccgguuccucugcaaaucuaccgggccuagcuuuaccaucuguuuccugacaggaaugcuuauccuguccuuuauuacgccgaucaacagcgagaagcucuauaaacuggaagaacuucccgaugacuacauuaaucuggaaaaccagcucucugagugcaauaacaauaagcagaucacccgcgcucuggccgucgcguguauucugggcaacauccucuucgugcuguuuuucaaauuuaucuauaauaaacuuauuaacaauaucuacagaacaugcaaccuguguaauauggugcaucaccggaagaaccucaaaauuuacuccgaauuuaccaauaagugcgggacaugcgucuguggauuuaacgaggagauccgcagcggcuucgauuaugaaguuuucauuaaagacaugcacaucuuuagagauaauugccuguucaaguuuuacucuaaauauagcaucauuuacaucuguauuaucauucuugugaucaaccugcaacucggcaugacccuggccgaggaaacggagacaaacugccugaaucucccuaucuccgcucagacccuggacauugugaaguguuaugggcuuaaccugaauaucaccgaaaacaagcagaaaucugaccucauuagcgagcugaagucccaaaagacaaucaccgaucaugacauucccgauuucaauaucauugacaugaagacagagagcgccuuugagaaaaucgagacggcugaaaacauccaccggauggccuuccuggaguacauucuuuauaagauggaaucuaagcucaauaccaucaaaacaaacuccggaccuuacaaugucgccuggcgcaccuacauuaaguaucauaaccuggaugcuugcggcaaauacccccacaagacaaucuguaccugcauuaaugcgcaucugagcuguucucagccgacgguggacuccaacagcgagaucaaaaccuuuuauuccaaucaccagucugccuucaagaacgauaucaauguucucauugagacaaucagcauugcuuuuagagggaucauuaaaguguccaucaaccugcuucugaagaacaauaagaucgacgaacucaaagagcugcugaccaacauuucuaagaaacuugauacaaauauccagaugaagggcauucuccuguucaccgccgaacaacugaaaacgcaggagacaaccgucaagagcaugcagcagacacggauggccaucauugugaagccucucgaguccaugaccggagacaaauuugauaacuucagcaccacaaauagaaacaucacgaagugcaaagaagcuaagucucuguccuguuacaugacccgcaaaaauagcauuaacaaguaucuucugugcaaucucgacggguacaagaucuuuucuuggcccgagaaaccuacacuguccaucaacaauaacauuugcaucggagacagccacuguaaucuguauuucaagcccauucuuaacgaugaagccaucaaaaccauuaauugcuacaagggcgacuucacacccaacccuauggauaugggcucugcgaucaaaaagugugaggcuaaggaaaucggggacugccucguuggagauaacaauauguggccgauuauccaauguagcaacgagaaauacuauuacgccgacggcaagaaucaugccaaagagggggauauuaacuccuauugccugagcgaaaaguguaauaccgaccgguuucccauccacaacgagugguucaaaucuugcaaguggauuuccacgaucaaagaaagcaucuccgugaaggaguuuguccaucuggauauugaaucuuacaagaaaggaaucgagagcgacauuagaacagaucucaucauucacaaguuccgcccugugaaaaaucugccccacaucgcuccuaaguauaaauccauuaccaucucuggcauccuugucgccgacgggauucagaacgcuuuugugagcggcgagaugcccgccaucuccggacugggcauuggguacaaucucuauucuccggauggaaccaagcuguucgacaucguucuguuucuucggaaggcgauuuacaaaagcuccuacaagcucaucuauaaaacaggcccuaccaucgggauuaacguggaacauaaugagcaguguacaggaagcugccccucuacgaucccuaagcaggaaggcuggcugaccuucuccaaagagcacacaagccaaugggggugugaagaguuuggcugccuggccauugacaccggaugccucuacggcucuugucaggauaucauuagacccgagauguccaucuauaagaugcugggggaagagaugacaagcaucgaaauuugccuuaccacgccuaaggagaccuacuguaacgaccuggaucuccuggagccccugaucggagacaaaauugaagucucuuuccagacagugcaguccagccauaugccgaagaucauugcuguuaaaaauaacaagguguauaccggccaaaucaaugauauugggaacacagccaauaucugcggauccguccagaucauuaacaaaaccgugaucggccaggggaacccuaaguuugacuaccuuugucacgcuaugaagcgcaaagaugugauuguucggaagugcuaugacaaucauuucgagacauguaaacugcucgaagagagaagcgaaauccugauuaaccaacagucugauaccaucgccgcgagcauguccggcaagaaucucggaaucaugaacuucaaauuugcccugggcgacauugauuacaagacguucacagaggacgcuucuuuugauaucaaggggcagugcgucggauguauuaauugcaucgaggaaauugugugugagcuuaacaucgugagcaccuccucuauccugugcaccauuaaaacacccugcgaaaauuaccacaacagccucgagaucaaucccgccaccacgaaguaucacauuaaaauguccuguccucauaacaucgacaagaugaaaauuacaaucugcucuaaggaccuggaaaugccgcugacccuuaaacagcacgaucaaaagauugaccugagcaagcucgaugaguccaauuacaucaaagaggaagaccugcgcuguagcacauggcucugcaaggucaaagaggaaggcaucggguucauuuucucuggaaucuucggcaacuuugggaaguauuggaccauuuuccugaucgugcuuguuauucuggcuacaggccuccugggaaucuuugugaucuaccccuguugcaaacggcugagaggcuuccuugagauuaaugauaucgccuaucuggccgaacagaagaugaaguga

SEQ ID NO: 14354 - RNA, 3231 nt, Artificial Sequence
  derived and/or modified CDS sequence (opt5) from HRTV(TN)__KJ740147.1__GP
augaucgugcccauuguccuguuccucacccugugcccuagcgagcuuuccgccuggggcucuccgggggaccccaucguuuguggagugagaacagaaacgaacaagagcauucagaucgaguggaaagaaggccgguccgagaagcugugccaaauugaucgccucgggcacgugaccucuuggcugagaaaucauagcuccuuucagggacuugucggccaggugaaagggcggccuucuguuagcuacuuccccgaaggagcuuccuauccucgcuggagcggccugcucucucccugugacgccgaguggcugggcaugaucgcgguguccaaggcuggggauacagacaugaucgucccuggaccgaccuacaaaggcaagauuuuuguggagagacccacauauaacggguacaagggauggggcugcgccgaugggaaaagccugucucacuccggaaccuauugugaaacagacagcucuguuuccagcggccucauccagggcgaucgggugcugugggucggggagguggugugccaacgcggaaccccuguccccgaagacguuuucuccgagcuugugucucugagccaguccgaguuuccugauguguguaagauugacggcgucgcccucaaucagugcgaacaggagagcaucccccaaccgcuggauguggcuuggauugacguugggagaucucauaaagugcuuaugcgggaacacaagacgaaauggguccaggaguccagcgccaaggauuucguguguuuuaagguuggacagggcccuugcucuaaacaggaagaggacgacuguaugagcaaggggaacugccauggagaugagguguucugccgcauggcuggcuguuccgccagaaugcaagacaaucaggaaggcugccggugugagcugcuccagaaacccggggaaaucauugucaacuacggaggcgugucuguccgcccuaccugcuauggguuuagcagaaugauggcgacacuggaggugcacaagcccgaucgggaacugaccggauguacaggcugccaccucgaguguaucgaagggggcguuaaaaucgugacccugacguccgagcuucgcagcgccacagucugcgcuucucauuucugugccuccgcuaagggaggcagcaaaaccacagacauucuguuucacaccggggcccucgugggacccaauucuaucagaauuaccggccaacugcuugauggguccaaguucagcuuugacggacauugcaucuucccugauggcuguauggcgcuggacugcacauucugcaaggaguuucuccggaacccgcaguguuaccccguuaaaaaguggcuguuccugguggucgugauuaugugcuguuacugcgcccucaugcugcuuacgaauauccugagagcuaucgggguguggggcaccuggguuuuugccccuauuaaacucgcucuggcccuuggacugcgccucgccaagcuguccaaaaagggccuggucgcuguggugacacgggggcagaugaucgucaacgaugaacuccaccagauuagaguggagcgcggagaacaaaaugagggccggcagggguauggacccagaggcccuauccgccacuggcuguacucucccgcgcuuauucugauccucaccacaagcaucuguuccgggugcgacgagcugguucaugccgaaucuaagagcauuaccuguaaauccgcuagcggcaacgagaaggaaugcucugugacgggacgggcccugcuuccggccgucaauccuggccaggaggcuugucuccacuucuccaugcccgggagcccugauucuaaaugccugaagaucaaagugaaguccauuaaccugagauguaagcaggccagcucuuauuacguucccgaggcgaaagcucgcugcacaagcgugcggagaugccgcugggccggagacugucaauccggcugcccuaccuauuuuagcucuaauuccuucagcgacgauugggccaaccggauggacagagcugggcucggaauguccggcuguucugaugggugcggcggagccgcuuguggcugcuuuaacgccgcgcccagcuguaucuucuggcggaagugggucgaaaauccguccaaccgcguguggaaaguuucuccuugcgccagcugggugcuggcugccaccauugagcuuacacugcccuccggggaagucaagacccucgagcccgugacaggacaggcuacgcagauguuuaaaggcguggccaucaccuaccuggggucuagcauugaaaucgucggaaugacaagacugugugagaugaaggagaugggcaccggcaucauggcgcuugccccuugcaaugacccggggcaugcuauuaugggaaacguuggcgaaauccaguguuccagcauugagucugccaagcacauccgguccgaugggugcauuuggaaugcugaccucgugggaaucgaacugagaguggaugacgccgucugcuucagcaaacugacaucuguggaggccguugcuaacuuuuccaagauccccgcgaccauuagcggcgugcgcuucgaucaagggaaucauggagaaucucggaucuauggcuccccucucgacauuacgagagucagcggcgaguuuuccgugagcuuccgcgggaugagacugaaacuuucugagaucagcgccuccuguaccggagaaauuacaaacguuucuggcugcuacagcuguaugaccggggcuuccgugucuaucaagcugcacagcuccaaaaauacaaccggacaccucaagugcgauucugacgagacggccuucagcgucauggaaggcacacauaccuaccggccccacauguccuuugauaaagccgugaucgacgaggaauguguucugaacugcgggggacauagcucuaagcugcuucucaagggcucccugguguucauggacgucccucgcuuuguggauggcagcuaugugcagacauaccacucuaaaguccccgcugggggaagaguuccuaaucccguggacuggcugaacgcccucuucggcgaugggauuacccgguggauccugggaauuaucggcgugcuucuggcgugugucaugcucuuugugguuguggucgcuauuacccgcagacugaucaaggggcugacacagcgggccaaaguggccuga

SEQ ID NO: 14355 - RNA, 3231 nt, Artificial Sequence
  derived and/or modified CDS sequence (opt5) from HRTV(Patient2)__JX005844.1__GP
augaucgugcccauuguccuguuccucacccugugcccuagcgagcuuuccgccuggggcucuccgggggaccccaucguuuguggagugagaacagaaacgaacaagagcauucagaucgaguggaaagaaggccgguccgagaagcugugccaaauugaucgccucgggcacgugaccucuuggcugagaaaucauagcuccuuucagggacuuaucggccaggucaaagggcggccuucugugagcuacuuccccgaaggagcuuccuauccucgcuggagcggccugcucucucccugugacgccgaguggcugggccugaucgcgguuuccaaggcuggggauacagacaugauugugccuggaccgaccuacaaaggcaagaucuuugucgagagacccacauauaacggguacaagggauggggcugcgccgaugggaaaagccucucucacuccggaaccuauugugaaacagacagcucuguguccagcggccugauucagggcgaucggguucuuugggugggggaggucgugugccaacgcggaaccccugugcccgaagacgucuucuccgagcugguuucucucagccaguccgaguuuccugauguguguaagaucgacggcguggcccugaaucagugcgaacaggagagcauuccccaaccgcuugaugucgcuuggaucgacguggggagaucucauaaaguucugaugcgggaacacaagacgaaaugggugcaggaguccagcgccaaggauuucgucuguuuuaaggugggacagggcccuugcucuaaacaggaagaggacgacuguaugagcaaggggaacugccauggagaugagguuuucugccgcauggcuggcuguuccgccagaaugcaagacaaucaggaaggcugccggugugagcuccugcagaaacccggggaaauuaucgugaacuacggaggcgucucugugcgcccuaccugcuauggguuuagcagaaugauggcgacacuggagguccacaagcccgaucgggaacucaccggauguacaggcugccaccuggaguguaucgaagggggcgugaaaauuguuacccuuacguccgagcugcgcagcgccacagugugcgcuucucauuucugugccuccgcuaagggaggcagcaaaaccacagacauccucuuucacaccggggcccuggucggacccaauucuauuagaaucaccggccaacuucuggauggguccaaguucagcuuugacggacauugcauuuucccugauggcuguauggcgcucgacugcacauucugcaaggaguuucugcggaacccgcaguguuaccccgugaaaaaguggcuguuccucguuguggucaucaugugcuguuacugcgcccugaugcuucugacgaauauccucagagcuauugggguguggggcaccuggguguuugccccuaucaaacuggcucuugcccugggacuccgccuggccaagcuguccaaaaagggccucguugcugucgugacacgggggcagaugauugugaacgaugaacugcaccaggucagaguggagcgcggagaacaaaaugagggccggcagggguauggacccagaggcccuauccgccacuggcuuuacucucccgcgcugauucucauccugaccacaagcaucuguuccgggugcgacgagcugguucaugccgaaucuaagagcauuaccuguaaauccgcuagcggcaacgagaaggaaugcucugugacgggacgggcccuucucccggccgucaauccuggccaggaggcuugucugcacuucuccgugcccgggagcccugauucuaaaugccugaagaucaaaguuaaguccauuaaccucagauguaagcaggccagcucuuauuacgugcccgaggcgaaagcucgcugcacaagcguccggagaugccgcugggccggagacugucaauccggcugcccuaccuauuuuagcucuaauuccuucagcgacgauugggccaaccggauggacagagcugggcugggaauguccggcuguucugaugggugcggcggagccgcuuguggcugcuuuaacgccgcgcccagcuguaucuucuggcggaaguggguggaaaauccguccaaccgcguuuggaaagugucuccuugcgccagcuggguccuugcugccaccauugagcugacacuccccuccggggaagugaagacccuggagcccgugacaggacaggcuacgcagauguuuaaaggcgucgccaucaccuaccuggggucuagcauugaaaucguuggaaugacaagacuuugugagaugaaggagaugggcaccggcaucauggcgcucgccccuugcaaugacccggggcaugcuauuaugggaaacgugggcgaaauccaguguuccagcauugagucugccaagcacauccgguccgaugggugcauuuggaaugcugaccuggugggaaucgaacugagagucgaugacgccgugugcuucagcaaacucacaucuguugaggccguggcuaacuuuuccaagauccccgcgaccauuagcggcguccgcuucgaucaagggaaucauggagaaucucggaucuauggcuccccucuggacauuacgagagugagcggcgaguuuuccguuagcuuccgcgggaugagacuuaaacugucugagaucagcgccuccuguaccggagaaauuacaaacgugucuggcugcuacagcuguaugaccggggcuuccgucucuaucaagcuccacagcuccaaaaauacaaccggacaccugaagugcgauucugacgagacggccuucagcgugauggaaggcacacauaccuaccggccccacauguccuuugauaaagccguuaucgacgaggaaugugugcugaacugcgggggacauagcucuaaacuucuccugaagggcucccuggucuucauggacgugccucgcuuuguggauggcagcuauguccagacauaccacucuaagguucccgcugggggaagagugccuaaucccguggacuggcucaacgcccuguucggcgaugggauuacccgguggauccuuggaauuaucggcguccugcucgcgugugugaugcuguuuguuguggucguggcuauuacccgcagacugaucaaggggcuuacacagcgggccaaaguugccuga

SEQ ID NO: 14356 - RNA, 3231 nt, Artificial Sequence
  derived and/or modified CDS sequence (opt5) from HRTV(Patient1)__JX005845.1__GP
augaucgcccccgugguccuguucuuuacccucugcccuagccagcuguccgcuuggggcucuccgggggaccccauuguuuguggagugagaacagagacgaacaagagcauccaaauugaauggaaagagggccgguccgaaaaacuuugccagaucgaucgccuggggcacgugaccucuuggcucagaaaucauagcuccuuccagggacugauuggccaggucaaggggcggccuucugugagcuacuuucccgagggagccuccuauccucgcuggagcggccuucugucucccugugacgcggaauggcucggccugaucgcuguuuccaaggccggggauacagacaugaucgugccuggaccgaccuacaaaggcaagauuuucgucgagagacccacauauaacggguacaagggauggggcugcgccgaugggaaaagccugucucacuccggaaccuauugugagacagacagcucuguguccagcggccucauccaaggcgaucggguucugugggugggggaagucgugugccagcgcggaaccccugugcccgaggacgucuuuuccgaacuuauuucucugagccaguccgaguucccugauguuuguaagguggacggcguggcucucaaucagugcgagcaagaaagcaucccccagccgcuggaugucgccuggauugacguggggagaucucauaaaguucuuaugcgggagcacaagacgaaaugggugcaggaauccagcgcuaaggauuuugucuguuucaaggugggacagggcccuugcucuaaacaagaggaagacgacuguaugagcaaggggaacugccauggagaugagguuuucugccgcauggccggcuguuccgcgagaaugcaggacaaucaggagggcugccggugugaacugcuccaaaaacccggggagaucauugugaacuacggaggcgucucugugcgcccuaccugcuauggguucagcagaaugauggccacacuggaaguccacaagcccgaucgggagcugaccggauguacaggcugccaccucgaauguaucgaagggggcgugaaaaucguuacccugacguccgagcuucgcagcgcuacagugugcgccucucauuuuugugcuuccgccaagggaggcagcaaaaccacagacauucuguuccacaccggggcgcucgucggacccaagucuaucagaauuaccggccagcugcuugauggguccaaguuuagcuucgacggacauugcaucuucccugauggcuguauggcccuggacugcacauuuugcaaagaauuucuccggaauccgcaguguuaccccgugaagaaauggcuguuucugguuguggucgugaugugcuguuacugcgcucucaugcugcuuacgaacauucugagagccaucgggguguggggcaccuggguuuucgcuccuaucaagcucguccuggcccuuggacugcgccucgccaaacuguccaagaagggccugguggcuguggucacacgggggcagaugauugugaaugaugagcuccaccaaaucagaguugaacgcggagagcagaacgaaggccggcuggggcacggacccagaggcccugugcgccauuggcuuuauucucccgcgcugauucucauccugaccacaagcauuuguuccgggugcgacgagcugguccacgccgagucuaaaagcaucaccuguaaguccgcuagcggcaaugaaaaagagugcucugugacgggacgggcccuucucccggccguuaacccuggccaggaggcuugucugcauuuuuccaugcccgggagcccugauucuaagugccugaaaaucaaggugaaguccauuaaucucagauguaaacaggccagcucuuacuauguccccgaggcgaaggcucgcugcacaagcgugcggagaugccgcugggccggagacugucaauccggcugcccuaccuacuucagcucuaacuccuuuagcgacgauugggccaaucggauggacagagcugggcugggaauguccggcuguucugaugggugcggcggagccgcuuguggcugcuucaacgccgcgcccagcuguaucuuuuggcggaaauggguugagaacccguccaaucgcguguggaaggucucuccuugcgccagcugggugcuugcugccauuaucgaacugacccuccccuccggggaggugaaaacacuggaacccgucaccggacaggcuacacagauguucaagggcguugccauuacguaucuggggucuagcaucgagauugugggaaugaccagacuuugugaaaugaaggagaugggcacaggcaucauggcgcucgccccuugcaacgacccggggcacgcuaucaugggaaaugugggcgagauucaguguuccagcaucgaaucugccaaacauauucgguccgaugggugcaucuggaacgcugaccuggucggaauugagcugagaguggaugacgccguuugcuuuagcaagcucaccucuguggaagccgucgcuaauuucuccaaaauccccgcgaucauuagcggcgugcgcuuugaucaagggaaccacggagagucucggaucuacggcuccccucuggacauuacaaagguuagcggcgaguucuccgugagcuucagagggaugcgccuuaaacugucugaaaucagcgccuccuguaccggagagauuacgaaugucucuggcugcuauagcuguaugaccggggcuuccgugucuaucaagcuccacagcuccaaaaacacaaccggacaucugaagugcgauucugacgaaacagccuuuagcguuauggagggcacccacacguacagaccccauauguccuucgauaaggccguggucgacgaagagugugugcugaauugcgggggacacagcucuaaacuucuccugaagggcucccugguguuuauggacgucccucgguucguugauggcagcuacgugcagacauaucacucuaaagugcccgcugggggacgcgucccuaaccccguggacuggcucaaugcccuguuuggcgaugggaucaccagauggauucuuggaaucauuggcguucugcucgcgugugugcugcuguucgucgugguuguggcuaucacacggcgccuuauuaaggggcucacccagagagccaaagucgccuga

SEQ ID NO: 14357 - RNA, 3942 nt, Artificial Sequence
  derived and/or modified CDS sequence (opt5) from PTV(PAN472868)__NC_027201.1__GP
augaucuucaccauucugaacgugcucacaagagccaugcuggucaugagcauguacucccuuacgaccugggacucuacaagccggaaugauaugugcuuuuccaacgacucuccccuggagggccucguuuauuacugggaaacccacagcaagaaacaugauuauaagaaacaggagucccaacgcuguagagugggggacucugauaagaaaaugaucacaaaugugaccauuaucagccugauuuccgaaauccaaaagagcaucucugagcuuucccugagcugcggaaacgacgauaauucuacaggccagguccucaccuucaacgggcuggaagacacgauucagggagauuacaucguggacuguguuaccggccuguaucaguccgauauuggggugggagucggccucggcaagacacaccaugaccaccaacaggugaaaaauaaggcuguugugaucgaugagaaagagcggaugauuagcuuucuggaaacccagcagucugagaacgacaucaagaugcagguccuuauguccgaaauugagcagcugaaaaaucagcucagcaagaagcgcaacgagagagggcaagaaaaacgggacgccgagaaggugauguccgaucugauggcgcgcaauucugaccuuagaaaacauaacgauauccugacagcugaaaucagccagauggagaauaacaauaccauucagcggaacaagaacgugauguccacgacagucguuccugccauccucagcguggcccugcugucuuccagcauugcuccgaucauggccgcuucucccgacagcccuaugauuaaucccuggccucacgccaaaaaccgcgugggaaccggcauguacaaguaugaugaaaaugacgauuccgggugcagacccauccgguacggagucucuuguaucggcuucgacuuuaugcucaaaauggauaaguacccuuucuuuaacgcguucauugggcacaagacaccgcuggagagcuuugccgacaaaaucauugagaaggaagaggaaaccugcgagaucggaaccaauaaagaauuuaaguguuucgaggagcgcgcuuauauuaaaggcacaugccccacgaacaucaaugccgugcauuacaucgauaacaagggcaaacuuagauauguuaaguguaaggaaaaucuggagaugaccgaagacugcgcuuucugucggaaaauuaagaaaaaggccgggcaauccauccaggugcagaagacaagcgucccucuccaggacgcgauuugccaagagaacucugauaccuacuccggacccaaaaucccuuuuaagggcgugugcaaaauugggcugaucaaguauaaagaauguaaguucaagacaagcucuuacgagaccguuuccuucauuacgcuuaaagagaagggaaaaaucuauaucgaacaccugaugcucaagaauauugagguggucacaaacgugagcuuugucugcuacgaacaugccggccaggacgagcaggagguggaacaccgcgcucugaaaagaguuuccgugaaugauuguaagaucgucgacaacucuaaacagaagauuugcaccggggaucacaucuucugugagaaguacgacugcagcaccuccuaucccgaugugacauguauucaugccccgggaucuggcccucuguacaucaaucucaugggcagcuggaucaaaccccaaugcguuggguaugaacgggugcuggucgacagagaggugaagcagccucuucuggcucccgaacagaacugugauaccugcguguccgagugucucgacgagggaguucacauuaaaagcacaggcuuugaaaucacgucugccgucgccugcucccaugggagcugcauuucugcucaccaggaggcguccaccagcgugaucgugcccuacccuggacugcuugccucugucggcgggcgcauuggcauccaucugagccacacauccgauagcgcuucugugcacaugguuguggucuguccgccccgggacuccugcgccgcccauaacugucuccugugcuaucacggaauccugaauuaccaaugucauagcacccucuccgcuauucugacaucuuuccuucugauccucuuuauuuauaccguguucagcguuacgaccaacaugcuguacgugcugagacuuaucccuaagcagcucaaaucccccgucggcuggcugcgccuguuuauuaauuggcuccugacagcccuucggaucaagaccagaaacgugauggggcgcaucaaucagcggauuggauggguugaucaccacgacguggaaagaccucgccaucgggagcccaugagacgcuucaagacaacccugcuccugacgcugaucaugaugacaggcgggaacgcgugcucuaauaccgucguggcuaacagcaaacagacacggugugugcaagaaggauccucuaccaagugcagcauuaccgccacaaucacgcuuagagccggcgucauuggggcugaguccuguuuuaucauuaaaggcccgauggagaaucagcagaagaccaucagcaucaaaacaauuucuuccgaaaccguuugccgggagggaagcucuuucuggacaucccucuacaucccuagcugucugucuucccgcagaugccaccuggugggcgacugcguggggaacaagugucaaagcuggcgggaugaccagcucuccagagaauuuagcggagucaaggauaaucauauuaugaacgagaauaaaugcuucgaacaguguggcgccaucgggugcggauguuuuaacauuaaucccucuugccuguaugugcacgcuuaccuuaagagcgcccgcaacgaggcgguucggguguucuccuguucugacuggguccauagagugagcuucgagguuaaaggcccugauggggaaaccgagcuggugacgcucggcucccugggaacaaaguuucugaacuggggcacccuuucucucagccuggacgccgaagggaucuccggaaccaauucuaucagcuuccuggaguccagcaaaggcggguuugcucucuaugaugagggauacucugaaauuccccgcgagggcuuccugggggaaaucagaugcuccagcgagucugccgcuauuuccgcccacaagagcuguauccgggcgccuggccuuauuaaguauaaacccaugacagaccagaucgaaugcaccgccucccuggucgauccguuugcuaucuuccucaagggaucucugccucaaacacgcaacggccagacguuuaccagcacaaaagacaagaaaaccgugcaggccuucacaaauggggcuauuaaggcccugcuuuccaucaaccucgaugaccacgagauuguuuuuaucaauaaagugagaagcugugaugccaccuuccugaacgucucuggaugcuacuccugcgacuauggcgcucaugugugugugaaggucaagagcucugagagcgcggacuuuuucgccgaauccgaggauaaaacgaccguucugucuuuucccauucagagcgggacacacgacuacugccaagugcuccauuuccagaagccccugguggaugaacggcuuuccuacucuuguggaagcgagccuaaacugaucgucauuaagggcacccucguguauaugggcguuuacgacuuccgcaauaaaacagggggauccagcaccguggucaacccgucugaaggcgcuugguccaucagcaauugguuuuccgggcugcuggauuggcuuggaggccccaugaaggccauccugaagauucucggguucaucgccauuggaaucgugugcuuuauucuguucaugauccucaucagaauugcuguuaacucuaucaauauuaaaaagaaaaacuga

SEQ ID NO: 14358 - RNA, 3942 nt, Artificial Sequence
  derived and/or modified CDS sequence (opt5) from PTV(Adames)__KR912209.1__GP
augaucuucaccauucugaacgugcucacaagagccaugcuggucaugagcauguacucccuuacgaccugggacucuagcucccggaaugauaucugcuuuucuaacgacagcccccuggagggccucguuuauuacugggaaacacacuccaagaaacaugauuauaagaaacaggggucucaaaagugucgcgugggagacagcgauaaaaagaugauuuccaaugugaccaucauuagccugaucucugagauccagaaguccauuagcgaacuuucucuguccugcggcaacaaugacaacagcacagggcagguccucaccuucaauggacuggaggauacaaucagaggcgacuacauuguggauuguguuaccgggcuguaucagucugacaucggagugggcgucggccucgggcggauuaaccacgaucaucaacaggugaaaaauaaggcuguugugaucgacgaaaaagagaagaugauuucccugcuugagacgcagcagagcgaaaacgauaucaaaacccaaguccugauguccgagaucgaacagcucaagaaucagcugucuaagcgcagaaacgagcggggacaggagaaacgcgacgccgaaaaacuuaugagcgaccugauggcgagaaauuccgaucuccggaaccacaaugugauucugacagacgagaucagccaaauuaagaacaacaucaccauucaucgcaauagaaacaugaugucuacaaccguggucccugcuauccuguccguugcccuccugagcucuagcgugggcccgaucacggccgcucccccugauuccacaaugauuaaucccuggccucacgccaagaaccggguggggaccggaauguacaaauaugacgaaaaugaugagucuggcugccgccccaucagauacggggucagcuguauuggauuugacuucaugcuuaagauggauaaauacccuuucuucaacgcuuuuaucggccacaagacaccgcuggaauccuucgccgacaagauuaucgagaaagaggaagagaccugcgaaaucggcaccaauaaggaguuuaaauguuucgaggaacgggcguauauuaaggggacaugccccacgaacaucaaugccgugcauuacauugauaacaaaggaaagcuccgcuauguuaaguguaaagagaaucuggaaaugaccgaggacugcgcuuuuuguagaaagaucaaaaagaaagccggccagagcgugcagguccaaaagacaucugugccucuucaggaugcuauuugccaggaaaacuccgacaucuacagcgggcccaagauuccuuucaaaggaguuugcaagaucggccugaucaaauauaaggaguguaaauuuaagaccucuuccuacgaaacaauuagcuucaucacccucaaggggaaaggaaagauuuauaucgagcaccugaugcugaaaaauauugagguggucacgaacguguccuucgucugcuacgaacaugccggccaggacgagcaagaaguggagcaccgggcgcucaagagaguuucugugaaugauuguaaaaucgucgacaacagcaagcagaaaaucugcacaggcgaucacaucuuuugugagaaguacgacugcuccaccucuuaucccgaugugaccuguauucauacaccggggagcggaccucuguacauuaaccuuaugggcuccuggaucaagccccagugcguuggguaugaacgcgugcuggucgaccgggaggugaaacagccucuccuggugcccgaacaaaauugugauaccugcguuagcgagugucuugacgaaggaguccacauuaagucuacaggcuucgagaucacguccgccguggcuugcagccaugggucuugcaucuccgcccaccaggaggcuagcaccucugugauuauccccuacccuggccugcucgccagcgucggaggcagaauugggauccaucugucccacacaagcgauucugccuccgugcacaugguuguggucuguccgccccgcgacagcugcgcugcgcauaacugucugcucugcuaucacggcauucugaauuaccagugucauuccacccuuucugccauccugaccagcuuucuccugauccuguucauuuauacagcuuuuuccgugacgaccaacguucuuuacgugcuccggcugaucccuaaacagcugaagucucccgucggauggcucaaacuguucgugaauuggcuucugacagcccucagaauuaagacccgccggguuauggggagaaucaaccaacgcauuggauggguggaucaccacgacgucgaacggccuagacaucgcgagcccaugcggagauuuaagacaacccugcugcuuacgcucaucauggugacaggcgggaaugccugcagcaacaccguggucgcuaauuccaaacagacacgguguguucaggaaggcucuaacaccaagugcagcauuaccgccacaaucacgcugcgcgcgggagugaucggcgcugaguccuguuucauuaucaaagggccgauggaaaaucagcaaaagaccauuagcaucaaaacaauuucuuccgagaccgugugcagagagggaagcucuuuuuggacaucccuguacaucccuagcugucucucuucccggagaugccaccuggucggcgauugcguggggaacaagugucagagcuggcgcgacgaccagcuuucccgggaauuuagcggaguuaaggauaaucauaucaugaacgagaauaaaugcuuugaacaauguggcgccauugggugcggcuguuucaacaucaaccccucuugccuguaugugcacgccuaccucaagagcgcuagaaaugaggccguccgcguguuuuccuguucugacuggguucauagagugagcuucgaagucaaaggaccugauggcgagauggagcuggugacccuggggucccuuggaacgaaguuccucaacuggggcacacugucucugagccucgacgcugaagggauuuccggaaccaauucuaucagcuuucuggaguccagcaaaggcggguucgcccuuuaugaugaaggcuacucugagauuccccgggagggauuucugggcgaaauccgcugcuccagcgagucugcggccaucuccgcucacaagagcuguauuagagccccugggcucaucaaguauaaacccaugaccgaccagauugaaugcacagcuucccugguugauccguucgccaucuuucugaagggaucucuuccucagacccggaacggccagacauucacgagcaccaaagacaagaaaacagugcaagcguuuaccaauggggccauuaaggcucuccuguccaucaaccuggaugaccacgagauuaucuucaucaauaaagucaagagcugugaugccacauuucucaacgugucuggaugcuacuccugcgacuauggcgcucaugugugugucaagguuaaaagcucugaaagcgccgauuucuuugccgaguccgaggacaagaccacggugcugucuuuccccauucagagcggcacccgcgacuacugccaggugcuucacuuucagaaaccccuggucgaugaaagacucuccuacucuugugggagcgagccuaagcugaucgugauuaaaggaacacugguuuauaugggcguguacgacuuccgggauaagaccgggggauccagcacagucaucaauccgucugaaggcaccugguccauuagcaacugguucuccgggcuucuggacuggcucggaggccccaugaaggcuauccugaaaauccucggcuuuauugcgaucgggauugugugcuucauccuguuuaugauucuuauccgcaucgccguuaauucuauuaacaucaagaaaaagaauuga

SEQ ID NO: 14359 - RNA, 3942 nt, Artificial Sequence
  derived and/or modified CDS sequence (opt5) from PTV(Balliet)__KR912213.1__GP
augaucuucaccauucugaacgugcucacaagagccaugcuggucaugagcauguacucccuuacgaccugggacucuacaagccggaaugauaugugcuuuuccaacgacucuccccuggagggccucguuuauuacugggaaacccacagcaagaaacaugauuauaagaaacaggagucccaacgcuguagagugggggacucugauaagaaaaugaucacaaaugugaccauuaucagccugauuuccgaaauccaaaagagcaucucugagcuuucccugagcugcggaaacgacgauaauucuacaggccagguccucaccuucaacgggcuggaagacacgauucggggagauuacaucguggacuguguuaccggccuguaucaguccgauauuggggugggagucggccucggccgcacacaccaugggcaccagcagaugaagaauaaagcugugguuaucgacgagaaggagagaaugauuagccugcuugaaacccagcagucugagaacgauaucaaaaugcaagugcugauguccgaaauugagcagcucaagaaucagcugagcaaaaagcggaacgagcgcggacaggaaaagagagacgccgagaaagucauguccgaccuuauggcgcgcaauucugaucugcggaagcauaacgacauccucacagcugaaaucagccaaaugaaaaauaagaacaccauucagagaaauaaaaacacgguguccacaaccguggucccugccauccugagcguugcccugcucucuuccagcguggcuccgauuaucgccgcucccccugauucucccaugauuaacccuuggccccacgccaagaaucgggugggcacagggauguacaaauaugacgagaacgaugacagcggaugccgcccuaucagauacggcgucuccuguaucggguuugauuucaugcugaagauggacaaguacccguuuuucaaugcguuuauuggacacaaaacaccccuugaaucuuucgccgauaagaucauugagaaagaggaagagaccugcgaaaucggcaccaacaaggaguuuaaauguuucgaggaacgggcuuauauuaagggcacgugcccuaccaauaucaacgccgugcauuacaucgacaauaaggggaaacugcgcuauguuaaguguaaagagaaccucgaaaugacagaggauugcgcuuuuuguagaaagauuaaaaagaaggccggacagagcgugcaaguccagaaaaccuccgugccccugcaggacgcgaucugccaggaaaauagcgacacauacucuggcccuaagauucccuucaaagggguuugcaagaucggacuuauuaaauauaaggaguguaaguuuaaaaccuccagcuacgaaacggugucuuucaucacacugaaggagaaaggcaagauuuauaucgagcaccucaugcugaaaaacaucgaagucgugaccaaugucuccuucgugugcuacgagcauguugggcaagaugaacaggagguggagcaccgggcccugaagagagucagcgugaacgacuguaaaauuguugauaauuccaagcagaagaucugcaccggagaccacguguuuugugaaaaauacgauugcucuacaagcuauccggacgucaccuguauucaugcuccuggcuccggcccccucuacaucaaccugauggggucuuggauuaagccucagugcgugggauaugagcgcgugcuuguugaucgggaagucaaacaaccccugcucgcccccgagcagaauugugacacaugcgugagcgaaugucuggaugagggcgugcacaucaaguccacgggguucgagaucaccagcgcugucgccugcucucauggauccugcauuagcgcccaccaggaaccuucuacauccgugaucguuccguaccccggccuucuggcuagcguugggggcagaauuggaauccaucucucucacaccagcgacuccgcgagcguccacauggugguuguguguccuccccgcgauucuugcgccgcucauaacugucugcugugcuaucacggcauucucaacuaccagugucauuccacacugagcgccauccuuaccuccuuucugcucauccuguucauuuauacggucuuuucugugaccacaaauauccuguacguucuucggcucauuccuaaacaacucaagagccccgugggguggcugaagcuguucaucaacuggcugcuuaccgcccugagaauuaaaacacgcaaugucaugcggagaaucaaccagcgcaucggauggguggaccaccacgauguggagcggccgagacaucgcgaaccuaugcggagauuuaagaccacgcuccugcugacacuuauuaugaugaccggcgggaaugcuugcuccaacacagucguugccaauucuaaacagacccggugugugcaggagggaagcaacaccaagugcuccaucacagcgacgauuacccuccgcgcuggcgugaucggggccgaaucuuguuucauuaucaaaggccccauggagaaucaacagaagacaauuagcaucaagaccaucuccagcgagacagucugcagagaaggaucuuccuuuuggaccagccuguacauuccuucuugucuguccagccggagaugccaccucgugggcgacugcguugggaacaaaugucagucuuggcgcgacgaucaacugucccgggaguucagcggagugaaggacaaucauaucaugaacgaaaauaaaugcuuugagcaguguggcgccauugggugcggauguuucaacaucaaucccuccugccuuuauguccacgcuuaccucaagagcgccagaaacgaagcugugcgcguguuuucuuguagcgauugggugcauagagucuccuucgaggugaaaggcccugacggggagacggaacugguuacacugggcucucugggaaccaaguuccuuaacuggggcacccucagccugucccuggaugccgaggggauuucuggaacaaauagcaucuccuuucucgaaucuagcaagggcggguucgcgcuguaugacgagggauacaacgagaucccccgggaaggcuuucuuggggagauucgcugcuccagcgaaucugccgcuaucuccgcccacaaaagcuguauuagagcuccgggccugaucaaguauaaaccuaugaccgaucagauugagugcacagccucucucguggaccccuucgcgaucuuucugaagggaucccugccccagacgcggaauggccaaaccuucacaagcaccaaagauaagaaaacaguccaggccuuuaccaacggggcuaucaaggcccuucucuccauuaaucuggacgaucacgaaaucguguucauuaacaaggugaaaaauugugacgcuacguuucugaacgucucuggaugcuacagcugcgauuauggcgcccauguuugugugaaggugaaauccagcgagucugccgacuucuuugcugaguccgaagacaagaccacaguccucagcuucccuauccagucugggacccacgauuacugccaggugcugcauuuucaaaaaccgcuuguugacgagcgccugagcuacuccuguggaucugaacccaagcucauugugaucaagggcacacuggucuauaugggcguguacgauuucagaaauaaaaccgggggaagcuccacaguugugaacccuucugagggcgcguggagcauuuccaauugguucagcgggcugcuugacuggcugggaggccccaugaaggccauccucaaaauccugggguuuauugcuaucggaauugucugcuucgugcucuuuaugauccugauucggaucgccgucaacucuaucaauauuaagaaaaagaacuga

SEQ ID NO: 14360 - RNA, 3942 nt, Artificial Sequence
  derived and/or modified CDS sequence (opt5) from PTV(PaAR2381)__KP272005.1__GP
augaucuucaccauucugaacauccucacaagagccaugcuggugaugagcauguacucccuuacgaccugggacucuacaagccggaaugauaugugcuuuuccaacgacucuccccuggagggccucgucuauuacugggaaacccacagcaagaaacaugauuauaagaaacaggagucccaaaagugucgcguuggggacucugauaaaaagaugauuagcaaugugacaaucauuucccugaucagcgaaauccagaagucuauuuccgagcuuagccugucuugcggaaacgacgauaauuccaccggccaggugcucacauucaacgggcuggaagacaccaucagaggagauuacauugucgacugugugacgggccuguaucagagcgauaucgggguuggagugggccucggccggacccaccaugaccaccaucaagucaaaaauaaggcugugguuauugaugagaaagagcgcaugaucucucugcuugaaacacagcaguccgagaacgacauuaagaugcaagugcugaugagcgaaaucgagcaacucaaaaaucagcuguccagaaagcggaacgagcgcgggcaggaaaagagagacgccgagaaagucaugucugaucuuauggcgcggaauagcgaccugcgcaagcacaacgauauccucaccgcugaaauuucccagaugaaauacaauaacacaauccaaagaagcaagaaugugaugucuaccacgguggucccugccauucuguccguugcccugcucagcucuagcguggcuccgaucauggccgcucccccugacucccccaugauuaacccuuggccccacgccaaaaaccgggugggaacaggcauguauaaguacgaugacaaugaugacucugggugccgcccuaucagauacggagucagcuguaucggcuuugauuucaugcugaaaauggacaaguauccguuuuucaacgcguuuauugggcauaagacaccccuugaguccuucgccgauaaaaucauugaaaaggaggaggaaacaugcgagaucggaaccaauaaagaauuuaaguguuucgaggaacgggcuuacauuaaaggaaccugcccuacaaacaucaaugccgugcacuauaucgacaacaagggcaagcugcgcuacguuaaauguaaggagaaucucgagaugacggaagacugcgcuuuuuguagaaaaauuaagaaaaaggccgggcagagcgugcagguccaaaagaccucugugccccugcaggaugcgaucugccaggagaacuccgacaauuauagcggaccuaaaauucccuucaagggcguuugccggaucgggcuuauuaaauacaaggaauguaaauuuaagacaucuuccuaugagaccgugagcuucaucacacugaaggaaaaaggaaagauuuacaucgagcaucucaugcugaaaaacaucgaggucgugaccaaugucuccuucgugugcuacgaacacgccggccaggaugagcaagaaguugagcacagagcucugaagcgcgugucugucaacgacuguaaaauuguggauaauagcaagcagaaaaucugcacgggggaccauguguuuugugagaaguaugauugcuccacaucuuacccggacgugaccuguauucacgccccuggaagcggcccccucuauaucaaccugaugggcuccuggauuaagccucagugcgucggguacgaacgggugcuuguggauagagagguuaaacagccccugcucgcucccgaacaaaauugugauaccugcgucagcgagugucuggacgaaggagugcauaucaagucuacaggcuucgagaucaccuccgccguggccugcagccacgggucuugcauuuccgcucaucaggaggcgagcacaucugucaucgugccuuauccgggacuucuggccagcguuggcgggcgcauuggcauccaccucucccacacgagcgacucugcuuccgugcauauggucgugguuugucccccucgggauagcugcgaagcccacaacugucugcugugcuaccauggcauucucaacuaucagugucacuccacccugucugccauccuuaccagcuuucugcucauccuguucauuuacaccguguuuuccgucacaaccaauaugcuguacgugcuuagacucauccccaaacagcugaagucuccuguuggcuggcugaaacucuucauuaacuggcugcuuacggcucugcgcaucaagacccggaaugugauggggagaauuaaccaacgcaucggaugggucgaccaccaugacguggagcggcccagacaccgcgaaccgaugcggagauuuaagacaacccuccugcugacacuuaucaugaugaccggcgggaaugccugcagcaacacgguggucgcuaauuccaaacagacacgguguguucaggagggaucuaacaccaagugcagcauuacagcuaccaucacccuccgcgccggcgugauuggggccgaauccuguuucaucauuaaaggcccuauggagaaucagcaaaagacaaucagcauuaaaacgaucucuuccgagaccgugugcagagaaggaagcucuuuuuggacaucccuguauauccccagcugucugucuucccggagaugccaucucgucggcgauugcguggggaacaagugucagagcuggcgcgacgaucagcugucccgggaguucagcggaguuaaggacaaucacauuaugaacgaaaauaaaugcuuugagcaauguggcgcuaucgggugcggauguuucaacauuaauccuucuugccuuuacgugcaugccuaucucaagagcgcuagaaacgaagccguccgcguguuuuccuguucugauuggguucacagagugagcuucgaggucaaaggccccgacggggagaccgaacuggugacacugggcucccugggaaccaaguuccuuaacuggggcacgcucucucugagccuggaugcggaggggaucuccggaacaaauucuauuagcuuucucgaauccagcaaaggcggguucgcccuguacgacgagggauauucugagaucccucgggaaggcuuucuuggggagauccgcugcuccagcgaaucugcugccauuuccgcucacaagagcuguaucagagcccccggccugauuaaguacaaaccgaugaccgaucagaucgagugcaccgcgucccucguugacccuuucgccauuuuucugaagggaucucugccccagacacggaacggccagaccuucacaagcacgaaagauaagaaaaccgugcaggcuuuuacaaauggggccaucaaggcgcuucucuccaucaaccuggacgaucaugaaauugucuucaucaauaaaguuaagagcugugacgccaccuuucugaacgugucuggaugcuauuccugcgacuacggcgcccacgucuguguuaaggugaaaagcucugagagcgcugauuucuuugcggaguccgaagacaagacaaccgugcucucuuuccccauucagagcgggacgcaugauuacugccagguccugcacuuucagaaaccucuuguggacgagcgccuguccuauucuuguggaagcgaaccgaagcucaucguuauuaaaggcacccugguguacaugggcgucuaugauuucagaaauaagacagggggauccagcaccgugguuaaccccucugagggcgccugguccaucagcaauugguucuccgggcugcuugacuggcugggaggcccuaugaaggcuauucucaaaauccugggguuuaucgccauuggaaucgugugcuucauucucuuuaugaucaugauucggaucgccgucaacucuaucaauauuaagaaaaagaacuga

SEQ ID NO: 14361 - RNA, 3942 nt, Artificial Sequence
  derived and/or modified CDS sequence (opt5) from PTV(PAN483391)__KP272008.1__GP
augaucuucaccauucugaacauccucacaagagccaugcuggugaugagcauguacucccuuacgaccugggacucuacaagccggaaugauaugugcuuuuccaacgacucuccccuggagggccucguguauuacugggaaacccacagcaagaaacaugauuauaagaaacaggagucccaacgcuguagaguuggggacucugauaagaaaaugauuacaaaugugaccaucauuagccugaucuccgaaauccaaaagagcauuucugagcuuucccugagcugcggaaacgacgauaauucuacaggccaggugcucaccuucaacgggcuggaagacacgauccggggagauuacauugucgacugugugaccggccuguaucaguccgauaucgggguuggagugggccucggccgcacacaccaugaccaccagcaggucaagaauaaagcugugguuauugaugagaaggagagaaugaucagccugcuugaaacccagcagucugagaacgacauuaaaaugcaagugcugauguccgaaaucgagcagcucaagaaucagcugagcaaaaagcggaacgagcgcgggcaggaaaagagagacgccgagaaagucauguccgaucuuauggcgcggaauagcgaccugcgcaagcauaacgauauccucacagcugaaauuagccaaaugaaauacgacaauaccauccagagaaacaagaaugugauguccacgacaguggucccugccauucugagcguugcccugcucucuuccagcaucgcuccgauuauggccgcuucucccgauagcccuaugaucaaccccuggccucacgccaaaaaccgggugggaaccggcauguauaaguacgacgagaaugaugacuccgggugccgccccaucagauacggagugucuuguauuggcuuugauuucaugcugaaaauggacaaguauccguuuuucaacgcguuuaucgggcacaagacaccucuugaaucuuucgccgauaaaauuaucgagaaggaggaagagaccugcgaaauuggaaccaauaaagaguuuaaguguuucgaggaacgggcuuacaucaaaggcacaugccccacgaacaucaaugccguccauuauauugacaacaagggcaagcugcgcuacgugaaauguaaggagaaucucgaaaugaccgaggacugcgcuuuuuguagaaaaaucaagaaaaaggccgggcaguccguucaagugcagaagacaagcgucccucugcaggaugcgauuugccaggaaaacucugacaccuauuccggacccaaaaucccuuucaagggcgugugcaaaauugggcuuaucaaguacaaagaguguaaguuuaagacaagcucuuaugaaaccguuuccuucauuacgcugaaagagaagggaaaaaucuacaucgagcaccucaugcugaagaauauugaaguggucacaaacgugagcuucgucugcuacgagcaugccggccaagaugaacaggagguggagcaccgggcucugaaaagaguuuccgugaaugacuguaagaucgucgauaacucuaaacagaagauuugcaccggggaccacguguuuugugaaaaguaugauugcagcaccuccuaccccgacguuacauguauccaugccccgggaucuggcccucucuauauuaaucugaugggcagcuggaucaaaccccagugcgugggguacgagaagguccuuguggaucgcgaagugaaacaaccucugcucgcucccgagcagaacugugauaccugcguuuccgaaugucuggacgagggaguccacaucaagagcacaggcuucgagauuacgucugccguggccugcucccaugggagcugcaucucugcucaccaggaagcguccaccagcgugauuguccccuauccuggacuucuggccucugugggcgggaaaaucggcauucaucucagccacacauccgacagcgcuucuguucacaugguggucguguguccgccccgggauuccugcgccgcccauaauugucugcugugcuaccacggaauccucaacuaucagugucauagcacccuguccgcuauccuuacaucuuuucugcucauucuguucaucuacaccguuuuuagcgugacgaccaacaugcuguacguccuuagacucauuccuaagcaacugaagucccccgugggcuggcugcgccucuucaucaauuggcugcuuacagcccugcggauuaaaaccagaaacguuauggggcgcaucaaucagcggaucggauggguggaccaccacgacgucgagagaccucgccaucgggaacccaugagacgcuuuaagacaacccuccugcugacgcuuauuaugaugacaggcgggaacgcgugcucuaauaccgugguggcuaacagcaaacagacacgguguguccaggagggauccaauaccaagugcucuaucaccgccacaauuacgcucaaagccggcguuaucggggcugaaagcuguuucauuaucaagggcccgauggagaaccaacagaagaccauuuccaucaaaacaaucagcucugagaccgugugcagagaaggauccagcuuuuggacaucucuguauauuccuuccugucugagcucucggcgcugccaccucgugggcgauugcgucgggaauaagugucaguccuggagagacgaucaacugagccgggaguucuccggagugaaagacaaccauaucaugaaugaaaacaagugcuuugagcaguguggcgccauugggugcggauguuucaauaucaaccccagcugccuuuacguucacgcuuaucugaaaucugccagaaaugaagcggugcgcgucuuuagcuguuccgauugggugcaucggguuucuuucgaggugaagggcccugacggggagaccgaacucgucacgcugggcagccugggaacaaaguuccuuaacuggggcacccucucccugucucuggaugccgaggggauuagcggaaccaacuccaucucuuuucucgaaagcuccaaaggcggguucgcucuguacgacgagggauauagcgagauccccagagaaggcuuucuuggggagauucgcuguucuuccgaaagcgccgcuaucucugcccacaaguccugcauuagagcgccuggccugaucaaauacaagcccaugacagaucagauugagugcaccgccagccucguggacccguucgcuaucuuucugaaaggaucccugccucagacacggaauggccaaacguucaccucuacaaaggauaaaaagaccguucaggccuuuacaaacggggcuaucaaggcccuucucagcauuaaucuggacgaucacgaaaucguguucauuaacaaaguccgcuccugugacgccaccuuucugaaugugagcggaugcuauucuugcgacuacggcgcucaugugugugucaagguuaaauccagcgagucugcggauuucuuugccgagagcgaagacaagacgaccgugcucuccuuccccauccagucugggacacacgauuacugccaggugcugcauuuucaaaaaccccuugucgacgagagacugagcuauuccuguggaucugaaccuaagcucauugugaucaagggcacccugguuuacaugggcguguaugauuuccggaacaaaacagggggaagcuccaccgucgugaauccgagcgagggcgcuuggucuauuuccaacugguucagcgggcugcuugacuggcugggaggccccaugaaggccauccucaaaauccugggguuuauugccaucggaauuguuugcuucauccucuuuaugauucugauccgcaucgcugucaauuccauuaacaucaagaaaaagaauuga

SEQ ID NO: 14362 - RNA, 3942 nt, Artificial Sequence
  derived and/or modified CDS sequence (opt5) from PTV(GML902876)__KP272011.1__GP
augaucuucaccauucugaacgugcucacaagagccaugcuggucaugagcauguacucccuuacgaccugggacucuacaagccggaaugauaugugcuuuuccaacgacucuccccuggagggccucguuuauuacugggaaacccacagcaagaaacaugauuauaagaaacaggagucccaaaagugucgcgugggggacucugauaaaaagaugaucagcaaugugacaauuaucucccugauuagcgaaauccagaagucuaucuccgagcuuagccugucuugcggaaacgacgauaauuccaccggccagguccucacauucaacgggcuggaagacaccauuagaggagauuacaucguggacuguguuacgggccuguaucagagcgauauuggggugggagucggccucggccggacccaccaugaccaccaucaagugaaaaauaaggcuguugugaucgaugagaaagagcgcaugauuucucugcuugaaacacagcaguccgagaacgacaucaagaugcagguccugaugagcgaaauugagcaacucaaaaaucagcuguccagaaagcggaacgagcgcgggcaggaaaagagagacgccgagaaagugaugucugaucuuauggcgcggaauagcgaccugcgcaagcacaacgauauccucaccgcugaaaucucccagauggagaauaacaauacaauucaaagaaacaaaaacgugaugagcaccacggucguuccugccauccugucuguggcccugcucuccagcucuauugcuccgaucauggccgcuagccccgacuccccuaugauuaaucccuggccucacgccaagaaccgggugggaacaggcauguacaaauaugaugaaaaugacgauucugggugccgccccaucagauacggagucagcuguaucggcuuugacuucaugcugaagauggauaaauacccuuucuucaacgcguuuauugggcauaagaccccgcuugaguccuucgccgacaagaucauugagaaagaagaggaaacaugcgagaucggaaccaauaaggaauuuaaauguuucgaggagcgggcuuauauuaaggggaccugccccacaaacaucaaugccgugcacuacaucgauaacaaaggcaagcugcgcuauguuaaguguaaagaaaaucucgagaugacggaagacugcgcuuuuuguagaaagauuaaaaagaaagccggccagagcauccaggugcaaaagaccucugucccucugcaggacgcgauuugccaggagaacuccgauacauacagcggacccaagaucccuuucaaaggcgugugcaagauugggcuuaucaaauauaaggaauguaaauuuaagaccucuuccuacgagacaguuagcuucauuacccugaaggagaaaggaaagaucuauaucgaacaucucaugcugaaaaauauugagguggucacgaacguguccuucgucugcuacgaacacgccggccaggacgagcaagagguggaacaccgggcucugaagagaguuucugugaaugauuguaaaaucgucgacaacagcaagcagaaaauuugcacaggggaucauaucuuuugugagaaguacgacugcuccaccucuuaucccgaugugaccuguauucacgccccgggaagcggcccucucuacaucaaucugaugggcuccuggaucaagccccagugcguuggguaugaacgcgugcuugucgaccgggaggugaaacagccucugcucgcucccgaacaaaacugugauacaugcgugagcgagugucuggacgagggaguucauauuaagucuaccggcuucgaaaucacauccgccgucgccugcagccacgggucuugcauuuccgcucaucaggaggcgagcacgucugugaucgugcccuacccuggacuucuggccagcgucggcgggagaauuggcauccaccucucccacaccagcgauucugcuuccgugcauaugguuguggucuguccgccccgcgacagcugcgccgcccacaacugucugcugugcuaucauggaauccucaauuaccagugucacuccacacugucugcuauucuuaccagcuuucugcucauccuguucauuuauacaguguuuuccguuaccacgaacaugcuguacgugcuucggcucaucccuaaacagcugaagucucccgucggcuggcugagacucuucauuaauuggcugcuuaccgcccugcgcaucaaaacacggaacgugauggggagaaucaaucaacgcauuggauggguugaucaccaugacguggaacggccuagacaccgcgagcccaugcggagauuuaagaccacacuccugcugacccuuaucaugaugacgggcgggaacgcgugcagcaauacagucguggcuaacuccaagcagacccggugugugcaggaaggaucuagcacaaaaugcuccauuaccgccaccaucacacuccgcgccggcgucauuggggcugagagcuguuucaucauuaagggcccgauggagaaucagcagaaaacgaucucuaucaagaccauuuccagcgaaacaguuugcagagagggaucuuccuuuuggaccagccuguacaucccuucuugucuguccagccggagaugccaucucgugggcgacugcguggggaacaaaugucaauccuggcgcgaugaccagcugagccgggaauuuucuggagucaaggauaaucacauuaugaacgagaauaagugcuuugaacaauguggcgccaucgggugcggauguuucaacauuaaucccagcugccuuuaugugcaugcuuaccugaaauccgccagaaacgaggcgguucgcguguuuucuuguagcgacuggguccacagaguguccuucgagguuaagggcccugauggggaaacagagcucguggcccugggcucucugggaaccaaauuccuuaacuggggcacgcucagccugucccuggacgcugaagggaucucuggaacaaauagcaucuccuuucucgagagcucuaagggcggguucgcccuguaugaugagggauacuccgaaauuccccgggagggcuuucuuggggaaauccgcugcagcucugaguccgcugccauuagcgcgcacaaauccuguaucagagccccuggccugauuaaguauaagcccaugaccgaccagaucgaaugcaccgcuucucucgucgauccguucgccaucuuucugaaaggaagccugccucagacacggaacggccagaccuucacauccacgaaggacaaaaagaccgugcaggcuuuuacaaauggggccauuaaagcccuucucagcaucaaccuggaugaccaugagauuguuuucaucaauaaggugaaaucuugugaugcuaccuuucugaacgucuccggaugcuacagcugcgacuauggcgcgcacgugugugugaaggucaagucuagcgaguccgccgacuucuuugcugaaucugaggauaaaacaaccguucucagcuuccccauucaauccgggacgcaugacuacugccaggugcugcacuuucagaagccccuuguggaugaacgccugucuuacagcuguggauccgagccuaaacucaucgucauuaagggcacccugguguauaugggcguuuacgacuucagaaauaaaacagggggaagcucuaccguggucaacccguccgaaggcgccuggagcaucuccaauugguucucugggcugcuugauuggcugggaggccccaugaaggccauccucaagauucugggguuuaucgcuauuggaaucgugugcuucauucucuuuaugaucaugauccggauugccguuaacagcaucaauauuaaaaagaaaaacuga

SEQ ID NO: 14363 - RNA, 3942 nt, Artificial Sequence
  derived and/or modified CDS sequence (opt5) from PTV(PAN479603)__KP272014.1__GP
augaucuucaccauucugaacauccucacaagagccaugcuggugaugagcauguacucccuuacgaccugggacucuacaagccggaaugauaugugcuuuuccaacgacucuccccuggagggccucgucuauuacugggaaacccacagcaagcgccaugauuauaaaaagcaggagucccaaaaauguagaguuggggacucugauaagaaaaugauuagcaaugugacaaucauuucccugaucagcgaaauccagaagucuauuuccgagcuuagccugucuugcggaaacgacgauaauuccaccggccaggugcucacauucaacgggcuggaagacaccauccggggagauuacauugucgacugugugacgggccuguaucagagcgauaucgggguuggagugggccucggccgcacccaccaugaccaccaucaagucaagaauaaagcugugguuauugaugagaaggagagaaugaucucucugcuugaaacacagcaguccgagaacgacauuaaaaugcaagugcugaugagcgaaaucgagcaacucaagaaucagcugucccggaaacgcaacgagagagggcaggaaaagcgggacgccgagaaggucaugucugaucuuauggcgcgcaauagcgaccugagaaaacacaacgauauccucaccgcugaaauuucccagaugaaguacgacaauacaauccaacggaacaaaaaugugaugagcaccacgguggucccugccauucugucuguugcccugcucuccagcucuguggcuccgaucauugccgcucccccugauagccccaugaucaacccuuggccccacgccaagaaccgcgugggaacaggcauguauaaauacgacgauaaugacgauuccgggugcagaccuauccgguacggagucucuuguauuggcuuugacuucaugcugaagauggauaaauauccguuuuucaacgcguuuaucgggcauaagacaccccuugagagcuucgccgacaagauuaucgaaaaagaggaggaaaccugcgagauuggaaccaauaaggaauuuaaauguuucgaggaacgcgcuuacaucaaggggaccugcccuacaaacaucaaugccgugcacuauauugacaacaaaggcaagcugagauacguuaaguguaaagagaaucucgagaugacggaagauugcgcuuuuugucggaagaucaaaaagaaagccggccaguccgugcagguccaaaagaccagcgugccccugcaggacgcgauuugccaggagaacucugauacauauuccggaccuaagauccccuucaaaggcguuugcaagauugggcuuaucaaauacaaggaauguaaauuuaagaccagcucuuaugagacaguguccuucauuacccugaaggaaaaaggaaagaucuacaucgagcaucucaugcugaaaaauauugaggucgugacgaacgucagcuucgugugcuacgaacacgccggccaggacgagcaagaaguugagcacagagcucugaagcgcguguccgucaaugauuguaaaaucguggacaacucuaagcagaaaauuugcacaggggaucauguguuuugugagaaguaugacugcagcaccuccuacccggauguuaccuguauccacgccccuggaucuggcccccucuauauuaaucugaugggcagcuggaucaagccucagugcgucggguacgaacgggugcuuguggacagagagguuaaacagccccugcucgcucccgaacaaaacugugauacaugcgucuccgagugucuggacgaaggagugcauaucaagagcaccggcuucgagauuacaucugccguggccugcucccacgggagcugcaucucugcucaucaggaggcguccacgagcgucauugugccuuauccgggacuucuggccucuguuggcgggcgcaucggcauucaccucagccacaccuccgauagcgcuucugugcauauggucgugguuugucccccucgggacuccugcgccgcccacaauugucugcugugcuaccauggaauccucaacuaucagugucacagcacacuguccgcuauccuuaccucuuuucugcucauucuguucaucuacacaguguuuagcgucaccacgaacaugcuguacgugcuuagacucauucccaaacagcugaaguccccuguuggcuggcugaaacucuucaucaauuggcugcuuaccacacugcgcauuaagacccggaacgugauggggagaaucaaucaacgcaucggaugggucgaccacuuugauguggaacggcccagacaucgcgagccgaugcggagauucaagacaacccuccugcugacgcuuauuaugaugacaggcgggaacgccugcucuaauaccguggucgcgaacagcaaacagacacgguguguucaggaaggauccaauaccaagugcucuaucaccgcuacaauuacgcuccgcgccggcgugaucggggccgagagcuguuuuauuaucaaaggcccuauggaaaaccagcaaaagaccauuuccaucaaaacaaucagcucugagaccgugugcagagagggauccagcuucuggacaucucuguauauucccuccugucugagcucucggagaugccaccucgucggcgacugcguggggaauaagugucaguccuggcgcgaugaccagcugagccgggaauuuuccggaguuaaggauaaccauaucaugaaugagaacaaaugcuucgaacaauguggcgcuauugggugcggauguuuuaauaucaacccuagcugccuuuacgugcacgccuaucugaagucugcuagaaaugaggccguccgcguguucagcuguuccgacuggguucauagagugucuuucgaagucaaaggccccgauggggagaccgagcucgugacgcugggcagccugggaacaaaguuucuuaacuggggcacccucucccugucucuggacgcggaagggauuagcggaaccaacuccaucucuuuccucgagagcuccaaaggcggguuugcccuguacgaugaaggauauagcgagaucccucgggagggcuuccuuggggaaauucgcuguucuuccgagagcgcugccaucucugcucacaaguccugcauuagagcccccggccugaucaaguacaaaccgaugacagaccagauugaaugcaccgcgagccucguugauccuuuugccaucuuccugaagggaucccugccccagacacggaauggccagacguuuaccucuacaaaagacaagaaaaccgugcaggcuuucacaaacggggccaucaaggcccuucucagcauuaaucuggaugaccacgagaucgucuuuauuaaccgcgugaaauccugugacgcuaccuuccugaaugugagcggaugcuauucuugcgauuacggcgcccaugucuguguuaaggugaaguccagcgaaucugcugacuuuuucgcggagagcgaggauaaaacgaccgugcucuccuuucccauccagucugggacacacgacuacugccagguccugcauuuccagaagccucuuguggaugaaagacugagcuauuccuguggaucugagccgaaacucauuguuaucaagggcacccugguguacaugggcgucuaugacuuccggaacaaaacagggggaagcuccaccgugguuaaucccagcgaaggcgccuggucuauuuccaacugguuuagcgggcugcuugauuggcugggaggcccuaugaaggcuauccucaagauccugggguucauugccaucggaauugugugcuuuauccucuucaugauucugauccgcaucgccgucaauuccauuaacaucaaaaagaaaaauuga

SEQ ID NO: 14364 - RNA, 3942 nt, Artificial Sequence
  derived and/or modified CDS sequence (opt5) from PTV(PAN478718)__KP272017.1__GP
augaucuucaccauucugaacgugcucacaagagccaugcuggucaugagcauguacucccuuacgaccugggacucuagcucccggaaugauaugugcuuuucuaacgacagcccccuggagggccucguuuauuacugggaaacacacuccaagaaacaugauuauaagaaacaggagucucaacgcuguagagugggggacagcgauaagaaaaugaucaccaaugugacaauuaucucccugauuagcgaaauccagaagucuaucuccgagcuuagccugucuugcggaaacgacgauaauuccaccggccagguccucacauucaacgggcuggaagacaccauucggggagauuacaucguggacuguguuacgggccuguaucagagcgauauuggggugggagucggccucggccgcacccaccaugaccaccaacaggugaagaauaaagcuguugugaucgaugagaaggagagaaugauuucucugcuugaaacacagcaguccgagaacgacaucaaaaugcaaguccugaugagcgaaauugagcagcucaagaaucagcuguccaaaaagcggaacgagcgcgggcaggaaaagagagacgccgagaaagugaugucugaucuuauggcgcggaauagcgaccugcgcaagcauaacgauauccucaccgcugaaaucucccaaaugaaauacaauaacacaauucagagaaauaagaacaucaugagcaccacgguggucccugccauucugucuguugcccugcucuccagcucuguggcuccgaucauggccgcucccccugacagccccaugauuaacccuuggccccacgccaaaaaucgggugggaacaggcauguauaaguacgaugacaacgaugacuccgggugccgcccuaucagauacggagucucuuguaucggcuuugauuucaugcugaaaauggacaaguauccguuuuucaaugcguuuauugggcacaagacaccccuugagagcuucgccgauaaaaucauugaaaaggaggaggaaaccugcgagaucggaaccaacaaagaauuuaaguguuucgaggaacgggcuuacauuaaaggaaccugcccuacaaauaucaacgccgugcauuauaucgacaauaagggcaagcugcgcuacguuaaauguaaggagaaccucgagaugacggaagacugcgcuuuuuguagaaaaauuaagaaaaaggccgggcaguccgugcaaguccagaagaccagcgugccccugcaggaugcgaucugccaggaaaauucugacacauauuccggaccuaaaauucccuucaagggcguuugcaaaaucgggcuuauuaaguacaaagaauguaaguuuaagaccagcucuuaugagacaguguccuucaucacccugaaagaaaagggaaaaauuuacaucgagcaccucaugcugaagaacaucgaggucgugacgaaugucagcuucgugugcuacgaacaugccggccaagaugagcaggaaguugagcaccgggcucugaaaagaguguccgucaacgacuguaagauuguggauucuagcaaacagaagaucugcacaggggaccacguguuuugugagaaguaugauugcuccaccucuuacccggacgugaccuguauucaugccccuggaagcggcccccucuauaucaaucugaugggcuccuggauuaaaccucagugcgucggguacgaacgcgugcuuguggaucgggagguuaagcaaccccugcucgcucccgaacagaacugugacacaugcgucagcgagugucuggaugaaggagugcacaucaaaucuaccggcuucgagaucacauccgccguggccugcagccaugggucuugcauuuccgcucaccaggaggcgagcacgucugucaucgugccuuauccgggacuucuggccagcguuggcgggagaauuggcauccaucucucccacaccagcgacucugcuuccgugcacauggucgugguuugucccccucgcgauagcugcgccgcccauaauugucugcugugcuaccacggcauucucaacuaucagugucauuccacacugucugcuauccuuaccagcuuucugcucauccuguucauuuacacaguguuuuccgucaccacgaacaugcuguacgugcuucggcucauccccaagcaacugaaaucuccuguuggcuggcugaaacucuucauuaauuggcugcuuaccgcccugagaaucaagacacgcaacgugauggggcggauuaaucagagaaucggaugggucgaccaccacgacguggaacgcccccggcauagagagccgaugcgccgguuuaagaccacacuccugcugacccuuaucaugaugacgggcgggaacgcgugcagcaauacaguggucgcuaacuccaagcagaccagauguguucaggaaggaucuaauacaaaaugcagcauuaccgccaccaucacacuccgggccggcgugauuggggcugaguccuguuucaucgugaagggcccuauggaaaaccaacagaaaacgauuagcaucaagaccauuucuuccgagacagucugccgcgagggaagcucuuuuuggaccucccuguauauccccagcugucugucuuccagacggugccaccucgugggcgauugcguugggaauaagugucagagcuggagagacgaucaacugucccgcgaguucagcggagugaaagacaaccauaucaugaaugagaacaagugcuuugaacaguguggcgccauugggugcggauguuucaauaucaacccuucuugccuuuacguccacgcuuaucugaaaagcgcccggaaugaggcggugagaguguuuuccuguucugauuggguucaucgcgucagcuucgaagugaagggccccgacggggagacagagcucguuacccugggcucccugggaacgaaauuccuuaacuggggcacacucucucugagccuggaugccgaagggauuuccggaaccaacucuaucagcuuucucgaguccagcaagggcggguucgcucuguacgacgaaggauauucugagauuccuagagagggcuuucuuggggaaauccggugcuccagcgagucugccgcuaucuccgcccacaagagcuguauucgcgcgcccggccugaucaaauacaagccgaugaccgaucagauugaaugcacagccucccucguggacccuuucgcuaucuuucugaaaggaucucugccccagaccagaaauggccaaacauucacgagcaccaaggauaaaaagacaguccaggccuuuaccaacggggcuauuaaagcccuucucuccaucaaucuggacgaucacgagaucguguucauuaacaaggugaucagcugugacgccacauuucugaaugucucuggaugcuauuccugcgacuacggcgcucauguuugugugaaggugaaaagcucugaaagcgcggauuucuuugccgaguccgaggacaagaccacgguccucucuuuccccauucagagcgggacccacgauuacugccaggugcugcauuuucaaaaaccucuuguugacgaacggcuguccuauucuuguggaagcgagccgaagcucaucgugauuaaaggcacacuggucuacaugggcguguaugauuuccgcaacaagaccgggggauccagcacaguugugaaucccucugaaggcgcuugguccaucagcaacugguucuccgggcugcuugacuggcugggaggcccuaugaaggccauucucaaaauccugggguuuaucgccauuggaaucgucugcuucauucucuuuaugauccugauuagaaucgcuguuaauucuaucaacauuaagaaaaagaauuga

SEQ ID NO: 14365 - RNA, 3942 nt, Artificial Sequence
  derived and/or modified CDS sequence (opt5) from PTV(Balliet)__KP272023.1__GP
augaucuucaccauucugaacgugcucacaagagccaugcuggucaugagcauguacucccuuacgaccugggacucuacaagccggaaugauaugugcuuuuccaacgacucuccccuggagggccucguuuauuacugggaaacccacagcaagaaacaugauuauaagaaacagaagucccaacgcuguagagugggggacucugauaaaaagaugaucacaaaugugaccauuaucagccugauuuccgagauccaaaagagcaucucugaacuuucccugagcugcggaaacgacgauaauucuacaggccagguccucaccuucaacgggcuggaggacacgauucggggagauuacaucguggacuguguuaccggccuguaucaguccgauauuggggugggagucggccucggccgcacacaccaugggcaccagcagaugaaaaauaaggcugugguuaucgacgaaaaagagagaaugauucugcuucuggagacccagcagagcgaaaacgauaucaagaugcaagugcucaugucugagauugaacagcugaaaaaucagcuuuccaagaagcggaacgagcgcggacaggagaaaagagacgccgaaaaggucaugagcgaccugauggcgcggaauagcgaucuccgcaaacauaacgacauccugacagcugagaucucucaaaugaagaauaaaaacaccauucagagaaauaagaacacggugagcacaaccguggucccugccauccuguccguugcccuccuguccucuuccguggcuccgauuaucgccgcucccccugauagccccaugauuaacccuuggccccacgccaaaaaucgggugggcacagggauguacaaguaugacgaaaacgaugacucuggaugccgcccuaucagauacggcgucagcuguaucggguuugauuucaugcuuaagauggacaaauacccguuuuucaaugcguuuauuggacacaagacaccccuggaguccuucgccgauaaaaucauugaaaaggaggaggaaaccugcgagaucggcaccaacaaagaauuuaaguguuucgaggaacgggcuuauauuaagggcacgugcccuaccaauaucaacgccgugcauuacaucgacaauaaagggaagcuccgcuauguuaaauguaaggagaaccuggagaugacagaagauugcgcuuuuuguagaaaaauuaagaagaaagccggacagucugugcaaguccagaagaccagcgugccccuucaggacgcgaucugccaggaaaauuccgacacauacagcggcccuaaaauucccuucaaggggguuugcaaaaucggacugauuaaguauaaggaauguaaauuuaagaccucuuccuacgagacggugagcuucaucacacucaaagaaaagggcaaaauuuauaucgagcaccugaugcugaagaacaucgaggucgugaccaaugucucuuucgugugcuacgaacaugccgggcaagaugagcaggaaguugagcacaaagcucucaagcggguguccgucaacgacuguaagauuguggauaauagcaaacagaagaucugcaccggagaccacguguuuugugagaaauacgauugcuccacaucuuauccggacguuaccuguauucaugccccuggcagcggcccccuguacaucaaccuuaugggguccuggauuaagccucagugcgucggauaugaaagagugcugguggaucgcgagguuaaacaaccccuccuggcucccgaacagaauugugacacaugcgucucugagugucuugaugaaggcgugcacaucaagagcacgggguucgagaucaccuccgccguggccugcagccauggaucuugcauuuccgcucaccaggagccuagcacaucugucaucgugccguaccccggccugcucgcguccguugggggccggauuggaauccaucugagccacaccucugacagcgccuccgugcacauggucgugguuuguccucccagagauagcugcgcugcccauaacugucugcucugcuaucacggcauucugaacuaccagugucauucuacacuuuccgccauccugaccagcuuucuccugauccuguucauuuauacgguguuuuccgucaccacaaauauccuuuacgugcuccgccugauuccuaagcaacugaaaucucccguuggguggcucaagcuguucaucaacuggcuucugaccgcucuccggauuaaaacaagaaaugugaugggacgcaucaaccagcggaucggcugggucgaccaccacgauguggaaagaccgcgccaucgggagccuaugagacgcuuuaagaccacgcugcugcuuacacucauuaugaugaccgggggaaaugccugcagcaacacaguggucgcuaauuccaaacagacccgguguguucaggaaggcucuaacaccaagugcagcaucacagcgacgauuacccugagagccggggugaucggcgccgaguccuguuucauuaucaagggacccauggaaaaucaacagaaaacaauuucuaucaagaccaucagcuccgagacagugugccgggagggcagcucuuuuuggaccucccuguacauuccuagcugucucucuucccgcagaugccaccuggucggggacugcgugggaaacaaaugucagagcuggcgggacgaucaacuuucuagagaguucuccggcguuaaggacaaucauaucaugaacgagaauaaaugcuuugaacaguguggggcuauuggaugcggcuguuucaacaucaaucccagcugccuguaugugcacgccuaccucaaguccgcucgcaacgaggccguccggguguuuagcuguucugauuggguucauagagugagcuucgaagucaaggggccugacggcgagacggagcuggugacacugggaucccuuggcaccaaauuccucaacugggggacccugucucugagccucgaugcggaaggaauuuccggcacaaauucuaucagcuuucuggaguccucuaaagggggauucgcccuuuaugacgaaggcuacaacgagaucccccgcgagggguuucugggcgaaauuagaugcagcuccgagagcgcugccaucucugcucacaaguccuguauucgggccccgggacucaucaaguauaaaccuaugaccgaucagauugaaugcacagcgagccugguugaccccuucgccaucuuucugaagggcucucuuccccagacgcgcaaugggcaaaccuucacauccaccaaagauaagaagacagugcaggcuuuuaccaacggagccaucaaagcucuccugagcauuaaucuggacgaucacgagaucgucuucauuaacaaggugaaaaauugugacgccacguuucucaacguguccggcugcuacucuugcgauuauggggcccaugucuguguuaaggugaaaagcuccgaaagcgcugacuucuuugcggagucugaggacaagaccacagugcuguccuucccuauccagagcggaacccacgauuacugccagguccuucauuuucaaaagccgcugguggacgaaagacucucuuacagcuguggcuccgagcccaaacugauuguuaucaagggcacacugguguauaugggggucuacgauuuccggaauaaaaccggaggcucuagcacagugguuaacccuuccgaaggggccuggucuauuagcaauugguucuccggacuucuggacuggcucggcgggcccaugaaggcuauccugaaaauccucggauuuauugccaucggcauugugugcuucguccuguuuaugauccuuauucgcaucgccgugaacagcaucaauauuaagaagaaaaacuga

SEQ ID NO: 14366 - RNA, 3942 nt, Artificial Sequence
  derived and/or modified CDS sequence (opt5) from PTV(Adames)__KP272029.1__GP
augaucuucaccauucugaacgugcucacaagagccaugcuggucaugagcauguacucccuuacgaccugggacucuagcucccggaaugauaucugcuuuucuaacgacagcccccuggagggccucguuuauuacugggaaacacacuccaagaaacaugauuauaagaaacaggggucucaaaagugucgcgugggagacagcgauaaaaagaugauuuccaaugugaccaucauuagccugaucucugagauccagaaguccauuagcgaacuuucucuguccugcggcaacaaugacaacagcacagggcagguccucaccuucaauggacuggaggauacaaucagaggcgacuacauuguggauuguguuaccgggcuguaucagucugacaucggagugggcgucggccucgggcggauuaaccacgaucaucaacaggugaaaaauaaggcuguugugaucgacgaaaaagagaagaugauuucccugcuugagacgcagcagagcgaaaacgauaucaaaacccaaguccugauguccgagaucgaacagcucaagaaucagcugucuaagcgcagaaacgagcggggacaggagaaacgcgacgccgaaaaacuuaugagcgaccugauggcgagaaauuccgaucuccggaaccacaaugugauucugacagacgagaucagccaaauuaagaacaacaucaccauucaucgcaauagaaacaugaugucuacaaccguggucccugcuauccuguccguugcccuccugagcucuagcgugggcccgaucacggccgcucccccugauuccacaaugauuaaucccuggccucacgccaagaaccggguggggaccggaauguacaaauaugacgaaaaugaugagucuggcugccgccccaucagauacggggucagcuguauuggauuugacuucaugcuuaagauggauaaauacccuuucuucaacgcuuuuaucggccacaagacaccgcuggaauccuucgccgacaagauuaucgagaaagaggaagagaccugcgaaaucggcaccaauaaggaguuuaaauguuucgaggaacgggcguauauuaaggggacaugccccacgaacaucaaugccgugcauuacauugauaacaaaggaaagcuccgcuauguuaaguguaaagagaaucuggaaaugaccgaggacugcgcuuuuuguagaaagaucaaaaagaaagccggccagagcgugcagguccaaaagacaucugugccucuucaggaugcuauuugccaggaaaacuccgacaucuacagcgggcccaagauuccuuucaaaggaguuugcaagaucggccugaucaaauauaaggaguguaaauuuaagaccucuuccuacgaaacaauuagcuucaucacccucaaggggaaaggaaagauuuauaucgagcaccugaugcugaaaaauauugagguggucacgaacguguccuucgucugcuacgaacaugccggccaggacgagcaagaaguggagcaccgggcgcucaagagaguuucugugaaugauuguaaaaucgucgacaacagcaagcagaaaaucugcacaggcgaucacaucuuuugugagaaguacgacugcuccaccucuuaucccgaugugaccuguauucauacaccggggagcggaccucuguacauuaaccuuaugggcuccuggaucaagccccagugcguuggguaugaacgcgugcuggucgaccgggaggugaaacagccucuccuggugcccgaacaaaauugugauaccugcguuagcgagugucuugacgaaggaguccacauuaagucuacaggcuucgagaucacguccgccguggcuugcagccaugggucuugcaucuccgcccaccaggaggcuagcaccucugugauuauccccuacccuggccugcucgccagcgucggaggcagaauugggauccaucugucccacacaagcgauucugccuccgugcacaugguuguggucuguccgccccgcgacagcugcgcugcgcauaacugucugcucugcuaucacggcauucugaauuaccagugucauuccacccuuucugccauccugaccagcuuucuccugauccuguucauuuauacagcuuuuuccgugacgaccaacguucuuuacgugcuccggcugaucccuaaacagcugaagucucccgucggauggcucaaacuguucgugaauuggcuucugacagcccucagaauuaagacccgccggguuauggggagaaucaaccaacgcauuggauggguggaucaccacgacgucgaacggccuagacaucgcgagcccaugcggagauuuaagacaacccugcugcuuacgcucaucauggugacaggcgggaaugccugcagcaacaccguggucgcuaauuccaaacagacacgguguguucaggaaggcucuaacaccaagugcagcauuaccgccacaaucacgcugcgcgcgggagugaucggcgcugaguccuguuucauuaucaaagggccgauggaaaaucagcaaaagaccauuagcaucaaaacaauuucuuccgagaccgugugcagagagggaagcucuuuuuggacaucccuguacaucccuagcugucucucuucccggagaugccaccuggucggcgauugcguggggaacaagugucagagcuggcgcgacgaccagcuuucccgggaauuuagcggaguuaaggauaaucauaucaugaacgagaauaaaugcuuugaacaauguggcgccauugggugcggcuguuucaacaucaaccccucuugccuguaugugcacgccuaccucaagagcgcuagaaaugaggccguccgcguguuuuccuguucugacuggguucauagagugagcuucgaagucaaaggaccugauggcgagauggagcuggugacccuggggucccuuggaacgaaguuccucaacuggggcacacugucucugagccucgacgcugaagggauuuccggaaccaauucuaucagcuuucuggaguccagcaaaggcggguucgcccuuuaugaugaaggcuacucugagauuccccgggagggauuucugggcgaaauccgcugcuccagcgagucugcggccaucuccgcucacaagagcuguauuagagccccugggcucaucaaguauaaacccaugaccgaccagauugaaugcacagcuucccugguugauccguucgccaucuuucugaagggaucucuuccucagacccggaacggccagacauucacgagcaccaaagacaagaaaacagugcaagcguuuaccaauggggccauuaaggcucuccuguccaucaaccuggaugaccacgagauuaucuucaucaauaaagucaagagcugugaugccacauuucucaacgugucuggaugcuacuccugcgacuauggcgcucaugugugugucaagguuaaaagcucugaaagcgccgauuucuuugccgaguccgaggacaagaccacggugcugucuuuccccauucagagcggcacccgcgacuacugccaggugcuucacuuucagaaaccccuggucgaugaaagacucuccuacucuugugggagcgagccuaagcugaucgugauuaaaggaacacugguuuauaugggcguguacgacuuccggaauaagaccgggggauccagcacagucaucaacccgucugaaggcaccugguccauuagcaauugguucuccgggcuucuggauuggcucggaggccccaugaaggcuauccugaaaauccucggcuuuauugcgaucgggauugugugcuucauccuguuuaugauucuuauccgcaucgccguuaacucuauuaauaucaagaaaaagaacuga

SEQ ID NO: 14367 - RNA, 3942 nt, Artificial Sequence
  derived and/or modified CDS sequence (opt5) from PTV(GML488831)__KP272032.1__GP
augaucuucaccauucugaacgugcucacaagagccaugcuggucaugagcauguacucccuuacgaccugggacucuacaagccggaaugauaugugcuuuuccaacgacucuccccuggagggccucguuuauuacugggaaacccacagcaagaaacaugauuauaagaaacaggagucccaacgcuguagagugggggacucugauaagaaaaugaucacaaaugugaccauuaucagccugauuuccgaaauccagaaaagcaucucugagcuuucccugagcugcggaaacgacgauaauucuacaggccagguccucaccuucaacgggcuggaagacacgauucggggagauuacaucguggacuguguuaccggccuguaucaguccgauauuggggugggagucggccucggccgcgcucaccaugaccaccaacaggugaagaauaaggccguugugaucgaugagaaggagagaaugauuagccugcuugaaacacagcagucugagaacgacaucaaaaugcaaguccugauguccgaaauugagcagcucaagaaucagcugagcaaaaagcggaacgagcgcgggcaggaaaagagagacgcggagaaagugauguccgaucuuauggcucgcaauucugaccugcggaagcauaacgauauccucaccgccgaaaucagccaaaugaaauacaauaacacaauucagagauccaagaaugugaugagcaccacggucguuccugccauccugucuguggcucugcucuccagcucuguggccccgauuauggcugcgcccccugacagccccaugaucaacccuuggccccacgccaaaaaccgggucggaacaggcauguauaaguacgaugacaaugaugacuccgggugccgcccuauuagauacggagugucuuguaucggcuuugauuucaugcugaaaauggacaaguauccguuuuucaacgccuuuaucgggcacaagacaccccuugagagcuucgcugauaaaauuaucgaaaaggaggaggaaacaugcgagauuggaaccaauaaagaauuuaaguguuucgaggaacgggccuacaucaaagggaccugcccuacaaacauuaaugcuguucauuauaucgacaacaagggcaagcugcgcuacgugaaauguaaggagaaucucgagaugacggaagacugcgccuuuuguagaaaaaucaagaaaaaggcgggccaguccguccaagugcagaagaccagcguuucucugcaggaugccauuugccaggagaacuccgacaauuauagcggacccaaaaucccuuucaagggcgugugcaaaauugggcuuaucaaguacaaagaauguaaguuuaagacaucuuccuaugagaccgucagcuucauuacacugaaagaaaagggaaaaaucuacauugagcaccucaugcugaagaacaucgagguggucaccaauguguccuucguuugcuacgaacaugcuggccaagaugagcaggaaguggagcaccgggcccugaaaagagucucugugaacgacuguaagaucguugauaauagcaaacagaagauuugcacgggggaccacguguuuugugagaaguaugauugcuccacaucuuaccccgacgucaccuguauccaugcuccgggaagcggcccucucuauauuaaccugaugggcuccuggaucaaaccccagugcgugggguacgaacgcgugcuuguugaucgggaggucaagcaaccucugcucgcccccgaacagaauugugauaccugcgugagcgagugucuggacgaaggagugcacauuaaaucuacaggcuucgagaucaccuccgccgucgcuugcagccaugggucuugcaucuccgcgcaccaggaggccagcacaucugugauuguucccuauccuggacuucuggcuagcgugggcgggagaaucggcauucaucucucccacacgagcgacucugccuccguccacauggugguuguguguccgccccgcgauagcugcgccgcucauaacugucugcugugcuaccacggaauccucaacuaucagugucauuccacccugucugccauucuuaccagcuuucugcucauccuguucaucuacaccgucuuuuccgugacaaccaauaugcuguacguucuucggcucauuccuaagcaacugaaaucucccgugggcuggcugaaacucuucaucaacuggcugcuuacggcgcugagaauuaagacccgcaaugucauggggcggaucaaccagagaauuggauggguggaccaccacgacguggaacgcccucggcauagagagcccaugcgccgguuuaagacaacccuccugcugacacuuaucaugaugaccggcgggaaugcuugcagcaacacggucguugccaauuccaagcagacaagaugugugcaggaaggaucuaacaccaaaugcagcaucacagccaccauuacccuccgggcuggcgugaucggggccgaguccuguuucauuaucaagggcccgauggaaaaucaacagaaaacaauuagcaucaagacgauuucuuccgagaccgucugccgcgagggaagcucuuuuuggacaucccuguauaucccuagcugucugucuuccagacggugccaccucgugggcgauugcguugggaacaagugucagagcuggagagacgaucaacugucccgcgaauuuagcggagugaaagacaaucauaucaugaacgagaauaagugcuuugaacaguguggcgcuauugggugcggauguuucaacaucaaucccucuugccuuuacguccacgccuaucugaaaagcgcgcggaacgaggccgugagaguuuucuccuguucugauugggugcaucgcgucagcuucgaagugaagggcccugacggggagaccgagcucguuacacugggcucccugggaaccaaauuccuuaacuggggcacgcucucucugagccuggaugcugaagggauuuccggaacaaauucuaucagcuuucucgaguccagcaagggcggguucgcccuguacgacgaaggauauucugagauucccagagagggcuuucuuggggaaauccggugcuccagcgagucugcugccaucuccgcgcacaagagcuguauucgcgccccuggccugaucaaauacaagcccaugaccgaucagauugaaugcaccgcuucccucguggacccguucgccaucuuucugaaaggaucucugccucagacaagaaacggccaaaccuucacaagcacgaaggauaaaaagaccguccaggcuuuuacaaauggggccauuaaagcccuucucuccaucaaccuggacgaucacgagaucguguucauuaauaaggugcggagcugugacgcuaccuuucugaacgucucuggaugcuauuccugcgacuacggcgcgcauguuugugugaaggugaaaagcucugaaagcgccgauuucuuugcugaguccgaggacaagacaaccguccucucuuuccccauccagagcgggacgcacgauuacugccaggugcugcauuuucaaaaaccccuuguugacgaacgccuguccuauucuuguggaagcgagccuaagcucauugugaucaaaggcacccuggucuacauuggcguguaugauuucagaaauaagacagggggauccagcaccguugugaacccgucugaaggcgccugguccaucagcaauugguucuccgggcugcuugacuggcugggaggccccaugaaggccauucucaaaauccugggguuuaucgcuauuggaaucgucugcuucauucucuuuaugauccugauucggaucgccgugaacucuaucaauauuaagaaaaagaacuga

SEQ ID NO: 14368 - RNA, 3942 nt, Artificial Sequence
  derived and/or modified CDS sequence (opt5) from PTV(GML488778)__KP272038.1__GP
augaucuucaccauucugaacgugcucaucagagccaugcuggucaugagcauguacucccuuacaacgugggacucuaccagccggaaugauaugugcuuuuccaacgacucuccccuggagggccucguuuauuacugggaaacacacagcaagaaacaugauuauaagaaacaggagucccaacgcuguagagugggggacucugauaagaaaaugauuaccaaugugacaaucauuagccugaucuccgaaauccagaagucuauuucugagcuuucccugagcugcggaaacgacgauaauucuaccggccagguccucacauucaacgggcuggaagacaccauccggggagauuacauuguggacuguguuacgggccuguaucaguccgauaucggggugggagucggccucggccgcacccaccaugaccaccaacaggugaagaauaaagcuguugugauugaugagaaggagagaaugaucagccugcuugaaacacagcagucugagaacgacauuaaaaugcaaguccugauguccgaaaucgagcagcucaagaaucagcugagcaaaaagcggaacgagcgcgggcaggaaaagagagacgccgagaaagugauguccgaucuuauggcgcggaauagcgaccugcgcaagcauaacggaauccucaccgcugaaauuagccaaaugaaauacaauaacacagugcagagauccaagaaugucaugagcaccacgguugugccugccauccugucuguggcccugcucuccagcucugucgcuccgauuauggccgcucccccugauagccccaugaucaacccuuggccccacgccaaaaaccgggugggcacagggauguauaaguacgacgauaaugacgauuccggaugccgcccuauuagauacggcguuucuuguaucggguuugacuucaugcugaaaauggauaaguauccguuuuucaacgcguuuaucggacacaagacaccccuugagagcuucgccgacaaaauuaucgaaaaggaggaggaaaccugcgagauuggcaccaauaaagaauuuaaguguuucgaggaacgggcuuacaucaaaggaaccugcccuacaaacauuaaugccgugcauuauaucgauaacaaggggaagcugcgcuacgucaaauguaaggagaaucucgagaugacggaagacugcgcuuuuuguagaaaaaucaagaaaaaggccggacaguccgugcaaguucagaagaccagcgugucucugcaggacgcgauuugccaggagaacuccgauaauuauagcggccccaaaaucccuuucaagggggucugcaaaauuggacuuaucaaguacaaagaauguaaguuuaagacaucuuccuaugagaccgugagcuucauuacacugaaagaaaagggcaaaaucuacauugagcaccucaugcugaagaacaucgaggucgugaccaauguuuccuucgugugcuacgaacaugccgggcaagacgagcaggaagucgagcaccgggcucugaaaagagugucuguuaacgauuguaagaucguggacagcuccaaacagaagauuugcacgggagaucacgucuuuugugagaaguucgacugcucuacaagcuaucccgaugugaccuguauccaugccccgggcuccggcccucucuacauuaaucugauggggagcuggaucaaaccccagugcgugggauaugaacgcguucuugucgaccgggaggugaagcaaccucugcucgcucccgaacagaacugugauaccugcgugucugagugucuggacgaaggcguccacauuaaauccacaggguuugagaucaccagcgccguggccugcucucauggauccugcaucagcgcucaccaggaggcgucuacaagcguuauugugcccuacccuggccuucuggccuccgucgggggcagaaucggcauucaucucagccacacgucugauuccgcuagcgugcacaugguuguggucuguccgccccgcgacuccugcgccgcccauaauugucugcugugcuaucacggcauccucaacuaccagugucauucuacccugagcgcuauucuuacauccuuccugcucauccuguuuaucuauaccguguucucuguuacaaccaacaugcuguacgugcuucggcucauuccuaagcaacugaaaagccccgucggguggcugaagcucuuuaucaauuggcugcuuacggcccugagaauuaagacccgcaacgugaugggacggaucaaucagagaauuggcuggguggaucaccacgacgucgaacgcccucggcauagagagcccaugcgccgguucaaaacaacccuccugcugacacuuaucaugaugaccgggggaaacgcgugcuccaauacgguuguggcuaacucuaagcagacaagaugugugcaggaaggcagcaauaccaaaugcuccaucacagccaccauuacccuccgggccggggucaucggcgcugagagcuguuuuauuaucaagucuccgauggaaaaccaacagaaaacaauuuccaucaagacgauuagcucugagaccgugugccgcgagggauccagcuucuggacaucucuguacaucccuuccugucugagcuccagacggugccaccucguuggcgacugcguggggaauaagugucagagcuggagagaugaccaacugucucgcgaauuuagcggagucaaagauaaccauaucaugaaugagaacaagugcuucgaacaguguggcgccauugggugcggauguuuuaauaucaaccccuccugccuuuaugugcacgcuuaccugaaaucugcccggaaugaggcgguuagaguguucagcuguuccgacuggguccaucgcgugucuuucgaaguuaagggcccugauggggagaccgagcucgugacacugggcagccugggaaccaaauuucuuaacuggggcacgcucucccugucucuggacgccgaagggauuagcggaacaaacuccaucagcuuccucgagucuuccaagggcggguuugcucuguaugaugaaggauacagcgagauucccagagagggcuuccuuggggaaauccgguguucuuccgagagcgccgcuaucuccgcccacaagucuugcauucgcgcgccuggccugaucaaauauaagcccaugaccgaccagauugaaugcaccgccagccucgucgauccguuugcuaucuuccugaaaggaucccugccucagacaagaaauggccaaaccuuuacaagcacgaaggacaaaaagaccgugcaggccuucacaaacggggcuauuaaagcccuucucucuaucaaucuggaugaccacgagaucauuuuuaucaacaaggugcgguccugugaugccaccuuccugaaugucagcggaugcuacucuugcgacuauggcgcucauguuugugugaaggugaaaagcuccgaaucugcggacuuuuucgccgagagcgaggauaagacaaccguccucuccuuucccauucagucugggacgcacgacuacugccaggugcugcauuuccaaaaaccccuuguugaugaacgccugagcuacuccuguggaagcgagccuaagcucaucgugauuaaaggcacccuggucuauaugggcguguacgacuucagaaacaagacagggggaucuuccaccguugugaauccgagcgaaggcgcuugguccaucucuaacugguuuagcgggcugcuugauuggcugggaggccccaugaaggccauuaucaaaauccucggguucauugccaucggagucgugugcuuuauucuguucaugauccucauucggaucgcugucaauuccaucaacauuaagaaaaagaauuga

SEQ ID NO: 14369 - RNA, 3945 nt, Artificial Sequence
  derived and/or modified CDS sequence (opt5) from PTV(Adames)__DQ363407.1__GP
augaucuucaccauucugaacgugcucacaagagccaugcuggucaugagcauguacucccuuacgaccugggacucuagcucccggaaugauaucugcuuuucuaacgacagcccccuggagggccucguuuauuacugggaaacacacuccaagaaacaugauuauaagaaacaggggucucaaaagugucgcgugggagacagcgauaaaaagaugauuuccaaugugaccaucauuagccugaucucugagauccagaaguccauuagcgaacuuucucuguccugcggcaacaaugacaacagcacagggcagguccucaccuucaauggacuggaggauacaaucagaggcgacuacauuguggauuguguuaccgggcuguaucagucugacaucggagugggcgucggccucgggcggauuaaccacgaucaucaacaggugaaaaauaaggcuguugugaucgacgaaaaagagaagaugauuucccugcuugagacgcagcagagcgaaaacgauaucaaaacccaaguccugauguccgagaucgaacagcucaagaaucagcugucuaagcgcagaaacgagcggggacaggagaaacgcgacgccgaaaaacuuaugagcgaccugauggcgagaaauuccgaucuccggaaccacaaugugauucugacagacgagaucagccaaauuaagaacaacaucaccauucaucgcaauagaaacaugaugucuacaaccguggucccugcuauccuguccguugcccuccugagcucuagcgugggcccgaucacggccgcucccccugauuccacaaugauuaaucccuggccucacgccaagaaccggguggggaccggaauguacaaauaugacgaaaaugaugagucuggcugccgccccaucagauacggggucagcuguauuggauuugacuucaugcuuaagauggauaaauacccuuucuucaacgcuuuuaucggccacaagacaccgcuggaauccuucgccgacaagauuaucgagaaagaggaagagaccugcgaaaucggcaccaauaaggaguuuaaauguuucgaggaacgggcguauauuaaggggacaugccccacgaacaucaaugccgugcauuacauugauaacaaaggaaagcuccgcuauguuaaguguaaagagaaucuggaaaugaccgaggacugcgcuuuuuguagaaagaucaaaaagaaagccggccagagcgugcagguccaaaagacaucugugccucuucaggaugcuauuugccaggaaaacuccgacaucuacagcgggcccaagauuccuuucaaaggaguuugcaagaucggccugaucaaauauaaggaguguaaauuuaagaccucuuccuacgaaacaauuagcuucaucacccucaaggggaaaggaaagauuuauaucgagcaccugaugcugaaaaauauugagguggucacgaacguguccuucgucugcuacgaacaugccggccaggacgaugagcaagaaguggagcaccgggcgcucaagagaguuucugugaaugacuguaaaaucgucgauaacagcaagcagaaaaucugcacaggcgaccacaucuuuugugagaaguacgauugcuccaccucuuaucccgacgugaccuguauucauacaccggggagcggaccucuguacauuaaccuuaugggcuccuggaucaagccccagugcguuggguaugaacgcgugcuggucgaucgggaggugaaacagccucuccuggugcccgaacaaaauugugacacaugcguuagcgagugucuugaugaaggaguccacauuaagucuacaggcuucgagaucacguccgccguggcuugcagccaugggucuugcaucuccgcccaccaggaggcuagcaccucugugauuauccccuacccuggccugcucgccagcgucggaggcagaauugggauccaucugucccacacaagcgacucugccuccgugcacaugguuguggucuguccgccccgcgauagcugcgcugcgcauaacugucugcucugcuaucacggcauucugaauuaccagugucauuccacccuuucugccauccugaccagcuuucuccugauccuguucauuuauaccgcuuuuuccgugacgaccaacguucuuuacgugcuccggcugaucccuaaacagcugaagucucccgucggauggcucaaacuguucgugaauuggcuucugacagcccucagaauuaagacccgccggguuauggggagaaucaaccaacgcauuggauggguggaccaccacgaugucgaacggccuagacaucgcgagcccaugcggagauuuaagacaacccugcugcuuacgcucaucauggugacaggcgggaaugccugcagcaacaccguggucgcuaauuccaaacagacacgguguguucaggaaggcucuaacaccaagugcagcauuaccgccacaaucacgcugcgcgcgggagugaucggcgcugaguccuguuucauuaucaaagggccgauggaaaaucagcaaaagaccauuagcaucaaaacaauuucuuccgagaccgugugcagagagggaagcucuuuuuggacaucccuguacaucccuagcugucucucuucccggagaugccaccuggucggcgacugcguggggaacaagugucagagcuggcgcgacgaucagcuuucccgggaauuuagcggaguuaaggacaaucauaucaugaacgagaauaaaugcuuugaacaauguggcgccauugggugcggcuguuucaacaucaaccccucuugccuguaugugcacgccuaccucaagagcgcuagaaaugaggccguccgcguguuuuccuguucugauuggguucauagagugagcuucgaagucaaaggaccugacggcgagauggagcuggugacccuggggucccuuggaacgaaguuccucaacuggggcacacugucucugagccucgaugcugaagggauuuccggaaccaauucuaucagcuuucuggaguccagcaaaggcggguucgcccuuuaugacgaaggcuacucugagauuccccgggagggauuucugggcgaaauccgcugcuccagcgagucugcggccaucuccgcucacaagagcuguauuagagccccugggcucaucaaguauaaacccaugaccgaucagauugaaugcacagcuucccugguugacccguucgccaucuuucugaagggaucucuuccucagacccggaacggccagacauucacgagcaccaaagauaagaaaacagugcaagcguuuaccaauggggccauuaaggcucuccuguccaucaaccuggacgaucacgagauuaucuucaucaauaaagucaagagcugugacgccacauuucucaacgugucuggaugcuacuccugcgauuauggcgcucaugugugugucaagguuaaaagcucugaaagcgccgacuucuuugccgaguccgaggacaagaccacggugcugucuuuccccauucagagcggcacccgcgauuacugccaggugcuucacuuucagaaaccccuggucgacgaaagacucuccuacucuugugggagcgagccuaagcugaucgugauuaaaggaacacugguuuauaugggcguguacgauuuccgggacaagaccgggggauccagcacagucaucaauccgucugaaggcaccugguccauuagcaacugguucuccgggcuucuggauuggcucggaggccccaugaaggcuauccugaaaauccucggcuuuauugcgaucgggauugugugcuucauccuguuuaugauucuuauccgcaucgccguuaauucuauuaacaucaagaaaaagaauuga

SEQ ID NO: 14370 - RNA, 3942 nt, Artificial Sequence
  derived and/or modified CDS sequence (opt5) from PTV__M11156.1__GP
augaucuucaccauucugaacgugcucacaagagccaugcuggucaugagcauguacucccuuacgaccugggacucuacaagccggaaugauaugugcuuuuccaacgacucuccccuggagggccucguuuauuacugggaaacccacagcaagcgccaugauuauaaaaagcaggagucccaaagaugucgggugggggacucugauaaaaagaugaucacaaaugugaccauuaucagccugauuuccgaaauccagaaaagcaucucugagcuuucccugagcugcgucaacgacgauaauucuacaggacaggugcucaccuucaacggccuggaagacacgauucgcggggauuacaucguugacugugugaccggacuguaucaguccgauauuggcgucggggugggacucggcagaacacaccauggccaccaacagaugaagaauaaggcuguugugaucgacgagaaagagcggaugauuagccugcuugaaacccagcagucugagaacgauaucaagaugcaaguccugauguccgaaauugagcagcucaaaaaucagcugagcaagaaacgcaacgagagagggcaggaaaagcgggacgccgagaaggugauguccgaccuuauggcgcgcaauucugaucugagaaaacauaacgacauccucacagcugaaaucagccaaaugaagaauaaaaacaccauucagcggaauaagaacacgguguccacaaccgucguuccugccauccugagcguggcccugcucucuuccagcguggcuccgauuaucgccgcucccccugauucucccaugauuaacccuuggccccacgccaaaaaucgcgucggaacaggcauguacaaguaugacgagaacgaugacagcgggugcagaccuauccgguacggaguguccuguaucggcuuugauuucaugcugaaaauggacaaguacccguuuuucaaugcguuuauugggcacaagacaccccuugaaucuuucgccgauaaaaucauugagaaggaggaagagaccugcgaaaucggaaccaacaaagaguuuaaguguuucgaggaacgcgcuuauauuaaaggcacgugcccuaccaauaucaacgccguucauuacaucgacaauaagggcaagcugagauaugugaaauguaaggagaaccucgaaaugacagaggauugcgcuuuuugucggaaaauuaagaaaaaggccgggcagagcguccaagugcagaagaccuccguuccccugcaggacgcgaucugccaggaaaauagcgacacauacucuggaccuaaaauucccuucaagggcgugugcaaaaucgggcuuauuaaguauaaagaguguaaguuuaagaccuccagcuacgaaacggucucuuucaucacacugaaagagaagggaaaaauuuauaucgagcaccucaugcugaagaacaucgaaguggucaccaauguguccuucguuugcuacgagcaugugggccaagaugaacaggaggucgagcacagagcccugaaacgcgugagcguuaacgacuguaagauuguggauaauuccaaacagaagaucugcaccggggaccacgucuuuugugaaaaguacgauugcucuacaagcuauccggacgugaccuguauucaugcuccuggauccggcccccucuacaucaaccugaugggcucuuggauuaaaccucagugcgugggguaugagcggguucuugucgauagagaagugaagcaaccccugcucgcccccgagcagaauugugacacaugcgugagcgaaugucuggaugagggaguccacaucaaauccacgggcuucgagaucaccagcgcuguggccugcucucauggguccugcauuagcgcccaccaggaaccuucuacauccguuaucgugccguaccccggacuucuggcuagcgucggcgggcgcauuggcauccaucucucucacaccagcgacuccgcgagcgugcacaugguuguggucuguccuccccgggauucuugcgccgcucauaacugucugcugugcuaucacggcauucucaacuaccagugucauuccacacugagcgccauccuuaccuccuuucugcucauccuguucauuuauacgguguuuucuguuaccacaaauauccuguacgugcuuagacucauuccuaagcaacugaaaagccccgucggcuggcugaaacucuucaucaacuggcugcuuaccgcccugcgcauuaagacacggaaugugaugagacgcaucaaccagcggaucggguggguggaccaccacgaugucgagagaccgcgccaucgggaaccuaugagacgguuuaagaccacgcuccugcugacacuuauuaugaugaccggaggcaaugcuugcuccaacacaguuguggccaauucuaagcagacccgcugugugcaggaggggagcaacaccaaaugcuccaucacagcgacgauuacccucagagcuggagucaucggcgccgaaucuuguuucauuaucaaggggcccauggagaaucaacagaaaacaauuagcaucaagaccaucuccagcgagacagugugccgggaaggaucuuccuuuuggaccagccuguacauuccuucuugucuguccagcagacgcugccaccucguuggagacugcgugggcaacaagugucagucuuggcgggacgaucaacuguccagagaguucagcggggucaaagacaaucauaucaugaacgaaaauaagugcuuugagcaguguggagccauuggcugcggguguuucaacaucaaucccuccugccuuuaugugcacgcuuaccugaaaagcgcccgcaacgaagcuguuagaguguuuucuuguagcgauuggguccaucggguguccuucgagguuaagggaccugacggcgagacggaacucgugacacuggggucucccggcaccaaauuccugaacuggggaacccuuagccucucccuggaugccgagggcauuucugggacaaauagcaucuccuuucuggaaucuagcaagggaggcuucgcgcucuaugacgagggguacaacgagaucccgcgcgaaggauuucugggcgagauuagaugcuccagcgaaucugccgcuaucuccgcccacaagagcuguauucgggcuccugggcuuaucaaauauaagcccaugaccgaucagauugagugcacagccucucuggucgaccccuucgcgaucuuucucaaaggcucccugccucagacgcgcaauggacaaaccuucacaagcaccaaggauaaaaagacagugcaggccuuuaccaacggcgcuaucaaagcccugcuuuccauuaaucucgacgaucacgaaaucguguucauuaacaaggucaagaauugugacgcuacguuucugaacguuucugggugcuacagcugcgauuauggagcccaugugugugugaaagucaaguccagcgagucugccgacuucuuugcugaguccgaagacaaaaccacagugcugagcuucccgauccagucuggcacccacgauuacugccagguucuccauuuucaaaagccccugguggacgagagacuuagcuacuccugugggucugaaccuaaacugauugucaucaagggaacacucgugugcaugggcguuuaugauuuccggaauaagaccggcgggagcuccacaguggucaaccccucugagggagcguggagcauuuccaauugguucagcggccugcuggacuggcuugggggaccuaugaaagccauccugaagauccucggcuuuauugcuaucgggauuguguguuucguccuguuuaugauccucauucgcaucgccgugaacucuaucaauauuaaaaagaaaaacuga

SEQ ID NO: 14371 - RNA, 3852 nt, Artificial Sequence
  derived and/or modified CDS sequence (opt5) from Phlebovirus(CoAr170255)__HM566149.1__GP
auguacaagcugaucaccaacauucucaaacugagcguggucuccgccauguauucuaucauguucugggaccccacaggcauuagcaagcugugccuguccaauaacucuccucucgaggggcugguuuacuauugggaaaauacgaugagagagggagaauuuaaacgggagaagcgcaaaaaguguagacuuggcaucagcgaaccggcucccguguccaaccagaccauugugucucugaucgaggagguccaaaagagcccugccgaaaugauccucauuugcgaggcgaaugggaacuccacaggaagcucucuguccuucgauggccugagcgacaaugaaaucaaacccucuauuguggauuguaccacaggggaccggaccuccgaucuccgcguucuggugggaaagggcaucuuugagaaaaagaugagcaugucuaacgagauugacagagucgugucccuugaagaucaccuucagcgggagaaagaacucguucagacauuccaggaccugcaucacaaugagagcgaaaagaacaaacuucuggagcaugagcucgaaaaugugcgccaacagcugaagagagagcgggaauccaacaagaucaaaauguggaccacgaagcgcccugagauuaccacaaucggccugaccacaaccaucgcuacgauucuccuggccucucagagcgucgccuccagcgugcccaugccugggcagcuuaauacauggccgcacgcuaaaaacagagugggaggcggggucuuuaaggccaaugaugacgaugaagacucuugcaaacugaucgauuacggaauugcuugucauggcuucgacuaucuccugcggaccgacaucuaccccuuuuucaacgcccacguuucccaccgcagccuucuggaggcgucuaacgaggggauuauccucaaggaugaagccagcugcgagaucgaaacaaauaaggacuuuaaauguuaugaggaaagagcuuuccugaagugguccugcccucaucuggugaacucugcccacuuuauugauagcaaaggaaagcuccggaucauuaaauguaaggcugaguacgagaucaccgaagacugcaccuacugucgcagaauuaagaaaaaggccgcgcaacagaaacagguguauaaguccagcaucgcccugcaggaugcugucugccaagaaaauucugacuacuaugauggcccccggaucacauucacgggcgugugcaaaauugggaccauggaguacaagaaguguaaacauaaguccagcucuuuugagaacaucggauucauuacaaucagagacaaaggcaaguauuacauugagaauaugcgcaccaaaaacaucgaaaugguuuccaaugugagcuucauuugcuauaaccacaaugggcaggauacagagaaggacguccggcuucugaagagagugaaaccuggagauuguaagguuguggacgacuccaaaaccaagcacugcacgggcgaucaugucuuuugugaaaaauacgacugcacaaagucuuaccccgaggccaccuguaugcacgcuccggggagcggaccuauccucgugcuggucaugggcgugugguucaaaccccagugcguuggcuaugaacgcgugcuugucgagcgggaggugaaggccccuguucugauccaagaaaaggauugugauaccugcguguuugagugucucgaagacaaaauucugaucaaguccacaggguucaaaaugauuucugccgucgcuugcagccauggauccugcgugagcucucaccagucccccagcaccuuucuguacaucgacuaucccggccucacagcgucuguugggggagagauuggccugcaucuuucccacacggaugacagcgugucuguccacaagaaaauccauuguccugccagagauccgugcgaagcucacagcuguaucgugugcuaccaugggcuggugaacuaucagugucacaccguccucuccuacagcgugguuucuuuccugcuggugugcaugauguaucuugccuuuuucauuacaucccgccuccuguuuuuccugcggaucaugcccagacgccuccggaauccuauuagcuggcugacccuucugaucagauggguccuccagacacugcuggccauucuucgccucuccuuuaagaagcugucugagaccaucggcuggaacagccccaauaaccggcaacagauggacguggaggcuaauagacggccucugcgcagauaccggacgaccuucauccucacacugcuuuuuguuggacugaccuccgccuguucuaacacagcggugagcaacuccaaacagaccaagugccuccagucuggcgggagcgucaaauguuccauuacggcuacaaucacccugaaggccggaacaauuggcgccgaaagcugcuucaucauuaaagggcccucugagaaucaacagaaggugaucagaguuaagaccguguccagcgaaaccgucugucgcgagggaucuuccuucuggacaggccaguuuacgccgagcugcgugucuucccggagaugccaccuggugggggauugugucggcaaccgcugccaggcuuggagagacgaaguugugagccgggaguucggaaauaugaaagauaacaaugugauguccgagaacaaguguuuugaacaaugcggcgccgcuggguguggaugcuucaauaucaacccuagcugucuuuacguccauucuaccuuuaaaagcgugcgcagagaggccauucggguuuucaagugcaaugacugggugcaccgccucacauuugaagucuccggccccucuggggagaaagacagaaucgugcugaacagccuguccaccaaguuccuccaguggggaacaauuucucugagccuugaugcggagggcaucuccgggaccaauucuuauagcuuucuggaauccaacaagggcggauucgccauucaugacgaggaauuuagcgagaucccucgggaaggcuaccucggggagauucgcuguucuuccgagagcgcuguuaucgccgcucacaaaucuugcaucagagcccccaaucugauuaaguauaaaccuaugacggaucagaucgacuguacagcgucccugguggaucccuucgccauuuuucuuaagggaagccucccgcagucccggucuggcuacaccuucaccagcuccacagacaaaaagaccguccaggcuuucaacagcgggucuaucaaagcccugauuuccaucaauauggaugaccaugaaaucgaguuucugaacgaugcugccgacugcgaugccacauuccucaacgugagcggaugcuauucuuguaauuacggcgcucaaguuugcauuaaggugcgcagcuccaagucuagcaucuuuuccucuaacaauaacgacaauagcauugucaucaacuucgaugcggaccaggggacgagagacuauugucggauuauccacuuuaauggcccucugguggaugaaacccuucacuacuccugcggaggcgagagcaaacugcuccaaaugaaggggucucugaucacagugggacccuacgacuucagaaacaccacaggcgggaaauccaccauugucaauccccaugaagagagcuggaaccuguuuuccugguucucuggacuucuggauuggcucggcggcccucugcgcgccauccucaagauuguucugaucauuaucauugggaucauccuuuuuauugugguggcuuuccugauccggcucgucauuuuuaaugugcugcugaaaagcaagaagaacuga

SEQ ID NO: 14372 - RNA, 3873 nt, Artificial Sequence
  derived and/or modified CDS sequence (opt5) from Phlebovirus(CoAr171616)__HM566154.1__GP
auguuccagaucauuuaccugcucaccaagcuguaucuugugagcuccauguacucuaucauguuuugggagaacgaaaauauuagcaaacugugccucuccaacaauucuccccuggagggccuugucuauuacugggaaaacguuaugaaggagggggacuucaaagaagagaagcggaaaaaguguagaaucggaccuagcgaucugaagcgcgugacaaaucaaacgcucaccacacugauugaggaagugcagaaauccccgucugagauccagcugcucugcgaagaggacggcaacaagaccgggaucagcauguuuuucgauggacuguccgacgauauuagcacacccucuaucgucgacuguaauggcaacauuagaaucuccgaucuucgggugcagguugggcgcggacacuuugagaaagaaaaugagauuagaaagaucgaagagauugugacccuggaagacgaucuccggcgcgagagagaccugaacaaacuucugcaagaucucaauaagaaggacgccgaggaacggcgcaucaucgagcaugaacugacaaacaugagagagcagcugcagcgggaacgcgagagaagcaaacagcaaauuaaggagcacgagaaaaucgaagucaauaaccauaaggaaccugcuacccaccucaaugugucuaaacugcuuacgauuggccugcucgcccagcagguuggccaggugaucgcgaccgagcccgggcaacugaacacauggauucaugcuaagaaccggaucggaaaaggccuuuauaagaccgaagauacagacgaggacgggugccgcggacuggauuacggcgucuccugucucggguucgacuaucugcugagaaccgauaucuacccuuucuucaauagcuuugugucucaccucuccaugcuggaggccagcacggaagaccuuauugagaaggaaggaacauccugcgagaucgagaccaacaaagaauuuaaguguuacgaggaacgggccuuuauuaaaggcucuugcccccaccuggugaauagcgcucauuuccucgauaacaagggcaaacugagaaucgucaaguguaagacagacuuugagaugaccgaagauugcaccuucugucgcaaaauuaagaaaaagaacucccagcacaaacagguuuucaagacaagcaucgcccuucaagacgcugugugccagaauaauucugaucuguauaacgggccucggaucguguacuccaaugucugcaagauuggaauggugagcuauaaacaguguaagucuaaaacgagcuccuacgagucuguuggcuuugugauccucaaggggaaaggaaaguucuauauugagaacaugaagaucaaaaauauugaagucaucgccaacgugagcuuuauuugccaucaguaccaaggccaggacgggaccgagaaggaacagagaucccugaaacgcaucagcguuggagaguguaagucugugaauccgcagaaaacaaagcacugcaccggcgaucacgucuucugugaaaaauaugacugcacaaaguccuaccccgaggugaccugucugauggcgccuggcagcgggcccauccucguccaaauuaugggaucuuggaucaagccucagugcgugggcuacgagaaaguucugguggaacgggaggucaagucccccacgcuuacagaagagagagacugugauaccugcguguaugaaugucuggaggacaaaauucucaucaagagcaccggguuuaaaaugauuuccgccguugcuugcucucauggaaugugcgugagcucccaccaggagccgucuacauuccuguacaucaacuauccuggcaugagcgccuccaucgggggcgaaauuggacugcaucuuagccacaccgaugacucucucucccugcauaaggucaucagcugucccucucgcaauccuugcgaugugcacuccuguauuaucugcuaccacggcauuaucaacuaucagugucauacagcucugagcuacacgaucguggccuuuucuuucauuagcuuucucuaucugaccuucaagguuaucucccaacuucuguacacauuuaaagucgugcccaagaaacucaaggggcccuucuacuggaugggauaucugauuaaauggaucgugaagaccauucugggcgucgugcggaacacauuuuucaccaugagcaauagaaucgggugggagcgccgggacgaaauccacgaggauauugaggcgaacccuagacgccaucuucagcgguucaagacgaccuuuguucucacaaugcugaugaucaauggaggccugugcuguucuaacacccucguguccaauagcaaacagacaagaugcguccaguccgggaacgaagugaaguguucuguuagcgccaccgugguccugaaagcuggcgugauuggagccgaguccugcuucaucauuaagggcccgucugaaaaucaacacaaaaugaucagcguucggacgcuuuccucugagacagugugucgcgaaggggcuagcuuuuggaccggacacuucucccccagcugcgucucuuccagacggugccaucuggugggcgagugucacgggaacagaugccagagcuggcgcgacgaucagauuucucgggaguuuggaggcgugaaggacaauaacagaauguccgaaaauaaguguuucgagcaaugcgggagcaucggcuguggaugcuuuaacaugaauccuucuugucucuacguccauacaacccugaaauccgcccgcaacgaagccguuagaguguucaagugcaaugauuggauccaccggcugaacuuugaggugauuggccccagcggggaaaaagacgucgugacccuuaacuccaugagcacaaaguuccuccaguggggaacgaucucucugagccuggaugcugagggcauuaccgggacaaauuccuauucuuuucucgagagcuccaaaggaggcuucgcgauccaugacgaagaguuuucugacauuccucgcgaaggguaccugggcgagaucagauguagcuccgaaucugccguuaucagcgcucacuccagcugcauucgggcccccgaucuuaucaaguauaaaccgaugaccgaccagauugaguguacaucuacccugaucgauccuuucgccauuuucaugaagggaucccucccccagacgcgcagcggcuacacauuuaccucuuccaaggacaaaaagaccauccaggcuuucaacacaaauagcaucaaagcccugauuucccugaaccuugaugaccacgagaucguguuugucucugaucaaaccaauugcgaaugcacauuccucaaccugacgggguguuauagcugcgacuacggagcgcauguguguuuuagaauuaaguccgauaaaaagggcguuuucgugagcaauaccgaggcuaaggacaucucuuuuggguucgaaguccugacaggaacccacgauuacugccagauucagcauuuuaacuccccuagcguguauaaaacacucucuuacagcuguggcggcgaguccaagcugcuuguuaucaaagggucucugauuaccaucggaccccacgacuaucggaauaagacgggcggggccagcaccguggucaacccuuccgaggaaggauggucugugacaaauuggaucggcggguucauuagcuggcucggaggcccccugaaagcccugcuuaagaucgcugugaccauucuggccggcgucguuaucuuucucauuaucuacuucuuccugcgccucaucgcuacaaacauucugaugaagaccaaaaagaauuga

SEQ ID NO: 14373 - RNA, 3852 nt, Artificial Sequence
  derived and/or modified CDS sequence (opt5) from Buenaventura virus(CoAr3319)__KP272002.1__GP
auguacaagcugaucaccaacauucucaaacugagcaugguguccgccauguauucuaucauguucugggaccccacaggcauuagcaagcugugccuguccaauaacucuccucucgaggggcuggucuacuauugggaaaauacgaugagagagggagaauuuaaacgggagaagcgcaaaaaguguagacuuggcaucagcgaaccggcucccguuuccaaccagaccauugugucucugaucgaggaggugcaaaagagcccugccgaaaugauccucauuugcgagacauccgggaaugcgaccggaagcucucuguccuucgauggccugagcgacaacgaagucaaacccucuaucguggauugugcuacaggggagcggaccuccgaccuccgcguucuggugggaaagggcacauuugagaaaaagaugagcaugucuaaugaaauugauagagucgugucccuugaggaccaucugcagcgggaacgcgagcucguucagaccuuccaggaucugcaccacaacgaaagcgagaaaaauaaacuucuggagcaugaacucgagaacgugagacaacagcugcggcgcgaaagagaguccaauaaggucaagguguggacgaccaagaaaccugaagugacaaccaucggccugacaaccacgauugccacaauccuccuggccucucagagcauugcuuccagcguccccaugccugggcagcuuaacaccuggccgcacgccaagaaucggguuggaggcgggguguuuaaagcuaacgacgaugacgaggauucuugcaagcugaucgacuacggaaucgccugucauggcuucgauuaucuccugcgcacagacauuuaccccuuuuucaaugcgcacgugucccacagaagcaugcuugaggccucuaacgaagggaucauucugaaagacgaggcuagcugcgaaaucgagaccaacaaggaucucaaguguuaugaggaacgggccuuucugaaaugguccugcccucaucuggucaauucugcucacuucauugacagcaagggaaaacuccgcaucaucaaguguaaagccgaguacgaaauuaccgaggauugcacauacuguagacggaucaagaagaaagcggcccaacagaaacagguguauaaguccagcauugcucugcaggacgccguuugccaagaaaacucugauuacuaugacggccccagaaucacguuuaccggcgugugcaagauuggguccauggaguacaaaaaguguaagcauaaaucuucuuccuucgagaaugucggauuuaucacaauccgcgauaagggcaaauauuacauugaaaacaugcggaucaagaauauugagauggugagcaacguuuccuucaucugcuauaaucacaacgggcaggacaccgaaaaagauauuagacuucugaagcgcgugaagccuucugacuguaaagucguggaugacagcaaguccaaacacugcacaggagaccauaucuucugugauaaguacgacugcaccaaaucuuaccccgaggcuagcuguaugcacgccccgggcuccgggccuauucucguccuggugaugggaguuugguuuaagccccagugcgugggcuaugaacggguccuuguggagagagagguuaaagugccuguccugacgcaagaaaaggauugugacacaugcguguucgagugucaggaagauaagauccucaucaaaagcaccggcuuuaagaugauuucugccguggcuugcucccaugggagcugcguuucuucccaccagagccccucuaccuuccuguacaucgacuaucccggacugacagcgagcgucggcggggagauuggacuccaucugucccacaccgaugacagcaucucugugcacaaaaagauucauuguccugcccgcgauccgugcgaagcucacaauugugugaucugcuaccauggccuuaucaacuaucagugucacacauuucuguccuacagcgucguguccuuccucuuuauuucuguucuguaucugacguucuuuaucgugagccggcuucuccuguuccugaaaauuaugcccaagagacucaagaauccuaucuccuggcugacccuucugauucgcuggguccuccaaacacugaucaccauccugcggcuuucuuuuaaaaagcucagcgagacaauuggguggaccacgaacgacaauagacagcacguggauguugaggccaaccgccggccccugagacgguaccgcaccacauucauccugacccuccuguuuauuggccuugccuccggaugcucuaauacagcugugagcaacuccaaacagaccaagugucugcagagcggcgggucugucaaaugcuccaucacggccacaauuacccucaaggcgggaaucaucggcgcugaaagcuguuucauuaucaaggggccuucugagaaccaacagagagugauucggguuaaaacaaucuccagcgaaaccgugugcagagagggaucuuccuucuggaccggccuguuuacacccagcugugucuccagccgccggugccaucuggugggggacugcgugggcaauagaugucagucuuggcgcgaugaagucguuagcagagaguucggaaacaugaaggacaauaacgccauguccgagaauaaaugcuuugaacaguguggcgccgcugggugcggauguuucaacauuaauccgucuugccuuuacgugcacagcguguuuaaguccguccggcgcgaggccaucagaguguucaaauguaacgacuggguucaucggcucacguuugaagugucuggcccuagcggggagaaggaucgcauuguccuuaauucccugucuaccaaguuccuccaauggggaacaaucagccugucccuugacgcugagggcaucagcgggaccaacucuuauuccuuucuggaaagcaauaaaggcggauucgccauucacgaugaggaauuuucugagauccccagagaaggcuaccucggggagauucggugcuccagcgaguccgcggugaucgccgcucauaagucuuguauucgcgccccuaaccugaucaaauauaagcccaugacagaccagaucgauugcaccgcuagccugguugacccuuucgccauuuuucuuaaaggaucccucccccagagcagaucuggcuacacguucacauccagcaccgauaagaaaaccgugcaggcguucaauucuggggccaucaaggcucugauuagcaucaaccuggacgaucacgaaauugaguuucucuccgacacagccgauugugacgcuaccuuccugaauaucucuggaugcuauagcugcaacuacggcgcccaagucuguaucaaggugcgguccucuaaaagcuccauuuuuagcucuaacaauaacgauaauuccaucguuauuaacuucgacgccgaacaggggacacgcgacuauugcagaaucauucacuuuaauggcccgcuuguggaugagacgcugcauuacagcuguggaggcgaauccaagcuccugcagaugaaagggucucugaucaccgucggaccuuacgacuuccggaacacaaccggcggaaagagcacaguggugaauccccacgaggaguccuggaaccuuuuuagcugguucagcgggcugcucgauuggcugggcggcccccucagagcuauucugaaaaucguccuuaucguuauuaucgggauuauccuguuuauugugguggucuuccucaugcgccuggcgauccugaaugugcuucugaaguccaagaaaaacuga

SEQ ID NO: 14374 - RNA, 3942 nt, Artificial Sequence
  derived and/or modified CDS sequence (opt5) from Cocle virus(GML244915)__KP272034.1__GP
augauguucacccaccuggacgugcucacaagagccaugcuggucaugagcauguacucccuuacgaccugggauucuauccggcgcaacgacauuugcuuuagcaaugauucuccccuggagggccucguuuauuacugggaaacacagucuaagaugcaugaguauaaaaaggaagacagccaaaaauguagagugggggauuccgagaagaaaaugaucucuaacgugaccauuaucagccugauuuccgaaauccagaaaagcaucucugagcuuucccugagcugcggaaaugacgauaacucuacaggccagguccucauguucaaugggcuggaggacaccauucggggagauuacaucguggacugucugacaggccucuaucaguccgauauugggguuggagugggcagcggcaagaccaaacacgaccauacgaagcugcgcaacaaagcugucaucauugaugaaaaggagaaaaugaucucucuucuggaagcccaacaguccgagaaugacauuaagacccaggugcucaugagcgagaucgaacagcugaagacacaacuucugaacagacgguccgagcgcgggcacgaaaagagaaagaaugaggaaaucguuucugaccucauggcgcggaacagcgaucugcgcaaacauaaugacauucugaaggaugagauggaccagaucaaagagaaccucaccauuuuuaaguccagaaaugcuaucagcacaaccucugugccugccauuauguccaucgcccugcuuagcucuagcgucaugccgaucauugcugccguguccgauucucccaugaucaacccuuggccccacgcuaaaaaucgggugggaagcggcauguacaaguaugacgauaacgacgaauccgggugccgcccuauuagauacggagucagcuguaucggcuucgaucacaugcugaagauggacaaauaccccuuuuucaacgccuuuauugggcauaagacgcuccuggagucuuucguugauaaaaucaucgaaaaggaggacgaaacaugcgagauuggaaccaauaaagaguuuaaguguuucgaggaacgggcguauaucaagggcacaugcccucacaacauuaaugccgugcauuaccuugacaacaaaggcaagcugcgcuaugugaaauguaaggaaaaucucgagaugaccgaagauugcgcuuuuuguagaaaaaucaagaagaaagccgggcaguccguccaggugcaaaagaccagcguuccgcugcaggacgcuauuugccaggauaacucugacaucuacacaggaccccggauuccuuauaaaggcaugugcaagaucgggcuggugaaauacaaggaguguaaguccaaaacgagcuccuaugagaccgucucuuucaucacacucaagggaaaaggcaagauuuacaucgaacaccugaugcuuaaaaauauugaggugguuaccaacgugagcuuugucugcuacgaacacgccgggcaaguggagcaggaggucgaacauagagcgcugaagcgcguguccguuaaugauuguaaaaucguggacucuagcaagcagaagauuugcacaggagaucacgucuucugugagaaauaugacugcuccaccagcuaccccgaugugacguguauccaggccccuggcucuggcccccucuauguuaaccugaugggguccuggaucaagccgcaaugcgugggauacgaacggguccuuguggagagagaagugaaacagccucugcucacacccgagcagaauugugauaccugcguuagcgagugucuggacgaaggcguccauauuaagucuaccggguucgagaucacauccgcuguggccugcagccacggaucuugcauuagcgcucaucaggaagccuccaccagcaucauugugccuuaucccggccugcucgccucugucgggggcaaaaucggacugcaccuuucccacacaagcgacuccgcuucugugcauaugaucguugugugucccccucgcgauagcugcgcggcccacaacugucugcucugcuaccauggcaugcugaauuaucaaugucacuccacgcugucugcuauucuuaccagcuuucuccugauccuguucauuuacacaaccuuuuccuucaucacaaacauucucuaccugcuucggcugcucccgaagcagcugaagucucccaucggguggcugaaacuuuuuaucaauuggcuuuucaccauucugagaauccgcacgaaguaucugaugggacggcucaaccagagaauuggcugggucgagaaccacgacguggaacgcccucggcccagagagccuaugcgccgguuuaaaaccacacugaugcuuaccaugcugaugaucacagggggauacgccugcagcaauaccguuguggccaacuccaagcagacgagauguguccaagagggcagcaauacaaaaugcucugugaccgcuacaguuacccucaaggccggggugauuggcgcggaauccuguuucgucaucaagggacccauggagaaccagcagaaaaccauuagcaucaagacagugucuuccgaaacggugugccgggagggcagcucuuuuuggaccucccuguauaucccgagcugucuguccagccgcagaugccaucuugucggggacugcguuggaaaucggugucagucuuggagagaagaucaacucagccgcgaguucuccggcgugaaagacaaccagauuaugaaugagaacaagugcuuugaacaguguggggcuaucggaugcggcuguuucaauauuaacccuucuugccuguacgugcacgccuaucugaaaagcgcccggaaugaggcugucagaguguuuuccuguucugauuggguucaucgcgugagcuucgaagucaaggggcccgacggcgagacagagcucgugacccugggaucccuuggcacaaaguuccugaacugggggacccucucucugagccuggaugccgaaggaaucacgggcacaaauucccuuagcuuucucgagucuuccaaagggggauucgcucuguacgacgaaggcuuuagcgagauuccuagagaaggguuccugggcgagauccggugcuccuccgagagcgccgcgaucuccgcccacaagucuuguauucgcgcucccggacucaucaaauauaagccuaugaccgaucaaauugaaugcaccgccagccugguugaccccuuugcuaucuuccuuaaaggcucccugccgcagacaagaaacgggcagaccuuuacaagcacgaaggauaaaaagaccgugcaggccuucacaaccggagcgauucgggcccuccugucuaucaaucuggacgaucaugagaucacauuuauuuccaagaucaaaaacugugaagcuaccuuccuuaacgucagcggcugcuacucuugcgacuacggggcccacguguguauuaagaucaaaagcuccgagucugcugauuuuuaugccgaaagcgaggacaagacgaccguucugucccucccugugucuagcggaacacaagacuacugccagguccugcacuuccagaaaccccucguggaugagcgccuguccuauagcuguggcucugaacccaagcucauggugauuaagggcacccuggucuacauggggguuuaugacuuuagaaauaaaacaggaggcuccagcaccguggugaacccuuccgaugccucuuggagcaucgcuaauugguucuccgggcuccuggacuggcugggaggcccgcuuaaggcgauucugaaaauccucggguucaucgccaugggagucgugugcuuuauucuguucaugauccucauuaagaucgcuguucggucugugaacaugaaaaagaagaauuga

SEQ ID NO: 14375 - RNA, 3873 nt, Artificial Sequence
  derived and/or modified CDS sequence (opt5) from Campana virus(VP-334K)__KP272041.1__GP
augcugcacuucaucaccauuacaacgaaguuucucgccguggcuagcauguacaaccugcuuuauugggaccccaauggccuguccagacucugccugucuaacaauagcccucuugaggggcuggucuacuauugggaaaaccucaugaaagaguccgauuucaagaaagacaagaaaaagcauugucggaucggaaccucuguugccgcgccggugacaaaugaaacccugacaacccugauugaggaagugcaaaagagccccuccgagaucauucuccaaugcgagucucgcaacaaugauacaggcaacagcaucuacuuugacgggcuggcugaugacaucgaauccccuagcauugucaauugugagucuggaaaaagagaauccgaucuucgggugcugguuggccaggggcucaagaaagagaucauucugaacgagaucgccgccauugaccgccaggcuagccuugaagaacaccugagaggagaaaaggcccucaccucucugcugcaggagaucuccaaacaagaugaagcugagcggaagcgccucgagcaugaagugagcucucugagacagcagcuuaugaaugagcgggaagagaacaagaaacgcaagaauauucccgccuucggcgucuccagcacgaccuccucuagccugaugaacaucuccagagugguuacaaucggccuccugagccagcaagcgauugccaauccuucucuucccggacaggugaacaccuggccucacgcuaaaaaccggaucgggcagggccuguaucgcauugacacauccgaugaagacgggugcagaggacucaauuacggcgucaucugucugggguuugaucaucugcuccggauggaccuguauccguucuuuaacgccuacgugagccaccuuucucugcucgaggcuuacaccgagaauauuauccagaaggacgaaacggagugcgaaaucgagggaggcaaagaguucaaguguuaugaggagcgcgccuacauuaaaggcgugugcccccacagaaucaagagcgcgcauuaucuggaucaaaaggggaaacuucggauuaucaaguguaaagaaaaccuggagcucacagaagacugcaccuacuguagaaagauuaaaaaggaucgcggacacacaaagcaggucuauaaaaccuccguuccucugcaggacgccaucugccaagauaauucugacgauuacagcggccccaagaucuccuuuaaaggggugugcaagauuggaaugaucgaguauaaagaguguaaguacaagucuucuuccuucgaaaccgugggcuuuauuacaaucaaagagaaggggaaauucuacauugaagacaugaagcugaaaaaccucgaggucacgaauaacguggcuuuuaucugccaucaguauaccggacaggauggcacaaccgacgaagagaaucggcaccugaagagaaugagcguuaaggauuguaaaaacgugaauagcuccaagagcaaauacugcacaggcgaccacauuuucugucaggucuaugacugcaccaaguccuacccugaggccacguguuucguggcucccgggucuggaccgguucuugugcaagucaugggcagcuggaucaaaccucagugcgugggguaugaaaagguccugguggagcgcgaaguuaaaaugcccauccucacagaggaacgggauugugauaccugcguguacgaguguaaggaggaccauauucugaucaaguccaccggauuuaacaugauuucugccgucgccugcagccacggcuccugcgugagcgcucaucaggacccuucuacauuccugaauaucgaauaucccgggauguccgcgagcguuggcggagagauuggcauccacaucucucauaccgaugacucccuuagccuccacaaaaagauuuacugucccgccagagauucuugcgaagcucacaacuguaucaugugcuaccaugggcugauuaauuaucagugucacacagcccugagcuacgccguggucuccuuuauguucgugagcaucgcuuaugugauuuuuaacguucuccgccugguccuuguggcccugcauguggucccucggaaacucaagucuccgaucgacuggcugauccugcuuauuaaauggguguuccuccugcuggcgaagguuaucagagcuuuucucacgcaccugaacaccacaauuggauggcgcgagcggcaaaauaacuucgccgccgaucuugaagcucagagacgcccccugcagcgguuuaagaccacagugcuccugaugaugaugcugaucuccgucgugagcuccugcucuaauagcguuguguccaacucuaaacagaccagauguauucaaagcggcuccaauacgaagugcucugucagcgccaccaucacacuuaaagcuggggugaucggagccgaguccuguuucguuauuaagggcccuagcgagaaccagcacaaaaccaucgugauucggacagucucuuccgaaaccaucugccgcgaggggagcucuuuuuggacgggccauuucacacccuccugucucagcucuagacggugccaccuggugggagacugcgugggcuccagaugucagggguggcgcgaagaugucauuagccgggaguuuggaggcguuaaggacaauaaccagauguccgagaauaagugcuucgaacaauguggggcggccggaugcggcuguuucaacaucaauccuagcugccuguacgugcauaccauucucagaucugcucgcaacgaggccgugagagucuuuaaauguaaugauugggugcacaagcugacauuccauaucaaagggcccaacggcgaagaggaagacguugugcuuaauagccuguccaccaaguuucucucuuggggaaccaucagccugucccuggacucugagggcauuacagggacgaacagcuauuccuuccuugagucuagcaaaggaggcuuugcuauccacgaugaagaguucuccgaaauuccgcgggagggguuucucggagaaauccgcugcagcucugaguccgccgucgugagcgcgcacaagucuuguauuagagccccuggccugaucaaguacaaacccaugaccgaccagguugagugcuccgcuagccugguggauccuuucgccaucuuuauuaaggggucccucccccagacacggucuggcuauaccuucacaagcucccgcgacaaaagaaccauccaggcuuuuaacaauggagccauuaaggcccugcuuacgcugaaccucgaugaccaugaagucaucuucagcgagucugugauuacaugugaaugcaccuuucugaauaucuccggcugcuacagcuguaacuucggggcucagguuugcuucaaaaucaagucuagcggaauuggcgauuuuguguccucuagcgagaccgggaauauccuguucuccuuuccugucaaaucuggaacagaagacuacugucagauucagcacuucaacagccccaugguguccgagagccuucaauauucuugcggcggcgaguccaagcugcuccugaucaaggggagccucauuuccgugggaccguacgauuaucggaauaaaaccggcgggucuagcacagucguuaacccugcggaagacuccuggucuaucuuuaauuggcugagcggauuccuugauuggcugggcgggccccuccgcgcccuggugaagauugcucuggccaucaucggagcccuugcucugcucuuuauuacgaucaugcuggccagauccgugauuagcaacacccucucucggaaaaagaaaaauuga

SEQ ID NO: 14376 - RNA, 3594 nt, Artificial Sequence
  derived and/or modified CDS sequence (opt5) from RVFV(ZH-548)__DQ380206.1__GP
auguacgugcugcucaccauccugauuagcguccuuguuugcgaggccgugaucagagugucccugucuagcacacgggaagagacguguuucggcgacuccaccaaccccgaaaugauugagggggcuugggauucucuccgcgaagaggagaugccugaagaacugagcugcuccaucucuggaauuagagaagucaagacaagcucccaggagcuuuaucgggcccugaaagcgaucaucgcugccgacggccucaauaacauuaccugucacgggaaggauccggaggacaaaaucagccugauuaagggacccccucauaaaaagcgcgugggcaucguuagaugcgaacggcgcagagaugccaagcaaauugggcgggagacaauggcuggaaucgccaugaccgugcugcccgcucucgccgucuuugcgcuggccccugugguuuucgcugaagacccccaccuucgcaauagaccuggcaaaggccauaacuacauugaugggaugacacaggaggacgccaccuguaagccggugacguaugcuggagccugcagcuccuuugauguccugcucgaaaaaggcaaguucccccuguuucagagcuacgcgcaccaucggacccuucuggaggccgugcacgacacaaucaucgcuaaagccgauccucccucuugugaccuccuguccgcucacgggaauccuugcaugaaggagaagcuggugaugaaaacccauugucccaacgauuaucagagcgcccacuaccucaauaacgacggaaagauggccucugucaaaugcccgccuaaguaugaacugacagaggacuguaauuucugccgccaaaugaccggcgcuucccuuaaaaaggggagcuacccccugcaggaucucuuuugccaguccucugaagacgauggaagcaaacugaagacgaagaugaaaggcguuugugaggugggcgugcaggcgcuuaagaaaugcgacgggcaacuguccacagcccaugaagucgugccuuucgcuguuuuuaagaacagcaaaaagguguaccucgauaagcuggaccugaaaaccgaggagaaucuccugcccgauucuuucgucuguuuugaacacaagggacaguauaaaggcacaauggacuccgggcagaccaagagagagcuuaaaucuuucgauauuucucagugccccaagaucggaggccacgggagcaagaaauguaccggagacgccgccuuuugcuccgcuuacgaauguacagcccaauaugcgaacgcuuacugcucucaugccaauggcagcggcauugugcagauccagguuuccgggguguggaagaaaccucugugugucggauaugagcggguggucgugaagcgcgaacucagcgccaaaccgauucaaagaguugagcccugcacgaccuguaucacaaagugcgagccucacggccuggugguccggucuaccggguucaagaucuccagcgcuguggccugcgcuucuggaguuugugugacaggcucccagagccccuccaccgaaauuacgcuuaaauacccugggaucucucagagcuccggcggagauauuggcguccauauggcccacgacgaccagucugugagcuccaagaucguggcgcauugucccccgcaagauccuugccugguucacgacugcauugucugugcccacgggcucaucaacuaucagugccauacagcucugagcgccuucgugguggucuuuguguucucuuccaucgcuauuaucugucuggccauucucuacagaguucugaaaugccuuaagaucgcgccccgcaaagugcugaauccucucauguggauuaccgccuuuauccgguggauuuacaagaaaauggucgcuagaguggccgauaacaucaaccagguuaaucgcgagaucggauggauggaaggcgggcagcuggugcugggaaaccccgcuccuauuccccggcacgccccgaucccuagauauagcaccuaccuuaugcuccugcugauugucucuuaugccuccgcuuguagcgagcucauccaagcgucuagccgcauuacaaccugcuccacagagggcgugaauacgaagugucggcugagcgggaccgcccuuaucagagcuggcucuguuggagccgaagccugccugaugcucaagggcgugaaagaggaccagacaaaguuccugaaaaucaagaccgucuccagcgaacuguccugccgcgaggggcagucuuacuggacaggcagcuuuucccccaaaugucuuucuagccggagaugccaucucgugggagaaugucacgugaaccgcugccuguccuggcgggauaaugagaccucugcugaguucagcuuugucggggaauccacgaccaugagagagaacaaguguuucgaacagugcggaggcuggggguguggcugcuuuaauguuaaccccagcugucuguucgugcacacauaucuccaaucugugcggaaggaggcccugcgcgucuuuaauugcauugacugggugcauaaacuuacccuggaaaucacagauuucgacggauccguuagcaccauugaucucggcgcgucuuccagcagauuuacgaacugggggucugugucccugagccuggacgcugagggaaucuccggcagcaauucuuucagcuucauugaguccccugggaagggauacgccaucgucgaugaaccguuuucugagaucccccggcagggcuuccuuggggaaauuagauguaacagcgaguccucugugcucagcgcccacgaauccugccugcgcgcuccuaaucugaucucuuauaaacccaugauugaccagcucgagugcacaaccaaccugaucgauccuuuuguuguguucgagcggggcagccuuccccagacaagaaaugacaagaccuuugccgcguccaaaggaaaccgcggcguccaggcuuucagcaaggggucugugcaagccgaccugacccucauguuugauaacuucgaaguugacuuugugggagccgcugucuccugugaugccgcuuuccugaaucugacaggcugcuacagcuguaacgccggggcgagagugugccuuucuauuacguccaccggaacaggcagccucuccgcccauaauaaggacggcucucugcacaucgugcugccuagcgagaacgggaccaaagaucagugucaaauccuccauuuuacaguccccgaaguugaggaggaguucauguacuccugcgacggagaugagcggccgcugcuugugaagggcacccugauugcuaucgacccuuuugaugaccgcagagaagccgggggagagagcacgguggucaaucccaaaucuggcuccuggaacuucuucgauugguuuagcgggcucaugucuugguucggaggcccucugaagacaauucugcuuaucugucuguauguggcucucagcauuggccuguuuuuccuccugaucuaccuugggcggaccggacuguccaaaauguggcucgccgccaccaagaaggcuucuuga

SEQ ID NO: 14377 - RNA, 3594 nt, Artificial Sequence
  derived and/or modified CDS sequence (opt5) from RVFV(ZS-6365)__DQ380205.1__GP
auguacgugcugcucaccauccugauuagcguccuuguuugcgaggccgugaucagagugucccugucuagcacacgggaagagacguguuucggcgacuccaccaaccccgaaaugauugagggggcuugggauucucuccgcgaagaggagaugccugaagaacugagcugcuccaucucuggaauuagagaagucaagacaagcucccaggagcuuuaucgggcccugaaagcgaucaucgcugccgacggccucaauaacauuaccugucacgggaaggauccggaggacaaaaucagccugauuaagggacccccucauaaaaagcgcgugggcaucguuagaugcgaacggcgcagagaugccaagcaaauugggcgggagacaauggcuggaaucgccaugaccgugcugcccgcucucgccgucuuugcgcuggccccugugguuuucgcugaagacccccaccuucgcaauagaccuggcaaaggccauaacuacauugaugggaugacacaggaggacgccaccuguaagccggugacguaugcuggagccugcagcuccuuugauguccugcucgaaaaaggcaaguucccccuguuucagagcuacgcgcaccaucggacccuucuggaggccgugcacgacacaaucaucgcuaaagccgauccucccucuugugaccuccaguccgcucacgggaauccuugcaugaaggagaagcuggugaugaaaacccauugucccaacgauuaucaaagcgcccacuaccugaauaacgacggaaagauggccucugucaaaugcccgccuaaguaugaacucacagaggacuguaauuucugccgccagaugaccggcgcuucccugaaaaaggggagcuacccccuucaggaucuguuuugccaguccucugaagacgauggaagcaaacucaagacgaagaugaaaggcguuugugaggugggcgugcaagcgcugaagaaaugcgacgggcagcuuuccacagcccaugaagucgugccuuucgcuguuuuuaagaacagcaaaaagguguaccuggauaagcucgaccugaaaaccgaggagaaucugcuccccgauucuuucgucuguuuugaacacaagggacaguauaaaggcacaauggacuccgggcagaccaagagagagcugaaaucuuucgauauuucucaaugccccaagaucggaggccacgggagcaagaaauguaccggagacgccgccuuuugcuccgcuuacgaauguacagcccaguaugcgaacgcuuacugcucucaugccaauggcagcggcauugugcagauccaaguuuccgggguguggaagaaaccucuuugugucggauaugagcggguggucgugaagcgcgaacugagcgccaaaccgauucagagaguugagcccugcacgaccuguaucacaaagugcgagccucacggccucgugguccggucuaccggguucaagaucuccagcgcuguggccugcgcuucuggaguuugugugacaggcucccagagccccuccaccgaaauuacgcugaaauacccugggaucucucagagcuccggcggagauauuggcguccauauggcccacgacgaccaaucugugagcuccaagaucguggcgcauugucccccgcaggauccuugccuuguucacgggugcauugucugugcccacggacugaucaacuaucagugccauacagcucucagcgccuucgugguggucuuuguguucucuuccaucgcuauuaucugucuggccauucuguacagaguucucaaaugccugaagaucgcgccccgcaaagugcuuaauccucugauguggauuaccgccuuuauccgguggauuuacaagaaaauggucgcuagaguggccgacaacaucaaccagguuaaucgcgagaucggcuggauggaagggggacaacucgugcugggcaaccccgcuccuauuccccggcacgccccgaucccuagauauagcaccuaccugaugcuucuccugauugucucuuaugccuccgcuuguagcgagcugauccaggcgucuagccgcauuacaaccugcuccacagagggggugaauacgaagugucggcucagcggcaccgcccugaucagagcuggaucuguuggcgccgaagccugccuuaugcugaagggggugaaagaggaucagacaaaguuccucaaaaucaagaccgucuccagcgaacuguccugccgcgagggacagucuuacuggacaggcagcuuuucccccaaaugucugucuagccggagaugccaucuugugggggaaugucacgugaaccgcugccucuccuggcgggacaaugagaccucugcugaguucagcuuugucggagaauccacgaccaugagagagaacaaguguuucgaacaaugcggcggguggggcuguggaugcuuuaauguuaaccccagcugucuguucgugcacacauaucugcagucugugcggaaggaggcccuccgcgucuuuaauugcauugauugggugcauaaacugacccuugaaaucacagacuucgauggcuccguuagcaccauugaccugggggcgucuuccagcagauuuacgaacuggggaucugugucccucagccuggaugcugagggcaucuccgggagcaauucuuucagcuucauugaguccccuggaaagggcuacgccaucgucgacgaaccguuuucugagaucccccggcagggguuccugggcgaaauuagauguaacagcgaguccucugugcuuagcgcccacgaauccugccuccgcgcuccuaaucugaucucuuauaaacccaugauugaucagcuggagugcacaaccaaccucaucgacccuuuuguuguguucgagcggggaagccugccccaaacaagaaaugauaagaccuuugccgcguccaaaggcaaccgcgggguccaggcuuucagcaagggaucugugcaggccgaccuuacccugauguuugacaacuucgaaguugauuuugugggcgccgcugucuccugugacgccgcuuuccucaaucugacagggugcuacagcuguaacgccggagcgagagugugccugucuauuacguccaccggcacaggcagccuuuccgcccauaauaaggaugggucucuccacaucgugcugccuagcgagaacggaaccaaagaccaaugucagauccugcauuuuacaguccccgaaguugaggaggaguucauguacuccugcgauggcgacgagcggccgcuccuggugaaggggacccuuauugcuaucgauccuuuugacgaucgcagagaagccggaggcgagagcacgguggucaaucccaaaucuggguccuggaacuucuucgacugguuuagcggacugaugucuugguucggcggcccucucaagacaauucugcugaucugucuuuauguggcucugagcauugggcucuuuuuccugcucaucuaccugggacggaccggccuuuccaaaauguggcuggccgccaccaagaaggcuucuuga

SEQ ID NO: 14378 - RNA, 3594 nt, Artificial Sequence
  derived and/or modified CDS sequence (opt5) from RVFV(CAR-R1622)__DQ380219.1__GP
auguacgugcugcucaccauccugauuagcguccuuguuugcgaggccgugaucagagugucccugucuagcacacgggaagagacguguuucggcgacuccaccaaccccgaaaugauugagggggcuugggauucucuccgcgaagaggagaugccugaagaacugagcugcuccaucucuggaauuagagaagucaagacaagcucccaggagcuuuaucgggcccugaaagcgaucaucgcugccgacggccucaauaacauuaccugucacgggaaggauccggaggacaaaaucagccugauuaagggacccccucauaaaaagcgcgugggcaucguuagaugcgaacggcgcagagaugccaagcaaauugggcgggagacaauggcuggaaucgccaugaccgugcugcccgcucucgccgucuuugcgcuggccccugugguuuucgcugaagacccccaccuucgcaauagaccuggcaaaggccauaacuacauugaugggaugacacaggaggacgccaccuguaagccggugacguaugcuggagccugcagcuccuuugauguccugcucgaaaaaggcaaguucccccuguuucagagcuacgcgcaccaucggacccuucuggaggccgugcacgacacaaucaucgcuaaagccgauccucccucuugugaccuccaguccgcucacgggaauccuugcaugaaggagaagcuggugaugaaaacccauugucccaacgauuaucaaagcgcccacuaccugaauaacgacggaaagauggccucugucaaaugcccgccuaaguaugaacucacagaggacuguaauuucugccgccagaugaccggcgcuucccugaaaaaggggagcuacccccuucaggaucuguuuugccaguccucugaagacgauggaagcaaacucaagacgaagaugaaaggcguuugugaggugggcgugcaagcgcugaagaaaugcgacgggcagcuuuccacagcccaugaagucgugccuuucgcuguuuuuaagaacagcaaaaagguguaccuggauaagcucgaccugaaaaccgaggagaaucugcuccccgauucuuucgucuguuuugaacacaagggacaguauaaaggcacaauggacuccgggcagaccaagagagagcugaaaucuuucgauauuucucaaugccccaagaucggaggccacgggagcaagaaauguaccggagacgccgccuuuugcuccgcuuacgaauguacagcccaguaugcgaacgcuuacugcucucaugccaauggcagcggcauugugcagauccaaguuuccgggguguggaagaaaccucuuugugucggauaugagcggguggucgugaagcgcgaacugagcgccaaaccgauucagagaguugagcccugcacgaccuguaucacaaagugcgagccucacggccucgugguccggucuaccggguucaagaucuccagcgcuguggccugcgcuucuggaguuugugugacaggcucccagagccccuccaccgaaauuacgcugaaauacccugggaucucucagagcuccggcggagauauuggcguccauauggcccacgacgaccaaucugugagcuccaagaucguggcgcauugucccccgcaggauccuugccuuguucacgggugcauugucugugcccacggacugaucaacuaucagugccauacagcucucagcgccuucgugguggucuuuguguucucuuccaucgcuauuaucugucuggccauucuguacagaguucucaaaugccugaagaucgcgccccgcaaagugcuuaauccucugauguggauuaccgccuuuauccggugggucuacaagaaaaugguggcuagaguugccgacaacauuaaccaggugaaucgcgagaucggcuggauggaagggggacaacucguccugggcaaccccgcuccuaucccccggcacgccccgauuccuagauauagcaccuaccugaugcuucuccugaucgugucuuaugccuccgcuuguagcgagcugauucaggcgucuagccgcaucacaaccugcuccacagaggggguuaauacgaagugucggcucagcggcaccgcccugauuagagcuggaucugugggcgccgaagccugccuuaugcugaagggggucaaagaggaucagacaaaguuccucaaaaucaagaccguguccagcgaacuguccugccgcgagggacagucuuacuggacaggcagcuuuucccccaaaugucugucuagccggagaugccaucuugugggggaaugucacgucaaccgcugccucuccuggcgggacaaugagaccucugcugaguucagcuuuguuggagaauccacgaccaugagagagaacaaguguuucgaacaaugcggcggguggggcuguggaugcuuuaaugugaaccccagcugucuguucgugcacacauaucugcagucuguccggaaggaggcccuccgcguguuuaauugcaucgauuggguucauaaacugacccuugaaauuacagacuucgauggcuccgugagcaccaucgaccugggggcgucuuccagcagauuuacgaacuggggaucugucucccucagccuggaugcugagggcauuuccgggagcaauucuuucagcuucaucgaguccccuggaaagggcuacgccauuguggacgaaccguuuucugagaucccccggcagggguuccugggcgaaaucagauguaacagcgaguccucuguucuuagcgcccacgaauccugccuccgcgcuccuaaucugauuucuuauaaacccaugaucgaucagcuggagugcacaaccaaccucauugacccuuuuguggucuucgagcggggaagccugccccaaacaagaaaugauaagaccuuugccgcguccaaaggcaaccgcggggugcaggcuuucagcaagggaucuguucaggccgaccuuacccugauguuugacaacuucgaaguggauuuugucggcgccgcuguguccugugacgccgcuuuccucaaucugacagggugcuacagcuguaacgccggagcgagagugugccugucuaucacguccaccggcacaggcacccuuagcgcccauaauaaggaugggucccuccacauuguccugccuucugagaacggaacaaaagaccaaugucagauccugcauuuuaccguucccgaaguggaggaggaguucauguacagcugcgauggcgacgagcggccgcuccuggugaaggggacgcuuaucgcuauugauccuuuugacgaucgcagagaagccggaggcgaguccacagucgugaaucccaaaagcgggucuuggaacuucuucgacugguuuuccggacugaugagcugguucggcggcccucucaagaccauccugcugauuugucuuuauguugcucugucuaucgggcucuuuuuccugcucauuuaccugggacggaccggccuuagcaaaauguggcuggccgccacaaagaaggcuuccuga

SEQ ID NO: 14379 - RNA, 3594 nt, Artificial Sequence
  derived and/or modified CDS sequence (opt5) from RVFV(2250/74)__DQ380209.1__GP
auguacgugcugcucaccauccugauuagcguccuuguuugcgaggccgugaucagagugucccugucuagcacacgggaagagacguguuucggcgacuccaccaaccccgaaaugauugagggggcuugggauucucuccgcgaagaggagaugccugaagaacugagcugcuccaucucuggaauuagagaagucaagacaagcucccaggagcuuuaucgggcccugaaagcgaucaucgcugccgacggccucaauaacauuaccugucacgggaaggauccggaggacaaaaucagccugauuaagggacccccucauaaaaagcgcgugggcaucguuagaugcgaacggcgcagagaugccaagcaaauugggcgggagacaauggcuggaaucgccaugaccgugcugcccgcucucgccgucuuugcgcuggccccugugguuuucgcugaagacccccaccuucgcaauagaccuggcaaaggccauaacuacauugaugggaugacacaggaggacgccaccuguaagccggugacguaugcuggagccuguucuuccuuugauguccugcucgaaaaaggcaaguucccccuguuucagagcuacgcgcaccaucggacccuucuggaggccgugcacgacacaaucaucgcuaaagccgauccucccucuugcgaccuccaguccgcucacgggaauccuugcaugaaggagaagcuggugaugaaaacccauugucccaacgauuaucaaagcgcccacuaccugaauaacgacggaaagauggccucugucaaaugcccgccuaaguaugaacucacagaggacuguaauuucugccgccagaugaccggcgcuucccugaaaaaggggagcuacccccuucaggaucuguuuugccaguccucugaagacgauggaagcaaacucaagacgaagaugaaaggcguuugugaggugggcgugcaagcgcugaagaaaugcgacgggcagcuuuccacagcccaugaagucgugccuuucgcuguuuuuaagaacagcaaaaagguguaccuggauaagcucgaccugaaaaccgaggagaaucugcuccccgauucuuucgucuguuuugaacacaagggacaguauaaaggcacaauggacuccgggcagaccaagagagagcugaaaucuuucgauauuucucaaugccccaagaucggaggccacgggagcaagaaauguaccggagacgccgccuuuugcuccgcuuacgaauguacagcccaguaugcgaacgcuuacugcucucaugccaauggcagcggcauugugcagauccaaguuuccgggguguggaagaaaccucuuugugucggauaugagcggguggucgugaagcgcgaacugagcgccaaaccgauucagagaguugagcccugcacgaccuguaucacaaagugcgagccucacggccucgugguccggucuaccggguucaagaucuccagcgcuguggccugcgcuucuggaguuugugugacaggcucccagagccccuccaccgaaauuacgcugaaauacccugggaucucucagagcuccggcggagauauuggcguccauauggcccacgacgaccaaucugugagcuccaagaucguggcgcauugucccccgcaggauccuugccuuguucacgggugcauugucugugcccacggacugaucaacuaucagugccauacagcucucagcgccuucgugguggucuuuguguucucuuccaucgcuauuaucugucuggccauucuguacagaguucucaaaugccugaagaucgcgccccgcaaagugcuuaauccucugauguggauuaccgccuuuauccgguggauuuacaagaaaauggucgcuagaguggccgacaacaucaaccagguuaaucgcgagaucggcuggauggaagggggacaacucgugcugggcaaccccgcuccuauuccccggcacgccccgaucccuagauauagcaccuaccugaugcuucuccugauugucucuuaugccuccgcuuguagcgagcugauccaggcgucuagccgcauuacaaccugcuccacagagggggugaauacgaagugucggcucagcggcaccgcccugaucagagcuggaucuguuggcgccgaagccugccuuaugcugaagggggugaaagaggaucagacaaaguuccucaaaaucaagaccgucuccagcgaacuguccugccgcgagggacagucuuacuggacaggcagcuuuucccccaaaugucugucuagccggagaugccaucuugugggggaaugucacgugaaccgcugccucuccuggcgggacaaugagaccucugcugaguucagcuuugucggagaauccacgaccaugagagagaacaaguguuucgaacaaugcggcggguggggcuguggaugcuuuaauguuaaccccagcugucuguucgugcacacauaucugcagucugugcggaaggaggcccuccgcgucuuuaauugcauugauugggugcauaaacugacccuugaaaucacagacuucgauggcuccguuagcaccauugaccugggggcgucuuccagcagauuuacgaacuggggaucugugucccucagccuggaugcugagggcaucuccgggagcaauucuuucagcuucauugaguccccuggaaagggcuacgccaucgucgacgaaccguuuucugagaucccccggcagggguuccugggcgaaauuagauguaacagcgaguccucugugcuuagcgcccacgaauccugccuccgcgcuccuaaucugaucucuuauaaacccaugauugaucagcuggagugcacaaccaaccucaucgacccuuuuguuguguucgagcggggaagccugccccaaacaagaaaugauaagaccuuugccgcguccaaaggcaaccgcgggguccaggcuuucagcaagggaucugugcaggccgaccuuacccugauguuugacaacuucgaaguugauuuugugggcgccgcugucuccugugacgccgcuuuccucaaucugacagggugcuacagcuguaacgccggagcgaaggugugccugucuauuacguccaccggcacaggcagccuuuccgcccauaauaaagaugggucucuccacaucgugcugccuagcgagaacggaaccaaggaccaaugucagauccugcauuuuacaguccccgaaguugaggaggaguucauguacuccugcgauggcgacgagagaccgcuccuggugaaagggacccuuauugcuaucgauccuuuugacgaucggcgcgaagccggaggcgagagcacgguggucaaucccaagucuggguccuggaacuucuucgacugguuuagcggacugaugucuugguucggcggcccucucaaaacaauucugcugaucugucuuuauguggcucugagcauugggcucuuuuuccugcucaucuaccugggaagaaccggccuuuccaagauguggcuggccgccaccaagaaagcuagcuga

SEQ ID NO: 14380 - RNA, 3594 nt, Artificial Sequence
  derived and/or modified CDS sequence (opt5) from RVFV(T1)__DQ380201.1__GP
auguacgugcugcucaccauccugauuagcguccuuguuugcgaggccgugaucagagugucccugucuagcacacgggaagagacguguuucggcgacuccaccaaccccgaaaugauugagggggcuugggauucucuccgcgaagaggagaugccugaagaacugagcugcuccaucucuggaauuagagaagucaagacaagcucccaggagcuuuaucgggcccugaaagcgaucaucgcugccgacggccucaauaacauuaccugucacgggaaggauccggaggacaaaaucagccugauuaagggacccccucauaaaaagcgcgugggcaucguuagaugcgaacggcgcagagaugccaagcaaauugggcgggagacaauggcuggaaucgccaugaccgugcugcccgcucucgccgucuuugcgcuggccccugugguuuucgcugaagacccccaccuucgcaauagaccuggcaaaggccauaacuacauugaugggaugacacaggaggacgccaccuguaagccggugacguaugcuggagccugcagcuccuuugauguccugcucgaaaaaggcaaguucccccuguuucagagcuacgcgcaccaucggacccuucuggaggccgugcacgacacaaucaucgcuaaagccgauccucccucuugugaccuccaguccgcucacgggaauccuugcaugaaggagaagcuggugaugaaaacccauugucccaacgauuaucaaagcgcccacuaccugaauaacgacggaaagauggccucugucaaaugcccgccuaaguaugaacucacagaggacuguaauuucugccgccagaugaccggcgcuucccugaaaaaggggagcuacccccuucaggaucuguuuugccaguccucugaagacgauggaagcaaacucaagacgaagaugaaaggcguuugugaggugggcgugcaagcgcugaagaaaugcgacgggcagcuuuccacagcccaugaagucgugccuuucgcuguuuuuaagaacagcaaaaagguguaccuggauaagcucgaccugaaaaccgaggagaaucugcuccccgauucuuucgucuguuuugaacacaagggacaguauaaaggcacaauggacuccgggcagaccaagagagagcugaaaucuuucgauauuucucaaugccccaagaucggaggccacgggagcaagaaauguaccggagacgccgccuuuugcuccgcuuacgaauguacagcccaguaugcgaacgcuuacugcucucaugccaauggcagcggcauugugcagauccaaguuuccgggguguggaagaaaccucuuugugucggauaugagcggguggucgugaagcgcgaacugagcgccaaaccgauucagagaguugagcccugcacgaccuguaucacaaagugcgagccucacggccucgugguccggucuaccggguucaagaucuccagcgcuguggccugcgcuucuggaguuugugugacaggcucccagagccccuccaccgaaauuacgcugaaauacccugggaucucucagagcuccggcggagauauuggcguccauauggcccacgacgaccaaucugugagcuccaagaucguggcgcauugucccccgcaggauccuugccuuguucacgggugcauugucugugcccacggacugaucaacuaucagugccauacagcucucagcgccuucgugguggucuuuguguucucuuccaucgcuauuaucugucuggccguucuguacagagugcucaaaugccugaagauugcgccccgcaaaguccuuaauccucugauguggaucaccgccuuuauucgguggaucuacaagaaaaugguggcuagaguugccgacaacauuaaccaggugaaucgcgagaucggcuggauggaagggggacaacucguccugggcaaccccgcuccuaucccccggcacgccccgauuccuagauauagcaccuaccugaugcuucuccugaucgugucuuaugccuccgcuuguagcgagcugauucaggcgucuagccgcaucacaaccugcuccacagaggggguuaauacgaagugucggcucagcggcaccgcccugauuagagcuggaucugugggcgccgaagccugccuuaugcugaagggggucaaagaggaucagacaaaguuccucaaaaucaagaccguguccagcgaacuguccugccgcgagggacagucuuacuggacaggcagcuuuucccccaaaugucugucuagccggagaugccaucuugugggggaaugucacgucaaccgcugccucuccuggcgggacaaugagaccucugcugaguucagcuuuguuggagaauccacgaccaugagagagaacaaguguuucgaacaaugcggcggguggggcuguggaugcuuuaaugugaaccccagcugucuguucgugcacacauaucugcagucuguccggaaggaggcccuccgcguguuuaauugcaucgauuggguucauaaacugacccuugaaauuacagacuucgauggcuccgugagcaccaucgaccugggggcgucuuccagcagauuuacgaacuggggaucugucucccucagccuggaugcugagggcauuuccgggagcaauucuuucagcuucaucgaguccccuggaaagggcuacgccauuguggacgaaccguuuucugagaucccccggcagggguuccugggcgaaaucagauguaacagcgaguccucuguucuuagcgcccacgaauccugccuccgcgcuccuaaucugauuucuuauaaacccaugaucgaucagcuggagugcacaaccaaccucauugacccuuuuguggucuucgagcggggaagccugccccaaacaagaaaugauaagaccuuugccgcguccaaaggcaaccgcggggugcaggcuuucagcaagggaucuguucaggccgaccuuacccugauguuugacaacuucgaaguggauuuugucggcgccgcuguguccugugacgccgcuuuccucaaucugacagggugcuacagcuguaacgccggagcgagagugugccugucuaucacguccaccggcacaggcagccuuuccgcccauaauaaggaugggucucuccacauuguccugccuagcgagaacggaaccaaagaccaaugucagauccugcauuuuacaguucccgaaguggaggaggaguucauguacuccugcgauggcgacgagcggccgcuccuggugaaggggacccuuaucgcuauugauccuuuugacgaucgcagagaagccggaggcgagagcacggucgugaaucccaaaucuggguccuggaacuucuucgacugguuuagcggacugaugucuugguucggcggcccucucaagacaauccugcugauuugucuuuauguugcucugagcaucgggcucuuuuuccugcucauuuaccugggacggaccggccuuuccaaaauguggcuggccgccaccaagaaggcuucuuga

SEQ ID NO: 14381 - RNA, 3594 nt, Artificial Sequence
  derived and/or modified CDS sequence (opt5) from RVFV(1853/78)__DQ380220.1__GP
auguacgugcugcucaccauccugauuagcguccuuguuugcgaggccgugaucagagugucccugucuagcacacgggaagagacguguuucggcgacuccaccaaccccgaaaugauugagggggcuugggauucucuccgcgaagaggagaugccugaagaacugagcugcuccaucucuggaauuagagaagucaagacaagcucccaggagcuuuaucgggcccugaaagcgaucaucgcugccgacggccucaauaacauuaccugucacgggaaggauccggaggacaaaaucagccugauuaagggacccccucauaaaaagcgcgugggcaucguuagaugcgaacggcgcagagaugccaagcaaauugggcgggagacaauggcuggaaucgccaugaccgugcugcccgcucucgccgucuuugcgcuggccccugugguuuucgcugaagacccccaccuucgcaauagaccuggcaaaggccauaacuacauugaugggaugacacaggaggacgccaccuguaagccggugacguaugcuggagccugcagcuccuuugauguccugcucgaaaaaggcaaguucccccuguuucagagcuacgcgcaccaucggacccuucuggaggccgugcacgacacaaucaucgcuaaagccgauccucccucuugugaccuccaguccgcucacgggaauccuugcaugaaggagaagcuggugaugaaaacccauugucccaacgauuaucaaagcgcccacuaccugaauaacgacggaaagauggccucugucaaaugcccgccuaaguaugaacucacagaggacuguaauuucugccgccagaugaccggcgcuucccugaaaaaggggagcuacccccuucaggaucuguuuugccaguccucugaagacgauggaagcaaacucaagacgaagaugaaaggcguuugugaggugggcgugcaagcgcugaagaaaugcgacgggcagcuuuccacagcccaugaagucgugccuuucgcuguuuuuaagaacagcaaaaagguguaccuggauaagcucgaccugaaaaccgaggagaaucugcuccccgauucuuucgucuguuuugaacacaagggacaguauaaaggcacaauggacuccgggcagaccaagagagagcugaaaucuuucgauauuucucaaugccccaagaucggaggccacgggagcaagaaauguaccggagacgccgccuuuugcuccgcuuacgaauguacagcccaguaugcgaacgcuuacugcucucaugccaauggcagcggcgugguucagauucaaguguccggggucuggaagaaaccucuuugugugggauaugagcgggucgugguuaagcgcgaacugagcgccaaaccgauccagagaguggagcccugcacgaccuguauuacaaagugcgagccucacggccucgucgugcggucuaccggguucaagaucuccagcgcuguugccugcgcuucuggagugugugucacaggcucccagagccccuccaccgaaaucacgcugaaauacccugggauuucucagagcuccggcggagauaucggcgugcauauggcccacgacgaccaaucugugagcuccaagauuguugcgcauugucccccgcaggauccuugccuuguccacgggugcaucgugugugcccacggacugauuaacuaucagugccauacagcucucagcgccuucguggucguguuuguuuucucuuccaucgcuaucauuugucuggccauccuguacagagugcucaaaugccugaagauugcgccccgcaaaguccuuaauccucugauguggaucaccgccuuuauucgguggguguacaagaaaaugguugcuagaguggccgacaacaucaaccaggucaaucgcgagauuggcuggauggaagggggacaacucgugcugggcaaccccgcuccuaucccccggcacgccccgaucccuagauauagcaccuaccugaugcuucuccugauuguuucuuaugccuccgcuuguagcgagcugauccaggcgucuagccgcauuacaaccugcuccacagagggggugaauacgaagugucggcucagcggcaccgcccugaucagagcuggaucugucggcgccgaagccugccuuaugcugaagggggugaaagaggaucagacaaaguuccucaaaauuaagaccguguccagcgaacuguccugccgcgagggacagucuuacuggacaggcagcuuuucccccaaaugucugucuagccggagaugccaucuugucggggaaugucacguuaaccgcugccucuccuggcgggacaaugagaccucugcugaguucagcuuugugggagaauccacgaccaugagagagaacaaguguuucgaacaaugcggcggguggggcuguggaugcuuuaaugugaaccccagcugucuguucguccacacauaucugcagucugugcggaaggaggcccuccgcguuuuuaauugcaucgauugggugcauaaacugacccuugaaaucacagacuucgauggcuccgucagcaccauugaccugggggcgucuuccagcagauuuacgaacuggggaucugugucccucagccuggaugcugagggcaucuccgggagcaauucuuucagcuucauugaguccccuggaaagggcuacgccaucguugacgaaccguuuucugagauuccccggcagggguuccugggcgaaaucagauguaacagcgaguccucugugcuuagcgcccacgaauccugccuccgcgcuccuaaucugaucucuuauaaacccaugauugaucagcuggagugcacaaccaaccucaucgacccuuuugucguguucgagcggggaagccugccccaaacaagaaaugauaagaccuuugccgcguccaaaggcaaccgcgggguucaggcuuucagcaagggaucugugcaggccgaccuuacccugauguuugacaacuucgaagucgauuuugugggcgccgcuguguccugugacgccgcuuuccucaaucugacagggugcuacagcuguaacgccggagcgagagucugccugucuauuacguccaccggcacaggcacccuuagcgcccauaauaaggaugggucccuccacaucguucugccuucugagaacggaacaaaagaccaaugucagauucugcauuuuaccgugcccgaaguggaggaggaguucauguacagcugcgauggcgacgagcggccgcuccuggucaaggggacgcuuaucgcuaucgauccuuuugacgaucgcagagaagccggaggcgaguccacagugguuaaucccaaaagcgggucuuggaacuucuucgacugguuuuccggacugaugagcugguucggcggcccucucaagaccauucugcugaucugucuuuauguggcucugucuauugggcucuuuuuccugcucaucuaccugggacggaccggccuuagcaaaauguggcuggccgccacaaagaaggcuuccuga

SEQ ID NO: 14382 - RNA, 3594 nt, Artificial Sequence
  derived and/or modified CDS sequence (opt5) from RVFV(MP-12)__DQ380208.1__GP
auguacgugcugcucaccauccugacaagcguccuuguuugcgaggccauuaucagagugucccugucuagcacgcgggaagagaccuguuucggcgacuccacaaaccccgaaaugauugagggggcuugggauucucuccgcgaagaggagaugccugaggaacugagcugcuccaucucuggaauuagagaagugaagaccagcucccaggagcuuuaucgggcccugaaagcgaucaucgcugccgacggccucaauaacauuacaugucacgggaaggauccggaggacaaaaucagccugauuaagggacccccucauaaaaagcgcgucggcaucgugagaugcgaacggcgcagagaugccaagcaaauugggcgggagaccauggcuggaaucgccaugacaguucugcccgcucucgccguguuugcgcuggccccugucguguucgcugaagacccccaccuucgcaauagaccuggcaaaggccauaacuacauugaugggaugacccaggaggacgccacguguaagccgguuaccuaugcuggagccugcagcuccuuugaugugcugcucgaaaaaggcaaguucccccuguuucagagcuacgcgcaccaucggacacuucuggaggccguccacgacaccaucaucgcuaaagccgauccucccucuugugaccuccuguccgcucacgggaauccuugcaugaaggagaagcuggugaugaaaacacauugucccaacgauuaucagagcgcccaccaucucaauaacgacggaaagauggccucugugaaaugcccgccuaaguacgaacugaccgaggacuguaauuucugccgccaaaugacgggcgcuucccuuaaaaaggggagcuauccccugcaggaucucuuuugccaguccucugaagacgauggaagcaaacugaagacaaagaugaaaggcgucugugagguuggcgugcaggcgcuuaagaaaugcgacgggcaacuguccaccgcccacgaaguggucccuuucgcuguguuuaagaacagcaaaaagguuuaccucgauaagcuggaccugaaaacagaggagaaucuccugcccgauucuuucguguguuuugaacacaagggacaguacaaaggcaccauggacuccgggcagaccaagagagagcuuaaaucuuucgauauuucucagugccccaagaucggaggccaugggagcaagaaauguacaggagacgccgccuuuugcuccgcuuaugaauguacggcccaauacgcgaacgcuuauugcucucacgccaauggcagcggcauuguccagauccagguguccgggguuuggaagaaaccucugugugugggauacgagcgggucguggucaagcgcgaacucagcgccaaaccgauucaaagaguggagcccugcaccacauguaucaccaagugcgagccucauggccugguugugcggucuacaggguucaagaucuccagcgcugucgccugcgcuucuggaguguguguuaccggcucccagagccccuccacggaaauuacacuuaaauauccugggaucucucagagcuccggcggagauauuggcgugcacauggcccaugacgaccagucugucagcuccaagaucguggcgcacugucccccgcaagauccuugccuggugcacgacugcauuguuugugcccaugggcucaucaacuaccagugccacaccgcucugagcgccuucgucgugguguuugucuucucuuccaucgcuauuaucugucuggccauucucuauagagugcugaaaugccuuaagaucgcgccccgcaaaguucugaauccucucauguggauuaccgccuuuauccgguggauuuacaagaaaaugguggcuagagucgccgauaacaucaaccaggugaaucgcgagaucggauggauggaaggcgggcagcugguucugggaaaccccgcuccuauuccccggcaugccccgaucccuagauacagcacauaucuuaugcuccugcugauugugucuuacgccuccgcuuguagcgagcucauccaagcgucuagccgcauuaccacaugcuccacggagggcgucaauaccaagugucggcugagcgggacagcccuuaucagagcuggcucugugggagccgaagccugccugaugcucaagggcguuaaagaggaccagaccaaguuccugaaacugaagacaguguccagcgaacuuuccugccgcgaggggcagucuuauuggaccgggagcuuuucccccaaaugucucucuagccggagaugccaccuggucggcgaaugucacgugaaccgcugccuguccuggcgggauaaugagacgucugcugaguucagcuuugugggggaauccaccacaaugagagagaacaaguguuucgaacagugcggaggcuggggguguggcugcuuuaaugucaaccccagcugucucuucguucauaccuaccugcaaucugugcggaaggaggcccuucgcguguuuaauugcaucgacuggguccacaaacugacacucgaaauuaccgauuucgacggauccgugagcacgaucgaucugggcgcgucuuccagcagauuuacaaacugggggucuguuucccugagccuugacgcugagggaauuuccggcagcaauucuuucagcuucaucgaguccccugggaagggauaugccauuguggaugaaccguuuucugagaucccccggcagggcuuccucggggaaaucagauguaacagcgaguccucuguccugagcgcccaugaauccugccugcgcgcuccuaaucucauuucuuacaaacccaugaucgaccagcuggagugcaccacaaaccuuauugauccuuuugugguuuucgagcggggcagccugccccagaccagaaaugacaagaccuuugccgcguccaaaggaaaccgcggcgugcaggcuuucagcaaggggucuguccaagccgaccucacacugauguuugauaacuucgaaguggacuuuguuggagccgcuguguccugugaugccgcuuuccugaaucuuacgggcugcuauagcuguaacgccggggcgagagucugccucucuaucaccuccacaggaaccggcagccuguccgcccacaauaaggacggcucucugcauauugugcucccuagcgagaacgggacaaaagaucagugucaaauccugcacuuuaccgugcccgaagucgaggaggaguucauguacuccugcgacggagaugaacggccgcuucugguuaagggcacgcucaucgcuauugacccuuuugaugaccgcagagaagccgggggagagagcacaguggugaaucccaaaucuggcuccuggaacuucuucgauugguuuagcgggcugaugucuugguucggaggcccucugaagaccauccuucugauuugucucuacgucgcucugagcaucggccucuuuuuccugcuuauuuaucugggaggaaccggccucuccaaaauguggcuggccgccacaaagaaggcuucuuga

SEQ ID NO: 14383 - RNA, 3594 nt, Artificial Sequence
  derived and/or modified CDS sequence (opt5) from RVFV(ZM-657)__DQ380204.1__GP
auguacgugcugcucaccauccugauuagcguccuuguuugcgaggccgugaucagagugucccugucuagcacacgggaagagacguguuucggcgacuccaccaaccccgaaaugauugagggggcuugggauucucuccgcgaagaggagaugccugaagaacugagcugcuccaucucuggaauuagagaagucaagacaagcucccaggagcuuuaucgggcccugaaagcgaucaucgcugccgacggccucaauaacauuaccugucacgggaaggauccggaggacaaaaucagccugauuaagggacccccucauaaaaagcgcgugggcaucguuagaugcgaacggcgcagagaugccaagcaaauugggcgggagacaauggcuggaaucgccaugaccgugcugcccgcucucgccgucuuugcgcuggccccugugguuuucgcugaagacccccaccuucgcaauagaccuggcaaaggccauaacuacauugaugggaugacacaggaggacgccaccuguaagccggugacguaugcuggagccuguucuuccuuugauguccugcucgaaaaaggcaaguucccccuguuucagagcuacgcgcaccaucggacccuucuggaggccgugcacgacacaaucaucgcuaaagccgauccucccucuugcgaccuccaguccgcucacgggaauccuugcaugaaggagaagcuggugaugaaaacccauugucccaacgauuaucaaagcgcccacuaccugaauaacgacggaaagauggccucugucaaaugcccgccuaaguaugaacucacagaggacuguaauuucugccgccagaugaccggcgcuucccugaaaaaggggagcuacccccuucaggaucuguuuugccaguccucugaagacgauggaagcaaacucaagacgaagaugaaaggcguuugugaggugggcgugcaagcgcugaagaaaugcgacgggcagcuuuccacagcccaugaagucgugccuuucgcuguuuuuaagaacagcaaaaagguguaccuggauaagcucgaccugaaaaccgaggagaaucugcuccccgauucuuucgucuguuuugaacacaagggacaguauaaaggcacaauggacuccgggcagaccaagagagagcugaaaucuuucgauauuucucaaugccccaagaucggaggccacgggagcaagaaauguaccggagacgccgccuuuugcuccgcuuacgaauguacagcccaguaugcgaaggcuuacugcucucaugccaacggcagcggcauugugcagauccaaguuuccgggguguggaaaaagccucuuugugucggauaugagcggguggucgugaaacgcgaacugagcgccaagccgauucagagaguugagcccugcacgaccuguaucacaaagugcgagccucacggccucgugguccggucuaccggguucaaaaucuccagcgcuguggccugcgcuucuggaguuugugugacaggcucccagagccccuccaccgaaauuacgcugaaguacccugggaucucucagagcuccggcggagauauuggcguccauauggcccacgacgaccaaucugugagcuccaaaaucguggcgcauugucccccgcaggauccuugccuuguucacgggugcauugucugugcccacggacugaucaauuaucagugccauacagcucucagcgccuucgugguggucuuuguguucucuuccaucgcuauuaucugucuggccauucuguacagaguucucaagugccugaaaaucgcgccccgcaaggugcuuaacccucugauguggauuaccgccuuuauccgguggauuuacaaaaagauggucgcuagaguggccgacaauaucaaccagguuaaccgcgagaucggcuggauggaagggggacaacucgugcugggcaaucccgcuccuauuccccggcacgccccgaucccuagauauagcaccuaccugaugcuucuccugauugucucuuaugccuccgcuuguagcgagcugauccaggcgucuagccgcauuacaaccugcuccacagagggggugaacacgaagugucggcucagcggcaccgcccugaucagagcuggaucuguuggcgccgaagccugccuuaugcugaaaggggugaaggaggaucagacaaaauuccucaagaucaaaaccgucuccagcgaacuguccugccgcgagggacagucuuacuggacaggcagcuuuucccccaagugucugucuagccggagaugccaucuugugggggaaugucacgugaaucgcugccucuccuggcgggacaacgagaccucugcugaguucagcuuugucggagaauccacgaccaugagagagaauaaguguuucgaacaaugcggcggguggggcuguggaugcuuuaacguuaaucccagcugucuguucgugcacacauaucugcagucugugcggaaagaggcccuccgcgucuuuaacugcauugauugggugcauaagcugacccuugaaaucacagacuucgauggcuccguuagcaccauugaccugggggcgucuuccagcagauuuacgaauuggggaucugugucccucagccuggaugcugagggcaucuccgggagcaacucuuucagcuucauugaguccccuggaaaaggcuacgccaucgucgacgaaccguuuucugagaucccccggcagggguuccugggcgaaauuagauguaauagcgaguccucugugcuuagcgcccacgaauccugccuccgcgcuccuaaccugaucucuuauaagcccaugauugaucagcuggagugcacaaccaaucucaucgacccuuuuguuguguucgagcggggaagccugccccaaacaagaaacgauaaaaccuuugccgcguccaagggcaaucgcgggguccaggcuuucagcaagggaucugugcaggccgaccuuacccugauguuugacaacuucgaaguugauuuugugggcgccgcugucuccugugacgccgcuuuccucaaccugacagggugcuacagcuguaaugccggagcgagagugugccugucuauuacguccaccggcacaggcagccuuuccgcccauaacaaagaugggucucuccacaucgugcugccuagcgagaauggaaccaaggaccaaugucagauccugcauuuuacaguccccgaaguugaggaggaguucauguacuccugcgauggcgacgagcggccgcuccuggugaaagggacccuuauugcuaucgauccuuuugacgaucgcagagaagccggaggcgagagcacgguggucaaccccaagucuggguccuggaauuucuucgacugguuuagcggacugaugucuugguucggcggcccucucaaaacaauucugcugaucugucuuuauguggcucugagcauugggcucuuuuuccugcucaucuaccugggacggaccggccuuuccaagauguggcuggccgccaccaagaaagcuagcuga

SEQ ID NO: 14384 - RNA, 3594 nt, Artificial Sequence
  derived and/or modified CDS sequence (opt5) from RVFV(ZH-501-777)__DQ380202.1__GP
auguacgugcugcucaccauccugauuagcguccuuguuugcgaggccgugaucagagugucccugucuagcacacgggaagagacguguuucggcgacuccaccaaccccgaaaugauugagggggcuugggauucucuccgcgaagaggagaugccugaagaacugagcugcuccaucucuggaauuagagaagucaagacaagcucccaggagcuuuaucgggcccugaaagcgaucaucgcugccgacggccucaauaacauuaccugucacgggaaggauccggaggacaaaaucagccugauuaagggacccccucauaaaaagcgcgugggcaucguuagaugcgaacggcgcagagaugccaagcaaauugggcgggagacaauggcuggaaucgccaugaccgugcugcccgcucucgccgucuuugcgcuggccccugugguuuucgcugaagacccccaccuucgcaauagaccuggcaaaggccauaacuacauugaugggaugacacaggaggacgccaccuguaagccggugacguaugcuggagccugcagcuccuuugauguccugcucgaaaaaggcaaguucccccuguuucagagcuacgcgcaccaucggacccuucuggaggccgugcacgacacaaucaucgcuaaagccgauccucccucuugugaccuccaguccgcucacgggaauccuugcaugaaggagaagcuggugaugaaaacccauugucccaacgauuaucaaagcgcccacuaccugaauaacgacggaaagauggccucugucaaaugcccgccuaaguaugaacucacagaggacuguaauuucugccgccagaugaccggcgcuucccugaaaaaggggagcuacccccuucaggaucuguuuugccaguccucugaagacgauggaagcaaacucaagacgaagaugaaaggcguuugugaggugggcgugcaagcgcugaagaaaugcgacgggcagcuuuccacagcccaugaagucgugccuuucgcuguuuuuaagaacagcaaaaagguguaccuggauaagcucgaccugaaaaccgaggagaaucugcuccccgauucuuucgucuguuuugaacacaagggacaguauaaaggcacaauggaccccgggcagaccaagagagagcugaaauccuucgauauuagccaaugcccuaagaucggaggccacgggucuaagaaauguaccggagacgccgccuuuugcagcgcuuacgaauguacagcccaguaugcgaacgcuuacugcucccaugccaauggcucuggcauugugcagauccaaguuagcgggguguggaagaaaccgcuuugugucggauaugagcggguggucgugaagcgcgaacuguccgccaaacccauucagagaguugagccuugcacgaccuguaucacaaagugcgagccccacggccucgugguccggagcaccggguucaagaucucuuccgcuguggccugcgcuagcggaguuugugugacaggcucucaguccccuagcaccgaaauuacgcugaaauaccccgggaucucccagucuagcggcggagauauuggcguccauauggcccacgacgaccaauccgugucuagcaagaucguggcgcauugcccgccucaggaucccugucuuguucacgggugcauugucugugcccacggacugaucaacuaucagugccauacagcucucuccgccuucgugguggucuuuguguucagcucuaucgcuauuaucugucuggccguucuguacagagugcucaaaugccugaagauugcgccucgcaaaguccuuaauccccugauguggaucaccgccuuuauucgguggaucuacaagaaaaugguggcuagaguugccgacaacauuaaccaggugaaucgcgagaucggcuggauggaagggggacaacucguccugggcaacccugcucccaucccgcggcacgccccuauucccagauauuccaccuaccugaugcuucuccugaucgugagcuaugccucugcuuguuccgagcugauucaggcgagcucucgcaucacaaccugcagcacagaggggguuaauacgaagugucggcucuccggcaccgcccugauuagagcuggaagcgugggcgccgaagccugccuuaugcugaagggggucaaagaggaucagacaaaguuccucaaaaucaagaccgugucuuccgaacugagcugccgcgagggacaguccuacuggacaggcucuuuuagccccaaaugucuguccucucggagaugccaucuugugggggaaugucacgucaaccgcugccucagcuggcgggacaaugagaccuccgcugaguucucuuuuguuggagaaagcacgaccaugagagagaacaaguguuucgaacaaugcggcggguggggcuguggaugcuuuaaugugaacccuuccugucuguucgugcacacauaucugcagagcguccggaaggaggcccuccgcguguuuaauugcaucgauuggguucauaaacugacccuugaaauuacagacuucgauggcucuguguccaccaucgaccugggggcgucuucuuccagauuuacgaacuggggaagcgucucucucucccuggaugcugagggcauuagcggguccaauagcuucucuuucaucgagagcccgggaaagggcuacgccauuguggacgaacccuuuuccgagaucccucggcagggguuccugggcgaaaucagauguaacucugagagcuccguucuuucugcccacgaaagcugccuccgcgcucccaaucugauuuccuauaaaccuaugaucgaucagcuggagugcacaaccaaccucauugaccccuuuguggucuucgagcggggaucucugccucaaacaagaaaugauaagaccuuugccgcgagcaaaggcaaccgcggggugcaggcuuucuccaagggaagcguucaggccgaccuuacccugauguuugacaacuucgaaguggauuuugucggcgccgcugugucuugugacgccgcuuuccucaaucugacagggugcuacuccuguaacgccggagcgagagugugccugagcaucacgucuaccggcacaggcucccuuagcgcccauaauaaggaugggucccuccacauuguccugcccucugagaacggaaccaaagaccaaugucagauccugcauuuuacaguuccggaaguggaggaggaguucauguacagcugcgauggcgacgagcggccucuccuggugaaggggacccuuaucgcuauugaucccuuugacgaucgcagagaagccggaggcgaguccacggucgugaauccuaaaagcgggucuuggaacuucuucgacugguuuuccggacugaugagcugguucggcggcccccucaagacaauccugcugauuugucuuuauguugcucugucuaucgggcucuuuuuccugcucauuuaccugggacggaccggccuuagcaaaauguggcuggccgccaccaagaaggcuuccuga

SEQ ID NO: 14385 - RNA, 3594 nt, Artificial Sequence
  derived and/or modified CDS sequence (opt5) from RVFV(OS-3)__DQ380184.1__GP
auguacgugcugcucaccauccugauuagcguccuuguuugcgaggccgugaucagagugucccugucuagcacacgggaagagacguguuucggcgacuccaccaaccccgaaaugauugagggggcuugggauucucuccgcgaagaggagaugccugaagaacugagcugcuccaucucuggaauuagagaagucaagacaagcucccaggagcuuuaucgggcccugaaagcgaucaucgcugccgacggccucaauaacauuaccugucacgggaaggauccggaggacaaaaucagccugauuaagggacccccucauaaaaagcgcgugggcaucguuagaugcgaacggcgcagagaugccaagcaaauugggcgggagacaauggcuggaaucgccaugaccgugcugcccgcucucgccgucuuugcgcuggccccugugguuuucgcugaagacccccaccuucgcaauagaccuggcaaaggccauaacuacauugaugggaugacacaggaggacgccaccuguaagccggugacguaugcuggagccugcagcuccuuugauguccugcucgaaaaaggcaaguucccccuguuucagagcuacgcgcaccaucggacccuucuggaggccgugcacgacacaaucaucgcuaaagccgauccucccucuugugaccuccaguccgcucacgggaauccuugcaugaaggagaagcuggugaugaaaacccauugucccaacgauuaucaaagcgcccacuaccugaauaacgacggaaagauggccucugucaaaugcccgccuaaguaugaacucacagaggacuguaauuucugccgccagaugaccggcgcuucccugaaaaaggggagcuacccccuucaggaucuguuuugccaguccucugaagacgauggaagcaaacucaagacgaagaugaaaggcguuugugaggugggcgugcaagcgcugaagaaaugcgacgggcagcuuuccacagcccaugaagucgugccuuucgcuguuuuuaagaacagcaaaaagguguaccuggauaagcucgaccugaaaaccgaggagaaucugcuccccgauucuuucgucuguuuugaacacaagggacaguauaaaggcacaauggacuccgggcagaccaagagagagcugaaaucuuucgauauuucucaaugccccaagaucggaggccacgggagcaagaaauguaccggagacgccgccuuuugcuccgcuuacgaauguacagcccaguaugcgaacgcuuacugcucucaugccaauggcagcggcgugguucagauucaaguguccggggucuggaagaaaccucuuugugugggauaugagcgggucgugguuaagcgcgaacugagcgccaaaccgauccagagaguggagcccugcacgaccuguauuacaaagugcgagccucacggccucgucgugcggucuaccggguucaagaucuccagcgcuguugccugcgcuucuggagugugugucacaggcucccagagccccuccaccgaaaucacgcugaaauacccugggauuucucagagcuccggcggagauaucggcgugcauauggcccacgacgaccaaucugugagcuccaagauuguugcgcauugucccccgcaggauccuugccuuguccacgggugcaucgugugugcccacggacugauuaacuaucagugccauacagcucucagcgccuucguggucguguuuguuuucucuuccguggcuaucaucugucuggccauucuguacaaaguccucaagugccugaaaaucgcgcccagaaaggugcuuaauccucugauguggauuaccgccuuuauccgcuggguuuacaaaaagaugguggcucgggucgccgacaacauuaaccaggugaauagagagaucggcuggauggaagggggacaacucgcucugggcaaccccgccccuauuccccgccacgccccgaucccucgguauagcaccuaccugaugcuucuccugaucguuucuuaugcuuccgcguguagcgagcugauucaggccucuagcagaaucacaaccugcuccacagagggggugaauacgaagugucgccucagcggcaccgcucugauucgggccggaucugucggcgccgaggcuugccuuaugcugaaaggggugaaggaggaucagacaaaauuccucaagaucaaaaccguguccagcgaacuguccugcagagagggacagucuuacuggacaggcagcuuuucccccaagugucugucuagccgccggugccaucuugucggggaaugucacguuaacagaugccucuccuggcgcgacaaugagaccucugccgaguucagcuuugugggagaauccacgaccaugcgggagaacaaguguuucgaacaaugcggcggguggggcuguggaugcuuuaaugugaaccccagcugucuguucguccacacauaucugcagucugugagaaaagaggcgcuccggguuuuuaauugcauugauugggugcauaagcugacccuugaaaucacagacuucgauggcuccgucagcaccaucgaccugggggcuucuuccagccgcuuuacgaacuggggaucugugucccucagccuggaugccgagggcauuuccgggagcaauucuuucagcuucaucgaguccccuggaaaaggcuacgccauuguugacgaaccguuuucugagauccccagacagggguuccugggcgaaauucgguguaacagcgaguccucugugcuuagcgcucacgaauccugccucagagccccuaaucugaucucuuauaagcccaugaucgaucagcuggagugcacaaccaaccucauugacccuuuugucguguucgagcgcggaagccugccccaaacacggaaugauaaaaccuuugcggcuuccaagggcaacagagggguucaggccuucagcaagggaucugugcaggccgaccuuacccugauguuugacaacuucgaagucgauuuugugggcgcugccguguccugugacgcugccuuccucaaucugacagggugcuacagcuguaacgcgggagcccgcgucugccugucuaucacguccaccggcacaggcacccuuagcgcucauaauaaagaugggucccuccacauuguucugccuucugagaacggaacaaaggaccaaugucagauccugcauuuuaccgugcccgaaguggaggaggaguucauguacagcugcgauggcgacgaaagaccgcuccuggucaaagggacgcuuauugccaucgauccuuuugacgaucggcgcgaagcuggaggcgaguccacagugguuaaucccaagagcgggucuuggaacuucuucgacugguuuuccggacugaugagcugguucggcggcccucucaaaaccauccugcugauuugucuuuauguggcccugucuaucgggcucuuuuuccugcucauuuaccugggaagaaccggccuuagcaagauguggcuggccgcuacaaagaaagcguccuga

SEQ ID NO: 14386 - RNA, 3594 nt, Artificial Sequence
  derived and/or modified CDS sequence (opt5) from RVFV(Sudan 86-2010)__JQ820489.1__GP
auguacgugcugcucaccauccugauuagcguccuuguuugcgaggccgugaucagagugucccugucuagcacacgggaagagacguguuucggcgacuccaccaaccccgaaaugauugagggggcuugggauucucuccgcgaagaggagaugccugaagaacugagcugcuccgucucuggaaucagagaagugaagacaagcucccaggagcuuuaucgggcccugaaagcgauuaucgcugccgacggccucaauaacaucaccugucacgggaagaauccggaggauaaaauuagccugaucaagggacccccucauaaaaagcgcguuggcauugugagaugcgaacggcgcagagacgccaagcaaaucgggcgggagacaauggcuggaauugccaugaccguccugcccgcucucgccguguuugcgcuggccccuguuguguucgcugaagauccccaccuucgcaacagaccuggcaaaggccauaauuacaucgacgggaugacacaggaggaugccaccuguaagccggucacguaugcuggagccugcagcuccuuugacgugcugcucgaaaaaggcaaguucccccuguuucagagcuacgcgcaccaucggacccuucuggaggccgugcacgauacaauuaucgcuaaagccgacccucccucuugugaucuccaguccgcucacgggaacccuugcaugaaggagaagcuggucaugaaaacccauugucccaaugacuaucaaagcgcccacuaccugaacaaugauggaaagauggccucuguuaaaugcccgccuaaguaugaacucacagaggacuguaacuucugccgccagaugaccggcgcuucccugaaaaaggggagcuacccccuucaggaccuguuuugccaguccucugaagaugacggaagcaaacucaagacgaagaugaaaggcgugugugaggugggcguccaagcgcugaagaaaugcgaugggcagcuuuccacagcccaugaagugguuccuuucgcuguguuuaagaauagcaaaaaggucuaccuggacaagcucgaucugaaaaccgaggagaaccugcuccccgacucuuucguguguuuugaacacaagggacaguauaaaggcacaauggauuccgggcagaccaagagagagcugaaaucuuucgacaucucucaaugccccaagauuggaggccacgggagcaagaaauguaccggagaugccgccuuuugcuccgcuuacgaauguacagcccaguaugcgaaugcuuacugcucucaugccaacggcagcggcaucguucagauucaaguguccggggucuggaagaaaccucuuugugugggauaugagcgggucgugguuaagcgcgaacugagcgccaaaccgauccagagaguggagcccugcacgaccuguauuacaaagugcgagccucacggccucgucgugcggucuaccggguucaagaucuccagcgcuguugccugcgcuucuggagugugugucacaggcucccagagccccuccaccgaaaucacgcugaaauacccugggauuucucagagcuccggcggagacaucggcgugcauauggcccacgaugaccaaucugugagcuccaagauuguugcgcauugucccccgcaggacccuugccuuguccacgggugcaucgugugugcccacggacugauuaauuaucagugccauacagcucucagcgccuucguggucguguuuguuuucucuuccaucgcuaucauuugucuggccauccuguacagagugcucaaaugccugaagauugcgccccgcaaaguccuuaacccucugauguggaucaccgccuuuauucgguggguguacaagaaaaugguugcuagaguggccgauaacaucaaucaggucaaccgcgagauuggcuggauggaagggggacaacucgugcugggcaaucccgcuccuaucccccggcacgccccgaucccuagauauagcaccuaccugaugcuucuccugauuguuucuuaugccuccgcuuguagcgagcugauccaggcgucuagccgcauuacaaccugcuccacagagggggugaacacgaagugucggcucagcggcaccgcccugaucagagcuggaucugucggcgccgaagccugccuuaugcugaagggggugaaagaggaccagacaaaguuccucaaaauuaagaccguguccagcgaacuguccugccgcgagggacagucuuacuggacaggcagcuuuucccccaaaugucugucuagccggagaugccaucuugucggggaaugucacguuaaucgcugccucuccuggcgggauaacgagaccucugcugaguucagcuuugugggagaauccacgaccaugagagagaauaaguguuucgaacaaugcggcggguggggcuguggaugcuuuaacgugaaucccagcugucuguucguccacacauaucugcagucugugcggaaggaggcccuccgcguuuuuaacugcaucgacugggugcauaaacugacccuugaaaucacagauuucgacggcuccgucagcaccauugaucugggggcgucuuccagcagauuuacgaauuggggaucugugucccucagccuggacgcugagggcaucuccgggagcaacucuuucagcuucauugaguccccuggaaagggcuacgccaucguugaugaaccguuuucugagauuccccggcagggguuccugggcgaaaucagauguaauagcgaguccucugugcuuagcgcccacgaauccugccuccgcgcuccuaaccugaucucuuauaaacccaugauugaccagcuggagugcacaaccaaucucaucgauccuuuugucauuuucgagcggggaagccugccccaaacaagaaacgacaagaccuuugccgcguccaaaggcaaccgcggggugcaggcuuucagcaagggaucuguucaggccgaucuuacccugauguuugacaauuucgaaguggacuuugucggcgccgcuguguccugugaugccgcuuuccucaaccugacagggugcuacagcuguaaugccggagcgagagugugccugucuaucacguccaccggcacaggcacccuuagcgcccauaacaaggacgggucccuccacauuguccugccuucugagaauggaacaaaagaucaaugucagauccugcauuuuaccguucccgaaguggaggaggaguucauguacagcugcgacggcgaugagcggccgcuccuggugaaggggacgcuuaucgcuauugacccuuuugaugaccgcagagaagccggaggcgaguccacagucgugaaccccaaaagcgggucuuggaauuucuucgauugguuuuccggacugaugagcugguucggcggcccucucaagaccauccugcugauuugucuuuauguugcucugucuaucgggcucuuuuuccugcucauuuaccugggacggaccggccuuagcaaaauguggcuggccgccacaaagaaggcuuccuga

SEQ ID NO: 14387 - RNA, 3594 nt, Artificial Sequence
  derived and/or modified CDS sequence (opt5) from RVFV(T-46 (228113))__DQ380199.1__GP
auguacgugcugcucaccauccugauuagcguccuuguuugcgaggccgugaucagagugucccugucuagcacacgggaagagacguguuucggcgacuccaccaaccccgaaaugauugagggggcuugggauucucuccgcgaagaggagaugccugaagaacugagcugcuccaucucuggaauuagagaagucaagacaagcucccaggagcuuuaucgggcccugaaagcgaucaucgcugccgacggccucaauaacauuaccugucacgggaaggauccggaggacaaaaucagccugauuaagggacccccucauaaaaagcgcgugggcaucguuagaugcgaacggcgcagagaugccaagcaaauugggcgggagacaauggcuggaaucgccaugaccgugcugcccgcucucgccgucuuugcgcuggccccugugguuuucgcugaagacccccaccuucgcaauagaccuggcaaaggccauaacuacauugaugggaugacacaggaggacgccaccuguaagccggugacguaugcuggagccuguucuuccuuugauguccugcucgaaaaaggcaaguucccccuguuucagagcuacgcgcaccaucggacccuucuggaggccgugcacgacacaaucaucgcuaaagccgauccucccucuugcgaccuccaguccgcucacgggaauccuugcaugaaggagaagcuggugaugaaaacccauugucccaacgauuaucaaagcgcccacuaccugaauaacgacggaaagauggccucugucaaaugcccgccuaaguaugaacucacagaggacuguaauuucugccgccagaugaccggcgcuucccugaaaaaggggagcuacccccuucaggaucuguuuugccaguccucugaagacgauggaagcaaacucaagacgaagaugaaaggcguuugugaggugggcgugcaagcgcugaagaaaugcgacgggcagcuuuccacagcccaugaagucgugccuuucgcuguuuuuaagaacagcaaaaagguguaccuggauaagcucgaccugaaaaccgaggagaaucugcuccccgauucuuucgucuguuuugaacacaagggacaguauaaaggcacaaaggacuccgggcagaccaaaagagagcugaagucuuucgauauuucucaaugccccaagaucggaggccacgggagcaaaaaguguaccggagacgccgccuuuugcuccgcuuacgaauguacagcccaguaugcgaacgcuuacugcucucaugccaauggcagcggcauugugcagauccaaguuuccgggguguggaaaaagccucuuugugucggauaugagcggguggucgugaaacgcgaacugagcgccaagccgauucagagaguugagcccugcacgaccuguaucacaaagugcgagccucacggccucgugguccggucuaccggguucaaaaucuccagcgcuguggccugcgcuucuggaguuugugugacaggcucccagagccccuccaccgaaauuacgcugaaguacccugggaucucucagagcuccggcggagauauuggcguccauauggcccacgacgaccaaucugugagcuccaaaaucguggcgcauugucccccgcaggauccuugccuuguucacgggugcauugucugugcccacggacugaucaacuaucagugccauacagcucucagcgccuucgugguggucuuuguguucucuuccaucgcuauuaucugucuggccguucuguacagagugcucaagugccugaaaauugcgccccgcaagguccuuaauccucugauguggaucaccgccuuuauucgguggaucuacaaaaagaugguggcuagaguugccgacaacauuaaccaggugaaucgcgagaucggcuggauggaagggggacaacucguccugggcaaccccgcuccuaucccccggcacgccccgauuccuagauauagcaccuaccugaugcuucuccugaucgugucuuaugccuccgcuuguagcgagcugauucaggcgucuagccgcaucacaaccugcuccacagaggggguuaauacgaagugucggcucagcggcaccgcccugauuagagcuggaucugugggcgccgaagccugccuuaugcugaaaggggucaaggaggaucagacaaaauuccucaagaucaaaaccguguccagcgaacuguccugccgcgagggacagucuuacuggacaggcagcuuuucccccaagugucugucuagccggagaugccaucuugugggggaaugucacgucaaccgcugccucuccuggcgggacaaugagaccucugcugaguucagcuuuguuggagaauccacgaccaugagagagaacaaguguuucgaacaaugcggcggguggggcuguggaugcuuuaaugugaaccccagcugucuguucgugcacacauaucugcagucuguccggaaagaggcccuccgcguguuuaauugcaucgauuggguucauaagcugacccuugaaauuacagacuucgauggcuccgugagcaccaucgaccugggggcgucuuccagcagauuuacgaacuggggaucugucucccucagccuggaugcugagggcauuuccgggagcaauucuuucagcuucaucgaguccccuggaaaaggcuacgccauuguggacgaaccguuuucugagaucccccggcagggguuccugggcgaaaucagauguaacagcgaguccucuguucuuagcgcccacgaauccugccuccgcgcuccuaaucugauuucuuauaagcccaugaucgaucagcuggagugcacaaccaaccucauugacccuuuuguggucuucgagcggggaagccugccccaaacaagaaaugauaaaaccuuugccgcguccaagggcaaccgcggggugcaggcuuucagcaagggaucuguucaggccgaccuuacccugauguuugacaacuucgaaguggauuuugucggcgccgcuguguccugugacgccgcuuuccucaaucugacagggugcuacagcuguaacgccggagcgagagugugccugucuaucacguccaccggcacaggcagccuuuccgcccauaauaaagaugggucucuccacauuguccugccuagcgagaacggaaccaaggaccaaugucagauccugcauuuuacaguucccgaaguggaggaggaguucauguacuccugcgauggcgacgagcggccgcuccuggugaaagggacccuuaucgcuauugauccuuuugacgaucgcagagaagccggaggcgagagcacggucgugaaucccaagucuggguccuggaacuucuucgacugguuuagcggacugaugucuugguucggcggcccucucaaaacaauccugcugauuugucuuuauguugcucugagcaucgggcucuuuuuccugcucauuuaccugggacggaccggccuuuccaagauguggcuggccgccaccaagaaagcuagcuga

SEQ ID NO: 14388 - RNA, 3594 nt, Artificial Sequence
  derived and/or modified CDS sequence (opt5) from RVFV(2007000094)__EU574055.1__GP
auguacgugcugcucaccauccugauuagcguccuuguuugcgaggccgugaucagagugucccugucuagcacacgggaagagacguguuucggcgacuccaccaaccccgaaaugauugagggggcuugggauucucuccgcgaagaggagaugccugaagaacugagcugcuccgucucuggaaucagagaagugaagacaagcucccaggagcuuuaucgggcccugaaagcgauuaucgcugccgacggccucaauaacaucaccugucacgggaagaauccggaggauaaaauuagccugaucaagggacccccucauaaaaagcgcguuggcauugugagaugcgaacggcgcagagacgccaagcaaaucgggcgggagacaauggcuggaauugccaugaccguccugcccgcucucgccguguuugcgcuggccccuguuguguucgcugaagauccccaccuucgcaacagaccuggcaaaggccauaauuacaucgacgggaugacacaggaggaugccaccuguaagccggucacguaugcuggagccugcagcuccuuugacgugcugcucgaaaaaggcaaguucccccuguuucagagcuacgcgcaccaucggacccuucuggaggccgugcacgauacaauuaucgcuaaagccgacccucccucuugugaucuccaguccgcucacgggaacccuugcaugaaggagaagcuggucaugaaaacccauugucccaaugacuaucaaagcgcccacuaccugaacaaugauggaaagauggccucuguuaaaugcccgccuaaguaugaacucacagaggacuguaacuucugccgccagaugaccggcgcuucccugaaaaaggggagcuacccccuucaggaccuguuuugccaguccucugaagaugacggaagcaaacucaagacgaagaugaaaggcgugugugaggugggcguccaagcgcugaagaaaugcgaugggcagcuuuccacagcccaugaagugguuccuuucgcuguguuuaagaauagcaaaaaggucuaccuggacaagcucgaucugaaaaccgaggagaaccugcuccccgacucuuucguguguuuugaacacaagggacaguauaaaggcacaauggauuccgggcagaccaagagagagcugaaaucuuucgacaucucucaaugccccaagauuggaggccacgggagcaagaaauguaccggagaugccgccuuuugcuccgcuuacgaauguacagcccaguaugcgaaugcuuacugcucucaugccaacggcagcggcaucguucagauucaaguguccggggucuggaagaaaccucuuugugugggauaugagcgggucgugguuaagcgcgaacugagcgccaaaccgauccagagaguggagcccugcacgaccuguauuacaaagugcgagccucacggccucgucgugcggucuaccggguucaagaucuccagcgcuguugccugcgcuucuggagugugugucacaggcucccagagccccuccaccgaaaucacgcugaaauacccugggauuucucagagcuccggcggagacaucggcgugcauauggcccacgaugaccaaucugugagcuccaagauuguugcgcauugucccccgcaggacccuugccuuguccacgggugcaucgugugugcccacggacugauuaauuaucagugccauacagcucucagcgccuucguggucguguuuguuuucucuuccaucgcuaucauuugucuggccauccuguacagagugcucaaaugccugaagauugcgccccgcaaaguccuuaacccucugauguggaucaccgccuuuauucgguggguguacaagaaaaugguugcuagaguggccgauaacaucaaucaggucaaccgcgagauuggcuggauggaagggggacaacucgugcugggcaaucccgcuccuaucccccggcacgccccgaucccuagauauagcaccuaccugaugcuucuccugauuguuucuuaugccuccgcuuguagcgagcugauccaggcgucuagccgcauuacaaccugcuccacagagggggugaacacgaagugucggcucagcggcaccgcccugaucagagcuggaucugucggcgccgaagccugccuuaugcugaagggggugaaagaggaccagacaaaguuccucaaaauuaagaccguguccagcgaacuguccugccgcgagggacagucuuacuggacaggcagcuuuucccccaaaugucugucuagccggagaugccaucuugucggggaaugucacguuaaucgcugccucuccuggcgggauaacgagaccucugcugaguucagcuuugugggagaauccacgaccaugagagagaauaaguguuucgaacaaugcggcggguggggcuguggaugcuuuaacgugaaucccagcugucuguucguccacacauaucugcagucugugcggaaggaggcccuccgcguuuuuaacugcaucgacugggugcauaaacugacccuugaaaucacagauuucgacggcuccgucagcaccauugaucugggggcgucuuccagcagauuuacgaauuggggaucugugucccucagccuggacgcugagggcaucuccgggagcaacucuuucagcuucauugaguccccuggaaagggcuacgccaucguugaugaaccguuuucugagauuccccggcagggguuccugggcgaaaucagauguaauagcgaguccucugugcuuagcgcccacgaauccugccuccgcgcuccuaaccugaucucuuauaaacccaugauugaccagcuggagugcacaaccaaucucaucgauccuuuugucguguucgagcggggaagccugccccaaacaagaaacgacaagaccuuugccgcguccaaaggcaaccgcgggguucaggcuuucagcaagggaucugugcaggccgaucuuacccugauguuugacaauuucgaagucgacuuugugggcgccgcuguguccugugaugccgcuuuccucaaccugacagggugcuacagcuguaaugccggagcgagagucugccugucuauuacguccaccggcacaggcacccuuagcgcccauaacaaggacgggucccuccacaucguucugccuucugagaauggaacaaaagaucaaugucagauucugcauuuuaccgugcccgaaguggaggaggaguucauguacagcugcgacggcgaugagcggccgcuccuggucaaggggacgcuuaucgcuaucgacccuuuugaugaccgcagagaagccggaggcgaguccacagugguuaaccccaaaagcgggucuuggaauuucuucgauugguuuuccggacugaugagcugguucggcggcccucucaagaccauucugcugaucugucuuuauguggcucugucuauugggcucuuuuuccugcucaucuaccugggacggaccggccuuagcaaaauguggcuggccgccacaaagaaggcuuccuga

SEQ ID NO: 14389 - RNA, 3594 nt, Artificial Sequence
  derived and/or modified CDS sequence (opt5) from RVFV(ZC-3349)__DQ380207.1__GP
auguacgugcugcucaccauccugauuagcguccuuguuugcgaggccgugaucagagugucccugucuagcacacgggaagagacguguuucggcgacuccaccaaccccgaaaugauugagggggcuugggauucucuccgcgaagaggagaugccugaagaacugagcugcuccaucucuggaauuagagaagucaagacaagcucccaggagcuuuaucgggcccugaaagcgaucaucgcugccgacggccucaauaacauuaccugucacgggaaggauccggaggacaaaaucagccugauuaagggacccccucauaaaaagcgcgugggcaucguuagaugcgaacggcgcagagaugccaagcaaauugggcgggagacaauggcuggaaucgccaugaccgugcugcccgcucucgccgucuuugcgcuggccccugugguuuucgcugaagacccccaccuucgcaauagaccuggcaaaggccauaacuacauugaugggaugacacaggaggacgccaccuguaagccggugacguaugcuggagccugcagcuccuuugauguccugcucgaaaaaggcaaguucccccuguuucagagcuacgcgcaccaucggacccuucuggaggccgugcacgacacaaucaucgcuaaagccgauccucccucuugugaccuccaguccgcucacgggaauccuugcaugaaggagaagcuggugaugaaaacccauugucccaacgauuaucaaagcgcccacuaccugaauaacgacggaaagauggccucugucaaaugcccgccuaaguaugaacucacagaggacuguaauuucugccgccagaugaccggcgcuucccugaaaaaggggagcuacccccuucaggaucuguuuugccaguccucugaagacgauggaagcaaacucaagacgaagaugaaaggcguuugugaggugggcgugcaagcgcugaagaaaugcgacgggcagcuuuccacagcccaugaagucgugccuuucgcuguuuuuaagaacagcaaaaagguguaccuggauaagcucgaccugaaaaccgaggagaaucugcuccccgauucuuucgucuguuuugaacacaagggacaguauaaaggcacaauggacuccgggcagaccaagagagagcugaaaucuuucgauauuucucaaugccccaagaucggaggccacgggagcaagaaauguaccggagacgccgccuuuugcuccgcuuacgaauguacagcccaguaugcgaacgcuuacugcucucaugccaauggcagcggcauugugcagauccaaguuuccgggguguggaagaaaccucuuugugucggauaugagcggguggucgugaagcgcgaacugagcgccaaaccgauucagagaguugagcccugcacgaccuguaucacaaagugcgagccucacggccucgugguccggucuaccggguucaagaucuccagcgcuguggccugcgcuucuggaguuugugugacaggcucccagagccccuccaccgaaauuacgcugaaauacccugggaucucucagagcuccggcggagauauuggcguccauauggcccacgacgaccaagcggugucuagcaagaucguggcccauugucccccgcaggauccuugccuuguucacgggugcauugucugugcucacggacugaucaacuaucagugccauacagcccucuccgcuuucgugguggucuuuguguucagcucuaucgccauuaucugucuggcgauucuguacagaguucucaaaugccugaagaucgcuccccgcaaagugcuuaauccucugauguggauuaccgcuuuuauccgguggauuuacaagaaaauggucgccagaguggcugacaacaucaaccacguuaaucgcgagaucggcuggauggaagggggacagcucgugcugggcaaccccgccccuauuccccggcaugccccgaucccuagauauuccaccuaccugaugcuucuccugauugucagcuaugcuucugcguguuccgagcugauccaagccagcucucgcauuacaaccugcagcacagagggggugaauacgaagugucggcucuccggcaccgcucugaucagagccggaagcguuggcgccgaagccugccuuaugcugaagggggugaaagaggaucagacaaaguuccucaaaaucaagaccgucucuuccgaacugagcugccgcgagggacaguccuacuggacaggcucuuuuagccccaaaugucuguccucucggagaugccaccuugugggggaaugucacgugaaccgcugccucagcuggcgggacaaugagaccuccgccgaguucucuuuugucggagaaagcacgaccaugagagagaacaaguguuucgaacagugcggcggguggggcuguggaugcuuuaauguuaaccccuccugucuguucgugcauacauaucugcaaagcgugcggaaggaggcgcuccgcgucuuuaauugcauugauugggugcacaaacugacccuugaaaucacagacuucgauggcucuguuuccaccauugaccugggggcuucuagcuccagauuuacgaacuggggaagcgugucucucucccuggaugccgagggcaucagcggguccaauagcuucucuuucauugagagcccuggaaagggcuacgccaucgucgacgaaccguuuuccgagaucccccggcagggguuccugggcgaaauuagauguaacucugagagcuccgugcuuucugcucaugaaagcugccucaaagccccuaaucugaucuccuauaagcccaugauugaucagcuggagugcacaaccaaccucaucgacccuuuuguuguguucgagcgcggaucucugccccagacacggaaugauaaaaccuuugcggcuagcaagggcaacagagggguccaagccuucuccaagggaagcgugcaggccgaccuuacccugauguuugacaacuucgaaguugauuuugugggcgcugccgucucuugugacgcugccuuccucaaucugacagggugcuacuccuguaacgcgggagcccgcgugugccugagcauuacgucuaccggcacaggcucccuuagcgcucacaauaaagaugggucccuccauaucgugcugccuucugagaacggaaccaaggaccagugucaaauccugcacuuuacaguccccgaaguugaggaggaguucauguacagcugcgauggcgacgagagaccgcuccuggugaaagggacccuuauugccaucgauccuuuugacgaucggcgcgaagcuggaggcgaguccacgguggucaaucccaagagcgggucuuggaacuucuucgacugguuuuccggacugaugagcugguucggcggcccucucaaaacaauucugcugaucugucuuuauguggcccugucuauugggcucuuuuuccugcucaucuaccugggaagaaccggccuuagcaagauguggcuggccgcuaccaagaaagcguccuga

SEQ ID NO: 14390 - RNA, 3594 nt, Artificial Sequence
  derived and/or modified CDS sequence (opt5) from RVFV(2007001602)__EU574043.1__GP
auguacgugcugcucaccauccugauuagcguccuuguuugcgaggccgugaucagaguguccauuucuagcacacgggaagagacguguuucggcgacuccaccaaccccgaaaugaucgagggggcuugggauucucugcgcgaagaggagaugccugaagaacucagcugcuccgucucuggaauuagagaagugaagacaagcucccaggagcuguaucgggcccuuaaagcgaucaucgcugccgacggccugaauaacauuaccugucacgggaagaauccggaggauaaaaucagccucauuaagggacccccucauaaaaagcgcguuggcaucgugagaugcgaacggcgcagagacgccaagcaaauugggcgggagacaauggcuggaaucgccaugaccguccugcccgcucuggccguguuugcgcucgccccuguuguguucgcugaagauccccaucugcgcaacagaccuggcaaaggccacaauuacauugacgggaugacacaggaggaugccaccuguaagccggucacguaugcuggagccugcagcuccuuugacgugcuucuggaaaaaggcaaguucccccucuuucagagcuacgcgcaccaucggacccugcuugaggccgugcacgauacaaucaucgcuaaagccgacccucccucuugugaucugcaguccgcucacgggaacccuugcaugaaggagaagcucgucaugaaaacccauugucccaaugacuaucaaagcgcccacuaccugaacaaugauggaaagauggccucuguuaaaugcccgccuaaguaugaacugacagaggacuguaacuucugccgccagaugaccggcgcuucccucaaaaaggggagcuacccccugcaggaccuuuucugccaguccucugaagaugacggaagcaaacugaagacgaagaugaaaggcgugugugaggugggcguccaagcgcucaagaaaugcgaugggcagcuguccacagcccaugaagugguuccuuucgcuguguuuaagaauagcaaaaaggucuaccuugacaagcuggaucucaaaaccgaggagaaccugcugcccgacucuuucguguguuuugaacacaagggacaguauaaaggcacaauggauuccgggcagaccaagagagagcucaaaucuuucgacauuucucaaugccccaagaucggaggccacgggagcaagaaauguaccggagaugccgccuuuugcuccgcuuacgaauguacagcccaguaugcgaaugcuuacugcucucaugccaacggcagcggcauuguucagauccaaguguccggggucuggaagaaaccucugugugugggauaugagcgggucgugguuaagcgcgaacuuagcgccaaaccgauucagagaguggagcccugcacgaccuguaucacaaagugcgagccucacggccuggucgugcggucuaccggguucaagaucuccagcgcuguugccugcgcuucuggagugugugucacaggcucccagagccccuccaccgaaauuacgcucaaauacccugggaucucucagagcuccggcggagacauuggcgugcauauggcccacgaugaccaaucugugagcuccaagaucguugcgcauugucccccgcaggacccuugccugguccacgggugcauugugugugcccacggacuuaucaauuaucagugccauacagcucugagcgccuucguggucaucuuuguguucucuuccaccgcuauuaucugucucgccguucuguacagagugcugaaaugccucaagauugcgccccgcaaaguccugaacccucuuauguggaucaccgccuuuauucgguggguguacaagaaaaugguugcuagaguggccgauaacaucaaucaggucaaccgcgagauuggcuggauggaagggggacaacuggcucucggcaaucccgccccuaucccccggcacgccccgaucccuagauauagcacauaccugaugcugcuucucauugugucuuaugcuuccgcguguagcgagcugauccaggccucuagccgcauuaccacaugcuccacggaggggguuaacaccaagugucggcugagcggcacagcucucaucagagccggaucugugggcgccgaggcuugccugaugcuuaagggggucaaagaggaccagaccaaguuccugaaaauuaagacaguguccagcgaacucuccugccgcgagggacagucuuacuggaccggcagcuuuucccccaaaugucugucuagccggagaugccaucuggugggggaaugucacgucaaucgcugccuuuccuggcgggauaacgagacgucugccgaguucagcuuuguuggagaauccaccacaaugagagagaauaaguguuucgaacaaugcggcggguggggcuguggaugcuuuaacgugaaucccagcugucucuucgugcacaccuaucugcagucuguccggaaggaggcgcugcgcguguuuaacugcaucgacuggguucauaaacucacacuggaaaucaccgauuucgacggcuccgugagcacgauugaucuuggggcuucuuccagcagauuuacaaauuggggaucugucucccugagccucgacgccgagggcaucuccgggagcaacucuuucagcuucauugaguccccuggaaagggcuacgccaucguggaugaaccguuuucugagauuccccggcagggguuccugggcgaaaucagauguaauagcgaguccucuguucugagcgcucacgaauccugccuucgcgccccuaaccucgugucuuauaaacccaugaucgaccagcuggagugcaccacaaaucugauugauccuuuugucguguucgagcggggaagccucccccaaaccagaaacgacaagaccuuugcggcuuccaaaggcaaccgcgggguucaggccuucagcaagggaucugugcaggccgaucugacacuuauguuugacaauuucgaagucgacuuugugggcgcugccguguccugugaugcugccuuccugaaccucacggggugcuacagcuguaaugcgggagccagagucugccugucuaucaccuccacaggcaccggcacacugagcgcucauaacaaggacgggucccuucacauuguucucccuucugagaauggaaccaaagaucaaugucagauccugcauuuuacggugcccgaaguggaggaggaauuuauguacagcugcgacggcgaugagcggccgcugcucgucaaggggacacugauugccaucgacccuuuugaugaccgcagagaagcuggaggcgaguccaccgugguuaaccccaaaagcgggucuuggaauuucuucgauugguuuuccggacuuaugagcugguucggcggcccucugaagaccauccuccugauuugucuguauguggcccuuucuaucgggcuguuuuuccuccugauuuaccucggacggacaggccugagcaaaauguggcuugccgcuaccaagaaggcguccuga

SEQ ID NO: 14391 - RNA, 3594 nt, Artificial Sequence
  derived and/or modified CDS sequence (opt5) from RVFV(1260/78)__DQ380214.1__GP
auguacgugcugcucaccauccugauuagcguccuuguuugcgaggccgugaucagagugucccugucuagcacacgggaagagacguguuucggcgacuccaccaaccccgaaaugauugagggggcuugggauucucuccgcgaagaggagaugccugaggaacugagcugcuccaucucuggaauuagagaagucaagacaagcucccaggagcuuuaucgggcccugaaagcgaucaucgcugccgacggccucaauaacauuaccugucacgggaaggauccggaggacaaaaucagccugauuaagggacccccucauaaaaagcgcgugggcaucguuagaugcgaacggcgcagagaugccaagcaaauugggcgggagacaauggcuggaaucgccaugaccgugcugcccgcucucgccgucuuugcgcuggccccugugguuuucgcugaagacccccaccuucgcaauagaccuggcaaaggccauaacuacauugaugggaugacacaggaggacgccaccuguaagccggugacguaugcuggagccugcagcuccuuugauguccugcucgaaaaaggcaaguucccccuguuucagagcuacgcgcaccaucggacccuucuggaggccgugcacgacacaaucaucgcuaaagccgauccucccucuugugaccuccaguccgcucacgggaauccuugcaugaaggagaagcuggugaugaaaacccauugucccaacgauuaucaaagcgcccacuaccugaauaacgacggaaagauggccucugucaaaugcccgccuaaguaugaacucacagaggacuguaauuucugccgccagaugaccggcgcuucccugaaaaaggggagcuacccccuucaggaucuguuuugccaguccucugaagacgauggaagcaaacucaagacgaagaugaaaggcguuugugaggugggcgugcaagcgcugaagaaaugcgacgggcagcuuuccacagcccaugaagucgugccuuucgcuguuuuuaagaacagcaaaaagguguaccuggauaagcucgaccugaaaaccgaggagaaucugcuccccgauucuuucgucuguuuugaacacaagggacaguauaaaggcacaauggacuccgggcagaccaagagagagcugaaaucuuucgauauuucucaaugccccaagaucggaggccacgggagcaagaaauguaccggagacgccgccuuuugcuccgcuuacgaauguacagcccaguaugcgaacgcuuacugcucucaugccaauggcagcggcauugugcagauccaaguuuccgggguguggaagaaaccucuuugugucggauaugagcggguggucgugaagcgcgaacugagcgccaaaccgauucagagaguugagcccugcacgaccuguaucacaaagugcgagccucacggccucgugguccggucuaccggguucaagaucuccagcgcuguggccugcgcuucuggaguuugugugacaggcucccagagccccuccaccgaaauuacgcugaaauacccugggaucucucagagcuccggcggagauauuggcguccauauggcccacgacgaccaaucugugagcuccaagaucguggcgcauugucccccgcaggauccuugccuuguucacgggugcauugucugugcccacggacugaucaacuaucagugccauacagcucucagcgccuucgugguggucuuuguguucucuuccaucgcuauuaucugucuggccauucugcacagaguucucaaaugccugaagaucgcgccccgcaaagugcuuaauccucugauguggauuaccgccuuuauccggugggucuacaagaaaaugguggcuagaguugccgacaacauuaaccaggugaaucgcgagaucggcuggauggaagggggacaacucguccugggcaaccccgcuccuaucccccggcaugccccgauuccuagauacagcaccuaucugaugcuucuccugaucgugucuuacgccuccgcuuguagcgagcugauucaggcgucuagccgcaucacaaccugcuccacagaggggguuaauacgaagugucggcucagcggcaccgcccugauuagagcuggaucugugggcgccgaagccugccuuaugcugaagggggucaaagaugaccagacaaaguuccucaaaaucaagaccguguccagcgagcuguccugccgcgaaggacagucuuauuggacaggcagcuuuucccccaaaugucugucuagccggagaugccaccuugugggggagugucacgucaaccgcugccucuccuggcgggauaaugaaaccucugcugaguucagcuuuguuggagaguccacgaccaugagagaaaacaaguguuucgagcaaugcggcggguggggcuguggaugcuuuaaugugaaccccagcugucuguucgugcauacauaccugcagucuguccggaaggaagcccuccgcguguuuaauugcaucgacuggguucacaaacugacccuugagauuacagauuucgacggcuccgugagcaccaucgaucugggggcgucuuccagcagauuuacgaacuggggaucugucucccucagccuggacgcugaaggcauuuccgggagcaauucuuucagcuucaucgaguccccuggaaagggcuaugccauuguggaugagccguuuucugaaaucccccggcagggguuccugggcgagaucagauguaacagcgaauccucuguucuuagcgcccaugaguccugccuccgcgcuccuaaucugauuucuuacaaacccaugaucgaccagcuggaaugcacaaccaaccucauugauccuuuuguggucuucgagcggggaagccugccccaaacaagaaaugacaagaccuuugccgcguccaaaggcaaccgcggggugcaggcuuucagcaagggaucuguucaggccgaccuuacccugauguuugauaacuucgagguggacuuugucggcgccgcuguguccugugaugccgcuuuccucaaucugacagggugcuauagcuguaacgccggagcgagagugugccugucuaucacguccaccggcacaggcacccuuagcgcccacaauaaggacgggucccuccauauuguccugccuucugaaaacggaacaaaagaucaaugucagauccugcacuuuaccguucccgagguggaagaggaguucauguacagcugcgacggcgaugaacggccgcuccuggugaaggggacgcuuaucgcuauugacccuuuugaugaccgcagagaggccggaggcgaauccacagucgugaaucccaaaagcgggucuuggaacuucuucgauugguuuuccggacugaugagcugguucggcggcccucucaagaccauccugcugauuugucuuuacguugcucugucuaucgggcucuuuuuccugcucauuuaucugggacggaccggccuuagcaaaauguggcuggccgccacaaagaaggcuuccuga

SEQ ID NO: 14392 - RNA, 3594 nt, Artificial Sequence
  derived and/or modified CDS sequence (opt5) from RVFV(2007000324)__JF326195.1__GP
auguacgugcugcucaccauccugauuagcguccuuguuugcgaggccgugaucagagugucccugucuagcacacgggaagagacguguuucggcgacuccaccaaccccgaaaugauugagggggcuugggauucucuccgcgaagaggagaugccugaagaacugagcugcuccgucucuggaaucagagaagugaagacaagcucccaggagcuuuaucgggcccugaaagcgauuaucgcugccgacggccucaauaacaucaccugucacgggaagaauccggaggauaaaauuagccugaucaagggacccccucauaaaaagcgcguuggcauugugagaugcgaacggcgcagagacgccaagcaaaucgggcgggagacaauggcuggaauugccaugaccguccugcccgcucucgccguguuugcgcuggccccuguuguguucgcugaagauccccaccuucgcaacagaccuggcaaaggccauaauuacaucgacgggaugacacaggaggaugccaccuguaagccggucacguaugcuggagccugcagcuccuuugacgugcugcucgaaaaaggcaaguucccccuguuucagagcuacgcgcaccaucggacccuucuggaggccgugcacgauacaauuaucgcuaaagccgacccucccucuugugaucuccaguccgcucacgggaacccuugcaugaaggagaagcuggucaugaaaacccauugucccaaugacuaucaaagcgcccacuaccugaacaaugauggaaagauggccucuguuaaaugcccgccuaaguaugaacucacagaggacuguaacuucugccgccagaugaccggcgcuucccugaaaaaggggagcuacccccuucaggaccuguuuugccaguccucugaagaugacggaagcaaacucaagacgaagaugaaaggcgugugugaggugggcguccaagcgcugaagaaaugcgaugggcagcuuuccacagcccaugaagugguuccuuucgcuguguuuaagaauagcaaaaaggucuaccuggacaagcucgaucugaaaaccgaggagaaccugcuccccgacucuuucguguguuuugaacacaagggacaguauaaaggcacaauggauuccgggcagaccaagagagagcugaaaucuuucgacaucucucaaugccccaagauuggaggccacgggagcaagaaauguaccggagaugccgccuuuugcuccgcuuacgaauguacagcccaguaugcgaaugcuuacugcucucaugccaacggcagcggcaucguucagauucaaguguccggggucuggaagaaaccucuuugugugggauaugagcgggucgugguuaagcgcgaacugagcgccaaaccgauccagagaguggagcccugcacgaccuguauuacaaagugcgagccucacggccucgucgugcggucuaccggguucaagaucuccagcgcuguugccugcgcuucuggagugugugucacaggcucccagagccccuccaccgaaaucacgcugaaauacccugggauuucucagagcuccggcggagacaucggcgugcauauggcccacgaugaccaaucugugagcuccaagauuguugcgcauugucccccgcaggacccuugccuuguccacgggugcaucgugugugcccacggacugauuaauuaucagugccauacagcucucagcgccuucguggucaucuuuguguucucuuccaccgcuaucauuugucuggccguucuguacagagugcucaaaugccugaagaucgcgccccgcaaaguccuuaacccucugauguggauuaccgccuuuauccgguggguguacaagaaaaugguugcuagaguggccgauaacauuaaucaggucaaccgcgagaucggcuggauggaagggggacaacucgcucugggcaaucccgccccuauuccccggcacgccccgaucccuagauauagcacauaccugaugcuucuccugaucgugucuuaugcuuccgcguguagcgagcugauucaggccucuagccgcaucaccacaugcuccacggaggggguuaacaccaagugucggcucagcggcacagcucugauuagagccggaucugugggcgccgaggcuugccuuaugcugaagggggucaaagaggaccagaccaaguuccucaaaaucaagacaguguccagcgaacuguccugccgcgagggacagucuuacuggaccggcagcuuuucccccaaaugucugucuagccggagaugccaucuugugggggaaugucacgucaaucgcugccucuccuggcgggauaacgagacgucugccgaguucagcuuuguuggagaauccaccacaaugagagagaauaaguguuucgaacaaugcggcggguggggcuguggaugcuuuaacgugaaucccagcugucuguucgugcacaccuaucugcagucuguccggaaggaggcgcuccgcguguuuaacugcauugacuggguucauaaacugacacuugaaaucaccgauuucgacggcuccgugagcacgaucgaucugggggcuucuuccagcagauuuacaaauuggggaucugucucccucagccuggacgccgagggcauuuccgggagcaacucuuucagcuucaucgaguccccuggaaagggcuacgccauuguggaugaaccguuuucugagaucccccggcagggguuccugggcgaaauuagauguaauagcgaguccucuguucuuagcgcucacgaauccugccuccgcgccccuaaccuggugucuuauaaacccaugaucgaccagcuggagugcaccacaaaucucaucgauccuuuugucguguucgagcggggaagccugccccaaaccagaaacgacaagaccuuugcggcuuccaaaggcaaccgcgggguucaggccuucagcaagggaucugugcaggccgaucuuacacugauguuugacaauuucgaagucgacuuugugggcgcugccguguccugugaugcugccuuccucaaccugacggggugcuacagcuguaaugcgggagccagagucugccugucuauuaccuccacaggcaccggcacacuuagcgcucauaacaaggacgggucccuccacaucguucugccuucugagaauggaaccaaagaucaaugucagauucugcauuuuacggugcccgaaguggaggaggaguucauguacagcugcgacggcgaugaacggccgcuccuggucaaggggacacuuaucgccauugacccuuuugaugaccgcagagaagcuggaggcgaguccaccgugguuaaccccaaaagcgggucuuggaauuucuucgauugguuuuccggacugaugagcugguucggcggcccucucaagaccauccugcugaucugucuuuauguggcccugucuauugggcucuuuuuccugcucaucuaccugggacggacaggccuuagcaaaauguggcuggccgcuaccaagaaggcguccuga

SEQ ID NO: 14393 - RNA, 3594 nt, Artificial Sequence
  derived and/or modified CDS sequence (opt5) from RVFV(KEN/Gar-Msq/131B-04/06)__HM586972.1__GP
auguacgugcugcucaccauccugauuagcguccuuguuugcgaggccgugaucagagugucccugucuagcacacgggaagagacguguuucggcgacuccaccaaccccgaaaugauugagggggcuugggauucuuuucgcgaagaggagaugccugaagaacucagcugcuccgucucuggaaucagagaagugaagacaagcucccaggagcuguaucgggcccuuaaagcgauuaucgcugccgacggccugaauaacaucaccugucacgggaagaauccggaggauaaaauuagccucaucaagggacccccucauaaaaagcgcguuggcauugugagaugcgaacggcgcagagacgccaagcaaaucgggcgggagacaauggcuggaauugccaugaccguccugcccgcucuggccguguucgcgcucgccccuguuguguuugcugaagauccccaucugcgcaacagaccuggcaaaggccacaauuacaucgacgggaugacacaggaggaugccaccuguaagccggucacguaugcuggagccugcagcuccuucgacgugcuucuggaaaaaggcaaguuuccccucuuccagagcuacgcgcaccaucggacccugcuugaggccgugcacgauacaauuaucgcuaaagccgacccucccucuugugaucugcaguccgcucacgggaacccuugcaugaaggagaagcucgucaugaaaacccauugucccaaugacuaucaaagcgcccacuaccugaacaaugauggaaagauggccucuguuaaaugcccgccuaaguaugaacugacagaggacuguaacuuuugccgccagaugaccggcgcuucccucaaaaaggggagcuacccccugcaggaccuuuucugccaguccucugaagaugacggaagcaaacugaagacgaagaugaaaggcgugugugaggugggcguccaagcgcucaagaaaugcgaugggcagcuguccacagcccaugaagugguuccuuuugcuguguucaagaauagcaaaaaggucuaccuugacaagcuggaucucaaaaccgaggagaaccugcugcccgacucuuuuguguguuucgaacacaagggacaguauaaaggcacaauggauuccgggcagaccaagagagagcucaaaucuuuugacaucucucaaugccccaagauuggaggccacgggagcaagaaauguaccggagaugccgccuucugcuccgcuuacgaauguacagcccaguaugcgaaugcuuacugcucucaugccaacggcagcggcaucguucagauucaaguguccggggucuggaagaaaccucugugugugggauaugagcgggucgugguuaagcgcgaacuuagcgccaaaccgauccagagaguggagcccugcacgaccuguauuacaaagugcgagccucacggccuggucgugcggucuaccggguucaagaucuccagcgcuguugccugcgcuucuggagugugugucacaggcucccagagccccuccaccgaaaucacgcucaaauacccugggauuucucagagcuccggcggagacaucggcgugcauauggcccacgaugaccaaucugugagcuccaagauuguugcgcauugucccccgcaggacccuugccugguccacgggugcaucgugugugcccacggacuuauuaauuaucagugccauacagcucugagcgccuuuguggucaucuucguguuuucuuccaccgcuaucauuugucucgccguucuguacagagugcugaaaugccucaagaucgcgccccgcaaaguccugaacccucuuauguggauuaccgccuucauccgguggguguacaagaaaaugguugcuagaguggccgauaacauuaaucaggucaaccgcgagaucggcuggauggaagggggacaacuggcucucggcaaucccgccccuauuccccggcacgccccgaucccuagauauagcacauaccugaugcugcuucucaucgugucuuaugcuuccgcguguagcgagcugauucaggccucuagccgcaucaccacaugcuccacggaggggguuaacaccaagugucggcugagcggcacagcucucauuagagccggaucugugggcgccgaggcuugccugaugcuuaagggggucaaagaggaccagaccaaguuucugaaaaucaagacaguguccagcgaacucuccugccgcgagggacagucuuacuggaccggcagcuucucccccaaaugucugucuagccggagaugccaucuggugggggaaugucacgucaaucgcugccuuuccuggcgggauaacgagacgucugccgaguuuagcuucguuggagaauccaccacaaugagagagaauaaguguuuugaacaaugcggcggguggggcuguggaugcuucaacgugaaucccagcugucucuuugugcacaccuaucugcagucuguccggaaggaggcgcugcgcguguucaacugcauugacuggguucauaaacucacacuggaaaucaccgauuuugacggcuccgugagcacgaucgaucuuggggcuucuuccagcagauucacaaauuggggaucugucucccugagccucgacgccgagggcauuuccgggagcaacucuuucagcuuuaucgaguccccuggaaagggcuacgccauuguggaugaaccguucucugagaucccccggcagggguuucugggcgaaauuagauguaauagcgaguccucuguucugagcgcucacgaauccugccuucgcgccccuaaccucgugucuuauaaacccaugaucgaccagcuggagugcaccacaaaucugaucgauccuuucgucguguuugagcggggaagccucccccaaaccagaaacgacaagaccuucgcggcuuccaaaggcaaccgcgggguucaggccuuuagcaagggaucugugcaggccgaucugacacuuauguucgacaauuuugaagucgacuucgugggcgcugccguguccugugaugcugccuuucugaaccucacggggugcuacagcuguaaugcgggagccagagucugccugucuauuaccuccacaggcaccggcacacugagcgcucauaacaaggacgggucccuucacaucguucucccuucugagaauggaaccaaagaucaaugucagauucugcauuucacggugcccgaaguggaggaggaauuuauguacagcugcgacggcgaugagcggccgcugcucgucaaggggacacugaucgccauugacccuuucgaugaccgcagagaagcuggaggcgaguccaccgugguuaaccccaaaagcgggucuuggaauuucuuugauugguucuccggacuuaugagcugguuuggcggcccucugaagaccauccuccugaucugucuguauguggcccuuucuauugggcuguucuuucuccugaucuaccucggacggacaggccugagcaaaauguggcuugccgcuaccaagaaggcguccuga

SEQ ID NO: 14394 - RNA, 3594 nt, Artificial Sequence
  derived and/or modified CDS sequence (opt5) from RVFV(2007004194)__EU574031.1__GP
auguacgugcugcucaccauccugauuagcguccuuguuugcgaggccgugaucagagugucccugucuagcacacgggaagagacguguuucggcgacuccaccaaccccgaaaugauugagggggcuugggauucucuccgcgaagaggagaugccugaagaacugagcugcuccgucucuggaaucagagaagugaagacaagcucccaggagcuuuaucgggcccugaaagcgauuaucgcugccgacggccucaauaacaucaccugucacgggaagaauccggaggauaaaauuagccugaucaagggacccccucauaaaaagcgcguuggcauugugagaugcgaacggcgcagagacgccaagcaaaucgggcgggagacaauggcuggaauugccaugaccguccugcccgcucucgccguguuugcgcuggccccuguuguguucgcugaagauccccaccuucgcaacagaccuggcaaaggccauaauuacaucgacgggaugacacaggaggaugccaccuguaagccggucacguaugcuggagccuguucuuccuuugacgugcugcucgaaaaaggcaaguucccccuguuucagagcuacgcgcaccaucggacccuucuggaggccgugcacgauacaauuaucgcuaaagccgacccucccucuugcgaucuccaguccgcucacgggaacccuugcaugaaggagaagcuggucaugaaaacccauugucccaaugacuaucaaagcgcccacuaccugucuaacgauggaaagauggccuccguuaaaugcccgccuaaguaugaacucacagaggacuguaauuucugccgccagaugaccggcgcuagccugaaaaagggguccuacccccuucaggaccuguuuugccagucuagcgaagaugacggauccaaacucaagacgaagaugaaaggcgugugugaggugggcguccaagcgcugaagaaaugcgaugggcagcuuagcacagcccaugaagugguuccuuucgcuguguuuaagaacucuaaaaaggucuaccuggacaagcucgaucugaaaaccgaggagaaucugcuccccgacuccuucguguguuuugaacacaagggacaguauaaaggcacaauggauagcgggcagaccaagagagagcugaaaucuuucgacaucagccaaugccccaagauuggaggccacggguccaagaaauguaccggagaugccgccuuuugcucugcuuacgaauguacagcccaguaugcgaacgcuuacugcagccaugccaauggcuccggcaucguucagauucaagugagcggggucuggaagaaaccucuuugugugggauaugagcgggucgugguuaagcgcgaacugucugccaaaccgauccagagaguggagcccugcacgaccuguauuacaaagugcgagccucacggccucgucgugcgguccaccggguucaagaucagcucugcuguugccugcgcuuccggagugugugucacaggcagccagucccccucuaccgaaaucacgcugaaauacccugggauuagccaguccucuggcggagacaucggcgugcauauggcccacgaugaccaaagcguguccagcaagauuguugcgcauugucccccgcaggacccuugccuuguccacgggugcaucgugugugcccacggacugauuaacuaucagugccauacagcucucucugccuucguggucguguuuguuuucuccagcaucgcuaucauuugucuggccauccuguacagagugcucaaaugccugaagauugcgccccgcaaaguccuuaauccucugauguggaucaccgccuuuauucgguggguguacaagaaaaugguugcuagaguggccgauaacaucaaccaggucaaucgcgagauuggcuggauggaagggggacaacucgugcugggcaaccccgcuccuaucccccggcacgccccgaucccuagauauucuaccuaccugaugcuucuccugauuguuuccuaugccagcgcuuguucugagcugauccaggcgagcucccgcauuacaaccugcagcacagagggggugaauacgaagugucggcucucuggcaccgcccugaucagagcuggauccgucggcgccgaagccugccuuaugcugaagggggugaaagaggaccagacaaaguuccucaaaauuaagaccgugagcuccgaacugucuugccgcgagggacagagcuacuggacaggcuccuuuucucccaaaugucugagcucccggagaugccaucuugucggggaaugucacguuaaccgcugccucucuuggcgggauaaugagaccagcgcugaguucuccuuugugggagaaagcacgaccaugagagagaacaaguguuucgaacaaugcggcggguggggcuguggaugcuuuaaugugaaccccucuugucuguucguccacacauaucugcaguccgugcggaaggaggcccuccgcguuuuuaauugcaucgacugggugcauaaacugacccuugaaaucacagauuucgacggcagcgucucuaccauugaucugggggcguccagcucuagauuuacgaacuggggauccgugagccucucccuggacgcugagggcaucagcgggucuaauagcuucuccuucauugagucuccuggaaagggcuacgccaucguugaugaaccguuuagcgagauuccccggcagggguuccugggcgaaaucagauguaacuccgagucuagcgugcuuuccgcccacgaaucuugccuccgcgcuccuaaucugaucagcuauaaacccaugauugaccagcuggagugcacaaccaaccucaucgauccuuuugucguguucgagcggggaucccugccccaaacaagaaaugacaagaccuuugccgcgagcaaaggcaaccgcgggguucaggcuuucucuaagggauccgugcaggccgaucuuacccugauguuugacaacuucgaagucgacuuugugggcgccgcugugagcugugaugccgcuuuccucaaucugacagggugcuacucuuguaacgccggagcgagagucugccuguccauuacgagcaccggcacaggcacccuuuccgcccauaauaaggacgggucucuccacaucguucugccuagcgagaacggaacaaaagaucaaugucagauucugcauuuuaccgugcccgaaguggaggaggaguucauguacuccugcgacggcgaugagcggccgcuccuggucaaggggacgcuuaucgcuaucgacccuuuugaugaccgcagagaagccggaggcgagagcacagugguuaaucccaaaucuggguccuggaacuucuucgauugguuuagcggacugaugucuugguucggcggcccucucaagaccauucugcugaucugucuuuauguggcucugagcauugggcucuuuuuccugcucaucuaccugggacggaccggccuuuccaaaauguggcuggccgccacaaagaaggcuucuuga

SEQ ID NO: 14395 - RNA, 3594 nt, Artificial Sequence
  derived and/or modified CDS sequence (opt5) from RVFV(73HB1230)__DQ380221.1__GP
auguacgugcugcucaccauccugauuagcguccuuguuugcgaggccgugaucagagugucccugucuagcacacgggaagagacguguuucggcgacuccaccaaccccgaaaugauugagggggcuugggauucucuccgcgaagaggagaugccugaagaacugagcugcuccaucucuggaauuagagaagucaagacaagcucccaggagcuuuaucgggcccugaaagcgaucaucgcugccgacggccucaauaacauuaccugucacgggaaggauccggaggacaaaaucagccugauuaagggacccccucauaaaaagcgcgugggcaucguuagaugcgaacggcgcagagaugccaagcaaguggggcgggagacaauggcuggaauugccaugaccguccugcccgcucucgccguguuugcgcuggccccuguuguguucgcugaagacccccaccuucgcaauagaccuggcaaaggccauaacuacaucgaugggaugacacaggaggacgccaccuguaagccggucacguaugcuggagccuguucuuccuuugaugugcugcucgaaaaaggcaaguucccccuguuucagagcuacgcgcaccaucggacccuucuggaggccgugcacgacacaauuaucgcuaaagccgauccucccucuugcgaccuccaguccgcucacgggaauccuugcaugaaggagaagcuggucaugaaaacccauugucccaacgauuaucaaagcgcccacuaccugaauaacgacggaaagauggccucuguuaaaugcccgccuaaguaugaacucacagaggacuguaauuucugccgccagaugaccggcgcuucccugaaaaaggggagcuacccccuucaggaucuguuuugccaguccucugaagacgauggaagcaaacucaagacgaagaugaaaggcgugugugaggugggcguccaagcgcugaagaaaugcgacgggcagcuuuccacagcccaugaagugguuccuuucgcuguguuuaagaacagcaaaaaggucuaccuggauaagcucgaccugaaaaccgaggagaaucugcuccccgauucuuucguguguuuugaacacaagggacaguauaaaggcacaauggacuccgggcagaccaagaaagagcugaaguccuucgauaucucucaaugccccaagauuggaggccacgggagcaaaaaguguaccggagacgccgccuuuugcuccgcuuacgaauguacagcccaguaugcgaacgcuuacugcucucaugccaauggcagcggcaucguucagauucaaguguccggggucuggaaaaagccucuuugugugggauaugagagagucgugguuaaacgggaacugagcgccaagccgauccagcgcguggagcccugcacgaccuguauuacaaagugcgagccucacggccucgucgugagaucuaccggguucaaaaucuccagcgcuguugccugcgcuucuggagugugugucacaggcucccagagccccuccaccgaaaucacgcugaaguacccugggauuucucagagcuccggcggagauaucggcgugcauauggcccacgacgaccaaucugugagcuccaaaauuguugcgcauugucccccgcaggauccuugccuuguccacgggugcaucgugugugcccacggacugauuaacuaucagugccauacagcucucagcgccuucguggucguguuuguuuucucuuccaucgcuaucauuugucuggccauccuguaccgggugcucaagugccugaaaauugcgcccagaaagguccuuaauccucugauguggaucaccgccuuuauucgcuggguguacaaaaagaugguugcucggguggccgacaacaucaaccaggucaauagagagauuggcuggauggaagggggacaacucgugcugggcaaccccgcuccuaucccccgccacgccccgaucccucgguauagcaccuaccugaugcuucuccugauuguuucuuaugccuccgcuuguagcgagcugauccaggcgucuagcagaauuacaaccugcuccacagagggggugaauacgaagugucgccucagcggcaccgcccugauccgggcuggaucugucggcgccgaagccugccuuaugcugaaaggggugaaggaggaucagacaaaauuccucaagauuaaaaccguguccagcgaacuguccugcagagagggacagucuuacuggacaggcagcuuuucccccaagugucugucuagccgccggugccaucuugucggggaaugucacguuaacagaugccucuccuggcgcgacaaugagaccucugcugaguucagcuuugugggagaauccacgaucaugcgggagaacaaguguuucgaacaaugcggcggguggggcuguggaugcuuuaaugugaaccccagcugucuguucguccacaccuaucugcagucugugagaaaagaggcccuccggguuuuuaauugcaucgauugggugcauaagcugacacuugaaauuaccgacuucgauggcuccgucagcacaaucgaccugggggcgucuuccagccgcuuuaccaacuggggaucugugucccucagccuggaugcugagggcauuuccgggagcaauucuuucagcuucaucgaguccccuggaaaaggcuacgccauuguugacgaaccguuuucugagauccccagacagggguuccugggcgaaauccgguguaacagcgaguccucugugcuuagcgcccacgaauccugccucagagcuccuaaucugauuucuuauaagcccaugaucgaucagcuggagugcacgacaaaccucauugacccuuuugucguguucgagcgcggaagccugccccaaacccggaaugauaaaacauuugccgcguccaagggcaacagagggguucaggcuuucagcaagggaucugugcaggccgaccuuacccugauguuugacaacuucgaagucgauuuugugggcgccgcuguguccugugacgccgcuuuccucaaucugaccgggugcuacagcuguaacgccggagcgcgcgucugccugucuaucacauccacgggcaccggcacacuuagcgcccauaauaaagaugggucccuccacauuguucugccuucugagaacggaaccaaggaccaaugucagauccugcauuuuacagugcccgaaguggaggaggaguucauguacagcugcgauggcgacgagagaccgcuccuggucaaagggacccuuaucgcuauugauccuuuugacgaucggcgcgaagccggaggcgaguccacggugguuaaucccaagagcgggucuuggaacuucuucgacugguuuuccggacugaugagcugguucggcggcccucucaaaacaauccugcugauuugucuuuauguggcucugucuaucgggcucuuuuuccugcucauuuaccugggaagaaccggccuuagcaagauguggcuggccgccaccaagaaagcuagcuga

SEQ ID NO: 14396 - RNA, 3594 nt, Artificial Sequence
  derived and/or modified CDS sequence (opt5) from RVFV(73HB1449)__DQ380211.1__GP
auguacgugcugcucaccauccugauuagcguccuuguuugcgaggccgugaucagagugucccugucuagcacacgggaagagacguguuucggcgacuccaccaaccccgaaaugauugagggggcuugggauucucuccgcgaagaggagaugccugaagaacugagcugcuccaucucuggaauuagagaagucaagacaagcucccaggagcuuuaucgggcccugaaagcgaucaucgcugccgacggccucaauaacauuaccugucacgggaaggauccggaggacaaaaucagccugauuaagggacccccucauaaaaagcgcgugggcaucguuagaugcgaacggcgcagagaugccaagcaaauugggcgggagacaauggcuggaaucgccaugaccgugcugcccgcucucgccgucuuugcgcuggccccugugguuuucgcugaagacccccaccuucgcaauagaccuggcaaaggccauaacuacauugaugggaugacacaggaggacgccaccuguaagccggugacguaugcuggagccugcagcuccuuugauguccugcucgaaaaaggcaaguucccccuguuucagagcuacgcgcaccaucggacccuucuggaggccgugcacgacacaaucaucgcuaaagccgauccucccucuugugaccuccaguccgcucacgggaauccuugcaugaaggagaagcuggugaugaaaacccauugucccaacgauuaucaaagcgcccacuaccugaauaacgacggaaagauggccucugucaaaugcccgccuaaguaugaacucacagaggacuguaauuucugccgccagaugaccggcgcuucccugaaaaaggggagcuacccccuucaggaucuguuuugccaguccucugaagacgauggaagcaaacucaagacgaagaugaaaggcguuugugaggugggcgugcaagcgcugaagaaaugcgacgggcagcuuuccacagcccaugaagucgugccuuucgcuguuuuuaagaacagcaaaaagguguaccuggauaagcucgaccugaaaaccgaggagaaucugcuccccgauucuuucgucuguuuugaacacaagggacaguauaaaggcacaauggacuccgggcagaccaagagagagcugaaaucuuucgauauuucucaaugccccaagaucggaggccacgggagcaagaaauguaccggagacgccgccuuuugcuccgcuuacgaauguacagcccaguaugcgaacgcuuacugcucucaugccaauggcagcggcauugugcagauccaaguuuccgggguguggaagaaaccucuuugugucggauaugagcggguggucgugaagcgcgaacugagcgccaaaccgauucagagaguugagcccugcacgaccuguaucacaaagugcgagccucacggccucgugguccggucuaccggguucaagaucuccagcgcuguggccugcgcuucuggaguuugugugacaggcucccagaaccccagcaccgaaauuacgcugaaauacccugggaucucccagucuagcggcggagauauuggcguccauauggcccacgacgaccaauccgugucuagcaagaucguggcgcauugucccccgcaggauccuugccuuguucacgggugcauugucugugcccacggacugaucaauuaucagugccauacagcucucuccgccuucgugguggucuuuguguucagcucuaucgcuauuaucugucuggccauucuguacagaguucucaaaugccugaagaucgcgccccgcaaagugcuuaacccucugauguggauuaccgccuuuauccggugggucuacaagaaaaugguggcuagaguugccgacaacauuaaucaggugaaccgcgagaucggcuggauggaagggggacaacucguccugggcaaucccgcuccuaucccccggcacgccccgauuccuagauauuccaccuaccugaugcuucuccugaucgugagcuaugccucugcuuguuccgagcugauucaggcgagcucucgcaucacaaccugcagcacagaggggguuaacacgaagugucggcucuccggcaccgcccugauuagagcuggaagcgugggcgccgaagccugccuuaugcugaagggggucaaagaugaccagacaaaguuccucaaaaucaagaccgugucuuccgagcugagcugccgcgaaggacaguccuacuggacaggcucuuuuagccccaaaugucuguccucucggagaugccaucuugugggggagugucacgucaaucgcugccucagcuggcgggauaacgaaaccuccgcugaguucucuuuuguuggagagagcacgaccaugagagaaaauaaguguuucgagcaaugcggcggguggggcuguggaugcuuuaacgugaaucccuccugucuguucgugcacacauaucugcagagcguccggaaggaagcccuccgcguguuuaacugcaucgacuggguucauaaacugacccuugagauuacagauuucgacggcucuguguccaccaucgaucugggggcgucuagcuccagauuuacgaauuggggaagcgucucucucucccuggacgcugaaggcauuagcggguccaacagcuucucuuucaucgagagcccuggaaagggcuacgccauuguggaugagccguuuuccgaaaucccccggcagggguuccugggcgagaucagauguaauucugaaagcuccguucuuucugcccacgagagcugccuccgcgcuccuaaccugauuuccuauaaacccaugaucgaccagcuggaaugcacaaccaaucucauugauccuuuuguggucuucgagcggggaucucugccccaaacaagaaacgagaagaccuuugccgcgagcaaaggcaaccgcggggugcaggcuuucuccaagggaagcguucaggccgaccuuacccugauguuugacaauuucgaaguggauuuugucggcgccgcugugucuugugacgccgcuuuccucaaccugacagggugcuacuccuguaaugccggagcgagagugugccugagcaucacgucuaccggcacaggcacccuuuccgcccauaacaaggaugggagccuccacauuguccugccuuccgagaauggaacaaaagaccaaugucagauccugcauuuuaccguucccgaaguggaggaggaguucauguacucuugcgauggcgacgagcggccgcuccuggugaaggggacgcuuaucgcuauugauccuuuugacgaucgcagagaagccggaggcgagagcacagucgugaaccccaaauccgggagcuggaauuucuucgacugguuuucuggacugauguccugguucggcggcccucucaagaccauccugcugauuugucuuuauguugcucugagcaucgggcucuuuuuccugcucauuuaccugggacggaccggccuuucuaaaauguggcuggccgccacaaagaaggcuagcuga

SEQ ID NO: 14397 - RNA, 3594 nt, Artificial Sequence
  derived and/or modified CDS sequence (opt5) from RVFV(ZH-548M12)__M25276.1__GP
auguacgugcugcucaccauccugacaagcguccuuguuugcgaggccauuaucagagugucccugucuagcacgcgggaagagaccuguuucggcgacuccacaaaccccgaaaugauugagggggcuugggauucucuccgcgaagaggagaugccugaggaacugagcugcuccaucucuggaauuagagaagugaaaaccagcucccaggagcuuuaucgggcccugaaagcgaucaucgcugccgacggccucaauaacauuacaugucacgggaaggauccggaggacaaaaucagccugauuaagggacccccucauaaaaagcgcgucggcaucgugagaugcgaacggcgcagagaugccaagcaaauugggcggaaaaccauggcuggaaucgccaugacaguucugcccgcucucgccguguuugcgcuggccccugucguguucgcugaggacccccaccuucgcaauagaccuggcaagggccauaacuacauugaugggaugacccaggaagacgccacguguaaaccgguuaccuaugcuggagccuguucuuccuuugaugugcugcucgagaagggcaaauucccccuguuucagagcuacgcgcaccaucggacacuucuggaagccguccacgacaccaucaucgcuaaggccgauccucccucuugcgaccuccuguccgcucacgggaauccuugcaugaaggagaaacuggugaugaagacacauugucccaacgauuaucagagcgcccaccaucucaauaacgacggaaaaauggccucugugaagugcccgccuaaauacgagcugaccgaagacuguaauuucugccgccaaaugacgggcgcuucccuuaagaaagggagcuauccccugcaggaucucuuuugccaguccucugaggacgauggaagcaagcugaagacaaaaaugaagggcgucugugaaguuggcgugcaggcgcuuaaaaagugcgacgggcaacuguccaccgcccacgagguggucccuuucgcuguguuuaaaaacagcaagaagguuuaccucgauaaacuggaccugaagacagaagagaaucuccugcccgauucuuucguguguuuugagcacaaaggacaguacaagggcaccauggacuccgggcagaccaaaagagaacuuaagagcuucgauauuucucagugccccaagaucggaggccaugggagcaaaaaguguacaggagacgccgccuuuugcuccgcuuaugaguguacggcccaauacgcgaacgcuuauugcucucacgccaauggcagcggcauuguccagauccagguguccgggguuuggaaaaagccucugugugugggauacgaacgggucguggucaaacgcgagcucagcgccaagccgauucaaagaguggaacccugcaccacauguaucaccaagugcgagccucauggccugguugugcggucuacaggguucaaaaucuccagcgcugucgccugcgcuucuggaguguguguuaccggcucccagagccccuccacggagauuacacuuaaguauccugggaucucucagagcuccggcggagauauuggcgugcacauggcccaugacgaccagucugucagcuccaaaaucguggcgcacugucccccgcaagauccuugccuggugcacgacugcauuguuugugcccaugggcucaucaacuaccagugccacaccgcucugagcgccuucgucgugguguuugucuucucuuccaucgcuauuaucugucuggccauucucuauagagugcugaagugccuuaaaaucgcgccccgcaagguucugaauccucucauguggauuaccgccuuuauccgguggauuuacaaaaagaugguggcuagagucgccgauaacaucaaccaggugaaucgcgaaaucggauggauggagggcgggcagcugguucugggaaaccccgcuccuauuccccggcaugccccgaucccuagauacagcacauaucuuaugcuccugcugauugugucuuacgccuccgcuuguagcgaacucauccaagcgucuagccgcauuaccacaugcuccacggagggcgucaauaccaagugucggcugagcgggacagcccuuaucagagcuggcucugugggagccgaggccugccugaugcucaaaggcguuaaggaagaccagaccaaauuccugaagcugaaaacaguguccagcgagcuuuccugccgcgaagggcagucuuauuggaccgggagcuuuucccccaagugucucucuagccggagaugccaccuggucggcgagugucacgugaaccgcugccuguccuggcgggauaaugaaacgucugcugaguucagcuuugugggggaguccaccacaaugagagaaaacaaguguuucgagcagugcggaggcuggggguguggcugcuuuaaugucaaccccagcugucucuucguucauaccuaccugcaaucugugcggaaagaagcccuucgcguguuuaauugcaucgacuggguccacaagcugacacucgagauuaccgauuucgacggauccgugagcacgaucgaucugggcgcgucuuccagcagauuuacaaacugggggucuguuucccugagccuugacgcugaaggaauuuccggcagcaauucuuucagcuucaucgaguccccugggaaaggauaugccauuguggaugagccguuuucugaaaucccccggcagggcuuccucggggagaucagauguaacagcgaauccucuguccugagcgcccaugaguccugccugcgcgcuccuaaucucauuucuuacaagcccaugaucgaccagcuggaaugcaccacaaaccuuauugauccuuuugugguuuucgagcggggcagccugccccagaccagaaaugacaaaaccuuugccgcguccaagggaaaccgcggcgugcaggcuuucagcaaggggucuguccaagccgaccucacacugauguuugauaacuucgagguggacuuuguuggagccgcuguguccugugaugccgcuuuccugaaucuuacgggcugcuauagcuguaacgccggggcgagagucugccucucuaucaccuccacaggaaccggcagccuguccgcccacaauaaagacggcucucugcauauugugcucccuagcgaaaacgggacaaaggaucagugucaaauccugcacuuuaccgugcccgaggucgaagaggaguucauguacuccugcgacggagaugaacggccgcuucugguuaaaggcacgcucaucgcuauugacccuuuugaugaccgcagagaggccgggggagaaagcacaguggugaaucccaagucuggcuccuggaacuucuucgauugguuuagcgggcugaugucuugguucggaggcccucugaaaaccauccuucugauuugucucuacgucgcucugagcaucggccucuuuuuccugcuuauuuaucugggaggaaccggccucuccaagauguggcuggccgccacaaagaaggcuucuuga

SEQ ID NO: 14398 - RNA, 3594 nt, Artificial Sequence
  derived and/or modified CDS sequence (opt5) from RVFV(ZINGA J83 R1)__KU978776.1__GP
auguacgugcugcucaccauccugauuagcguccuuguuugcgaggccgugaucagagugucccugucuagcacacgggaagagacguguuucggcgacuccaccaaccccgaaaugauugagggggcuugggauucucuccgcgaagaggagaugccugaagaacugagcugcuccaucucuggaauuagagaagucaagacaagcucccaggagcuuuaucgggcccugaaagcgaucaucgcugccgacggccucaauaacauuaccugucacgggaaggauccggaggacaaaaucagccugauuaagggacccccucauaaaaagcgcgugggcaucguuagaugcgaacggcgcagagaugccaagcaaauugggcgggagacaauggcuggaaucgccaugaccgugcugcccgcucucgccgucuuugcgcuggccccugugguuuucgcugaagacccccaccuucgcaauagaccuggcaaaggccauaacuacauugaugggaugacacaggaggacgccaccuguaagccggugacguaugcuggagccuguucuuccuuugauguccugcucgaaaaaggcaaguucccccuguuucagagcuacgcgcaccaucggacccuucuggaggccgugcacgacacaaucaucgcuaaagccgauccucccucuugcgaccuccaguccgcucacgggaauccuugcaugaaggagaagcuggugaugaaaacccauugucccaacgauuaucaaagcgcccacuaccugaauaacgacggaaagauggccucugucaaaugcccgccuaaguaugaacucacagaggacuguaauuucugccgccugaugaccggcgcuucccuuaaaaaggggagcuacccccugcaggaucucuuuugccaguccucugaagacgauggaagcaaacugaagacgaagaugaaaggcguuugugaggugggcgugcaggcgcuuaagaaaugcgacgggcaacuguccacagcccaugaagucgugccuuucgcuguuuuuaagaacagcaaaaagguguaccucgauaagcuggaccugaaaaccgaggagaaucuccugcccgauucuuucgucuguuuugaacacaagggacaguauaaaggcacaauggacuccgggcagaccaagagagagcuuaagagcuucgauauuucucagugccccaagaucggaggccacgggagcaagaaauguaccggagacgccgccuuuugcuccgcuuacgaauguacagcccaauaugcgaacgcuuacugcucucaugccaauggcagcggcauugugcagauccagguuuccgggguguggaagaaaccucugugugucggauaugagcggguggucgugaagcgcgaacucagcgccaaaccgauucaaagaguugagcccugcacgaccuguaucacaaagugcgagccucacggccuggugguccggucuaccggguucaagaucuccagcgcuguggccugcgcuucuggaguuugugugacaggcucccagagccccuccaccgaaauuacgcuuaaauacccugggaucucucagagcuccggcggagauauuggcguccauauggcccacgacgaccagucugugagcuccaagaucguggcgcauugucccccgcaagauccuugccugguucacgggugcauugucugugcccacggacucaucaacuaucagugccauacagcucugagcgccuucgugguggucuuuguguucucuuccaucgcuauuaucugucuggccauucucuacagaguucugaaaugccuuaagaucgcgccccgcaaagugcugaauccucucauguggauuaccgccuuuauccggugggucuacagaaagaugguggcucgcguugccgacaacauuaaccaggugaaucgggagaucggcuggauggaagggggacagcugguccugggcaaccccgcuccuauccccagacacgugccgauuccucgcuauagcaccuaccuuaugcuccugcugaucguuucuuaugccuccgccuguagcgagcucauucaggcuucuagccggaucacaaccugcuccacagagggggugaauacgaaauguagacugagcggcaccgcgcuuauucgcgccggaucugucggcgcugaagccugccugaugcucaagggggugaaggaggaucaaacaaaauuccugaagaucaaaaccguguccagcgaacuguccugccgggagggacagucuuacuggacaggcagcuuuucccccaagugucuuucuagcagacgcugccaucucgucggggaaugucacguuaaccggugccuguccuggagagacaaugagaccucugccgaguucagcuuugugggagaauccacgaccaugcgggagaacaaauguuucgaacagugcggcggguggggcuguggaugcuuuaaugugaaccccagcugucuguucguccacacauaucuccaaucugugcgcaaggaggcucugagaguuuuuaauugcaucgauugggugcauaaacuuacccuggaaauuacagacuucgauggcuccgucagcaccaucgaccucggggccucuuccagccgguuuacgaacuggggaucugugucccugagccuggaugcggagggcauuuccgggagcaauucuuucagcuucaucgaguccccuggaaaaggcuacgcuauuguugacgaaccguuuucugagauccccagacagggguuccuuggcgaaauccgcuguaacagcgaguccucugugcucagcgcccacgaauccugccugcgggccccuaaucugauuucuuauaagcccaugaucgaucagcucgagugcacaaccaaccugauugacccuuuugucguguucgagagaggaagccuuccccagacacgcaaugauaaaaccuuugcugccuccaagggcaacagagggguucaagcguucagcaaaggaucugugcaggcugaccugacccucauguuugacaacuucgaagucgauuuugugggcgccgccguguccugugacgcugccuuccugaaucugacagggugcuacagcuguaacgcuggagcccgggucugccuuucuaucacguccaccggcacaggcacccucagcgcgcauaauaaggaugggucccugcacauuguucugccuucugagaacggaacaaaggaccagugucaaauccuccauuuuaccgugcccgaaguggaggaggaguucauguacagcugcgauggcgacgagcgcccgcugcuugucagagggacgcugaucgccauugauccuuuugacgaucggcgcgaagcuggaggcgaguccacagugguuaaucccaaaagcgggucuuggaacuucuucgacugguuuuccggacucaugagcugguucggcggcccucugaagaccauccugcuuauuugucuguauguggcccucucuaucgggcuguuuuuccuccugauuuaccuuggaagaaccggccugagcaaaauguggcucgcugccacaaagaaagccuccuga

SEQ ID NO: 14399 - RNA, 3594 nt, Artificial Sequence
  derived and/or modified CDS sequence (opt5) from RVFV(Sudan 28-2010)__JQ820491.1__GP
auguacgugcugcucaccauccugauuagcguccuuguuugcgaggccgugaucagagugucccugucuagcacacgggaagagacguguuucggcgacuccaccaaccccgaaaugauugagggggcuugggauucucuccgcgaagaggagaugccugaagaacugagcugcuccgucucuggaaucagagaagugaagacaagcucccaggagcuuuaucgggcccugaaagcgauuaucgcugccgacggccucaauaacaucaccugucacgggaagaauccggaggauaaaauuagccugaucaagggacccccucauaaaaagcgcguuggcauugugagaugcgaacggcgcagagacgccaagcaaaucgggcgggagacaauggcuggaauugccaugaccguccugcccgcucucgccguguuugcgcuggccccuguuguguucgcugaagauccccaccuucgcaacagaccuggcaaaggccauaauuacaucgacgggaugacacaggaggaugccaccuguaagccggucacguaugcuggagccugcagcuccuuugacgugcugcucgaaaaaggcaaguucccccuguuucagagcuacgcgcaccaucggacccuucuggaggccgugcacgauacaauuaucgcuaaagccgacccucccucuugugaucuccaguccgcucacgggaacccuugcaugaaggagaagcuggucaugaaaacccauugucccaaugacuaucaaagcgcccacuaccugaacaaugauggaaagauggccucuguuaaaugcccgccuaaguaugaacucacagaggacuguaacuucugccgccagaugaccggcgcuucccugaaaaaggggagcuacccccuucaggaccuguuuugccaguccucugaagaugacggaagcaaacucaagacgaagaugaaaggcgugugugaggugggcguccaagcgcugaagaaaugcgaugggcagcuuuccacagcccaugaagugguuccuuucgcuguguuuaagaauagcaaaaaggucuaccuggacaagcucgaucugaaaaccgaggagaaccugcuccccgacucuuucguguguuuugaacacaagggacaguauaaaggcacaauggauuccgggcagaccaagagagagcugaaaucuuucgacaucucucaaugccccaagauuggaggccacgggagcaagaaauguaccggagaugccgccuuuugcuccgcuuacgaauguacagcccaguaugcgaaugcuuacugcucucaugccaacggcagcggcaucguucagauucaaguguccggggucuggaagaaaccucuuugugugggauaugagcgggucgugguuaagcgcgaacugagcgccaaaccgauccagagaguggagcccugcacgaccuguauuacaaagugcgagccucacggccucgucgugcggucuaccggguucaagaucuccagcgcuguugccugcgcuucuggagugugugucacaggcucccagagccccuccaccgaaaucacgcugaaauacccugggauuucucagagcuccggcggagacaucggcgugcauauggcccacgaugaccaaucugugagcuccaagauuguugcgcauugucccccgcaggacccuugccuuguccacgggugcaucgugugugcccacggacugauuaauuaucagugccauacagcucucagcgccuucguggucguguuuguuuucucuuccaucgcuaucauuugucuggccauccuguacagagugcucaaaugccugaagauugcgccccgcaaaguccuuaacccucugauguggaucaccgccuuuauucgguggguguacaagaaaaugguugcuagaguggccgauaacaucaaucaggucaaccgcgagauuggcuggauggaagggggacaacucgugcugggcaaucccgcuccuaucccccggcacgccccgaucccuagauauagcaccuaccugaugcuucuccugauuguuucuuaugccuccgcuuguagcgagcugauccaggcgucuagccgcauuacaaccugcuccacagagggggugaacacgaagugucggcucagcggcaccgcccugaucagagcuggaucugucggcgccgaagccugccuuaugcugaagggggugaaagaggaccagacaaaguuccucaaaauuaagaccguguccagcgaacuguccugccgcgagggacagucuuacuggacaggcagcuuuucccccaaaugucugucuagccggagaugccaucuugucggggaaugucacguuaaucgcugccucuccuggcgggauaacgagaccucugcugaguucagcuuugugggagaauccacgaccaugagagagaauaaguguuucgaacaaugcggcggguggggcuguggaugcuuuaacgugaaucccagcugucuguucguccacacauaucugcagucugugcggaaggaggcccuccgcguuuuuaacugcaucgacugggugcauaaacugacccuugaaaucacagauuucgacggcuccgucagcaccauugaucugggggcgucuuccagcagauuuacgaauuggggaucugugucccucagccuggacgcugagggcaucuccgggagcaacucuuucagcuucauugaguccccuggaaagggcuacgccaucguugaugaaccguuuucugagauuccccggcagggguuccugggcgaaaucagauguaauagcgaguccucugugcuuagcgcccacgaauccugccuccgcgcuccuaaccugaucucuuauaaacccaugauugaccagcuggagugcacaaccaaucucaucgauccuuuugucguguucgagcggggaagccugccccaaacaagaaacgacaagaccuuugccgcguccaaaggcaaccgcgggguucaggcuuucagcaagggaucugugcaggccgaucuuacccugauguuugacaauuucgaagucgacuuugugggcgccgcuguguccugugaugccgcuuuccucaaccugacagggugcuacagcuguaaugccggagcgagagucugccugucuauuacguccaccggcacaggcacccuuagcgcccauaacaaggacgggucccuccacaucguucugccuucugagaauggaacaaaagaucaaugucagauucugcauuuuaccgugcccgaaguggaggaggaguucauguacagcugcgacggcgaugagcggccgcuccuggucaaggggacgcuuaucgcuaucgacccuuuugaugaccgcagagaagccggaggcgaguccacagugguuaaccccaaaagcgggucuuggaauuucuucgauugguuuuccggacugaugagcugguucggcggcccucucaagaccauucugcugaucugucuuuaugugguccugucuauugggcucuuuuuccugcucaucuaccugggacggaccggccuuagcaaaauguggcuggcugccacaaagaaggccuccuga

SEQ ID NO: 14400 - RNA, 3594 nt, Artificial Sequence
  derived and/or modified CDS sequence (opt5) from RVFV(2007001292)__EU574046.1__GP
auguacgugcugcucaccauccugauuagcguccuuguuugcgaggccgugaucagagugucccugucuagcacacgggaagagacguguuucggcgacuccaccaaccccgaaaugauugagggggcuugggauucucuccgcgaagaggagaugccugaagaacugagcugcuccgucucuggaaucagagaagugaagacaagcucccaggagcuuuaucgggcccugaaagcgauuaucgcugccgacggccucaauaacaucaccugucacgggaagaauccggaggauaaaauuagccugaucaagggacccccucauaaaaagcgcguuggcauugugagaugcgaacggcgcagagacgccaagcaaaucgggcgggagacaauggcuggaauugccaugaccguccugcccgcucucgccguguuugcgcuggccccuguuguguucgcugaagauccccaccuucgcaacagaccuggcaaaggccauaauuacaucgacgggaugacacaggaggaugccaccuguaagccggucacguaugcuggagccugcagcuccuuugacgugcugcucgaaaaaggcaaguucccccuguuucagagcuacgcgcaccaucggacccuucuggaggccgugcacgauacaauuaucgcuaaagccgacccucccucuugugaucuccaguccgcucacgggaacccuugcaugaaggagaagcuggucaugaaaacccauugucccaaugacuaucaaagcgcccacuaccugaacaaugauggaaagauggccucuguuaaaugcccgccuaaguaugaacucacagaggacuguaacuucugccgccagaugaccggcgcuucccugaaaaaggggagcuacccccuucaggaccuguuuugccaguccucugaagaugacggaagcaaacucaagacgaagaugaaaggcgugugugaggugggcguccaagcgcugaagaaaugcgaugggcagcuuuccacagcccaugaagugguuccuuucgcuguguuuaagaauagcaaaaaggucuaccuggacaagcucgaucugaaaaccgaggagaaccugcuccccgacucuuucguguguuuugaacacaagggacaguauaaaggcacaauggauuccgggcagaccaagagagagcugaaaucuuucgacaucucucaaugccccaagauuggaggccacgggagcaagaaauguaccggagaugccgccuuuugcuccgcuuacgaauguacagcccaguaugcgaaugcuuacugcucucaugccaacggcagcggcaucguucagauucaaguguccggggucuggaagaaaccucuuugugugggauaugagcgggucgugguuaagcgcgaacugagcgccaaaccgauccagagaguggagcccugcacgaccuguauuacaaagugcgagccucacggccucgucgugcggucuaccggguucaagaucuccagcgcuguugccugcgcuucuggagugugugucacaggcucccagagccccuccaccgaaaucacgcugaaauacccugggauuucucagagcuccggcggagacaucggcgugcauauggcccacgaugaccaaucugugagcuccaagauuguugcgcauugucccccgcaggacccuugccuuguccacgggugcaucgugugugcccacggacugauuaauuaucagugccauacagcucucagcgccuucguggucaucuuuguguucucuuccaccgcuaucauuugucuggccguucuguacagagugcucaaaugccugaagaucgcgccccgcaaaguccuuaacccucugauguggauuaccgccuuuauccgguggguguacaagaaaaugguugcuagaguggccgauaacauuaaucaggucaaccgcgagaucggcuggauggaagggggacaacucgcucugggcaaucccgccccuauuccccggcacgccccgaucccuagauauagcacauaccugaugcuucuccugaucgugucuuaugcuuccgcguguagcgagcugauucaggccucuagccgcaucaccacaugcuccacggaggggguuaacaccaagugucggcucagcggcacagcucugauuagagccggaucugugggcgccgaggcuugccuuaugcugaagggggucaaagaggaccagaccaaguuccucaaaaucaagacaguguccagcgaacuguccugccgcgagggacagucuuacuggaccggcagcuuuucccccaaaugucugucuagccggagaugccaucuugugggggaaugucacgucaaucgcugccucuccuggcgggauaacgagacgucugccgaguucagcuuuguuggagaauccaccacaaugagagagaauaaguguuucgaacaaugcggcggguggggcuguggaugcuuuaacgugaaucccagcugucuguucgugcacaccuaucugcagucuguccggaaggaggcgcuccgcguguuuaacugcauugacuggguucauaaacugacacuugaaaucaccgauuucgacggcuccgugagcacgaucgaucugggggcuucuuccagcagauuuacaaauuggggaucugucucccucagccuggacgccgagggcauuuccgggagcaacucuuucagcuucaucgaguccccuggaaagggcuacgccauuguggaugaaccguuuucugagaucccccggcagggguuccugggcgaaauuagauguaauagcgaguccucuguucuuagcgcucacgaauccugccuccgcgccccuaaccuggugucuuauaaacccaugaucgaccagcuggagugcaccacaaaucucaucgauccuuuugucguguucgagcggggaagccugccccaaaccagaaacgacaagaccuuugcggcuuccaaaggcaaccgcgggguucaggccuucagcaagggaucugugcaggccgaucuuacacugauguuugacaauuucgaagucgacuuugugggcgcugccguguccugugaugcugccuuccucaaccugacggggugcuacagcuguaaugcgggagccagagucugccugucuauuaccuccacaggcaccggcacacuuagcgcucauaacaaggacgggucccuccacaucguucugccuucugagaauggaaccaaagaucaaugucagauucugcauuuuacggugcccgaaguggaggaggaguucauguacagcugcgacggcgaugaacggccgcuccuggucaaggggacacuuaucgccauugacccuuuugaugaccgcagagaagcuggaggcgaguccaccgugguuaaccccaaaagcgggucuuggaaucuguucgauugguucuccggacucaugagcugguuuggcggcccucugaagaccauccugcuuaucugucuguauguggcccucucuauugggcuguucuuucuccugaucuaccuuggacggacaggccugagcaaaauguggcucgccgcuaccaagaaggcguccuga

SEQ ID NO: 14401 - RNA, 3594 nt, Artificial Sequence
  derived and/or modified CDS sequence (opt5) from RVFV(Sudan 85-2010)__JQ820488.1__GP
auguacgugcugcucaccauccugauuagcguccuuguuugcgaggccgugaucagagugucccugucuagcacacgggaagagacguguuucggcgacuccaccaaccccgaaaugauugagggggcuugggauucucuccgcgaagaggagaugccugaggaacugagcugcuccgucucuggaaucagagaagugaagacaagcucccaggagcuuuaucgggcccugaaagcgauuaucgcugccgacggccucaauaacaucaccugucacgggaagaauccggaggauaaaauuagccugaucaagggacccccucauaaaaagcgcguuggcauugugagaugcgaacggcgcagagacgccaagcaaaucgggcgggagacaauggcuggaauugccaugaccguccugcccgcucucgccguguuugcgcuggccccuguuguguucgcugaagauccccaccuucgcaacagaccuggcaaaggccauaauuacaucgacgggaugacacaggaggaugccaccuguaagccggucacguaugcuggagccugcagcuccuuugacgugcugcucgaaaaaggcaaguucccccuguuucagagcuacgcgcaccaucggacccuucuggaggccgugcacgauacaauuaucgcuaaagccgacccucccucuugugaucuccaguccgcucacgggaacccuugcaugaaggagaagcuggucaugaaaacccauugucccaaugacuaucaaagcgcccacuaccugaacaaugauggaaagauggccucuguuaaaugcccgccuaaguaugaacucacagaggacuguaacuucugccgccagaugaccggcgcuucccugaaaaaggggagcuacccccuucaggaccuguuuugccaguccucugaagaugacggaagcaaacucaagacgaagaugaaaggcgugugugaggugggcguccaagcgcugaagaaaugcgaugggcagcuuuccacagcccaugaagugguuccuuucgcuguguuuaagaauagcaaaaaggucuaccuggacaagcucgaucugaaaaccgaggagaaccugcuccccgacucuuucguguguuuugaacacaagggacaguauaaaggcacaauggauuccgggcagaccaagagagagcugaaaucuuucgacaucucucaaugccccaagauuggaggccacgggagcaagaaauguaccggagaugccgccuuuugcuccgcuuacgaauguacagcccaguaugcgaaugcuuacugcucucaugccaacggcagcggcaucguucagauucaaguguccggggucuggaagaaaccucuuugugugggauaugagcgggucgugguuaagcgcgaacugagcgccaaaccgauccagagaguggagcccugcacgaccuguauuacaaagugcgagccucacggccucgucgugcggucuaccggguucaagaucuccagcgcuguugccugcgcuucuggagugugugucacaggcucccagagccccuccaccgaaaucacgcugaaauacccugggauuucucagagcuccggcggagacaucggcgugcauauggcccacgaugaccaaucugugagcuccaagauuguugcgcauugucccccgcaggacccuugccuuguccacgggugcaucgugugugcccacggacugauuaauuaucagugccauacagcucucagcgccuucguggucguguuuguuuucucuuccaucgcuaucauuugucuggccauccuguacagagugcucaaaugccugaagauugcgccccgcaaaguccuuaacccucugauguggaucaccgccuuuauucgguggguguacaagaaaaugguugcuagaguggccgauaacaucaaucaggucaaccgcgagauuggcuggauggaagggggacaacucgugcugggcaaucccgcuccuaucccccggcacgccccgaucccuagauauagcaccuaccugaugcuucuccugauuguuucuuaugccuccgcuuguagcgagcugauccaggcgucuagccgcauuacaaccugcuccacagagggggugaacacgaagugucggcucagcggcaccgcccugaucagagcuggaucugucggcgccgaagccugccuuaugcugaagggggugaaagaggaccagacaaaguuccucaaaauuaagaccguguccagcgaacuguccugccgcgagggacagucuuacuggacaggcagcuuuucccccaaaugucugucuagccggagaugccaucuugucggggaaugucacguuaaucgcugccucuccuggcgggauaacgagaccucugcugaguucagcuuugugggagaauccacgaccaugagagagaauaaguguuucgaacaaugcggcggguggggcuguggaugcuuuaacgugaaucccagcugucuguucguccacacauaucugcagucugugcggaaggaggcccuccgcguuuuuaacugcaucgacugggugcauaaacugacccuugaaaucacagauuucgacggcuccgucagcaccauugaucugggggcgucuuccagcagauuuacgaauuggggaucugugucccucagccuggacgcugagggcaucuccgggagcaacucuuucagcuucauugaguccccuggaaagggcuacgccaucguugaugaaccguuuucugagauuccccggcagggguuccugggcgaaaucagauguaauagcgaguccucugugcuuagcgcccacgaauccugccuccgcgcuccuaaccugaucucuuauaaacccaugauugaccagcuggagugcacaaccaaucucaucgauccuuuugucguguucgagcggggaagccugccccaaacaagaaacgaaaagaccuuugccgcguccaaaggcaaccgcgggguucaggcuuucagcaagggaucugugcaggccgaccuuacccugauguuugauaauuucgaggucgacuuugugggcgccgcuguguccugugacgccgcuuuccucaaccugacagggugcuacagcuguaaugccggagcgagagucugccugucuauuacguccaccggcacaggcacccuuagcgcccauaacaaggaugggucccuccacaucguucugccuucugaaaauggaacaaaagaccaaugucagauucugcauuuuaccgugcccgagguggaggaagaguucauguacagcugcgauggcgacgaacggccgcuccuggucaaggggacgcuuaucgcuaucgauccuuuugacgaucgcagagaggccggaggcgaauccacagugguuaaccccaaaagcgggucuuggaauuucuucgacugguuuuccggacugaugagcugguucggcggcccucucaagaccauucugcugaucugucuuuauguggcucugucuauugggcucuuuuuccugcucaucuaccugggacggaccggccuuagcaaaauguggcuggccgccacaaagaaggcuuccuga

SEQ ID NO: 14402 - RNA, 3594 nt, Artificial Sequence
  derived and/or modified CDS sequence (opt5) from RVFV(2007002060)__EU574039.1__GP
auguacgugcugcucaccauccugauuagcguccuuguuugcgaggccgugaucagagugucccugucuagcacacgggaagagacguguuucggcgacuccaccaaccccgaaaugauugagggggcuugggauucucuccgcgaagaggagaugccugaagaacugagcugcuccgucucuggaaucagagaagugaagacaagcucccaggagcuuuaucgggcccugaaagcgauuaucgcugccgacggccucaauaacaucaccugucacgggaagaauccggaggauaaaauuagccugaucaagggacccccucauaaaaagcgcguuggcauugugagaugcgaacggcgcaaggacgccaaacaaaucgggagagagacaauggcuggaauugccaugaccguccugcccgcucucgccguguuugcgcuggccccuguuguguucgcugaagauccccaccuucggaaccgcccuggcaagggccauaauuacaucgacgggaugacacaggaggaugccaccuguaaaccggucacguaugcuggagccugcagcuccuuugacgugcugcucgaaaagggcaaauucccccuguuucagagcuacgcgcaccauagaacccuucuggaggccgugcacgauacaauuaucgcuaaggccgacccucccucuugugaucuccaguccgcucacgggaacccuugcaugaaggagaaacuggucaugaagacccauugucccaaugacuaucaaagcgcccacuaccugaacaaugauggaaaaauggccucuguuaagugcccgccuaaauaugaacucacagaggacuguaacuucugccggcagaugaccggcgcuucccugaagaaagggagcuacccccuucaggaccuguuuugccaguccucugaagaugacggaagcaagcucaagacgaaaaugaagggcgugugugaggugggcguccaagcgcugaaaaagugcgaugggcagcuuuccacagcccaugaagugguuccuuucgcuguguuuaaaaauagcaagaaggucuaccuggacaaacucgaucugaagaccgaggagaaccugcuccccgacucuuucguguguuuugaacacaaaggacaguauaagggcacaauggauuccgggcagaccaaacgcgagcugaagucuuucgacaucucucaaugccccaagauuggaggccacgggagcaaaaaguguaccggagaugccgccuuuugcuccgcuuacgaauguacagcccaguaugcgaaugcuuacugcucucaugccaacggcagcggcaucguucagauucaaguguccggggucuggaaaaagccucuuugugugggauaugagagagucgugguuaaacgggaacugagcgccaagccgauccagcgcguggagcccugcacgaccuguauuacaaagugcgagccucacggccucgucgugagaucuaccggguucaaaaucuccagcgcuguugccugcgcuucuggagugugugucacaggcucccagagccccuccaccgaaaucacgcugaaguacccugggauuucucagagcuccggcggagacaucggcgugcauauggcccacgaugaccaaucugugagcuccaaaauuguugcgcauugucccccgcaggacccuugccuuguccacgggugcaucgugugugcccacggacugauuaauuaucagugccauacagcucucagcgccuucguggucaucuuuguguucucuuccaccgcuaucauuugucuggccguucuguaccgggugcucaagugccugaaaaucgcgcccagaaagguccuuaacccucugauguggauuaccgccuuuauccgcuggguguacaaaaagaugguugcucggguggccgauaacauuaaucaggucaacagagagaucggcuggauggaagggggacaacucgcucugggcaaucccgccccuauuccccgccacgccccgaucccucgguauagcacauaccugaugcuucuccugaucgugucuuaugcuuccgcguguagcgagcugauucaggccucuagcagaaucaccacaugcuccacggaggggguuaacaccaagugucgccucagcggcacagcucugauucgggccggaucugugggcgccgaggcuugccuuaugcugaaaggggucaaggaggaccagaccaaauuccucaagaucaaaacaguguccagcgaacuguccugcagagagggacagucuuacuggaccggcagcuuuucccccaagugucugucuagccgccggugccaucuugugggggaaugucacgucaauagaugccucuccuggcgcgauaacgagacgucugccgaguucagcuuuguuggagaauccaccacaaugcgggagaauaaguguuucgaacaaugcggcggguggggcuguggaugcuuuaacgugaaucccagcugucuguucgugcacaccuaucugcagucugucagaaaagaggcgcuccggguguuuaacugcauugacuggguucauaagcugacacuugaaaucaccgauuucgacggcuccgugagcacgaucgaucugggggcuucuuccagccgcuuuacaaauuggggaucugucucccucagccuggacgccgagggcauuuccgggagcaacucuuucagcuucaucgaguccccuggaaaaggcuacgccauuguggaugaaccguuuucugagauccccagacagggguuccugggcgaaauucgguguaauagcgaguccucuguucuuagcgcucacgaauccugccucagagccccuaaccuggugucuuauaagcccaugaucgaccagcuggagugcaccacaaaucucaucgauccuuuugucguguucgagcgcggaagccugccccaaacccggaacgacaaaaccuuugcggcuuccaagggcaacagagggguucaggccuucagcaagggaucugugcaggccgaucuuacacugauguuugacaauuucgaagucgacuuugugggcgcugccguguccugugaugcugccuuccucaaccugacggggugcuacagcuguaaugcgggagcccgcgucugccugucuauuaccuccacaggcaccggcacacuuagcgcucauaacaaagacgggucccuccacaucguucugccuucugagaauggaaccaaggaucaaugucagauucugcauuuuacggugcccgaaguggaggaggaguucauguacagcugcgacggcgaugaaagaccgcuccuggucaaagggacacuuaucgccauugacccuuuugaugaccggcgcgaagcuggaggcgaguccaccgugguuaaccccaagagcgggucuuggaauuucuucgauugguuuuccggacugaugagcugguucggcggcccucucaaaaccauccugcugaucugucuuuauguggcccugucuauugggcucuuuuuccugcucaucuaccugggaagaacaggccuuagcaagauguggcuggccgcuaccaagaaagcguccuga

SEQ ID NO: 14403 - RNA, 3594 nt, Artificial Sequence
  derived and/or modified CDS sequence (opt5) from RVFV(2007002476)__EU574036.1__GP
auguacgugcugcucaccauccugauuagcguccuuguuugcgaggccgugaucagagugucccugucuagcacacgggaagagacguguuucggcgacuccaccaaccccgaaaugauugagggggcuugggauucucuccgcgaagaggagaugccugaagaacugagcugcuccgucucuggaaucagagaagugaagacaagcucccaggagcuuuaucgggcccugaaagcgauuaucgcugccgacggccucaauaacaucaccugucacgggaagaauccggaggauaaaauuagccugaucaagggacccccucauaaaaagcgcguuggcauugugagaugcgaacggcgcagagacgccaagcaaaucgggcgggagacaauggcuggaauugccaugaccguccugcccgcucucgccguguuugcgcuggccccuguuguguucgcugaagauccccaccuucgcaacagaccuggcaaaggccauaauuacaucgacgggaugacacaggaggaugccaccuguaagccggucacguaugcuggagccugcagcuccuuugacgugcugcucgaaaaaggcaaguucccccuguuucagagcuacgcgcaccaucggacccuucuggaggccgugcacgauacaauuaucgcuaaagccgacccucccucuugugaucuccaguccgcucacgggaacccuugcaugaaggagaagcuggucaugaaaacccauugucccaaugacuaucaaagcgcccacuaccugaacaaugauggaaagauggccucuguuaaaugcccgccuaaguaugaacucacagaggacuguaacuucugccgccagaugaccggcgcuucccugaaaaaggggagcuacccccuucaggaccuguuuugccaguccucugaagaugacggaagcaaacucaagacgaagaugaaaggcgugugugaggugggcguccaagcgcugaagaaaugcgaugggcagcuuuccacagcccaugaagugguuccuuucgcuguguuuaagaauagcaaaaaggucuaccuggacaagcucgaucugaaaaccgaggagaaccugcuccccgacucuuucguguguuuugaacacaagggacaguauaaaggcacaauggauuccgggcagaccaagagagagcugaaaucuuucgacaucucucaaugccccaagauuggaggccacgggagcaagaaauguaccggagaugccgccuuuugcuccgcuuacgaauguacagcccaguaugcgaaugcuuacugcucucaugccaacggcagcggcaucguucagauucaaguguccggggucuggaagaaaccucuuugugugggauaugagcgggucgugguuaagcgcgaacugagcgccaaaccgauccagagaguggagcccugcacgaccuguauuacaaagugcgagccucacggccucgucgugcggucuaccggguucaagaucuccagcgcuguugccugcgcuucuggagugugugucacaggcucccagagccccuccaccgaaaucacgcugaaauacccugggauuucucagagcuccggcggagacaucggcgugcauauggcccacgaugaccaaucugugagcuccaagauuguugcgcauugucccccgcaggacccuugccuuguccacgggugcaucgugugugcccacggacugauuaauuaucagugccauacagcucucagcgccuucguggucaucuuuguguucucuuccaccgcuaucauuugucuggccguucuguacagagugcucaaaugccugaagaucgcgccccgcaaaguccuuaacccucugauguggauuaccgccuuuaucaaguggguguacaaaaagaugguugcucggguggccgauaacauuaaucaggucaacagagagaucggcuggauggaagggggacaacucgcucugggcaaucccgccccuauuccccgccacgccccgaucccucgguauagcacauaccugaugcuucuccugaucgugucuuaugcuuccgcguguagcgagcugauucaggccucuagcagaaucaccacaugcuccacggaggggguuaacaccaagugucgccucagcggcacagcucugauucgggccggaucugugggcgccgaggcuugccuuaugcugaaaggggucaaggaggaccagaccaaauuccucaagaucaaaacaguguccagcgaacuguccugcagagagggacagucuuacuggaccggcagcuuuucccccaagugucugucuagccgccggugccaucuugugggggaaugucacgucaauagaugccucuccuggcgcgauaacgagacgucugccgaguucagcuuuguuggagaauccaccacaaugcgggagaauaaguguuucgaacaaugcggcggguggggcuguggaugcuuuaacgugaaucccagcugucuguucgugcacaccuaucugcagucugucagaaaagaggcgcuccggguguuuaacugcauugacuggguucauaagcugacacuugaaaucaccgauuucgacggcuccgugagcacgaucgaucugggggcuucuuccagccgcuuuacaaauuggggaucugucucccucagccuggacgccgagggcauuuccgggagcaacucuuucagcuucaucgaguccccuggaaaaggcuacgccauuguggaugaaccguuuucugagauccccagacagggguuccugggcgaaauucgguguaauagcgaguccucuguucuuagcgcucacgaauccugccucagagccccuaaccuggugucuuauaagcccaugaucgaccagcuggagugcaccacaaaucucaucgauccuuuugucguguucgagcgcggaagccugccccaaacccggaacgacaaaaccuuugcggcuuccaagggcaacagagggguucaggccuucagcaagggaucugugcaggccgaucuuacacugauguuugacaauuucgaagucgacuuugugggcgcugccguguccugugaugcugccuuccucaaccugacggggugcuacagcuguaaugcgggagcccgcgucugccugucuauuaccuccacaggcaccggcacacuuagcgcucauaacaaagacgggucccuccacaucguucugccuucugagaauggaaccaaggaucaaugucagauucugcauuuuacggugcccgaaguggaggaggaguucauguacagcugcgacggcgaugaaagaccgcuccuggucaaagggacacuuaucgccauugacccuuuugaugaccggcgcgaagcuggaggcgaguccaccgugguuaaccccaagagcgggucuuggaauuucuucgauugguuuuccggacugaugagcugguucggcggcccucucaaaaccauccugcugaucugucuuuauguggcccugucuauugggcucuuuuuccugcucaucuaccugggaagaacaggccuuagcaagauguggcuggccgcuaccaagaaagcguccuga

SEQ ID NO: 14404 - RNA, 3594 nt, Artificial Sequence
  derived and/or modified CDS sequence (opt5) from RVFV(2269/74)__DQ380222.1__GP
auguacgugcugcucacaauccugauuagcguccuuguuugcgaggccgugaucagagugucccugucuagcacacgggaagagacguguuucggcgacuccaccaaccccgaaaugauugagggggcuugggauucucuccgcgaagaggagaugccugaagaacugagcugcuccaucucuggaauuagagaagucaagacaagcucccaggagcuuuaucgggcccugaaagcgaucaucgcugccgacggccucaauaacauuaccugucacgggaaggauccggaggacaaaaucagccugauuaagggacccccucauaaaaagcgcgugggcaucguuagaugcgaacggcgcagagaugccaagcaaauugggcgggagacaauggcuggaaucgccaugaccgugcugcccgcucucgccgucuuugcgcuggccccugugguuuucgcugaagacccccaccuucgcaauagaccuggcaaaggccauaacuacauugaugggaugacacaggaggacgccaccuguaagccggugacguaugcuggagccugcagcuccuuugauguccugcucgaaaaaggcaaguucccccuguuucagagcuacgcgcaccaucggacccuucuggaggccgugcacgacacaaucaucgcuaaagccgauccucccucuugugaccuccaguccgcucacgggaauccuugcaugaaggagaagcuggugaugaaaacccauugucccaacgauuaucaaagcgcccacuaccugaauaacgacggaaagauggccucugucaaaugcccgccuaaguaugaacucacagaggacuguaauuucugccgccagaugaccggcgcuucccugaaaaaggggagcuacccccuucaggaucuguuuugccaguccucugaagacgauggaagcaaacucaagacgaagaugaaaggcguuugugaggugggcgugcaagcgcugaagaaaugcgacgggcagcuuuccacagcccaugaagucgugccuuucgcuguuuuuaagaacagcaaaaagguguaccuggauaagcucgaccugaaaaccgaggagaaucugcuccccgauucuuucgucuguuuugaacacaagggacagcacaaaggcacaauggacuccgggcagaccaagagagagcugaaaucuuucgauauuucucaaugccccaagaucggaggccaugggagcaagaaauguaccggagacgccgccuuuugcuccgcuuaugaauguacagcccaguacgcgaacgcuuauugcucucacgccaauggcagcggcauugugcagauccaaguuuccgggguguggaagaaaccucuuugugucggauacgagcggguggucgugaagcgcgaacugagcgccaaaccgauucagagaguugagcccugcacgaccuguaucacaaagugcgagccucauggccucgugguccggucuaccggguucaagaucuccagcgcuguggccugcgcuucuggaguuugugugacaggcucccagagccccuccaccgaaauuacgcugaaauauccugggaucucucagagcuccggcggagauauuggcguccacauggcccaugacgaccaaucugugagcuccaagaucguggcgcacugucccccgcaggauccuugccuuguucacgggugcauugucugugcccauggacugaucaacuaccagugccacacagcucucagcgccuucgugguggucuuuguguucucuuccguugcuaucauuugucuggccauccuguauaaagugcucaagugccugaaaauugcgcccaagaaaguccuuaauccucugauguggaucaccgccuuuauuagauggguguacaagaagaugguugcucgcguggccgacaacaucaaccaggucaaucgggagauuggcuggauggaagggggacaacucgcucugggcaaccccgccccuauccccagacaugccccgaucccucgcuacagcaccuaucugaugcuucuccugauugugucuuacgcuuccgcguguagcgagcugauccaggccucuagccggauuacaaccugcuccacagaggggguuaauacgaaauguagacucagcggcaccgcucugauccgcgccggaucugugggcgccgaggcuugccuuaugcugaagggggucaaagaggaucagacaaaguuccucaaaauuaagaccguguccagcgaacuguccugccgggagggacagucuuauuggacaggcagcuuuucccccaagugucugucuagcagacgcugccaccuugugggggaaugucacgucaaccggugccucuccuggagagacaaugagaccucugccgaguucagcuuuguuggagaauccacgaccaugcgcgagaacaaauguuucgaacaaugcggcggguggggcuguggaugcuuuaaugugaaccccagcugucuguucgugcauacauaccugcagucuguccggaaggaggcgcucagaguguuuaauugcaucgauuggguucacaaacugacccuugaaaucacagacuucgauggcuccgugagcaccauugaccugggggcuucuuccagccgguuuacgaacuggggaucugucucccucagccuggaugccgagggcaucuccgggagcaauucuuucagcuucauugaguccccuggaaagggcuaugccaucguggacgaaccguuuucugagauuccccgccagggguuccugggcgaaaucagauguaacagcgaguccucuguucuuagcgcucaugaauccugccuccgggccccuaaucugaucucuuacaaacccaugauugaucagcuggagugcacaaccaaccucaucgacccuuuuguggucuucgagagaggaagccugccccaaacacgcaaugauaagaccuuugcggcuuccaagggcaacagaggggugcaggccuucagcaaaggaucuguucaggccgaccuuacccugauguuugacaacuucgaaguggauuuugucggcgcugccguguccugugacgcugccuuccucaaucugacagggugcuauagcuguaacgcgggagcccgggugugccugucuauuacguccaccggcacaggcacccuuagcgcucacaauaaggaugggucccuccauaucguccugccuucugagaacggaacaaaagaccaaugucagauucugcacuuuaccguucccgaaguggaggaggaguucauguacagcugcgauggcgacgaacgcccgcuccuggugaaggggacgcuuaucgccaucgauccuuuugacgauagacgggaagcuggaggcgaguccacagucgugaaucccaaaagcgggucuuggaacuucuucgacugguuuuccggacugaugagcugguucggcggcccucucaagaccauucugcugaucugucuuuacguugcccugucuauugggcucuuuuuccugcucaucuaucugggacgcaccggccuuagcaagauguggcuggccgcuaccaaaaaggcguccuga

SEQ ID NO: 14405 - RNA, 3594 nt, Artificial Sequence
  derived and/or modified CDS sequence (opt5) from RVFV(SA-51 (Van Wyck))__DQ380195.1__GP
auguacgugcugcucaccauccugauuagcguccuuguuugcgaggccgugaucagagugucccugucuagcacacgggaagagacguguuucggcgacuccaccaaccccgaaaugauugagggggcuugggauucucuccgcgaagaggagaugccugaagaacugagcugcuccaucucuggaauuagagaagucaagacaagcucccaggagcuuuaucgggcccugaaagcgaucaucgcugccgacggccucaauaacauuaccugucacgggaaggauccggaggacaaaaucagccugauuaagggacccccucauaaaaagcgcgugggcaucguuagaugcgaacggcgcagagaugccaagcaaauugggcgggagacaauggcuggaaucgccaugaccgugcugcccgcucucgccgucuuugcgcuggccccugugguuuucgcugaagacccccaccuucgcaauagaccuggcaaaggccauaacuacauugaugggaugacacaggaggacgccaccuguaagccggugacguaugcuggagccugcagcuccuuugauguccugcucgaaaaaggcaaguucccccuguuucagagcuacgcgcaccaucggacccuucuggaggccgugcacgacacaaucaucgcuaaagccgauccucccucuugugaccuccaguccgcucacgggaauccuugcaugaaggagaagcuggugaugaaaacccauugucccaacgauuaucaaagcgcccacuaccugaauaacgacggaaagauggccucugucaaaugcccgccuaaguaugaacucacagaggacuguaauuucugccgccagaugaccggcgcuucccugaaaaaggggagcuacccccuucaggaucuguuuugccaguccucugaagacgauggaagcaaacucaagacgaagaugaaaggcguuugugaggugggcgugcaagcgcugaagaaaugcgacgggcagcuuuccacagcccaugaagucgugccuuucgcuguuuuuaagaacagcaaaaagguguaccuggauaagcucgaccugaaaaccgaggagaaucugcuccccgauucuuucgucuguuuugaacacaagggacaguauaaaggcacaauggacuccgggcagaccaagagagagcugaaaucuuucgauauuucucaaugccccaagaucggaggccgggggagcaagaaauguaccggagacgccgccuuuugcuccgcuuacgaauguacagcccaguaugcgaacgcuuacugcucucacgccaauggcagcggcauugugcagauccaaguuuccgggguguggaagaaaccucuuugugucggauaugagcgcguggucgugaagagagaacugagcgccaaaccgauucagcggguugagcccugcacgaccuguaucacaaagugcgagccucauggccucguggucagaucuaccggguucaagaucuccagcgcuguggccugcgcuucuggaguuugugugacaggcucccagagccccuccaccgaaauuacgcugaaauacccugggaucucucagagcuccggcggagauauuggcguccacauggcccaugacgaccaaucugugagcuccaagaucguggcgcacugucccccgcaggauccuugccuuguucaugggugcauugucugugcccacggacugaucaacuaucagugccacacagcucucagcgccuucgugguggucuuuguguucucuuccguugcuaucauuugucuggccauccuguacaaagugcucaagugccugaaaauugcgccccgcaagguccuuaauccucugauguggaucaccgccuuuauucgguggguguacaaaaagaugguugcuagaguggccgacaacaucaaccaggucaaucgcgagauuggcuggauggaagggggacaacucgcucugggcaaccccgccccuaucccccggcaugccccgaucccuagauauagcaccuaccugaugcuucuccugauugugucuuaugcuuccgcguguagcgagcugauccaggccucuagccgcauuacaaccugcuccacagaggggguuaauacgaagugucggcucagcggcaccgcucugaucagagccggaucugugggcgccgaggcuugccuuaugcugaaaggggucaaggaggaucagacaaaauuccucaagauuaaaaccguguccagcgaacuguccugccgcgagggacagucuuacuggacaggcagcuuuucccccaagugucugucuagccggagaugccaccuugugggggaaugucaugucaaccgcugccucuccuggcgggacaaugagaccucugccgaguucagcuuuguuggagaauccacgaccaugagagagaacaaguguuucgaacaaugcggcggguggggcuguggaugcuuuaaugugaaccccagcugucuguucgugcacacauaucugcagucuguccggaaagaggcgcuccgcguguuuaauugcaucgauuggguucacaagcugacccuugaagugacagacuucgauggcuccgucagcaccaucgaccugggggcuucuuccagcagauuuacgaacuggggaucugugucccucagccuggaugccgagggcauuuccgggagcaauucuuucagcuucaucgaguccccuggaaaaggcuacgccauuguugacgaaccguuuucugagaucccccggcagggguuccugggcgaaauuagauguaacagcgaguccucugugcuuagcgcucaugaauccugccuccgcgccccuaaucugaucucuuauaagcccaugaucgaucagcuggagugcacaaccaaccucauugacccuuuugucguguucgagcggggaagccugccccaaacaagaaaugauaaaaccuuugcggcuuccaagggcaaccgcgggguucaggccuucagcaagggaucugugcaggccgaccuuacccugauguuugacaacuucgaagucgauuuugugggcgcugccguguccugugacgcugccuuccucaaucugacagggugcuacagcuguaacgcgggagccagagucugccugucuaucacguccaccggcacaggcacccuuagcgcucacaauaaagaugggucccuccauauuguucugccuucugagaacggaacaaaggaccaaugucagauccugcacuuuaccgugcccgaaguggaggaggaguucauguacagcugcgauggcgacgaacggccgcuccuggucaaagggacgcuuauugccaucgauccuuuugacgaucgcagagaagcuggaggcgaguccacagugguuaaucccaagagcgggucuuggaacuucuucgacugguuuuccggacugaugagcugguucggcggcccucucaaaaccauccugcugauuugucuuuauguggcccugucuaucgggcucuuuuuccugcucauuuaccugggacggaccggccuuagcaagauguggcuggccgcuacaaagaaagcguccuga

SEQ ID NO: 14406 - RNA, 3594 nt, Artificial Sequence
  derived and/or modified CDS sequence (opt5) from RVFV(OS-8)__DQ380185.1__GP
auguacgugcugcucaccauccugauuagcguccuuguuugcgaggccgugaucagagugucccugucuagcacacgggaagagacguguuucggcgacuccaccaaccccgaaaugauugagggggcuugggauucucuccgcgaagaggagaugccugaagaacugagcugcuccaucucuggaauuagagaagucaagacaagcucccaggagcuuuaucgggcccugaaagcgaucaucgcugccgacggccucaauaacauuaccugucacgggaaggauccggaggacaaaaucagccugauuaagggacccccucauaaaaagcgcgugggcaucguuagaugcgaacggcgcagagaugccaagcaaauugggcgggagacaauggcuggaaucgccaugaccgugcugcccgcucucgccgucuuugcgcuggccccugugguuuucgcugaagacccccaccuucgcaauagaccuggcaaaggccauaacuacauugaugggaugacacaggaggacgccaccuguaagccggugacguaugcuggagccugcagcuccuuugauguccugcucgaaaaaggcaaguucccccuguuucagagcuacgcgcaccaucggacccuucuggaggccgugcacgacacaaucaucgcuaaagccgauccucccucuugugaccuccaguccgcucacgggaauccuugcaugaaggagaagcuggugaugaaaacccauugucccaacgauuaucaaagcgcccacuaccugaauaacgacggaaagauggccucugucaaaugcccgccuaaguaugaacucacagaggacuguaauuucugccgccagaugaccggcgcuucccugaaaaaggggagcuacccccuucaggaucuguuuugccaguccucugaagacgauggaagcaaacucaagacgaagaugaaaggcguuugugaggugggcgugcaagcgcugaagaaaugcgacgggcagcuuuccacagcccaugaagucgugccuuucgcuguuuuuaagaacagcaaaaagguguaccuggauaagcucgaccugaaaaccgaggagaaucugcuccccgauucuuucgucuguuuugaacacaagggacaguauaaaggcacaauggacuccgggcagaccaagagagagcugaaaucuuucgauauuucucaaugccccaagaucggaggccacgggagcaagaaauguaccggagacgccgccuuuugcuccgcuuacgaauguacagcccaguaugcgaacgcuuacugcucucaugccaauggcagcggcgugguucagauucaaguguccggggucuggaagaaaccucuuugugugggauaugagcgggucgugguuaagcgcgaacugagcgccaaaccgauccagagaguggagcccugcacgaccuguauuacaaagugcgagccucacggccucgucgugcggucuaccggguucaagaucuccagcgcuguugccugcgcuucuggagugugugucacaggcucccagagccccuccaccgaaaucacgcugaaauacccugggauuucucagagcuccggcggagauaucggcgugcauauggcccacgacgaccaaucugugagcuccaagauuguugcgcauugucccccgcaggauccuugccuuguccacgggugcaucgugugugcccacggacugauuaacuaucagugccauacagcucucagcgccuucguggucguguuuguuuucucuuccguggcuaucaucugucuggccauucuguacaaaguccucaagugccugaaaaucgcgcccagaaaggugcuuaauccucugauguggauuaccgccuuuauccgcuggguuuacaaaaagaugguggcucgggucgccgacaacauuaaccaggugaauagagagaucggcuggauggaagggggacaacucgcucugggcaaccccgccccuauuccccgccacgccccgaucccucgguauagcaccuaccugaugcuucuccugaucguuucuuaugcuuccgcguguagcgagcugauucaggccucuagcagaaucacaaccugcuccacagagggggugaauacgaagugucgccucagcggcaccgcucugauucgggccggaucugucggcgccgaggcuugccuuaugcugaaaggggugaaggaggaucagacaaaauuccucagaaucaagaccguguccagcgaacuguccugccgcgagggacagucuuacuggacaggcagcuuuucccccaaaugucugucuagccggagaugccaucuugucggggaaugucacguuaaccgcugccucuccuggcgggacaaugagaccucugccgaguucagcuuugugggagaauccacgaccaugagagagaacaaguguuucgaacaaugcggcggguggggcuguggaugcuuuaaugugaaccccagcugucuguucguccacacauaucugcagucugugcggaaggaggcgcuccgcguuuuuaauugcauugauugggugcauaaacugacccuugaaaucacagacuucgauggcuccgucagcaccaucgaccugggggcuucuuccagcagauuuacgaacuggggaucugugucccucagccuggaugccgagggcauuuccgggagcaauucuuucagcuucaucgaguccccuggaaagggcuacgccauuguugacgaaccguuuucugagaucccccggcagggguuccugggcgaaauuagauguaacagcgaguccucugugcuuagcgcucacgaauccugccuccgcgccccuaaucugaucucuuauaaacccaugaucgaucagcuggagugcacaaccaaccucauugacccuuuugucguguucgagcggggaagccugccccaaacaagaaaugauaagaccuuugcggcuuccaaaggcaaccgcgggguucaggccuucagcaagggaucugugcaggccgaccuuacccugauguuugacaacuucgaagucgauuuugugggcgcugccguguccugugacgcugccuuccucaaucugagcgggugcuacucuuguaacgcgggagccagagucugccuguccaucacaagcacgggcaccggcacacuuuccgcucauaauaaggaugggucucuccacauuguucugccuagcgagaacggaaccaaagaccaaugucagauccugcauuuuacagugcccgaaguggaggaggaguucauguacuccugcgauggcgacgaacggccgcuccuggucaaggggacccuuauugccaucgauccuuuugacgaucgcagagaagcuggaggcgagagcacggugguuaaucccaaaucuggguccuggaacuucuucgacugguuuagcggacugaugucuugguucggcggcccucucaagacaauccugcugauuugucuuuauguggcccugagcaucgggcucuuuuuccugcucauuuaccugggacggaccggccuuuccaaaauguggcuggccgcuaccaagaaggcgucuuga

SEQ ID NO: 14407 - RNA, 3594 nt, Artificial Sequence
  derived and/or modified CDS sequence (opt5) from RVFV(BIME-01)__KX609032.1__GP
auguacgugcugcucaccauccugauuagcguccuuguuugcgaggccaucauuagagugucccugucuagcacacgggaagagacguguuucggcgacuccaccaaccccgaaaugaucgagggggcuugggauucucuccgcgaagaggagaugccugaagaacugagcugcuccauuucuggaaucagagaagugaagacaagcucccaggagcuuuaucgggcccugaaagcgaucauugcugccgacggccucaauaacaucaccugucacgggaaggauccggaggacaaaauuagccugaucaagggacccccucauaaaaagcgcgucggcauugugagaugcgaacggcgcagagaugccaagcaaaucgggcgggagacaauggcuggaauugccaugaccguucugcccgcucucgccguguuugcgcuggccccugucguguucgcugaagacccccaccuucgcaauagaccuggcaaaggccauaacuacaucgaugggaugacacaggaggacgccaccuguaagccgguuacguaugcuggagccugcagcuccuuugaugugcugcucgaaaaaggcaaguucccccuguuucagagcuacgcgcaccaucggacccuucuggaggccguccacgacacaaucauugcuaaagccgauccucccucuugugaccuccaguccgcucacgggaauccuugcaugaaggagaagcuggugaugaaaacccauugucccaacgauuaucaaagcgcccacuaccugaauaacgacggaaagauggccucugugaaaugcccgccuaaguaugaacucacagaggacuguaauuucugccgccagaugaccggcgcuucccugaaaaaggggagcuacccccuucaggaucuguuuugccaguccucugaagacgauggaagcaaacucaagacgaagaugaaaggcgucugugagguuggcgugcaagcgcugaagaaaugcgacgggcagcuuuccacagcccaugaaguggucccuuucgcuguguuuaagaacagcaaaaagguuuaccuggauaagcucgaccugaaaaccgaggagaaucugcuccccgauucuuucguguguuuugaacacaagggacaguauaaaggcacaauggacuccgggcagaccaagagagagcugaaaucuuucgauaucucucaaugccccaagauuggaggccacgggagcaagaaauguaccggagacgccgccuuuugcuccgcuuacgaauguacagcccaguaugcgaacgcuuacugcucucaugccaauggcagcggcaucguccagauucaaguguccgggguuuggaagaaaccucuuugugugggauaugagcgggucguggucaagcgcgaacugagcgccaaaccgauccagagaguggagcccugcacgaccuguaucacaaagugcgagccucacggccucguugugcggucuaccggguucaagauuuccagcgcugucgccugcgcuucuggaguguguguuacaggcucccagagccccuccaccgaaaucacgcugaaauacccugggauuucucagagcuccggcggagauaucggcgugcauauggcccacgacgaccaaucugucagcuccaagauuguggcgcauugucccccgcaggauccuugccuugugcacgggugcaucguuugugcccacggacugaucaacuaucagugccauacagcucucagcgccuucgucgugguguuugucuucucuuccguggcuauuaucugucuggccauucuguacaaaguucucagaugccugaagaucgcgcccaaaaaggugcuuaauccucugauguggauuaccgccuuuauccgcugggucuacaaaaagaugguggcucggguugccgacaacauuaaccaggugaauagagagaucggcuggauggaagggggacaacucgcucugggcaaccccgccccuaucccccgccacgccccgauuccucgguauagcaccuaccugaugcuucuccugaucauuucuuaugcuuccgcguguagcgagcugauccaggccucuagcagaauuacaaccugcuccacagagggggucaauacgaagugucgccucagcggcaccgcucugauccgggccggaucugugggcgccgaggcuugccuuaugcugaaagggguuaaggaggaucagacaaaauuccucaagaucaaaaccguguccagcgaacuguccugcagagagggacagucuuacuggacaggcagcuuuucccccaagugucugucuagccgccggugccaucuugucggggaaugucacgugaacagaugccucuccuggcgcgacaaugagaccucugccgaguucagcuuugugggagaauccacgaccaugcgggagaacaaguguuucgaacaaugcggcggguggggcuguggaugcuuuaaugucaaccccagcugucuguucguucacacauaucugcagucugugagaaaagaggcgcuccggguguuuaauugcauugauuggguccauaagcugacccuugaaaucacagacuucgauggcuccgugagcaccauugaccugggggcuucuuccagccgcuuuacgaacuggggaucuguuucccucagccuggaugccgagggcaucuccgggagcaauucuuucagcuucauugaguccccuggaaaaggcuacgccaucguggacgaaccguuuucugagauccccagacagggguuccugggcgaaauucgguguaacagcgaguccucuguccuuagcgcucacgaauccugccucagagccccuaaucugaucucuuauaagcccaugauugaucagcuggagugcacaaccaaccucaucgacccuuuugugguuuucgagcgcggaagccugccccaaacacggaaugauaaaaccuuugcggcuuccaagggcaacagaggggugcaggccuucagcaagggaucuguccaggccgaccuuacccugauguuugacaacuucgaaguggauuuuguuggcgcugccguguccugugacgcugccuuccucaaucugacagggugcuacagcuguaacgcgggagcccgcgucugccugucuauuacguccaccggcacaggcacccuuagcgcucauaauaaagaugggucccuccacaucgugcugccuucugagaacggaacaaaggaccaaugucagauccugcauuuuaccgugcccgaagucgaggaggaguucauguacagcugcgauggcgacgaaagaccgcuccugguuaaagggacgcuuauugccaucgauccuuuugacgaucggcgcgaagcuggaggcgaguccacaguggugaaucccaagagcgggucuuggaacuucuucgacugguuuuccggacugaugagcugguucggcggcccucucaaaaccauucugcugaucugucuuuaugucgcccugucuauugggcucuuuuuccugcucaucuaccugggaagaaccggccuuagcaagauguggcuggccgcuacaaagaaagcguccuga

SEQ ID NO: 14408 - RNA, 3594 nt, Artificial Sequence
  derived and/or modified CDS sequence (opt5) from RVFV(Kenya 83 (21445))__DQ380198.1__GP
auguacgugcugcucaccauccugauuagcguccuuguuugcgaggccgugaucagagugucccugucuagcacacgggaagagacguguuucggcgacuccaccaaccccgaaaugauugagggggcuugggauucucuccgcgaagaggagaugccugaagaacugagcugcuccaucucuggaauuagagaagucaagacaagcucccaggagcuuuaucgggcccugaaagcgaucaucgcugccgacggccucaauaacauuaccugucacgggaagaauccggagaacaaaaucagccugauuaagggacccccucauaaaaagcgcgugggcaucguuagaugcgaacggcgcagagaugccaagcaaauugggcgggagacaauggcuggaaucgccaugaccgugcugcccgcucucgccgucuuugcgcuggccccugugguuuucgcugaagacccccaccuucgcaauagaccuggcaaaggccauaacuacauugaugggaugacacaggaggacgccaccuguaagccggugacguaugcuggagccugcagcuccuuugauguccugcucgaaaaaggcaaguucccccuguuucagagcuacgcgcaccaucggacccuucuggaggccgugcacgacacaaucaucgcuaaagccgauccucccucuugugaccuccaguccgcucacgggaauccuugcaugaaggagaagcuggugaugaaaacccauugucccaacgauuaucaaagcgcccacuaccugaauaacgacggaaagauggccucugucaaaugcccgccuaaguaugaacucacagaggauuguaauuucugccgccagaugaccggcgcuucccugaaaaaggggagcuacccccuucaggaccuguuuugccaguccucugaagacgauggaagcaaacucaagacgaagaugaaaggcguuugugaggugggcgugcaagcgcugaagaaaugcgacgggcagcuuuccacagcccaugaagucgugccuuucgcuguuuuuaagaacagcaaaaagguguaccuggauaagcucgaccugaaaaccgaggagaaucugcuccccgauucuuucgucuguuuugaacacaagggacaguauaaaggcacaauggacuccgggcagaccaagagagagcugaaaucuuucgauauuucucaaugccccaagaucggaggccacgggagcaagaaauguaccggagacgccgccuuuugcuccgcuuacgaauguacagcccaguaugcgaacgcuuacugcucucaugccaauggcagcggcauugugcagauccaaguuuccgggguguggaagaaaccucuuugugucggauaugagcggguggucgugaagcgcgaacugagcgccaaaccgauucagagaguugagcccugcacgaccuguaucacaaagugcgagccucacggccucgugguccggucuaccggguucaagaucuccagcgcuguggccugcgcuucuggaguuugugugacaggcucccagagccccuccaccgaaauuacgcugaaauacccugggaucucucagagcuccggcggagauauuggcguccauauggcccacgacgaucaaucugugagcuccaagaucguggcgcauugucccccgcaggacccuugccuuguucacgggugcauugucugugcccacggacugaucaacuaucagugccauacagcucucagcgccuucgugguggucuuuguguucucuuccaucgcuauuaucugucuggccauucuguacagaguucucaaaugccugaagaucgcgccccgcaaagugcuuaacccucugauguggauuaccgccuuuauccggugggucuacaagaaaaugguggcuagaguugccgacaauauuaaccaggugaaucgcgagaucggcuggauggaagggggacaacucgcucugggcaaccccgccccuaucccccggcacgccccgauuccuagauauagcaccuaccugaugcuucuccugaucgucucuuaugcuuccgcguguagcgagcugauucaggccucuagccgcaucacaaccugcuccacagagggggugaauacgaagugucggcucagcggcaccgcucugauuagagccggaucuguuggcgccgaggcuugccuuaugcugaagggggugaaagaggaucagacaaaguuccucaaaaucaagaccgucuccagcgaacuguccugccgcgagggacagucuuacuggacaggcagcuuuucccccaaaugucugucuagccggagaugccaucuugugggggaaugucacgugaaccgcugccucuccuggcgggacaaugagaccucugccgaguucagcuuugucggagaauccacgaccaugagagagaacaaguguuucgaacaaugcggcggguggggcuguggaugcuuuaauguuaaccccagcugucuguucgugcacacauaucugcagucugugcggaaggaggcgcuccgcgucuuuaauugcaucgauugggugcauaaacugacccuugaaauuacagacuucgauggcuccguuagcaccaucgaccugggggcuucuuccagcagauuuacgaacuggggaucugugucccucagccuggaugccgagggcauuuccgggagcaauucuuucagcuucaucgaguccccuggaaagggcuacgccauugucgacgaaccguuuucugagaucccccggcagggguuccugggcgaaaucagauguaacagcgaguccucugugcuuagcgcucacgaauccugccuccgcgccccuaaucugauuucuuauaaacccaugaucgaucagcuggagugcacaaccaaccucauugacccuuuuguuguguucgagcggggaagccugccccaaacaagaaacgauaagaccuuugcggcuuccaaaggcaaucgcgggguccaggccuucagcaagggaucugugcaggccgaccuuacccugauguuugauaacuucgaaguugacuuugugggcgcugccgucuccugugacgcugccuuccucaaucugacagggugcuacagcuguaacgcgggagccagagugugccugucuaucacguccaccggcacaggcacccuuagcgcucauaauaaggaugggucccuccacauugugcugccuucugagaacggaacaaaagaccaaugucagauccugcauuuuaccguccccgaaguugaggaggaguucauguacagcugcgauggcgacgaacggccgcuccuggugaaggggacgcuuaucgccauugauccuuuugacgaucgcagagaagcuggaggcgaguccacaguggucaaucccaaaagcgggucuuggaacuucuucgacugguuuuccggacugaugagcugguucggcggcccucucaagaccauccugcugauuugucuuuauguggcccugucuaucgggcucuuuuuccugcucauuuaccugggacggaccggccuuagcaaaauguggcuggccgcuacaaagaaggcguccuga

SEQ ID NO: 14409 - RNA, 3594 nt, Artificial Sequence
  derived and/or modified CDS sequence (opt5) from RVFV(2007000253)__JF326192.1__GP
auguacgugcugcucaccauccugauuagcguccuuguuugcgaggccgugaucagagugucccugucuagcacacgggaagagacguguuucggcgacuccaccaaccccgaaaugauugagggggcuugggauucucuccgcgaagaggagaugccugaagaacugagcugcuccgucucuggaaucagagaagugaagacaagcucccaggagcuuuaucgggcccugaaagcgauuaucgcugccgacggccucaauaacaucaccugucacgggaagaauccggaggauaaaauuagccugaucaagggacccccucauaaaaagcgcguuggcauugugagaugcgaacggcgcagagacgccaagcaaaucgggcgggagacaauggcuggaauugccaugaccguccugcccgcucucgccguguuugcgcuggccccuguuguguucgcugaagauccccaccuucgcaacagaccuggcaaaggccauaauuacaucgacgggaugacacaggaggaugccaccuguaagccggucacguaugcuggagccugcagcuccuuugacgugcugcucgaaaaaggcaaguucccccuguuucagagcuacgcgcaccaucggacccuucuggaggccgugcacgauacaauuaucgcuaaagccgacccucccucuugugaucuccaguccgcucacgggaacccuugcaugaaggagaagcuggucaugaaaacccauugucccaaugacuaucaaagcgcccacuaccugaacaaugauggaaagauggccucuguuaaaugcccgccuaaguaugaacucacagaggacuguaacuucugccgccagaugaccggcgcuucccugaaaaaggggagcuacccccuucaggaccuguuuugccaguccucugaagaugacggaagcaaacucaagacgaagaugaaaggcgugugugaggugggcguccaagcgcugaagaaaugcgaugggcagcuuuccacagcccaugaagugguuccuuucgcuguguuuaagaauagcaaaaaggucuaccuggacaagcucgaucugaaaaccgaggagaaccugcuccccgacucuuucguguguuuugaacacaagggacaguauaaaggcacaauggauuccgggcagaccaagagagagcugaaaucuuucgacaucucucaaugccccaagauuggaggccacgggagcaagaaauguaccggagaugccgccuuuugcuccgcuuacgaauguacagcccaguaugcgaaugcuuacugcucucaugccaacggcagcggcaucguucagauucaaguguccggggucuggaagaaaccucuuugugugggauaugagcgggucgugguuaagcgcgaacugagcgccaaaccgauccagagaguggagcccugcacgaccuguauuacaaagugcgagccucacggccucgucgugcggucuaccggguucaagaucuccagcgcuguugccugcgcuucuggagugugugucacaggcucccagagccccuccaccgaaaucacgcugaaauacccugggauuucucagagcuccggcggagacaucggcgugcauauggcccacgaugaccaaucugugagcuccaagauuguugcgcauugucccccgcaggacccuugccuuguccacgggugcaucgugugugcccacggacugauuaauuaucagugccauacagcucucagcgccuucguggucaucuuuguguucucuuccaccgcuaucauuugucuggccguucuguacagagugcucaaaugccugaagaucgcgccccgcaaaguccuuaacccucugauguggauuaccgccuuuauccgguggguguacaagaaaaugguugcuagaguggccgauaacauuaaucaggucaaccgcgagaucggcuggauggaagggggacaacucgcucugggcaaucccgccccuauuccccggcacgccccgaucccuagauauagcacauaccugaugcuucuccugaucgugucuuaugcuuccgcguguagcgagcugauucaggccucuagccgcaucaccacaugcuccacggaggggguuaacaccaagugucggcucagcggcacagcucugauuagagccggaucugccggcgcugaagccugccuuaugcugaagggggugaaagaggaccagaccaaguuccucaaaaucaagacagucuccagcgaacuguccugccgcgagggacagucuuacuggaccggcagcuuuucccccaaaugucugucuagccggagaugccaucuugugggggaaugucacgugaaucgcugccucuccuggcgggauaacgagacgucugcggaguucagcuuugucggagaauccaccacaaugagagagaauaaguguuucgaacaaugcggcggguggggcuguggaugcuuuaacguuaaucccagcugucuguucgugcacaccuaucugcagucugugcggaaggaggcucuccgcgucuuuaacugcauugacugggugcauaaacugacacuugaaaucaccgauuucgacggcuccguuagcacgaucgaucugggggccucuuccagcagauuuacaaauuggggaucugugucccucagccuggacgccgagggcauuuccgggagcaacucuuucagcuucaucgaguccccuggaaagggcuacgcuauugucgaugaaccguuuucugagaucccccggcagggguuccugggcgaaauuagauguaauagcgaguccucugugcuuagcgcccacgaauccugccuccgcgcgccuaaccugguuucuuauaaacccaugaucgaccagcuggagugcaccacaaaucucaucgauccuuuuguggucuucgagcggggaagccugccccaaaccagaaacgacaagaccuuugcugccuccaaaggcaaccgcggggugcaggccuucagcaagggaucuguucaggcugaucuuacacugauguuugacaauuucgaaguggacuuugucggcgccgcuguguccugugaugccgcguuccucaaccugacggggugcuacagcuguaaugccggagcuagagugugccugucuauuaccuccacaggcaccggcacacuuagcgcccauaacaaggacgggucccuccacaucguccugccuucugagaauggaaccaaagaucaaugucagauucugcauuuuacgguucccgaaguggaggaggaguucauguacagcugcgacggcgaugagcggccgcuccuggugaaggggacacuuaucgcuauugacccuuuugaugaccgcagagaagccggaggcgaguccaccgucgugaaccccaaaagcgggucuuggaauuucuucgauugguuuuccggacugaugagcugguucggcggcccucucaagaccauccugcugaucugucuuuauguugcccugucuauugggcucuuuuuccugcucaucuaccugggacggacaggccuuagcaaaauguggcuggcugcgaccaagaaggccuccuga

SEQ ID NO: 14410 - RNA, 3594 nt, Artificial Sequence
  derived and/or modified CDS sequence (opt5) from RVFV(200803166)__JF311381.1__GP
auguacgugcugcucaccauccugauuagcguccuuguuugcgaggccgugaucagagugucccugucuagcacacgggaagagacguguuucggcgacuccaccaaccccgaaaugauugagggggcuugggauucucuccgcgaagaggagaugccugaggagcugagcugcuccgucucuggaaucagagaagugaagacaagcucccaggagcuuuaucgggcccugaaagcgauuaucgcugccgacggccucaauaacaucaccugucacgggaagaauccggaggauaaaauuagccugaucaagggacccccucauaaaaagcgcguuggcauugugagaugcgaacggcgcagagacgccaagcaaaucgggcgggagacaauggcuggaauugccaugaccguccugcccgcucucgccguguuugcgcuggccccuguuguguucgcugaagauccccaccuucgcaacagaccuggcaaaggccauaauuacaucgacgggaugacacaggaggaugccaccuguaagccggucacguaugcuggagccugcagcuccuuugacgugcugcucaaaaagggcaaauucccccuguuucagagcuacgcgcaccaucggacccuucuggaagccgugcacgauacaauuaucgcuaaggccgacccucccucuugugaucuccaguccgcucacgggaacccuugcaugaaggagaaacuggucaugaagacccauugucccaaugacuaucaaagcgcccacuaccugaacaaugauggaaaaauggccucuguuaagugcccgccuaaauaugagcucacagaagacuguaacuucugccgccagaugaccggcgcuucccugaagaaagggagcuacccccuucaggaccuguuuugccaguccucugaggaugacggaagcaagcucaagacgaaaaugaagggcgugugugaagugggcguccaagcgcugaaaaagugcgaugggcagcuuuccacagcccaugaggugguuccuuucgcuguguuuaaaaauagcaagaaggucuaccuggacaaacucgaucugaagaccgaagagaaccugcuccccgacucuuucguguguuuugagcacaaaggacaguauaagggcacaauggauuccgggcagaccaaaagagaacuuaagagcuucgacaucucucaaugccccaagauuggaggccacgggagcaaaaaguguaccggagaugccgccuuuugcuccgcuuacgaguguacagcccaguaugcgaaugcuuacugcucucaugccaacggcagcggcaucguucagauucaaguguccggggucuggaaaaagccucugugugugggauaugaacgggucgugguuaaacgcgagcugagcgccaagccgauccagagaguggaacccugcacgaccuguauuacaaagugcgagccucacggccucgucgugcggucuaccggguucaaaaucuccagcgcuguugccugcgcuucuggagugugugucacaggcucccagagccccuccaccgagaucacgcugaaguacccugggauuucucagagcuccggcggagacaucggcgugcauauggcccacgaugaccaaucugugagcuccaaaauuguugcgcauugucccccgcaggacccuugccuuguccacgggugcaucgugugugcccacggacugauuaauuaucagugccauacagcucucagcgccuucguggucguguuuguuuucucuuccaucgcuaucauuugucuggccauccuguacagagugcucaagugccugaaaauugcgccccgcaagguccuuaacccucugauguggaucaccgccuuuauucgguggguguacaaaaagaugguugcuagaguggccgauaacaucaaucaggucaaccgcgaaauuggcuggauggaagggggacaacucgugcugggcaaucccgcuccuaucccccggcacgccccgaucccuagauauagcaccuaccugaugcuucuccugauuguuucuuaugccacagcuuguuccgaacugauccaggcgagcucucgcauuaccacaugcagcacggagggggugaacaccaagugucggcucuccggcacagcccugaucagagcuggaagcgucggcgccgaggccugccuuaugcugaaaggggugaaggaagaccagaccaaauuccucaagauuaaaacagugucuuccgagcugagcugccgcgaaggacaguccuacuggaccggcucuuuuagccccaagugucuguccucucggagaugccaucuugucggggagugucacguuaaucgcugccucagcuggcgggauaacgaaacguccgcugaguucucuuuugugggagagagcaccacaaugagagaaaauaaguguuucgagcaaugcggcggguggggcuguggaugcuuuaacgugaaucccuccugucuguucguccacaccuaucugcagagcgugcggaaagaagcccuccgcguuuuuaacugcaucgacugggugcauaagcugacacuugagaucaccgauuucgacggcucugucuccacgauugaucugggggcgucuucuuccagauuuacaaauuggggaagcgugucucucucccuggacgcugaaggcaucagcggguccaacagcuucucuuucauugagagcccuggaaaaggcuacgccaucguugaugagccguuuuccgaaauuccccggcagggguuccugggcgagaucagauguaauucugaaagcuccgugcuuucugcccacgagagcugccuccgcgcuccuaaccugaucuccuauaagcccaugauugaccagcuggaaugcaccacaaaucucaucgauccuuuugucguguucgagcggggaucucugccccaaaccagaaacgacaaaaccuuugccgcgagcaagggcaaccgcgggguucaggcuuucuccaagggaagcgugcaggccgaucuuacacugauguuugacaauuucgaggucgacuuugugggcgccgcugugucuugugaugccgcuuuccucaaccugacggggugcuacuccuguaaugccggagcgagagucugccugagcauuaccucuacaggcaccggcacacuuuccgcccauaacaaagacgggagccuccacguugugcugccuuccgaaaauggaaccaaggaucaaugucagauccugcauuuuacggugcccgaggucgaagaggaguucauguacucuugcgacggcgaugaacggccgcuccuggugaaagggacacuuauugcuaucgacccuuuugaugaccgcagagaggccggaggcgaaagcaccguugugaaccccaaguccgggagcuggaauuucuucgauugguuuucuggacugauguccugguucggcggcccucucaaaaccauccugcugauuugucuuuaugucgcucugagcaucgggcucuuuuuccugcucauuuaccugggacggacaggccuuucuaagauguggcuggccgccaccaagaaagcuagcuga

SEQ ID NO: 14411 - RNA, 3594 nt, Artificial Sequence
  derived and/or modified CDS sequence (opt5) from RVFV(2007001107)__EU574047.1__GP
auguacgugcugcucaccauccugauuagcguccuuguuugcgaggccgugaucagagugucccugucuagcacacgggaagagacguguuucggcgacuccaccaaccccgaaaugauugagggggcuugggauucucuccgcgaagaggagaugccugaagaacugagcugcuccgucucuggaaucagagaagugaagacaagcaaucaggagcuuuaucgggcccugaaagcgauuaucgcugccgacggccucaacaauaucaccugucacgggaagaacccggaggauaaaauuucccugaucaagggacccccucauaaaaagcgcguuggcauugugagaugcgaacggcgcagagacgccaagcaaaucgggcgggagacaauggcuggaauugccaugaccguccugcccgcucucgccguguuugcgcuggccccuguuguguucgcugaagauccccaccuucgcaauagaccuggcaaaggccauaacuacaucgacgggaugacacaggaggaugccaccuguaagccggucacguaugcuggagccugcagcucuuuugacgugcugcucgaaaaaggcaaguucccccuguuucaguccuacgcgcaccaucggacccuucuggaggccgugcacgauacaauuaucgcuaaagccgacccucccagcugugaucuccagucugcucacgggaauccuugcaugaaggagaagcuggucaugaaaacccauugucccaacgacuaucaauccgcccacuaccugaauaacgauggaaagauggccagcguuaaaugcccgccuaaguaugaacucacagaggacuguaauuucugccgccagaugaccggcgcuucucugaaaaagggguccuacccccuucaggaccuguuuugccagagcuccgaagaugacggaucuaaacucaagacgaagaugaaaggcgugugugaggugggcguccaagcgcugaagaaaugcgaugggcagcuuagcacagcccaugaagugguuccuuucgcuguguuuaagaacuccaaaaaggucuaccuggacaagcucgaucugaaaaccgaggagaaucugcuccccgacagcuucguguguuuugaacacaagggacaguauaaaggcacaauggauucugggcagaccaagagagagcugaaauccuucgacaucagccaaugccccaagauuggaggccacgggucuaagaaauguaccggagaugccgccuuuugcagcgcuuacgaauguacagcccaguaugcgaacgcuuacugcucccaugccaauggcucuggcaucguucagauucaagugagcggggucuggaagaaaccucuuugugugggauaugagcgggucgugguuaagcgcgaacuguccgccaaaccgauccagagaguggagcccugcacgaccuguauuacaaagugcgagccucacggccucgucgugcggagcaccggguucaagaucucuuccgcuguugccugcgcuagcggagugugugucacaggcucucagucccccagcaccgaaaucacgcugaaauacccugggauuucccagucuagcggcggagacaucggcgugcauauggcccacgaugaccaauccgugucuagcaagauuguugcgcauugucccccgcaggacccuugccuuguccacgggugcaucgugugugcccacggacugauuaacuaucagugccauacagcucucuccgccuucguggucaucuuuguguucagcucuaccgcuaucauuugucuggccguucuguacagagugcucaaaugccugaagaucgcgccccgcaaaguccuuaacccucugauguggauuaccgccuuuauccgguggguguacaagaaaaugguugcuagaguggccgauaauauuaaccaggucaaucgcgagaucggcuggauggaagggggacaacucgcucugggcaaccccgccccuauuccccggcacgccccgaucccuagauauuccacauaccugaugcuucuccugaucgugagcuaugcuucugcguguuccgagcugauucaggccagcucucgcaucaccacaugcagcacggaggggguuaauaccaagugucggcucuccggcacagcucugauuagagccggaagcgugggcgccgaggcuugccuuaugcugaagggggucaaagaggaccagaccaaguuccucaaaaucaagacagugucuuccgaacugagcugccgcgagggacaguccuacuggaccggcucuuuuagccccaaaugucuguccucucggagaugccaucuugugggggaaugucacgucaaccgcugccucagcuggcgggauaaugagacguccgccgaguucucuuuuguuggagaaagcaccacaaugagagagaacaaguguuucgaacaaugcggcggguggggcuguggaugcuuuaaugugaaccccuccugucuguucgugcacaccuaucugcagagcguccggaaggaggcgcuccgcguguuuaauugcauugacuggguucauaaacugacacuugaaaucaccgauuucgacggcucuguguccacgaucgaucugggggcuucuagcuccagauuuacaaacuggggaagcgucucucucucccuggacgccgagggcauuagcggguccaauagcuucucuuucaucgagagcccuggaaagggcuacgccauuguggaugaaccguuuuccgagaucccccggcagggguuccugggcgaaauuagauguaacucugagagcuccguucuuucugcucacgaaagcugccuccgcgccccuaaucugguguccuauaaacccaugaucgaccagcuggagugcaccacaaaccucaucgauccuuuugucguguucgagcggggaucucugccccaaaccagaaacgacaagaccuuugcggcuagcaaaggcaaucgcgggguucaggccuucuccaagggaagcgugcaggccgaucuuacacugauguuugacaacuucgaagucgacuuugugggcgcugccgugucuugugaugcugccuuccucaaucugacggggugcuacuccuguaacgcgggagccagagucugccugagcauuaccucuacaggcaccggcacacuuuccgcucauaauaaggacgggagccuccacaucguucugccuuccgagaacggaaccaaagaucaaugucagauucugcauuuuacggugcccgaaguggaggaggaguucauguacucuugcgacggcgaugaacggccgcuccuggucaaggggacacuuaucgccauugacccuuuugaugaccgcagagaagcuggaggcgagagcaccgugguuaaucccaaauccgggagcuggaacuucuucgauugguuuucuggacugauguccugguucggcggcccucucaagaccauccugcugaucugucuuuauguggcccugagcauugggcucuuuuuccugcucaucuaccugggacggacaggccuuucuaaaauguggcuggccgcuaccaagaaggcgagcuga

SEQ ID NO: 14412 - RNA, 3594 nt, Artificial Sequence
  derived and/or modified CDS sequence (opt5) from RVFV(ANK-3837)__DQ380215.1__GP
auguacgugcugcucaccauccugauuagcguccuuguuugcgaggccgugaucagagugucccugucuagcacacgggaagagacguguuucggcgacuccaccaaccccgaaaugauugagggggcuugggauucucuccgcgaagaggagaugccugaagaacugagcugcuccaucucuggaauuagagaagucaagacaagcucccaggagcuuuaucgggcccugaaagcgaucaucgcugccgacggccucaauaacauuaccugucacgggaaggauccggaggacaaaaucagccugauuaagggacccccucauaaaaagcgcgugggcaucguuagaugcgaacggcgcagagaugccaagcaaauugggcgggagacaauggcuggaaucgccaugaccgugcugcccgcucucgccgucuuugcgcuggccccugugguuuucgcugaagacccccaccuucgcaauagaccuggcaaaggccauaacuacauugaugggaugacacaggaggacgccaccuguaagccggugacguaugcuggagccuguucuuccuuugauguccugcucgaaaaaggcaaguucccccuguuucagagcuacgcgcaccaucggacccuucuggaggccgugcacgacacaaucaucgcuaaagccgauccucccucuugcgaccuccaguccgcucacgggaauccuugcaugaaggagaagcuggugaugaaaacccauugucccaacgauuaucaaagcgcccacuaccugaauaacgacggaaagauggccucugucaaaugcccgccuaaguaugaacucacagaggacuguaauuucugccgccagaugaccggcgcuucccugaaaaaggggagcuacccccuucaggaucuguuuugccaguccucugaagacgauggaagcaaacucaagacgaagaugaaaggcguuugugaggugggcgugcaagcgcugaagaaaugcgacgggcagcuuuccacagcccaugaagucgugccuuucgcuguuuuuaagaacagcaaaaagguguaccuggauaagcucgaccugaaaaccgaggagaaucugcuccccgauucuuucgucuguuuugaacacaagggacaguauaaaggcaagcuggacuccgggcagacaaaaagagagcuuaagagcuucgauauuucucaaugccccaagaucggaggccacgggagcaaaaaguguaccggagacgccgccuuuugcuccgcuuacgaauguaccgcccaguaugcgaacgcuuacugcucucaugccaauggcagcggcauugugcagauccaaguuuccgggguguggaaaaagccucugugugucggauaugagcggguggucgugaaacgcgaacucagcgccaagccgauucagagaguugagcccugcacaacguguaucaccaagugcgagccucacggccuggugguccggucuacaggguucaaaaucuccagcgcuguggccugcgcuucuggaguuugugugaccggcucccagagccccuccacagaaauuacccuuaaguacccugggaucucucagagcuccggcggagauauuggcguccauauggcccacgacgaccaaucugugagcuccaaaaucguggcgcauugucccccgcaggauccuugccugguucacgggugcauugucugugcccacggacucaucaacuaucagugccauacggcucugagcgccuucgugguggucuuuguguucucuuccaucgcuauuaucugucuggccauucucuacagaguucugaagugccuuaaaaucgcgccccgcaaggugcugaauccucucauguggauuacagccuuuauccggugggucuacagaaaaaugguggcucgcguugccgacaacauuaaccaggugaaucgggagaucggcuggauggaagggggacaacugguccugggcaaccccgcuccuauccccagacacgugccgauuccucgcuauagcaccuaccuuaugcuccugcugaucguuucuuaugccuccgccuguagcgagcucauucaggcuucuagccggaucaccacaugcuccaccgagggggugaauacaaaguguagacugagcggcacggcgcuuauucgcgccggaucugucggcgcugaagccugccugaugcucaagggggugaaagaggaucagaccaaguuccugaaaaucaagacaguguccagcgaacuguccugccgggagggacagucuuacuggaccggcagcuuuucccccaaaugucuuucuagcagacgcugccaucucgucggggaaugucacguuaaccggugccuguccuggagagacaaugagacaucugccgaguucagcuuugugggagaauccaccacgaugcgggagaacaaguguuucgaacaaugcggcggguggggcuguggaugcuuuaaugugaaccccagcugucuguucguccacaccuaucuccagucugugcgcaaggaggcucugagaguuuuuaauugcaucgauugggugcauaaacuuacacuggaaauuaccgacuucgauggcuccgucagcacaaucgaccucggggccucuuccagccgguuuaccaacuggggaucugugucccugagccuggaugcggagggcauuuccgggagcaauucuuucagcuucaucgaguccccuggaaagggcuacgcuauuguugacgaaccguuuucugagauccccagacagggguuccuuggcgaaauccgcuguaacagcgaguccucugugcucagcgcccacgaauccugccugcgggccccuaaucugauuucuuauaaacccaugaucgaucagcucgagugcacgacaaaccugauugacccuuuugucguguucgagagaggaagccuuccccaaacccgcaaugauaagacauuugcugccuccaaaggcaacagagggguucaggcguucagcaagggaucugugcaggcugaccugacccucauguuugacaacuucgaagucgauuuugugggcgccgccguguccugugacgcugccuuccugaaucugaccgggugcuacagcuguaacgcuggagcccgggucugccuuucuaucacauccacgggcaccggcacacucagcgcgcauaauaaggaugggucccugcacauuguucugccuucugagaacggaaccaaagaccaaugucagauccuccauuuuacagugcccgaaguggaggaggaguucauguacagcugcgauggcgacgagcgcccgcugcuugucagagggacccugaucgccauugauccuuuugacgaucggcgcgaagcuggaggcgaguccacggugguuaaucccaagagcgggucuuggaacuucuucgacugguuuuccggacucaugagcugguucggcggcccucugaaaacaauccugcuuauuugucuguauguggcccucucuaucgggcuguuuuuccuccugauuuaccuuggaagaaccggccugagcaagauguggcucgcugccaccaaaaaggccuccuga

SEQ ID NO: 14413 - RNA, 3594 nt, Artificial Sequence
  derived and/or modified CDS sequence (opt5) from RVFV(OS-1)__DQ380186.1__GP
auguacgugcugcucacaauccugauuagcguccuuguuugcgaggccgugaucagagugucccugucuagcacacgggaagagacguguuucggcgacuccaccaaccccgaaaugauugagggggcuugggauucucuccgcgaagaggagaugccugaagaacugagcugcuccaucucuggaauuagagaagucaagacaagcucccaggagcuuuaucgggcccugaaagcgaucaucgcugccgacggccucaauaacauuaccugucacgggaaggauccggaggacaaaaucagccugauuaagggacccccucauaaaaagcgcgugggcaucguuagaugcgaacggcaacgcgaugccaagcagauugggagagagacaauggcuggaaucgccaugaccgugcugcccgcucucgccgucuuugcgcuggccccugugguuuucgcugaagacccccaccuucggaaucgcccuggcaaaggccauaacuacauugaugggaugacacaggaggacgccaccuguaagccggugacguaugcuggagccugcagcuccuuugauguccugcucgaaaaaggcaaguucccccuguuucagagcuacgcgcaccauagaacccuucuggaggccgugcacgacacaaucaucgcuaaagccgauccucccucuugugaccuccaauccgcucacgggaauccuugcaugaaggagaagcuggugaugaaaacccauugucccaacgauuaucagagcgcccacuaccugaauaacgacggaaagauggccucugucaaaugcccgccuaaguaugaacucacagaggacuguaauuucugccggcagaugaccggcgcuucccugaaaaaggggagcuacccccuucaggaucuguuuugccaauccucugaagacgauggaagcaaacucaagacgaagaugaaaggcguuugugaggugggcgugcaggcgcugaagaaaugcgacgggcagcuuuccacagcccaugaagucgugccuuucgcuguuuuuaagaacagcaaaaagguguaccuggauaagcucgaccugaaaaccgaggagaaucugcuccccgauucuuucgucuguuuugaacacaagggacaguauaaaggcacaauggacuccgggcaaaccaagcgcgagcugaaaucuuucgauauuucucagugccccaagaucggaggccacgggagcaagaaauguaccggagacgccgccuuuugcuccgcuuacgaauguacagcccaguaugcgaacgcuuacugcucucaugccaauggcagcggcgugguucaaauucagguguccggggucuggaagaaaccucuuugugugggauaugagagagucgugguuaagcgggaacugagcgccaaaccgauccagcgcguggagcccugcacgaccuguauuacaaagugcgagccucacggccucgucgugagaucuaccggguucaagaucuccagcgcuguugccugcgcuucuggagugugugucacaggcucccagagccccuccaccgaaaucacgcugaaauacccugggauuucucaaagcuccggcggagauaucggcgugcauauggcccacgacgaccagucugugagcuccaagauuguugcgcauugucccccgcaggauccuugccuuguccacgggugcaucgugugugcccacggacugauuaacuaucagugccauacagcucucagcgccuucguggucguguuuguuuucucuuccguggcuaucaucugucuggccauucuguacaaaguccucaagugccugaaaaucgcgccccggaaggugcuuaauccucugauguggauuaccgccuuuaucagauggguuuacaaaaagaugguggcucgcgucgccgacaacauuaaccaagugaaucgggagaucggcuggauggaagggggacagcucgcucugggcaaccccgccccuauucccagacacgccccgaucccucgcuauagcaccuaccugaugcuucuccugaucguuucuuaugcuuccgcguguagcgagcugauucaggccucuagccggaucacaaccugcuccacagagggggugaauacgaaguguagacucagcggcaccgcucugauucgcgccggaucugucggcgccgaggcuugccuuaugcugaaaggggugaaggaggaucagacaaaauuccucaagaucaaaaccguguccagcgaacuguccugccgggagggacaaucuuacuggacaggcagcuuuucccccaagugucugucuagcagacgcugccaucuugucggggaaugucacguuaaccggugccucuccuggagagacaaugagaccucugccgaguucagcuuugugggagaauccacgaccaugcgcgagaacaaguguuucgaacagugcggcggguggggcuguggaugcuuuaaugugaaccccagcugucuguucguccacacauaucugcagucugugcggaaagaggcgcucaagguuuuuaauugcauugauugggugcauaaacugacccuugaaaucacagacuucgauggcuccgucagcaccaucgaccugggggcuucuuccagcagauuuacgaacuggggaucugugucccucagccuggaugccgagggcauuuccgggagcaauucuuucagcuucaucgaguccccuggaaagggcuacgccauuguugacgaaccguuuucugagaucccccggcagggguuccugggcgaaauucgcuguaacagcgaguccucugugcuuagcgcucacgaauccugccucagagccccuaaucugaucucuuauaaacccaugaucgaucaacuggagugcacaaccaaccucauugacccuuuugucguguucgagcggggaagccugccccagacaagaaaugauaagaccuuugcggcuuccaagggcaaccgcgggguucaggccuucagcaaaggaucugugcaagccgaccuuacccugauguuugacaacuucgaagucgauuuugugggcgcugccguguccugugacgcugccuuccucaaucugacagggugcuacagcuguaacgcgggagcccgggucugccugucuaucacguccaccggcacaggcacccuuagcgcucauaauaaggaugggucccuccacauuguucugccuucugagaacggaacaaaagaccagugucagauccugcauuuuaccgugcccgaaguggaggaggaguucauguacagcugcgauggcgacgaaagaccgcuccuggucaaggggacgcuuauugccaucgauccuuuugacgaucgcagagaagcuggaggcgaguccacagugguuaaucccaaaagcgggucuuggaacuucuucgacugguuuuccggacugaugagcugguucggcggcccucucaagaccauccugcugauuugucuuuauguggcccugucuaucgggcucuuuuuccugcucauuuaccugggacggaccggccuuagcaagauguggcuggccgcuaccaaaaaggcguccuga

SEQ ID NO: 14414 - RNA, 3594 nt, Artificial Sequence
  derived and/or modified CDS sequence (opt5) from RVFV(Sudan 2V-2007)__JQ820490.1__GP
auguacgugcugcucaccauccugauuagcguccuuguuugcgaggccgugaucagagugucccugucuagcacacgggaagagacguguuucggcgacuccaccaaccccgaaaugauugagggggcuugggauucucuccgcgaagaggagaugccugaagaacugagcugcuccgucucuggaaucagagaagugaagacaagcucccaggagcuuuaucgggcccugaaagcgauuaucgcugccgacggccucaauaacaucaccugucacgggaagaauccggaggauaaaauuagccugaucaagggacccccucauaaaaagcgcguuggcauugugagaugcgaacggcgcagagacgccaagcaaaucgggcgggagacaauggcuggaauugccaugaccguccugcccgcucucgccguguuugcgcuggccccuguuguguucgcugaagauccccaccuucgcaacagaccuggcaaaggccauaauuacaucgacgggaugacacaggaggaugccaccuguaagccggucacguaugcuggagccugcagcuccuuugacgugcugcucgaaaaaggcaaguucccccuguuucagagcuacgcgcaccaucggacccuucuggaggccgugcacgauacaauuaucgcuaaagccgacccucccucuugugaucuccaguccgcucacgggaacccuugcaugaaggagaagcuggucaugaaaacccauugucccaaugacuaucaaagcgcccacuaccugaacaaugauggaaagauggccucuguuaaaugcccgccuaaguaugaacucacagaggacuguaacuucugccgccagaugaccggcgcuucccugaaaaaggggagcuacccccuucaggaccuguuuugccaguccucugaagaugacggaagcaaacucaagacgaagaugaaaggcgugugugaggugggcguccaagcgcugaagaaaugcgaugggcagcuuuccacagcccaugaagugguuccuuucgcuguguuuaagaauagcaaaaaggucuaccuggacaagcucgaucugaaaaccgaggagaaccugcuccccgacucuuucguguguuuugaacacaagggacaguauaaaggcacaauggauuccgggcagaccaagagagagcugaaaucuuucgacaucucucaaugccccaagauuggaggccacgggagcaagaaauguaccggagaugccgccuuuugcuccgcuuacgaauguacagcccaguaugcgaaugcuuacugcucucaugccaacggcagcggcaucguucagauucaaguguccggggucuggaagaaaccucuuugugugggauaugagcgggucgugguuaagcgcgaacugagcgccaaaccgauccagagaguggagcccugcacgaccuguauuacaaagugcgagccucacggccucgucgugcggucuaccggguucaagaucuccagcgcuguugccugcgcuucuggagugugugucacaggcucccagagccccuccaccgaaaucacgcugaaauacccugggauuucucagagcuccggcggagacaucggcgugcauauggcccacgaugaccaaucugugagcuccaagauuguugcgcauugucccccgcaggacccuugcagcguccacgggugcaucgugugugcccacggacuuauuaauuaucagugccauacagcucugucugccuucguggucguguuuguuuucuccagcaucgcuaucauuugucucgccauccuguacagagugcugaaaugccucaagauugcgccccgcaaaguccugaacccucuuauguggaucaccgccuuuauucgguggguguacaagaaaaugguugcuagaguggccgauaacaucaaucaggucaaccgcgagauuggcuggauggaagggggacaacuggugcucggcaaucccgcuccuaucccccggcacgccccgaucccuagauauucuaccuaccugaugcugcuucucauuguuucccaugccagcgcuuguucugagcugauccaggcgagcucccgcauuacaaccugcagcacagagggggugaacacgaagugucggcugucuggcaccgcccucaucagagcuggauccgucggcgccgaagccugccugaugcuuaagggggugaaagaggaccagacaaaguuccugaaaauuaagaccgugagcuccgaacucucuugccgcgagggacagagcuauuggacaggcuccuuuucucccaaaugucugagcucccggagaugccaccuggucggggaaugucacguuaaucgcugccuuucuuggcgggauaacgagaccagcgcugaguucuccuuugugggagaaagcacgaccaugagagagaauaaguguuucgaacaaugcggcggguggggcuguggaugcuuuaacgugaaucccucuugucucuucguccauacauaccugcaguccgugcggaaggaggcccugcgcguuuuuaacugcaucgacugggugcacaaacucacccuggaaaucacagauuucgacggcagcgucucuaccauugaucuuggggcguccagcucuagauuuacgaauuggggauccgugagccugucccucgacgcugagggcaucagcgggucuaacagcuucuccuucauugagucuccuggaaagggcuaugccaucguugaugaaccguuuagcgagauuccccggcagggguuccugggcgaaaucagauguaauuccgagucuagcgugcuguccgcccaugaaucuugccuucgcgcuccuaaccucaucagcuacaaacccaugauugaccagcuggagugcacaaccaaucugaucgauccuuuugucguguucgagcggggaucccucccccaaacaagaaacgacaagaccuuugccgcgagcaaaggcaaccgcgggguucaggcuuucucuaagggauccgugcaggccgaucugacccuuauguuugacaauuucgaagucgacuuugugggcgccgcugugagcugugaugccgcuuuccugaaccucacagggugcuauucuuguaaugccggagcgagagucugccuguccauuacgagcaccggcacaggcacccuguccgcccacaacaaggacgggucucuucauaucguucucccuagcgagaauggaacaaaagaucaaugucagauucugcacuuuaccgugcccgaaguggaggaggaguucauguacuccugcgacggcgaugagcggccgcugcucgucaaggggacgcugauggcuaucgacccuuuugaugaccgcagagaagccggaggcgagagcacagugguuaaccccaaaucuggguccuggaauuucuucgauugguuuagcggacuuaugucuugguucggcggcccucugaagaccauccuccugauuugucuguacguggcucuuagcaucgggcuguuuuuccuccugauuuaucucggacggaccggccuguccaaaauguggcuugccgccacaaagaaggcuucuuga

SEQ ID NO: 14415 - RNA, 3594 nt, Artificial Sequence
  derived and/or modified CDS sequence (opt5) from RVFV(200803162)__JF311377.1__GP
auguacgugcugcucaccauccugauuagcguccuuguuugcgaggccgugaucagagugucccugucuagcacacgggaagagacguguuucggcgacuccaccaaccccgaaaugauugagggggcuugggauucucuccgcgaagaggagaugccugaagaacugagcugcuccgucucuggaaucagagaagugaagacaagcucccaggagcuuuaucgggcccugaaagcgauuaucgcugccgacggccucaauaacaucaccugucacgggaagaauccggaggauaaaauuagccugaucaagggacccccucauaaaaagcgcguuggcauugugagaugcgaacggcgcagagacgccaagcaaaucgggcgggagacaauggcuggaauugccaugaccguccugcccgcucucgccguguuugcgcuggccccuguuguguucgcugaagauccccaccuucgcaacagaccuggcaaaggccauaauuacaucgacgggaugacacaggaggaugccaccuguaagccggucacguaugcuggagccugcagcuccuuugacgugcugcucgaaaaaggcaaguucccccuguuucagagcuacgcgcaccaucggacccuucuggaggccgugcacgauacaauuaucgcuaaagccgacccucccucuugugaucuccaguccgcucacgggaacccuugcaugaaggagaagcuggucaugaaaacccauugucccaaugacuaucaaagcgcccacuaccugaacaaugauggaaagauggccucuguuaaaugcccgccuaaguaugaacucacagaggacuguaacuucugccgccagaugaccggcgcuucccugaaaaaggggagcuacccccuucaggaccuguuuugccaguccucugaagaugacggaagcaaacucaagacgaagaugaaaggcgugugugaggugggcguccaagcgcugaagaaaugcgaugggcagcuuuccacagcccaugaagugguuccuuucgcuguguuuaagaauagcaaaaaggucuaccuggacaagcucgaucugaaaaccgaggagaaccugcuccccgacucuuucguguguuuugaacacaagggacaguauaaaggcacaauggauuccgggcagaccaagagagagcugaaaucuuucgacaucucucaaugccccaagauuggaggccacgggagcaagaaauguaccggagaugccgccuuuugcuccgcuuacgaauguacagcccaguaugcgaaugcuuacugcucucaugccaacggcagcggcaucguucagauucaaguguccggggucuggaagaaaccucuuugugugggauaugagcgggucgugguuaagcgcgaacugagcgccaaaccgauccagagaguggagcccugcacgaccuguauugcuaagugcgagccucacggccucgucgugcggucuacaggguucaagaucuccagcgccguugcuugcgccucuggagugugugucaccggcucccagagccccuccacagaaaucacccugaaauacccugggauuucucagagcuccggcggagacaucggcgugcauauggcgcacgaugaccaaucugugagcuccaagauuguugcccauugucccccgcaggacccuugccuuguccacgauugcaucgugugugcucacgggcugauuaauuaucagugccauacggcccucagcgcuuucguggucaucuuuguguucucuuccacagccaucauuugucuggcgguucuguacagagugcucaaaugccugaagaucgcuccccgcaaaguccuuaacccucugauguggauuaccgccuuuauccgguggguguacaagaaaaugguugccagaguggcugacaacauuaaucaggucaaccgcgagaucggauggauggaaggcgggcaacucgcccugcggaaucccgccccuauucccagacacgcuccgaucccucgcuauagcaccuaccugaugcuucuccugaucgugucuuaugcguccgccuguagcgagcugauucaggcuucuagccggaucacaaccugcuccacagagggaguuaacacgaaguguagacucagcggcaccgcccugauucgcgccgggucugugggcgcugaagccugccuuaugcugaagggagucaaagaggaucagacaaaguuccucaaaaucaagaccguguccagcgaacuguccugccgggagggccagucuuacuggacagggagcuuuucccccaaaugucugucuagcagacgcugccaucuugugggagaaugucacgucaaucggugccucuccuggagagacaacgagaccucugcggaguucagcuuuguuggcgaauccacgaccaugcgggagaauaaguguuucgaacaaugcgggggauggggcugugggugcuuuaacgugaaucccagcugucuguucgugcacacauaucugcagucuguccgcaaggaggcucucagaguguuuaacugcauugauuggguucauaaacugacccuugaaaucacagacuucgauggcuccgugagcaccaucgaccugggagccucuuccagccgguuuacgaauuggggcucugucucccucagccuggaugccgaggggauuuccggaagcaacucuuucagcuucaucgaguccccuggcaagggguacgcuauuguggacgaaccguuuucugagauccccagacagggauuccugggcgaaauucgcuguaauagcgaguccucuguucuuagcgcccacgaauccugccuccgggcgccuaaccuggugucuuauaaacccaugaucgaucagcuggagugcacaaccaaucucaucgacccuuuugucguguucgagagagggagccugccccaaacacgcaacgauaagaccuuugcugccuccaaaggcaacagaggaguucaggccuucagcaagggcucugugcaggcugaccuuacccugauguuugacaauuucgaagucgauuuugugggggccgcuguguccugugacgccgcguuccucaaccugacaggaugcuacagcuguaaugccggcgcucgggucugccugucuauuacguccaccgggacaggaacccuuagcgcccauaacaaggauggcucccuccacaucguucugccuucugagaauggcacaaaagaccaaugucagauucugcauuuuaccgugcccgaaguggaggaggaguucauguacagcugcgauggggacgagcgcccgcuccuggucaagggaacgcuuaucgcuauugauccuuuugacgauagacgggaagccggcggggaguccacagugguuaaccccaaaagcggaucuuggaauuucuucgacugguuuuccggccugaugagcugguucgggggaccucucaagaccauccugcugaucugucuuuauguggcccugucuauuggccucuuuuuccugcucaucuaccugggccgcaccgggcuuagcaaaauguggcuggcugcgacaaagaaggccuccuga

SEQ ID NO: 14416 - RNA, 3594 nt, Artificial Sequence
  derived and/or modified CDS sequence (opt5) from RVFV(2007001811)__EU574040.1__GP
auguacgugcugcucacaauccugauuagcguccuuguuugcgaggccgugaucagagugucccugucuagcacacgggaagagacguguuucggcgacuccaccaaccccgaaaugauugagggggcuugggauucucuccgcgaagaggagaugccugaagaacugagcugcuccgucucuggaaucagagaagugaagacaagcucccaggagcuuuaucgggcccugaaagcgauuaucgcugccgacggccucaauaacaucaccugucacgggaagaauccggaggauaaaauuagccugaucaagggacccccucauaaaaagcgcguuggcauugugagaugcgaacggcgcagagacgccaagcaaaucgggcgggagacaauggcuggaauugccaugaccguccugcccgcucucgccguguuugcgcuggccccuguuguguucgcugaagauccccaccuucgcaacagaccuggcaaaggccauaauuacaucgacgggaugacacaggaggaugccaccuguaagccggucacguaugcuggagccugcagcuccuuugacgugcugcucgaaaaaggcaaguucccccuguuucagagcuacgcgcaccaucggacccuucuggaggccgugcacgauacaauuaucgcuaaagccgacccucccucuugugaucuccaguccgcucacgggaacccuugcaugaaggagaagcuggucaugaaaacccauugucccaaugacuaucaaagcgcccacuaccugaacaaugauggaaagauggccucuguuaaaugcccgccuaaguaugaacucacagaggacuguaacuucugccgccagaugaccggcgcuucccugaaaaaggggagcuacccccuucaggaccuguuuugccaguccucugaagaugacggaagcaaacucaagacgaagaugaaaggcgugugugaggugggcguccaagcgcugaagaaaugcgaugggcagcuuuccacagcccaugaagugguuccuuucgcuguguuuaagaauagcaaaaaggucuaccuggacaagcucgaucugaaaaccgaggagaaccugcuccccgacucuuucguguguuuugaacacaagggacaguauaaaggcacaauggauuccgggcagaccaagagagagcugaaaucuuucgacaucucucaaugccccaagauuggaggccacgggagcaagaaauguaccggagaugccgccuuuugcuccgcuuacgaauguacagcccaguaugcgaaugcuuacugcucucaugccaacggcagcggcaucguucagauucaaguguccggggucuggaagaaaccucuuugugugggauaugagcgggucgugguuaagcgcgaacugagcgccaaaccgauccagagaguggagcccugcacgaccuguauuacaaagugcgagccucacggccucgucgugcggucuaccggguucaagaucuccagcgcuguugccugcgcuucuggagugugugucacaggcucccagagccccuccaccgaaaucacgcugaaauacccugggauuucucagagcuccggcggagacaucggcgugcauauggcccacgaugaccaaucugugagcuccaagauuguugcgcauugucccccgcaggacccuugccuuguccacgggugcaucgugugugcccacggacugauuaauuaucagugccauacagcucucagcgccuucguggucguguuuguuuucucuuccaucgcuaucauuugucuggccauccuguacagagugcucaaaugccugaagauugcgccccgcaaaguccuuaacccucugauguggaucaccgccuuuauucgguggguguacaagaaaaugguugcuagaguggccgauaacaucaaucaggucaaccgcgagauuggcuggauggaagggggacaacucgugcugggcaaucccgcuccuaucccccggcacgccccgaucccuagauauagcaccuaccugaugcuucuccugauuguuucuuaugccuccgcuuguagcgagcugauccaggcgucuagccgcauuacaaccugcuccacagagggggugaacacgaagugucggcucagcggcaccgcccugaucagagcuggaucugucggcgccgaagccugccuuaugcugaagggggugaaagaggaccagacaaaguuccucaugauuaaaaccguguccagcgaacuguccugccgcgagggacagucuuacuggacaggcagcuuuucccccaagugucugucuagccggagaugccaucuugucggggaaugucacguuaaucgcugccucuccuggcgggauaacgagaccucugcugaguucagcuuugugggagaauccacgaccaugagagagaauaaauguuucgaacaaugcggcggguggggcuguggaugcuuuaacgugaaucccagcugucuguucguccacacauaucugcagucugugcggaaggaggcccuccgcguuuuuaacugcaucgacugggugcauaagcugacccuugaaaucacagauuucgacggcuccgucagcaccauugaucugggggcgucuuccagcagauuuacgaauuggggaucugugucccucagccuggacgcugagggcaucuccgggagcaacucuuucagcuucauugaguccccuggaaaaggcuacgccaucguugaugaaccguuuucugagauuccccggcagggguuccugggcgaaaucagauguaauagcgaguccucugugcuuagcgcccacgaauccugccuccgcgcuccuaaccugaucucuuauaagcccaugauugaccagcuggagugcacaaccaaucucaucgauccuuuugucguguucgagcggggaagccugccccaaacaagaaacgagaaaaccuuugccgcguccaagggcaaccgcgggguucaggcuuucagcaaaggaucugugcaggccgaccuuacccugauguuugauaauuucgaggucgacuuugugggcgccgcuguguccugugacgccgcuuuccucaaccugacagggugcuacagcuguaaugccggagcgagagucugccugucuauuacguccaccggcacaggcacccuuagcgcccauaacaaggaugggucccuccacaucguucugccuucugaaaauggaacaaaggaccaaugucagauucugcauuuuaccgugcccgagguggaggaagaguucauguacagcugcgauggcgacgaacggccgcuccuggucaaagggacgcuuaucgcuaucgauccuuuugacgaucgcagagaggccggaggcgaauccacagugguuaaccccaagagcgggucuuggaauuucuucgacugguuuuccggacugaugagcugguucggcggcccucucaaaaccauucugcugaucugucuuuauguggcucugucuauugggcucuuuuuccugcucaucuaccugggacggaccggccuuagcaagauguggcuggccgccaccaaaaaggcuuccuga

SEQ ID NO: 14417 - RNA, 3594 nt, Artificial Sequence
  derived and/or modified CDS sequence (opt5) from RVFV(clone 13)__DQ380213.1__GP
auguacgugcugcucaccauccugauuagcguccuuguuugcgaggccgugaucagagugucccugucuagcacacgggaagagacguguuucggcgacuccaccaaccccgaaaugauugagggggcuugggauucucuccgcgaagaggagaugccugaagaacugagcugcuccaucucuggaauuagagaagucaagacaagcucccaggagcuuuaucgggcccugaaagcgaucaucgcugccgacggccucaauaacauuaccugucacgggaaggauccggaggacaaaaucagccugauuaagggacccccucauaaaaagcgcgugggcaucguuagaugcgaacggcgcagagaugccaagcaaauugggcgggagacaauggcuggaaucgccaugaccgugcugcccgcucucgccgucuuugcgcuggccccugugguuuucgcugaagacccccaccuucgcaauagaccuggcaaaggccauaacuacauugaugggaugacacaggaggacgccaccuguaagccggugacguaugcuggagccugcagcuccuuugauguccugcucgaaaaaggcaaguucccccuguuucagagcuacgcgcaccaucggacccuucuggaggccgugcacgacacaaucaucgcuaaagccgauccucccucuugugaccuccaguccgcucacgggaauccuugcaugaaggagaagcuggugaugaaaacccauugucccaacgauuaucaaagcgcccacuaccugaauaacgacggaaagauggccucugucaaaugcccgccuaagcaugaacucacagaggacuguaauuucugccgccagaugaccggcgcuucccugaaaaaggggagcuauccccuucaggaucuguuuugccaguccucugaagacgauggaagcaaacucaagacgaagaugaaaggcguuugugaggugggcgugcaagcgcugaagaaaugcgacgggcagcuuuccacagcccacgaagucgugccuuucgcuguuuuuaagaacagcaaaaagguguaccuggauaagcucgaccugaaaaccgaggagaaucugcuccccgauucuuucgucuguuuugaacacaagggacaguacaaaggcacaauggacuccgggcagaccaagagagagcugaaaucuuucgauauuucucaaugccccaagaucggaggccaugggagcaagaaauguaccggagacgccgccuuuugcuccgcuuaugaauguacagcccaguacgcgaacgcuuauugcucucacgccaauggcagcggcauugugcagauccaaguuuccgggguguggaagaaaccucuuugugucggauacgagcggguggucgugaagcgcgaacugagcgccaaaccgauucagagaguugagcccugcacgaccuguaucacaaagugcgagccucauggccucgugguccggucuaccggguucaagaucuccagcgcuguggccugcgcuucuggaguuugugugacaggcucccagaaccccagcaccgaaauuacgcugaaauauccugggaucucccagucuagcggcggagauauuggcguccacauggcccaugacgaccaauccgugucuagcaagaucguggcgcacugucccccgcaggauccuugccuuguucacgggugcauugucugugcccauggacugaucaauuaccagugccacacagcucucuccgccuucgugguggucuuuguguucagcucuaucgcuauuaucugucuggccauucuguauagaguucucaaaugccugaagaucgcgccccgcaaagugcuuaacccucugauguggauuaccgccuuuauccggugggucuacaagaaaaugguggcuagaguugccgacaacauuaaucaggugaaccgcgagaucggcuggauggaagggggacaacucguccugggcaaucccgcuccuaucccccggcaugccccgauuccuagauacuccaccuaucugaugcuucuccugaucgugagcuacgccucugcuuguuccgagcugauucaggcgagcucucgcaucacaaccugcagcacagaggggguuaacacgaagugucggcucuccggcaccgcccugauuagagcuggaagcgugggcgccgaagccugccuuaugcugaagggggucaaagaugaccagacaaaguuccucaaaaucaagaccgugucuuccgagcugagcugccgcgaaggacaguccuauuggacaggcucuuuuagccccaaaugucuguccucucggagaugccaccuugugggggagugucacgucaaucgcugccucagcuggcgggauaacgaaaccuccgcugaguucucuuuuguuggagagagcacgaccaugagagaaaauaaguguuucgagcaaugcggcggguggggcuguggaugcuuuaacgugaaucccuccugucuguucgugcauacauaccugcagagcguccggaaggaagcccuccgcguguuuaacugcaucgacuggguucacaaacugacccuugagauuacagauuucgacggcucuguguccaccaucgaucugggggcgucuagcuccagauuuacgaauuggggaagcgucucucucucccuggacgcugaaggcauuagcggguccaacagcuucucuuucaucgagagcccuggaaagggcuaugccauuguggaugagccguuuuccgaaaucccccggcagggguuccugggcgagaucagauguaauucugaaagcuccguucuuucugcccaugagagcugccuccgcgcuccuaaccugauuuccuacaaacccaugaucgaccagcuggaaugcacaaccaaucucauugauccuuuuguggucuucgagcggggaucucugccccaaacaagaaacgagaagaccuuugccgcgagcaaaggcaaccgcggggugcaggcuuucuccaagggaagcguucaggccgaccuuacccugauguuugacaauuucgaaguggauuuugucggcgccgcugugucuugugacgccgcuuuccucaaccugacagggugcuauuccuguaaugccggagcgagagugugccugagcaucacgucuaccggcacaggcacccuuuccgcccacaacaaggaugggagccuccauauuguccugccuuccgagaauggaacaaaagaccaaugucagauccugcacuuuaccguucccgaaguggaggaggaguucauguacucuugcgauggcgacgagcggccgcuccuggugaaggggacgcuuaucgcuauugauccuuuugacgaucgcagagaagccggaggcgagagcacagucgugaaccccaaauccgggagcuggaauuucuucgacugguuuucuggacugauguccugguucggcggcccucucaagaccauccugcugauuugucuuuacguugcucugagcaucgggcucuuuuuccugcucauuuaucugggacggaccggccuuucuaaaauguggcuggccgccacaaagaaggcuagcuga

SEQ ID NO: 14418 - RNA, 3594 nt, Artificial Sequence
  derived and/or modified CDS sequence (opt5) from RVFV(MP12)__Z30318.1__GP
auguacgugcugcucaccauccugacaagcguccuuguuugcgaggccauuaucagagugucccugucuagcacgcgggaagagaccuguuucggcgacuccacaaaccccgaaaugauugagggggcuugggauucucuccgcgaagaggagaugccugaggaacugagcugcuccaucucuggaauuagagaagugaaaaccagcucccaggagcuuuaucgggcccugaaagcgaucaucgcugccgacggccucaauaacauuacaugucacgggaaggauccggaggacaaaaucagccugauuaagggacccccucauaaaaagcgcgucggcaucgugagaugcgaacggcgcagagaugccaagcaaauugggcggaaaaccauggcuggaaucgccaugacaguucugcccgcucucgccguguuugcgcuggccccugucguguucgcugaggacccccaccuucgcaauagaccuggcaagggccauaacuacauugaugggaugacccaggaagacgccacguguaaaccgguuaccuaugcuggagccuguucuuccuuugaugugcugcucgagaagggcaaauucccccuguuucagagcuacgcgcaccaucggacacuucuggaagccguccacgacaccaucaucgcuaaggccgauccucccucuugcgaccuccuguccgcucacgggaauccuugcaugaaggagaaacuggugaugaagacacauugucccaacgauuaucagagcgcccaccaucucaauaacgacggaaaaauggccucugugaagugcccgccuaaauacgagcugaccgaagacuguaauuucugccgccaaaugacgggcgcuucccuuaagaaagggagcuauccccugcaggaucucuuuugccaguccucugaggacgauggaagcaagcugaagacaaaaaugaagggcgucugugaaguuggcgugcaggcgcuuaaaaagugcgacgggcaacuguccaccgcccacgagguggucccuuucgcuguguuuaaaaacagcaagaagguuuaccucgauaaacuggaccugaagacagaagagaaucuccugcccgauucuuucguguguuuugagcacaaaggacaguacaagggcaccauggacuccgggcagaccaaaagagaacuuaagagcuucgauauuucucagugccccaagaucggaggccaugggagcaaaaaguguacaggagacgccgccuuuugcuccgcuuaugaguguacggcccaauacgcgaacgcuuauugcucucacgccaauggcagcggcauuguccagauccagguguccgggguuuggaaaaagccucugugugugggauacgaacgggucguggucaaacgcgagcucagcgccaagccgauucaaagaguggaacccugcaccacauguaucaccaagugcgagccucauggccugguugugcggucuacaggguucaaaaucuccagcgcugucgccugcgcuucuggaguguguguuaccggcucccagagccccuccacggagauuacacuuaaguauccugggaucucucagagcuccggcggagauauuggcgugcacauggcccaugacgaccagucugucagcuccaaaaucguggcgcacugucccccgcaagauccuugccuggugcacgacugcauuguuugugcccaugggcucaucaacuaccagugccacaccgcucugagcgccuucgucgugguguuugucuucucuuccaucgcuauuaucugucuggccauucucuauagagugcugaagugccuuaaaaucgcgccccgcaagguucugaauccucucauguggauuaccgccuuuauccgguggauuuacaaaaagaugguggcuagagucgcccauaacaucaaccaggugaaucgcgaaaucggauggauggagggcgggcagcugguucugggaaaccccgcuccuauuccccggcacgccccgaucccuagauacagcacauaucuuaugcuccugcugauugugucuuacgccuccgcuuguagcgaacucauccaagcgucuagccgcauuaccacaugcuccacggagggcgucaauaccaagugucggcugagcgggacagcccuuaucagagcuggcucugugggagccgaggccugccugaugcucaaaggcguuaaggaagaucagaccaaauuccugaagcugaaaacaguguccagcgagcuuuccugccgcgaagggcagucuuauuggaccgggagcuuuucccccaagugucucucuagccggagaugccaccuggucggcgagugucaugugaaccgcugccuguccuggcgggacaaugaaacgucugcugaguucagcuuugugggggaguccaccacaaugagagaaaacaaguguuucgagcagugcggaggcuggggguguggcugcuuuaaugucaaccccagcugucucuucguucacaccuaccugcaaucugugcggaaagaagcccuucgcguguuuaauugcaucgauuggguccauaagcugacacucgagauuaccgacuucgauggauccgugagcacgaucgaccugggcgcgucuuccagcagauuuacaaacugggggucuguuucccugagccuugaugcugaaggaauuuccggcagcaauucuuucagcuucaucgaguccccugggaaaggauaugccauuguggacgagccguuuucugaaaucccccggcagggcuuccucggggagaucagauguaacagcgaauccucuguccugagcgcccacgaguccugccugcgcgcuccuaaucucauuucuuacaagcccaugaucgaucagcuggaaugcaccacaaaccuuauugacccuuuugugguuuucgagcggggcagccugccccagaccagaaaugauaaaaccuuugccgcguccaagggaaaccgcggcgugcaggcuuucagcaaggggucuguccaagccgaccucacacugauguuugacaacuucgagguggauuuuguuggagccgcuguguccugugacgccgcuuuccugaaucuuacgggcugcuauagcuguaacgccggggcgagagucugccucucuaucaccuccacaggaaccggcagccuguccgcccauaauaaagauggcucucugcacauugugcucccuagcgaaaacgggacaaaggaccagugucaaauccugcacuuuaccgugcccgaggucgaagaggaguucauguacuccugcgauggagacgaacggccgcuucugguuaaaggcacgcucaucgcuauugauccuuuugacgaucgcagagaggccgggggagaaagcacaguggugaaucccaagucuggcuccuggaacuucuucgacugguuuagcgggcugaugucuugguucggaggcccucugaaaaccauccuucugauuugucucuacgucgcucugagcaucggccucuuuuuccugcuuauuuaucugggaggaaccggccucuccaagauguggcuggccgccacaaagaaggcuucuuga

SEQ ID NO: 14419 - RNA, 3594 nt, Artificial Sequence
  derived and/or modified CDS sequence (opt5) from RVFV__JQ068143.1__GP
auguacgugcugcucaccauccugauuagcguccuuguuugcgaggccgugaucagagugucccugucuagcacacgggaagagacguguuucggcgacuccaccaaccccgaaaugauugagggggcuugggauucucuccgcgaagaggagaugccugaagaacugagcugcuccaucucuggaauuagagaagucaagacaagcucccaggagcuuuaucgggcccugaaagcgaucaucgcugccgacggccucaauaacauuaccugucacgggaaggauccggaggacaaaaucagccugauuaagggacccccucauaaaaagcgcgugggcaucguuagaugcgaacggcgcagagaugccaagcaaauugggcgggagacaauggcuggaaucgccaugaccgugcugcccgcucucgccgucuuugcgcuggccccugugguuuucgcugaagacccccaccuucgcaauagaccuggcaaaggccauaacuacauugaugggaugacacaggaggacgccaccuguaagccggugacguaugcuggagccugcagcuccuuugauguccugcucgaaaaaggcaaguucccccuguuucagagcuacgcgcaccaucggacccuucuggaggccgugcacgacacaaucaucgcuaaagccgauccucccucuugugaccuccaguccgcucacgggaauccuugcaugaaggagaagcuggugaugaaaacccauugucccaacgauuaucaaagcgcccacuaccugaauaacgacggaaagauggccucugucaaaugcccgccuaaguaugaacucacagaggacuguaauuucugccgccagaugaccggcgcuucccugaaaaaggggagcuacccccuucaggaucuguuuugccaguccucugaagacgauggaagcaaacucaagacgaagaugaaaggcguuugugaggugggcgugcaagcgcugaagaaaugcgacgggcagcuuuccacagcccaugaagucgugccuuucgcuguuuuuaagaacagcaaaaagguguaccuggauaagcucgaccugaaaaccgaggagaaucugcuccccgauucuuucgucuguuuugaacacaagggacaguauaaaggcacaauugacuccgggcagaccaagagagagcugaaaucuuucgauaucucucaaugccccaagauuggaggccacgggagcaagaaauguaccggagacgccgccuuuugcuccgcuuacgaauguacagcccaguaugcgaacgcuuacugcucucaugccaauggcagcggcaucgugcagauucaaguuuccgggguguggaagaaaccucuuugugucggauaugagcggguggucgugaagcgcgaacugagcgccaaaccgauccagagaguugagcccugcacgaccuguaucacaaagugcgagccucacggccucgugguccggucuaccggguucaagauuuccagcgcuguggccugcgcuucuggaguuugugugacaggcucccagagccccuccaccgaaaucacgcugaaauacccugggauuucucagagcuccggcggagauaucggcguccauauggcccacgacgaccaaucugugagcuccaagauuguggcgcauugucccccgcaggauccuugccuuguucacgggugcaucgucugugcccacggacugaucaacuaucagugccauacagcucucagcgccuucgugguggucuuuguguucucuuccguugcuauuaucugucuggccauucuguacaaagugcucagaugccugaagaucgcgcccaaaaagguccuuaauccucugauguggauuaccgccuuuauccgcuggguguacaaaaagaugguugcucggguggccgacaacauuaaccaggucaauagagagaucggcuggauggaagggggacaacucgcucugggcaaccccgccccuaucccccgccacgccccgauuccucgguauagcaccuaccugaugcuucuccugaucauuucuuaugcuuccgcguguagcgagcugauccaggccucuagcagaauuacaaccugcuccacagagggggugaauacgaagugucgccucagcggcaccgcucugauccgggccggaucuguuggcgccgaggcuugccuuaugcugaaaggggugaaggaggaucagacaaaauuccucaagaucaaaaccgucuccagcgaacuguccugcagagagggacagucuuacuggacaggcagcuuuucccccaagugucugucuagccgccggugccaucuugugggggaaugucacgugaacagaugccucuccuggcgcgacaaugagaccucugccgaguucagcuuugucggagaauccacgaccaugcgggagaacaaguguuucgaacaaugcggcggguggggcuguggaugcuuuaauguuaaccccagcugucuguucgugcacacauaucugcagucugugagaaaagaggcgcuccgggucuuuaauugcauugauugggugcauaagcugacccuugaaaucacagacuucgauggcuccguuagcaccauugaccugggggcuucuuccagccgcuuuacgaacuggggaucugugucccucagccuggaugccgagggcaucuccgggagcaauucuuucagcuucauugaguccccuggaaaaggcuacgccaucgucgacgaaccguuuucugagauccccagacagggguuccugggcgaaauucgguguaacagcgaguccucugugcuuagcgcucacgaauccugccucagagccccuaaucugaucucuuauaagcccaugauugaucagcuggagugcacaaccaaccucaucgacccuuuuguuguguucgagcgcggaagccugccccaaacacggaaugauaaaaccuuugcggcuuccaagggcaacagagggguccaggccuucagcaagggaucugugcaggccgaccuuacccugauguuugacaacuucgaaguugauuuugugggcgcugccgucuccugugacgcugccuuccucaaucugacagggugcuacagcuguaacgcgggagcccgcgugugccugucuauuacguccaccggcacaggcacccuuagcgcucauaauaaagaugggucccuccacaucgugcugccuucugagaacggaacaaaggaccaaugucagauccugcauuuuaccguccccgaaguugaggaggaguucauguacagcugcgauggcgacgaaagaccgcuccuggugaaagggacgcuuauugccaucgauccuuuugacgaucggcgcgaagcuggaggcgaguccacaguggucaaucccaagagcgggucuuggaacuucuucgacugguuuuccggacugaugagcugguucggcggcccucucaaaaccauucugcugaucugucuuuauguggcccugucuauugggcucuuuuuccugcucaucuaccugggaagaaccggccuuagcaagauguggcuggccgcuacaaagaaagcguccuga

SEQ ID NO: 14420 - RNA, 3594 nt, Artificial Sequence
  derived and/or modified CDS sequence (opt5) from RVFV(2007002445)__EU574037.1__GP
auguacgugcugcucaccauccugauuagcguccuuguuugcgaggccgugaucagagugucccugucuagcacacgggaagagacguguuucggcgacuccaccaaccccgaaaugauugagggggcuugggauucucuccgcgaagaggagaugccugaagaacugagcugcuccgucucuggaaucagagaagugaagacaagcucccaggagcuuuaucgggcccugaaagcgauuaucgcugccgacggccucaauaacaucaccugucacgggaagaauccggaggauaaaauuagccugaucaagggacccccucauaaaaagcgcguuggcauugugagaugcgaacggcgcagagacgccaagcaaaucgggcgggagacaauggcuggaauugccaugaccguccugcccgcucucgccguguuugcgcuggccccuguuguguucgcugaagauccccaccuucgcaacagaccuggcaaaggccauaauuacaucgacgggaugacacaggaggaugccaccuguaagccggucacguaugcuggagccugcagcuccuuugacgugcugcucgaaaaaggcaaguucccccuguuucagagcuacgcgcaccaucggacccuucuggaggccgugcacgauacaauuaucgcuaaagccgacccucccucuugugaucuccaguccgcucacgggaacccuugcaugaaggagaagcuggucaugaaaacccauugucccaaugacuaucaaagcgcccacuaccugaacaaugauggaaagauggccucuguuaaaugcccgccuaaguaugaacucacagaggacuguaacuucugccgccagaugaccggcgcuucccugaaaaaggggagcuacccccuucaggaccuguuuugccaguccucugaagaugacggaagcaaacucaagacgaagaugaaaggcgugugugaggugggcguccaagcgcugaagaaaugcgaugggcagcuuuccacagcccaugaagugguuccuuucgcuguguuuaagaauagcaaaaaggucuaccuggacaagcucgaucugaaaaccgaggagaaccugcuccccgacucuuucguguguuuugaacacaagggacaguauaaaggcacaauggauuccgggcagaccaagagagagcugaaaucuuucgacaucucucaaugccccaagauuggaggccacgggagcaagaaauguaccggagaugccgccuuuugcuccgcuuacgaauguacagcccaguaugcgaaugcuuacugcucucaugccaacggcagcggcaucguucagauucaaguguccggggucuggaagaaaccucuuugugugggauaugagcgggucgugguuaagcgcgaacugagcgccaaaccgauccagagaguggagcccugcacgaccuguauuacaaagugcgagccucacggccucgucgugcggucuaccggguucaagaucuccagcgcuguugccugcgcuucuggagugugugucacaggcucccagagccccuccaccgaaaucacgcugaaauacccugggauuucucagagcuccggcggagacaucggcgugcauauggcccacgaugaccaaucugugagcuccaagauuguugcgcauugucccccgcaggacccuugccuuguccacgggugcaucgugugugcccacggacugauuaauuaucagugccauacagcucucagcgccuucguggucaucuuuguguucucuuccaccgcuaucauuugucuggccguucuguacagagugcucaaaugccugaagaucgcgccccgcaaaguccuuaacccucugauguggauuaccgccuuuauccgguggguguacaagaaaaugguugcuagaguggccgauaacauuaaucaggucaaccgcgagaucggcuggauggaagggggacaacucgcucugggcaaucccgccccuauuccccggcacgccccgaucccuagauauagcacauaccugaugcuucuccugaucgugucuuaugcuuccgcguguagcgagcugauucaggccucuagccgcaucaccacaugcuccacggaggggguuaacaccaagugucggcucagcggcacagcucugauuagagccggaucugugggcgccgaggcuugccuuaugcugaagggggucaaagaggaccagaccaaguuccucaaaaucaagacaguguccagcgaacuguccugccgcgagggacagucuuacuggaccggcagcuuuucccccaaaugucugucuagccggagaugccaucuugugggggaaugucacgucaaucgcugccucuccuggcgggauaacgagacgucugccgaguucagcuuuguuggagaauccaccacaaugagagagaauaaguguuucgaacaaugcggcggguggggcuguggaugcuuuaacgugaaucccagcugucuguucgugcacaccuaucugcagucuguccggaaggaggcgcuccgcguguuuaacugcauugacuggguucauaaacugacacuugaaaucaccgauuucgacggcuccgugagcacgaucgaucugggggcuucuuccagcagauuuacaaauuggggaucugucucccucagccuggacgccgagggcauuuccgggagcaacucuuucagcuucaucgaguccccuggaaagggcuacgccauuguggaugaaccguuuucugagaucccccggcagggguuccugggcgaaauuagauguaauagcgaguccucuguucuuagcgcucacgaauccugccuccgcgccccuaaccuggugucuuauaaacccaugaucgaccagcuggagugcaccacaaaucucaucgauccuuuugucguguucgagcggggaagccugccccaaaccagaaacgaaaagaccuuugcggcuuccaaaggcaaccgcgggguucaggccuucagcaagggaucuauucaggccgaccuuacacugauguuugauaauuucgagguggacuuugucggcgcugccguguccugugacgcugccuuccucaaccugacggggugcuacagcuguaaugcgggagccagagugugccugucuaucaccuccacaggcaccggcacacuuagcgcucauaacaaggaugggucccuccacauuguccugccuucugaaaauggaaccaaagaccaaugucagauccugcauuuuacgguucccgagguggaggaagaguucauguacagcugcgauggcgacgaacggccgcuccuggugaaggggacacuuauugccaucgauccuuuugacgaucgcagagaggcuggaggcgaauccaccgucgugaaccccaaaagcgggucuuggaauuucuucgacugguuuuccggacugaugagcugguucggcggcccucucaagaccauccugcugauuugucuuuauguugcccugucuaucgggcucuuuuuccugcucauuuaccugggacggacaggccuuagcaaaauguggcuggccgcuaccaagaaggcguccuga

SEQ ID NO: 14421 - RNA, 3594 nt, Artificial Sequence
  derived and/or modified CDS sequence (opt5) from RVFV(2008/00101)__HE687306.1__GP
auguacgugcugcucaccauccugauuagcguccuuguuugcgaggccgugaucagagugucccugucuagcacacgggaagagacguguuucggcgacuccaccaaccccgaaaugauugagggggcuugggauucucuccgcgaagaggagaugccugaagaacugagcugcuccgucucuggaaucagagaagugaagacaagcucccaggagcuuuaucgggcccugaaagcgauuaucgcugccgacggccucaauaacaucaccugucacgggaagaauccggaggauaaaauuagccugaucaagggacccccucauaaaaagcgcguuggcauugugagaugcgaacggcgcagagacgccaagcaaaucgggcgggagacaauggcuggaauugccaugaccguccugcccgcucucgccguguuugcgcuggccccuguuguguucgcugaagauccccaccuucgcaacagaccuggcaaaggccauaauuacaucgacgggaugacacaggaggaugccaccuguaagccggucacguaugcuggagccugcagcuccuuugacgugcugcucgaaaaaggcaaguucccccuguuucagagcuacgcgcaccaucggacccuucuggaggccgugcacgauacaauuaucgcuaaagccgacccucccucuugugaucuccaguccgcucacgggaacccuugcaugaaggagaagcuggucaugaaaacccauugucccaaugacuaucaaagcgcccacuaccugaacaaugauggaaagauggccucuguuaaaugcccgccuaaguaugaacucacagaggacuguaacuucugccgccagaugaccggcgcuucccugaaaaaggggagcuacccccuucaggaccuguuuugccaguccucugaagaugacggaagcaaacucaagacgaagaugaaaggcgugugugaggugggcguccaagcgcugaagaaaugcgaugggcagcuuuccacagcccaugaagugguuccuuucgcuguguuuaagaauagcaaaaaggucuaccuggacaagcucgaucugaaaaccgaggagaaccugcuccccgacucuuucguguguuuugaacacaagggacaguauaaaggcacaauggauuccgggcagaccaagagagagcugaaaucuuucgacaucucucaaugccccaagauuggaggccacgggagcaagaaauguaccggagaugccgccuuuugcuccgcuuacgaauguacagcccaguaugcgaaugcuuacugcucucaugccaacggcagcggcaucguucagauucaaguguccggggucuggaagaaaccucuuugugugggauaugagcgggucgugguuaagcgcgaacugagcgccaaaccgauccagagaguggagcccugcacgaccuguauuacaaagugcgagccucacggccucgucgugcggucuaccggguucaagaucuccagcgcuguugccugcgcuucuggagugugugucacaggcucccagagccccuccaccgaaaucacgcugaaauacccugggauuucucagagcuccggcggagacaucggcgugcauauggcccacgaugaccaaucugugagcuccaagauuguugcgcauugucccccgcaggacccuugccuuguccacgggugcaucgugugugcccacggacugauuaauuaucagugccauacagcucucagcgccuucguggucaucuuuguguucucuuccaccgcuaucauuugucuggccguucuguacagagugcucaaaugccugaagaucgcgccccgcaaaguccuuaacccucugauguggauuaccgccuuuauccgguggguguacaagaaaaugguugcuagaguggccgauaacauuaaucaggucaaccgcgagaucggcuggauggaagggggacaacucgcucugggcaaucccgccccuauuccccggcacgccccgaucccuagauauagcacauaccugaugcuucuccugaucgugucuuaugcuuccgcguguagcgagcugauucaggccucuagccgcaucaccacaugcuccacggaggggguuaacaccaagugucggcucagcggcacagcucugauuagagccggaucugugggcgccgaggcuugccuuaugcugaagggggucaaagaggaccagaccaaguuccucaaaaucaagacaguguccagcgaacuguccugccgcgagggacagucuuacuggaccggcagcuuuucccccaaaugucugucuagccggagaugccaucuugugggggaaugucacgucaaucgcugccucuccuggcgggauaacgagacgucugccgaguucagcuuuguuggagaauccaccacaaugagagagaauaaguguuucgaacaaugcggcggguggggcuguggaugcuuuaacgugaaucccagcugucuguucgugcacaccuaucugcagucuguccggaaggaggcgcuccgcguguuuaacugcauugacuggguucauaaacugacacuugaaaucaccgauuucgacggcuccgugagcacgaucgaucugggggcuucuuccagcagauuuacaaauuggggaucugucucccucagccuggacgccgagggcauuuccgggagcaacucuuucagcuucaucgaguccccuggaaagggcuacgccauuguggaugaaccguuuucugagaucccccggcagggguuccugggcgaaauuagauguaauagcgaguccucuguucuuagcgcucacgaauccugccuccgcgccccuaaccuggugucuuauaaacccaugaucgaccagcuggagugcaccacaaaucucaucgauccuuuugucguguucgagcggggaagccugccccaaaccagaaacgacaagaccuuugcggcuuccaaaggcaaccgcgggguucaggccuucagcaagggaucugugcaggccgaucuuacacugauguuugacaauuucgaagucgacuuugugggcgcugccguguccugugaugcugccuuccucaaccugacggggugcuacagcuguaaugcgggagccagagucugccugucuauuaccuccacaggcaccggcacacuuagcgcucauaacaaggacgggucccuccacaucguucugccuucugagaauggaaccaaagaucaaugucagauucugcauuuuacggugcccgaaguggaggaggaguucauguacagcugcgacggcgaugaacggccgcuccuggucaaggggacacuuaucgccauugacccuuuugaugaccgcagagaagcuggaggcgaguccaccgugguuaaccccaaaagcgggucuuggaauuucuucgauugguuuuccggacugaugagcugguucggcggcccucucaagaccacacugcugaucugucuuuauguggcccugucuaucgggcucuuuuuccugcucauuuaccugggacggaccggccuuagcaaaauguggcuggccgcuacaaagaaggcguccuga

SEQ ID NO: 14422 - RNA, 3594 nt, Artificial Sequence
  derived and/or modified CDS sequence (opt5) from RVFV(Hv-B375)__DQ380218.1__GP
auguacgugcugcucaccauccugauuagcguccuuguuugcgaggccgugaucagagugucccugucuagcacacgggaagagacguguuucggcgacuccaccaaccccgaaaugauugagggggcuugggauucucuccgcgaaggagagaugccugaggaacugagcugcuccaucucuggcauuagagaggucaagacaagcucccaggaacuuuaucgggcccugaaagcgaucaucgcugccgacgggcucaauaacauuaccugucacggaaaggauccggaggacaaaaucagccugauuaaggggcccccucauaaaaagcgcgugggcaucguuagaugcgagcggcgcagagaugccaagcaaauuggacgggaaacaauggcuggcaucgccaugaccgugcugcccgcucucgccgucuuugcgcuggccccugugguuuucgcugaggacccccaccuucgcaauagaccuggcaaagggcauaacuacauugauggaaugacacaggaagacgccaccuguaagccggugacguaugcuggcgccugcagcuccuuugauguccugcucgagaaagggaaguucccccuguuucagagcuacgcgcaccaucggacccuucuggaagccgugcacgacacaaucaucgcuaaagccgauccucccucuugugaccuccaguccgcucacggaaauccuugcaugaaggagaagcuggugaugaaaacccauugucccaacgauuaucaaagcgcccacuaccugaauaacgacggcaagauggccucugucaaaugcccgccuaagaaugagcucacagaagacuguaacuucugccgccagaugaccggggcuucccugaaaaagggaagcuauccccuucaggaucuguuuugccaguccucugaggacgauggcagcaaacucaagacgaagaugaaaggcguuugugaagugggggugcaagcgcugaagaaaugcgacggacagcuuuccacagcccaugaggucgugccuuucgcuguuuuuaagaauagcaaaaagguguaccuggauaagcucgaccugaaaaccgaagagaaccugcuccccgauucuuucgucuguuuugagcacaagggccaguacaaagggacaauggacuccggacagaccaagagagaacugaaaucuuucgauauuucucaaugccccaagaucggcgggcacggaagcaagaaauguaccggcgacgccgccuuuugcuccgcuuaugaguguacagcccaguacgcgaaugcuuauugcucucaugccaacggcagcgggauugugcagauccaaguuuccggaguguggaagaaaccucuuugugucggcuacgaacggguggucgugaagcgcgagcugagcgccaaaccgauucagagaguugaacccugcacgaccuguaucacaaagugcgagccucacgggcucgugguccggucuaccggauucaagaucuccagcgcuguggccugcgcuucuggcguuugugugacagggucccagagccccuccaccgagauuacgcugaaauauccuggcaucucucagagcuccggaggcgauauugggguccauauggcccacgacgaccaaucugugagcuccaagaucguggcgcauugucccccgcaggauccuugccuuguucacggaugcauugucugugcccacggccugaucaauuaccagugccauacagcucucagcgccuucgugguggucuuuguguucucuuccaucgcuauuaucugucuggccauucuguauagaguucucaaaugccugaagaucgcgccccgcaaagugcuuaacccucugauguggauuaccgccuuuauccggugggucuacaagaaaaugguggcuagaguugccgacaacauuaaucaggugaaccgcgaaaucggguggauggagggaggccaacucguccuggggaaucccgcuccuaucccccggcacgccccgauuccuagauacagcaccuaucugaugcuucuccugaucgugucuuacgccuccgcuuguagcgaacugauucaggcgucuagccgcaucacaaccugcuccacagagggcguuaacacgaagugucggcucagcggaaccgcccugauuagagcuggcucugugggggccgaggccugccuuaugcugaagggagucaaagaagaucagacaaaguuccucaaaaucaagaccguguccagcgagcuguccugccgcgaaggccagucuuauuggacagggagcuuuucccccaaaugucugucuagccggagaugccaucuugugggagagugucacgucaaucgcugccucuccuggcgggacaacgaaaccucugcugaguucagcuuuguuggcgaguccacgaccaugagagaaaauaaguguuucgagcaaugcgggggcuggggauguggcugcuuuaacgugaaucccagcugucuguucgugcacacauaccugcagucuguccggaaggaagcccuccgcguguuuaacugcaucgauuggguucauaaacugacccuugagauuacagacuucgauggguccgugagcaccaucgaccugggagcgucuuccagcagauuuacgaauuggggcucugucucccucagccuggaugcugaagggauuuccggaagcaacucuuucagcuucaucgaguccccuggcaagggguaugccauuguggacgagccguuuucugaaaucccccggcagggcuuccugggagagaucagauguaauagcgaauccucuguucuuagcgcccacgaguccugccuccgcgcuccuaaccugauuucuuacaaacccaugaucgaucagcuggaaugcacaaccaaucucauugacccuuuuguggucuucgagcggggcagccugccccaaacaagaaacgauaagaccuuugccgcguccaaagggaaccgcggagugcaggcuuucagcaagggcucuguucaggccgaccuuacccugauguuugacaauuucgagguggauuuugucggggccgcuguguccugugacgccgcuuuccucaaccugacaggaugcuauagcuguaaugccggcgcgagagugugccugucuaucacguccaccggcacagggacccuuagcgcccauaacaaggauggaucccuccacauuguccugccuucugaaaauggcacaaaagaccaaugucagauccugcauuuuaccguucccgagguggaagaggaguucauguacagcugcgauggggacgaacggccgcuccuggugaagggaacgcuuaucgcuauugauccuuuugacgaucgcagagaggccggcggggaauccacagucgugaaccccaaaagcggaucuuggaauuucuucgacugguuuuccggccugaugagcugguucggcgggccucucaagaccauccugcugauuugucuuuacguugcucugucuaucggacucuuuuuccugcucauuuaucugggccggaccgggcuuagcaaaauguggcuggccgccacaaagaaggcuuccuga

SEQ ID NO: 14423 - RNA, 3594 nt, Artificial Sequence
  derived and/or modified CDS sequence (opt5) from RVFV(763/70)__DQ380188.1__GP
auguacgugcugcucaccauccugauuacaguccuuguuugcgaggccgugaucagagugagccuguccucuacgcgggaagagaccuguuucggcgacagcacaaaccccgaaaugauugagggggcuugggauucccuccgcgaagaggagaugccugaggaacugucuugcagcaucuccggaauuagagaagucaagaccucuagccaggagcuuuaucgggcccugaaagcgaucaucgcugccgacggccucaauaacauuacaugucacgggaaggauccggaggacaaaaucucccuggugaagggacccccucauaaaaagcgcguuggcauugugagaugcgaacggcgcagagaugccaagcaaaucgggcgggagaccauggcuggaauugccaugacaguccugcccgcucucgccguguuugcgcuggccccuguuguguucgcugaagacccccaccuucgcaauagaccuggcaaaggccauaacuacaucgaugggaugacccaggaggacgccacguguaagccggucaccuaugcuggagccugcagcucuuuugaugugcugcucgaaaaaggcaaguucccccuguuucaguccuacgcgcaccaucggacacuucuggaggccgugcacgacaccauuaucgcuaaagccgauccucccagcugugaccuccagucugcucacgggaauccuugcaugaaggagaagcuggucaugaaaacacauugucccaacgauuaucaauccgcccacuaccugaauaacgacggaaagauggccagcguuaaaugcccgccuaaguauggccucaccgaagacuguaauuucugccgccagaugacgggggcuucucugaaaaagggauccuacccccuucaggaucuguuuugccagagcuccgaggacgauggcucuaaacucaagacaaagaugaaaggcgugugugaaguggggguccaagcgcugaagaaaugcgacggacagcuuagcaccgcccaugaggugguuccuuucgcuguguuuaagaacuccaaaaaggucuaccuggauaagcucgaccugaaaacagaagagaaucugcuccccgauagcuucguguguuuugagcacaagggccaguauaaagggaccauggacucuggacagaccaagagagaacugaaauccuucgauaucagccaaugccccaagauuggcgggcacggaucuaagaaauguacaggcgacgccgccuuuugcagcgcuuacgaguguacggcccaguaugcgaacgcuuacugcucccaugccaauggcucugggaucguucagauucaagugagcggagucuggaagaaaccucuuugugugggcuaugaacgggucgugguuaagcgcgagcuguccgccaaaccgauccagagaguggaacccugcaccacauguauuaccaagugcgagccucacgggcucgucgugcggagcacaggauucaagaucucuuccgcuguugccugcgcuagcggcgugugugucaccgggucucagucccccagcacggagaucacacugaaauacccuggcauuucccagucuagcggaggcgauaucggggugcauauggcccacgacgaccaauccgugucuagcaagauuguugcgcauugucccccgcaggauccuugccuuguccacggaugcaucgugugugcccacggccugauuaacuaucagugccauaccgcucucuccgccuucguggucguguuuguuuucagcucuguggcuaucaucugucuggccauucuguacaaaguccucaagugccugaaaaucgcgcccagaaaggugcuuaauccucugauguggauuaccgccuuuauccgcuggguuuacaaaaagaugguggcucgggucgccgacaacauuaaccaggugaauagagaaaucggguggauggagggaggccaacucgcucuggggaaccccgccccuauuccccgccacgccccgaucccucgguauuccacauaccugaugcuucuccugaucguuagcuaugcuucugcguguuccgaacugauucaggccagcucuagaaucaccacaugcagcacggagggcgugaauaccaagugucgccucuccggaacagcucugauucgggccggcagcgucggggccgaggcuugccuuaugcugaaaggagugaaggaagaucagaccaaauuccucaagaucaaaacagugucuuccgagcugagcugcagagaaggccaguccuacuggaccgggucuuuuagccccaagugucuguccucucgccggugccaucuugucggagagugucacguuaacagaugccucagcuggcgcgacaaugaaacguccgccgaguucucuuuugugggcgagagcaccacaaugcgggaaaacaaguguuucgagcaaugcgggggcuggggauguggcugcuuuaaugugaaccccuccugucuguucguccacaccuaucugcagagcgugagaaaagaagcgcuccggguuuuuaauugcauugauugggugcauaagcugacacuugagaucaccgacuucgaugggucugucuccacgaucgaccugggagcuucuagcucccgcuuuacaaacuggggcagcgugucucucucccuggaugccgaagggauuagcggauccaauagcuucucuuucaucgagagcccuggcaaaggguacgccauuguugacgagccguuuuccgaaauccccagacagggcuuccugggagagauucgguguaacucugaaagcuccgugcuuucugcucacgagagcugccucagagccccuaaucugaucuccuauaagcccaugaucgaucagcuggaaugcaccacaaaccucauugacccuuuugucguguucgagcgcggcucucugccccaaacccggaaugauaaaaccuuugcggcuagcaaggggaacagaggaguucaggccuucuccaagggcagcgugcaggccgaccuuacacugauguuugacaacuucgaggucgauuuugugggggcugccgugucuugugacgcugccuuccucaaucugacgggaugcuacuccuguaacgcgggcgcccgcgucugccugagcaucaccucuacaggcaccgggacacuuuccgcucauaauaaagauggaagccuccacauuguucugccuuccgaaaacggcaccaaggaccaaugucagauccugcauuuuacggugcccgagguggaagaggaguucauguacucuugcgauggggacgaaagaccgcuccuggucaaaggaacacuuauugccaucgauccuuuugacgaucggcgcgaggcuggcggggaaagcaccgugguuaaucccaaguccggaagcuggaacuucuucgacugguuuucuggccugauguccugguucggcgggccucucaaaaccauccugcugauuugucuuuauguggcccugagcaucggacucuuuuuccugcucauuuaccugggcagaacagggcuuucuaagauguggcuggccgcuaccaagaaagcgagcuga

SEQ ID NO: 14424 - RNA, 3594 nt, Artificial Sequence
  derived and/or modified CDS sequence (opt5) from RVFV(RVFBJ01/2016)__KX785331.1__GP
auguacgugcugcucaccauccugauuagcguccuuguuugcgaggccaucauuagagugucccugucuagcacacgggaagagacguguuucggcgacuccaccaaccccgaaaugaucgagggggcuugggauucucuccgcgaagaggagaugccugaagaacugagcugcuccauuucuggaaucagagaagugaagacaagcucccaggagcuuuaucgggcccugaaagcgaucauugcugccgacggccucaauaacaucaccugucacgggaaggauccggaggacaaaauuagccugaucaagggacccccucauaaaaagcgcgucggcauugugagaugcgaacggcgcagagaugccaagcaaaucgggcgggagacaauggcuggaauugccaugaccguucugcccgcucucgccguguuugcgcuggccccugucguguucgcugaagacccccaccuucgcaauagaccuggcaaaggccauaacuacaucgaugggaugacacaggaggacgccaccuguaagccgguuacguaugcuggagccugcagcuccuuugaugugcugcucgaaaaaggcaaguucccccuguuucagagcuacgcgcaccaucggacccuucuggaggccguccacgacacaaucauugcuaaagccgauccucccucuugugaccuccaguccgcucacgggaauccuugcaugaaggagaagcuggugaugaaaacccauugucccaacgauuaucaaagcgcccacuaccugaauaacgacggaaagauggccucugugaaaugcccgccuaagcaugaacucacagaggacuguaauuucugccgccagaugaccggcgcuucccugaaaaaggggagcuauccccuucaggaucuguuuugccaguccucugaagacgauggaagcaaacucaagacgaagaugaaaggcgucugugagguuggcgugcaagcgcugaagaaaugcgacgggcagcuuuccacagcccacgaaguggucccuuucgcuguguuuaagaacagcaaaaagguuuaccuggauaagcucgaccugaaaaccgaggagaaucugcuccccgauucuuucguguguuuugaacacaagggacaguacaaaggcacaauggacuccgggcagaccaagagagagcugaaaucuuucgauaucucucaaugccccaagauuggaggccaugggagcaagaaauguaccggagacgccgccuuuugcuccgcuuaugaauguacagcccaguacgcgaacgcuuauugcucucacgccaauggcagcggcaucguccagauucaaguguccgggguuuggaagaaaccucuuugugugggauacgagcgggucguggucaagcgcgaacugagcgccaaaccgauccagagaguggagcccugcacgaccuguaucacaaagugcgagccucauggccucguugugcggucuaccggguucaagauuuccagcgcugucgccugcgcuucuggaguguguguuacaggcucccagagccccuccaccgaaaucacgcugaaauauccugggauuucucagagcuccggcggagauaucggcgugcacauggcccaugacgaccaaucugucagcuccaagauuguggcgcacugucccccgcaggauccuugccuugugcacgggugcaucguuugugcccauggacugaucaacuaccagugccacacagcucucagcgccuucgucgugguguuugucuucucuuccguggcuauuaucugucuggccauucuguauaaaguucucagaugccugaagaucgcgcccaaaaaggugcuuaauccucugauguggauuaccgccuuuauccgcugggucuacaaaaagaugguggcucggguugccgacaacauuaaccaggugaauagagagaucggcuggauggaagggggacaacucgcucugggcaaccccgccccuaucccccgccaugccccgauuccucgguacagcaccuaucugaugcuucuccugaucauuucuuacgcuuccgcguguagcgagcugauccaggccucuagcagaauuacaaccugcuccacagagggggucaauacgaagugucgccucagcggcaccgcucugauccgggccggaucugugggcgccgaggcuugccuuaugcugaaagggguuaaggaggaucagacaaaauuccucaagaucaaaaccguguccagcgaacuguccugcagagagggacagucuuauuggacaggcagcuuuucccccaagugucugucuagccgccggugccaccuugucggggaaugucacgugaacagaugccucuccuggcgcgacaaugagaccucugccgaguucagcuuugugggagaauccacgaccaugcgggagaacaaguguuucgaacaaugcggcggguggggcuguggaugcuuuaaugucaaccccagcugucuguucguucauacauaccugcagucugugagaaaagaggcgcuccggguguuuaauugcauugauuggguccacaagcugacccuugaaaucacagacuucgauggcuccgugagcaccauugaccugggggcuucuuccagccgcuuuacgaacuggggaucuguuucccucagccuggaugccgagggcaucuccgggagcaauucuuucagcuucauugaguccccuggaaaaggcuaugccaucguggacgaaccguuuucugagauccccagacagggguuccugggcgaaauucgguguaacagcgaguccucuguccuuagcgcucaugaauccugccucagagccccuaaucugaucucuuacaagcccaugauugaucagcuggagugcacaaccaaccucaucgacccuuuugugguuuucgagcgcggaagccugccccaaacacggaaugauaaaaccuuugcggcuuccaagggcaacagaggggugcaggccuucagcaagggaucuguccaggccgaccuuacccugauguuugacaacuucgaaguggauuuuguuggcgcugccguguccugugacgcugccuuccucaaucugacagggugcuauagcuguaacgcgggagcccgcgucugccugucuauuacguccaccggcacaggcacccuuagcgcucacaauaaagaugggucccuccauaucgugcugccuucugagaacggaacaaaggaccaaugucagauccugcacuuuaccgugcccgaagucgaggaggaguucauguacagcugcgauggcgacgaaagaccgcuccugguuaaagggacgcuuauugccaucgauccuuuugacgaucggcgcgaagcuggaggcgaguccacaguggugaaucccaagagcgggucuuggaacuucuucgacugguuuuccggacugaugagcugguucggcggcccucucaaaaccauucugcugaucugucuuuacgucgcccugucuauugggcucuuuuuccugcucaucuaucugggaagaaccggccuuagcaagauguggcuggccgcuacaaagaaagcguccuga

SEQ ID NO: 14425 - RNA, 3594 nt, Artificial Sequence
  derived and/or modified CDS sequence (opt5) from RVFV(Lunyo)__KU167026.1__GP
auguacgugcugcucaccauccugauuagcguccuuguuugcgaggccgugaucagagugucccugucuagcacacgggaagagacguguuucggcgacuccaccaaccccgaaaugauugagggggcuugggauucucuccgcgaagaggagaugccugaagaacugagcugcuccaucucuggaauuagagaagucaagacaagcucccaggagcuuuaucgggcccugaaagcgaucaucgcugccgacggccucaauaacauuaccugucacgggaaggauccggaggacaaaaucagccugauuaagggacccccucauaaaaagcgcgugggcaucguuagaugcgaacggcgcagagaugccaagcaaauugggcgggagacaauggcuggaaucgccaugaccgugcugcccgcucucgccgucuuugcgcuggccccugugguuuucgcugaagacccccaccuucgcaauagaccuggcaaaggccauaacuacauugaugggaugacacaggaggacgccaccuguaagccggugacguaugcuggagccugcagcuccuuugauguccugcucgaaaaaggcaaguucccccuguuucagagcuacgcgcaccaucggacccuucuggaggccgugcacgacacaaucaucgcuaaagccgauccucccucuugugaccuccaguccgcucacgggaauccuugcaugaaggagaagcuggugaugaaaacccauugucccaacgauuaucaaagcgcccacuaccugaauaacgacggaaagauggccucugucaaaugcccgccuaaguaugaacucacagaggacuguaauuucugccgccagaugaccggcgcuucccugaaaaaggggagcuacccccuucaggaucuguuuugccaguccucugaagacgauggaagcaaacucaagacgaagaugaaaggcguuugugaggugggcgugcaagcgcugaagaaaugcgacgggcagcuuuccacagcccaugaagucgugccuuucgcuguuuuuaagaacagcaaaaagguguaccuggauaagcucgaccugaaaaccgaggagaaucugcuccccgauucuuucgucuguuuugaacacaagggacaguauaaaggcacaaugguguccgggcagaccaagagagagcugaaaucuuucgacauuucucaaugccccaagaucggaggccacgggagcaagaaauguaccggagaugccgccuuuugcuccgcuuacgaauguacagcccaguaugcgaacgcuuacugcucucaugccaauggcagcggcauuguucagauccaaguguccggggucuggaagaaaccucuuugugugggauaugagcgggucgugguuaagcgcgaacugagcgccaaaccgauucagagaguggagcccugcacgaccuguaucacaaagugcgagccucacggccucgucgugcggucuaccggguucaagaucuccagcgcuguugccugcgcuucuggagugugugucacaggcucccagagccccuccaccgaaauuacgcugaaauacccugggaucucucagagcuccggcggagacauuggcgugcauauggcccacgaugaccaaucugugagcuccaagaucguugcgcauugucccccgcaggacccuugccuuguccacgggugcauugugugugcccacggacugaucaacuaucagugccauacagcucucagcgccuucguggucguguuuguuuucucuuccguggcuaucauuugucuggccauccuguacaaaguccucaagugccugaaaauugcgcccagaaaggugcuuaauccucugauguggaucaccgccuuuauucgcuggguuuacaaaaagaugguggcucgggucgccgauaacaucaaccaggugaauagagagauuggcuggauggaagggggacaacucgcucugggcaaccccgccccuaucccccgccacgccccgaucccucgguauagcaccuaccugaugcuucuccugauuguuucuuaugcuuccgcguguagcgagcugauccaggccucuagcagaauuacaaccugcuccacagagggggugaauacgcgcugucggcucagcggcaccgcucugaucagagccggaucugucggcgccgaggcuugccuuaugcugaagggggugaaagaggaccagacaaaguuccucaaaauuaagaccguguccagcgaacuguccugccgcgagggacagucuuacuggacaggcagcuuuucccccaaaugucugucuagccggagaugccaucuugucggggaaugucacguuaaccgcugccucuccuggcgggauaaugagaccucugccgaguucagcuuugugggagaauccacgaccaugagagagaacaaguguuucgaacaaugcggcggguggggcuguggaugcuuuaaugugaaccccagcugucuguucguccacacauaucugcagucugugcggaaggaggcgcuccgcguuuuuaauugcaucgacugggugcauaaacugacccuugaaaucacagauuucgacggcuccgucagcaccauugaucugggggcuucuuccagcagauuuacgaacuggggaucugugucccucagccuggacgccgagggcaucuccgggagcaauucuuucagcuucauugaguccccuggaaagggcuacgccaucguugaugaaccguuuucugagauuccccggcagggguuccugggcgaaaucagauguaacagcgaguccucugugcuuagcgcucacgaauccugccuccgcgccccuaaucugaucucuuauaaacccaugauugaccagcuggagugcacaaccaaccucaucgauccuuuugucguguucgagcggggaagccugccccaaacaagaaaugacaagaccuuugcggcuuccaaaggcaaccgcgggguucaggccuucagcaagggaucugugcaggccgaucuuacccugauguuugacaacuucgaagucgacuuugugggcgcugccguguccugugaugcugccuuccucaaucugacagggugcuacagcuguaacgcgggagccagagucugccugucuauuacguccaccggcacaggcacccuuagcgcucauaauaaggacgggucccuccacaucguucugccuucugagaacggaacaaaagaucaaugucagauucugcauuuuaccgugcccgaaguggaggaggaguucauguacagcugcgacggcgaugaacggccgcuccuggucaaggggacgcuuaucgccaucgacccuuuugaugaccgcagagaagcuggaggcgaguccacagugguuaaucccaaaagcgggucuuggaacuucuucgauugguuuuccggacugaugagcugguucggcggcccucucaagaccauucugcugaucugucuuuauguggcccugucuauugggcucuuuuuccugcucaucuaccugggacggaccggccuuagcaaaauguggcuggccgcuacaaagaaggcguccuga

SEQ ID NO: 14426 - RNA, 3594 nt, Artificial Sequence
  derived and/or modified CDS sequence (opt5) from RVFV(2007000234)__JF326191.1__GP
auguacgugcugcucaccauccugauuagcguccuuguuugcgaggccgugaucagagugucccugucuagcacacgggaagagacguguuucggcgacuccaccaaccccgaaaugauugagggggcuugggauucucuccgcgaagaggagaugccugaagaacugagcugcuccgucucuggaaucagagaagugaagacaagcucccaggagcuuuaucgggcccugaaagcgauuaucgcugccgacggccucaauaacaucaccugucacgggaagaauccggaggauaaaauuagccugaucaagggacccccucauaaaaagcgcguuggcauugugagaugcgaacggcgcagagacgccaagcaaauccggcgcgagacaauggcugggauugccaugaccguccugcccgcucucgccguguuugcgcuggccccuguuguguucgcugaagauccccaccuuagaaaccggccuggaaaaggccauaauuacaucgacggcaugacacaggaggaugccaccuguaagccggucacguaugcuggggccugcagcuccuuugacgugcugcucgaaaaaggaaaguucccccuguuucagagcuacgcgcaccaucgcacccuucuggaggccgugcacgauacaauuaucgcuaaagccgacccucccucuugugaucuccaguccgcucacggcaacccuugcaugaaggagaagcuggucaugaaaacccauugucccaaugacuaucaaagcgcccacuaccugaacaaugaugggaagauggccucuguuaaaugcccgccuaaguaugaacucacagaggacuguaacuucugcagacagaugaccggagcuucccugaaaaagggcagcuacccccuucaggaccuguuuugccaguccucugaagaugacgggagcaaacucaagacgaagaugaaaggagugugugaggugggcguccaagcgcugaagaaaugcgauggccagcuuuccacagcccaugaagugguuccuuucgcuguguuuaagaauagcaaaaaggucuaccuggacaagcucgaucugaaaaccgaggagaaccugcuccccgacucuuucguguguuuugaacacaaggggcaguauaaaggaacaauggauuccggccagaccaagcgggagcugaaaucuuucgacaucucucaaugccccaagauugggggacacggcagcaagaaauguaccggggaugccgccuuuugcuccgcuuacgaauguacagcccaguaugcgaaugcuuacugcucucaugccaacggaagcggcaucguucagauucaaguguccggcgucuggaagaaaccucuuugugugggguaugagcgcgucgugguuaagagagaacugagcgccaaaccgauccagcggguggagcccugcacgaccuguauuacaaagugcgagccucacggacucgucgugagaucuaccggcuucaagaucuccagcgcuguugccugcgcuucuggggugugugucacaggaucccagagccccuccaccgaaaucacgcugaaauacccuggcauuucucagagcuccgggggcgacaucggagugcauauggcccacgaugaccaaucugugagcuccaagauuguugcgcauugucccccgcaggacccuugccuuguccacggcugcaucgugugugcccacgggcugauuaauuaucagugccauacagcucucagcgccuucguggucaucuuuguguucucuuccaccgcuaucauuugucuggccguucuguaccgcgugcucaaaugccugaagaucgcgccccggaaaguccuuaacccucugauguggauuaccgccuuuaucagauggguguacaagaaaaugguugcucgcguggccgauaacauuaaucaggucaaccgggagaucggauggauggaaggcgggcaacucgcucugggaaaucccgccccuauucccagacacgccccgaucccucgcuauagcacauaccugaugcuucuccugaucgugucuuaugcuuccgcguguagcgagcugauucaggccucuagccggaucaccacaugcuccacggagggcguuaacaccaaguguagacucagcgggacagcucugauucgcgccggcucugugggagccgaggcuugccuuaugcugaagggcgucaaagaggaccagaccaaguuccucaaaaucaagacaguguccagcgaacuguccugccgggaggggcagucuuacuggaccggcagcuuuucccccaaaugucugucuagcagacgcugccaucuugugggagaaugucacgucaaucggugccucuccuggagagauaacgagacgucugccgaguucagcuuuguuggggaauccaccacaaugcgggagaauaaguguuucgaacaaugcggaggcuggggguguggcugcuuuaacgugaaucccagcugucuguucgugcacaccuaucugcagucuguccgcaaggaggcgcucagaguguuuaacugcauugacuggguucauaaacugacacuugaaaucaccgauuucgacggauccgugagcacgaucgaucugggcgcuucuuccagccgguuuacaaauugggggucugucucccucagccuggacgccgagggaauuuccggcagcaacucuuucagcuucaucgaguccccugggaagggauacgccauuguggaugaaccguuuucugagauccccagacagggcuuccugggggaaauucgcuguaauagcgaguccucuguucuuagcgcucacgaauccugccuccgggccccuaaccuggugucuuauaaacccaugaucgaccagcuggagugcaccacaaaucucaucgauccuuuugucguguucgagagaggcagccugccccaaacccgcaacgacaagaccuuugcggcuuccaaaggaaacagaggcguucaggccuucagcaaggggucugugcaggccgaucuuacacugauguuugacaauuucgaagucgacuuugugggagcugccguguccugugaugcugccuuccucaaccugacgggcugcuacagcuguaaugcgggggcccgggucugccugucuauuaccuccacaggaaccggcacacuuagcgcucauaacaaggacggcucccuccacaucguucugccuucugagaaugggaccaaagaucaaugucagauucugcauuuuacggugcccgaaguggaggaggaguucauguacagcugcgacggagaugaacgcccgcuccuggucaagggcacacuuaucgccauugacccuuuugaugacagacgggaagcugggggagaguccaccgugguuaaccccaaaagcggcucuuggaauuucuucgauugguuuuccgggcugaugagcugguucggaggcccucucaagaccauccugcugaucugucuuuauguggcccugucuauuggccucuuuuuccugcucaucuaccuggggcgcacaggacuuagcaaaauguggcuggccgcuaccaagaaggcguccuga

SEQ ID NO: 14427 - RNA, 3594 nt, Artificial Sequence
  derived and/or modified CDS sequence (opt5) from RVFV(KEN07-KUR340)__EF460404.1__GP
auguacgugcugcucaccauccugauuagcguccuuguuugcgaggccgugaucagagugucccugucuagcacacgggaagagacguguuucggcgacuccaccaaccccgaaaugauugagggggcuugggauucucuccgcgaagaggagaugccugaagaacugagcugcuccgucucuggaaucagagaagugaagacaagcucccaggagcuuuaucgggcccugaaagcgauuaucgcugccgacggccucaauaacaucaccugucacgggaagaauccggaggauaaaauuagccugaucaagggacccccucauaaaaagcgcguuggcauugugagaugcgaacggcgcagagacgccaagcaaaucgggcgggagacaauggcuggaauugccaugaccguccugcccgcucucgccguguuugcgcuggccccuguuguguucgcugaagauccccaccuucgcaacagaccuggcaaaggccauaauuacaucgacgggaugacacaggaggaugccaccuguaagccggucacguaugcuggagccugcagcuccuuugacgugcugcucgaaaaaggcaaguucccccuguuucagagcuacgcgcaccaucggacccuucuggaggccgugcacgauacaauuaucgcuaaagccgacccucccucuugugaucuccaguccgcucacgggaacccuugcaugaaggagaagcuggucaugaaaacccauugucccaaugacuaucaaagcgcccacuaccugaacaaugauggaaagauggccucuguuaaaugcccgccuaaguaugaacucacagaggacuguaacuucugccgccagaugaccggcgcuucccugaaaaaggggagcuacccccuucaggaccuguuuugccaguccucugaagaugacggaagcaaacucaagacgaagaugaaaggcgugugugaggugggcguccaagcgcugaagaaaugcgaugggcagcuuuccacagcccaugaagugguuccuuucgcuguguuuaagaauagcaaaaaggucuaccuggacaagcucgaucugaaaaccgaggagaaccugcuccccgacucuuucguguguuuugaacacaagggacaguauaaaggcacaauggauuccgggcagaccaagagagagcugaaaucuuucgacaucucucaaugccccaagauuggaggccacgggagcaagaaauguaccggagaugccgccuuuugcuccgcuuacgaauguacagcccaguaugcgaaugcuuacugcucucaugccaacggcagcggcaucguucagauucaaguguccggggucuggaagaaaccucuuugugugggauaugagcgggucgugguuaagcgcgaacugagcgccaaaccgauccagagaguggagcccugcacgaccuguauuacaaagugcgagccucacggccucgucgugcggucuaccggguucaagaucuccagcgcuguugccugcgcuucuggagugugugucacaggcucccagagccccuccaccgaaaucacgcugaaauacccugggauuucucagagcuccggcggagacaucggcgugcauauggcccacgaugaccaaucugugagcuccaagauuguugcgcauugucccccgcaggacccuugccuuguccacgggugcaucgugugugcccacggacugauuaauuaucagugccauacagcucucagcgccuucguggucaucuuuguguucucuuccaccgcuaucauuugucuggccguucuguacagaaugcucaaaugccugaagaucgcgccccgcauugugcuuaacccucugauguggaucaccgccuuuauucggugggucuacaaaaagaugguggcuagaguugccgauaacaucaaucaggugaaccgcgagauuggcuggauggaagggggacaacucgcucugggcaaucccgccccuaucccccggcacgccccgaucccuagauauagcacauaccugaugcuucuccugauugucucuuaugcuuccgcguguagcgagcugauccaggccucuagccgcauuaccacaugcuccacggagggggugaacaccaaaugucggcucagcggcacagcucugaucagagccggaucuguuggcgccgaggcuugccuuaugcugaagggggugaaggaggaccagaccaaauuccucaagauuaaaacagucuccagcgaacuguccugccgcgagggacagucuuacuggaccggcagcuuuucccccaagugucugucuagccggagaugccaucuugugggggaaugucacgugaaucgcugccucuccuggcgggauaacgagacgucugccgaguucagcuuugucggagaauccaccacaaugagagagaauaaauguuucgaacaaugcggcggguggggcuguggaugcuuuaacguuaaucccagcugucuguucgugcacaccuaucugcagucugugcggaaggaggcgcuccgcgucuuuaacugcaucgacugggugcauaagcugacacuugaaaucaccgauuucgacggcuccguuagcacgauugaucugggggcuucuuccagcagauuuacaaauuggggaucugugucccucagccuggacgccgagggcaucuccgggagcaacucuuucagcuucauugaguccccuggaaaaggcuacgccaucgucgaugaaccguuuucugagauuccccggcagggguuccugggcgaaaucagauguaauagcgaguccucugugcuuagcgcucacgaauccugccuccgcgccccuaaccugguuucuuauaagcccaugaucgaccagcuggagugcaccacaaaucucauugauccuuuuguggucuucgagcggggaagccugccccaaaccagaaacgacaaaaccuuugcggcuuccaagggcaaccgcggggugcaggccuucagcaaaggaucuguucaggccgaucuuacacugauguuugacaauuucgaaguggacuuugucggcgcugccguguccugugaugcugccuuccucaaccugacggggugcuacagcuguaaugcgggagccagagugugccugucuaucaccuccacaggcaccggcacacuuagcgcucauaacaaggacgggucccuccacauuguccugccuucugagaauggaaccaaggaucaaugucagauccugcauuuuacgguucccgaaguggaggaggaguucauguacagcugcgacggcgaugaacggccgcuccuggugaaagggacacuuauugccaucgacccuuuugaugaccgcagagaagcuggaggcgaguccaccgucgugaaccccaagagcgggucuuggaauuucuucgauugguuuuccggacugaugagcugguucggcggcccucucaaaaccauccugcugauuugucuuuauguugcccugucuaucgggcucuuuuuccugcucauuuaccugggacggacaggccuuagcaagauguggcuggccgcuaccaaaaaggcguccuga

SEQ ID NO: 14428 - RNA, 3594 nt, Artificial Sequence
  derived and/or modified CDS sequence (opt5) from RVFV(2373/74)__DQ380194.1__GP
auguacgugcugcucaccauccugauuagcguccuuguuugcgaggccgugaucagagugucccugucuagcacacgggaagagacguguuucggcgacuccaccaaccccgaaaugauugagggggcuugggauucucuccgcgaagaggagaugccugaagaacugagcugcuccaucucuggaauuagagaagucaagacaagcucccaggagcuuuaucgggcccugaaagcgaucaucgcugccgacggccucaauaacauuaccuguuacgggaaggauccggaggacaaaaucagccugauuaagggacccccucacaaaaagcgcgugggcaucguuagaugcgaacggcgcagagaugccaagcaaauugggcgggagacaauggcuggaaucgccaugaccgugcugcccgcucucgccgucuuugcgcuggccccugugguuuucgcugaagacccccaucuucgcaauagaccuggcaaaggccacaacuauauugaugggaugacacaggaggacgccaccuguaagccggugacguacgcuggagccugcagcuccuuugauguccugcucgaaaaaggcaaguucccccuguuucagagcuaugcgcaucaccggacccuucuggaggccgugcaugacacaaucaucgcuaaagccgauccucccucuugugaccuccaguccgcucacgggaauccuugcaugaaggagaagcuggugaugaaaacccacugucccaacgauuaccaaagcgcccauuaucugaauaacgacggaaagauggccucugucaaaugcccgccuaaguacgaacucacagaggacuguaauuucugccgccagaugaccggcgcuucccugaaaaaggggagcuacccccuucaggaucuguuuugccaguccucugaagacgauggaagcaaacucaagacgaagaugaaaggcguuugugaggugggcgugcaagcgcugaagaaaugcgacgggcagcuuuccacagcccacgaagucgugccuuucgcuguuuuuaagaacagcaaaaagguguaucuggauaagcucgaccugaaaaccgaggagaaucugcuccccgauucuuucgucuguuuugaacauaagggacaguacaaaggcacaauggacuccgggcagaccaagagagagcugaaaucuuucgauauuucucaaugccccaagaucggaggccacgggagcaagaaauguaccggagacgccgccuuuugcuccgcuuaugaauguacagcccaguacgcgaacgcuuauugcucucacgccaauggcagcggcauugugcagauccaaguuuccgggguguggaagaaaccucuuugugucggauacgagcggguggucgugaagcgcgaacugagcgccaaaccgauucagagaguugagcccugcacgaccuguaucacaaagugcgagccucauggccucgugguccggucuaccggguucaagaucuccagcgcuguggccugcgcuucuggaguuugugugacaggcucccagagccccuccaccgaaauuacgcugaaauauccugggaucucucagagcuccggcggagauauuggcguccacauggcccaugacgaccaaucugugagcuccaagaugguggcgcacugucccccgcaggauccuugccuuguucaugggugcaucgucugugcccacggacugauuaacuaccagugccacacagcucucagcgccuucgugguggucuuuguguucucuuccguugcuaucaucugucuggccauucuguacaaagugcucaagugccugaaaaucgcgcccagaaagguccuuaauccucugauguggauuaccgccuuuauccgcuggguguauaaaaagaugguugcucggguggccgacaacauuaaccaggucaauagagagaucggcuggauggaagggggacaacucgcucugggcaaccccgccccuauuccccgccaugccccgaucccucgguacagcaccuaucugaugcuucuccugaucgugucuuacgcuuccgcguguagcgagcugauucaggccucuagcagaaucacaaccugcuccacagaggggguuaauacgaagugucgccucagcggcaccgcucugauucgggccggaucugugggcgccgaggcuugccuuaugcugaaaggggucaaggaggaucagacaaaauuccucaagaucaaaaccguguccagcgaacuguccugcagagagggacagucuuauuggacaggcagcuuuucccccaagugucugucuagccgccggugccaccuugugggggaaugucaugucaacagaugccucuccuggcgcgacaaugagaccucugccgaguucagcuuuguuggagaauccacgaccaugcgggagaacaaguguuucgaacaaugcggcggguggggcuguggaugcuuuaaugugaaccccagcugucuguucgugcacacauaccugcagucugucagaaaagaggcgcuccggguguuuaauugcauugauuggguucacaagcugacccuugaaaucacagacuucgauggcuccgugagcacccuggaccucggggcuucuuccagccgcuuuacgaacuggggaucugucucccugagccuggaugccgagggcaucuccgggagcaauucuuucagcuucauugaguccccuggaaaaggcuaugccaucguggacgaaccguuuucugagauucccagacagggguuccuuggcgaaauccgguguaacagcgaguccucuguucucagcgcucaugaauccugccugagagccccuaaucugauuucuuacaagcccaugaucgaucagcucgagugcacaaccaaccugaucgacccuuuuguggucuucgagcgcggaagccuuccccaaacacggaaugagaaaaccuuugcggcuuccaagggcaacagaggggugcaggccuucagcaagggaucuguucaggccgaucugacccucauguuugacaacuucgaaguggacuuugucggcgcugccguguccugugaugcugccuuccugaaucugacagggugcuacagcuguaacgcgggagcccgcgugugccuuucuauuacguccaccggcacaggcacccucagcgcucacaauaaagacgggucccugcauaucguccugccuucugaaaacggaacaaaggaucaaugucagauucuccacuuuaccguucccgagguggaggaagaguucauguauagcugcgacggcgaugaaagaccgcugcuugugaaagggacgcugaucgccauugacccuuuugaugaccggcgcgaggcuggaggcgaauccacagucgugaaucccaagagcgggucuuggaacuucuucgauugguuuuccggacucaugagcugguucggcggcccucugaaaaccauccugcuuaucugucuguacguugcccucucuauugggcuguuuuuccuccugaucuaucuuggaagaaccggccugagcaagauguggcucgccgcuacaaagaaagcguccuga

SEQ ID NO: 14429 - RNA, 3594 nt, Artificial Sequence
  derived and/or modified CDS sequence (opt5) from RVFV(200803169)__JF311384.1__GP
auguacgugcugcucaccauccugauuagcguccuuguuugcgaggccgugaucagagugucccugucuagcacacgggaagagacguguuucggcgacuccaccaaccccgaaaugauugagggggcuugggauucucuccgcgaagaggagaugccugaagaacugagcugcuccgucucuggaaucagagaagugaagacaagcucccaggagcuuuaucgggcccugaaagcgauuaucgcugccgacggccucaauaacaucaccugucacgggaagaauccggaggauaaaauuagccugaucaagggacccccucauaaaaagcgcguuggcauugugagaugcgaacggcgcagagacgccaagcaaaucgggcgggagacaauggcuggaauugccaugaccguccugcccgcucucgccguguuugcgcuggccccuguuguguucgcugaagauccccaccuucgcaacagaccuggcaaaggccauaauuacaucgacgggaugacacaggaggaugccaccuguaagccggucacguaugcuggagccugcagcuccuuugacgugcugcucgaaaaaggcaaguucccccuguuucagagcuacgcgcaccaucggacccuucuggaggccgugcacgauacaauuaucgcuaaagccgacccucccucuugugaucuccaguccgcucacgggaacccuugcaugaaggagaagcuggucaugaaaacccauugucccaaugacuaucaaagcgcccacuaccugaacaaugauggaaagauggccucuguuaaaugcccgccuaaguaugaacucacagaggacuguaacuucugccgccagaugaccggcgcuucccugaaaaaggggagcuacccccuucaggaccuguuuugccaguccucugaagaugacggaagcaaacucaagacgaagaugaaaggcgugugugaggugggcguccaagcgcugaagaaaugcgaugggcagcuuuccacagcccaugaagugguuccuuucgcuguguuuaagaauagcaaaaaggucuaccuggacaagcucgaucugaaaaccgaggagaaccugcuccccgacucuuucguguguuuugaacacaagggacaguauaaaggcacaauggauuccgggcagaccaagagagagcugaaaucuuucgacaucucucaaugccccaagauuggaggccacgggagcaagaaauguaccggagaugccgccuuuugcuccgcuuacgaauguacagcccaguaugcgaaugcuuacugcucucaugccaacggcagcggcaucguucagauucaaguguccggggucuggaagaaaccucuuugugugggauaugagcgggucgugguuaagcgcgaacugagcgccaaaccgauccagagaguggagcccugcacgaccuguauuacaaagugcgagccucacggccucgucgugcggucuaccggguucaagaucuccagcgcuguugccugcgcuucuggagugugugucacaggcucccagagccccuccaccgaaaucacgcugaaauacccugggauuucucagagcuccggcggagacaucggcgugcauauggcccacgaugaccaaucugugagcuccaagauuguugcgcauugucccccgcaggacccuugccuuguccacgggugcaucgugugugcccacggacugauuaauuaucagugccauacagcucucagcgccuucguggucaucuuuguguucucuuccaccgcuaucauuugucuggccguucuguacagagugcucaaaugccugaagaucgcgccccgcaaaguccuuaacccucugauguggauuaccgccuuuauccgguggguguacaagaaaaugguugcuagaguggccgauaacauuaaucaggucaaccgcgagaucggcuggauggaagggggacaacucgcucugggcaaucccgccccuauuccccggcacgccccgaucccuagauauagcacauaccugaugcuucuccugaucgugucuuaugcuuccgcguguagcgagcugauucaggccucuagccgcaucaccacaugcuccacggaggggguuaacaccaagugucggcucagcggcacagcucugauuagagccggaucugugggcgccgaggcuugccuuaugcugaagggggucaaaguggaccagaccaaguuccucaaaaucaagacaguguccagcgagcuguccugccgcgaaggacagucuuacuggaccggcagcuuuucccccaaaugucugucuagccggagaugccaucuugucggggagugucacguuaaucgcugccucuccuggcgggauaacgaaacgucugccgaguucagcuuugugggagaguccaccacaaugagagaaaauaaguguuucgagcaaugcggcggguggggcuguggaugcuuuaacgugaaucccagcugucuguucguccacaccuaucugcagucugugcggaaggaagcgcuccgcguuuuuaacugcauugacugggugcauaaacugacacuugagaucaccgauuucgacggcuccgucagcacgaucgaucugggggcuucuuccagcagauuuacaaauuggggaucugugucccucagccuggacgccgaaggcauuuccgggagcaacucuuucagcuucaucgaguccccuggaaagggcuacgccauuguugaugagccguuuucugaaaucccccggcagggguuccugggcgaggugagauguaauagcgaauccucuguccuuagcgcucacgaguccugccuccgcgccccuaaccuggugucuuauaaacccaugauugaccagcuggaaugcaccacaaaucucaucgauccuuuuguuguguucgagcggggaagccugccccaaaccagaaacgacaagaccuuugcggcuuccaaaggcaaccgcgggguccaggccuucagcaagggaucugugcaggccgaucuuacacugauguuugacaauuucgagguggacuuugucggcgcugccguuuccugugaugcugccuuccucaaccugacggggugcuacagcuguaaugcgggagccagagugugccugucuaucaccuccacaggcaccggcacacuuagcgcucauaacaaggacgggucccuccacauugugcugccuucugaaaauggaaccaaagaucaaugucagauccugcauuuuacgguccccgagguggaagaggaguucauguacagcugcgacggcgaugaacggccgcuccugguuaaggggacacuuauugccaucgacccuuuugaugaccgcagagaggcuggaggcgaauccaccguggucaaccccaaaagcgggucuuggaauuucuucgauugguuuuccggacugaugagcugguucggcggcccucucaagaccauucugcugaucugucuuuauguggcccugucuaucgggcucuuuuuccugcucauuuaccugggacggacaggccuuagcaaaauguggcuggccgcuaccaagaaggcguccuga

SEQ ID NO: 14430 - RNA, 3594 nt, Artificial Sequence
  derived and/or modified CDS sequence (opt5) from RVFV(200803167)__JF311382.1__GP
auguacgugcugcucaccauccugauuagcguccuuguuugcgaggccgugaucagagugucccugucuagcacacgggaagagacguguuucggcgacuccaccaaccccgaaaugauugagggggcuugggauucucuccgcgaagaggagaugccugaagaacugagcugcuccgucucuggaaucagagaagugaagacaagcucccaggagcuuuaucgggcccugaaagcgauuaucgcugccgacggccucaauaacaucaccugucacgggaagaauccggaggauaaaauuagccugaucaagggacccccucauaaaaagcgcguuggcauugugagaugcgaacggcgcagagacgccaagcaaaucgggcgggagacaauggcuggaauugccaugaccguccugcccgcucucgccguguuugcgcuggccccuguuguguucgcugaagaucuucaucugcgcaacagacccggcaaaggccacaauuacaucgacgggaugacacaggaggaugccaccuguaagccugucacguaugcuggagccugcagcuccuuugacgugcuccuggaaaaaggcaaguucccgcuuuuucagagcuacgcgcaccaucggacccugcucgaggccgugcacgauacaauuaucgcuaaagccgaucccccuucuugugaccugcaguccgcucacgggaaccccugcaugaaggagaagcuggucaugaaaacccauuguccuaaugacuaucaaagcgcccacuaccucaacaaugauggaaagauggccucuguuaaaugucccccgaaguaugaacugacagaggacugcaacuucugccgccagaugaccggcgcuucccuuaaaaaggggagcuacccucugcaggaccucuuuugccaguccucugaagaugacggaagcaaacugaagacgaagaugaaaggcgugugugaggugggcguccaagcgcuuaagaaaugcgaugggcagcuguccacagcccaugaagugguucccuucgcuguguuuaagaauagcaaaaaggucuaccucgacaagcuggaucugaaaaccgaggagaaccuccugccugacucuuucguguguuuugaacacaagggacaguauaaaggcacaauggauuccgggcagaccaagagagagcuuaaaucuuucgacaucucucaaugccccaagauuggaggccacgggagcaagaaauguaccggagaugccgccuuuugcuccgcuuacgaauguacagcccaguaugcgaaugcuuacugcucucaugccaacggcagcggcaucguucagauucaaguguccggggucuggaagaaaccccugugugugggauaugagcgggucgugguuaagcgcgaacucagcgccaaaccuauccagagaguggagccgugcacgaccuguauuacaaagugcgagccccacggccuggucgugcggucuaccggguucaagaucuccagcgcuguugccugcgcuucuggagugugugucacaggcucccagagcccuuccaccgaaaucgcccuuaaauaccccgggauuucucagagcuccggcggagacaucggcgugcauauggcgcacgaugaccaaucugugagcuccaagauuguugcccauugcccuccccaggacccgugucugguccacgggugcaucgugugugcucacggacucauuaauuaucagugccauacggcccugagcgcuuucguggucguguuuguuuucucuuccaucgccaucauuugucuggcgauccucuacagagugcugaaaugccuuaagauugccccucgcaaaguccugaacccccucauguggaucacagcuuuuauucgguggguguacaagaaaaugguugccagaguggcugauaacaucaaucaggucaaccgcgagauuggcuggauggaagggggacaacuggugcugggcaauccugcccccaucccucggcacgcccccaucccgagauauagcaccuaccuuaugcuccugcugauuguuucuuaugcuuccgcguguagcgagcucauccaggccucuagccgcauuaccacaugcuccaccgagggggugaacacaaagugucggcugagcggcacggcucuuaucagagccggaucugucggcgccgaggcuugccugaugcucaagggggugaaagaggaccagaccaaguuccugaaaauuaagacaguguccagcgaacuguccugccgcgagggacagucuuacuggaccggcagcuuuuccccuaaaugucuuucuagccggagaugccaucucgucggggaaugucacguuaaucgcugccuguccuggcgggauaacgagacaucugccgaguucagcuuugugggagaauccaccacgaugagagagaauaaguguuucgaacaaugcggcggguggggcuguggaugcuuuaacgugaaucccagcugucuguucguccacaccuaucuccagucugugcggaaggaggcgcugcgcguuuuuaacugcaucgacugggugcauaaacuuacacuggaaaucaccgauuucgacggcuccgucagcacaauugaucucggggcuucuuccagcagauuuaccaauuggggaucugugucccugagccuggacgccgagggcaucuccgggagcaacucuuucagcuucauugagucccccggaaagggcuacgccaucguugaugaaccuuuuucugagauuccgcggcagggguuccuuggcgaaaucagauguaauagcgaguccucugugcucagcgcucacgaauccugccugcgcgcccccaaccugaucucuuauaaaccuaugauugaccagcucgagugcacgacaaaucugaucgaucccuuugucguguucgagcggggaagccuuccucaaaccagaaacgacaagacauuugcggcuuccaaaggcaaccgcgggguucaggccuucagcaagggaucugugcaggccgaucugacccucauguuugacaauuucgaagucgacuuugugggcgcugccguguccugugaugcugccuuccugaaccugaccgggugcuacagcuguaaugcgggagccagagucugccuuucuauuacauccacgggcaccggcacacucagcgcucauaacaaggacgggucccugcacaucguucugcccucugagaauggaaccaaagaucaaugucagauucuccauuuuacagugccugaaguggaggaggaguucauguacagcugcgacggcgaugaacggccccugcuugucaaggggacccugaucgccaucgacccguuugaugaccgcagagaagcuggaggcgaguccacggugguuaacccuaaaagcgggucuuggaauuucuucgauugguuuuccggacucaugagcugguucggcggcccccugaagacaaugcugcuuauuugucuguauguggcccucucuaucgggcuguuuuuccuccugauuuaccuuggacggaccggccugagcaaaauguggcucgccgcuaccaagaaggcguccuga

SEQ ID NO: 14431 - RNA, 3594 nt, Artificial Sequence
  derived and/or modified CDS sequence (opt5) from RVFV(Entebbe)__DQ380191.1__GP
auguacgcccugcucaccauccugauuagcgugcuugucugcgaggcuguuaucagagugucccugucuagcacacgggaagagacguguuucggcgacuccaccaaccccgaaaugauugagggggccugggauucucuccgcgaagaggagaugccugaagaacugagcugcuccaucucuggaauuagagaagugaagacaagcucccaggagcuucaccgggcgcugaaagcuaucaucgccgccgacggccucaauaacauuaccugucaugggaaggauccggaggacaaaaucagccugauuaagggacccccucacaaaaagcgcgucggcgugguuagaugcgaacggcgcagagaugcuaagcaaaucgggcgggagacaauggccggaauugcuaugaccgugcugcccgcccucgcggucuuugcccuggcuccugugguuuucgccgaagacccccaucuucgcaauagaccuggcaaaggccacaacuauaucgaugggaugacacaggaggacgcuaccuguaagccggugacguacgccggagcgugcagcuccuuugauguccugcucgaaaaaggcaaguucccccuguuucagagcuaugcccaucaccggacccuucuggaggcugugcacgacacaauuaucgccaaagcugauccucccucuugugaccuccaguccgcccaugggaauccuugcaugaaggagaagcuggugaugaaaacccacugucccaacgauuaccaaagcgcccauuaucugaauaacgacggaaagauggcuucugucaaaugcccgccuaaguacgaacucacagaggacuguaauuucugccgccagaugaccggcgcgucccugaaaaaggggagcuauccccuucaggaucuguuuugccaguccucugaagacgauggaagcaaacucaagacgaagaugaaaggcguuugugaggugggcgugcaagcccugaagaaaugcgacgggcagcuuuccacagcucacgaagucgugccuuucgccguuuuuaagaacagcaaaaagguguaccuggauaagcucgaccugaaaaccgaggagaaucugcuccccgauucuuucgucuguuuugaacacaagggacaguacaaaggcacaauggacuccgggcagaucaagagagagcugaaaucuuucgauauuucucaaugccccaagaucggaggccaugggagcaagaaauguaccggagacgccgcuuuuugcuccgccuaugaauguaccgcgcaguacgcuaacgccuauugcucucacgccaauggcagcggcauugugcagauccaaguuuccgggguguggaagaaaccucuuugugucggauacgagcggguggucgugaagcgcgaacugagcgcuaaaccgauucagagaguugagcccugcacaacguguaucaccaagugcgagccucauggccucgugguccggucuacaggguucaagaucuccagcgccguggcuugcgccucuggaguuugugugaccggcucccagagccccuccacagaaauuacccugaaauauccugggaucucucagagcuccggcggagauauuggcguccacauggcgcaugacgaccaaucugugagcuccaagaucguggcccacugucccccgcaggauccuugccuuguucacgggugcauugucugugcucauggacugaucaacuaccagugccacacggcccucagcgcuuucgugguggucuuuguguucucuuccguugccaucauuugucuggcgauccuguauaaagugcucaagugccugaaaauugcccccagaaagguccuuaauccucugauguggaucacagcuuuuauucgcuggguguacaaaaagaugguugcccggguggcugacaacaucaaccaggucaauagagagauuggcuggauggaagggggacaacucgugcugggcaaccccgccccuaucccccgccaugccccgaucccucgguacagcaccuaucugaugcuucuccugauuguuucuuacgcuuccgcguguagcgagcugauccaggccucuagcagaauuaccacaugcuccaccgagggggugaauacaaagugucgccucagcggcacggcucugauccgggccggaucugucggcgccgaggcuugccuuaugcugaaaggggugaaggaggaucagaccaaauuccucaagauuaaaacaguguccagcgaacuguccugcagagagggacagucuuauuggaccggcagcuuuucccccaagugucugucuagccgccggugccaccuugucggggaaugucacguuaacagaugccucuccuggcgcgacaaugagacaucugccgaguucagcuuugugggagaauccaccacgaugcgggagaacaaguguuucgaacaaugcggcggguggggcuguggaugcuuuaaugugaaccccagcugucuguucguccauaccuaccugcagucugugagaaaagaggcgcuccggguuuuuaauugcaucgauugggugcacaagcugacacuugaaaucaccgacuucgauggcuccgucagcacaguggaccugggggcuucuuccagccgcuuuaccaacuggggaucuguuucccucagccuggaugccgagggcauuuccgggagcaauucuuucagcuucaucgaguccccuggaaaaggcuaugccauuguggacgaaccguuuucugagauccccagacagggguuccugggcgaaauucgguguaacagcgaguccucuguccuuagcgcucaugaauccugccucagagccccuaaucugaucucuuacaagcccaugaucgaucagcuggagugcacgacaaaccucauugacccuuuugugguuuucgagcgcggaagccugccccaaacccggaaugauaaaacauuugcggcuuccaagggcaacagaggggugcaggccuucagcaagggaucuguccaggccgaccuuacccugauguuugacaacuucgaaguggauuuugugggcgcugccgucuccugugacgcugccuuccucaaucugaccgggugcuauagcuguaacgcgggagcccgcguuugccugucuaucacauccacgggcaccggcacacuuagcgcucacaauaaagaugggucccuccauauugugcugccuucugagaacggaaccaaggaccaaugucagauccugcacuuuacagugcccgaagucgaggaggaguucauguacagcugcgauggcgacgaaagaccgcuccuggugaaagggacccuuauugccaucgauccuuuugacgaucggcgcgaagcuggaggcgaguccacgguugugaaucccaagagcgggucuuggaacuucuucgacugguuuuccggacugaugagcugguucggcggcccucucaaaacaauccugcugauuugucuuuacgucgcccugucuaucgggcucuuuuuccugcucauuuaucugggaagaaccggccuuagcaagauguggcuggccgcuaccaagaaagcguccuga

SEQ ID NO: 14432 - RNA, 3594 nt, Artificial Sequence
  derived and/or modified CDS sequence (opt5) from RVFV(25010-24)__KM210509.1__GP
auguacgugcugcucacaauccugauuagcguccuuguuugcgaggccgugaucagagugucccugucuagcacacgggaagagacguguuucggcgacuccaccaaccccgaaaugauugagcgcgcuugggauucucucagagaagaggagaugccugaagaacugagcugcuccaucucugggauucgggaagucaagacaagcucccaggagcuuuaucgcgcccugaaagcgaucaucgcugccgacggacucaauaacauuaccugucacggcaaggauccggaggacaaaaucagccugauuaaggggcccccucauaaaaagagagugggaaucguucggugcgaacgcagacgggaugccaagcaagugggccgcgagacaauggcugggauugccaugaccguccugcccgcucucgccguguuugcgcuggccccuguuguguucgcugaagacccccaccuuagaaaucggccuggaaaaggccauaacuacaucgauggcaugacacaggaggacgccaccuguaagccggucacguaugcuggggccugcagcuccuuugaugugcugcucgaaaaaggaaaguucccccuguuucagagcuacgcgcaccaucgcacccuucuggaggccgugcacgacacaauuaucgcuaaagccgauccucccucuugugaccuccaguccgcucacggcaauccuugcaugaaggagaagcuggucaugaaaacccauugucccaacgauuaucaaagcgcccacuaccugaauaacgacgggaagauggccucuguuaaaugcccgccuaaguaugaacucacagaggacuguaauuucugcagacagaugaccggagcuucccugaaaaagggcagcuacccccuucaggaucuguuuugccaguccucugaagacgaugggagcaaacucaagacgaagaugaaaggagugugugaggugggcguccaagcgcugaagaaaugcgacggccagcuuuccacagcccaugaagugguuccuuucgcuguguuuaagaacagcaaaaaggucuaccuggauaagcucgaccugaaaaccgaggagaaucugcuccccgauucuuucguguguuuugaacacaaggggcaguauaaaggaacaauggacuccggccagaccaagcgggagcugaaaucuuucgauaucucucaaugccccaagauugggggacacggcagcaagaaauguaccggggacgccgccuuuugcuccgcuuacgaauguacagcccaguaugcgaacgcuuacugcucucaugccaauggaagcggcaucguucagauucaaguguccggcgucuggaagaaaccucuuugugugggguaugagcgcgucgugguuaagagagaacugagcgccaaaccgauccagcggguggagcccugcacgaccuguauuacaaagugcgagccucacggacucaucgucagaucuaccggcuucaagaucuccagcgcuguggccugcgcuucugggguuugugugacaggaucccagagccccuccaccgaaauuacgcugaaauacccuggcaucucucagagcuccgggggcgauauuggaguccauauggcccacgacgaccaaucugugagcuccaagaucguggcgcauugucccccgcaggauccuugccuuguucacggcugcauugucugugcccacgggcugaucaacuaucagugccauacagcucucagcgccuucgugguggucuuuguguucucuuccguugcuaucauuugucuggccauccuguacaaagugcucaagugccugaaaauugcgcccaagaaaguccuuaauccucugauguggaucaccgccuuuauucgcuggguguacaagaagaugguugcucggguggccgacaacaucaaccaggucaauagagagauuggauggauggaaggcgggcaacucgcucugggaaaccccgccccuaucccccgccacgccccgaucccucgguauagcaccuaccugaugcuucuccugauugugucuuaugcuuccgcguguagcgagcugauccaggccucuagcagaauuacaaccugcuccacagagggcguuaauacgaaaugucgccucagcgggaccgcucugauccgggccggcucugugggagccgaggcuugccuuaugcugaagggcgucaaagaugaccagacaaaguuccucaaaauuaagaccguguccagcgagcuguccugcagagaagggcagucuuacuggacaggcagcuuuucccccaagugucugucuagccgccggugccaucuugugggagagugucacgucaacagaugccucuccuggcgcgauaaugaaaccucugccgaguucagcuuuguuggggaguccacgaccaugcgggaaaacaaauguuucgagcaaugcggaggcuggggguguggcugcuuuaaugugaaccccagcugucuguucgugcacacauaucugcagucugucagaaaggaagcgcuccggguguuuaauugcaucgacuggguucauaaacugacccuugagaucacagauuucgacggauccgugagcaccauugaucugggcgcuucuuccagccgcuuuacgaacugggggucugucucccucagccuggacgccgaaggaaucuccggcagcaauucuuucagcuucauugaguccccugggaagggauacgccaucguggaugagccguuuucugaaauucccagacagggcuuccugggggagauccgguguaacagcgaauccucuguucuuagcgcucacgaguccugccucagagccccuaaucugaucucuuauaaacccaugauugaccagcuggaaugcacaaccaaccucaucgauccuuuuguggucuucgagcgcggcagccugccccaaacacggaaugacaagaccuuugcggcuuccaagggaaacagaggcgugcaggccuucagcaaagggucuguucaggccgaccuuacccugauguuugauaacuucgagguggacuuugucggagcugccguguccugugaugcugccuuccucaaucugacaggcugcuacagcuguaacgcgggggcccgcgugugccugucuauuacguccaccggaacaggcacccuuagcgcucauaauaaggacggcucccuccacaucguccugccuucugaaaacgggacaaaagaucaaugucagauucugcauuuuaccguucccgagguggaagaggaguucauguacagcugcgacggagaugaaagaccgcuccuggugaagggcacgcuuaucgccaucgacccuuuugaugaccggcgcgaggcugggggagaauccacagucgugaaucccaaaagcggcucuuggaacuucuucgauugguuuuccgggcugaugagcugguucggaggcccucucaagaccauucugcugaucugucuuuauguugcccugucuauuggccucuuuuuccugcucaucuaccuggggagaaccggacuuagcaagauguggcuggccgcuaccaaaaaggcguccuga

SEQ ID NO: 14433 - RNA, 3594 nt, Artificial Sequence
  derived and/or modified CDS sequence (opt5) from RVFV(Kenya 9800523)__DQ380196.1__GP
auguacgugcugcucaccauccugauuagcguccuuguuugcgaggccgugaucagagugucccugucuagcacacgggaagagacguguuucggcgacuccaccaaccccgaaaugauugagggggcuugggauucucuccgcgaagaggagaugccugaggaacugagcugcuccgucucuggaaucagagaagugaagacaagcucccaggagcuuuaucgggcccugaaagcgauuaucgcugccgacggccucaauaacaucaccugucacgggaagaauccggaggauaaaauuagccugaucaagggacccccucauaaaaagcgcguuggcauugugagaugcgaacggcgcagagacacaaagcaaaucgggcgggagaccauggccggaauugcuaugacaguccugcccgcccucgcuguguuugcccuggcgccuguuguguucgccgaagauccccaccuucgcaacagaccuggcaaaggccauaauuacaucgacgggaugacccaggaggaugcuacguguaagccggucaccuaugccggagcuuguucuuccuuugacgugcugcucgaaaaaggcaaguucccccuguuucagagcuacgcccaccaucggacacuucuggaggcggugcacgauaccauuaucgccaaagcugacccucccucuugcgaucuccaguccgcccacgggaacccuugcaugaaggagaagcuggucaugaaaacacauugucccaaugacuaucaaagcgcucacuaccugaacaaugauggaaagauggccucuguuaaaugcccgccuaaguaugaacucaccgaggacuguaacuucugccgccagaugacgggcgccucccugaaaaaggggagcuacccccuucaggaccuguuuugccaguccucugaagaugacggaagcaaacucaagacaaagaugaaaggcgugugugaggugggcguccaagcucugaagaaaugcgaugggcagcuuuccaccgcgcaugaagugguuccuuucgccguguuuaagaauagcaaaaaggucuaccuggacaagcucgaucugaaaacagaggagaaccugcuccccgacucuuucguguguuuugaacacaagggacaguauaaaggcaccauggauuccgggcagaccaagagagagcugaaaucuuucgacaucucucaaugccccaagauuggaggccacgggagcaagaaauguacaggagaugcugccuuuugcuccgccuacgaauguacggcucaguaugccaaugcguucugcucucaugcuaacggcagcggcaucguucagauucaaguguccggggucuggaagaaaccucuuugugugggauacgagcgggucgugguuaagcgcgaacugagcgccaaaccgauccagagaguggagcccugcaccacauguauuaccaagugcgagccucacggccucgucgugcggucuacaggguucaagaucuccagcgccguugcuugcgccucuggagugugugucaccggcucccagagccccuccacggaaaucacacugaaauauccugggauuucucagagcuccggcggagacaucggcgugcauauggcucacgaugaccaaucugugagcuccaagauuguugcccauugucccccgcaggacccuugccuuguccacgggugcaucgugugugcgcacggacugauuaauuaccagugccauaccgcccucagcgcuuuuguggucguguucguuuuuagcuccaucgccaucauuugucuggcuauccuguauagagugcucaaaugccugaagauugcgccccgcaaaguccuuaacccucugauguggaucaccgccuucauucgguggguguacaagaaaaugguugccagaguggcugauaacaucaaucaggucaaccgcgagauuggcuggauggaagggggacaacucgugcugggcaaucccgccccuaucccccggcacgcuccgaucccuagauacagcacauaucugaugcuucuccugauuguuucuuacgccuccgccuguagcgagcugauccaggcuucuagccgcauuaccacaugcuccacggagggggugaacaccaagugucggcucagcggcacagcgcugaucagagccggaucugucggcgcugaagccugccuuaugcugaagggggugaaagaggaccagaccaaguuucucaaaauuaagacaguguccagcgaacuguccugccgcgagggacagucuuauuggaccggcagcuucucccccaaaugucugucuagccggagaugccaucuugucggggaaugucacguuaaucgcugccucuccuggcgggauaacgagacgucugccgaguuuagcuucgugggagaauccaccacaaugagagagaauaaguguuuugaacaaugcggcggguggggcuguggaugcuucaacgugaaucccagcugucuguuuguccacaccuaccugcagucugugcggaaggaggcucuccgcguuuucaacugcaucgacugggugcauaaacugacacuugaaaucaccgauuuugacggcuccgucagcacgauugaucugggggccucuuccagcagauucacaaauuggggaucugugucccucagccuggacgcggagggcaucuccgggagcaacucuuucagcuuuauugaguccccuggaaagggcuaugcuaucguugaugaaccguucucugagauuccccggcagggguuucugggcgaaaucagauguaauagcgaguccucugugcuuaacgcccacgaaagcugccuccgcgccccuaaucugaucuccuacaaacccaugauugaccagcuggagugcaccacaaaccucaucgauccuuucgucguguuugagcggggaucucugccccaaaccagaaacgacaagaccuucgcugccagcaaaggcaaucgcgggguucaggcguuuuccaagggaagcgugcaggcugaucuuacacugauguucgacaacuuugaagucgacuucgugggcgccgccgugucuugugaugcugccuuucucaaucugacggggugcuauuccuguaacgcuggagccagagucugccugagcauuaccucuacaggcaccggcacacuuuccgcgcauaauaaggaggggagccuccacaucguucugccuuccgaaaacggaaccaaagaccaaugucagauucugcauuucacggugcccgagguggaggaagaguuuauguacucuugcgauggcgacgaacggccgcuccuggucaaggggacacuuaucgccaucgauccuuucgacgaucgcagagaggcuggaggcgaaagcaccgugguuaaucccaaauccgggagcuggaacuucuuugacugguucucuggacugauguccugguuuggcggcccucucaagaccauucugcugaucugucuuuacguggcccugagcauuggacucuucuuucugcucaucuaucuggggcggacaggccuuucuaaaauguggcuggcugccaccaagaaggccagcuga

SEQ ID NO: 14434 - RNA, 3594 nt, Artificial Sequence
  derived and/or modified CDS sequence (opt5) from RVFV(ANK-6087)__DQ380216.1__GP
auguacgugcugcucaccauccugauuagcguccuuguuugcgaggccgugaucagagugucccugucuagcacacgggaagagacguguuucggcgacuccaccaaccccgaaaugauugagggggcuugggauucucuccgcgaagaggagaugccugaggaacugagcugcuccaucucuggaauuagagaagucaagacaagcucccaggagcuuuaucgggcccugaaagcgaucaucgcugccgacggccucaauaacauuaccugucacgggaaggauccggaggacaaaaucagccugauuaagggacccccucauaaaaagcgcgugggcaucguuagaugcgaacggcgcagagaugccaagcaaauugggcgggagacaauggcuggaaucgccaugaccgugcugcccgcucucgccgucuuugcgcuggccccugugguuuucgcugaagacccccaccuucgcaauagaccuggcaaaggccauaacuacauugaugggaugacacaggaggacgccaccuguaagccggugacguaugcuggagccuguucuuccuuugauguccugcucgaaaaaggcaaguucccccuguuucagagcuacgcgcaccaucggacccuucuggaggccgugcacgacacaaucaucgcuaaagccgauccucccucuugcgaccuccaguccgcucacgggaauccuugcaugaaggagaagcuggugaugaaaacccauugucccaacgauuaucaaagcgcccacuaccugaauaacgacggaaagauggccucugucaaaugcccgccuaaguaugaacucacagaggacuguaauuucugccgccagaugaccggcgcuucccugaaaaaggggagcuacccccuucaggaucuguuuugccaguccucugaagacgauggaagcaaacucaagacgaagaugaaaggcguuugugaggugggcgugcaagcgcugaagaaaugcgacgggcagcuuuccacagcccaugaagucgugccuuucgcuguuuuuaagaacagcaaaaagguguaccuggauaagcucgaccugaaaaccgaggagaaucugcuccccgauucuuucgucuguuuugaacacaagggacaguauaaaggcaagcuggacuccgggcagacaaaaagagagcuuaagagcuucgauauuucucaaugccccaagaucggaggccacgggagcaaaaaguguaccggagacgccgccuuuugcuccgcuuacgaauguaccgcccaguaugcgaacgcuuacugcucucaugccaauggcagcggcauugugcagauccaaguuuccgggguguggaaaaagccucugugugucggauaugagcggguggucgugaaacgcgaacucagcgccaagccgauucagagaguugagcccugcacaacguguaucaccaagugcgagccucacggccuggugguccggucuacaggguucaaaaucuccagcgcuguggccugcgcuucuggaguuugugugaccggcucccagagccccuccacagaaauuacccuuaaguacccugggaucucucagagcuccggcggagauauuggcguccauauggcccacgacgaccaaucugugagcuccaaaaucguggcgcauugucccccgcaggauccuugccugguucacgggugcauugucugugcccacggacucaucaacuaucagugccauacggcucugagcgccuucgugguggucuuuguguucucuuccaucgcuauuaucugucuggccauucucuacagaguucugaagugccuuaaaaucgcgccccgcaaggugcugaauccucucauguggauuacagccuuuauccggugggucuacagaaaaaugguggcucgcguugccgacaacauuaaccaggugaaucgggagaucggcuggauggaagggggacaacugguccugggcaaccccgcuccuauccccagacacgugccgauuccucgcuauagcaccuaccuuaugcuccugcugaucguuucuuaugccuccgccuguagcgagcucauucaggcuucuagccggaucaccacaugcuccaccgagggggugaauacaaaguguagacugagcggcacggcgcuuauucgcgccggaucugucggcgcugaagccugccugaugcucaagggggugaaagaggaucagaccaaguuccugaaaaucaagacaguguccagcgaacuguccugccgggagggacagucuuacuggaccggcagcuuuucccccaaaugucuuucuagcagacgcugccaucucgucggggaaugucacguuaaccggugccuguccuggagagacaaugagacaucugccgaguucagcuuugugggagaauccaccacgaugcgggagaacaaguguuucgaacaaugcggcggguggggcuguggaugcuuuaaugugaaccccagcugucuguucguccacaccuaucuccagucugugcgcaaggaggcucugagaguuuuuaauugcaucgauugggugcauaaacuuacacuggaaauuaccgacuucgauggcuccgucagcacaaucgaccucggggccucuuccagccgguuuaccaacuggggaucugugucccugagccuggaugcggagggcauuuccgggagcaauucuuucagcuucaucgaguccccuggaaagggcuacgcuauuguugacgaaccguuuucugagauccccagacagggguuccuuggcgaaauccgcuguaacagcgaguccucugugcucagcgcccacgaauccugccugcgggccccuaaucugauuucuuauaaacccaugaucgaucagcucgagugcagcacgaaccugauugacccuuuugucguguucaagagaggaucccuuccccaaacacgcaaugauaaaaccuuugcugccagcaagggcaacagagggguucaggcguucucuaagggauccgugcaggcugaccugacacucauguuugacaacuucgaggucgauuuugugggcgccgccgugagcugugacgcugccuuccugaaucugaccgggugcuacucuuguaacgcuggagcccgggucugccuuuccaucaccagcacaggcacgggcacccucuccgcgcauaauaaagaugggucucugcacauuguucugccuagcgaaaacggaacaaaggaccaaugucagauccuccauuuuaccgugcccgagguggaagaggaguucauguacuccugcgauggcgacgaacgcccgcugcuugucagagggacacugaucgccauugauccuuuugacgaucggcgcgaggcuggaggcgaaagcaccgugguuaaucccaaaucuggguccuggaacuucuucgacugguuuagcggacucaugucuugguucggcggcccucugaagacgauccugcuuauuugucuguauguggcccucagcaucgggcuguuuuuccuccugauuuaccuuggaagaacaggccuguccaaaauguggcucgcugccaccaagaaggccucuuga

SEQ ID NO: 14435 - RNA, 3594 nt, Artificial Sequence
  derived and/or modified CDS sequence (opt5) from RVFV(SAUDI 200010901)__KU978778.1__GP
auguacgugcugcucaccauccugauuagcguccuuguuugcgaggccgugaucagagugucccugucuagcacacgggaagagacguguuucggcgacuccaccaaccccgaaaugauugagggggcuugggauucucuccgcgaagaggagaugccugaggaacugagcugcuccgucucuggaaucagagaagugaagacaagcucccaggagcuuuaucgggcccugaaagcgauuaucgcugccgacggccucaauaacaucaccugucacgggaagaauccggaggauaaaauuagccugaucaagggacccccucauaaaaagcgcguuggcauugugagaugcgggcggcgcagagacacaaagcaaaucggacgggaaaccauggccggcauugcuaugacaguccugcccgcccucgcuguguuugcccuggcgccuguuguguucgccgaggauccccaccuucgcaacagaccuggcaaagggcauaauuacaucgacggaaugacccaggaagaugcuacguguaagccggucaccuaugccggcgcuuguucuuccuuugacgugcugcucgagaaagggaaguucccccuguuucagagcuacgcccaccaucggacacuucuggaagcggugcacgauaccauuaucgccaaagcugacccucccucuugcgaucuccaguccgcccacggaaacccuugcaugaaggagaagcuggucaugaaaacacauugucccaaugacuaucaaagcgcucacuaccugaacaaugauggcaagauggccucuguuaaaugcccgccuaaguaugagcucaccgaagacuguaacuucugccgccagaugacgggggccucccugaaaaagggaagcuacccccuucaggaccuguuuugccaguccucugaggaugacggcagcaaacucaagacaaagaugaaaggcgugugugaaguggggguccaagcucugaagaaaugcgauggacagcuuuccaccgcgcaugaggugguuccuuucgccguguuuaagaauagcaaaaaggucuaccuggacaagcucgaucugaaaacagaagagaaccugcuccccgacucuuucguguguuuugagcacaagggccaguauaaagggaccauggauuccggacagaccaagagagaacugaaaucuuucgacaucucucaaugccccaagauuggcgggcacggaagcaagaaauguacaggcgaugcugccuuuugcuccgccuacgaguguacggcucaguaugccaaugcguucugcucucaugcuaacggcagcgggaucguucagauucaaguguccggagucuggaagaaaccucuuugugugggcuacgaacgggucgugguuaagcgcgagcugagcgccaaaccgauccagagaguggaacccugcaccacauguauuaccaagugcgagccucacgggcucgucgugcggucuacaggauucaagaucuccagcgccguugcuugcgccucuggcgugugugucaccgggucccagagccccuccacggagaucacacugaaauauccuggcauuucucagagcuccggaggcgacaucggggugcauauggcucacgaugaccaaucugugagcuccaagauuguugcccauugucccccgcaggacccuugccuuguccacggaugcaucgugugugcgcacggccugauuaauuaccagugccauaccgcccucagcgcuuuuguggucguguucguuuuuagcuccaucgccaucauuugucuggcuauccuguauagagugcucaaaugccugaagauugcgccccgcaaaguccuuaacccucugauguggaucaccgccuucauucgguggguguacaagaaaaugguugccagaguggcugauaacaucaaucaggucaaccgcgaaauuggguggauggagggaggccaacucgugcuggggaaucccgccccuaucccccggcacgcuccgaucccuagauacagcacauaucugaugcuucuccugauuaucucuuacgccuccgccuguagcgaacugauucaggcuucuagccgcaucaccacaugcuccacggagggcguuaacaccaagugucggcucagcggaacagcgcugauuagagccggcucugugggggcugaggccugccuuaugcugaagggagucaaagaagaccagaccaaguuucucaaaaucaagacaguguccagcgagcuguccugccgcgaaggccagucuuauuggaccgggagcuucucccccaaaugucugucuagccggagaugccaucuugugggagagugucacgucaaucgcugccucuccuggcgggauaacgaaacgucugccgaguuuagcuucguuggcgaguccaccacaaugagagaaaauaaguguuuugagcaaugcgggggcuggggauguggcugcuucaacgugaaucccagcugucuguuugugcacaccuaccugcagucuguccggaaggaagcucuccgcguguucaacugcaucgacuggguucauaaacugacacuugagauuaccgauuuugacggguccgugagcacgaucgaucugggagccucuuccagcagauucacaaauuggggcucugucucccucagccuggacgcggaagggauuuccggaagcaacucuuucagcuuuaucgaguccccuggcaagggguaugcuauuguggaugagccguucucugaaaucccccggcagggcuuucugggagagaucagauguaauagcgaauccucuguucuuagcgcccacgaguccugccuccgcgccccuaaccugauuucuuacaaacccaugaucgaccagcuggaaugcaccacaaaucucauugauccuuucguggucuuugagcggggcagccugccccaaaccagaaacgagaagaccuucgcugccuccaaagggaaccgcggagugcaggcguuuagcaagggcucuguucaggcugaccuuacacugauguucgauaauuuugaaguggacuucgucggggccgccguguccugugacgcugccuuucucaaccugacgggaugcuauagcuguaaugcuggcgccagagugugccugucuaucaccuccacaggcaccgggacacuuagcgcgcauaacaaggauggaucccuccacauuguccugccuucugagaauggcaccaaagaccaaugucagauccugcauuucacgguucccgaaguggaggaggaauuuauguacagcugcgauggggacgagcggccgcuccuggugaagggaacacuuaucgccauugauccuuucgacgaucgcagagaagcuggcggggaguccaccgucgugaaccccaaaagcggaucuuggaauuucuuugacugguucuccggccugaugagcugguuuggcgggccucucaagaccauccugcugauuugucuuuacguugcccugucuaucggacucuucuuucugcucauuuaucugggccggacagggcuuagcaaaauguggcuggcugccaccaagaaggccuccuga

SEQ ID NO: 14436 - RNA, 3594 nt, Artificial Sequence
  derived and/or modified CDS sequence (opt5) from RVFV(35/74)__JF784387.1__GP
auguacgugcugcucaccauccugauuacaguccuuguuugcgaggccgugaucagagugagccuguccucuacgcgggaagagaccuguuucggcgacuauacaaaccccgaaaugauugagggggcuugggauagccuccgcgaagaggagaugccugaagaacuguccugcucuaucagcggaauuagagaagucaaaaccuccucucaggagcuuuaccgggcccugaaagcgaucaucgcugccgacggccucaauaacauuacaugucacgggaaggauccggaggacaaaaucagccuggugaagggacccccucauaaaaagcgcguuggcauugugagaugcgaacggcgcagagaugccaagcaaaucgggcgggagaccauggcuggaauugccaugacaguccugcccgcucucgccguguuugcgcuggccccuguuguguucgcugaagacccccaccuucgcaauagaccuggcaaaggccauaacuauaucgaugggaugacccaggaggacgccacguguaagccggucaccuacgcuggagccugcuccagcuuugaugugcugcucgaaaaaggcaaguucccccuguuucagucuuaugcgcaccaucggacacuucuggaggccgugcacgacaccauuaucgcuaaagccgauccucccuccugugaccuccagagcgcucacgggaauccuugcaugaaggagaagcuggucaugaaaacacauugucccaacgauuaccaaucugcccacuaucugaauaacgacggaaagauggccuccguuaaaugcccgccuaaguacgaacucaccgaggacuguaauuucugccgccagaugacgggcgcuagccugaaaaaggggucuuacccccuucaggaucuguuuugccaguccagcgaagacgauggauccaaacucaagacaaagaugaaaggcgugugugaggugggcguccaagcgcugaagaaaugcgacgggcagcuuucuaccgcccaugaagugguuccuuucgcuguguuuaagaacagcaaaaaggucuaucuggauaagcucgaccugaaaacagaggagaaucugcuccccgauuccuucguguguuuugaacacaagggacaguacaaaggcaccauggacagcgggcagaccaagagagagcugaaaucuuucgauaucucccaaugccccaagauuggaggccacgggagcaagaaauguacaggagacgccgccuuuugcucugcuuaugaauguacggcccaguacgcgaacgcuuauugcagccaugccaauggcuccggcguugugcagauccaagucucugggguguggaagaaaccucuuugugucggauacgagcgggugguugugaagcgcgaacugagcgccaaaccgauucagagagucgagcccugcaccacauguaucaccaagugcgagccucacggccucgugguucgguccacaggguucaagauuagcucugcuguggccugcgcuuccggagucugugugaccggcagccagucucccuccacggaaaucacacugaaauauccugggaucagccaguccucuggcggagauauuggcgugcauauggcccacgacgaccaaagcguuuccucuaagaucgucgcgcauugucccccgcaggauccuugccuugugcacgggugcauugugugugcccacggacugaucaacuaccagugccauaccgcucucagcgccuucgucgugguuuuuguguucuccagcgucgcuauuaucugucuggccauccuguacaaagugcucaagugccugaaaauugcgcccagaaagguucuugacccucugauguggaucaccguguuuauucgcugggucuauaaaaagaugguggcccggguugcugauaauaucaaccaggugaacagagagauuggcuggauggaagggggacaacucgcccugggcaaucccgcuccuaucccccgccacgccccgauuccucgguacucuacauaucugaugcuucuccugaucgucuccuacgccagcgcuuguucugagcugauccaggcguccagcagaauuaccacaugcucuacggagggggugaacaccaagugucgccucagcggcacagcccugauccgggcuggauccgugggcgccgaagccugccuuaugcugaaaggggucaaggaggaccagaccaaauuccucaagauuaaaacaguuagcucugaacuguccugcagagagggacagagcuauuggaccggcuccuuuucucccaagugucugagcucccgccggugccaucuugugggggaaugucacgugaauagaugccucucuuggcgcgauaacgagacgagcgcugaguucuccuuugucggagaaucuaccacaaugcgggagaauaaguguuucgaacaaugcggcggguggggcuguggaugcuuuaacgugaaucccagcugucuguucguucacaccuaccugcaguccgugagaaaagaggcccuccgggucuuuaacugcaucgacugggugcauaagcugacacuugaaauuaccgauuucgacggcagcguuucuacgaucgaucugggggcguccagcucucgcuuuacaaauuggggauccgugagccucucucuggacgcugagggcaucuccgggagcaacuccuucagcuucauugagucuccuggaaaaggcuaugccaucgucgaugaaccguuuagcgagauucccagacagggguuccugggcgaaauccgguguaauuccgagucuagcgugcuuuccgcccacgaaucuugccucagagcuccuaaccugauuagcuacaagcccaugaucgaccagcuggagugcaccacaaaucucaucgauccuuuuguuguguucgagcgcggaucccugccccaaacccggaacgacaaaaccuuugccgcgucuaagggcaauagagggguccaggcuuucagcaagggauccgugcaggccgaccuuacacugauguuugauaacuucgaaguggacuuugucggcgccgcuguuagcugugaugccgcuuuccucaaccugacggggugcuacucuuguaaugccggagcgcgcgugugccuguccauuaccagcacaggcaccggcacacuuucugcccauaacaaagacgggucccuccacaucgugcugccuagcgagaauggaaccaaggaucaaugucagauucugcauuuuacgguccccgaaguggaggaggaguucauguauuccugcgacggcgaugagagaccgcuccugguuaaagggacacuuaucgcuauugacccuuuugaugaccggcgcgaagccggaggcgagucuaccguggucaaccccaagagcggguccuggaauuucuucgauugguuuagcggacugaugucuugguucggcggcccucucaaaaccauccugcugaucugucuuuacguggcucuguccauugggcucuuuuuccugcucaucuaucugggaagaacaggccuuagcaagauguggcuggccgccaccaagaaggcuucuuga

SEQ ID NO: 14437 - RNA, 3594 nt, Artificial Sequence
  derived and/or modified CDS sequence (opt5) from RVFV(KEN/Kil-006/07)__HM586966.1__GP
auguacgugcugcucaccauccugauuagcguccuuguuugcgaggccgugaucagagugucccugucuagcacacgggaagagacguguuucggcgacuccaccaaccccgaaaugauugagggggcuugggauucucuccgcgaagaggagaugccugaagaacugagcugcuccgucucuggaaucagagaagugaagacaagcucccaggagcuuuaucgggcccugaaagcgauuaucgcugccgacggccucaauaacaucaccugucacgggaagaauccggaggauaaaauuagccugaucaagggacccccucauaaaaagcgcguuggcguggucagaugcgaacggcgcagagacgccaagcaaauugggcgggagacaauggcuggaaucgccaugaccgugcugcccgcucucgccguuuuugcgcuggccccuguggucuucgcugaagauccccaccuucgcaacagaccuggcaaaggccauaauuacauugacgggaugacacaggaggaugccaccuguaagccggugacguaugcuggagccugcagcuccuuugacgugcugcucgaaaaaggcaaguucccccuguuucagagcuacgcgcaccaucggacccuucuggaggccguccacgauacaaucauugcuaaagccgacccucccucuugugaucuccaguccgcugacgggaacaagugcaugaaggagaaacugguuaugaagacccacuguccuaaugauuaucaaagcgcccauuaccugaacaaugacggaaaaauggccucugugaagugucccccgaaauaugaacucacagaggacugcaacuucugccgccagaugaccggcgcuucccugaagaaagggagcuacccucuucaggaucuguuuugccaguccucugaagacgauggaagcaagcucaagacgaaaaugaagggcgugugugaggucggcgugcaagcgcugaaaaagugcgacgggcagcuuuccacagcccacgaaguugugcccuucgcugucuuuaaaaauagcaagaagguguaccuggauaaacucgaccugaagaccgaggagaaccugcucccugauucuuucguuuguuuugaacauaaaggacaguauaagggcacaauggacuccgggcagaccaaaagagagcugaagucuuucgauaucucucaaugccccaagaucggaggccacgggagcaaaaaguguaccggagacgccgccuuuugcuccgcuuacgaauguacagcccaguaugcgaaugcuuacugcucucacgccaacggcagcggcauugugcagauccaagucuccgggguguggaaaaagccccuuugugucggauaugagcgggugguugugaaacgcgaacugagcgccaagccuauucagagagucgagccgugcacgaccuguaucacaaagugcgagccccauggccucgugguucggucuaccggguucaaaauuuccagcgcuguggccugcgcuucuggagucugugugacaggcucccagagcccuuccaccgaaaucacgcugaaguaccccgggaucucucagagcuccggcggagauauuggcgugcacauggcccaugacgaccaaucuguuagcuccaaaaucgucgcgcacugcccuccccaggauccgugucuugugcaugggugcauugugugugcccacggacugaucaauuaucagugccacacagcucucagcgccuucgucgugauuuuuguuuucucuuccaccgcuaucaucugucuggccgugcuguacagaguccucaagugccugaaaauugcgccucgcaaggugcuuaacccccugauguggaucaccgccuuuauucgguggguuuacaaaaagaugguggcuagagucgccgacaacaucaaucaggugaaccgcgagauuggcuggauggaagggggacaacucgcucugggcaauccugcccccaucccucggcaugcccccauuccgagauauagcacauaccugaugcuucuccugaucguuucuuaugcuuccgcguguagcgagcugauccaggccucuagccgcauuaccacaugcuccacggagggggugaacaccaagugucggcucagcggcacagcucugaucagagccggaucugucggcgccgaggcuugccuuaugcugaaaggggugaaggaggaucagaccaaauuccucaagauuaaaacaguguccagcgaacuguccugccgcgagggacagucuuacuggaccggcagcuuuuccccuaagugucugucuagccggagaugccaccuugucggggaaugucauguuaaucgcugccucuccuggcgggacaacgagacgucugccgaguucagcuuugugggagaauccaccacaaugagagagaauaaguguuucgaacaaugcggcggguggggcuguggaugcuuuaacgugaaucccagcugucuguucguccacaccuaucugcagucugugcggaaagaggcgcuccgcguuuuuaacugcaucgauugggugcacaagcugacacuugaaauuaccgacuucgauggcuccgucagcacgaucgaccugggggcuucuuccagcagauuuacaaauuggggaucugugucccucagccuggaugccgagggcaucuccgggagcaacucuuucagcuucauugagucccccggaaaaggcuacgccaucguugacgaaccuuuuucugagauuccgcggcagggguuccugggcgaaaucagauguaauagcgaguccucugugcuuagcgcucaugaauccugccuccgcgcccccaaccuggucucuuauaagccuaugauugaucagcuggagugcaccacaaaucucaucgaccccuuugugguuuucgagcggggaagccugccucaaaccagaaacgauaaaaccuuugcggcuuccaagggcaaccgcggggugcaggccuucagcaagggaucuguccaggccgaccuuacacugauguuugacaauuucgaaguggauuuugugggcgcugccgucuccugugacgcugccuuccucaaccugacggggugcuacagcuguaaugcgggagccagaguuugccugucuaucaccuccacaggcaccggcacacuuagcgcucacaacaaagaugggucccuccauauugugcugcccucugagaauggaaccaaggaccaaugucagauccugcacuuuacggugccugaagucgaggaggaguucauguacagcugcgauggcgacgaacggccccuccuggugaaagggacacuuauugccaucgauccguuugacgaucgcagagaagcuggaggcgaguccaccguugugaacccuaagagcgggucuuggaauuucuucgacugguuuuccggacugaugagcugguucggcggcccccucaaaaccauucugcugaucugucuuuaugucgcccugucuaucgggcucuuuuuccugcucauuuaccugggacggacaggccuuagcaagauguggcuggccgcuaccaagaaagcguccuga

SEQ ID NO: 14438 - RNA, 3594 nt, Artificial Sequence
  derived and/or modified CDS sequence (opt5) from RVFV(MgH824)__DQ380210.1__GP
auguacgugcugcucaccauccugauuagcguccuuguuugcgaggccgugaucagagugucccugucuagcacacgggaagagacguguuucggcgacuccaccaaccccgaaaugauugagggggcuugggauucucuccgcgaagaggagaugccugaagaacugagcugcuccaucucuggaauuagagaagucaagacaagcucccaggagcuuuaucgggcccugaaagcgaucaucgcugccgacggccucaauaacauuaccugucacgggaaggauccggaggacaaaaucagccugauuaagggacccccucauaaaaagcgcgugggcaucguuagaugcgaacggcgcagagaugccaagcaaauugggcgggagacaauggcuggaaucgccaugaccgugcugcccgcucucgccgucuuugcgcuggccccugugguuuucgcugaagacccccaccuucgcaauagaccuggcaaaggcuacaacuauauugaugggaugacacaggaggacgccaccuguaagccggugacguacgcuggagccugcagcuccuuugauguccugcucgaaaaaggcaaguucccccuguuucagagcuaugcgcaucaccggacccuucuggaggccgugcaugacacaaucaucgcuaaagccgauccucccucuugugaccuccaguccgcucacgggaauccuugcaugaaggagaagcuggugaugaaaacccacugucccaacgauuaccaaagcgcccauuaucugaauaacgacggaaagauggccucugucaaaugcccgccuaaguacgaacucacagaggacuguaauuucugccgccagaugaccggcgcuucccugaaaaaggggagcuacccccuucaggaucuguuuugccaguccucugaagacgauggaagcaaacucaagacgaagaugaaaggcguuugugaggugggcgugcaagcgcugaagaaaugcgacgggcagcuuuccacagcccacgaagucgugccuuucgcuguuuuuaagaacagcaaaaagguguaucuggauaagcucgaccugaaaaccgaggagaaucugcuccccgauucuuucgucuguuuugaaagaaagggacaguacaaaggcacaauggacuccgggcagaccaagcgggagcugaaaucuuucgauauuucucaaugccccaagaucggaggccaugggagcaagaaauguaccggagacgccgccuuuugcuccgcuuaugaauguacaacgcaguacgccaacgcguauugcucucacgcuaauggcagcggcgugguucagauucaaguguccggggucuggaagaaaccucuuugugugggauacgagcgcgucgugguuaagagagaacugagcgccaaaccgauccagcggguggagcccugcaccacauguauuaccaagugcgagccucacggccucgucgugagaucuacaggguucaagaucuccagcgccguugcuugcgccucuggagugugugucaccggcucccagagccccuccacggaaaucacacugaaauauccugggauuucucagagcuccggcggagauaucggcgugcauauggcucacgacgaccaaucugugagcuccaagauuguugcccauugucccccgcaggauccuugccuuguccacgggugcaucgugugugcgcauggacugauuaacuaccagugccacaccgcccucagcgcuuucguggucguguuuguuuucucuuccaucgccaucauuugucuggcuauccuguaccgcgugcucaaaugccugaagauugcgccccggaaaguccuuaauccucugauguggaucaccgccuuuauuagauggaucuauaagaaaaugguggcccgcguugcugacaacauuaaccaggugaaucgggagaucggcuggauggaagggggacaacucguccugggcaaccccgccccuauccccagacacgcuccgauuccucgcuacagcacauaucugaugcuucuccugaucgugucuuacgccuccgccuguagcgagcugauucaggcuucuagccggaucaccacaugcuccacggaggggguugauaccaaguguagacucagcggcacagcgcugauucgcgccggaucugugggcgcugaagccugccuuaugcugaagggggucaaagaggaccagaccaaguuccucaaaaucaagacaguguccagcgaacuguccugccgggagggacagucuuauuggaccggcagcuuuucccccaaaugucugucuagcagacgcugccaucuugugggggaaugucacgucaaucggugccucuccuggagagauaacgagacgucugccgaguucagcuuuguuggagaauccaccacaaugcgggagaauaaguguuucgaacaaugcggcggguggggcuguggaugcuuuaacgugaaucccagcugucuguucgugcauaccuaccugcagucuguccgcaaggaggcucucagaguguuuaacugcaucgacuggguucacaaacugacacuugaaauuaccgauuucgacggcuccgugagcacgaucgaucugggggccucuuccagccgguuuacaaauuggggaucugucucccucagccuggacgcggagggcauuuccgggagcaacucuuucagcuucaucgaguccccuggaaagggcuaugcuauuguggaugaaccguuucccgagaucccuagacagggguuccugggcgaaauccgcuguaauucugagagcuccguucuuucugcccacgaaagcugccuccgggcccccaaccugauuuccuacaaaccuaugaucgaccagcuggagugcaccacaaaucucauugaucccuuuguggucuucgagagaggaucucugccucaaacccgcaacgacaagaccuuugcugccagcaaaggcaauagaggggugcaggcguucuccaagggaagcguucaggcugaccuuacacugauguuugauaacuucgaaguggacuuugucggcgccgccgugucuugugaugcugccuuccucaaccugacggggugcuacuccuguaaugcuggagcccgggugugccugagcaucaccucuacaggcaccggcucccuuagcgcgcauaacaaggacgggucccuccacauuguccugcccucugagaauggaacaaaagaucaaugucagauccugcauuuuaccguuccggaaguggaggaggaguucauguauagcugcgacggcgaugagcgcccucuccuggugaaggggacgcuuaucgccauugaccccuuugaugacagacgggaagcuggaggcgaguccacagucgugaacccuaaaagcgggucuuggaauuucuucgauugguuuuccggacugaugagcugguucggcggcccccucaagaccauccugcugauuugucuuuacguugcccugucuaucgggcucuuuuuccugcucauuuaucugggacgcaccggccuuagcaaaauguggcuggcugccacaaagaaggccuccuga

SEQ ID NO: 14439 - RNA, 3594 nt, Artificial Sequence
  derived and/or modified CDS sequence (opt5) from RVFV(Kenya 57 (Rintoul))__DQ380192.1__GP
auguacgcccugcucaccauccugauuagcgugcuugucugcgaggcuguuaucagagugucccugucuagcacacgggaagagacguguuucggcgacuccaccaaccccgaaaugauugagggggccugggauucucuccgcgaagaggagaugccugaagaacugagcugcuccaucucuggaauuagagaagugaagacaagcucccaggagcuucaccgggcgcugaaagcuaucaucgccgccgacggccucaauaacauuaccugucaugggaaggauccggaggacaaaaucagccugauuaagggacccccucacaaaaagcgcgucggcgugguuagaugcgaacggcgcagagaugcuaagcaaaucgggcgggagacaauggccggaauugcuaugaccgugcugcccgcccucgcggucuuugcccuggcuccugugguuuucgccgaagacccccaucuucgcaauagaccuggcaaaggccacaacuauaucgaugggaugacacaggaggacgcuaccuguaagccggugacguacgccggagcgugcagcuccuuugauguccugcucgaaaaaggcaaguucccccuguuucagagcuaugcccaucaccggacccuucuggaggcugugcacgacacaauuaucgccaaagcugauccucccucuugugaccuccaguccgcccaugggaauccuugcaugaaggagaagcuggugaugaaaacccacugucccaacgauuaccaaagcgcccauuaucugaauaacgacggaaagauggcuucugucaaaugcccgccuaaguacgaacucacagaggacuguaauuucugccgccagaugaccggcgcgucccugaaaaaggggagcuauccccuucaggaucuguuuugccaguccucugaagacgauggaagcaaacucaagacgaagaugaaaggcguuugugaggugggcgugcaagcccugaagaaaugcgacgggcagcuuuccacagcucacgaagucgugccuuucgccguuuuuaagaacagcaaaaagguguaccuggauaagcucgaccugaaaaccgaggagaaucugcuccccgauucuuucgucuguuuugaacacaagggacaguacaaaggcacaauggacuccgggcagaucaagagagagcugaaaucuuucgauauuucucaaugccccaagaucggaggccaugggagcaagaaauguaccggagacgccgcuuuuugcuccgccuaugaauguaccgcgcaguacgcuaacgccuauugcucucacgccaauggcagcggcauugugcagauccaaguuuccgggguguggaagaaaccucuuugugucggauacgagcggguggucgugaagcgcgaacugagcgcuaaaccgauucagagaguugagcccugcacaacguguaucaccaagugcgagccucauggccucgugguccggucuacaggguucaagaucuccagcgccguggcuugcgccucuggaguuugugugaccggcucccagagccccuccacagaaauuacccugaaauauccugggaucucucagagcuccggcggagauauuggcguccacauggcgcaugacgaccaaucugugagcuccaagaucguggcccacugucccccgcaggauccuugccuuguucacgggugcauugucugugcucauggacugaucaacuaccagugccacacggcccucagcgcuuucgugguggucuuuguguucucuuccguugccaucauuugucuggcgauccuguauaaagugcucaagugccugaaaauugcccccagaaagguccuuaauccucugauguggaucacagcuuuuauucgcuggguguacaaaaagaugguugcccggguggcugacaacaucaaccaggucaauagagagauuggcuggauggaagggggacaacucgugcugggcaaccccgccccuaucccccgccaugccccgaucccucgguacagcaccuaucugaugcuucuccugauuguuucuuacgcuuccgcguguagcgagcugauccaggccucuagcagaauuaccacaugcuccaccgagggggugaauacaaagugucgccucagcggcacggcucugauccgggccggaucugucggcgccgaggcuugccuuaugcugaaaggggugaaggaggaucagaccaaauuccucaagauuaaaacaguguccagcgaacuguccugcagagagggacagucuuauuggaccggcagcuuuucccccaagugucugucuagccgccggugccaccuugucggggaaugucacguuaacagaugccucuccuggcgcgacaaugagacaucugccgaguucagcuuugugggagaauccaccacgaugcgggagaacaaguguuucgaacaaugcggcggguggggcuguggaugcuuuaaugugaaccccagcugucuguucguccauaccuaccugcagucugugagaaaagaggcgcuccggguuuuuaauugcaucgauugggugcacaagcugacacuugaaaucaccgacuucgauggcuccgucagcacaguggaccugggggcuucuuccagccgcuuuaccaacuggggaucuguuucccucagccuggaugccgagggcauuuccgggagcaauucuuucagcuucaucgaguccccuggaaaaggcuaugccauuguggacgaaccguuuucugagaucagcagacagggguuccugggcgaaauucgguguaacuccgagucuagcguccuuuccgcucaugaaucuugccucagagcccccaaucugaucagcuacaagccuaugaucgaucagcuggagugcacgacaaaccucauugaccccuuugugguuuucgagcgcggaucccugccucaaacccggaaugauaaaacauuugcggcuagcaagggcaacagaggggugcaggccuucucuaagggauccguccaggccgaccuuacccugauguuugacaacuucgaaguggauuuugugggcgcugccgucagcugugacgcugccuuccucaaucugaccgggugcuauucuuguaacgcgggagcccgcguuugccuguccaucacaagcacgggcaccggcacacuuuccgcucacaauaaagaugggucucuccauauugugcugcccagcgagaacggaaccaaggaccaaugucagauccugcacuuuacagugccugaagucgaggaggaguucauguacuccugcgauggcgacgaaagaccccuccuggugaaagggacccuuauugccaucgauccguuugacgaucggcgcgaagcuggaggcgagagcacgguugugaauccuaagucuggguccuggaacuucuucgacugguuuagcggacugaugucuugguucggcggcccccucaaaacaauccugcugauuugucuuuacgucgcccugagcaucgggcucuuuuuccugcucauuuaucugggaagaaccggccuuuccaagauguggcuggccgcuaccaagaaagcgucuuga

SEQ ID NO: 14440 - RNA, 3594 nt, Artificial Sequence
  derived and/or modified CDS sequence (opt5) from RVFV(SA-75)__DQ380189.1__GP
auguacgugcugcucaccauccugauuacaguccuuguuugcgaggccgugaucagagugagccuguccucuacgcgggaagagaccuguuucggcgacuauacaaaccccgaaaugauugagggggcuugggauagccuccgcgaagaggagaugccugaagaacuguccugcucuaucagcggaauuagagaagucaaaaccuccucucaggagcuuuaccgggcccugaaagcgaucaucgcugccgacggccucaauaacauuacaugucacgggaaggauccggaggacaaaaucagccuggugaagggacccccucauaaaaagcgcguuggcauugugagaugcgaacggcgcagagaugccaagcaaaucgggcgggagaccauggcucgcauugccaugacaguccugcccgcucucgccguguuugcgcuggccccuguuguguucgcugaagacccccaccuuagaaaucggccuggaaaaggccauaacuauaucgauggcaugacccaggaggacgccacguguaagccggucaccuacgcuggggccugcuccagcuuugaugugcugcucgaaaaaggaaaguucccccuguuucagucuuaugcgcaccaucgcacacuucuggaggccgugcacgacaccauuaucgcuaaagccgauccucccuccugugaccuccagagcgcucacggcaauccuugcaugaaggagaagcuggucaugaaaacacauugucccaacgauuaccaaucugcccacuaucugaauaacgacgggaagauggccuccguuaaaugcccgccuaaguacgaacucaccgaggacuguaauuucugcagacagaugacgggagcuagccugaaaaagggcucuuacccccuucaggaucuguuuugccaguccagcgaagacgauggguccaaacucaagacaaagaugaaaggagugugugaggugggcguccaagcgcugaagaaaugcgacggccagcuuucuaccgcccaugaagugguuccuuucgcuguguuuaagaacagcaaaaaggucuaucuggauaagcucgaccugaaaacagaggagaaucugcuccccgauuccuucguguguuuugaacacaaggggcaguacaaaggaaccauggacagcggccagaccaagcgggagcugaaaucuuucgauaucucccaaugccccaagauugggggacacggcagcaagaaauguacaggggacgccgccuuuugcucugcuuaugaauguacggcccaguacgcgaacgcuuauugcagccaugccaauggauccggcguugugcagauccaagucucuggcguguggaagaaaccucuuugugucggguacgagcgcgugguugugaagagagaacugagcgccaaaccgauucagcgggucgagcccugcaccacauguaucaccaagugcgagccucacggacucgugguuagauccacaggcuucaagauuagcucugcuguggccugcgcuuccggggucugugugaccggaagccagucucccuccacggaaaucacacugaaauauccuggcaucagccaguccucugggggcgauauuggagugcauauggcccacgacgaccaaagcguuuccucuaagaucgucgcgcauugucccccgcaggauccuugccuugugcacggcugcauugugugugcccacgggcugaucaacuaccagugccauaccgcucucagcgccuucgucgugguuuuuguguucuccagcgucgcuauuaucugucuggccauccuguacaaagugcucaagugccugaaaauugcgccccgcaagguucuuaauccucugauguggaucaccguguuuauucggugggucuauaaaaagaugguggccagaguugcugacaacaucaaccaggugaaucgcgagauuggauggauggaaggcgggcaacucgcccugggaaaccccgcuccuaucccccggcacgccccgauuccuagauacucuacauaucugaugcuucuccugaucgucuccuacgccagcgcuuguucugagcugauccaggcguccagccgcauuaccacaugcucuacggagggcgugaauaccaagugucggcucagcgggacagcccugaucagagcuggcuccgugggagccgaagccugccuuaugcugaaaggcgucaaggaggaucagaccaaauuccucaagauuaaaacaguuagcucugaacuguccugccgcgaggggcagagcuauuggaccggauccuuuucucccaagugucugagcucccggagaugccaucuugugggcgaaugucacgugaaccgcugccucucuuggcgggacaaugagacgagcgcugaguucuccuuugucggggaaucuaccacaaugagagagaacaaguguuucgaacaaugcggaggcuggggguguggcugcuuuaaugugaaccccagcugucuguucguucacaccuaccugcaguccgugcggaaagaggcccuccgcgucuuuaauugcaucgauugggugcauaagcugacacuugaaauuaccgacuucgauggaagcguuucuacgaucgaccugggcgcguccagcucuagauuuacaaacuggggguccgugagccucucucuggaugcugagggaaucuccggcagcaauuccuucagcuucauugagucuccugggaaaggauaugccaucgucgacgaaccguuuagcgagauuccccggcagggcuuccugggggaaaucagauguaacuccgagucuagcgugcuuuccgcccacgaaucuugccuccgcgcuccuaaucugauuagcuacaagcccaugaucgaucagcuggagugcaccacaaaccucaucgacccuuuuguuguguucgagcggggcucccugccccaaaccagaaaugauaaaaccuuugccgcgucuaagggaaaccgcggcguccaggcuuucagcaagggguccgugcaggccgaccuuacacugauguuugacaacuucgaaguggauuuugucggagccgcuguuagcugugacgccgcuuuccucaaucugacgggcugcuacucuuguaacgccggggcgagagugugccuguccauuaccagcacaggaaccggcacacuuucugcccauaauaaagauggcucccuccacaucgugcugccuagcgagaacgggaccaaggaccaaugucagauucugcauuuuacgguccccgaaguggaggaggaguucauguauuccugcgauggagacgagcggccgcuccugguuaaaggcacacuuaucgcuauugauccuuuugacgaucgcagagaagccgggggagagucuaccguggucaaucccaagagcggcuccuggaacuucuucgacugguuuagcgggcugaugucuugguucggaggcccucucaaaaccauccugcugaucugucuuuacguggcucuguccauuggccucuuuuuccugcucaucuaucuggggcggacaggacuuagcaagauguggcuggccgccaccaagaaggcuucuuga

SEQ ID NO: 14441 - RNA, 3594 nt, Artificial Sequence
  derived and/or modified CDS sequence (opt5) from RVFV(SA01-1322)__KX096942.1__GP
auguacgugcugcucaccauccugauuagcguccuuguuugcgaggccgugaucagagugucccugucuagcacacgggaagagacguguuucggcgacuccaccaaccccgaaaugauugagggggcuugggauucucuccgcgaagaggagaugccugaggaacugagcugcuccgucucuggaaucagagaagugaagacaagcucccaggagcuuuaucgggcccugaaagcgauuaucgcugccgacggccucaauaacaucaccugucacgggaagaauccggaggauaaaauuagccugaucaagggacccccucauaaaaagcgcguuggcauugugagaugcgggcggcgcagagacacaaagcaaaucggacgggaaaccauggccggcauugcuaugacaguccugcccgcccucgcuguguuugcccuggcgccuguuguguucgccgaggauccccaccuucgcaacagaccuggcaaagggcauaauuacaucgacggaaugacccaggaagaugcuacguguaagccggucaccuaugccggcgcuuguucuuccuuugacgugcugcucgagaaagggaaguucccccuguuucagagcuacgcccaccaucggacacuucuggaagcggugcacgauaccauuaucgccaaagcugacccucccucuugcgaucuccaguccgcccacggaaacccuugcaugaaggagaagcuggucaugaaaacacauugucccaaugacuaucaaagcgcucacuaccugaacaaugauggcaagauggccucuguuaaaugcccgccuaaguaugagcucaccgaagacuguaacuucugccgccagaugacgggggccucccugaaaaagggaagcuacccccuucaggaccuguuuugccaguccucugaggaugacggcagcaaacucaagacaaagaugaaaggcgugugugaaguggggguccaagcucugaagaaaugcgauggacagcuuuccaccgcgcaugaggugguuccuuucgccguguuuaagaauagcaaaaaggucuaccuggacaagcucgaucugaaaacagaagagaaccugcuccccgacucuuucguguguuuugagcacaagggccaguauaaagggaccauggauuccggacagaccaagagagaacugaaaucuuucgacaucucucaaugccccaagauuggcgggcacggaagcaagaaauguacaggcgaugcugccuuuugcuccgccuacgaguguacggcucaguaugccaaugcguucugcucucaugcuaacggcagcgggaucguucagauucaaguguccggagucuggaagaaaccucuuugugugggcuacgaacgggucgugguuaagcgcgagcugagcgccaaaccgauccagagaguggaacccugcaccacauguauuaccaagugcgagccucacgggcucgucgugcggucuacaggauucaagaucuccagcgccguugcuugcgccucuggcgugugugucaccgggucccagagccccuccacggagaucacacugaaauauccuggcauuucucagagcuccggaggcgacaucggggugcauauggcucacgaugaccaaucugugagcuccaagauuguugcccauugucccccgcaggacccuugccuuguccacggaugcaucgugugugcgcacggccugauuaauuaccagugccauaccgcccucagcgcuuuuguggucguguucguuuuuagcuccaucgccaucauuugucuggcuauccuguauagagugcucaaaugccugaagauugcgccccgcaaaguccuuaacccucugauguggaucaccgccuucauucgguggguguacaagaaaaugguugccagaguggcugauaacaucaaucaggucaaccgcgaaauuggguggauggagggaggccaacucgugcugggggaccccgccccuaucccccggcacgcuccgaucccuagauacagcacauaucugaugcuucuccugauuaucucuuacgccuccgccuguagcgaacugauucaggcuucuagccgcaucaccacaugcuccacggagggcguuaauaccaagugucggcucagcggaacagcgcugauuagagccggcucugugggggcugaggccugccuuaugcugaagggagucaaagaagaucagaccaaguuucucaaaaucaagacaguguccagcgagcuguccugccgcgaaggccagucuuauuggaccgggagcuucucccccaaaugucugucuagccggagaugccaucuugugggagagugucacgucaaccgcugccucuccuggcgggacaaugaaacgucugccgaguuuagcuucguuggcgaguccaccacaaugagagaaaacaaguguuuugagcaaugcgggggcuggggauguggcugcuucaaugugaaccccagcugucuguuugugcacaccuaccugcagucuguccggaaggaagcucuccgcguguucaauugcaucgauuggguucauaaacugacacuugagauuaccgacuuugauggguccgugagcacgaucgaccugggagccucuuccagcagauucacaaacuggggcucugucucccucagccuggaugcggaagggauuuccggaagcaauucuuucagcuuuaucgaguccccuggcaagggguaugcuauuguggacgagccguucucugaaaucccccggcagggcuuucugggagagaucagauguaacagcgaauccucuguucuuagcgcccacgaguccugccuccgcgccccuaaucugauuucuuacaaacccaugaucgaucagcuggaaugcaccacaaaccucauugacccuuucguggucuuugagcggggcagccugccccaaaccagaaaugagaagaccuucgcugccuccaaagggaaccgcggagugcaggcguuuagcaagggcucuguucaggcugaucuuacacugauguucgacaacuuugaaguggacuucgucggggccgccguguccugugaugcugccuuucucaaucugacgggaugcuauagcuguaacgcuggcgccagagugugccugucuaucaccuccacaggcaccgggacacuuagcgcgcauaauaaggacggaucccuccacauuguccugccuucugagaacggcaccaaagaucaaugucagauccugcauuucacgguucccgaaguggaggaggaauuuauguacagcugcgacggggaugagcggccgcuccuggugaagggaacacuuaucgccauugacccuuucgaugaccgcagagaagcuggcggggaguccaccgucgugaaucccaaaagcggaucuuggaacuucuuugauugguucuccggccugaugagcugguuuggcgggccucucaagaccauccugcugauuugucuuuacguugcccugucuaucggacucuucuuucugcucauuuaucugggccggacagggcuuagcaaaauguggcuggcugccaccaagaaggccuccuga

SEQ ID NO: 14442 - RNA, 3594 nt, Artificial Sequence
  derived and/or modified CDS sequence (opt5) from RVFV(KEN/Mal-032/07)__HM586967.1__GP
auguacgugcugcucaccauccugauuagcguccuuguuugcgaggccgugaucagagugucccugucuagcacacgggaagagacguguuucggcgacuccaccaaccccgaaaugauugagggggcuugggauucucuccgcgaagaggagaugccugaagaacugagcugcuccgucucuggaaucagagaagugaagacaagcucccaggagcuuuaucgggcccugaaagcgauuaucgcugccgacggccucaauaacaucaccugucacgggaagaauccggaggauaaaauuagccugaucaagggacccccucauaaaaagcgcguuggcauugugagaugcgaacggcgcagagacgccaagcaaaucgggcgggagacaauggcuggaauugccaugaccguccugcccgcucucgccguguuugcgcuggccccuguuguguucgcugaagauccccaccuucgcaacagaccuggcaaaggccauaauuacaucgacgggcggcugcaggaggaugccacauguaagccggucaccuaugcuggagccuguucuuccuuugacgugcuccuggaaaaaggcaaguucccccuuuuucagagcuacgcgcaccaucgcacgcugcucgaggccgugcacgauaccauuaucgcuaaagccgacccucccucuugcgaucugcaguccgcugacgggaacaagugcaugaaggagaaacuggucaugaagacacacuguccuaaugauuaucaaagcgcccauuaccucaacaaugacggaaaaauggccucuguuaagugucccccgaaauaugaacugaccgaggacugcaacuucugcagacagaugacaggcgcuucccuuaagaaagggagcuacccucugcaggaucucuuuugccaguccucugaagacgauggaagcaagcugaagaccaaaaugaagggcgugugugaggugggcguccaagcgcuuaaaaagugcgacgggcagcuguccacggcccacgaagugguucccuucgcuguguuuaaaaauagcaagaaggucuaccucgauaaacuggaccugaagacagaggagaaccuccugccugauucuuucguguguuuugaacauaaaggacaguauaagggcaccauggacuccgggcagacaaaacgggagcuuaagagcuucgauaucucucaaugccccaagauuggaggccacgggagcaaaaaguguaccggagacgccgccuuuugcuccgcuuacgaauguaccgcccaguaugcgaaugcuuacugcucucacgccaacggcagcggcaucguucagauucaaguguccggggucuggaaaaagccccugugugugggauaugagcgcgucgugguuaaaagagaacucagcgccaagccuauccagcggguggagccgugcacaacguguauuaccaagugcgagccccauggccuggucgugagaucuacaggguucaaaaucuccagcgcuguugccugcgcuucuggagugugugucaccggcucccagagcccuuccacagaaaucacccuuaaguaccccgggauuucucagagcuccggcggagauaucggcgugcacauggcccaugacgaccaaucugugagcuccaaaauuguugcgcacugcccuccccaggauccgugucugguccaugggugcaucgugugugcccacggacucauuaauuaucagugccacacggcucugagcgccuucguggucaucuuuguguucucuuccacagcuaucauuugucuggccguucucuaccgcgugcugaagugccuuaaaaucgcgccucggaagguccugaacccccucauguggauuaccgccuuuaucagauggguguacaaaaagaugguugcucgcguggccgacaacauuaaucaggucaaccgggagaucggcuggauggaagggggacaacuggcucugggcaauccugcccccauuccuagacaugcccccaucccgcgcuauagcaccuaccuuaugcuccugcugaucgugucuuaugcuuccgcguguagcgagcucauucaggccucuagccggaucacaaccugcuccacagaggggguuaacacgaaguguagacugagcggcaccgcucuuauucgcgccggaucugugggcgccgaggcuugccugaugcucaaaggggucaaggaggaucagacaaaauuccugaagaucaaaaccguguccagcgaacuguccugccgggagggacagucuuacuggacaggcagcuuuuccccuaagugucuuucuagcagacgcugccaccucgugggggaaugucaugucaaucggugccuguccuggagagacaacgagaccucugccgaguucagcuuuguuggagaauccacgaccaugcgggagaauaaguguuucgaacaaugcggcggguggggcuguggaugcuuuaacgugaaucccagcugucuguucgugcacacauaucuccagucuguccgcaaagaggcgcugagaguguuuaacugcauugauuggguucacaaacuuacccuggaaaucacagacuucgauggcuccgugagcaccaucgaccucggggcuucuuccagccgguuuacgaauuggggaucugucucccugagccuggaugccgagggcauuuccgggagcaacucuuucagcuucaucgagucccccggaaagggcuacgccauuguggacgaaccuuuuucugagaucccgagacagggguuccuuggcgaaauucgcuguaauagcgaguccucuguucucagcgcucaugaauccugccugcgggcccccaaccuggugucuuauaagccuaugaucgaucagcucgagugcacaaccaaucugaucgaccccuuugucguguucgagagaggaagccuuccucaaacacgcaacgauaaaaccuuugcggcuuccaagggcaacagagggguucaggccuucagcaagggaucugugcaggccgaccugacccucauguuugacaauuucgaagucgauuuugugggcgcugccguguccugugacgcugccuuccugaaccugacagggugcuacagcuguaaugcgggagcccgggucugccuuucuauuacguccaccggcacaggcacccucagcgcucacaacaaagaugggucccugcauaucguucugcccucugagaauggaacaaaggaccaaugucagauucuccacuuuaccgugccugaaguggaggaggaguucauguacagcugcgauggcgacgaacgcccccugcuugucaaagggacgcugaucgccauugauccguuugacgauagacgggaagcuggaggcgaguccacagugguuaacccuaagagcgggucuuggaauuucuucgacugguuuuccggacucaugagcugguucggcggcccccugaaaaccauccugcuuaucugucuguauguggcccucucuauugggcuguuuuuccuccugaucuaccuuggacgcaccggccugagcaagauguggcucgccgcuacaaagaaagcguccuga

SEQ ID NO: 14443 - RNA, 3594 nt, Artificial Sequence
  derived and/or modified CDS sequence (opt5) from RVFV(KEN/Gar-008/06)__HM586965.1__GP
auguacgugcugcucaccauccugauuagcguccuuguuugcgaggccgugaucagagugucccugucuagcacacgggaagagacguguuucggcgacuccaccaaucccgaaaugauugagggggcuugggauucucuccgcgaagaggagaugccugaagaacugagcugcuccgucucuggaaucagagaagugaagacaagcucccaggagcuuuaucgggcccugaaagcgauuaucgcugccgacggccucaauaacaucaccugucacgggaagaauccggaggauaaaauuagccugaucaagggacccccucauaaaaagcgcguuggcauugugagaugcgaacggcgcagagacgccaagcaaaucgggcgggagacaauggcuggaauugccaugaccguccugcccgcucucgccguguuugcgcuggccccuguuguguucgcugaagauccccaccuucgcaacagaccuggcaaaggccauaauuacaucgacgggaugacacaggaggaugccaccuguaagccggucacguaugcuggagccugcagcuccuuugacgugcugcucgaaaaaggcaaguucccccuguuucagagcuacgcgcaccaucggacccuucuggaggccgugcacgauacaauuaucgcuaaagccgacccucccucuugugaucuccaguccgcucacgggaacccuugcaugaaggagaagcuggucaugaaaacccauugucccaaugacuaucaaagcgcccacuaccugaacaaugauggaaagauggccucuguuaaaugcccgccuaaguaugaacucacagaggacuguaacuucugccgccagaugaccggcgcuucccugaaaaaggggagcuacccccuucaggaccuguuuugccaguccucugaagaugacggaagcaaacucaagacgaagaugaaaggcgugugugaggugggcguccaagcgcugaagaaaugcgaugggcagcuuuccacagcccaugaagugguuccuuucgcuguguuuaagaauagcaaaaaggucuaccuggacaagcucgaucugaaaaccgaggagaaccugcuccccgacucuuucguguguuuugaacacaagggacaguauaaaggcacaauggauuccgggcagaccaagagagagcugaaaucuuucgacaucucucaaugccccaagauuggaggccacgggagcaagaaauguaccggagaugccgccuuuugcuccgcuuacgaauguacagcccaguaugcgaaugcuuacugcucucaugccaacggcagcggcaucguucagauucaagugucccgggucuggaagaaaccucuuugugugggguaugagcgcgucgugguuaagagagaacugagcgccaaaccgauccagcggguggagcccugcacgaccuguauuacaaagugcgagccucacggacucgucgugagaucuaccggcuucaagaucuccagcgcuguugccugcgcuucuggggugugugucacaggaucccagagccccuccaccgaaaucacgcugaaauacccuggcauuucucagagcuccgggggcgacaucggagugcauauggcccacgaugaccaaucugugagcuccaagauuguugcgcauugucccccgcaggacccuugccuuguccacggcugcaucgugugugcccacgggcugauuaauuaucagugccauacagcucucagcgccuucguggucaucuuuguguucucuuccaccgcuaucauuugucuggccguucuguaccgcgugcucaaaugccugaagaucgcgccccggaaaguccuuaacccucugauguggauuaccgccuuuaucagauggguguacaagaaaaugguugcucgcguggccgauaacauuaaucaggucaaccgggagaucggauggauggaaggcgggcaacucgcucugggaaaucccgccccuauucccagacacgccccgaucccucgcuauagcacauaccugaugcuucuccugaucgugucuuaugcuuccgcguguagcgagcugauucaggccucuagccggaucaccacaugcuccacggagggcguuaacaccaaguguagacucagcgggacagcucugauucgcgccggcucugugggagccgaggcuugccuuaugcugaagggcgucaaagaggaccagaccaaguuccucaaaaucaagacaguguccagcgaacuguccugccgggaggggcagucuuacuggaccggcagcuuuucccccaaaugucugucuagcagacgcugccaucuugugggagaaugucacgucaaucggugccucuccuggagagauaacgagacgucugccgaguucagcuuuguuggggaauccaccacaaugcgggagaauaaguguuucgaacaaugcggaggcuggggguguggcugcuuuaacgugaaucccagcugucuguucgugcacaccuaucugcagucuguccgcaaggaggcgcucagaguguuuaacugcauugacuggguucauaaacugacacuugaaaucaccgauuucgacggauccgugagcacgaucgaucugggcgcuucuuccagccgguuuacaaauugggggucugucucccucagccuggacgccgagggaauuuccggcagcaacucuuucagcuucaucgaguccccugggaagggauacgccauuguggaugaaccguuuucugagauccccagacagggcuuccugggggaaauucgcuguaauagcgaguccucuguucuuagcgcucacgaauccugccuccgggccccuaaccuggugucuuauaaacccaugaucgaccagcuggagugcaccacaaaucucaucgauccuuuugucguguucgagagaggcagccugccccaaacccgcaacgacaagaccuuugcggcuuccaaaggaaacagaggcguucaggccuucagcaaggggucugugcaggccgaucuuacacugauguuugacaaucucaaggucgacuucgugggagcugccguguccugugaugcugccuuucugaaccugacgggcugcuacagcuguaaugcgggggcccgggucugccuuucuauuaccuccacaggaaccggcacacucagcgcucauaacaaagacggcucccugcacaucguucugccuucugaaaaugggaccaaggaucaaugucagauucuccauuucacggugcccgaggugaaagaagaguuuauguacagcugcgacggagaugagcgcgcccugcuuaugaagggcacacugaucgcuauugacccguucgaugacagacgggaagccgggggagaguccaccgucgugaacccuaaaagcggcucuuggaacuuuuucgauugguucuccgggcucaugagcugguuuggaggcccccugaagaccauccugcuuaucugucuguauguugcccucucuauuggccuguucuuucuccugaucuaccuugggcgcacaggacugagcaagauguggcucgcugcgaccaaaaaggccuccuga

SEQ ID NO: 14444 - RNA, 3594 nt, Artificial Sequence
  derived and/or modified CDS sequence (opt5) from RVFV(Kenya 56 (IB8))__DQ380190.1__GP
auguacgugcugcucaccauccugauuacaguccuuguuugcgaggccgugaucagagugagccuguccucuacgcgggaagagaccuguuucggcgacagcacaucccccgaaaugauugagggggcuugggauucucuccgcgaagaggagaugccugaggaacugagcugcuccaucucuggaauuagagaagucaagaccagcucccaggagcuuuaucgggcccugaaagcgaucaucgcugccgacggccucaacaauauuacaugucacgggaaggauccggaggacaaaaucagccugauuaagggacccccucauaaaaagcaagugggcaucguucgcugcgaaagacggcgcgaugccaagcagauugggagagagaccauggcuggaaucgccaugacagugcugcccgcucucgccgucuuugcgcuggccccugugguuuucgcugaagacccccaccuucggaaccgcccuggcaaaggccauaauuacauugaugggaugacccagggagacgccacguguaagccggugaccuaugcuggcgccugcagcuccuuugauguccugcucgagaaagggaaguucccccuguuucagagcuacgcgcaccauagaacacuucuggaagccgugcacgacaccaucaucgcuaaagccgauccucccucuugugaccuccaauccgcucacggaaacccuugcaugaaggagaagcuggugaugaaaacacauugucccaaggauuaucagagcgcccacuaccugaauaacgacggcaaaauggccucugucaagugcccgccuaaauaugagcucaccgaagacuguaauuucugccggcagaugacgggggcuucccugaagaaaggaagcuacccccuucaggaucuguuuugccaauccucugaggacgauggcagcaagcucaagacaaaaaugaagggcguuugugaagugggggugcaggcgcugaaaaagugcgacggacagcuuuccaccgcccaugaggucgugccuuucgcuguuuuuaaaaacagcaagaagguguaccuggauaaacucgaccugaagacagaagagaaucugcuccccgauucuuucgucuguuuugagcacaaaggccaguauaaggggaccauggacuccggacaaaccaaacgcgaacugaagucuuucgauauuucucagugccccaagaucggcgggcacggaagcaaaaaguguacaggcgacgccgccuuuugcuccgcuuacgaguguacggcccaguaugcgaacgcuuacugcucucaugccaauggcagcgggauugugcaaauccagguuuccggaguguggaaaagaccucuuugugucggcuaugaacggguggucgugaagcgcgagcugagcgccaaaccgauucagagaguugaacccugcaccacauguaucaccaagugcgagccucacgggcucgugguccggucuacaggauucaagaucuccagcgcuguggccugcgcuucuggcguuugugugaccgggucccagagccccuccacggagauuacacugaaauacccuggcaugucucaaagcuccggaggcgauaucgggguccauauggcccacgacgaccagucugugagcuccaagauuguggcgcauugucccccgcaggauccuugccuuguucacggaugcaucgucugugcccacggccugauuaacuaucagugccauaccgcucucagcgccuucgugguggucuuuguguucucuuccguugcuaucaucugucuggccauucuguacaaagugcucaagugccugaaaaucgcgcccagaaagguccuuaauccucugauguggauuaccgccuuuauccgcuggguguacaaaaagaugguugcucggguggccgacaacauuaaucaagucaacagagaaaucggguggauggagggaggccagcccgcucucgggaacccugcccccauuccgcgccacgccccuaucccccgguauagcacauaccugaugcugcuucucaucgugucuuaugcuuccgcguguagcgaacugauucaggccucuagcagaaucaccacaugcuccacggagggcguuaauaccaagugucgccugagcggaacagcucucauucgggccggcucugugggggccgaggcuugccugaugcuuaaaggagucaaggaagaucagaccaaauuccugaagaucaaaacaguguccagcgagcucuccugcagagaaggccaaucuuacuggaccgggagcuuuucccccaagugucugucuagccgccggugccaucuggugggagagugucacgucaacagaugccuuuccuggcgcgacaaugaaacgucugccgaguucagcuuuguuggcgaguccaccacaaugcgggaaaacaaguguuucgagcagugcgggggcuggggauguggcugcuuuaaugugaacccuagcugucucuucgugcacaccuaucugcagucugucagaaaagaagcgcugcggguguuuaauugcauugauuggguucauaagcucacacuggagaucaccgacuucgauggguccgugagcacgaucgaccuuggagcuucuuccagccgcuuuacaaacuggggcucugucucccugagccucgaugccgaagggauuuccggaagcaauucuuucagcuucaucgaguccccgggcaaaggguacgccauuguggacgagcccuuuucugaaaucccuagacagggcuuccugggagagauucgguguaacagcgaauccucuguucugagcgcucacgaguccugccuuagagcccccaaucucaucucuuauaagccuaugaucgaucaacuggaaugcaccacaaaccugauugaccccuuuguggcguucgagcgcggcagccucccucagacccggaaugauaaaaccuuugcugccuccaaggggaacagaggaguccaggccuucagcaagggcucugugcaagcugaccugacacuuauguuugacaauuucgagguugauuuugugggggccgcugucuccugugacgccgcguuccugaaccucacgggaugcuacagcuguaacgccggcgcucgcgugugccugucuaucaccuccacaggcaccgggacacugagcgcccauaauaaagauggaucccuucacauugugcuccccucugaaaacggcaccaaggaccagugucagauccugcauuuuacggucccggagguugaagaggaguucauguacagcugcgauggggacgaaagaccucugcucgugaaaggaacacugauugcuaucgaucccuuugacgaucggcgcgaggccggcggggaauccaccguggucaauccuaagagcggaucuuggaacuucuucgacugguuuuccggccuuaugagcugguucggcgggccccugaaaaccauccuccugauuugucuguauguggcccuuucuaucggacuguuuuuccuccugauuuaccucggcagaacagggcugagcaagauguggcuugcugcgaccaagaaagccuccuga

SEQ ID NO: 14445 - RNA, 3594 nt, Artificial Sequence
  derived and/or modified CDS sequence (opt5) from RVFV(KEN/Bar-035/07)__HM586969.1__GP
auguacgugcugcucaccauccugauuagcguccuuguuugcgaggccgugaucagagugucccugucuagcacacgggaagagacguguuucggcgacuccaccaaccccgaaaugauugagggggcuugggauucucuccgcgaagaggagaugccugaagaacugagcugcuccgucucuggaaucagagaagugaagacaagcucccaggagcuuuaucgggcccugaaagcgauuaucgcugccgacggccucaauaacaucaccugucacgggaagaauccggaggauaaaauuagccugaucaagggacccccucauaaaaagcgcguuggcauugugagaugcgaacggcgcagagacgccaagcaaaucgggcgggagacaauggcuggaauugccaugaccguccugcccgcucucgccguguuugcgcuggccccuguuguguucgcugaagauccccaccuucgcaacagaccuggcaaaggccauaauuacaucgacgggcggcugcaggaggaugccacauguaagccggucaccuaugcuggagccugcagcuccuuugacgugcuccuggaaaaaggcaaguucccccuuuuucagagcuacgcgcaccaucgcacgcugcucgaggccgugcacgauaccauuaucgcuaaagccgacccucccucuugugaucugcaguccgcugacgggaacaagugcaugaaggagaaacuggucaugaagacacacuguccuaaugauuaucaaagcgcccauuaccucaacaaugacggaaaaauggccucuguuaagugucccccgaaauaugaacugaccgaggacugcaacuucugcagacagaugacaggcgcuucccuuaagaaagggagcuacccucugcaggaucucuuuugccaguccucugaagacgauggaagcaagcugaagaccaaaaugaagggcgugugugaggugggcguccaagcgcuuaaaaagugcgacgggcagcuguccacggcccacgaagugguucccuucgcuguguuuaaaaauagcaagaaggucuaccucgauaaacuggaccugaagacagaggagaaccuccugccugauucuuucguguguuuugaacauaaaggacaguauaagggcaccauggacuccgggcagacaaaacgggagcuuaagagcuucgauaucucucaaugccccaagauuggaggccacgggagcaaaaaguguaccggagacgccgccuuuugcuccgcuuacgaauguaccgcccaguaugcgaaugcuuacugcucucacgccaacggcagcggcaucguucagauucaaguguccggggucuggaaaaagccccugugugugggauaugagcgcgucgugguuaaaagagaacucagcgccaagccuauccagcggguggagccgugcacaacguguauuaccaagugcgagccccauggccuggucgugagaucuacaggguucaaaaucuccagcgcuguugccugcgcuucuggagugugugucaccggcucccagagcccuuccacagaaaucacccuuaaguaccccgggauuucucagagcuccggcggagauaucggcgugcacauggcccaugacgaccaaucugugagcuccaaaauuguugcgcacugcccuccccaggauccgugucugguccaugggugcaucgugugugcccacggacucauuaauuaucagugccacacggcucugagcgccuucguggucaucuuuguguucucuuccacagcuaucauuugucuggccguucucuaccgcgugcugaagugccuuaaaaucgcgccucggaagguccugaacccccucauguggauuaccgccuuuaucagauggguguacaaaaagaugguugcucgcguggccgacaacauuaaucaggucaaccgggagaucggcuggauggaagggggacaacuggcucugggcaauccugcccccauuccuagacaugcccccaucccgcgcuauagcaccuaccuuaugcuccugcugaucgugucuuaugcuuccgcguguagcgagcucauucaggccucuagccggaucacaaccugcuccacagaggggguuaacacgaaguguagacugagcggcaccgcucuuauucgcgcccggucugugggagccgaggcuugccugaugcucaaaggcgucaaggaggaucagacaaaauuccugaagaucaaaaccguguccagcgaacuguccugcagagaggggcagucuuacuggacaggaucuuuuuccccuaagugucuuucuagccgccggugccaccucgugggcgaaugucaugucaauagaugccuguccuggcgggacaacgagaccucugccgaguucagcuuuguuggggaauccacgaccaugcgcgagaauaaguguuucgaacaaugcggaggcuggggguguggcugcuuuaacgugaaucccagcugucuguucgugcacacauaucuccagucugucagaaaagaggcgcugcggguguuuaacugcauugauuggguucacaaacuuacccuggaaaucacagacuucgauggauccgugagcaccaucgaccucggcgcuucuuccagcagauuuacgaauugggggucugucucccugagccuggaugccgagggaauuuccggcagcaacucuuucagcuucaucgagucccccgggaagggauacgccauuguggacgaaccuuuuucugagaucccgcgccagggcuuccuuggggaaauucgguguaauagcgaguccucuguucucagcgcucaugaauccugccugagagcccccaaccuggugucuuauaagccuaugaucgaucagcucgagugcacaaccaaucugaucgaccccuuugucguguucgagcgcggcagccuuccucaaacaagaaacgauaaaaccuuugcggcuuccaagggaaaccggggcguucaggccuucagcaaggggucugugcaggccgaccugacccucauguuugacaauuucgaagucgauuuugugggagcugccguguccugugacgcugccuuccugaaccugacaggcugcuacagcuguaaugcgggggcccgcgucugccuuucuauuacguccaccggaacaggcacccucagcgcucacaacaaagauggcucccugcauaucguucugcccucugagaaugggacaaaggaccaaugucagauucuccacuuuaccgugccugaaguggaggaggaguucauguacagcugcgauggagacgaaagaccccugcuugucaaaggcacgcugaucgccauugauccguuugacgaucggcgcgaagcugggggagaguccacagugguuaacccuaagagcggcucuuggaauuucuucgacugguuuuccgggcucaugagcugguucggaggcccccugaaaaccauccugcuuaucugucuguauguggcccucucuauuggccuguuuuuccuccugaucuaccuugggagaaccggacugagcaagauguggcucgccgcuacaaagaaagcguccuga

SEQ ID NO: 14446 - RNA, 3594 nt, Artificial Sequence
  derived and/or modified CDS sequence (opt5) from RVFV(TAN/Dod-002/07)__HM586971.1__GP
auguacgugcugcucaccauccugauuagcguccuuguuugcgaggccgugaucagagugucccugucuagcacacgggaagagacguguuucggcgacuccaccaaccccgaaaugauugagggggcuugggauucucuccgcgaagaggagaugccugaagaacugagcugcuccgucucuggaaucagagaagugaagacaagcucccaggagcuuuaucgggcccugaaagcgauuaucgcugccgacggccucaauaacaucaccugucacgggaagaauccggaggauaaaauuagccugaucaagggacccccucauaaaaagcgcguuggcauugugagaugcgaacggcgcagagacgccaagcaaaucgggcgggagacaauggcuggaauugccaugaccguccugcccgcucucgccguguuugcgcuggccccuguuguguucgcugaagauccccaccuucgcaacagaccuggcaaaggccauaauuacaucgacgggaugacacaggaggaugccaccuguaagccggucacguaugcuggagccugcagcuccuuugacgugcugcucgaaaaaggcaaguucccccuguuucagagcuacgcgcaccaucggacccuucuggaggccgugcacgauacaauuaucgcuaaagccgacccucccucuugugaucuccaguccgcucacgggaacccuugcaugaaggagaagcuggucaugaaaacccauugucccaaugacuaucaaagcgcccacuaccugaacaaugauggaaagauggccucuguuaaaugcccgccuaaguaugaacucacagaggacuguaacuucugccgccagaugaccggcgcuucccugaaaaaggggagcuacccccuucaggaccuguuuugccaguccucugaagaugacggaagcaaacucaagacgaagaugaaaggcgugugugaggugggcguccaagcgcugaagaaaugcgaugggcagcuuuccacagcccaugaagugguuccuuucgcuguguuuaagaauagcaaaaaggucuaccuggacaagcucgaucugaaaaccgaggagaaccugcuccccgacucuuucguguguuuugaacacaagggacaguauaaaggcacaauggauuccgggcagaccaagagagagcugaaaucuuucgacaucucucaaugccccaagauuggaggccacgggcggaagaaauguaccggagaugccgccuuuugcagcgcuuacgaauguacagcccaguaugcgaaugcuuacugcucccaugccaacggcucuggcaucguucagauucaagugagcggggucuggaagaaaccucuuugugugggauaugagcgcgucgugguuaagagagaacuguccgccaaaccgauccagcggguggagcccugcacgaccuguauuacaaagugcgagccucacggccucgucgugagaagcaccggguucaagaucucuuccgcuguugccugcgcuagcggagugugugucacaggcucucagucccccagcaccgaaaucacgcugaaauacccugggauuucccagucuagcggcggagacaucggcgugcauauggcccacgaugaccaauccgugucuagcaagauuguugcgcauugucccccgcaggacccuugccuuguccacgggugcaucgugugugcccaggcuuggauuaucucccaguggcacacagcccugagcgcuuucguggucaucuuuguguucucuuccaccgccauuaucugccucgcgguucuguaucgcgugcugaaaugucucaagauugcuccccggaaaguccugaauccucuuauguggaucaccgccuuuauuagauggguguacaagaaaaugguugcccgcguggcugauaacaucaaccaagucaaucgggagauuggauggauggaaggcgggcagcuggcccucggaaaccccgccccuauccccagacaugcuccgaucccucgcuacagcacauaucugaugcugcuucucauugugucuuacgcguccgccugcagcgagcugauccaggcuucuagccggauuaccacauguuccacggagggcguuaauaccaagugcagacugagcgggacagcccucauccgcgccggcucugugggagcugaagccugucugaugcuuaagggcgucaaagaggaccagaccaaguuccugaaaauuaagacaguguccagcgaacucuccugccgggaggggcaaucuuauuggaccggcagcuuuucccccaaaugccugucuagcagacgcugucaccuggugggagaaugccaugucaaccggugucuuuccuggagagauaaugagacgucugcggaguucagcuuuguuggggaauccaccacaaugcgggagaacaagugcuucgaacaguguggaggcugggggugcggcuguuuuaaugugaaccccagcugccucuucgugcacaccuaccugcagucuguccgcaaggaggcucugagaguguuuaauuguaucgacuggguucacaaacucacacuggaaaucaccgauuucgacggauccgugagcacgauugaucuuggcgccucuuccagccgguuuacaaacugggggucugucucccugagccucgacgccgagggaaucuccggcagcaauucuuucagcuucauugaguccccugggaagggauaugcuaucguggaugaaccguuuucugagauucccagacagggcuuccugggggaaauccgcugcaacagcgaguccucuguucugagcgcccaugaauccugucuucgggcgccuaaucucgugucuuacaaacccaugaucgaccaacuggagugcaccacaaaccugauugauccuuuugucguguucgagagaggcagccucccccagacccgcaaugacaagaccuuugcugccuccaaaggaaacagaggcguucaggccuucagcaaggggucugugcaagcugaucugacacuuauguuugacaacuucgaagucgacuuugugggagccgcuguguccugcgaugccgcguuccugaaucucacgggcuguuauagcugcaacgccggggcucgggucugucugucuaucaccuccacaggaaccggcacacugagcgcccacaauaaggacggcucccuucauauuguucucccuucugagaacgggaccaaagaucagugccagauccugcacuuuacggugcccgaaguggaggaggaguucauguacagcugugacggagaugagcgcccgcugcucgucaagggcacacugauugcuaucgacccuuuugaugacagacgggaagccgggggagaguccaccgugguuaaucccaaaagcggcucuuggaacuucuucgauugguuuuccgggcuuaugagcugguucggaggcccucugaagaccauccuccugauuugccuguacguggcccuuucuaucggccuguuuuuccuccugauuuaucucgggcgcacaggacugagcaaaauguggcuugcugcgaccaagaaggccuccuga

SEQ ID NO: 14447 - RNA, 3594 nt, Artificial Sequence
  derived and/or modified CDS sequence (opt5) from RVFV(Beijing-01)__KX611606.1__GP
auguacgugcugcucaccauccugauuagcguccuuguuuucgagguggugaucagagucucccugucuagcacacgggaagagacgugcuuuggcgacuccaccaaccccgaaaugauugagggggccugggauucucuccgcgaagaggagaugccugaggaacugagcuguuccaucucuggaauuagagaagugaagacaagcucccaggagcuuuaucgggcucugaaagccaucaucgcggcugacggccucaauaacauuaccugccacgggaaggauccggaggacaaaaucagccugauuaagggacccccucauaaaaagcgcguuggcaucgugagaugugaacggcgcagagaugccaagcaaauugggcgggagacaauggccggaaucgcuaugaccguccugcccgcccucgcuguguucgcccuggcgccuguuguguuugccgaagacccccaccuucgcaauagaccuggcaaaggccauaacuacauugauggggucacacaggaggacgcuaccugcaagccggugacguaugccggagcuuguucuuccuucgaugugcugcucgaaaaaggcaaguuuccccuguuccagagcuacgcccaccaucggacccuucuggaggcgguccacgacacaaucaucgccaaagcugauccucccucuugcgaccuccaguccgcccacgggaauccuuguaugaaggagaagcugguuaugaaaacccauugccccaacgauuaucaaagcgcucacuaccugaauaacgacggaaagauggccucugugaaauguccgccuaaguaugaacucacagaggacugcaauuuuugucgccagaugaccggcgccucccugaaaaaggggagcuacccccuucaggaucuguucugccaguccucugaagacgauggaagcaaacucaagacgaagaugaaaggcgugugcgaggucggcgugcaagcucugaagaaaugugacgggagacuuuccacagcgcaugaaguugugccuuuugccgucuucaagaacagcaaaaagguguaccuggauaagcucgaccugaaaaccgaggagaaucugcuccccgauucuuuuguuugcuucgaacacaagggacaguauaaaggcacaauggacuccgggcagaccaagcgggagcugaaaucuuuugauauuucucagugucccaagaucggaggccacgggagcaagaaaugcaccggagacgcugccuucuguuccgccuacgaaugcacagcucaauaugccaacgcguacuguucucaugcuaauggcagcggcauugugcagauccaggucuccgggguguggaagaaaccucuuugcgucggauaugagcgcgugguugugaagagagaacugagcgccaaaccgauucaacgggucgagcccuguacgaccugcaucacaaagugugagccucacggccucgugguuagaucuaccggguucaagaucuccagcgccguggcuugcgccucuggagucugcgugacaggcucccagagccccuccaccgaaauuacgcugaaauacccugggaucucucagagcuccggcggagauauuggcgugcauauggcucacgacgaccagucuguuagcuccaagaucgucuuugauugucccccgcaagacccuugccuugugcauggguguauugugugcgcccacggacugaucaacuaucagugucacacagcgcucagcgccuucgucgugguuuuuguguucucuuccgucgcuaucauuugccuggccauccuguacaaagugcuccgcugucugaagauugcucccaaaaagguucuuaauccucugauguggaucaccgccuuuauucgguggguguacaaaaagauggucgcgagaguggccgauaacaucaaccagguuaaucgcgagauuggcuggauggaagggggacagcucgcucugggcaaccccgccccuaucccccggcaugcuccgaucccuagauauagcaccuaccugaugcuucuccugauuaucucuuaugccuccgccugcagcgagcugauucaagcuagcagccgcaucacaaccuguuccacagagggggugaauacgaagugccggcucagcggcaccgcgcugauuagagccggaucugucggcgcugaagccugucuuauguucgagggggugaaagaagaccagacaaaguuucugaaaaucaagaccguguccagcgagcucuccugccgcgaaggacagucuuacuggacaggcagcuucucccccaaaugccugucuagccggagaugucaccuggucggggagugccauguuaaccgcugucuuuccuggcgggauaaugagaccucugccgaauuuagcuucgugggagaguccacgaccaugagagaaaacaagugcuuugagcaguguggcggguggggcugcggauguuucaaugugaaccccagcugccucuuuguccacacauaucugcaaucugugcggaaggaagcucugcgcguuuucaauuguaucgacugggugcacaaacucacccuggagauuacagauuucgacggcuccgucagcaccaucgaucuuggggccucuuccagcagauuuacgaacuggggaucugugucccugagccucgacgcggagggcauuuccgggagcaauucuuucagcuuuaucgaauccccuggaaagggcuacgcuauuguugaugagccguucucugaaaucccccggcagggguuucugggcgagaucagaugcaacagcgaauccucugugcugagcgcccaugaguccugucuucgcgccccuaaucucauuucuuauaaacccaugaucgaccagcuggagugcacaaccaaccugauugauccuuucgucguguuugaacggggaagccucccccagacaagaaaugacaagaccuucgcugccuccaaaggcaaccgcgggguucaagcguuuagcaagggaucugugcaggcugaccugacccuuauguucgauaacuuugaggucgacuucgugggcgccgccguguccugcgaugcugccuuucugaaucucacaggguguuacagcugcaacgcuggagccagagucugucugucuaucacguccaccggcacaggcacccugagcgcgcacaauaaggacgggucccuucauauuguucucccuucugaaaacggaacaaaagaucagugccaaauccugcacuucaccgugcccgagguggaggaagaguucauguacagcugugacggcgaugaacggccgcugcucgucaaggggacgcugaucgccauugacccuuuugaugaccgcagagaggcuggaggcgaauccacagugguuaaucccaaaagcgggucuuggaacuucuuugauugguucuccggacuuaugagcugguuuggcggcccucugaagaccauccuccugauuugccuguauguggcccuuucuaucgggcuguucuuucuccugauuuaccucggacggaccggccugagcaaaauguggcuugcugccacaaagaaggccuccuga

SEQ ID NO: 14448 - RNA, 3594 nt, Artificial Sequence
  derived and/or modified CDS sequence (opt5) from RVFV(Smithburn)__DQ380193.1__GP
auguacgugcugcucaccauccugauuagcguccuuguuugcgaggccgugaucagagugucccugucuagcacacgggaagagacguguuucggcgacuccaccaaccccgaaaugauugagggggcuugggauucucuccgcgaagaggagaugccugaggaacugagcugcuccaucucuggaauuagagaagucaagacaagcucccaggagcuuuaucgggcccugaaagcgaccaucgcugccgacggccucaauaacaucacaugucacgggaaggauccggaggacaaaauuagccugaucaagggacccccucauaaaaagcgcgugggcguugugagaugcgaacggcaacgcgaugccaagcagauugggagaggaaccauggcuggcaucgccaugacagucuuucccgcucuggugguuuucgcccucgcgccuguggucuuugccgaggacccccaucugcggaaucgcccuggcaaagggcacaacuacauugauggaaugacccaggaagacgcuacguguaagccggugaccuaugccggcgcuuguucuuccuucgaugugcuucuggagaaagggaaguuuccccucuuccagagcuacgcccaccauagaacacugcuugaagcgguccacgacaucauuaucgccaaagcugauccucccucuugcaaucugcaauccgcccacggaaacccuugcaugaaggagaagcucguuaugaaaaccuauugucccaaugacuaccagagcgcucauuaucugaacaaugauggcaagauggccucugugaaaugcccgccuaagcacgagcugacagaagacuguaacuuuugccggcagaugaccggggccucccucaaagagggaagcuacccccugcaggaccuuuucugccaauccucugaagaugacggcagcaagcugaaaacgaagaugaagggcgugugugaggucggggugcagguucucaaaaagugcgauggacagcuguccacagcucaugaaguggucccuuuugcgguguucaaaaauagcaagaaaguuuaccuugacaagcuggaucucaagaccgaggagaaccugcugcccgacucuuuuguguguuucgaacacaaaggccaguauaaggggacaauggauuccggacaaaucaaacgcgagcucaagagcuuugacauuucucagugccccaaaaucggcgggcacggaagcaagaaguguaccggcgaugccgcuuucugcuccgccuacgaauguaccgcccaguaugcuaaugccuacugcucucaugcgaacggcagcgggauuguccaaauccagguguccggagucuggaaaaagccucugugugugggcuaugagagaguuguggucaaacgggaacuuagcgcuaagccgauucagcgcguggagcccugcacaacguguaucaccaaaugcgagccucacgggcugguugugagaucuacaggauucaagaucuccagcgccgucgccugcgcuucuggcgugugugugaccgggucccagagccccuccacagaaauuacccucaaguacccuggcaucucucaaagcuccggaggcgacauugggguucauauggcccacgaugaccagucugucagcuccaaaaucguggcucauugucccccgcaggacccuugccuggugcacggaugcauugucugugcccacggccuuaucaauuaucagugccauacggcguuuagcgccuucgugguuguguuugucuucucuuccgugguuaucauuugucuggcuauccucuacaaggugcugaaaugccugaagauugcuccccggaaaguccucaacccucugauguggaucacagccuuuauuagauggguguacaagaaaaugguugcccgcguggcggauaacaucaaucaagucaaccgggagauuggguggauggaaggaggccagcuugugcuggggaaucccgccccuauccccagacacgcuccgaucccucgcuauagcaccuaccucaugcugcugcuuauugugucuuaugccuccgcuuguagcgagcucauccaggccucuagccggauuaccacaugcuccaccgagggcgucaacacaaaguguagacugagcggaacggcccugauccgcgcuggcucuguuggggcggaagccugccucaugcugaagggagugaaagaggaccagaccaaguuccuuaaaauuaagacaguguccagcgaacuguccugccgggagggccaaucuuacuggaccgggagcuuuucccccaaaugucucucuagcagacgcugccaucuggucggagaaugucacgugaaucggugccuguccuggagagauaacgagacaucugcugaguucagcuuuguuggcgaauccaccacgaugcgcgagaauaaguguuucgaacagugcgggggcuggggauguggcugcuuuaacgugaaucccagcugucuuuucguccacaccuaucuccagucugugcggaaggaggcccugagaguuuuuaacugcaucgacugggugcauaaacugacacucgaaaucaccgauuucgacggguccgucagcacaguggaucugggagccucuuccagccgguucaccaauuggggcucuguuucccuuagccuggacgcugaggggauuuccggaagcaacucuuuuagcuucaucgaguccccuggcaagggguacgccauuguggaugaaccguuuucugagaucccccgccagggcuuccucggagaaauuagauguaauagcgaguccucuguccugagcgcgcacgaauccugccugcgggcuccuaaccuuaucucuuauaaacccaugaucgaccaacucgagugcacgacaaaucugauugauccuuuugugguguucgagagaggcagccugccccagacccgcaacgacaagacauuugccgccuccaaagggaaccggggaguccaggcuuucagcaagggcucuguucaagccgaucucacccugauguuugacaauuucgaaguggacuuugugggggcggcugucuccugugaugccgccuuccuuaaccugaccggaugcuacagcuguaaugcuggcgccagagugugccucucuaucacauccacgggcaccgggacacugagcgcucauaacaaggacggaucccugcacauuguucuuccuucugagaauggcaccaaagaucagugucagauccuccauuuuacagugcccgaagucgaggaggaauuuauguacagcugcgacggggaugagcgcccgcugcuggugaagggaacccucauugccaucgacccuuucgaugacagacgggaagcgggcggggaguccacgguugugaaccccaaaagcggaucuuggaauuucuucgauugguuuuccggccugaugagcugguucggcgggccucuuaagacaauccugcucauuugucuguaugucgcccugucuaucggacuguuuuucuuucuuauuuaccucggccgcaccgggcugagcaaaauguggcucgcugccaccaagaaggcuuccuga

SEQ ID NO: 14449 - RNA, 3594 nt, Artificial Sequence
  derived and/or modified CDS sequence (opt5) from RVFV(KEN/Bar-032/07)__HM586968.1__GP
auguacgugcugcucaccauccugauuagcguccuuguuugcgaggccgugaucagagugucccugucuagcacacgggaagagacguguuucggcgacuccaccaaccccgaaaugauugagggggcuugggauucucuccgcgaagaggagaugccugaagaacugagcugcuccgucucuggaaucagagaagugaagacaagcucccaggagcuuuaucgggcccugaaagcgauuaucgcugccgacggccucaauaacaucaccugucacgggaagaauccggaggauaaaauuagccugaucaagggacccccucauaaaaagcgcguuggcauugugagaugcgaacggcgcagagacgccaagcaaaucgggcgggagacaauggcuggaauugccaugaccguccugcccgcucucgccguguuugcgcuggccccuguuguguucgcugaagauccccaccuucgcaacagaccuggcaaaggccauaauuacaucgacgggcggcugcaggaggaugccacauguaagccggucaccuaugcuggagccuguucuuccuuugacgugcuccuggaaaaaggcaaguucccccuuuuucagagcuacgcgcaccaucgcacgcugcucgaggccgugcacgauaccauuaucgcuaaagccgacccucccucuugcgaucugcaguccgcugacgggaacaagugcaugaaggagaaacuggucaugaagacacacuguccuaaugauuaucaaagcgcccauuaccucaacaaugacggaaaaauggccucuguuaagugucccccgaaauaugaacugaccgaggacugcaacuucugcagacagaugacaggcgcuucccuuaagaaagggagcuacccucugcaggaucucuuuugccaguccucugaagacgauggaagcaagcugaagaccaaaaugaagggcgugugugaggugggcguccaagcgcuuaaaaagugcgacgggcagcuguccacggcccacgaagugguucccuucgcuguguuuaaaaauagcaagaaggucuaccucgauaaacuggaccugaagacagaggagaaccuccugccugauucuuucguguguuuugaacauaaaggacaguauaagggcaccauggacuccgggcagacaaaacgggagcuuaagagcuucgauaucucucaaugccccaagauuggaggccacgggagcaaaaaguguaccggagacgccgccuuuugcuccgcuuacgaauguaccgcccaguaugcgaaugcuuacugcucucacgccaacggcagcggcaucguucagauucaaguguccggggucuggaaaaagccccugugugugggauaugagcgcgucgugguuaaaagagaacucagcgccaagccuauccagcggguggagccgugcacaacguguauuaccaagugcgagccccauggccuggucgugagaucuacaggguucaaaaucuccagcgcuguugccugcgcuucuggagugugugucaccggcucccagagcccuuccacagaaaucacccuuaaguaccccgggauuucucagagcuccgugggcgauaucggagugcacauggcccaugacgaccaaucuguuagcuccaaaauugucgcgcacugcccuccccaggauccgugucuggugcauggcugcaucgugugugcccacgggcucauuaauuaucagugccacacggcucugagcgccuucgucgugaucuuuguuuucucuuccacagcuaucauuugucuggccgugcucuaccgcguccugaagugccuuaaaaucgcgccucggaaggugcugaacccccucauguggauuaccgccuuuaucagauggguuuacaaaaagaugguggcucgcgucgccgacaacauuaaucaggugaaccgggagaucggauggauggaaggcgggcaacuggcucugggaaauccugcccccauuccuagacaugcccccaucccgcgcuauagcaccuaccuuaugcuccugcugaucguuucuuaugcuuccgcguguagcgagcucauucaggccucuagccggaucacaaccugcuccacagagggcgugaacacgaaguguagacugagccacaccgcucuuauucgcgccgggucugucggcgccgaggcuugccugaugcucaaaggagugaaggaggaucagacaaaauuccugaagaucaaaaccguguccagcgaacuguccugccgggagggccagucuuacuggacagggagcuuuuccccuaagugucuuucuagcagacgcugccaucucgucggagaaugucacguuaaucggugccuguccuggagagacaacgagaccucugccgaguucagcuuugugggcgaauccacgaccaugcgggagaauaaguguuucgaacaaugcgggggauggggcugugggugcuuuaacgugaaucccagcugucuguucguccacacauaucuccagucugugcgcaaagaggcgcugagaguuuuuaacugcauugauugggugcauaaacuuacccuggaaaucacagacuucgauggcuccgucagcaccaucgaccucggagcuucuuccagccgguuuacgaauuggggcucugugucccugagccuggaugccgaggggauuuccggaagcaacucuuucagcuucaucgagucccccggcaagggguacgccauuguugacgaaccuuuuucugagaucccgagacagggauuccuuggcgaaauucgcuguaauagcgaguccucugugcucagcgcucacgaauccugccugcgggcccccaaccuggucucuuauaagccuaugaucgaucagcucgagugcacaaccaaucugaucgaccccuuugugguuuucgagagagggagccuuccucaaacacgcaacgauaaaaccuuugcggcuuccaagggcaacagaggagugcaggccuucagcaagggcucuguccaggccgaccugacccuccgguuugacaauuucgaaguggauuuugugggggcugccgucuccugugacgcugccuuccugaaccugacaggaugcuacagcuguaaugcgggcgcccgcguuugccuuucuauuacguccaccgggacaggaacccucagcgcucauaacaaagauggcucccugcacaucgugcugcccucugagaauggcacaaaggaccaaugucagauucuccauuuuaccgugccugaagucgaggaggaguucauguacagcugcgauggggacgaaagaccccugcuugugaaaggaacgcugaucgccauugauccguuugacgaucggcgcgaagcuggcggggaguccacaguugugaacccuaagagcggaucuuggaauuucuucgacugguuuuccggccucaugagcugguucgggggaccccugaaaaccauccugcuuaucugucuguaugucgcccucucuauuggccuguuuuuccuccugaucuaccuuggcagaaccgggcugagcaagauguggcucgccgcuacaaagaaagcguccuga

SEQ ID NO: 14450 - RNA, 3594 nt, Artificial Sequence
  derived and/or modified CDS sequence (opt5) from RVFV(KEN/Gar-004/06)__HM586964.1__GP
auguacgugcugcucacaauccugauuagcgucuggguuugcgaggccgugaucagagugucccuuucuagcacacgggaagagacguguuucggcgacuccaccaaccccgaaaugauugagggggcuugggauucucugcgcgaagaggagaugccugaagaacucagcugcuccgucucuggaaucagagaagugaagacaagcucccaggagcuguaucgggcccuuaaagcgauuaucgcugccgacggccugaauaacaucaccugucacgggaagaauccggaggauaaaauuagccucaucaagggacccccucauaaaaagcgcguuggcauugugagaugcgaacggcgcagagacgccaagcaaaucgggcgggagacaauggcuggaauugccaugaccguccugcccgcucuggccguguuugcgcucgccccuguuguguucgcugaagauccccaucugcgcaacagaccuggcaaaggccacaauuacaucgacgggaugacacaggaggaugccaccuguaagccggucacguaugcuggagccuguucuuccuuugacgugcuucuggaaaaaggcaaguucccccucuuucagagcuacgcgcaccaucggacccugcuugaggccgugcacgauacaauuaucgcuaaagccgacccucccucuugcgaucugcaguccgcucacgggaacccuugcaugaaggagaagcucgucaugaaaacccauugucccaaugacuaucaaagcgcccacuaccugaacaaugauggaaagauggccucuguuaaaugcccgccuaaguaugaacugacagaggacuguaacuucugccgccagaugaccggcgcuucccucaaaaaggggagcuacccccugcaggaccuuuucugccaguccucugaagaugacggaagcaaacugaagacgaagaugaaaggcgugugugaggugggcguccaagcgcucaagaaaugcgaugggcagcuguccacagcccaugaagugguuccuuucgcuguguuuaagaauagccagaaagucuaccuugacaagcuggaucucaagaccgaggagaaccugcugcccgacucuuucguguguuuugaacacaaaggacaguauaagggcacaauggauuccgggcaaaccaaaagagagcucaagagcuucgacaucucucagugccccaaaauuggaggccacgggcggaagaagcgcaccggagaugccgccuuuuguagcgcuuacgaaugcacagcccaguaugcgaaugcuuacuguuccagagccaacggcucuggcaucguucaaauucaggugagccgggucuggaaaaagccucugugcgugggguaugagagagucgugguuaaacgcgaacuuuccgccaagccgauccagcggguggagcccuguacgaccugcauuacaaaaugugagccucauggacuggucgugagaagcaccggcuucaagaucucuuccgcuguugccugcgcuagcggggugugcgucacaggaucucagucccccagcaccgaaaucacgcucaaguacccuggcauuucccaaucuagcgggggcgacaucggagugcacauggcccaugaugaccaguccgugucuagcaaaauuguugcgcacugucccccgcaggacccuugccugguccauggcuguaucgugugcgcccacgggcuuauuaauaaccagucccacagcgcucugucugccuucguggucaucuuuguguucuccagcacagcuaucauuugucucgccguucuguaucgcgugcugaagugccucaaaaucgcgccccggaagguccugaacccucuuauguggauuaccgccuuuaucagauggguguacaaaaagaugguugcucgcguggccgauaauauuaaccaagucaaucgggagaucggauggauggaaggcgggcagcuggcucucggaaaccccgccccuauucccagacaugccccgaucccucgcuacucuaccuaucugaugcugcuucucaucguguccuacgcuagcgcguguucugagcugauucaggccagcucccggaucacaaccugcagcacagagggcguuaauacgaaauguagacugucugggaccgcucucauucgcgccggcuccgugggagccgaggcuugccugaugcuuaagggcgucaaggaggaccagacaaaauuccugaagaucaaaaccgugagcuccgaacucucuugucgggaggggcaaagcuauuggacaggauccuuuucucccaagugccugagcuccagacggugccaccuggugggcgaaugucaugucaaccgcugccuuucuuggagagauaaugagaccagcgccgaguucuccuuuguuggggaaagcacgaccaugcgggagaacaaauguuucgaacagugcggaggcuggggguguggcugcuuuaaugugaaccccucuugucucuucgugcacacauaccugcaguccgucagaaaggaggcgcugcgcguguuuaauugcauugacuggguucacaagcucacccuggaaaucacagauuucgacggaagcgugucuaccaucgaucuuggcgcuuccagcucucgguuuacgaacuggggguccgucagccugucccucgacgccgagggaauuagcggcucuaauagcuucuccuucaucgagucuccugggaaaggauaugccauuguggaugaaccguuuagcgagauccccagacagggcuuccugggggaaauucgcuguaacuccgagucuagcguucuguccgcucaugaaucuugccuuagagccccuaaucucgugagcuacaagcccaugaucgaccaacuggaguguacaaccaaccugaucgauccuuuugucguguucgagcggggcucccucccccagacacgcaacgacaaaaccuuugcggcuagcaagggaaauagaggcguucaggccuucucuaaaggguccgugcaagccgaucugacccuucgguuugacaacuucgaagucgacuuugugggagcugccgugagcugcgaugcugccuuccugaaucucacaggcugcuauucuuguaacgcgggggcccgcgucugccuguccauuacgagcaccggaacaggcacccuguccgcucacaauaaggacggcucucuucauaucguucucccuagcgagaacgggacaaaggaucagugucagauucugcacuuuaccgugcccgaaguggaggaggaauuuauguacuccugcgacggagaugagagaccgcugcucgucaaaggcacgcugaucgccauugacccuuuugaugaccggcgcgaagcugggggagagagcacagugguuaaucccaagucuggcuccuggaacuucuucgauugguuuagcgggcuuaugucuugguucggaggcccucugaaaaccauccuccugaucugucuguacguggcccuuagcauuggccuguuuuuccuccugaucuaucucgggagaaccggacuguccaagauguggcuugccgcuaccaaaaaggcgucuuga

SEQ ID NO: 14451 - RNA, 3621 nt, Artificial Sequence
  derived and/or modified CDS sequence (opt5) from RVFV(RVFV)__M11157.1__GP
auguacgugcugcucaccauccugauuagcguccuuguuugcgaggccgugaucagagugucccugucuagcacacgggaagagacguguuucggcgacuccaccaaccccgaaaugauugagggggcuugggauucucuccgcgaagaggagaugccugaggaacugagcugcuccaucucuggaauuagagaagucaagacaagcucccaggagcuuuaucgggcccugaaagcgaucaucgcugccgacggccucaauaacauuaccugucacgggaaggauccggaggacaaaaucagccugauuaagggacccccucauaaaaagcgcgugggcaucguuagaugcgaacggcgcagagaugccaagcaaauugggcgggagacaauggcuggaaucgccaugaccgugcugcccgcucucgccgucuuugcgcuggccccugugguuuucgcugaagacccccaccuucgcaauagaccuggcaaaggccauaacuacauugaugggaugacacaggaggacgccaccuguaagccggugacguaugcuggagccugcagcuccuuugauguccugcucgaaaaaggcaaguucccccuguuucagagcuacgcgcaccaucggacccuucuggaggccgugcacgacacaaucaucgcuaaagccgauccucccucuugugaccuccaguccgcucacgggaauccuugcaugaaggagaagcuggugaugaaaacccauugucccaacgauuaucaaagcgcccacuaccugaauaacgacggaaagauggccucugucaaaugcccgccuaaguauggccucacagaagacuguaauuucugccgccagaugaccggggcuucccugaaaaagggaagcuacccccuucaggaucuguuuugccaguccucugaggacgauggcagcaaacucaagacgaagaugaaaggcguuugugaagugggggugcaagcgcauaagaaaugcgacggacagcuguccacagcccacgaggucgugccuuucgcuguuuuuaagaacagcaaaaagguguaccuugauaagcuggaccucaaaaccgaagagaaucugcugcccgauucuuucgucuguuuugagcacaagggccaguauaaagggacaauggacuccggacagaccaagagagaacucaaaucuuucgauauuucucaaugccccaagaucggcgggcauggaagcaagaaauguaccggcgacgccgccuuuugcuccgcuuacgaguguacagcccaguaugcgaacgcuuacugcucucacgccaauggcagcgggauugugcagauccaaguuuccggaguguggaagaaaccucugugugucggcuaugaacggguggucgugaagcgcgagcuuagcgccaaaccgauucagagaguugaacccugcacgaccuguaucacaaagugcgagccucaugggcuggugguccggucuaccggauucaagaucuccagcgcuguggccugcgcuucuggcguuugugugacagggucccagagccccuccaccgagauuacgcucaaauacccuggcaucucucagagcuccggaggcgauauugggguccacauggcccaugacgaccaaucugugagcuccaagaucguggcgcacugucccccgcaggauccuugccugguucacggaugcauugucugugcccauggccuuaucaacuaucagugccacacagcucugagcgccuucgugguggucuuuguguucucuuccaucgcuauuaucugucucgccguucuguacagagugcugaaaugccucaagauugcgccccgcaaaguccugaauccucuuauguggaucaccgccuuuauucgguggaucuacaagaaaaugguggcuagaguugcccauaacauuaaccaggugaaucgcgaaaucggguggauggagggaggccaacugguccucgggaaccccgcuccuaucccccggcacgccccgauuccuagauauagcaccuaccugaugcugcuucucaucgugucuuaugccuccgcuuguagcgaacugauucaggcgucuagccgcaucacaaccugcuccacagagggcguuaauacgaagugucggcugagcggaaccgcccucauuagagcuggcucugugggggccgaggccugccugaugcuuaagggagucaaagaagaccagacaaaguuccugaaaaucaagaccguguccagcgagcucuccugccgcgaaggccagucuuacuggacagggagcaucucccccaaaugucugucuagccggagaugccaccuggugggagagugucaugucaaccgcugccuuuccuggcgggauaaugaaaccucugcugaguuuagcuucguuggcgaguccacgaccaugagagaaaacaaguguuuugagcaaugcgggggcuggggauguggcugcuucaaugugaaccccagcugucucuuugugcacacauaucugcagucuguccggaaggaagcccugcgcguguucaauugcauugacuggguucauaaacucacccuggagaucacagauuuugacggguccgugagcaccauugaucuuggagcgucuuccagcagauucacgaacuggggcucugucucccugagccucgacgcugaagggaucuccggaagcaauucuuuuagcuucauugaguccccuucuaagggcuacgccaucguggaugagccguucagcgaaaucccccggcagggguuucugggcgagauuagauguaacuccgaaucuagcguucuguccgcccacgagucuugccuucgcgcuccuaaucucaucagcuauaaacccaugauugaccagcuggaaugcacaaccaaccugaucgauccuuucguggucuuugagcggggaucccucccccaaacaagaaaugacaagaccuucgccgcgagcaaaggcaaccgcggggugcaggcuuuuucuaagggauccguucaggccgaucugacccuuauguucgacaacuuugagguggacuucgucggcgccgcugugagcugugaugccgcuuuucugaaucucacagggugcuacucuuguaacgccggagcgagagugugccuguccauuacgagcaccggcacaggcucccugucugcccauaauaaggacgggagccuucacaucguccucccuuccgaaaacggaaccaaagaucaaugucagauccugcacuucacaguucccgagguggaagaggaguuuauguacagcugcgacggcgaugaacggccgcugcucgugaaggggacccugauugcuaucgacccuuucgaugaccgcagagaggccggaggcgaaucuacggucgugaaucccaaauccgggagcuggaacuuuuucgauugguucucuggacuuaugagcugguuuggcggcccucugaagcucuauuccucuuucgcuuguaugcugcauuaccagcuggggagcuuuuccucucuuuauauucuggaggaacaggccagccucaaaugcggacugcucccccugcggcgcccgcacagauccguucgggugaaggucaucuguuga

SEQ ID NO: 14452 - RNA, 3480 nt, Artificial Sequence
  derived and/or modified CDS sequence (opt5) from RVFV(ZH-548)__DQ380206.1__NSm-Gn-Gc
augaucgagggcgccugggacagccugagagaagaggaaaugcccgaggaacucuccugcucuauuagcgggauccgggaggugaagaccuccucucaggagcuguaccgcgcucuuaaagccauuaucgcggcugauggacugaauaauauuacaugucacggcaaggacccugaagauaaaaucagccucaucaaggggccgccccauaaaaagagagucggaauuguucggugcgagcgcagacgggacgccaagcaaaucggccgcgaaacgauggccgggauugcuaugaccgugcugccugcccuugcuguguucgcccuggcgcccgucguguuugccgaggauccucaccucagaaaccggcccggaaaaggccauaauuauaucgacggcaugacacaggaggaugcuaccuguaagccuguuacauacgccggggcuugcuccucuuucgacgugcugcuggaaaaaggaaaguuuccccucuuccagagcuaugcccaccaucgcacccugcuugaggcgguccacgauacaauuaucgccaaagcugacccgccuuccugugaucugcucagcgcccacggcaaccccugcaugaaggaaaagcuggugaugaaaacccauuguccuaaugacuaccagucugcucacuaucuuaacaaugaugggaagauggccuccguuaaaugucccccgaaguacgagcugacggaagacugcaacuuuugcagacaaaugaccggagccagccucaaaaagggcucuuauccucugcaggaccuguucugucaguccagcgaggaugacgggucuaaacucaagacaaagaugaaaggagugugcgaggucggcgugcaggcucugaagaaaugcgauggccaacuuuccaccgcgcaugaagugguccccuuugccguuuucaagaauagcaaaaagguguaccuggacaagcucgaucugaaaacagaggaaaaccuucugccugacuccuuuguguguuucgagcacaaggggcaguacaaaggaaccauggauucuggccagacgaagcgggaacucaaauccuuugacauuucccagugccccaagaucgggggacacggcagcaagaaauguacaggggaugcugccuucugcucugccuaugaguguaccgcucaauacgccaaugcguauugcucccaugcuaacggaagcggcaucguccagauucaggugucuggcguuuggaagaaaccccugugugugggguacgagcgcgucgugguuaagagagaacugagcgccaaaccuauccaacggguggagccgugcacaaccuguauuaccaagugcgaaccccacggacucgucgugcgcuccacaggcuuuaagaucucuagcgccgucgcuugugccuccggggugugcguuacgggaagccagucuccuuccaccgagauuacacugaaauaucccggcaucagccagucuuccgggggcgacaucggagugcauauggcucacgaugaccagagcgucuccucuaagauuguggcccauugcccuccccaagacccgugucuuguucacgauugcaucgugugugcgcacggccugauuaauuaccagugccauaccgcccucagcgcuuucgucgugguguucguuuuuagcucuaucgccauuaucugucuggcuauccuuuauagaguccugaaaugccucaagauugccccucggaaagugcugaacccccugauguggaucacagcguucauuagauggaucuacaagaaaaugguggcccgcgucgcugacaauauuaaccaggugaaccgggaaaucggguggauggagggaggccagcucguucuggggaauccugcccccauuccuagacacgcucccaucccgcgcuacagcaccuaucuuaugcugcuccugaucguguccuacgccagcgccuguucugagcugauucaggcuuccagccggaucacgacaugcucuaccgaaggagucaacaccaaguguagacuuuccggcacagcgcucauucgcgccgggagcgugggcgcugaggccugccugaugcugaagggaguuaaagaagaucaaaccaaguuucucaaaaucaagacagugucuagcgagcuguccugucgggagggccagagcuauuggacggggucuuucuccccuaaaugccuuagcuccagacgcugccaucuggucggagaaugucacgugaaucggugccucucuuggagagacaacgagaccagcgccgaauuuuccuucguuggcgagucuacaaccaugcgcgaaaauaaguguuuugagcagugcgggggauggggcugugggugcuucaacgugaaucccagcugucuguuuguccacacauaccugcaauccgugcggaaggaggcucuuagaguguucaacugcauugauuggguccauaaacucacccuggaaaucacggacuuugauggcucuguuagcaccaucgaccugggagccuccagcucucgguucacaaauuggggcuccgugagccucucucuggaugcggaggggauuuccggaagcaacucuuuuuccuucaucgaaagccccggcaagggguaugcuauuguggacgagccuuucuccgaaaucccgcgccagggauuucuuggcgagauuagauguaauagcgagucuagcguccuguccgcccacgaaucuugccuccgggcccccaaccugaucagcuacaaaccuaugaucgaucagcuggaguguaccacaaaucuuauugaccccuucgugguuuuugaaagagggucccucccucagacccgcaacgauaagacguucgcugccucuaaaggcaaucggggagugcaagcguuuagcaagggcuccguccaggcugaccugacacugauguucgacaacuuugagguggauuucguuggggccgccgugucuugcgacgcugccuuucucaaccugaccggaugcuauagcuguaaugcuggcgccagagucugccuuuccaucacaagcaccgggaccggaucucuguccgcgcauaacaaggauggcagccuccacauugugcugcccucugaaaauggcacaaaagaccagugucaaauccugcauuucacgguuccugagguggaggaagaguuuauguacuccugcgauggggacgaacgcccccuucucgucaagggaacccugauugccaucgauccguucgacgauagacgggaggcuggcggggagagcacaguggugaacccuaaauccggaucuuggaacuuuuucgacugguucagcggccugauguccugguuugggggaccccucaagaccauccugcuuauuugucuguacgucgcccucagcaucggccuguucuuucugcuuauuuaucugggccgcacagggcucucuaaaauguggcuggcugccaccaagaaggccuccuga

SEQ ID NO: 14453 - RNA, 3480 nt, Artificial Sequence
  derived and/or modified CDS sequence (opt5) from RVFV(ZS-6365)__DQ380205.1__NSm-Gn-Gc
augaucgagggcgccugggacagccugagagaagaggaaaugcccgaggaacucuccugcucuauuagcgggauccgggaggugaagaccuccucucaggagcuguaccgcgcucuuaaagccauuaucgcggcugauggacugaauaauauuacaugucacggcaaggacccugaagauaaaaucagccucaucaaggggccgccccauaaaaagagagucggaauuguucggugcgagcgcagacgggacgccaagcaaaucggccgcgaaacgauggccgggauugcuaugaccgugcugccugcccuugcuguguucgcccuggcgcccgucguguuugccgaggauccucaccucagaaaccggcccggaaaaggccauaauuauaucgacggcaugacacaggaggaugcuaccuguaagccuguuacauacgccggggcuugcuccucuuucgacgugcugcuggaaaaaggaaaguuuccccucuuccagagcuaugcccaccaucgcacccugcuugaggcgguccacgauacaauuaucgccaaagcugacccgccuuccugugaucugcagagcgcccacggcaaccccugcaugaaggaaaagcucgugaugaaaacccauuguccuaaugacuaccaaucugcucacuaucugaacaaugaugggaagauggccuccguuaaaugucccccgaaguacgagcuuacggaagacugcaacuuuugcagacagaugaccggagccagccugaaaaagggcucuuauccucuccaggaccuguucugucaguccagcgaggaugacgggucuaaacugaagacaaagaugaaaggagugugcgaggucggcgugcaagcucucaagaaaugcgauggccagcuguccaccgcgcaugaagugguccccuuugccguuuucaagaauagcaaaaagguguaccuugacaagcuggaucucaaaacagaggaaaaccugcuuccugacuccuuuguguguuucgagcacaaggggcaguacaaaggaaccauggauucuggccagacgaagcgggaacugaaauccuuugacauuucccaaugccccaagaucgggggacacggcagcaagaaauguacaggggaugcugccuucugcucugccuaugaguguaccgcucaguacgccaaugcguauugcucccaugcuaacggaagcggcaucguccagauucaagugucuggcguuuggaagaaaccccucugugugggguacgagcgcgucgugguuaagagagaacugagcgccaaaccuauccagcggguggagccgugcacaaccuguauuaccaagugcgaaccccacggacuggucgugcgcuccacaggcuuuaagaucucuagcgccgucgcuugugccuccggggugugcguuacgggaagccagucuccuuccaccgagauuacacucaaauaucccggcaucagccagucuuccgggggcgacaucggagugcauauggcucacgaugaccaaagcgucuccucuaagauuguggcccauugcccuccccaggacccgugucugguucacggcugcaucgugugugcgcacgggcuuauuaauuaccagugccauaccgcccugagcgcuuucgucgugguguucguuuuuagcucuaucgccauuaucugucucgcuauccuguauagaguccuuaaaugccugaagauugccccucggaaagugcucaacccccugauguggaucacagcguucauuagauggaucuacaagaaaaugguggcccgcgucgcugauaauauuaaccaggugaaccgggaaaucggauggauggagggcgggcaacugguucucggaaauccugcccccauuccuagacacgcucccaucccgcgcuacagcaccuaucugaugcuucugcucaucguguccuacgccagcgccuguucugagcugauucaggcuuccagccggaucacgacaugcucuaccgaaggcgucaacaccaaguguagacuguccgggacagcgcuuauucgcgccggcagcgugggagcugaggccugccucaugcugaagggcguuaaagaagaccagaccaaguuucugaaaaucaagacagugucuagcgagcucuccugucgggaggggcagagcuauuggacgggaucuuucuccccuaaaugccugagcuccagacgcugccaucuugucggcgaaugucacgugaaucggugccugucuuggagagauaacgagaccagcgccgaauuuuccuucguuggggagucuacaaccaugcgcgaaaauaaguguuuugagcaaugcggaggcuggggguguggcugcuucaacgugaaucccagcugucucuuuguccacacauaccugcaguccgugcggaaggaggcucugagaguguucaacugcauugacuggguccauaaacuuacccucgaaaucacggauuuugacggaucuguuagcaccaucgaucugggcgccuccagcucucgguucacaaauuggggguccgugagccugucucucgacgcggagggaauuuccggcagcaacucuuuuuccuucaucgaaagccccgggaagggauaugcuauuguggaugagccuuucuccgaaaucccgcgccagggcuuucugggggagauuagauguaauagcgagucuagcguccuuuccgcccacgaaucuugccugcgggcccccaaccucaucagcuacaaaccuaugaucgaccagcuggaguguaccacaaaucugauugaucccuucgugguuuuugaaagaggcucccuuccucaaacccgcaacgacaagacguucgcugccucuaaaggaaaucggggcgugcaggcguuuagcaagggguccguccaggcugaucucacacugauguucgacaacuuugagguggacuucguuggagccgccgugucuugcgaugcugccuuucugaaccucaccggcugcuauagcuguaaugcuggggccagagucugccuguccaucacaagcaccggaaccggcucucuuuccgcgcauaacaaggacggcagccugcacauugugcuccccucugaaaaugggacaaaagaucaaugucagauccugcauuucacgguuccugagguggaggaagaguuuauguacuccugcgacggagaugaacgcccccugcuugucaagggcacccucauugccaucgacccguucgaugacagacgggaggcugggggagagagcacaguggugaacccuaaauccggcucuuggaacuuuuucgauugguucagcgggcugauguccugguuuggaggcccccugaagaccauccuccugauuugucuuuacgucgcccugagcaucggccucuucuuucugcugauuuaucuugggcgcacaggacugucuaaaauguggcucgcugccaccaagaaggccuccuga

SEQ ID NO: 14454 - RNA, 3480 nt, Artificial Sequence
  derived and/or modified CDS sequence (opt5) from RVFV(MP-12)__DQ380208.1__NSm-Gn-Gc
augaucgagggcgccugggacagccugagagaagaggaaaugcccgaggaacucuccugcucuauuagcgggauccgggaggugaagaccuccucucaggagcuguaccgcgcucuuaaagccauuaucgcggcugauggacugaauaauauuacaugucacggcaaggacccugaagauaaaaucagccucaucaaggggccgccccauaaaaagagagucggaauuguucggugcgagcgcagacgggacgccaagcaaaucggccgcgaaacgauggccgggauugcuaugaccgugcugccugcccuugcuguguucgcccuggcgcccgucguguuugccgaggauccucaccucagaaaccggcccggaaaaggccauaauuauaucgacggcaugacacaggaggaugcuaccuguaagccuguuacauacgccggggcuugcuccucuuucgacgugcugcuggaaaaaggaaaguuuccccucuuccagagcuaugcccaccaucgcacccugcuugaggcgguccacgauacaauuaucgccaaagcugacccgccuuccugugaucugcucagcgcccacggcaaccccugcaugaaggaaaagcuggugaugaaaacccauuguccuaaugacuaccagucugcucaccaucuuaacaaugaugggaagauggccuccguuaaaugucccccgaaguaugagcugacggaagacugcaacuuuugcagacaaaugaccggagccagccucaaaaagggcucuuacccucugcaggaccuguucugucaguccagcgaggaugacgggucuaaacucaagacaaagaugaaaggagugugcgaggucggcgugcaggcucugaagaaaugcgauggccaacuuuccaccgcgcacgaagugguccccuuugccguuuucaagaauagcaaaaagguguaucuggacaagcucgaucugaaaacagaggaaaaccuucugccugacuccuuuguguguuucgagcacaaggggcaguacaaaggaaccauggauucuggccagacgaagcgggaacucaaauccuuugacauuucccagugccccaagaucgggggacauggcagcaagaaauguacaggggaugcugccuucugcucugccuacgaguguaccgcucaauaugccaaugcguacugcucccacgcuaacggaagcggcaucguccagauucaggugucuggcguuuggaagaaaccccugugugugggguaugagcgcgucgugguuaagagagaacugagcgccaaaccuauccaacggguggagccgugcacaaccuguauuaccaagugcgaaccccauggacucgucgugcgcuccacaggcuuuaagaucucuagcgccgucgcuugugccuccggggugugcguuacgggaagccagucuccuuccaccgagauuacacugaaauaccccggcaucagccagucuuccgggggcgacaucggagugcacauggcucaugaugaccagagcgucuccucuaagauuguggcccacugcccuccccaagacccgugucuuguucacgauugcaucgugugugcgcauggccugauuaauuaucagugccacaccgcccucagcgcuuucgucgugguguucguuuuuagcucuaucgccauuaucugucuggcuauccuuuacagaguccugaaaugccucaagauugccccucggaaagugcugaacccccugauguggaucacagcguucauuagauggaucuauaagaaaaugguggcccgcgucgcugacaauauuaaccaggugaaccgggaaaucggguggauggagggaggccagcucguucuggggaauccugcccccauuccuagacaugcucccaucccgcgcuacagcaccuaccuuaugcugcuccugaucguguccuaugccagcgccuguucugagcugauucaggcuuccagccggaucacgacaugcucuaccgaaggagucaacaccaaguguagacuuuccggcacagcgcucauucgcgccgggagcgugggcgcugaggccugccugaugcugaagggaguuaaagaagaucaaaccaaguuucucaaacugaagacagugucuagcgagcuuuccugucgggagggccagagcuacuggacggggucuuucuccccuaaaugccugagcuccagacgcugccaccucgucggagaaugucacgugaaucggugccugucuuggagagacaacgagaccagcgccgaauuuuccuucguuggcgagucuacaaccaugcgcgaaaauaaguguuuugagcagugcgggggauggggcugugggugcuucaacgugaaucccagcugucuguuuguccauacauaucuucaauccgugcggaaggaggcucucagaguguucaacugcaucgauuggguccacaaacugacccuggaaauuacggacuuugauggcucuguuagcaccaucgaccucggagccuccagcucucgguucacaaauuggggcuccgugagccugucucuugaugcggaggggaucuccggaagcaacucuuuuuccuucauugaaagccccggcaagggguacgcuaucguggacgagccuuucuccgaaauuccgcgccagggauuucugggcgagaucagauguaauagcgagucuagcguccucuccgcccaugaaucuugccugcgggcccccaaccugauuagcuauaaaccuaugaucgaucagcuugaguguaccacaaaucucaucgaccccuucgugguuuuugaaagagggucccugccucagacccgcaacgauaagacguucgcugccucuaaaggcaaucggggagugcaagcguuuagcaagggcuccguccaggcugaccugacacucauguucgacaacuuugagguggauuucguuggggccgccgugucuugcgacgcugccuuucugaaccuuaccggaugcuacagcuguaaugcuggcgccagagucugccuguccauuacaagcaccgggaccggaucucucuccgcgcacaacaaggauggcagccugcauaucgugcugcccucugaaaauggcacaaaagaccagugucaaauucuucacuucacgguuccugagguggaggaagaguuuauguauuccugcgauggggacgaacgcccccuccuggucaagggaacccugaucgccauugauccguucgacgauagacgggaggcuggcggggagagcacaguggugaacccuaaauccggaucuuggaacuuuuucgacugguucagcggccucauguccugguuugggggaccccugaagaccauccuucugaucugucucuacgucgcccugagcauuggccuguucuuucuucugaucuaccucggcgggacaggacugucuaaaauguggcucgcugccaccaagaaggccuccuga

SEQ ID NO: 14455 - RNA, 3480 nt, Artificial Sequence
  derived and/or modified CDS sequence (opt5) from RVFV(T1)__DQ380201.1__NSm-Gn-Gc
augaucgagggcgccugggacagccugagagaagaggaaaugcccgaggaacucuccugcucuauuagcgggauccgggaggugaagaccuccucucaggagcuguaccgcgcucuuaaagccauuaucgcggcugauggacugaauaauauuacaugucacggcaaggacccugaagauaaaaucagccucaucaaggggccgccccauaaaaagagagucggaauuguucggugcgagcgcagacgggacgccaagcaaaucggccgcgaaacgauggccgggauugcuaugaccgugcugccugcccuugcuguguucgcccuggcgcccgucguguuugccgaggauccucaccucagaaaccggcccggaaaaggccauaauuauaucgacggcaugacacaggaggaugcuaccuguaagccuguuacauacgccggggcuugcuccucuuucgacgugcugcuggaaaaaggaaaguuuccccucuuccagagcuaugcccaccaucgcacccugcuugaggcgguccacgauacaauuaucgccaaagcugacccgccuuccugugaucugcagagcgcccacggcaaccccugcaugaaggaaaagcucgugaugaaaacccauuguccuaaugacuaccaaucugcucacuaucugaacaaugaugggaagauggccuccguuaaaugucccccgaaguacgagcuuacggaagacugcaacuuuugcagacagaugaccggagccagccugaaaaagggcucuuauccucuccaggaccuguucugucaguccagcgaggaugacgggucuaaacugaagacaaagaugaaaggagugugcgaggucggcgugcaagcucucaagaaaugcgauggccagcuguccaccgcgcaugaagugguccccuuugccguuuucaagaauagcaaaaagguguaccuugacaagcuggaucucaaaacagaggaaaaccugcuuccugacuccuuuguguguuucgagcacaaggggcaguacaaaggaaccauggauucuggccagacgaagcgggaacugaaauccuuugacauuucccaaugccccaagaucgggggacacggcagcaagaaauguacaggggaugcugccuucugcucugccuaugaguguaccgcucaguacgccaaugcguauugcucccaugcuaacggaagcggcaucguccagauucaagugucuggcguuuggaagaaaccccucugugugggguacgagcgcgucgugguuaagagagaacugagcgccaaaccuauccagcggguggagccgugcacaaccuguauuaccaagugcgaaccccacggacuggucgugcgcuccacaggcuuuaagaucucuagcgccgucgcuugugccuccggggugugcguuacgggaagccagucuccuuccaccgagauuacacucaaauaucccggcaucagccagucuuccgggggcgacaucggagugcauauggcucacgaugaccaaagcgucuccucuaagauuguggcccauugcccuccccaggacccgugucugguucacggcugcaucgugugugcgcacgggcuuauuaauuaccagugccauaccgcccugagcgcuuucgucgugguguucguuuuuagcucuaucgccauuaucugucucgcuguccuguauagagugcuuaaaugccugaagaucgccccucggaaagugcucaacccccugauguggauuacagcguucaucagauggauuuacaagaaaauggucgcccgcguggcugauaauaucaaccagguuaaccgggaaauuggauggauggagggcgggcaacuggugcucggaaauccugcccccaucccuagacacgcucccauuccgcgcuacagcaccuaucugaugcuucugcucaucgucuccuacgccagcgccuguucugagcugauccaggcuuccagccggauuacgacaugcucuaccgaaggcgugaacaccaaguguagacuguccgggacagcgcuuauccgcgccggcagcguuggagcugaggccugccucaugcugaagggcgugaaagaagaccagaccaaguuucugaaaauuaagacagucucuagcgagcucuccugucgggaggggcagagcuauuggacgggaucuuucuccccuaaaugccugagcuccagacgcugccaucuugugggcgaaugucacguuaaucggugccugucuuggagagauaacgagaccagcgccgaauuuuccuucgugggggagucuacaaccaugcgcgaaaauaaguguuuugagcaaugcggaggcuggggguguggcugcuucaacgucaaucccagcugucucuuugugcacacauaccugcaguccgugcggaaggaggcucugagagucuucaacugcaucgacuggguucauaaacuuacccucgaaauuacggauuuugacggaucugugagcaccaucgaucugggcgccuccagcucucgguucacaaauuggggguccgugagccugucucucgacgcggagggaaucuccggcagcaacucuuuuuccuucauugaaagccccgggaagggauaugcuaucgucgaugagccuuucuccgaaauuccgcgccagggcuuucugggggagaucagauguaauagcgagucuagcgugcuuuccgcccacgaaucuugccugcgggcccccaaccucauuagcuacaaaccuaugaucgaccagcuggaguguaccacaaaucugaucgaucccuucguuguguuugaaagaggcucccuuccucaaacccgcaacgacaagacguucgcugccucuaaaggaaaucggggcguccaggcguuuagcaagggguccgugcaggcugaucucacacugauguucgacaacuuugagguugacuucgugggagccgccgucucuugcgaugcugccuuucugaaccucaccggcugcuauagcuguaaugcuggggccagagugugccuguccauuacaagcaccggaaccggcucucuuuccgcgcauaacaaggacggcagccugcacaucguucuccccucugaaaaugggacaaaagaucaaugucagauucugcauuucacggugccugaggucgaggaagaguuuauguacuccugcgacggagaugaacgcccccugcuugugaagggcacccucaucgccauugacccguucgaugacagacgggaggcugggggagagagcacaguggucaacccuaaauccggcucuuggaacuuuuucgauugguucagcgggcugauguccugguuuggaggcccccugaagaccauccuccugaucugucuuuacguugcccugagcauuggccucuucuuucugcugaucuaucuugggcgcacaggacugucuaaaauguggcucgcugccaccaagaaggccuccuga

SEQ ID NO: 14456 - RNA, 3480 nt, Artificial Sequence
  derived and/or modified CDS sequence (opt5) from RVFV(1853/78)__DQ380220.1__NSm-Gn-Gc
augaucgagggcgccugggacagccugagagaagaggaaaugcccgaggaacucuccugcucuauuagcgggauccgggaggugaagaccuccucucaggagcuguaccgcgcucuuaaagccauuaucgcggcugauggacugaauaauauuacaugucacggcaaggacccugaagauaaaaucagccucaucaaggggccgccccauaaaaagagagucggaauuguucggugcgagcgcagacgggacgccaagcaaaucggccgcgaaacgauggccgggauugcuaugaccgugcugccugcccuugcuguguucgcccuggcgcccgucguguuugccgaggauccucaccucagaaaccggcccggaaaaggccauaauuauaucgacggcaugacacaggaggaugcuaccuguaagccuguuacauacgccggggcuugcuccucuuucgacgugcugcuggaaaaaggaaaguuuccccucuuccagagcuaugcccaccaucgcacccugcuugaggcgguccacgauacaauuaucgccaaagcugacccgccuuccugugaucugcagagcgcccacggcaaccccugcaugaaggaaaagcucgugaugaaaacccauuguccuaaugacuaccaaucugcucacuaucugaacaaugaugggaagauggccuccguuaaaugucccccgaaguacgagcuuacggaagacugcaacuuuugcagacagaugaccggagccagccugaaaaagggcucuuauccucuccaggaccuguucugucaguccagcgaggaugacgggucuaaacugaagacaaagaugaaaggagugugcgaggucggcgugcaagcucucaagaaaugcgauggccagcuguccaccgcgcaugaagugguccccuuugccguuuucaagaauagcaaaaagguguaccuugacaagcuggaucucaaaacagaggaaaaccugcuuccugacuccuuuguguguuucgagcacaaggggcaguacaaaggaaccauggauucuggccagacgaagcgggaacugaaauccuuugacauuagccaaugccccaagaucgggggacacggcagcaagaaauguacaggggaugcugccuucugcucugccuaugaguguaccgcucaguacgccaaugcguauugcucccaugcuaacggaagcggcgucgugcagauccaaguuucuggcguguggaagaaaccccucugugucggguacgagcgcgugguugugaagagagaacugagcgccaaaccuauucagcgggucgagccgugcacaaccuguaucaccaagugcgaaccccacggacuggugguccgcuccacaggcuuuaagauuucuagcgccguggcuugugccuccgggguuugcgugacgggaagccagucuccuuccaccgagaucacacucaaauaucccggcauuagccagucuuccgggggcgacaucggaguccauauggcucacgaugaccaaagcguguccucuaagaucguugcccauugcccuccccaggacccgugucuggugcacggcugcauugucugugcgcacgggcuuaucaauuaccagugccauaccgcccugagcgcuuucguggugguuuucgucuuuuccucuauugccaucauuugucucgcuauccuguauagagugcuuaaaugccugaagaucgccccucggaaagugcucaacccccugauguggauuacagcguucaucagaugggucuacaagaaaaugguggcccgcguugcugauaauauuaaccaggugaaccgggaaaucggauggauggagggcgggcaacugguccucggaaauccugcccccauuccuagacacgcucccaucccgcgcuacagcaccuaucugaugcuucugcucauuguguccuacgccagcgccuguucugagcugauccaggcuuccagccggaucacgacaugcucuaccgaaggcguuaacaccaaguguagacuguccgggacagcgcuuauucgcgccggcagcgugggagcugaggccugccucaugcugaagggcgucaaagaagaccagaccaaguuucugaaaaucaagacagugucuagcgagcucuccugucgggaggggcagagcuauuggacgggaucuuucuccccuaaaugccugagcuccagacgcugccaucuuguuggcgaaugucacgugaaucggugccugucuuggagagauaacgagaccagcgccgaauuuuccuucgucggggagucuacaaccaugcgcgaaaauaaguguuuugagcaaugcggaggcuggggguguggcugcuucaacgugaaucccagcugucucuuugugcacacauaccugcaguccguccggaaggaggcucugagaguuuucaacugcauugacugggugcauaaacuuacccucgaaaucacggauuuugacggaucugugagcaccauugaucugggcgccuccagcucucgguucacaaauuggggguccgucagccugucucucgacgcggagggaaucuccggcagcaacucuuuuuccuucaucgaaagccccgggaagggauaugcuauuguggaugagccuuucuccgaaaucccgcgccagggcuuucugggggagauuagauguaauagcgagucuagcguucuuuccgcccacgaaucuugccugcgggcccccaaccucaucagcuacaaaccuaugauugaccagcuggaguguaccacaaaucugaucgaucccuucguggucuuugaaagaggcucccuuccucaaacccgcaacgacaagacguucgcugccucuaaaggaaaucggggcgugcaggcguuuagcaagggguccguucaggcugaucucacacugauguucgacaacuuugagguggacuucgucggagccgccgugucuugcgaugcugccuuucugaaccucaccggcugcuauagcuguaaugcuggggccagaguuugccuguccaucacaagcaccggaaccggcacacuuucugcgcauaacaaggacggcucccugcacauugugcuccccagcgaaaaugggacgaaagaucaaugucagauccugcauuucaccgucccugagguggaggaagaguuuauguacucuugcgacggagaugaacgcccccugcuugugaagggcacacucauugccaucgacccguucgaugacagacgggaggcugggggagaguccaccgucguuaacccuaaaagcggcuccuggaacuuuuucgauugguucucugggcugaugagcugguuuggaggcccccugaagacaauucuccugaucugucuuuacguggcccuguccaucggccucuucuuucugcugauuuaucuugggcgcaccggacugagcaaaauguggcucgcugccacgaagaaggccucuuga

SEQ ID NO: 14457 - RNA, 3480 nt, Artificial Sequence
  derived and/or modified CDS sequence (opt5) from RVFV(CAR-R1622)__DQ380219.1__NSm-Gn-Gc
augaucgagggcgccugggacagccugagagaagaggaaaugcccgaggaacucuccugcucuauuagcgggauccgggaggugaagaccuccucucaggagcuguaccgcgcucuuaaagccauuaucgcggcugauggacugaauaauauuacaugucacggcaaggacccugaagauaaaaucagccucaucaaggggccgccccauaaaaagagagucggaauuguucggugcgagcgcagacgggacgccaagcaaaucggccgcgaaacgauggccgggauugcuaugaccgugcugccugcccuugcuguguucgcccuggcgcccgucguguuugccgaggauccucaccucagaaaccggcccggaaaaggccauaauuauaucgacggcaugacacaggaggaugcuaccuguaagccuguuacauacgccggggcuugcuccucuuucgacgugcugcuggaaaaaggaaaguuuccccucuuccagagcuaugcccaccaucgcacccugcuugaggcgguccacgauacaauuaucgccaaagcugacccgccuuccugugaucugcagagcgcccacggcaaccccugcaugaaggaaaagcucgugaugaaaacccauuguccuaaugacuaccaaucugcucacuaucugaacaaugaugggaagauggccuccguuaaaugucccccgaaguacgagcuuacggaagacugcaacuuuugcagacagaugaccggagccagccugaaaaagggcucuuauccucuccaggaccuguucugucaguccagcgaggaugacgggucuaaacugaagacaaagaugaaaggagugugcgaggucggcgugcaagcucucaagaaaugcgauggccagcuguccaccgcgcaugaagugguccccuuugccguuuucaagaauagcaaaaagguguaccuugacaagcuggaucucaaaacagaggaaaaccugcuuccugacuccuuuguguguuucgagcacaaggggcaguacaaaggaaccauggauucuggccagacgaagcgggaacugaaauccuuugacauuucccaaugccccaagaucgggggacacggcagcaagaaauguacaggggaugcugccuucugcucugccuaugaguguaccgcucaguacgccaaugcguauugcucccaugcuaacggaagcggcaucguccagauucaagugucuggcguuuggaagaaaccccucugugugggguacgagcgcgucgugguuaagagagaacugagcgccaaaccuauccagcggguggagccgugcacaaccuguauuaccaagugcgaaccccacggacuggucgugcgcuccacaggcuuuaagaucucuagcgccgucgcuugugccuccggggugugcguuacgggaagccagucuccuuccaccgagauuacacucaaauaucccggcaucagccagucuuccgggggcgacaucggagugcauauggcucacgaugaccaaagcgucuccucuaagauuguggcccauugcccuccccaggacccgugucugguucacggcugcaucgugugugcgcacgggcuuauuaauuaccagugccauaccgcccugagcgcuuucgucgugguguucguuuuuagcucuaucgccauuaucugucucgcuauccuguauagaguccuuaaaugccugaagauugccccucggaaagugcucaacccccugauguggaucacagcguucauuagauggguguacaagaaaauggucgcccgcguggcugauaauaucaaccagguuaaccgggaaauuggauggauggagggcgggcaacuggugcucggaaauccugcccccaucccuagacacgcucccauuccgcgcuacagcaccuaucugaugcuucugcucaucgucuccuacgccagcgccuguucugagcugauccaggcuuccagccggauuacgacaugcucuaccgaaggcgugaacaccaaguguagacuguccgggacagcgcuuauccgcgccggcagcguuggagcugaggccugccucaugcugaagggcgugaaagaagaccagaccaaguuucugaaaauuaagacagucucuagcgagcucuccugucgggaggggcagagcuauuggacgggaucuuucuccccuaaaugccugagcuccagacgcugccaucuugugggcgaaugucacguuaaucggugccugucuuggagagauaacgagaccagcgccgaauuuuccuucgugggggagucuacaaccaugcgcgaaaauaaguguuuugagcaaugcggaggcuggggguguggcugcuucaacgucaaucccagcugucucuuugugcacacauaccugcaguccgugcggaaggaggcucugagagucuucaacugcaucgacuggguucauaaacuuacccucgaaauuacggauuuugacggaucugugagcaccaucgaucugggcgccuccagcucucgguucacaaauuggggguccgugagccugucucucgacgcggagggaaucuccggcagcaacucuuuuuccuucauugaaagccccgggaagggauaugcuaucgucgaugagccuuucuccgaaauuccgcgccagggcuuucugggggagaucagauguaauagcgagucuagcgugcuuuccgcccacgaaucuugccugcgggcccccaaccucauuagcuacaaaccuaugaucgaccagcuggaguguaccacaaaucugaucgaucccuucguuguguuugaaagaggcucccuuccucaaacccgcaacgacaagacguucgcugccucuaaaggaaaucggggcguccaggcguuuagcaagggguccgugcaggcugaucucacacugauguucgacaacuuugagguugacuucgugggagccgccgucucuugcgaugcugccuuucugaaccucaccggcugcuauagcuguaaugcuggggccagagugugccuguccauuacaagcaccggaaccggcacacuuucugcgcauaacaaggacggcucccugcacaucguucuccccagcgaaaaugggacgaaagaucaaugucagauucugcauuucaccgugccugaggucgaggaagaguuuauguacucuugcgacggagaugaacgcccccugcuugugaagggcacacucaucgccauugacccguucgaugacagacgggaggcugggggagaguccaccguggucaacccuaaaagcggcuccuggaacuuuuucgauugguucucugggcugaugagcugguuuggaggcccccugaagacaauccuccugaucugucuuuacguugcccuguccauuggccucuucuuucugcugaucuaucuugggcgcaccggacugagcaaaauguggcucgcugccacgaagaaggccucuuga

SEQ ID NO: 14458 - RNA, 3480 nt, Artificial Sequence
  derived and/or modified CDS sequence (opt5) from RVFV(2250/74)__DQ380209.1__NSm-Gn-Gc
augaucgagggcgccugggacagccugagagaagaggaaaugcccgaggaacucuccugcucuauuagcgggauccgggaggugaagaccuccucucaggagcuguaccgcgcucuuaaagccauuaucgcggcugauggacugaauaauauuacaugucacggcaaggacccugaagauaaaaucagccucaucaaggggccgccccauaaaaagagagucggaauuguucggugcgagcgcagacgggacgccaagcaaaucggccgcgaaacgauggccgggauugcuaugaccgugcugccugcccuugcuguguucgcccuggcgcccgucguguuugccgaggauccucaccucagaaaccggcccggaaaaggccauaauuauaucgacggcaugacacaggaggaugcuaccuguaagccuguuacauacgccggggcuugcuccucuuucgacgugcugcuggaaaaaggaaaguuuccccucuuccagagcuaugcccaccaucgcacccugcuugaggcgguccacgauacaauuaucgccaaagcugacccgccuuccugugaucugcagagcgcccacggcaaccccugcaugaaggaaaagcucgugaugaaaacccauuguccuaaugacuaccaaucugcucacuaucugaacaaugaugggaagauggccuccguuaaaugucccccgaaguacgagcuuacggaagacugcaacuuuugcagacagaugaccggagccagccugaaaaagggcucuuauccucuccaggaccuguucugucaguccagcgaggaugacgggucuaaacugaagacaaagaugaaaggagugugcgaggucggcgugcaagcucucaagaaaugcgauggccagcuguccaccgcgcaugaagugguccccuuugccguuuucaagaauagcaaaaagguguaccuugacaagcuggaucucaaaacagaggaaaaccugcuuccugacuccuuuguguguuucgagcacaaggggcaguacaaaggaaccauggauucuggccagacgaagcgggaacugaaauccuuugacauuucccaaugccccaagaucgggggacacggcagcaagaaauguacaggggaugcugccuucugcucugccuaugaguguaccgcucaguacgccaaugcguauugcucccaugcuaacggaagcggcaucguccagauucaagugucuggcguuuggaagaaaccccucugugugggguacgagcgcgucgugguuaagagagaacugagcgccaaaccuauccagcggguggagccgugcacaaccuguauuaccaagugcgaaccccacggacuggucgugcgcuccacaggcuuuaagaucucuagcgccgucgcuugugccuccggggugugcguuacgggaagccagucuccuuccaccgagauuacacucaaauaucccggcaucagccagucuuccgggggcgacaucggagugcauauggcucacgaugaccaaagcgucuccucuaagauuguggcccauugcccuccccaggacccgugucugguucacggcugcaucgugugugcgcacgggcuuauuaauuaccagugccauaccgcccugagcgcuuucgucgugguguucguuuuuagcucuaucgccauuaucugucucgcuauccuguauagaguccuuaaaugccugaagauugccccucggaaagugcucaacccccugauguggaucacagcguucauuagauggaucuacaagaaaaugguggcccgcgucgcugauaauauuaaccaggugaaccgggaaaucggauggauggagggcgggcaacugguucucggaaauccugcccccauuccuagacacgcucccaucccgcgcuacagcaccuaucugaugcuucugcucaucguguccuacgccagcgccuguucugagcugauucaggcuuccagccggaucacgacaugcucuaccgaaggcgucaacaccaaguguagacuguccgggacagcgcuuauucgcgccggcagcgugggagcugaggccugccucaugcugaagggcguuaaagaagaccagaccaaguuucugaaaaucaagacagugucuagcgagcucuccugucgggaggggcagagcuauuggacgggaucuuucuccccuaaaugccugagcuccagacgcugccaucuugucggcgaaugucacgugaaucggugccugucuuggagagauaacgagaccagcgccgaauuuuccuucguuggggagucuacaaccaugcgcgaaaauaaguguuuugagcaaugcggaggcuggggguguggcugcuucaacgugaaucccagcugucucuuuguccacacauaccugcaguccgugcggaaggaggcucugagaguguucaacugcauugacuggguccauaaacuuacccucgaaaucacggauuuugacggaucuguuagcaccaucgaucugggcgccuccagcucucgguucacaaauuggggguccgugagccugucucucgacgcggagggaauuuccggcagcaacucuuuuuccuucaucgaaagccccgggaagggauaugcuauuguggaugagccuuucuccgaaaucccgcgccagggcuuucugggggagauuagauguaauagcgagucuagcguccuuuccgcccacgaaucuugccugcgggcccccaaccucaucagcuacaaaccuaugaucgaccagcuggaguguaccacaaaucugauugaucccuucgugguuuuugaaagaggcucccuuccucaaacccgcaacgacaagacguucgcugccucuaaaggaaaucggggcgugcaggcguuuagcaagggguccguccaggcugaucucacacugauguucgacaacuuugagguggacuucguuggagccgccgugucuugcgaugcugccuuucugaaccucaccggcugcuauagcuguaaugcuggggccaaggucugccuguccaucacaagcaccggaaccggcucucuuuccgcgcauaacaaagacggcagccugcacauugugcuccccucugaaaaugggacaaaggaucaaugucagauccugcauuucacgguuccugagguggaggaagaguuuauguacuccugcgacggagaugaaagaccccugcuugucaaaggcacccucauugccaucgacccguucgaugaccgcagagaggcugggggagagagcacaguggugaacccuaaguccggcucuuggaacuuuuucgauugguucagcgggcugauguccugguuuggaggcccccugaaaaccauccuccugauuugucuuuacgucgcccugagcaucggccucuucuuucugcugauuuaucuugggcggacaggacugucuaagauguggcucgcugccaccaagaaagccuccuga

SEQ ID NO: 14459 - RNA, 3480 nt, Artificial Sequence
  derived and/or modified CDS sequence (opt5) from RVFV(2007000094)__EU574055.1__NSm-Gn-Gc
augaucgagggcgccugggacagccugagagaagaggaaaugcccgaggaacucuccugcucugugagcgggauucgggaggucaagaccuccucucaggagcuguaccgcgcucuuaaagccaucauugcggcugauggacugaacaauaucacaugucacggcaagaacccugaagacaaaauuagccucaucaaggggccgccccauaaaaagagaguuggaaucgugcggugcgagcgcagacgggaugccaagcaaauuggccgcgaaacgauggccgggaucgcuaugaccgugcugccugcccuugcugucuucgcccuggcgcccgugguuuuugccgaggacccucaccucagaaaucggcccggaaaaggccauaacuauauugauggcaugacacaggaggacgcuaccuguaagccugugacauacgccggggcuugcuccucuuucgauguccugcuggaaaaaggaaaguuuccccucuuccagagcuaugcccaccaucgcacccugcuugaggcggugcacgacacaaucauugccaaagcugaucccccuuccugugaccugcagagcgcccacggcaaucccugcaugaaggaaaagcucguuaugaaaacccauuguccuaacgauuaccaaucugcucacuaucugaauaacgacgggaagauggccuccgugaaaugcccgccgaaguacgagcuuacggaagauuguaauuuuugcagacagaugaccggagccagccugaaaaagggcucuuauccucuccaggaccuguucugucaguccagcgaggacgaugggucuaaacugaagacaaagaugaaaggagucugcgaggugggcgugcaagcucucaagaaaugcgacggccagcuguccaccgcgcaugaagucguucccuuugccguguucaagaacagcaaaaagguguaccuugauaagcuggaccucaaaacagaggaaaaucugcuuccugauuccuuugucuguuucgagcacaaggggcaguacaaaggaaccauggacucuggccagacgaagcgggaacugaaauccuuugauaucagccaaugccccaagauugggggacacggcagcaagaaauguacaggggacgcugccuucugcucugccuaugaguguaccgcucaguacgccaacgcguauugcucccaugcuaauggaagcggcaucgugcagauccaaguuucuggcguguggaagaaaccccucugugucggguacgagcgcgugguugugaagagagaacugagcgccaaaccuauucagcgggucgagccgugcacaaccuguaucaccaagugcgaaccccacggacuggugguccgcuccacaggcuuuaagauuucuagcgccguggcuugugccuccgggguuugcgugacgggaagccagucuccuuccaccgagaucacacucaaauaucccggcauuagccagucuuccgggggcgauaucggaguccauauggcucacgacgaucaaagcguguccucuaagaucguugcccauugcccuccccaggacccgugucuggugcacggcugcauugucugugcgcacgggcuuaucaacuaccagugccauaccgcccugagcgcuuucguggugguuuucgucuuuuccucuauugccaucauuugucucgcuauccuguauagagugcuuaaaugccugaagaucgccccucggaaagugcucaauccccugauguggauuacagcguucaucagaugggucuacaagaaaaugguggcccgcguugcugacaacauuaaccaggugaaucgggaaaucggauggauggagggcgggcaacugguccucggaaacccugcccccauuccuagacacgcucccaucccgcgcuacagcaccuaucugaugcuucugcucauuguguccuacgccagcgccuguucugagcugauccaggcuuccagccggaucacgacaugcucuaccgaaggcguuaauaccaaguguagacuguccgggacagcgcuuauucgcgccggcagcgugggagcugaggccugccucaugcugaagggcgucaaagaagaucagaccaaguuucugaaaaucaagacagugucuagcgagcucuccugucgggaggggcagagcuauuggacgggaucuuucuccccuaaaugccugagcuccagacgcugccaucuuguuggcgaaugucacgugaaccggugccugucuuggagagacaaugagaccagcgccgaauuuuccuucgucggggagucuacaaccaugcgcgaaaacaaguguuuugagcaaugcggaggcuggggguguggcugcuucaaugugaaccccagcugucucuuugugcacacauaccugcaguccguccggaaggaggcucugagaguuuucaauugcauugauugggugcauaaacuuacccucgaaaucacggacuuugauggaucugugagcaccauugaccugggcgccuccagcucucgguucacaaacuggggguccgucagccugucucucgaugcggagggaaucuccggcagcaauucuuuuuccuucaucgaaagccccgggaagggauaugcuauuguggacgagccuuucuccgaaaucccgcgccagggcuuucugggggagauuagauguaacagcgagucuagcguucuuuccgcccacgaaucuugccugcgggcccccaaucucaucagcuacaaaccuaugauugaucagcuggaguguaccacaaaccugaucgaccccuucguggucuuugaaagaggcucccuuccucaaacccgcaaugauaagacguucgcugccucuaaaggaaaccggggcgugcaggcguuuagcaagggguccguucaggcugaccucacacugauguucgauaacuuugagguggacuucgucggagccgccgugucuugcgacgcugccuuucugaaucucaccggcugcuauagcuguaacgcuggggccagaguuugccuguccaucacaagcaccggaaccggcacacuuucugcgcauaauaaggauggcucccugcacauugugcuccccagcgaaaacgggacgaaagaccaaugucagauccugcauuucaccgucccugagguggaggaagaguuuauguacucuugcgauggagacgaacgcccccugcuugugaagggcacacucauugccaucgauccguucgacgauagacgggaggcugggggagaguccaccgucguuaauccuaaaagcggcuccuggaacuuuuucgacugguucucugggcugaugagcugguuuggaggcccccugaagacaauucuccugaucugucuuuacguggcccuguccaucggccucuucuuucugcugauuuaucuugggcgcaccggacugagcaaaauguggcucgcugccacgaagaaggccucuuga

SEQ ID NO: 14460 - RNA, 3480 nt, Artificial Sequence
  derived and/or modified CDS sequence (opt5) from RVFV(ZM-657)__DQ380204.1__NSm-Gn-Gc
augaucgagggcgccugggacagccugagagaagaggaaaugcccgaggaacucuccugcucuauuagcgggauccgggaggugaagaccuccucucaggagcuguaccgcgcucuuaaagccauuaucgcggcugauggacugaacaauauuacaugucacggcaaggacccugaagauaaaaucagccucaucaaggggccgccccauaaaaagagagucggaauuguucggugcgagcgcagacgggacgccaagcaaaucggccgcgaaacgauggccgggauugcuaugaccgugcugccugcccuugcuguguucgcccuggcgcccgucguguuugccgaggauccucaccucagaaaccggcccggaaaaggccauaauuauaucgacggcaugacacaggaggaugcuaccuguaagccuguuacauacgccggggcuugcuccucuuucgacgugcugcuggaaaaaggaaaguuuccccucuuccagagcuaugcccaccaucgcacccugcuugaggcgguccacgauacaauuaucgccaaagcugacccgccuuccugugaucugcagagcgcccacggcaaccccugcaugaaggaaaagcucgugaugaaaacccauuguccuaaugacuaccaaucugcucacuaucugaacaaugaugggaagauggccuccguuaaaugucccccgaaguacgagcuuacggaagacugcaacuuuugcagacagaugaccggagccagccugaaaaagggcucuuauccucuccaggaccuguucugucaguccagcgaggaugacgggucuaaacugaagacaaagaugaaaggagugugcgaggucggcgugcaagcucucaagaaaugcgauggccagcuguccaccgcgcaugaagugguccccuuugccguuuucaagaauagcaaaaagguguaccuugacaagcuggaucucaaaacagaggaaaaccugcuuccugacuccuuuguguguuucgagcacaaggggcaguacaaaggaaccauggauucuggccagacgaagcgggaacugaaauccuuugacauuucccaaugccccaagaucgggggacacggcagcaagaaauguacaggggaugcugccuucugcucugccuaugaguguaccgcucaguacgccaaggcguauugcucccaugcuaauggaagcggcaucguccagauucaagugucuggcguuuggaaaaagccccucugugugggguacgagcgcgucgugguuaaaagagaacugagcgccaagccuauccagcggguggagccgugcacaaccuguauuaccaagugcgaaccccacggacuggucgugcgcuccacaggcuuuaaaaucucuagcgccgucgcuugugccuccggggugugcguuacgggaagccagucuccuuccaccgagauuacacucaaguaucccggcaucagccagucuuccgggggcgacaucggagugcauauggcucacgaugaccaaagcgucuccucuaaaauuguggcccauugcccuccccaggacccgugucugguucacggcugcaucgugugugcgcacgggcuuauuaacuaccagugccauaccgcccugagcgcuuucgucgugguguucguuuuuagcucuaucgccauuaucugucucgcuauccuguauagaguccuuaagugccugaaaauugccccucggaaggugcucaauccccugauguggaucacagcguucauuagauggaucuacaaaaagaugguggcccgcgucgcugauaacauuaaucaggugaaccgggaaaucggauggauggagggcgggcaacugguucucggaaacccugcccccauuccuagacacgcucccaucccgcgcuacagcaccuaucugaugcuucugcucaucguguccuacgccagcgccuguucugagcugauucaggcuuccagccggaucacgacaugcucuaccgaaggcgucaauaccaaguguagacuguccgggacagcgcuuauucgcgccggcagcgugggagcugaggccugccucaugcugaaaggcguuaaggaagaccagaccaaauuucugaagaucaaaacagugucuagcgagcucuccugucgggaggggcagagcuauuggacgggaucuuucuccccuaagugccugagcuccagacgcugccaucuugucggcgaaugucacgugaaccggugccugucuuggagagauaaugagaccagcgccgaauuuuccuucguuggggagucuacaaccaugcgcgaaaacaaguguuuugagcaaugcggaggcuggggguguggcugcuucaaugugaaccccagcugucucuuuguccacacauaccugcaguccgugcggaaagaggcucugagaguguucaauugcauugacuggguccauaaacuuacccucgaaaucacggauuuugacggaucuguuagcaccaucgaucugggcgccuccagcucucgguucacaaacuggggguccgugagccugucucucgacgcggagggaauuuccggcagcaauucuuuuuccuucaucgaaagccccgggaagggauaugcuauuguggaugagccuuucuccgaaaucccgcgccagggcuuucugggggagauuagauguaacagcgagucuagcguccuuuccgcccacgaaucuugccugcgggcccccaaucucaucagcuacaagccuaugaucgaccagcuggaguguaccacaaaccugauugaucccuucgugguuuuugaaagaggcucccuuccucaaacccgcaaugacaaaacguucgcugccucuaagggaaaccggggcgugcaggcguuuagcaagggguccguccaggcugaucucacacugauguucgacaauuuugagguggacuucguuggagccgccgugucuugcgaugcugccuuucugaaccucaccggcugcuauagcuguaacgcuggggccagagucugccuguccaucacaagcaccggaaccggcucucuuuccgcgcauaauaaagacggcagccugcacauugugcuccccucugaaaacgggacaaaggaucaaugucagauccugcauuucacgguuccugagguggaggaagaguuuauguacuccugcgacggagaugaacgcccccugcuugucaaaggcacccucauugccaucgacccguucgaugacagacgggaggcugggggagagagcacaguggugaauccuaaguccggcucuuggaacuuuuucgauugguucagcgggcugauguccugguuuggaggcccccugaaaaccauccuccugauuugucuuuacgucgcccugagcaucggccucuucuuucugcugauuuaucuugggcgcacaggacugucuaagauguggcucgcugccaccaagaaagccuccuga

SEQ ID NO: 14461 - RNA, 3480 nt, Artificial Sequence
  derived and/or modified CDS sequence (opt5) from RVFV(ZH-548M12)__M25276.1__NSm-Gn-Gc
augaucgagggcgccugggacagccugagagaagaggaaaugcccgaggaacucuccugcucuauuagcgggauccgggaggugaagaccuccucucaggagcuguaccgcgcucuuaaagccauuaucgcggcugauggacugaauaauauuacaugucacggcaaggacccugaagauaaaaucagccucaucaaggggccgccccauaaaaagagagucggaauuguucggugcgagcgcagacgggacgccaagcaaaucggccgcaaaacgauggccgggauugcuaugaccgugcugccugcccuugcuguguucgcccuggcgcccgucguguuugccgaagauccucaccucagaaaccggcccggaaagggccauaauuauaucgacggcaugacacaggaggaugcuaccuguaaaccuguuacauacgccggggcuugcuccucuuucgacgugcugcuggagaagggaaaauuuccccucuuccagagcuaugcccaccaucgcacccugcuugaagcgguccacgauacaauuaucgccaaggcugacccgccuuccugugaucugcucagcgcccacggcaaccccugcaugaaggagaaacuggugaugaagacccauuguccuaaugacuaccagucugcucaccaucuuaacaaugaugggaaaauggccuccguuaagugucccccgaaauaugaacugacggaggacugcaacuuuugcagacaaaugaccggagccagccucaagaaaggcucuuacccucugcaggaccuguucugucaguccagcgaagaugacgggucuaagcucaagacaaaaaugaagggagugugcgaggucggcgugcaggcucugaaaaagugcgauggccaacuuuccaccgcgcacgaggugguccccuuugccguuuucaaaaauagcaagaagguguaucuggacaaacucgaucugaagacagaagagaaccuucugccugacuccuuuguguguuucgaacacaaagggcaguacaagggaaccauggauucuggccagacgaaacgggagcucaagagcuuugacauuucccagugccccaagaucgggggacauggcagcaaaaaguguacaggggaugcugccuucugcucugccuacgaauguaccgcucaauaugccaaugcguacugcucccacgcuaacggaagcggcaucguccagauucaggugucuggcguuuggaaaaagccccugugugugggguaugagcgcgucgugguuaaaagagagcugagcgccaagccuauccaacggguggaaccgugcacaaccuguauuaccaagugcgagccccauggacucgucgugcgcuccacaggcuuuaaaaucucuagcgccgucgcuugugccuccggggugugcguuacgggaagccagucuccuuccaccgaaauuacacugaaguaccccggcaucagccagucuuccgggggcgacaucggagugcacauggcucaugaugaccagagcgucuccucuaaaauuguggcccacugcccuccccaagacccgugucuuguucacgauugcaucgugugugcgcauggccugauuaauuaucagugccacaccgcccucagcgcuuucgucgugguguucgucuuuuccucuaucgccauuaucugucuggcuauccuuuacagaguucugaagugccucaaaauugccccucggaaggugcugaacccccugauguggaucacagcguucauuagauggaucuauaaaaagaugguggcccgcgucgcugacaauauuaaccaggugaaccgggagaucggguggauggaaggaggccagcucguucuggggaauccugcccccauuccuagacaugcucccaucccgcgcuacagcaccuaccuuaugcugcuccugaucguguccuaugccagcgccuguucugagcugauucaggcuuccagccggaucacgacaugcucuaccgagggagucaacaccaaguguagacuuuccggcacagcgcucauucgcgccgggagcgugggcgcugaagccugccugaugcugaaaggaguuaaggaggaucaaaccaaauuucucaagcugaaaacagugucuagcgaacuuuccugucgggagggccagagcuacuggacggggucuuucuccccuaagugccugagcuccagacgcugccaccucgucggagagugucacgugaaucggugccugucuuggagagacaacgaaaccagcgccgaguuuuccuucguuggcgaaucuacaaccaugcgcgagaauaaguguuuugaacagugcgggggauggggcugugggugcuucaacgugaaucccagcugucuguuuguccauacauaucuucaauccgugcggaaagaggcucucagaguguucaacugcaucgauuggguccacaagcugacccuggagauuacggacuuugauggcucuguuagcaccaucgaccucggagccuccagcucucgguucacaaauuggggcuccgugagccugucucuugaugcggaagggaucuccggaagcaacucuuuuuccuucauugagagccccggcaaaggguacgcuaucguggacgaaccuuucuccgagauuccgcgccagggauuucugggcgaaaucagauguaauagcgagucuagcguccucuccgcccaugagucuugccugcgggcccccaaccugauuagcuauaagccuaugaucgaucagcuugaauguaccacaaaucucaucgaccccuucgugguuuuugagagagggucccugccucagacccgcaacgauaaaacguucgcugccucuaagggcaaucggggagugcaagcguuuagcaagggcuccguccaggcugaccugacacucauguucgacaacuuugaaguggauuucguuggggccgccgugucuugcgacgcugccuuucugaaccuuaccggaugcuacagcuguaaugcuggcgccagagucugccuguccauuacaagcaccgggaccggaucucucuccgcgcacaacaaagauggcagccugcauaucgugcugcccucugagaauggcacaaaggaccagugucaaauucuucacuucacgguuccugaaguggaggaggaauuuauguauuccugcgauggggacgagcgcccccuccuggucaaaggaacccugaucgccauugauccguucgacgauagacgggaagcuggcggggagagcacaguggugaacccuaaguccggaucuuggaacuuuuucgacugguucagcggccucauguccugguuugggggaccccugaaaaccauccuucugaucugucucuacgucgcccugagcauuggccuguucuuucuucugaucuaccucggcgggacaggacugucuaagauguggcucgcugccaccaagaaagccuccuga

SEQ ID NO: 14462 - RNA, 3480 nt, Artificial Sequence
  derived and/or modified CDS sequence (opt5) from RVFV(ZH-501-777)__DQ380202.1__NSm-Gn-Gc
augaucgagggcgccugggacagccugagagaagaggaaaugcccgaggaacucuccugcucuauuagcgggauccgggaggugaagaccuccucucaggagcuguaccgcgcucuuaaagccauuaucgcggcugauggacugaauaauauuacaugucacggcaaggacccugaagauaaaaucagccucaucaaggggccgccccauaaaaagagagucggaauuguucggugcgagcgcagacgggacgccaagcaaaucggccgcgaaacgauggccgggauugcuaugaccgugcugccugcccuugcuguguucgcccuggcgcccgucguguuugccgaggauccucaccucagaaaccggcccggaaaaggccauaauuauaucgacggcaugacacaggaggaugcuaccuguaagccuguuacauacgccggggcuugcuccucuuucgacgugcugcuggaaaaaggaaaguuuccccucuuccagagcuaugcccaccaucgcacccugcuugaggcgguccacgauacaauuaucgccaaagcugacccgccuuccugugaucugcagagcgcccacggcaaccccugcaugaaggaaaagcucgugaugaaaacccauuguccuaaugacuaccaaucugcucacuaucugaacaaugaugggaagauggccuccguuaaaugucccccgaaguacgagcuuacggaagacugcaacuuuugcagacagaugaccggagccagccugaaaaagggcucuuauccucuccaggaccuguucugucaguccagcgaggaugacgggucuaaacugaagacaaagaugaaaggagugugcgaggucggcgugcaagcucucaagaaaugcgauggccagcuguccaccgcgcaugaagugguccccuuugccguuuucaagaauagcaaaaagguguaccuugacaagcuggaucucaaaacagaggaaaaccugcuuccugacuccuuuguguguuucgagcacaaggggcaguacaaaggaaccauggaucccggccagacgaagcgggaacugaaaucuuuugacauuagccaaugccccaagaucgggggacacggcuccaagaaauguacaggggaugcugccuucugcagcgccuaugaguguaccgcucaguacgccaaugcguauugcucucaugcuaacggauccggcaucguccagauucaagugagcggcguuuggaagaaaccucucugugugggguacgagcgcgucgugguuaagagagaacugucugccaaaccgauccagcggguggagcccugcacaaccuguauuaccaagugcgaaccucacggacuggucgugcgcagcacaggcuuuaagaucuccucugccgucgcuugugccagcggggugugcguuacgggaucccagagccccucuaccgagauuacacucaaauauccuggcaucucccagagcucugggggcgacaucggagugcauauggcucacgaugaccaauccgucagcuccaagauuguggcccauugucccccgcaggacccuugccugguucacggcugcaucgugugugcgcacgggcuuauuaauuaccagugccauaccgcccugucugcuuucgucgugguguucguuuuuagcuccaucgccauuaucugucucgcuguccuguauagagugcuuaaaugccugaagaucgcgccccggaaagugcucaacccucugauguggauuacagccuucaucagauggauuuacaagaaaauggucgcccgcguggcugauaauaucaaccagguuaaccgggaaauuggauggauggagggcgggcaacuggugcucggaaaucccgccccuauccccagacacgcuccgauuccucgcuacucuaccuaucugaugcuucugcucaucgucagcuacgccuccgccuguagcgagcugauccaggcuucuucccggauuacgacaugcagcaccgaaggcgugaacaccaaguguagacugucugggacagcgcuuauccgcgccggcuccguuggagcugaggccugccucaugcugaagggcgugaaagaagaccagaccaaguuucugaaaauuaagacagucagcucugagcucagcugucgggaggggcaguccuauuggacgggcagcuucucucccaaaugccuguccagcagacgcugccaucuugugggagaaugucacguuaaucggugccuguccuggagagauaacgagaccucugccgaauuuagcuucgugggggaguccacaaccaugcgcgaaaauaaguguuuugagcaaugcggaggcuggggguguggcugcuucaacgucaaucccucuugucucuuugugcacacauaccugcagagcgugcggaaggaggcucugagagucuucaacugcaucgacuggguucauaaacuuacccucgaaauuacggauuuugacggauccgugucuaccaucgaucugggcgccagcuccagccgguucacaaauugggggucugugucccugagccucgacgcggagggaaucucuggcuccaacagcuuuucuuucauugaauccccugggaagggauaugcuaucgucgaugagccguucagcgaaauuccccgccagggcuuucugggggagaucagauguaauuccgagagcucugugcuuagcgcccacgaauccugccugcgggccccuaaccucauuucuuacaaacccaugaucgaccagcuggaguguaccacaaaucugaucgauccuuucguuguguuugaaagaggcagccuuccccaaacccgcaacgacaagacguucgcugccuccaaaggaaaucggggcguccaggcguuuucuaaggggagcgugcaggcugaucucacacugauguucgacaacuuugagguugacuucgugggagccgccgucuccugcgaugcugccuuucugaaccucaccggcugcuauucuuguaaugcuggggccagagugugccugagcauuacauccaccggaaccggcagccuuucugcgcauaacaaggacggcucccugcacaucguucucccuagcgaaaaugggacaaaagaucaaugucagauucugcauuucacggugcccgaggucgaggaagaguuuauguacucuugcgacggagaugaacgcccgcugcuugugaagggcacccucaucgccauugacccuuucgaugacagacgggaggcugggggagaguccacaguggucaaccccaaaagcggcuccuggaacuuuuucgauugguucucugggcugaugagcugguuuggaggcccucugaagaccauccuccugaucugucuuuacguugcccuguccauuggccucuucuuucugcugaucuaucuugggcgcacaggacugagcaaaauguggcucgcugccaccaagaaggccucuuga

SEQ ID NO: 14463 - RNA, 3480 nt, Artificial Sequence
  derived and/or modified CDS sequence (opt5) from RVFV(T-46 (228113))__DQ380199.1__NSm-Gn-Gc
augaucgagggcgccugggacagccugagagaagaggaaaugcccgaggaacucuccugcucuauuagcgggauccgggaggugaagaccuccucucaggagcuguaccgcgcucuuaaagccauuaucgcggcugauggacugaauaauauuacaugucacggcaaggacccugaagauaaaaucagccucaucaaggggccgccccauaaaaagagagucggaauuguucggugcgagcgcagacgggacgccaagcaaaucggccgcgaaacgauggccgggauugcuaugaccgugcugccugcccuugcuguguucgcccuggcgcccgucguguuugccgaggauccucaccucagaaaccggcccggaaaaggccauaauuauaucgacggcaugacacaggaggaugcuaccuguaagccuguuacauacgccggggcuugcuccucuuucgacgugcugcuggaaaaaggaaaguuuccccucuuccagagcuaugcccaccaucgcacccugcuugaggcgguccacgauacaauuaucgccaaagcugacccgccuuccugugaucugcagagcgcccacggcaaccccugcaugaaggaaaagcucgugaugaaaacccauuguccuaaugacuaccaaucugcucacuaucugaacaaugaugggaagauggccuccguuaaaugucccccgaaguacgagcuuacggaagacugcaacuuuugcagacagaugaccggagccagccugaaaaagggcucuuauccucuccaggaccuguucugucaguccagcgaggaugacgggucuaaacugaagacaaagaugaaaggagugugcgaggucggcgugcaagcucucaagaaaugcgauggccagcuguccaccgcgcaugaagugguccccuuugccguuuucaagaauagcaaaaagguguaccuugacaagcuggaucucaaaacagaggaaaaccugcuuccugacuccuuuguguguuucgagcacaaggggcaguacaaaggaaccaaggauucuggccagacgaaacgggaacuuaagagcuuugacauuucccaaugccccaagaucgggggacacggcagcaaaaaguguacaggggaugcugccuucugcucugccuaugaguguaccgcucaguacgccaaugcguauugcucccaugcuaacggaagcggcaucguccagauucaagugucuggcguuuggaaaaagccccucugugugggguacgagcgcgucgugguuaaaagagaacugagcgccaagccuauccagcggguggagccgugcacaaccuguauuaccaagugcgaaccccacggacuggucgugcgcuccacaggcuuuaaaaucucuagcgccgucgcuugugccuccggggugugcguuacgggaagccagucuccuuccaccgagauuacacucaaguaucccggcaucagccagucuuccgggggcgacaucggagugcauauggcucacgaugaccaaagcgucuccucuaaaauuguggcccauugcccuccccaggacccgugucugguucacggcugcaucgugugugcgcacgggcuuauuaauuaccagugccauaccgcccugagcgcuuucgucgugguguucgucuuuuccucuaucgccauuaucugucucgcuguucuguauagagugcuuaagugccugaaaaucgccccucggaaggugcucaacccccugauguggauuacagcguucaucagauggauuuacaaaaagauggucgcccgcguggcugauaauaucaaccagguuaaccgggaaauuggauggauggagggcgggcaacuggugcucggaaauccugcccccaucccuagacacgcucccauuccgcgcuacagcaccuaucugaugcuucugcucaucgucuccuacgccagcgccuguucugagcugauccaggcuuccagccggauuacgacaugcucuaccgaaggcgugaacaccaaguguagacuguccgggacagcgcuuauccgcgccggcagcguuggagcugaggccugccucaugcugaaaggcgugaaggaagaccagaccaaauuucugaagauuaaaacagucucuagcgagcucuccugucgggaggggcagagcuauuggacgggaucuuucuccccuaagugccugagcuccagacgcugccaucuugugggcgaaugucacguuaaucggugccugucuuggagagauaacgagaccagcgccgaauuuuccuucgugggggagucuacaaccaugcgcgaaaauaaguguuuugagcaaugcggaggcuggggguguggcugcuucaacgucaaucccagcugucucuuugugcacacauaccugcaguccgugcggaaagaggcucugagagucuucaacugcaucgacuggguucauaagcugacccucgaaauuacggauuuugacggaucugugagcaccaucgaucugggcgccuccagcucucgguucacaaauuggggguccgugagccugucucucgacgcggagggaaucuccggcagcaacucuuuuuccuucauugaaagccccgggaaaggauaugcuaucgucgaugagccuuucuccgaaauuccgcgccagggcuuucugggggagaucagauguaauagcgagucuagcgugcuuuccgcccacgaaucuugccugcgggcccccaaccucauuagcuacaagccuaugaucgaccagcuggaguguaccacaaaucugaucgaucccuucguuguguuugaaagaggcucccuuccucaaacccgcaacgacaaaacguucgcugccucuaagggaaaucggggcguccaggcguuuagcaagggguccgugcaggcugaucucacacugauguucgacaacuuugagguugacuucgugggagccgccgucucuugcgaugcugccuuucugaaccucaccggcugcuauagcuguaaugcuggggccagagugugccuguccauuacaagcaccggaaccggcucucuuuccgcgcauaacaaagacggcagccugcacaucguucuccccucugaaaaugggacaaaggaucaaugucagauucugcauuucacggugccugaggucgaggaagaguuuauguacuccugcgacggagaugaacgcccccugcuugugaaaggcacccucaucgccauugacccguucgaugacagacgggaggcugggggagagagcacaguggucaacccuaaguccggcucuuggaacuuuuucgauugguucagcgggcugauguccugguuuggaggcccccugaaaaccauccuccugaucugucuuuacguugcccugagcauuggccucuucuuucugcugaucuaucuugggcgcacaggacugucuaagauguggcucgcugccaccaagaaagccuccuga

SEQ ID NO: 14464 - RNA, 3480 nt, Artificial Sequence
  derived and/or modified CDS sequence (opt5) from RVFV(OS-3)__DQ380184.1__NSm-Gn-Gc
augaucgagggcgccugggacagccugagagaagaggaaaugcccgaggaacucuccugcucuauuagcgggauccgggaggugaagaccuccucucaggagcuguaccgcgcucuuaaagccauuaucgcggcugauggacugaauaauauuacaugucacggcaaggacccugaagauaaaaucagccucaucaaggggccgccccauaaaaagagagucggaauuguucggugcgagcgcagacgggacgccaagcaaaucggccgcgaaacgauggccgggauugcuaugaccgugcugccugcccuugcuguguucgcccuggcgcccgucguguuugccgaggauccucaccucagaaaccggcccggaaaaggccauaauuauaucgacggcaugacacaggaggaugcuaccuguaagccuguuacauacgccggggcuugcuccucuuucgacgugcugcuggaaaaaggaaaguuuccccucuuccagagcuaugcccaccaucgcacccugcuugaggcgguccacgauacaauuaucgccaaagcugacccgccuuccugugaucugcagagcgcccacggcaaccccugcaugaaggaaaagcucgugaugaaaacccauuguccuaaugacuaccaaucugcucacuaucugaacaaugaugggaagauggccuccguuaaaugucccccgaaguacgagcuuacggaagacugcaacuuuugcagacagaugaccggagccagccugaaaaagggcucuuauccucuccaggaccuguucugucaguccagcgaggaugacgggucuaaacugaagacaaagaugaaaggagugugcgaggucggcgugcaagcucucaagaaaugcgauggccagcuguccaccgcgcaugaagugguccccuuugccguuuucaagaauagcaaaaagguguaccuugacaagcuggaucucaaaacagaggaaaaccugcuuccugacuccuuuguguguuucgagcacaaggggcaguacaaaggaaccauggauucuggccagacgaagcgggaacugaaauccuuugacauuagccaaugccccaagaucgggggacacggcagcaagaaauguacaggggaugcugccuucugcucugccuaugaguguaccgcucaguacgccaaugcguauugcucccaugcuaacggaagcggcgucgugcagauccaaguuucuggcguguggaagaaaccccucugugucggguacgagcgcgugguugugaagagagaacugagcgccaaaccuauucagcgggucgagccgugcacaaccuguaucaccaagugcgaaccccacggacuggugguccgcuccacaggcuuuaagauuucuagcgccguggcuugugccuccgggguuugcgugacgggaagccagucuccuuccaccgagaucacacucaaauaucccggcauuagccagucuuccgggggcgacaucggaguccauauggcucacgaugaccaaagcguguccucuaagaucguugcccauugcccuccccaggacccgugucuggugcacggcugcauugucugugcgcacgggcuuaucaauuaccagugccauaccgcccugagcgcuuucguggugguuuucgucuuuuccucuguggccauuaucugucucgcuauucuguauaaagugcuuaagugccugaaaaucgccccuagaaagguccucaacccccugauguggaucacagcguucauucgguggguguacaaaaagaugguugccagaguggcugauaauaucaaccaggucaaccgcgaaauuggauggauggagggcgggcaacuggcccucggaaauccugcucccaucccucggcacgcccccauuccgagauacagcaccuaucugaugcuucugcucaucguguccuacgccagcgcuuguucugagcugauucaggcguccagccgcaucacgacaugcucuaccgaaggcguuaacaccaagugucggcuguccgggacagcccuuaucagagcuggcagcgugggagccgaggccugccucaugcugaaaggcgucaaggaagaccagaccaaauuucugaagauuaaaacagugucuagcgagcucuccugucgcgaggggcagagcuauuggacgggaucuuucuccccuaagugccugagcucccggagaugccaucuuguuggcgaaugucacgugaaucgcugccugucuuggcgggauaacgagaccagcgcugaauuuuccuucgucggggagucuacaaccaugagagaaaauaaguguuuugagcaaugcggaggcuggggguguggcugcuucaacgugaaucccagcugucucuuugugcacacauaccugcaguccguccgcaaagaggcccugcggguuuucaacugcaucgacugggugcauaaacuuacccucgaaauuacggauuuugacggaucugugagcaccaucgaucugggcgcguccagcucuagauucacaaauuggggguccgucagccugucucucgacgcugagggaauuuccggcagcaacucuuuuuccuucaucgaaagccccgggaaaggauaugccaucguggaugagccuuucuccgaaauuccgcggcagggcuuucugggggagauccgcuguaauagcgagucuagcguucuuuccgcccacgaaucuugccugagagcucccaaccucauuagcuacaagccuaugaucgaccagcuggaguguaccacaaaucugauugaucccuucguggucuuugaacggggcucccuuccucaaaccagaaacgacaaaacguucgccgcgucuaagggaaaucgcggcgugcaggcuuuuagcaagggguccguucaggccgaucucacacugauguucgacaacuuugagguggacuucgucggagccgcugugucuugcgaugccgcuuuucugaaccucaccggcugcuauagcuguaaugccggggcgcggguuugccuguccaucacaagcaccggaaccggcacacuuucugcccauaacaaagacggcucccugcacaucgugcuccccagcgaaaaugggacgaaggaucaaugucagauucugcauuucaccgucccugagguggaggaagaguuuauguacucuugcgacggagaugaaagaccccugcuugugaaaggcacacucaucgcuauugacccguucgaugaccgcagagaggccgggggagaguccaccgucguuaacccuaagagcggcuccuggaacuuuuucgauugguucucugggcugaugagcugguuuggaggcccccugaaaacaauccuccugauuugucuuuacguggcucuguccaucggccucuucuuucugcugaucuaucuugggcggaccggacugagcaagauguggcucgccgccacgaagaaggcuucuuga

SEQ ID NO: 14465 - RNA, 3480 nt, Artificial Sequence
  derived and/or modified CDS sequence (opt5) from RVFV(Sudan 86-2010)__JQ820489.1__NSm-Gn-Gc
augaucgagggcgccugggacagccugagagaagaggaaaugcccgaggaacucuccugcucugugagcgggauucgggaggucaagaccuccucucaggagcuguaccgcgcucuuaaagccaucauugcggcugauggacugaacaauaucacaugucacggcaagaacccugaagacaaaauuagccucaucaaggggccgccccauaaaaagagaguuggaaucgugcggugcgagcgcagacgggaugccaagcaaauuggccgcgaaacgauggccgggaucgcuaugaccgugcugccugcccuugcugucuucgcccuggcgcccgugguuuuugccgaggacccucaccucagaaaucggcccggaaaaggccauaacuauauugauggcaugacacaggaggacgcuaccuguaagccugugacauacgccggggcuugcuccucuuucgauguccugcuggaaaaaggaaaguuuccccucuuccagagcuaugcccaccaucgcacccugcuugaggcggugcacgacacaaucauugccaaagcugaucccccuuccugugaccugcagagcgcccacggcaaucccugcaugaaggaaaagcucguuaugaaaacccauuguccuaacgauuaccaaucugcucacuaucugaauaacgacgggaagauggccuccgugaaaugcccgccgaaguacgagcuuacggaagauuguaauuuuugcagacagaugaccggagccagccugaaaaagggcucuuauccucuccaggaccuguucugucaguccagcgaggacgaugggucuaaacugaagacaaagaugaaaggagucugcgaggugggcgugcaagcucucaagaaaugcgacggccagcuguccaccgcgcaugaagucguucccuuugccguguucaagaacagcaaaaagguguaccuugauaagcuggaccucaaaacagaggaaaaucugcuuccugauuccuuugucuguuucgagcacaaggggcaguacaaaggaaccauggacucuggccagacgaagcgggaacugaaauccuuugauaucagccaaugccccaagauugggggacacggcagcaagaaauguacaggggacgcugccuucugcucugccuaugaguguaccgcucaguacgccaacgcguauugcucccaugcuaauggaagcggcaucgugcagauccaaguuucuggcguguggaagaaaccccucugugucggguacgagcgcgugguugugaagagagaacugagcgccaaaccuauucagcgggucgagccgugcacaaccuguaucaccaagugcgaaccccacggacuggugguccgcuccacaggcuuuaagauuucuagcgccguggcuugugccuccgggguuugcgugacgggaagccagucuccuuccaccgagaucacacucaaauaucccggcauuagccagucuuccgggggcgauaucggaguccauauggcucacgacgaucaaagcguguccucuaagaucguugcccauugcccuccccaggacccgugucuggugcacggcugcauugucugugcgcacgggcuuaucaacuaccagugccauaccgcccugagcgcuuucguggugguuuucgucuuuuccucuauugccaucauuugucucgcuauccuguauagagugcuuaaaugccugaagaucgccccucggaaagugcucaauccccugauguggauuacagcguucaucagaugggucuacaagaaaaugguggcccgcguugcugacaacauuaaccaggugaaucgggaaaucggauggauggagggcgggcaacugguccucggaaacccugcccccauuccuagacacgcucccaucccgcgcuacagcaccuaucugaugcuucugcucauuguguccuacgccagcgccuguucugagcugauccaggcuuccagccggaucacgacaugcucuaccgaaggcguuaauaccaaguguagacuguccgggacagcgcuuauucgcgccggcagcgugggagcugaggccugccucaugcugaagggcgucaaagaagaucagaccaaguuucugaaaaucaagacagugucuagcgagcucuccugucgggaggggcagagcuauuggacgggaucuuucuccccuaaaugccugagcuccagacgcugccaucuuguuggcgaaugucacgugaaccggugccugucuuggagagacaaugagaccagcgccgaauuuuccuucgucggggagucuacaaccaugcgcgaaaacaaguguuuugagcaaugcggaggcuggggguguggcugcuucaaugugaaccccagcugucucuuugugcacacauaccugcaguccguccggaaggaggcucugagaguuuucaauugcauugauugggugcauaaacuuacccucgaaaucacggacuuugauggaucugugagcaccauugaccugggcgccuccagcucucgguucacaaacuggggguccgucagccugucucucgaugcggagggaaucuccggcagcaauucuuuuuccuucaucgaaagccccgggaagggauaugcuauuguggacgagccuuucuccgaaaucccgcgccagggcuuucugggggagauuagauguaacagcgagucuagcguucuuuccgcccacgaaucuugccugcgggcccccaaucucaucagcuacaaaccuaugauugaucagcuggaguguaccacaaaccugaucgaccccuucgugaucuuugaaagaggcucccuuccucaaacccgcaaugauaagacguucgcugccucuaaaggaaaccggggcguccaggcguuuagcaagggguccgugcaggcugaccucacacugauguucgauaacuuugagguugacuucgugggagccgccgucucuugcgacgcugccuuucugaaucucaccggcugcuauagcuguaacgcuggggccagagugugccuguccauuacaagcaccggaaccggcacacuuucugcgcauaauaaggauggcucccugcacaucguucuccccagcgaaaacgggacgaaagaccaaugucagauucugcauuucaccgugccugaggucgaggaagaguuuauguacucuugcgauggagacgaacgcccccugcuugugaagggcacacucaucgccauugauccguucgacgauagacgggaggcugggggagaguccaccguggucaauccuaaaagcggcuccuggaacuuuuucgacugguucucugggcugaugagcugguuuggaggcccccugaagacaauccuccugaucugucuuuacguugcccuguccauuggccucuucuuucugcugaucuaucuugggcgcaccggacugagcaaaauguggcucgcugccacgaagaaggccucuuga

SEQ ID NO: 14466 - RNA, 3480 nt, Artificial Sequence
  derived and/or modified CDS sequence (opt5) from RVFV(Sudan 28-2010)__JQ820491.1__NSm-Gn-Gc
augaucgagggcgccugggacagccugagagaagaggaaaugcccgaggaacucuccugcucugugagcgggauucgggaggucaagaccuccucucaggagcuguaccgcgcucuuaaagccaucauugcggcugauggacugaacaauaucacaugucacggcaagaacccugaagacaaaauuagccucaucaaggggccgccccauaaaaagagaguuggaaucgugcggugcgagcgcagacgggaugccaagcaaauuggccgcgaaacgauggccgggaucgcuaugaccgugcugccugcccuugcugucuucgcccuggcgcccgugguuuuugccgaggacccucaccucagaaaucggcccggaaaaggccauaacuauauugauggcaugacacaggaggacgcuaccuguaagccugugacauacgccggggcuugcuccucuuucgauguccugcuggaaaaaggaaaguuuccccucuuccagagcuaugcccaccaucgcacccugcuugaggcggugcacgacacaaucauugccaaagcugaucccccuuccugugaccugcagagcgcccacggcaaucccugcaugaaggaaaagcucguuaugaaaacccauuguccuaacgauuaccaaucugcucacuaucugaauaacgacgggaagauggccuccgugaaaugcccgccgaaguacgagcuuacggaagauuguaauuuuugcagacagaugaccggagccagccugaaaaagggcucuuauccucuccaggaccuguucugucaguccagcgaggacgaugggucuaaacugaagacaaagaugaaaggagucugcgaggugggcgugcaagcucucaagaaaugcgacggccagcuguccaccgcgcaugaagucguucccuuugccguguucaagaacagcaaaaagguguaccuugauaagcuggaccucaaaacagaggaaaaucugcuuccugauuccuuugucuguuucgagcacaaggggcaguacaaaggaaccauggacucuggccagacgaagcgggaacugaaauccuuugauaucagccaaugccccaagauugggggacacggcagcaagaaauguacaggggacgcugccuucugcucugccuaugaguguaccgcucaguacgccaacgcguauugcucccaugcuaauggaagcggcaucgugcagauccaaguuucuggcguguggaagaaaccccucugugucggguacgagcgcgugguugugaagagagaacugagcgccaaaccuauucagcgggucgagccgugcacaaccuguaucaccaagugcgaaccccacggacuggugguccgcuccacaggcuuuaagauuucuagcgccguggcuugugccuccgggguuugcgugacgggaagccagucuccuuccaccgagaucacacucaaauaucccggcauuagccagucuuccgggggcgauaucggaguccauauggcucacgacgaucaaagcguguccucuaagaucguugcccauugcccuccccaggacccgugucuggugcacggcugcauugucugugcgcacgggcuuaucaacuaccagugccauaccgcccugagcgcuuucguggugguuuucgucuuuuccucuauugccaucauuugucucgcuauccuguauagagugcuuaaaugccugaagaucgccccucggaaagugcucaauccccugauguggauuacagcguucaucagaugggucuacaagaaaaugguggcccgcguugcugacaacauuaaccaggugaaucgggaaaucggauggauggagggcgggcaacugguccucggaaacccugcccccauuccuagacacgcucccaucccgcgcuacagcaccuaucugaugcuucugcucauuguguccuacgccagcgccuguucugagcugauccaggcuuccagccggaucacgacaugcucuaccgaaggcguuaauaccaaguguagacuguccgggacagcgcuuauucgcgccggcagcgugggagcugaggccugccucaugcugaagggcgucaaagaagaucagaccaaguuucugaaaaucaagacagugucuagcgagcucuccugucgggaggggcagagcuauuggacgggaucuuucuccccuaaaugccugagcuccagacgcugccaucuuguuggcgaaugucacgugaaccggugccugucuuggagagacaaugagaccagcgccgaauuuuccuucgucggggagucuacaaccaugcgcgaaaacaaguguuuugagcaaugcggaggcuggggguguggcugcuucaaugugaaccccagcugucucuuugugcacacauaccugcaguccguccggaaggaggcucugagaguuuucaauugcauugauugggugcauaaacuuacccucgaaaucacggacuuugauggaucugugagcaccauugaccugggcgccuccagcucucgguucacaaacuggggguccgucagccugucucucgaugcggagggaaucuccggcagcaauucuuuuuccuucaucgaaagccccgggaagggauaugcuauuguggacgagccuuucuccgaaaucccgcgccagggcuuucugggggagauuagauguaacagcgagucuagcguucuuuccgcccacgaaucuugccugcgggcccccaaucucaucagcuacaaaccuaugauugaucagcuggaguguaccacaaaccugaucgaccccuucguggucuuugaaagaggcucccuuccucaaacccgcaaugauaagacguucgcugccucuaaaggaaaccggggcgugcaggcguuuagcaagggguccguucaggcugaccucacacugauguucgauaacuuugagguggacuucgucggagccgccgugucuugcgacgcugccuuucugaaucucaccggcugcuauagcuguaacgcuggggccagaguuugccuguccaucacaagcaccggaaccggcacacuuucugcgcauaauaaggauggcucccugcacauugugcuccccagcgaaaacgggacgaaagaccaaugucagauccugcauuucaccgucccugagguggaggaagaguuuauguacucuugcgauggagacgaacgcccccugcuugugaagggcacacucauugccaucgauccguucgacgauagacgggaggcugggggagaguccaccgucguuaauccuaaaagcggcuccuggaacuuuuucgacugguucucugggcugaugagcugguuuggaggcccccugaagacaauucuccugaucugucuuuacguggugcuguccaucggccucuucuuucugcugauuuaucuugggcgcaccggacugagcaaaauguggcucgccgcuacgaagaaggccucuuga

SEQ ID NO: 14467 - RNA, 3480 nt, Artificial Sequence
  derived and/or modified CDS sequence (opt5) from RVFV(2007004194)__EU574031.1__NSm-Gn-Gc
augaucgagggcgccugggacagccugagagaagaggaaaugcccgaggaacucuccugcucugugagcgggauucgggaggucaagaccuccucucaggagcuguaccgcgcucuuaaagccaucauugcggcugauggacugaauaauaucacaugucacggcaagaacccugaagacaaaauuagccucaucaaggggccgccccauaaaaagagaguuggaaucgugcggugcgagcgcagacgggaugccaagcaaauuggccgcgaaacgauggccgggaucgcuaugaccgugcugccugcccuugcugucuucgcccuggcgcccgugguuuuugccgaggacccucaccucagaaaucggcccggaaaaggccauaacuauauugauggcaugacacaggaggacgcuaccuguaagccugugacauacgccggggcuugcuccucuuucgauguccugcuggaaaaaggaaaguuuccccucuuccagagcuaugcccaccaucgcacccugcuugaggcggugcacgacacaaucauugccaaagcugaucccccuuccugugaccugcagagcgcccacggcaaucccugcaugaaggaaaagcucguuaugaaaacccauuguccuaacgauuaccaaucugcucacuaucuguccaaugacgggaagauggccagcgugaaaugcccgccgaaguacgagcuuacggaagauuguaacuuuugcagacagaugaccggagccucucugaaaaagggcuccuauccucuccaggaccuguucugucagagcucugaggacgauggguccaaacugaagacaaagaugaaaggagucugcgaggugggcgugcaagcucucaagaaaugcgacggccagcugagcaccgcgcaugaagucguucccuuugccguguucaagaauagcaaaaagguguaccuugauaagcuggaccucaaaacagaggaaaaccugcuuccugauucuuuugucuguuucgagcacaaggggcaguacaaaggaaccauggacagcggccagacgaagcgggaacugaaauccuuugauaucagccaaugccccaagauugggggacacggcucuaagaaauguacaggggacgcugccuucugcuccgccuaugaguguaccgcucaguacgccaaugcguauugcagccaugcuaacggaucuggcaucgugcagauccaaguuagcggcguguggaagaaaccccucugugucggguacgagcgcgugguugugaagagagaacuguccgccaaaccuauucagcgggucgagccgugcacaaccuguaucaccaagugcgaaccccacggacuggugguccgcucuacaggcuuuaagauuagcuccgccguggcuugugccagcgggguuugcgugacgggaucucaguccccuagcaccgagaucacacucaaauaucccggcauuucucaguccagcgggggcgauaucggaguccauauggcucacgacgaucaauccgugucuagcaagaucguugcccauugcccuccccaggacccgugucuggugcacggcugcauugucugugcgcacgggcuuaucaauuaccagugccauaccgcccuguccgcuuucguggugguuuucgucuuuucuagcauugccaucauuugucucgcuauccuguauagagugcuuaaaugccugaagaucgccccucggaaagugcucaacccccugauguggauuacagcguucaucagaugggucuacaagaaaaugguggcccgcguugcugacaauauuaaccaggugaaccgggaaaucggauggauggagggcgggcaacugguccucggaaauccugcccccauuccuagacacgcucccaucccgcgcuacuccaccuaucugaugcuucugcucauugugagcuacgccucugccuguuccgagcugauccaggcuagcucucggaucacgacaugcuccaccgaaggcguuaacaccaaguguagacugagcgggacagcgcuuauucgcgccggcucugugggagcugaggccugccucaugcugaagggcgucaaagaagaucagaccaaguuucugaaaaucaagacagugagcuccgagcucagcugucgggaggggcagucuuauuggacgggauccuucagcccuaaaugccuguccucuagacgcugccaucuuguuggcgaaugucacgugaaucggugccugagcuggagagacaacgagaccuccgccgaauuuucuuucgucggggagagcacaaccaugcgcgaaaauaaguguuuugagcaaugcggaggcuggggguguggcugcuucaacgugaaucccuccugucucuuugugcacacauaccugcagucuguccggaaggaggcucugagaguuuucaacugcauugauugggugcauaaacuuacccucgaaaucacggacuuugauggaagcguguccaccauugaccugggcgccuccucuucccgguucacaaauugggggagcgucucucugucccucgaugcggagggaaucagcggcucuaacuccuuuagcuucaucgaaucccccgggaagggauaugcuauuguggacgagccuuucagcgaaaucccgcgccagggcuuucugggggagauuagauguaauucugagagcuccguucuuucugcccacgaaagcugccugcgggcccccaaccucaucuccuacaaaccuaugauugaucagcuggaguguaccacaaaucugaucgaccccuucguggucuuugaaagaggcucucuuccucaaacccgcaacgauaagacguucgcugccagcaaaggaaaucggggcgugcaggcguuuuccaaggggucuguucaggcugaccucacacugauguucgauaacuuugagguggacuucgucggagccgccgugagcugcgacgcugccuuucugaaccucaccggcugcuauuccuguaaugcuggggccagaguuugccugagcaucacaucuaccggaaccggcacacuuuccgcgcauaacaaggauggcagccugcacauugugcuccccucugaaaaugggacgaaagaccaaugucagauccugcauuucaccgucccugagguggaggaagaguuuauguacuccugcgauggagacgaacgcccccugcuugugaagggcacacucauugccaucgauccguucgacgauagacgggaggcugggggagagagcaccgucguuaacccuaaauccggcucuuggaacuuuuucgacugguucagcgggcugauguccugguuuggaggcccccugaagacaauucuccugaucugucuuuacguggcccugagcaucggccucuucuuucugcugauuuaucuugggcgcaccggacugucuaaaauguggcucgcugccacgaagaaggccuccuga

SEQ ID NO: 14468 - RNA, 3480 nt, Artificial Sequence
  derived and/or modified CDS sequence (opt5) from RVFV(73HB1230)__DQ380221.1__NSm-Gn-Gc
augaucgagggcgccugggacagccugagagaagaggaaaugcccgaggaacucuccugcucuauuagcgggauccgggaggugaagaccuccucucaggagcuguaccgcgcucuuaaagccauuaucgcggcugauggacugaauaauauuacaugucacggcaaggacccugaagauaaaaucagccucaucaaggggccgccccauaaaaagagagucggaauuguucggugcgagcgcagacgggacgccaagcaagugggccgcgaaacgauggccgggaucgcuaugaccgugcugccugcccuugcugucuucgcccuggcgcccgugguuuuugccgaggauccucaccucagaaaccggcccggaaaaggccauaauuauauugacggcaugacacaggaggaugcuaccuguaagccugugacauacgccggggcuugcuccucuuucgacguccugcuggaaaaaggaaaguuuccccucuuccagagcuaugcccaccaucgcacccugcuugaggcggugcacgauacaaucauugccaaagcugacccgccuuccugugaucugcagagcgcccacggcaaccccugcaugaaggaaaagcucguuaugaaaacccauuguccuaaugacuaccaaucugcucacuaucugaacaaugaugggaagauggccuccgugaaaugucccccgaaguacgagcuuacggaagacugcaacuuuugcagacagaugaccggagccagccugaaaaagggcucuuauccucuccaggaccuguucugucaguccagcgaggaugacgggucuaaacugaagacaaagaugaaaggagucugcgaggugggcgugcaagcucucaagaaaugcgauggccagcuguccaccgcgcaugaagucguucccuuugccguguucaagaauagcaaaaagguguaccuugacaagcuggaucucaaaacagaggaaaaccugcuuccugacuccuuugucuguuucgagcacaaggggcaguacaaaggaaccauggauucuggccagacgaagaaagaacuuaagagcuuugacaucucccaaugccccaagauugggggacacggcagcaaaaaguguacaggggaugcugccuucugcucugccuaugaguguaccgcucaguacgccaaugcguauugcucccaugcuaacggaagcggcaucgugcagauccaaguuucuggcguguggaaaaagccccucugugucggguacgagcgggugguugugaaacgcgaacugagcgccaagccuauucagagagucgagccgugcacaaccuguaucaccaagugcgaaccccacggacuggugguccgguccacaggcuuuaaaauuucuagcgccguggcuugugccuccgggguuugcgugacgggaagccagucuccuuccaccgagaucacacucaaguaucccggcauuagccagucuuccgggggcgacaucggaguccauauggcucacgaugaccaaagcguguccucuaaaaucguugcccauugcccuccccaggacccgugucuggugcacggcugcauugucugugcgcacgggcuuaucaauuaccagugccauaccgcccugagcgcuuucguggugguuuucgucuuuuccucuauugccaucauuugucucgcuauccuguaucgcgugcuuaagugccugaaaaucgccccuagaaaggugcucaacccccugauguggauuacagcguucauccggugggucuacaaaaagaugguggccagaguugcugauaauauuaaccaggugaaccgcgaaaucggauggauggagggcgggcaacugguccucggaaauccugcccccauuccucggcacgcucccaucccgagauacagcaccuaucugaugcuucugcucauuguguccuacgccagcgccuguucugagcugauccaggcuuccagccgcaucacgacaugcucuaccgaaggcguuaacaccaagugucggcuguccgggacagcgcuuauuagagccggcagcgugggagcugaggccugccucaugcugaaaggcgucaaggaagaccagaccaaauuucugaagaucaaaacagugucuagcgagcucuccugucgcgaggggcagagcuauuggacgggaucuuucuccccuaagugccugagcucccggagaugccaucuuguuggcgaaugucacgugaaucgcugccugucuuggcgggauaacgagaccagcgccgaauuuuccuucgucggggagucuacaauuaugagagaaaauaaguguuuugagcaaugcggaggcuggggguguggcugcuucaacgugaaucccagcugucucuuugugcacaccuaccugcaguccguccgcaaagaggcucugcggguuuucaacugcaucgacugggugcauaagcugacacucgaaauuaccgauuuugacggaucugugagcacgaucgaucugggcgccuccagcucuagauucaccaauuggggguccgucagccugucucucgacgcggagggaaucuccggcagcaacucuuuuuccuucauugaaagccccgggaaaggauaugcuaucguggaugagccuuucuccgaaauuccgcggcagggcuuucugggggagauccgcuguaauagcgagucuagcguucuuuccgcccacgaaucuugccugagagcccccaaccucauuagcuacaagccuaugaucgaccagcuggaguguacaaccaaucugaucgaucccuucguggucuuugaacggggcucccuuccucaaacaagaaacgacaaaaccuucgcugccucuaagggaaaucgcggcgugcaggcguuuagcaagggguccguucaggcugaucucacgcugauguucgacaacuuugagguggacuucgucggagccgccgugucuugcgaugcugccuuucugaaccucacaggcugcuauagcuguaaugcuggggcccggguuugccuguccauuaccagcacaggaaccggcacccuuucugcgcauaacaaagacggcucccugcacaucgugcuccccagcgaaaaugggacaaaggaucaaugucagauucugcauuucacggucccugagguggaggaagaguuuauguacucuugcgacggagaugaaagaccccugcuugugaaaggcacccucaucgccauugacccguucgaugaccgcagagaggcugggggagaguccacagucguuaacccuaagagcggcuccuggaacuuuuucgauugguucucugggcugaugagcugguuuggaggcccccugaaaaccauccuccugaucugucuuuacguggcccuguccauuggccucuucuuucugcugaucuaucuugggcggacaggacugagcaagauguggcucgcugccaccaagaaagccucuuga

SEQ ID NO: 14469 - RNA, 3480 nt, Artificial Sequence
  derived and/or modified CDS sequence (opt5) from RVFV(1260/78)__DQ380214.1__NSm-Gn-Gc
augaucgagggcgccugggacagccugagagaagaggaaaugcccgaggaacucuccugcucuauuagcgggauccgggaggugaagaccuccucucaggagcuguaccgcgcucuuaaagccauuaucgcggcugauggacugaauaauauuacaugucacggcaaggacccugaagauaaaaucagccucaucaaggggccgccccauaaaaagagagucggaauuguucggugcgagcgcagacgggacgccaagcaaaucggccgcgaaacgauggccgggauugcuaugaccgugcugccugcccuugcuguguucgcccuggcgcccgucguguuugccgaggauccucaccucagaaaccggcccggaaaaggccauaauuauaucgacggcaugacacaggaggaugcuaccuguaagccuguuacauacgccggggcuugcuccucuuucgacgugcugcuggaaaaaggaaaguuuccccucuuccagagcuaugcccaccaucgcacccugcuugaggcgguccacgauacaauuaucgccaaagcugacccgccuuccugugaucugcagagcgcccacggcaaccccugcaugaaggaaaagcucgugaugaaaacccauuguccuaaugacuaccaaucugcucacuaucugaacaaugaugggaagauggccuccguuaaaugucccccgaaguacgagcuuacggaagacugcaacuuuugcagacagaugaccggagccagccugaaaaagggcucuuauccucuccaggaccuguucugucaguccagcgaggaugacgggucuaaacugaagacaaagaugaaaggagugugcgaggucggcgugcaagcucucaagaaaugcgauggccagcuguccaccgcgcaugaagugguccccuuugccguuuucaagaauagcaaaaagguguaccuugacaagcuggaucucaaaacagaggaaaaccugcuuccugacuccuuuguguguuucgagcacaaggggcaguacaaaggaaccauggauucuggccagacgaagcgggaacugaaauccuuugacauuucccaaugccccaagaucgggggacacggcagcaagaaauguacaggggaugcugccuucugcucugccuaugaguguaccgcucaguacgccaaugcguauugcucccaugcuaacggaagcggcaucguccagauucaagugucuggcguuuggaagaaaccccucugugugggguacgagcgcgucgugguuaagagagaacugagcgccaaaccuauccagcggguggagccgugcacaaccuguauuaccaagugcgaaccccacggacuggucgugcgcuccacaggcuuuaagaucucuagcgccgucgcuugugccuccggggugugcguuacgggaagccagucuccuuccaccgagauuacacucaaauaucccggcaucagccagucuuccgggggcgacaucggagugcauauggcucacgaugaccaaagcgucuccucuaagauuguggcccauugcccuccccaggacccgugucugguucacggcugcaucgugugugcgcacgggcuuauuaauuaccagugccauaccgcccugagcgcuuucgucgugguguucguuuuuagcucuaucgccauuaucugucucgcuauccugcacagaguccuuaaaugccugaagauugccccucggaaagugcucaacccccugauguggaucacagcguucauuagauggguguauaagaaaauggucgcccgcguggcugauaauaucaaccagguuaaccgggaaauuggauggauggagggcgggcaacuggugcucggaaauccugcccccaucccuagacaugcucccauuccgcgcuacagcaccuaccugaugcuucugcucaucgucuccuaugccagcgccuguucugagcugauccaggcuuccagccggauuacgacaugcucuaccgaaggcgugaacaccaaguguagacuguccgggacagcgcuuauccgcgccggcagcguuggagcugaggccugccucaugcugaagggcgugaaagacgaucagaccaaguuucugaaaauuaagacagucucuagcgaacucuccugucgggaggggcagagcuacuggacgggaucuuucuccccuaaaugccugagcuccagacgcugccaccuugugggcgagugucacguuaaucggugccugucuuggagagacaacgaaaccagcgccgaguuuuccuucgugggggaaucuacaaccaugcgcgagaauaaguguuuugaacaaugcggaggcuggggguguggcugcuucaacgucaaucccagcugucucuuugugcauacauaucugcaguccgugcggaaggaggcucugagagucuucaacugcaucgauuggguucacaaacuuacccucgagauuacggacuuugauggaucugugagcaccaucgaccugggcgccuccagcucucgguucacaaauuggggguccgugagccugucucucgaugcggaaggaaucuccggcagcaacucuuuuuccuucauugagagccccgggaagggauacgcuaucgucgacgaaccuuucuccgagauuccgcgccagggcuuucugggggaaaucagauguaauagcgagucuagcgugcuuuccgcccaugagucuugccugcgggcccccaaccucauuagcuauaaaccuaugaucgaucagcuggaauguaccacaaaucugaucgaccccuucguuguguuugagagaggcucccuuccucaaacccgcaacgauaagacguucgcugccucuaaaggaaaucggggcguccaggcguuuagcaagggguccgugcaggcugaccucacacugauguucgacaacuuugaaguugauuucgugggagccgccgucucuugcgacgcugccuuucugaaccucaccggcugcuacagcuguaaugcuggggccagagugugccuguccauuacaagcaccggaaccggcacacuuucugcgcacaacaaggauggcucccugcauaucguucuccccagcgagaaugggacgaaagaccaaugucagauucugcacuucaccgugccugaagucgaggaggaauuuauguauucuugcgauggagacgagcgcccccugcuugugaagggcacacucaucgccauugauccguucgacgauagacgggaagcugggggagaguccaccguggucaacccuaaaagcggcuccuggaacuuuuucgacugguucucugggcugaugagcugguuuggaggcccccugaagacaauccuccugaucugucuuuacguugcccuguccauuggccucuucuuucugcugaucuaccuugggcgcaccggacugagcaaaauguggcucgcugccacgaagaaggccucuuga

SEQ ID NO: 14470 - RNA, 3480 nt, Artificial Sequence
  derived and/or modified CDS sequence (opt5) from RVFV(ZC-3349)__DQ380207.1__NSm-Gn-Gc
augaucgagggcgccugggacagccugagagaagaggaaaugcccgaggaacucuccugcucuauuagcgggauccgggaggugaagaccuccucucaggagcuguaccgcgcucuuaaagccauuaucgcggcugauggacugaauaauauuacaugucacggcaaggacccugaagauaaaaucagccucaucaaggggccgccccauaaaaagagagucggaauuguucggugcgagcgcagacgggacgccaagcaaaucggccgcgaaacgauggccgggauugcuaugaccgugcugccugcccuugcuguguucgcccuggcgcccgucguguuugccgaggauccucaccucagaaaccggcccggaaaaggccauaauuauaucgacggcaugacacaggaggaugcuaccuguaagccuguuacauacgccggggcuugcuccucuuucgacgugcugcuggaaaaaggaaaguuuccccucuuccagagcuaugcccaccaucgcacccugcuugaggcgguccacgauacaauuaucgccaaagcugacccgccuuccugugaucugcagagcgcccacggcaaccccugcaugaaggaaaagcucgugaugaaaacccauuguccuaaugacuaccaaucugcucacuaucugaacaaugaugggaagauggccuccguuaaaugucccccgaaguacgagcuuacggaagacugcaacuuuugcagacagaugaccggagccagccugaaaaagggcucuuauccucuccaggaccuguucugucaguccagcgaggaugacgggucuaaacugaagacaaagaugaaaggagugugcgaggucggcgugcaagcucucaagaaaugcgauggccagcuguccaccgcgcaugaagugguccccuuugccguuuucaagaauagcaaaaagguguaccuugacaagcuggaucucaaaacagaggaaaaccugcuuccugacuccuuuguguguuucgagcacaaggggcaguacaaaggaaccauggauucuggccagacgaagcgggaacugaaaucuuuugacauuucccaaugccccaagaucgggggacacggcagcaagaaauguacaggggaugcugccuucugcucugccuaugaguguaccgcucaguacgccaaugcguauugcucccaugcuaacggaagcggcaucguccagauucaagugucuggcguuuggaagaaaccccucugugugggguacgagcgcgucgugguuaagagagaacugagcgccaaaccuauccagcggguggagccgugcacaaccuguauuaccaagugcgaaccccacggacuggucgugcgcuccacaggcuuuaagaucucuagcgccgucgcuugugccuccggggugugcguuacgggaagccagucuccuuccaccgagauuacacucaaauaucccggcaucagccagucuuccgggggcgacaucggagugcauauggcucacgaugaccaagccgucagcuccaagauuguggcgcauugcccuccccaggacccgugucugguucacggcugcaucgugugugcccacgggcuuauuaauuaccagugccauaccgcucugucugccuucgucgugguguucguuuuuagcuccaucgcuauuaucugucucgccauccuguauagaguccuuaaaugccugaagauugcgccucggaaagugcucaacccccugauguggaucacagccuucauuagauggaucuacaagaaaaugguggcucgcgucgccgauaauauuaaccacgugaaccgggaaaucggauggauggagggcgggcagcugguucucggaaauccugcucccauuccuagacaugcccccaucccgcgcuacucuaccuaucugaugcuucugcucaucgugagcuacgccuccgcuuguagcgagcugauucaagcgucuucccggaucacgacaugcagcaccgaaggcgucaacaccaaguguagacugucugggacagcccuuauucgcgcuggcuccgugggagccgaggccugccucaugcugaagggcguuaaagaagaccagaccaaguuucugaaaaucaagacagugagcucugagcucagcugucgggaggggcaguccuauuggacgggcagcuucucuccuaaaugccuguccagcagacgcugccaccuugucggagaaugucacgugaaucggugccuguccuggagagauaacgagaccucugcugaauuuagcuucguuggggaguccacaaccaugcgcgaaaauaaguguuuugagcagugcggaggcuggggguguggcugcuucaacgugaaucccucuugucucuuuguccauacauaccugcaaagcgugcggaaggaggcccugagaguguucaacugcauugacuggguccacaaacuuacccucgaaaucacggauuuugacggauccguuucuaccaucgaucugggcgcgagcuccagccgguucacaaauugggggucugugucccugagccucgacgcugagggaauuucuggcuccaacagcuuuucuuucaucgaaucccccgggaagggauaugccauuguggaugagccuuucagcgaaaucccgcgccagggcuuucugggggagauuagauguaauuccgagagcucuguccuuagcgcccaugaauccugccugaaagcucccaaccucaucucuuacaagccuaugaucgaccagcuggaguguaccacaaaucugauugaucccuucgugguuuuugaacggggcagccuuccucagaccagaaacgacaaaacguucgccgcguccaagggaaaucgcggcgugcaggcuuuuucuaaggggagcguccaagccgaucucacacugauguucgacaacuuugagguggacuucguuggagccgcuguguccugcgaugccgcuuuucugaaccucaccggcugcuauucuuguaaugccggggcgcgggucugccugagcaucacauccaccggaaccggcagccuuucugcccacaacaaagacggcucccugcauauugugcuccccagcgaaaaugggacaaaggaucagugucaaauccugcacuucacgguuccugagguggaggaagaguuuauguacucuugcgacggagaugaaagaccccugcuugucaaaggcacccucauugcuaucgacccguucgaugaccgcagagaggccgggggagaguccacaguggugaacccuaagagcggcuccuggaacuuuuucgauugguucucugggcugaugagcugguuuggaggcccccugaaaaccauccuccugauuugucuuuacgucgcucuguccaucggccucuucuuucugcugauuuaucuugggcggacaggacugagcaagauguggcucgccgccaccaagaaagcuagcuga

SEQ ID NO: 14471 - RNA, 3480 nt, Artificial Sequence
  derived and/or modified CDS sequence (opt5) from RVFV(Sudan 85-2010)__JQ820488.1__NSm-Gn-Gc
augaucgagggcgccugggacagccugagagaagaggaaaugcccgaggaacucuccugcucugugagcgggauucgggaggucaagaccuccucucaggagcuguaccgcgcucuuaaagccaucauugcggcugauggacugaacaauaucacaugucacggcaagaacccugaagacaaaauuagccucaucaaggggccgccccauaaaaagagaguuggaaucgugcggugcgagcgcagacgggaugccaagcaaauuggccgcgaaacgauggccgggaucgcuaugaccgugcugccugcccuugcugucuucgcccuggcgcccgugguuuuugccgaggacccucaccucagaaaucggcccggaaaaggccauaacuauauugauggcaugacacaggaggacgcuaccuguaagccugugacauacgccggggcuugcuccucuuucgauguccugcuggaaaaaggaaaguuuccccucuuccagagcuaugcccaccaucgcacccugcuugaggcggugcacgacacaaucauugccaaagcugaucccccuuccugugaccugcagagcgcccacggcaaucccugcaugaaggaaaagcucguuaugaaaacccauuguccuaacgauuaccaaucugcucacuaucugaauaacgacgggaagauggccuccgugaaaugcccgccgaaguacgagcuuacggaagauuguaauuuuugcagacagaugaccggagccagccugaaaaagggcucuuauccucuccaggaccuguucugucaguccagcgaggacgaugggucuaaacugaagacaaagaugaaaggagucugcgaggugggcgugcaagcucucaagaaaugcgacggccagcuguccaccgcgcaugaagucguucccuuugccguguucaagaacagcaaaaagguguaccuugauaagcuggaccucaaaacagaggaaaaucugcuuccugauuccuuugucuguuucgagcacaaggggcaguacaaaggaaccauggacucuggccagacgaagcgggaacugaaauccuuugauaucagccaaugccccaagauugggggacacggcagcaagaaauguacaggggacgcugccuucugcucugccuaugaguguaccgcucaguacgccaacgcguauugcucccaugcuaauggaagcggcaucgugcagauccaaguuucuggcguguggaagaaaccccucugugucggguacgagcgcgugguugugaagagagaacugagcgccaaaccuauucagcgggucgagccgugcacaaccuguaucaccaagugcgaaccccacggacuggugguccgcuccacaggcuuuaagauuucuagcgccguggcuugugccuccgggguuugcgugacgggaagccagucuccuuccaccgagaucacacucaaauaucccggcauuagccagucuuccgggggcgauaucggaguccauauggcucacgacgaucaaagcguguccucuaagaucguugcccauugcccuccccaggacccgugucuggugcacggcugcauugucugugcgcacgggcuuaucaacuaccagugccauaccgcccugagcgcuuucguggugguuuucgucuuuuccucuauugccaucauuugucucgcuauccuguauagagugcuuaaaugccugaagaucgccccucggaaagugcucaauccccugauguggauuacagcguucaucagaugggucuacaagaaaaugguggcccgcguugcugacaacauuaaccaggugaaucgggaaaucggauggauggagggcgggcaacugguccucggaaacccugcccccauuccuagacacgcucccaucccgcgcuacagcaccuaucugaugcuucugcucauuguguccuacgccagcgccuguucugagcugauccaggcuuccagccggaucacgacaugcucuaccgaaggcguuaauaccaaguguagacuguccgggacagcgcuuauucgcgccggcagcgugggagcugaggccugccucaugcugaagggcgucaaagaagaucagaccaaguuucugaaaaucaagacagugucuagcgagcucuccugucgggaggggcagagcuauuggacgggaucuuucuccccuaaaugccugagcuccagacgcugccaucuuguuggcgaaugucacgugaaccggugccugucuuggagagacaaugagaccagcgccgaauuuuccuucgucggggagucuacaaccaugcgcgaaaacaaguguuuugagcaaugcggaggcuggggguguggcugcuucaaugugaaccccagcugucucuuugugcacacauaccugcaguccguccggaaggaggcucugagaguuuucaauugcauugauugggugcauaaacuuacccucgaaaucacggacuuugauggaucugugagcaccauugaccugggcgccuccagcucucgguucacaaacuggggguccgucagccugucucucgaugcggagggaaucuccggcagcaauucuuuuuccuucaucgaaagccccgggaagggauaugcuauuguggacgagccuuucuccgaaaucccgcgccagggcuuucugggggagauuagauguaacagcgagucuagcguucuuuccgcccacgaaucuugccugcgggcccccaaucucaucagcuacaaaccuaugauugaucagcuggaguguaccacaaaccugaucgaccccuucguggucuuugaaagaggcucccuuccucaaacccgcaaugagaagacguucgcugccucuaaaggaaaccggggcgugcaggcguuuagcaagggguccguucaggcugaucucacacugauguucgacaacuuugaaguggauuucgucggagccgccgugucuugcgacgcugccuuucugaaucucaccggcugcuauagcuguaacgcuggggccagaguuugccuguccaucacaagcaccggaaccggcacacuuucugcgcauaauaaggacggcucccugcacauugugcuccccagcgagaacgggacgaaagaucaaugucagauccugcauuucaccgucccugagguggaagaggaauuuauguacucuugcgacggagaugagcgcccccugcuugugaagggcacacucauugccaucgacccguucgaugacagacgggaggcugggggagaauccaccgucguuaauccuaaaagcggcuccuggaacuuuuucgauugguucucugggcugaugagcugguuuggaggcccccugaagacaauucuccugaucugucuuuacguggcccuguccaucggccucuucuuucugcugauuuaucuugggcgcaccggacugagcaaaauguggcucgcugccacgaagaaggccucuuga

SEQ ID NO: 14472 - RNA, 3480 nt, Artificial Sequence
  derived and/or modified CDS sequence (opt5) from RVFV(2007000324)__JF326195.1__NSm-Gn-Gc
augaucgagggcgccugggacagccugagagaagaggaaaugcccgaggaacucuccugcucugugagcgggauucgggaggucaagaccuccucucaggagcuguaccgcgcucuuaaagccaucauugcggcugauggacugaacaauaucacaugucacggcaagaacccugaagacaaaauuagccucaucaaggggccgccccauaaaaagagaguuggaaucgugcggugcgagcgcagacgggaugccaagcaaauuggccgcgaaacgauggccgggaucgcuaugaccgugcugccugcccuugcugucuucgcccuggcgcccgugguuuuugccgaggacccucaccucagaaaucggcccggaaaaggccauaacuauauugauggcaugacacaggaggacgcuaccuguaagccugugacauacgccggggcuugcuccucuuucgauguccugcuggaaaaaggaaaguuuccccucuuccagagcuaugcccaccaucgcacccugcuugaggcggugcacgacacaaucauugccaaagcugaucccccuuccugugaccugcagagcgcccacggcaaucccugcaugaaggaaaagcucguuaugaaaacccauuguccuaacgauuaccaaucugcucacuaucugaauaacgacgggaagauggccuccgugaaaugcccgccgaaguacgagcuuacggaagauuguaauuuuugcagacagaugaccggagccagccugaaaaagggcucuuauccucuccaggaccuguucugucaguccagcgaggacgaugggucuaaacugaagacaaagaugaaaggagucugcgaggugggcgugcaagcucucaagaaaugcgacggccagcuguccaccgcgcaugaagucguucccuuugccguguucaagaacagcaaaaagguguaccuugauaagcuggaccucaaaacagaggaaaaucugcuuccugauuccuuugucuguuucgagcacaaggggcaguacaaaggaaccauggacucuggccagacgaagcgggaacugaaauccuuugauaucucccaaugccccaagauugggggacacggcagcaagaaauguacaggggacgcugccuucugcucugccuaugaguguaccgcucaguacgccaacgcguauugcucccaugcuaauggaagcggcaucgugcagauccaaguuucuggcguguggaagaaaccccucugugucggguacgagcgcgugguugugaagagagaacugagcgccaaaccuauucagcgggucgagccgugcacaaccuguaucaccaagugcgaaccccacggacuggugguccgcuccacaggcuuuaagauuucuagcgccguggcuugugccuccgggguuugcgugacgggaagccagucuccuuccaccgagaucacacucaaauaucccggcauuagccagucuuccgggggcgauaucggaguccauauggcucacgacgaucaaagcguguccucuaagaucguugcccauugcccuccccaggacccgugucuggugcacggcugcauugucugugcgcacgggcuuaucaacuaccagugccauaccgcccugagcgcuuucguggugauuuucguuuuuagcucuacagccaucauuugucucgcuguccuguauagagugcuuaaaugccugaagaucgccccucggaaagugcucaauccccugauguggaucaccgcguucauuagaugggucuacaagaaaaugguggcccgcguugcugacaacaucaaccaggugaaucgggaaauuggauggauggagggcgggcaacuggcccucggaaacccugcucccaucccuagacacgcccccauuccgcgcuacagcacguaucugaugcuucugcucaucgucuccuacgccagcgcuuguucugagcugauucaggcguccagccggaucacaaccugcucuaccgaaggcgugaauacaaaguguagacuguccgggaccgcccuuauccgcgcuggcagcguuggagccgaggccugccucaugcugaagggcgugaaagaagaucagacaaaguuucugaaaauuaagacggucucuagcgagcucuccugucgggaggggcagagcuauuggaccggaucuuucuccccuaaaugccugagcuccagacgcugccaucuugugggcgaaugucacguuaaccggugccugucuuggagagacaaugagacaagcgcugaauuuuccuucgugggggagucuaccacaaugcgcgaaaacaaguguuuugagcaaugcggaggcuggggguguggcugcuucaaugucaaccccagcugucucuuugugcacaccuaccugcaguccgugcggaaggaggcccugagagucuucaauugcaucgauuggguucauaaacuuacgcucgaaauuaccgacuuugauggaucugugagcacaaucgaccugggcgcguccagcucucgguucaccaacuggggguccgugagccugucucucgaugcugagggaauuuccggcagcaauucuuuuuccuucaucgaaagccccgggaagggauaugccaucgucgacgagccuuucuccgaaauuccgcgccagggcuuucugggggagaucagauguaacagcgagucuagcgugcuuuccgcccacgaaucuugccugcgggcucccaaucucguuagcuacaaaccuaugauugaucagcuggaguguacaaccaaccugaucgaccccuucguggucuuugaaagaggcucccuuccucaaacgcgcaaugauaagacauucgccgcgucuaaaggaaaccggggcgugcaggcuuuuagcaagggguccguucaggccgaccucacccugauguucgauaacuuugagguggacuucgucggagccgcugugucuugcgacgccgcuuuucugaaucucacaggcugcuauagcuguaacgccggggcgagaguuugccuguccauuaccagcaccggaacaggcacgcuuucugcccauaauaaggauggcucccugcacaucgugcuccccagcgaaaacgggaccaaagaccaaugucagauccugcauuucacagucccugagguggaggaagaguuuauguacucuugcgauggagacgaacgcccccugcuugugaagggcacccucauugcuaucgauccguucgacgauagacgggaggccgggggagaguccacagucguuaauccuaaaagcggcuccuggaacuuuuucgacugguucucugggcugaugagcugguuuggaggcccccugaagaccauucuccugaucugucuuuacguggcucuguccauuggccucuucuuucugcugaucuaucuugggcgcacgggacugagcaaaauguggcucgccgccacaaagaaggcuucuuga

SEQ ID NO: 14473 - RNA, 3480 nt, Artificial Sequence
  derived and/or modified CDS sequence (opt5) from RVFV(OS-8)__DQ380185.1__NSm-Gn-Gc
augaucgagggcgccugggacagccugagagaagaggaaaugcccgaggaacucuccugcucuauuagcgggauccgggaggugaagaccuccucucaggagcuguaccgcgcucuuaaagccauuaucgcggcugauggacugaauaauauuacaugucacggcaaggacccugaagauaaaaucagccucaucaaggggccgccccauaaaaagagagucggaauuguucggugcgagcgcagacgggacgccaagcaaaucggccgcgaaacgauggccgggauugcuaugaccgugcugccugcccuugcuguguucgcccuggcgcccgucguguuugccgaggauccucaccucagaaaccggcccggaaaaggccauaauuauaucgacggcaugacacaggaggaugcuaccuguaagccuguuacauacgccggggcuugcuccucuuucgacgugcugcuggaaaaaggaaaguuuccccucuuccagagcuaugcccaccaucgcacccugcuugaggcgguccacgauacaauuaucgccaaagcugacccgccuuccugugaucugcagagcgcccacggcaaccccugcaugaaggaaaagcucgugaugaaaacccauuguccuaaugacuaccaaucugcucacuaucugaacaaugaugggaagauggccuccguuaaaugucccccgaaguacgagcuuacggaagacugcaacuuuugcagacagaugaccggagccagccugaaaaagggcucuuauccucuccaggaccuguucugucaguccagcgaggaugacgggucuaaacugaagacaaagaugaaaggagugugcgaggucggcgugcaagcucucaagaaaugcgauggccagcuguccaccgcgcaugaagugguccccuuugccguuuucaagaauagcaaaaagguguaccuugacaagcuggaucucaaaacagaggaaaaccugcuuccugacuccuuuguguguuucgagcacaaggggcaguacaaaggaaccauggauucuggccagacgaagcgggaacugaaauccuuugacauuagccaaugccccaagaucgggggacacggcagcaagaaauguacaggggaugcugccuucugcucugccuaugaguguaccgcucaguacgccaaugcguauugcucccaugcuaacggaagcggcgucgugcagauccaaguuucuggcguguggaagaaaccccucugugucggguacgagcgcgugguugugaagagagaacugagcgccaaaccuauucagcgggucgagccgugcacaaccuguaucaccaagugcgaaccccacggacuggugguccgcuccacaggcuuuaagauuucuagcgccguggcuugugccuccgggguuugcgugacgggaagccagucuccuuccaccgagaucacacucaaauaucccggcauuagccagucuuccgggggcgacaucggaguccauauggcucacgaugaccaaagcguguccucuaagaucguugcccauugcccuccccaggacccgugucuggugcacggcugcauugucugugcgcacgggcuuaucaauuaccagugccauaccgcccugagcgcuuucguggugguuuucgucuuuuccucuguggccauuaucugucucgcuauucuguauaaagugcuuaagugccugaaaaucgccccuagaaagguccucaacccccugauguggaucacagcguucauucgguggguguacaaaaagaugguugccagaguggcugauaauaucaaccaggucaaccgcgaaauuggauggauggagggcgggcaacuggcccucggaaauccugcucccaucccucggcacgcccccauuccgagauacagcaccuaucugaugcuucugcucaucguguccuacgccagcgcuuguucugagcugauucaggcguccagccgcaucacgacaugcucuaccgaaggcguuaacaccaagugucggcuguccgggacagcccuuaucagagcuggcagcgugggagccgaggccugccucaugcugaaaggcgucaaggaagaccagaccaaauuucugcgcauuaagacagugucuagcgagcucuccugucgggaggggcagagcuauuggacgggaucuuucuccccuaaaugccugagcuccagacgcugccaucuuguuggcgaaugucacgugaaucggugccugucuuggagagauaacgagaccagcgcugaauuuuccuucgucggggagucuacaaccaugcgcgaaaauaaguguuuugagcaaugcggaggcuggggguguggcugcuucaacgugaaucccagcugucucuuugugcacacauaccugcaguccguccggaaggaggcccugagaguuuucaacugcaucgacugggugcauaaacuuacccucgaaauuacggauuuugacggaucugugagcaccaucgaucugggcgcguccagcucucgguucacaaauuggggguccgucagccugucucucgacgcugagggaauuuccggcagcaacucuuuuuccuucaucgaaagccccgggaagggauaugccaucguggaugagccuuucuccgaaauuccgcgccagggcuuucugggggagaucagauguaauagcgagucuagcguucuuuccgcccacgaaucuugccugcgggcucccaaccucauuagcuacaaaccuaugaucgaccagcuggaguguaccacaaaucugauugaucccuucguggucuuugaaagaggcucccuuccucaaacccgcaacgacaagacguucgccgcgucuaaaggaaaucggggcgugcaggcuuuuagcaagggguccguucaggccgaucucacacugauguucgacaacuuugagguggacuucgucggagccgcugugucuugcgaugccgcuuuucugaaccucagcggcugcuauuccuguaaugccggggcgagaguuugccugagcaucaccucuacaggaaccggcacccuuuccgcccauaacaaggacggcagccugcacaucgugcuccccucugaaaaugggacaaaagaucaaugucagauucugcauuucacggucccugagguggaggaagaguuuauguacuccugcgacggagaugaacgcccccugcuugugaagggcacccucaucgcuauugacccguucgaugacagacgggaggccgggggagagagcacagucguuaacccuaaauccggcucuuggaacuuuuucgauugguucagcgggcugauguccugguuuggaggcccccugaagaccauccuccugauuugucuuuacguggcucugagcaucggccucuucuuucugcugaucuaucuugggcgcacaggacugucuaaaauguggcucgccgccaccaagaaggcuuccuga

SEQ ID NO: 14474 - RNA, 3480 nt, Artificial Sequence
  derived and/or modified CDS sequence (opt5) from RVFV(ZINGA J83 R1)__KU978776.1__NSm-Gn-Gc
augaucgagggcgccugggacagccugagagaagaggaaaugcccgaggaacucuccugcucuauuagcgggauccgggaggugaagaccuccucucaggagcuguaccgcgcucuuaaagccauuaucgcggcugauggacugaauaauauuacaugucacggcaaggacccugaagauaaaaucagccucaucaaggggccgccccauaaaaagagagucggaauuguucggugcgagcgcagacgggacgccaagcaaaucggccgcgaaacgauggccgggauugcuaugaccgugcugccugcccuugcuguguucgcccuggcgcccgucguguuugccgaggauccucaccucagaaaccggcccggaaaaggccauaauuauaucgacggcaugacacaggaggaugcuaccuguaagccuguuacauacgccggggcuugcuccucuuucgacgugcugcuggaaaaaggaaaguuuccccucuuccagagcuaugcccaccaucgcacccugcuugaggcgguccacgauacaauuaucgccaaagcugacccgccuuccugugaucugcagagcgcccacggcaaccccugcaugaaggaaaagcucgugaugaaaacccauuguccuaaugacuaccaaucugcucacuaucugaacaaugaugggaagauggccuccguuaaaugucccccgaaguacgagcuuacggaagacugcaacuuuugcagacugaugaccggagccagccucaaaaagggcucuuauccucugcaggaccuguucugucaguccagcgaggaugacgggucuaaacucaagacaaagaugaaaggagugugcgaggucggcgugcaggcucugaagaaaugcgauggccaacuuuccaccgcgcaugaagugguccccuuugccguuuucaagaauagcaaaaagguguaccuggacaagcucgaucugaaaacagaggaaaaccuucugccugacuccuuuguguguuucgagcacaaggggcaguacaaaggaaccauggauucuggccagacgaagcgggaacucaaauccuuugacauuucccagugccccaagaucgggggacacggcagcaagaaauguacaggggaugcugccuucugcucugccuaugaguguaccgcucaauacgccaaugcguauugcucccaugcuaacggaagcggcaucguccagauucaggugucuggcguuuggaagaaaccccugugugugggguacgagcgcgucgugguuaagagagaacugagcgccaaaccuauccaacggguggagccgugcacaaccuguauuaccaagugcgaaccccacggacucgucgugcgcuccacaggcuuuaagaucucuagcgccgucgcuugugccuccggggugugcguuacgggaagccagucuccuuccaccgagauuacacugaaauaucccggcaucagccagucuuccgggggcgacaucggagugcauauggcucacgaugaccagagcgucuccucuaagauuguggcccauugcccuccccaagacccgugucuuguucacggcugcaucgugugugcgcacgggcugauuaauuaccagugccauaccgcccucagcgcuuucgucgugguguucguuuuuagcucuaucgccauuaucugucuggcuauccuuuauagaguccugaaaugccucaagauugccccucggaaagugcugaacccccugauguggaucacagcguucauuagauggguguaccgcaagauggucgcccggguggcugauaauaucaaccagguuaacagagaaauuggauggauggagggcgggcagcucgugcugggaaauccugcccccaucccucgccacguccccauuccgcgguacagcaccuaucuuaugcugcuccugaucguguccuacgcuagcgccuguucugagcugauccaagccuccagcagaauuacgacaugcucuaccgaaggcguuaacaccaaaugucgccuuuccgggacagcucucauccgggcgggcagcgugggagccgaggcuugccugaugcugaagggcgucaaggaagaccagaccaaauuucucaagauuaaaacagugucuagcgagcuguccuguagagaggggcagagcuauuggacgggaucuuucuccccuaagugccuuagcucccgccggugccaucugguuggcgaaugucacgugaauagaugccucucuuggcgcgauaacgagaccagcgccgaauuuuccuucgucggggagucuacaaccaugcgggaaaauaaauguuuugagcagugcggaggcuggggguguggcugcuucaacgugaaucccagcugucuguuugugcacacauaccugcaauccgucagaaaggaggcccuucggguuuucaacugcaucgacugggugcauaagcucacccuggaaauuacggauuuugacggaucugugagcaccaucgaucugggcgcuuccagcucucgcuucacaaauuggggguccgucagccucucucuggacgccgagggaaucuccggcagcaacucuuuuuccuucauugaaagccccgggaaaggauaugcgaucguggaugagccuuucuccgaaauuccgagacagggcuuucuuggggagauccgguguaauagcgagucuagcguucuguccgcucacgaaucuugccucagagcccccaaccugauuagcuacaagccuaugaucgaccagcuggaguguaccacaaaucuuaucgaucccuucguggucuuugaacgcggcucccucccucagacccggaacgacaaaacguucgccgcuucuaagggaaauagaggcgugcaagccuuuagcaaaggguccguucaggcggaucugacacugauguucgacaacuuugagguggacuucgucggagcugccgugucuugcgaugccgcuuuucucaaccugaccggcugcuauagcuguaaugccggggcucgcguuugccuuuccauuacaagcaccggaaccggcacacugucugcccauaacaaggacggcucccuccacaucgugcugcccagcgaaaaugggacgaaggaucagugucaaauucugcauuucaccgucccugagguggaggaagaguuuauguacucuugcgacggagaugaaagaccccuucucgugcggggcacacugaucgcgauugacccguucgaugaccgcagagaggccgggggagaguccaccgucguuaacccuaaaagcggcuccuggaacuuuuucgauugguucucugggcugaugagcugguuuggaggcccccucaagacaauccugcuuaucugucuguacguggcucucuccauuggccuguucuuucugcuuaucuaucuggggcggaccggacucagcaaaauguggcuggccgcuacgaagaaagccucuuga

SEQ ID NO: 14475 - RNA, 3480 nt, Artificial Sequence
  derived and/or modified CDS sequence (opt5) from RVFV(2007000253)__JF326192.1__NSm-Gn-Gc
augaucgagggcgccugggacagccugagagaagaggaaaugcccgaggaacucuccugcucugugagcgggauucgggaggucaagaccuccucucaggagcuguaccgcgcucuuaaagccaucauugcggcugauggacugaacaauaucacaugucacggcaagaacccugaagacaaaauuagccucaucaaggggccgccccauaaaaagagaguuggaaucgugcggugcgagcgcagacgggaugccaagcaaauuggccgcgaaacgauggccgggaucgcuaugaccgugcugccugcccuugcugucuucgcccuggcgcccgugguuuuugccgaggacccucaccucagaaaucggcccggaaaaggccauaacuauauugauggcaugacacaggaggacgcuaccuguaagccugugacauacgccggggcuugcuccucuuucgauguccugcuggaaaaaggaaaguuuccccucuuccagagcuaugcccaccaucgcacccugcuugaggcggugcacgacacaaucauugccaaagcugaucccccuuccugugaccugcagagcgcccacggcaaucccugcaugaaggaaaagcucguuaugaaaacccauuguccuaacgauuaccaaucugcucacuaucugaauaacgacgggaagauggccuccgugaaaugcccgccgaaguacgagcuuacggaagauuguaauuuuugcagacagaugaccggagccagccugaaaaagggcucuuauccucuccaggaccuguucugucaguccagcgaggacgaugggucuaaacugaagacaaagaugaaaggagucugcgaggugggcgugcaagcucucaagaaaugcgacggccagcuguccaccgcgcaugaagucguucccuuugccguguucaagaacagcaaaaagguguaccuugauaagcuggaccucaaaacagaggaaaaucugcuuccugauuccuuugucuguuucgagcacaaggggcaguacaaaggaaccauggacucuggccagacgaagcgggaacugaaauccuuugauaucucccaaugccccaagauugggggacacggcagcaagaaauguacaggggacgcugccuucugcucugccuaugaguguaccgcucaguacgccaacgcguauugcucccaugcuaauggaagcggcaucgugcagauccaaguuucuggcguguggaagaaaccccucugugucggguacgagcgcgugguugugaagagagaacugagcgccaaaccuauucagcgggucgagccgugcacaaccuguaucaccaagugcgaaccccacggacuggugguccgcuccacaggcuuuaagauuucuagcgccguggcuugugccuccgggguuugcgugacgggaagccagucuccuuccaccgagaucacacucaaauaucccggcauuagccagucuuccgggggcgauaucggaguccauauggcucacgacgaucaaagcguguccucuaagaucguugcccauugcccuccccaggacccgugucuggugcacggcugcauugucugugcgcacgggcuuaucaacuaccagugccauaccgcccugagcgcuuucguggugauuuucguuuuuagcucuacagccaucauuugucucgcuguccuguauagagugcuuaaaugccugaagaucgccccucggaaagugcucaauccccugauguggaucaccgcguucauuagaugggucuacaagaaaaugguggcccgcguugcugacaacaucaaccaggugaaucgggaaauuggauggauggagggcgggcaacuggcccucggaaacccugcucccaucccuagacacgcccccauuccgcgcuacagcacguaucugaugcuucugcucaucgucuccuacgccagcgcuuguucugagcugauucaggcguccagccggaucacaaccugcucuaccgaaggcgugaauacaaaguguagacuguccgggaccgcccuuauccgcgcuggcagcgccggagccgaggcuugccucaugcugaagggcguuaaagaagaucagacaaaguuucugaaaauuaagacggugucuagcgagcucuccugucgggaggggcagagcuauuggaccggaucuuucuccccuaaaugccugagcuccagacgcugccaucuugucggcgaaugucacgugaaccggugccugucuuggagagacaaugagacaagcgccgaauuuuccuucguuggggagucuaccacaaugcgcgaaaacaaguguuuugagcaaugcggaggcuggggguguggcugcuucaaugugaaccccagcugucucuuuguccacaccuaccugcaguccgugcggaaggaggcgcugagaguguucaauugcaucgauuggguccauaaacuuacgcucgaaauuaccgacuuugauggaucuguuagcacaaucgaccugggcgcuuccagcucucgguucaccaacuggggguccgugagccugucucucgaugccgagggaauuuccggcagcaauucuuuuuccuucaucgaaagccccgggaagggauaugccaucguggacgagccuuucuccgaaauuccgcgccagggcuuucugggggagaucagauguaacagcgagucuagcguccuuuccgcucacgaaucuugccugcgggcccccaaucucgugagcuacaaaccuaugauugaucagcuggaguguacaaccaaccugaucgaccccuucguuguguuugaaagaggcucccuuccucaaacgcgcaaugauaagacauucgcggcuucuaaaggaaaccggggcguccaggccuuuagcaagggguccgugcaggccgaccucacccugauguucgauaacuuugagguugacuucgugggagcugccgucucuugcgacgcugccuuucugaaucucacaggcugcuauagcuguaacgcgggggccagagugugccuguccauuaccagcaccggaacaggcacgcuuucugcucauaauaaggauggcucccugcacaucguucuccccagcgaaaacgggaccaaagaccaaugucagauccugcauuucacagugccugaggucgaggaagaguuuauguacucuugcgauggagacgaacgcccccugcuugugaagggcacccucauugccaucgauccguucgacgauagacgggaggcugggggagaguccacaguggucaauccuaaaagcggcuccuggaacuuuuucgacugguucucugggcugaugagcugguuuggaggcccccugaagaccauucuccugaucugucuuuacguugcccuguccauuggccucuucuuucugcugaucuaucuugggcgcacgggacugagcaaaauguggcucgccgcuacaaagaaggcgucuuga

SEQ ID NO: 14476 - RNA, 3480 nt, Artificial Sequence
  derived and/or modified CDS sequence (opt5) from RVFV(MP12)__Z30318.1__NSm-Gn-Gc
augaucgagggcgccugggacagccugagagaagaggaaaugcccgaggaacucuccugcucuauuagcgggauccgggaggugaagaccuccucucaggagcuguaccgcgcucuuaaagccauuaucgcggcugauggacugaauaauauuacaugucacggcaaggacccugaagauaaaaucagccucaucaaggggccgccccauaaaaagagagucggaauuguucggugcgagcgcagacgggacgccaagcaaaucggccgcaaaacgauggccgggauugcuaugaccgugcugccugcccuugcuguguucgcccuggcgcccgucguguuugccgaagauccucaccucagaaaccggcccggaaagggccauaauuauaucgacggcaugacacaggaggaugcuaccuguaaaccuguuacauacgccggggcuugcuccucuuucgacgugcugcuggagaagggaaaauuuccccucuuccagagcuaugcccaccaucgcacccugcuugaagcgguccacgauacaauuaucgccaaggcugacccgccuuccugugaucugcucagcgcccacggcaaccccugcaugaaggagaaacuggugaugaagacccauuguccuaaugacuaccagucugcucaccaucuuaacaaugaugggaaaauggccuccguuaagugucccccgaaauaugaacugacggaggacugcaacuuuugcagacaaaugaccggagccagccucaagaaaggcucuuacccucugcaggaccuguucugucaguccagcgaagaugacgggucuaagcucaagacaaaaaugaagggagugugcgaggucggcgugcaggcucugaaaaagugcgauggccaacuuuccaccgcgcacgaggugguccccuuugccguuuucaaaaauagcaagaagguguaucuggacaaacucgaucugaagacagaagagaaccuucugccugacuccuuuguguguuucgaacacaaagggcaguacaagggaaccauggauucuggccagacgaaacgggagcucaagagcuuugacauuucccagugccccaagaucgggggacauggcagcaaaaaguguacaggggaugcugccuucugcucugccuacgaauguaccgcucaauaugccaaugcguacugcucccacgcuaacggaagcggcaucguccagauucaggugucuggcguuuggaaaaagccccugugugugggguaugagcgcgucgugguuaaaagagagcugagcgccaagccuauccaacggguggaaccgugcacaaccuguauuaccaagugcgagccccauggacucgucgugcgcuccacaggcuuuaaaaucucuagcgccgucgcuugugccuccggggugugcguuacgggaagccagucuccuuccaccgaaauuacacugaaguaccccggcaucagccagucuuccgggggcgacaucggagugcacauggcucaugaugaccagagcgucuccucuaaaauuguggcccacugcccuccccaagacccgugucuuguucacgauugcaucgugugugcgcauggccugauuaauuaucagugccacaccgcccucagcgcuuucgucgugguguucgucuuuuccucuaucgccauuaucugucuggcuauccuuuacagaguucugaagugccucaaaauugccccucggaaggugcugaacccccugauguggaucacagcguucauuagauggaucuauaaaaagaugguggcccgcgucgcucauaauauuaaccaggugaaccgggagaucggguggauggaaggaggccagcucguucuggggaauccugcccccauuccuagacacgcucccaucccgcgcuacagcaccuaccuuaugcugcuccugaucguguccuaugccagcgccuguucugagcugauucaggcuuccagccggaucacgacaugcucuaccgagggagucaacaccaaguguagacuuuccggcacagcgcucauucgcgccgggagcgugggcgcugaagccugccugaugcugaaaggaguuaaggaggaccaaaccaaauuucucaagcugaaaacagugucuagcgaacuuuccugucgggagggccagagcuacuggacggggucuuucuccccuaagugccugagcuccagacgcugccaccucgucggagagugucaugugaaucggugccugucuuggagagauaacgaaaccagcgccgaguuuuccuucguuggcgaaucuacaaccaugcgcgagaauaaguguuuugaacagugcgggggauggggcugugggugcuucaacgugaaucccagcugucuguuuguccacacauaucuucaauccgugcggaaagaggcucucagaguguucaacugcaucgacuggguccauaagcugacccuggagauuacggauuuugacggcucuguuagcaccaucgaucucggagccuccagcucucgguucacaaauuggggcuccgugagccugucucuugacgcggaagggaucuccggaagcaacucuuuuuccuucauugagagccccggcaaaggguacgcuaucguggaugaaccuuucuccgagauuccgcgccagggauuucugggcgaaaucagauguaauagcgagucuagcguccucuccgcccacgagucuugccugcgggcccccaaccugauuagcuauaagccuaugaucgaccagcuugaauguaccacaaaucucaucgaucccuucgugguuuuugagagagggucccugccucagacccgcaacgacaaaacguucgcugccucuaagggcaaucggggagugcaagcguuuagcaagggcuccguccaggcugaucugacacucauguucgacaacuuugaaguggacuucguuggggccgccgugucuugcgaugcugccuuucugaaccuuaccggaugcuacagcuguaaugcuggcgccagagucugccuguccauuacaagcaccgggaccggaucucucuccgcgcauaacaaagacggcagccugcacaucgugcugcccucugagaauggcacaaaggaucagugucaaauucuucacuucacgguuccugaaguggaggaggaauuuauguauuccugcgacggggaugagcgcccccuccuggucaaaggaacccugaucgccauugacccguucgaugacagacgggaagcuggcggggagagcacaguggugaacccuaaguccggaucuuggaacuuuuucgauugguucagcggccucauguccugguuugggggaccccugaaaaccauccuucugaucugucucuacgucgcccugagcauuggccuguucuuucuucugaucuaccucggcgggacaggacugucuaagauguggcucgcugccaccaagaaagccuccuga

SEQ ID NO: 14477 - RNA, 3480 nt, Artificial Sequence
  derived and/or modified CDS sequence (opt5) from RVFV(BIME-01)__KX609032.1__NSm-Gn-Gc
augaucgagggcgccugggacagccugagagaagaggaaaugcccgaggaacucuccugcucuauuagcgggauccgggaggugaagaccuccucucaggagcuguaccgcgcucuuaaagccauuaucgcggcugauggacugaauaauauuacaugucacggcaaggacccugaagauaaaaucagccucaucaaggggccgccccauaaaaagagagucggaauuguucggugcgagcgcagacgggacgccaagcaaaucggccgcgaaacgauggccgggauugcuaugaccgugcugccugcccuugcuguguucgcccuggcgcccgucguguuugccgaggauccucaccucagaaaccggcccggaaaaggccauaauuauaucgacggcaugacacaggaggaugcuaccuguaagccuguuacauacgccggggcuugcuccucuuucgacgugcugcuggaaaaaggaaaguuuccccucuuccagagcuaugcccaccaucgcacccugcuugaggcgguccacgauacaauuaucgccaaagcugacccgccuuccugugaucugcagagcgcccacggcaaccccugcaugaaggaaaagcucgugaugaaaacccauuguccuaaugacuaccaaucugcucacuaucugaacaaugaugggaagauggccuccguuaaaugucccccgaaguacgagcuuacggaagacugcaacuuuugcagacagaugaccggagccagccugaaaaagggcucuuauccucuccaggaccuguucugucaguccagcgaggaugacgggucuaaacugaagacaaagaugaaaggagugugcgaggucggcgugcaagcucucaagaaaugcgauggccagcuguccaccgcgcaugaagugguccccuuugccguuuucaagaauagcaaaaagguguaccuugacaagcuggaucucaaaacagaggaaaaccugcuuccugacuccuuuguguguuucgagcacaaggggcaguacaaaggaaccauggauucuggccagacgaagcgggaacugaaauccuuugacauuucccaaugccccaagaucgggggacacggcagcaagaaauguacaggggaugcugccuucugcucugccuaugaguguaccgcucaguacgccaaugcguauugcucccaugcuaacggaagcggcaucguccagauucaagugucuggcguuuggaagaaaccccucugugugggguacgagcgcgucgugguuaagagagaacugagcgccaaaccuauccagcggguggagccgugcacaaccuguauuaccaagugcgaaccccacggacuggucgugcgcuccacaggcuuuaagaucucuagcgccgucgcuugugccuccggggugugcguuacgggaagccagucuccuuccaccgagauuacacucaaauaucccggcaucagccagucuuccgggggcgacaucggagugcauauggcucacgaugaccaaagcgucuccucuaagauuguggcccauugcccuccccaggacccgugucugguucacggcugcaucgugugugcgcacgggcuuauuaauuaccagugccauaccgcccugagcgcuuucgucgugguguucguuuuuagcucugucgccaucauuugucucgcuauccuguauaaagugcuuagaugccugaagaucgccccuaaaaaggugcucaacccccugauguggauuacagcguucauccggugggucuacaaaaagaugguggccagaguugcugauaauauuaaccaggugaaccgcgaaaucggauggauggagggcgggcaacuggcccucggaaauccugcucccauuccucggcacgcccccaucccgagauacagcaccuaucugaugcuucugcucauuaucuccuacgccagcgcuuguucugagcugauccaggcguccagccgcauuacgacaugcucuaccgaaggcgucaacaccaagugucggcuguccgggacagcccuuaucagagcuggcagcgugggagccgaggccugccucaugcugaaaggcguuaaggaagaccagaccaaauuucugaagauuaaaacagugucuagcgagcucuccugucgcgaggggcagagcuauuggacgggaucuuucuccccuaagugccugagcucccggagaugccaucuugucggcgaaugucacgugaaucgcugccugucuuggcgggauaacgagaccagcgcugaauuuuccuucguuggggagucuacaaccaugagagaaaauaaguguuuugagcaaugcggaggcuggggguguggcugcuucaacgugaaucccagcugucucuuuguccacacauaccugcaguccgugcgcaaagaggcccugcggguguucaacugcaucgacuggguccauaaacuuacccucgaaauuacggauuuugacggaucuguuagcaccaucgaucugggcgcguccagcucuagauucacaaauuggggguccgugagccugucucucgacgcugagggaaucuccggcagcaacucuuuuuccuucauugaaagccccgggaaaggauaugccaucguggaugagccuuucuccgaaauuccgcggcagggcuuucugggggagauccgcuguaauagcgagucuagcguccuuuccgcccacgaaucuugccugagagcucccaaccucauuagcuacaagccuaugaucgaccagcuggaguguaccacaaaucugaucgaucccuucgugguuuuugaacggggcucccuuccucaaaccagaaacgacaaaacguucgccgcgucuaagggaaaucgcggcgugcaggcuuuuagcaagggguccguccaggccgaucucacacugauguucgacaacuuugagguggacuucguuggagccgcugugucuugcgaugccgcuuuucugaaccucaccggcugcuauagcuguaaugccggggcgcgggucugccuguccauuacaagcaccggaaccggcacacuuucugcccauaacaaagacggcucccugcacaucgugcuccccagcgaaaaugggacgaaggaucaaugucagauucugcauuucaccguuccugagguggaggaagaguuuauguacucuugcgacggagaugaaagaccccugcuugucaaaggcacacucaucgcuauugacccguucgaugaccgcagagaggccgggggagaguccaccguggugaacccuaagagcggcuccuggaacuuuuucgauugguucucugggcugaugagcugguuuggaggcccccugaaaacaauccuccugaucugucuuuacgucgcucuguccauuggccucuucuuucugcugaucuaucuugggcggaccggacugagcaagauguggcucgccgccacgaagaaggcuucuuga

SEQ ID NO: 14478 - RNA, 3480 nt, Artificial Sequence
  derived and/or modified CDS sequence (opt5) from RVFV(200803166)__JF311381.1__NSm-Gn-Gc
augaucgagggcgccugggacagccugagagaagaggaaaugcccgaggaacucuccugcucugugagcgggauucgggaggucaagaccuccucucaggagcuguaccgcgcucuuaaagccaucauugcggcugauggacugaacaauaucacaugucacggcaagaacccugaagacaaaauuagccucaucaaggggccgccccauaaaaagagaguuggaaucgugcggugcgagcgcagacgggaugccaagcaaauuggccgcgaaacgauggccgggaucgcuaugaccgugcugccugcccuugcugucuucgcccuggcgcccgugguuuuugccgaggacccucaccucagaaaucggcccggaaaaggccauaacuauauugauggcaugacacaggaggacgcuaccuguaagccugugacauacgccggggcuugcuccucuuucgauguccugcugaaaaagggaaaauuuccccucuuccagagcuaugcccaccaucgcacccugcuugaagcggugcacgacacaaucauugccaaggcugaucccccuuccugugaccugcagagcgcccacggcaaucccugcaugaaggagaaacucguuaugaagacccauuguccuaacgauuaccaaucugcucacuaucugaauaacgacgggaaaauggccuccgugaagugcccgccgaaauacgaacuuacggaggauuguaauuuuugcagacagaugaccggagccagccugaagaaaggcucuuauccucuccaggaccuguucugucaguccagcgaagacgaugggucuaagcugaagacaaaaaugaagggagucugcgaggugggcgugcaagcucucaaaaagugcgacggccagcuguccaccgcgcaugaggucguucccuuugccguguucaaaaacagcaagaagguguaccuugauaaacuggaccucaagacagaagagaaucugcuuccugauuccuuugucuguuucgaacacaaagggcaguacaagggaaccauggacucuggccagacgaaacgggagcuuaagagcuuugauaucucccaaugccccaagauugggggacacggcagcaaaaaguguacaggggacgcugccuucugcucugccuaugaauguaccgcucaguacgccaacgcguauugcucccaugcuaauggaagcggcaucgugcagauccaaguuucuggcguguggaaaaagccccucugugucggguacgagcgcgugguugugaaaagagagcugagcgccaagccuauucagcgggucgaaccgugcacaaccuguaucaccaagugcgagccccacggacuggugguccgcuccacaggcuuuaaaauuucuagcgccguggcuugugccuccgggguuugcgugacgggaagccagucuccuuccaccgaaaucacacucaaguaucccggcauuagccagucuuccgggggcgauaucggaguccauauggcucacgacgaucaaagcguguccucuaaaaucguugcccauugcccuccccaggacccgugucuggugcacggcugcauugucugugcgcacgggcuuaucaacuaccagugccauaccgcccugagcgcuuucguggugguuuucgucuuuuccucuauugccaucauuugucucgcuauccuguauagagugcuuaagugccugaaaaucgccccucggaaggugcucaauccccugauguggauuacagcguucaucagaugggucuacaaaaagaugguggcccgcguugcugacaacauuaaccaggugaaucgggagaucggauggauggaaggcgggcaacugguccucggaaacccugcccccauuccuagacacgcucccaucccgcgcuacagcaccuaucugaugcuucugcucauuguguccuacgccacggccuguagcgagcugauccaggcuucuucccggaucacaaccugcagcaccgagggcguuaauacaaaguguagacugucugggaccgcgcuuauucgcgccggcuccgugggagcugaagccugccucaugcugaaaggcgucaaggaggaucagacaaaauuucugaagaucaaaacggugagcucugaacucagcugucgggaggggcaguccuauuggaccggcagcuucucuccuaagugccuguccagcagacgcugccaucuuguuggagagugucacgugaaccggugccuguccuggagagacaaugaaacaucugccgaguuuagcuucgucggggaauccaccacaaugcgcgagaacaaguguuuugaacaaugcggaggcuggggguguggcugcuucaaugugaaccccucuugucucuuugugcacaccuaccugcagagcguccggaaagaggcucugagaguuuucaauugcauugauugggugcauaagcugacgcucgagaucaccgacuuugauggauccgugucuacaauugaccugggcgccagcuccagccgguucaccaacugggggucugucucccugagccucgaugcggaaggaaucucuggcuccaauagcuuuucuuucaucgagucccccgggaaaggauaugcuauuguggacgaaccuuucagcgagaucccgcgccagggcuuucugggggaaauuagauguaacuccgagagcucuguucuuagcgcccacgaguccugccugcgggcccccaaucucaucucuuacaagccuaugauugaucagcuggaauguacaaccaaccugaucgaccccuucguggucuuugagagaggcagccuuccucaaacgcgcaaugauaaaacauucgcugccuccaagggaaaccggggcgugcaggcguuuucuaaggggagcguucaggcugaccucacccugauguucgauaacuuugaaguggacuucgucggagccgccguguccugcgacgcugccuuucugaaucucacaggcugcuauucuuguaacgcuggggccagaguuugccugagcaucaccuccaccggaacaggcacgcuuagcgcgcauaauaaagauggcucucugcacgugguccuccccuccgagaacgggaccaaggaccaaugucagauucugcauuucacagugccugaaguggaggaggaauuuauguacagcugcgauggagacgagcgcccccugcuugucaaaggcacccucaucgccauugauccguucgacgauagacgggaagcugggggagagucuacaguugugaauccuaaguccggcagcuggaacuuuuucgacugguucuccgggcugaugucuugguuuggaggcccccugaaaaccauccuccugauuugucuuuacguggcccugagcaucggccucuucuuucugcugaucuaucuugggcgcacgggacuguccaagauguggcucgcugccacaaagaaagccagcuga

SEQ ID NO: 14479 - RNA, 3480 nt, Artificial Sequence
  derived and/or modified CDS sequence (opt5) from RVFV(Kenya 83 (21445))__DQ380198.1__NSm-Gn-Gc
augaucgagggcgccugggacagccugagagaagaggaaaugcccgaggaacucuccugcucuauuagcgggauccgggaggugaagaccuccucucaggagcuguaccgcgcucuuaaagccauuaucgcggcugauggacugaauaauauuacaugucacggcaagaacccugaaaauaaaaucagccucaucaaggggccgccccauaaaaagagagucggaauuguucggugcgagcgcagacgggacgccaagcaaaucggccgcgaaacgauggccgggauugcuaugaccgugcugccugcccuugcuguguucgcccuggcgcccgucguguuugccgaggauccucaccucagaaaccggcccggaaaaggccauaauuauaucgacggcaugacacaggaggaugcuaccuguaagccuguuacauacgccggggcuugcuccucuuucgacgugcugcuggaaaaaggaaaguuuccccucuuccagagcuaugcccaccaucgcacccugcuugaggcgguccacgauacaauuaucgccaaagcugacccgccuuccugugaucugcagagcgcccacggcaaccccugcaugaaggaaaagcucgugaugaaaacccauuguccuaaugacuaccaaucugcucacuaucugaacaaugaugggaagauggccuccguuaaaugucccccgaaguacgagcuuacggaagacugcaacuuuugcagacagaugaccggagccagccugaaaaagggcucuuauccucuccaggaucuguucugucaguccagcgaggacgacgggucuaaacugaagacaaagaugaaaggagugugcgaggucggcgugcaagcucucaagaaaugcgauggccagcuguccaccgcgcaugaagugguccccuuugccguuuucaagaauagcaaaaagguguaccuugacaagcuggaucucaaaacagaggaaaaccugcuuccugacuccuuuguguguuucgagcacaaggggcaguacaaaggaaccauggauucuggccagacgaagcgggaacugaaauccuuugacauuucccaaugccccaagaucgggggacacggcagcaagaaauguacaggggaugcugccuucugcucugccuaugaguguaccgcucaguacgccaaugcguauugcucccaugcuaacggaagcggcaucguccagauucaagugucuggcguuuggaagaaaccccucugugugggguacgagcgcgucgugguuaagagagaacugagcgccaaaccuauccagcggguggagccgugcacaaccuguauuaccaagugcgaaccccacggacuggucgugcgcuccacaggcuuuaagaucucuagcgccgucgcuugugccuccggggugugcguuacgggaagccagucuccuuccaccgagauuacacucaaauaucccggcaucagccagucuuccgggggcgacaucggagugcauauggcucacgaugaccaaagcgucuccucuaagauuguggcccauugcccuccccaggauccgugucugguucacggcugcaucgugugugcgcacgggcuuauuaauuaccagugccauaccgcccugagcgcuuucgucgugguguucguuuuuagcucuaucgccauuaucugucucgcuauccuguauagaguccuuaaaugccugaagauugccccucggaaagugcucaacccccugauguggaucacagcguucauuagauggguguacaagaaaauggucgcccgcguggcugacaacaucaaucagguuaaccgggaaauuggauggauggagggcgggcaacuggcccucggaaauccugcucccaucccuagacacgcccccauuccgcgcuacagcaccuaucugaugcuucugcucaucguguccuacgccagcgcuuguucugagcugauccaggcguccagccggauuacgacaugcucuaccgaaggcgucaacaccaaguguagacuguccgggacagcccuuauccgcgcuggcagcgugggagccgaggccugccucaugcugaagggcguuaaagaagaccagaccaaguuucugaaaauuaagacagugucuagcgagcucuccugucgggaggggcagagcuauuggacgggaucuuucuccccuaaaugccugagcuccagacgcugccaucuugucggcgaaugucacgugaaucggugccugucuuggagagauaacgagaccagcgcugaauuuuccuucguuggggagucuacaaccaugcgcgaaaauaaguguuuugagcaaugcggaggcuggggguguggcugcuucaacgugaaucccagcugucucuuuguccacacauaccugcaguccgugcggaaggaggcccugagaguguucaacugcaucgacuggguccauaaacuuacccucgaaauuacggauuuugacggaucuguuagcaccaucgaucugggcgcguccagcucucgguucacaaauuggggguccgugagccugucucucgacgcugagggaaucuccggcagcaacucuuuuuccuucauugaaagccccgggaagggauaugccaucguggaugagccuuucuccgaaauuccgcgccagggcuuucugggggagaucagauguaauagcgagucuagcguccuuuccgcccacgaaucuugccugcgggcucccaaccucauuagcuacaaaccuaugaucgaccagcuggaguguaccacaaaucugaucgaucccuucgugguuuuugaaagaggcucccuuccucaaacccgcaacgacaagacguucgccgcgucuaaaggaaaccggggcgugcaggcuuuuagcaagggguccguccaggccgaucucacacugauguucgacaauuuugagguggauuucguuggagccgcugugucuugcgacgccgcuuuucugaaccucaccggcugcuauagcuguaaugccggggcgagagucugccuguccauuacaagcaccggaaccggcacacuuucugcccauaacaaggacggcucccugcacaucgugcuccccagcgaaaaugggacgaaagaucaaugucagauucugcauuucaccguuccugagguggaggaagaguuuauguacucuugcgacggagaugaacgcccccugcuugucaagggcacacucaucgcuauugacccguucgaugacagacgggaggccgggggagaguccaccguggugaacccuaaaagcggcuccuggaacuuuuucgauugguucucugggcugaugagcugguuuggaggcccccugaagacaauccuccugaucugucuuuacgucgcucuguccauuggccucuucuuucugcugaucuaucuugggcgcaccggacugagcaaaauguggcucgccgccacgaagaaggcuucuuga

SEQ ID NO: 14480 - RNA, 3480 nt, Artificial Sequence
  derived and/or modified CDS sequence (opt5) from RVFV(Entebbe)__DQ380191.1__NSm-Gn-Gc
augaucgagggcgccugggacagccugagagaagaggaaaugcccgaggaacucuccugcucuauuagcgggauccgggaggugaagaccuccucucaggagcugcaccgcgcucuuaaagccauuaucgcggcugauggacugaauaauauuacaugucauggcaaggacccugaagauaaaaucagccucaucaaggggccgccccacaaaaagagagucggaguugugcggugcgagcgcagacgggacgccaagcaaauuggccgcgaaacgauggccgggaucgcuaugaccgugcugccugcccuugcugucuucgcccuggcgcccgugguuuuugccgaggauccucaucucagaaaccggcccggaaaaggccacaauuacauugacggcaugacacaggaggaugcuaccuguaagccugugacauaugccggggcuugcuccucuuucgacguccugcuggaaaaaggaaaguuuccccucuuccagagcuacgcccaucaccgcacccugcuugaggcggugcacgauacaaucauugccaaagcugacccgccuuccugugaucugcagagcgcccauggcaaccccugcaugaaggaaaagcucguuaugaaaacccacuguccuaaugacuaucaaucugcucauuaccugaacaaugaugggaagauggccuccgugaaaugucccccgaaguaugagcuuacggaagacugcaacuuuugcagacagaugaccggagccagccugaaaaagggcucuuacccucuccaggaccuguucugucaguccagcgaggaugacgggucuaaacugaagacaaagaugaaaggagucugcgaggugggcgugcaagcucucaagaaaugcgauggccagcuguccaccgcgcacgaagucguucccuuugccguguucaagaauagcaaaaagguguaucuugacaagcuggaucucaaaacagaggaaaaccugcuuccugacuccuuugucuguuucgagcacaaggggcaguacaaaggaaccauggauucuggccagaucaagcgggaacugaaauccuuugacauuagccaaugccccaagaucgggggacauggcagcaagaaauguacgggggaugcugccuucugcucugccuacgaguguacagcucaguaugccaaugcguacugcucccacgcuaacggaagcggcaucgugcagauucaaguuucuggcguguggaagaaaccccucugugucggguaugagcgcgugguugugaagagagaacugagcgccaaaccuauccagcgggucgagccgugcaccacauguauuaccaagugcgaaccccauggacuggugguccgcuccaccggcuuuaagaucucuagcgccguggcuugugccuccgggguuugcgugacaggaagccagucuccuuccacggagauuacccucaaauaccccggcaucagccagucuuccgggggcgacaucggaguccacauggcucaugaugaccaaagcguguccucuaagauuguugcccacugcccuccccaggacccgugucuggugcacggcugcaucgucugugcgcaugggcuuauuaauuaucagugccacacagcccugagcgcuuucguggugguuuucgucuuuuccucuguggccaucauuugucucgcuauccuguacaaagugcuuaagugccugaaaaucgccccuagaaagguccucaacccccugauguggauuaccgcguucauccgguggguguauaaaaagaugguugccagaguggcugauaauauuaaccaggucaaccgcgaaaucggauggauggagggcgggcaacuggugcucggaaauccugcccccauuccucggcaugcucccaucccgagauacagcacauaccugaugcuucugcucauuguuuccuaugccagcgccuguucugagcugauccaggcuuccagccgcaucaccacgugcucuacagaaggcgugaacaccaagugucggcuguccgggaccgcgcuuauuagagccggcagcgucggagcugaggccugccucaugcugaaaggcgugaaggaagaccagacaaaauuucugaagaucaaaaccguuucuagcgagcucuccugucgcgaggggcagagcuacuggacaggaucuuucuccccuaagugccugagcucccggagaugccaccuugugggcgaaugucacgucaaucgcugccugucuuggcgggauaacgagacgagcgccgaauuuuccuucgugggggagucuaccacaaugagagaaaauaaguguuuugagcaaugcggaggcuggggguguggcugcuucaacgugaaucccagcugucucuuuguccauaccuaucugcaguccguucgcaaagaggcucugcggguguucaacugcauugacugggugcacaaacuuacacucgaaaucaccgauuuugacggaucugucagcacgguggaucugggcgccuccagcucuagauucaccaauuggggguccguuagccugucucucgacgcggagggaauuuccggcagcaacucuuuuuccuucaucgaaagccccgggaagggauacgcuaucguggaugagccuuucuccgaaauuccgcggcagggcuuucugggggagauccgcuguaauagcgagucuagcguccuuuccgcccaugaaucuugccugagagcccccaaccucauuagcuauaagccuaugaucgaccagcuggaguguacaaccaaucugauugaucccuucgugguuuuugaacggggcucccuuccucaaacaagaaacgacaaaaccuucgcugccucuaagggaaaucgcggcgugcaggcguuuagcaagggguccguccaggcugaucucacgcugauguucgacaacuuugagguggacuucguuggagccgccgugucuugcgaugcugccuuucugaaccucacaggcugcuacagcuguaaugcuggggcccgggucugccuguccaucaccagcacaggaaccggcacccuuucugcgcacaacaaagacggcucccugcauaucgugcuccccagcgaaaaugggacaaaggaucaaugucagauucugcacuucacggugccugaggucgaggaagaguuuauguauucuugcgacggagaugaaagaccccugcuuguuaaaggcacccucaucgccauugacccguucgaugaccgcagagaggcugggggagaguccacaguggugaacccuaagagcggcuccuggaacuuuuucgauugguucucugggcugaugagcugguuuggaggcccccugaaaaccauccuccugauuugucuuuacgucgcccuguccaucggccucuucuuucugcugaucuaccuugggcggacaggacugagcaagauguggcucgcugccaccaagaaagccucuuga

SEQ ID NO: 14481 - RNA, 3480 nt, Artificial Sequence
  derived and/or modified CDS sequence (opt5) from RVFV(763/70)__DQ380188.1__NSm-Gn-Gc
augaucgagggcgccugggacagccugagagaagaggaaaugcccgaggaacucuccugcucuauuagcgggauccgggaggugaagaccuccucucaggagcuguaccgcgcucuuaaagccauuaucgcggcugauggacugaauaauauuacaugucacggcaaggacccugaagauaaaaucagccucgucaaggggccgccccauaaaaagagaguuggaaucgugcggugcgagcgcagacgggacgccaagcaaauuggccgcgaaacgauggccgggaucgcuaugaccgugcugccugcccuugcugucuucgcccuggcgcccgugguuuuugccgaggauccucaccucagaaaccggcccggaaaaggccauaauuauauugacggcaugacacaggaggaugcuaccuguaagccugugacauacgccggggcuugcuccucuuucgacguccugcuggaaaaaggaaaguuuccccucuuccagagcuaugcccaccaucgcacccugcuugaggcggugcacgauacaaucauugccaaagcugacccgccuuccugugaucugcagagcgcccacggcaaccccugcaugaaggaaaagcucguuaugaaaacccauuguccuaaugacuaccaaucugcucacuaucugaacaaugaugggaagauggccuccgugaaaugucccccgaaguacggacuuacggaggacugcaacuuuugcagacagaugaccggcgccagccugaaaaaggggucuuauccucuccaggaccuguucugucaguccagcgaagaugacggaucuaaacugaagacaaagaugaaaggcgucugcgaggugggcgugcaagcucucaagaaaugcgaugggcagcuguccaccgcgcaugaggucguucccuuugccguguucaagaauagcaaaaagguguaccuugacaagcuggaucucaaaacagaagagaaccugcuuccugacuccuuugucuguuucgaacacaagggacaguacaaaggcaccauggauucugggcagacgaagcgggagcugaaaucuuuugacaucucccaaugccccaagauuggaggccacgggagcaagaaauguacaggagaugcugccuucugcucugccuaugaauguaccgcucaguacgccaaugcguauugcucccaugcuaacggcagcggcaucgugcagauccaaguuucugggguguggaagaaaccccucugugucggauacgagcgcgugguugugaagagagagcugagcgccaaaccuauucagcgggucgaaccgugcacaaccuguaucaccaagugcgagccccacggccuggugguccgcuccacaggguuuaagauuucuagcgccguggcuugugccuccggaguuugcgugacgggcagccagucuccuuccaccgaaaucacacucaaauaucccgggauuagccagucuuccggcggagacaucggcguccauauggcucacgaugaccaaagcguguccucuaagaucguugcccauugcccuccccaggacccgugucuggugcacgggugcauugucugugcgcacggacuuaucaauuaccagugccauaccgcccugagcgcuuucguggugguuuucgucuuuuccucuguggccauuaucugucucgcuauucuguauaaagugcuuaagugccugaaaaucgccccuagaaagguccucaacccccugauguggaucacagcguucauucgguggguguacaaaaagaugguugccagaguggcugauaauaucaaccaggucaaccgcgagauuggcuggauggaagggggacaacuggcccucggcaauccugcucccaucccucggcacgcccccauuccgagauacagcaccuaucugaugcuucugcucaucguguccuacgccagcgcuuguucugagcugauucaggcguccagccgcaucacgacaugcucuaccgaggggguuaacaccaagugucggcuguccggcacagcccuuaucagagcuggaagcgugggcgccgaagccugccucaugcugaaaggggucaaggaggaccagaccaaauuucugaagauuaaaacagugucuagcgaacucuccugucgcgagggacagagcuauuggacgggcucuuucuccccuaagugccugagcucccggagaugccaucuuguuggggagugucacgugaaucgcugccugucuuggcgggauaacgaaaccagcgcugaguuuuccuucgucggagaaucuacaaccaugagagagaauaaguguuuugaacaaugcggcggguggggcuguggaugcuucaacgugaaucccagcugucucuuugugcacacauaccugcaguccguccgcaaagaggcccugcggguuuucaacugcaucgacugggugcauaagcucacccucgagauuacggauuuugacggcucugugagcaccaucgaucugggggcguccagcucuagauucacaaauuggggauccgucagccugucucucgacgcugaaggcauuuccgggagcaacucuuuuuccuucaucgagagccccggaaaaggcuaugccaucguggaugaaccuuucuccgagauuccgcggcagggguuucugggcgaaauccgcuguaauagcgagucuagcguucuuuccgcccacgagucuugccugagagcucccaaccucauuagcuacaagccuaugaucgaccagcuggaauguaccacaaaucugauugaucccuucguggucuuugagcggggaucccuuccucaaaccagaaacgacaaaacguucgccgcgucuaagggcaaucgcggggugcaggcuuuuagcaagggauccguucaggccgaucucacacugauguucgacaacuuugaaguggacuucgucggcgccgcugugucuugcgaugccgcuuuucugaaccucaccgggugcuauagcuguaaugccggagcgcggguuugccuguccaucacaagcaccggcaccggcacacuuucugcccauaacaaagacgggucccugcacaucgugcuccccagcgagaauggaacgaaggaucaaugucagauucugcauuucaccgucccugaaguggaggaggaauuuauguacucuugcgacggcgaugagagaccccugcuugugaaagggacacucaucgcuauugacccguucgaugaccgcagagaagccggaggcgaguccaccgucguuaacccuaagagcggguccuggaacuuuuucgauugguucucuggacugaugagcugguuuggcggcccccugaaaacaauccuccugauuugucuuuacguggcucuguccaucgggcuuuucuuucugcugaucuaucuuggacggaccggccugagcaagauguggcucgccgccacgaagaaagcuagcuga

SEQ ID NO: 14482 - RNA, 3480 nt, Artificial Sequence
  derived and/or modified CDS sequence (opt5) from RVFV(OS-1)__DQ380186.1__NSm-Gn-Gc
augaucgagggcgccugggacagccugagagaagaggaaaugcccgaggaacucuccugcucuauuagcgggauccgggaggugaagaccuccucucaggagcuguaccgcgcucuuaaagccauuaucgcggcugauggacugaauaauauuacaugucacggcaaggacccugaagauaaaaucagccucaucaaggggccgccccauaaaaagagagucggaauuguucggugcgagcgccaaagagacgccaagcagaucggccgggaaacgauggccgggauugcuaugaccgugcugccugcccuugcuguguucgcccuggcgcccgucguguuugccgaggauccucaccuccgcaacagacccggaaaaggccauaauuauaucgacggcaugacacaggaggaugcuaccuguaagccuguuacauacgccggggcuugcuccucuuucgacgugcugcuggaaaaaggaaaguuuccccucuuccagagcuaugcccaccaucggacccugcuugaggcgguccacgauacaauuaucgccaaagcugacccgccuuccugugaucugcaaagcgcccacggcaaccccugcaugaaggaaaagcucgugaugaaaacccauuguccuaaugacuaccagucugcucacuaucugaacaaugaugggaagauggccuccguuaaaugucccccgaaguacgagcuuacggaagacugcaacuuuugccgccagaugaccggagccagccugaaaaagggcucuuauccucuccaggaccuguucugucaauccagcgaggaugacgggucuaaacugaagacaaagaugaaaggagugugcgaggucggcgugcaggcucucaagaaaugcgauggccagcuguccaccgcgcaugaagugguccccuuugccguuuucaagaauagcaaaaagguguaccuugacaagcuggaucucaaaacagaggaaaaccugcuuccugacuccuuuguguguuucgagcacaaggggcaguacaaaggaaccauggauucuggccaaacgaagagagaacugaaauccuuugacauuagccagugccccaagaucgggggacacggcagcaagaaauguacaggggaugcugccuucugcucugccuaugaguguaccgcucaguacgccaaugcguauugcucccaugcuaacggaagcggcgucgugcaaauccagguuucuggcguguggaagaaaccccucugugucggguacgagcgggugguugugaagcgcgaacugagcgccaaaccuauucagagagucgagccgugcacaaccuguaucaccaagugcgaaccccacggacuggugguccgguccacaggcuuuaagauuucuagcgccguggcuugugccuccgggguuugcgugacgggaagccagucuccuuccaccgagaucacacucaaauaucccggcauuagccaaucuuccgggggcgacaucggaguccauauggcucacgaugaccagagcguguccucuaagaucguugcccauugcccuccccaggacccgugucuggugcacggcugcauugucugugcgcacgggcuuaucaauuaccagugccauaccgcccugagcgcuuucguggugguuuucgucuuuuccucuguggccauuaucugucucgcuauucuguauaaagugcuuaagugccugaaaaucgccccucgcaagguccucaacccccugauguggaucacagcguucauuagauggguguacaaaaagaugguugcccggguggcugauaauaucaaccaagucaacagagaaauuggauggauggagggcgggcagcuggcccucggaaauccugcucccaucccucgccacgcccccauuccgcgguacagcaccuaucugaugcuucugcucaucguguccuacgccagcgcuuguucugagcugauucaggcguccagcagaaucacgacaugcucuaccgaaggcguuaacaccaagugucgccuguccgggacagcccuuauccgggcuggcagcgugggagccgaggccugccucaugcugaaaggcgucaaggaagaccagaccaaauuucugaagauuaaaacagugucuagcgagcucuccuguagagaggggcaaagcuauuggacgggaucuuucuccccuaagugccugagcucccgccggugccaucuuguuggcgaaugucacgugaauagaugccugucuuggcgcgauaacgagaccagcgcugaauuuuccuucgucggggagucuacaaccaugcgggaaaauaaguguuuugagcagugcggaggcuggggguguggcugcuucaacgugaaucccagcugucucuuugugcacacauaccugcaguccgucagaaaagaggcccugaagguuuucaacugcaucgacugggugcauaaacuuacccucgaaauuacggauuuugacggaucugugagcaccaucgaucugggcgcguccagcucucgcuucacaaauuggggguccgucagccugucucucgacgcugagggaauuuccggcagcaacucuuuuuccuucaucgaaagccccgggaagggauaugccaucguggaugagccuuucuccgaaauuccgcggcagggcuuucugggggagaucagauguaauagcgagucuagcguucuuuccgcccacgaaucuugccugcgggcucccaaccucauuagcuacaaaccuaugaucgaccaacuggaguguaccacaaaucugauugaucccuucguggucuuugaacgcggcucccuuccucagaccagaaacgacaagacguucgccgcgucuaagggaaaucggggcgugcaggcuuuuagcaaaggguccguucaagccgaucucacacugauguucgacaacuuugagguggacuucgucggagccgcugugucuugcgaugccgcuuuucugaaccucaccggcugcuauagcuguaaugccggggcgagaguuugccuguccaucacaagcaccggaaccggcacacuuucugcccauaacaaggacggcucccugcacaucgugcuccccagcgaaaaugggacgaaagaucagugucagauucugcauuucaccgucccugagguggaggaagaguuuauguacucuugcgacggagaugaacgcccccugcuugugaagggcacacucaucgcuauugacccguucgaugaccggagagaggccgggggagaguccaccgucguuaacccuaaaagcggcuccuggaacuuuuucgauugguucucugggcugaugagcugguuuggaggcccccugaagacaauccuccugauuugucuuuacguggcucuguccaucggccucuucuuucugcugaucuaucuugggcgcaccggacugagcaagauguggcucgccgccacgaaaaaggcuucuuga
